United States Patent 7,420,044 (NUCLEIC ACID AND PROTEIN HOMOLOGS AND USES THEREOF) - sequence listing, part 5

SEQ ID NO: 14057 - DNA, 1050 bp, Homo sapiens
  misc_feature (1)...(1050): n = A,T,C or G
cggtattcagcttggtgatctgttaaattaaatatcagtagattatctttgggttgtgggacatgagatatatgatacaatgcggttcatggcgagaggaacacggnnnngccagtcacattctatctgtctngtctcacgncatctaccatacaggcgcagtgggagggngattgatacgacnnacacctccatcataactatccgtaatataatggagcggaatatggaggaagggctgtgtactcatgattgatacatgcggttcggagaacaaannnnaaccctcccctctcttgcttgttagtgatcccctgtgcgtgcgtgcattggagctgtatggatatgagncgtcactgtctgtggagagcatacatataccaacgcaattaggggcttttcgtctactttccttctgtacttgttacatncattacacctcgtaacttagtggaagaagangtgtattgttgtcgtggagtgngngattttcgttctctttgtttggtacgggatactttgtgtgtctttccagnacatcccgcgagngcgttgcactctctgctgttcggtgctatgtctcggtgaccatataagcgtcggaaaccttataactctctatcgcctacacatcgcttgagatctctgatatgtacactganaataatcaatacttttcttctgtnacttgtntcactctctgaaccttattaattaacacctatataatataaattaatatataattacttataatatttttnaaaaactcccgtaatctcaccctcctgcctggccaaaaaatcacaaccaagccccactccactcatancccaacgtaattaacattcgaaaaaaacagacctaaaaaatggggcgaacccttcttttcaccttaacctaaaccttctccaaaaatnnnttaaattttctttctctttnnncatnctgttctcgttcgaactcccgtcttcctgttccctccaacctctccccctcaccttaacacactattctctttctatatttcttatcatttccccctattcc

SEQ ID NO: 14058 - DNA, 506 bp, Homo sapiens
ggaatgggtttcagctattatgcatcttctttgatgcaatcttcttgtatcactaaacatttttttaaatttggacataagttaaacttatacaaaagttgcaagactaattcaaagaattcctggatatcgctttggccagatttctaatattaatatttttctacattgacctcctcctcgtcctcctctttcttccctctccccctccttctccctctcctctctcaccccctttctctctgtgtagtttttctaaactgtttagtaaattgtagacatgatgctttttccctaaaatggcattgtgtttttactaaaaaataattatcttacataatcacagcctacttttcaaaatcagattacatacaacactatgatctgatctgcagaccttattctgaatttgccaattgtcccaataatgtcttgtctagcaaaagaaaattcaaaatcattctggaactagtttagtacatttgaaataaatgtatatcttgttt

SEQ ID NO: 14059 - DNA, 400 bp, Homo sapiens
  misc_feature (1)...(400): n = A,T,C or G
cagctcctgaaaggcttcactcttctgccctggtgcagaaacgggccctacctctttcagattggcctggagctgtcagctaccagtgacttccagaaccaacttgcaaatgtctgccgatcagtggcactgctcagaccagagctcagataagatgttctgcagtctgctgagaaaatcttccaacaccagttgtgggacacangaagtcactcaccagaaacactggngtcatatcacttctcccttatctctcttcctgggtgacgaaagcccaatcgcctngtgagatctnttttaaacagaaccccctttttccanaataagatttgacccgnacacagnggccccagctgtatgtgaacaataaaagcttcactccactaaaaaaaaaaaaaaa

SEQ ID NO: 14060 - DNA, 257 bp, Homo sapiens
  misc_feature (1)...(257): n = A,T,C or G
gagagaacagcaagaggaggaaagcaaggaaagaaactgggggaaannttcgtagtnaaccggncccaanctgnaggggngaaacgacancagnnacggaaaaggnanccccacancacagcaggggagccaagcccacagacacggccaagggaacaagcagaaagagaacaacagcaaaaggggacagaggggacccgcaaacaacaacaacncgcggggagaaaaggacagggaaaaggggaaaaaaaaaaaaa

SEQ ID NO: 14061 - DNA, 797 bp, Homo sapiens
  misc_feature (1)...(797): n = A,T,C or G
ttagtgagcaacattcaggacctgttttcataagactacgtggagaattacctgcagaatagatgctgaatctttgtgcctctctgctctccaagaagatggcatgctccttgatgacaagagccacctctgatctcccccatccagtcaaaatcttccagaaaacagaccatcaatatggatttgcagcatgtattgtgattgtttaacataattttccaacagccaattatgtgtggccactatacgtagatatttctttagctcatattttaatacctgtcctgtcattctacattacatatgtggaagacctttaacccagtttagtttatatataataagtacaaaagggaaaaaagaaagcttccttttttcacctctttggggacttcttcagtctttttccagatgtggaatccagatcgtgttattttctttccagactgggcctaggagcaatacgttaagagtcagcaaagcctcaagaatcatccagctcttcagcaaagcctcaagaatcatccagctcttttttcctcttcaaagttgcccttcttttctctgaacattaatgtatctttctgtatcacttatccattgctgtgcaacaaactacctcaaaacctagcactttcagtcagcaaacacttatcagttacagagtttctgagatcagaagtcaaggagtggttcacgtcggtggttctggctcagtctctcatggngctgcagaggaggtgcagaatctgacggggctgacgattcacttccaagctcacctcactggtgcggct

SEQ ID NO: 14062 - DNA, 718 bp, Homo sapiens
ctgggggcttccctctataatacaccactgtggaggataagtgaaaggaaccactaaggtcaagagtgtaagccagctgtgaccaacaaaattaaaccccggttgtggggaaacaacataatttatccaggcataatgtaatggtagcacctgtgtatcccacttattctgcagcttaaggcaagaaaattgcttgatcctgtggaccagaggttccagtagtctgagataaaaaaaggaggaccaagccttcgaatgtgagccacacgcccttttataatcaggtctctgaagtcatccaatgtatcctactgtgtagaagtaaatcactaagtccagtcccggaagggcaattagactttatctcttaaaggaaaaagtatgaatttttgcatggacagtcacgcactgcttaatgacgttttgtcaatgatggacccacatatgtaatggtggtcccattagataataatggacgtgaacagttcctgctgcctaatgacactgaggccaccataacatcatggtgcaagacattccttatgtgtttgtggtgatgccggtggaaacaaacctactgtgctgccagttgtacacatgtctaggccatacaattatgtacagtgcgtaatacttgaacataataacaaatgactatgctactagtttgtgtgtttactatattatatttttatcattaaaaaaaaaaaaaaaaaaa

SEQ ID NO: 14063 - DNA, 288 bp, Homo sapiens
gtttagagatatgtgaacagaagagaaaagtccatgccctcatgggagttacatctcagctaaagctctcactcacggtctgaattaccaggttcacttatttttgtgtttgttgcctgtctcccttctctggacttccaaattgcaggcatcttggcaatttttttctcactgtgtacagtacttagtttctggaaaagtatccctaacataatattggcccaataaatatttttaaaaattaataaatgaatggagactttttaaaacattagaaaaaaaaaaaaa

SEQ ID NO: 14064 - DNA, 1231 bp, Homo sapiens
  misc_feature (1)...(1231): n = A,T,C or G
aggaaaaaaaaggaaagaaggaaaggggagggncgaggggagggagagggagagagagagaggcgcgcgccggacacgttggagggcgagcggggggcngagaaaccattgtcaggcggcaccaggcgggccacatgaaaaaaatgacaaagcaacagagaggagcgcgaagtctccnatcgngaagaagcgacagagccccaagaatacgaactacacaaacacagcggcgaaagcacaacagaggagcccacgaacccgcggatgtataaatacatataaaaaaagagatgtcgaggtaatagaaagacgaaaacaataataactaagagaacagccaaggaggcgagcccgcaagaacagccaacaaaccgacgcccccgcaaggaaggagacgagacaaatgagcagagagagaaagggaggagggagggcagagagaggagagagagggagataacgacacaatacgcaaacaaaaaaatagagaaaacaccggcaggggcagtgaagngcgagagagaagaaagancaacacaagggagagaggaagcggccgagccacgcagggaataggtgcacggcncgggatagaggaggaaccagaggagacagagagatcaaagagacgtgaagaagagaggcacatcgaacagaaagaaggtaccacaagcagaacagccaaagaacacagcgcgagacggtgaagcagaaacaagagaggagtaaagagacagacgaagaaacanggagagaaggaatatagtagataagagaggnagcggagagccataggcagcgcgaggcacagaaggagagagccagcacaggaaaggagcgatagaaagaatgatccaagccagaggactccataggtacaaacacacagacagggaaatcatggagagcgagcgagccgagcacgaggaaccacaaccaacgcaaataagaacgcacanaaagagcagaggacgagtgaaagtaagaccncagccaggagaccgagagagagagaccgacgataatgaccaaagcacctaggcacaagaacgtaagagaggagaaatagcaacagaaatagccgtctgactagagagctaataaagatatgcagagacnagcgaaggagcagcaggcataagaggtagaccaagtgcacgggacatggagcgcagaagagagccaggcagatagcaccgacaagagagagagggaggaagaagaagaagag

SEQ ID NO: 14065 - DNA, 881 bp, Homo sapiens
  misc_feature (1)...(881): n = A,T,C or G
cggtggagtggacggtgnggcagtgtgactaatctgtttctggtcgatcaggatggggtgggacgttaactcctaatcgatcgtacaatcgcgcctganaaatacacgtggnngganggggaggtggggtattagggtgtgtggggacgctacgagcggtggcagcggcgngagtacnactgagctgtgnnntattcactactaacgtgctgacaaagtgggcgggcagagggtcaggagagggcgaggacaaacaagtgatagaggtgggggggggggtggtatgganggtcgacacgcgagatgtgaggtcaggggnaaggtgtcaagagcaggccgagtatgtggggtggcgttggcgttgtagtaatttgacttaagatgtaaaggtgttagagagtggaggaagagccgagtaagcatctggtagagaggggtgnaggggaacgaagaacgagtaagcggaggnaagcgcggcggaactggcttgnacagtgaatgggttgcggagagaaggtttcggtgcagagatgcctannggttggttggngggtgtaacctgaggcgggaggaaacgaatcgtggngcgtgggggccggcggcgtagcaaatnggagaatgcagggtgagaagcgcatataatataaccatatatttacaaattacttgctccatgccacnccctatcttnttcactaatacatctacaccatatccaataatctactcccattacttcccaaaannaaaacagactttaaaacatagtaggaagagncacgctncgtatctttgctaaacgctagtgtgttaataataatgtacaagaagggacaaaaaaaggtagcgaagaaaagtttatgtgactgtacttgngcctg

SEQ ID NO: 14066 - DNA, 742 bp, Homo sapiens
atggtggcaaaccattagaattacagtatgttttgtgcaggcatgctcaaccagaacacataccaggtttagttgtaatggggaaataatgtatttatcctaagttattgattttttctttagaccccagtttacattgttagtaaggtaacactcaaagtagttaaaaattctgtaaatatcacatctagtcgccaaatatttataaaaaattattaattatgggcgccaataaacaacatataagatataagttcacttttatcagaactttttagtctaattggggcattattcacgggaaaaatagagttttttaagcttcatcaaatagtcatttttttctaaatgttagcaattcatcacccaccagggtttgcaaaaaaatataaacatcttgcttcttatcactactgtcaactcttttcagtatgtactggtttcttttacaattatttaatcaaatatcttgatgactttaaacactctccatgaaataattataggtaatgcaataaaggggtaagtttcaaaacttagttctctaggcaaatcacatatggcctgatctcttatatggtaaatttttgtaaaatgatataaagattgaaatattattaatcatatctgtgagtcactcatatgtgtgggtaatcatagtaaataaatgattaattagttgatattgcttattttattcagaaaaataataaaatgttagaatgacaaaaaaaaaaaaaaa

SEQ ID NO: 14067 - DNA, 932 bp, Homo sapiens
  misc_feature (1)...(932): n = A,T,C or G
attatatattaatatctaattttatttaattgttaggttatctctccctaatctaattaggtatgagggnctccttcagtctgctcccaagctagaagctgcagaatgtgatgacctggggtccctgctcggagcctggcctcccgggagtctaccacacctgtgaatcccttcatttcttggatccaagataatgtctccaacgtctcctttgacacactgaagtgggaccagggccaactgtggagagaggaggtggaggttctctcctccccccttttttttctgatagcgacgaaagaaaggattcacttaaaggttatactctccggccgagtatacttattcccccctcctcgtttgtattctcccctccgctaatcttttcagttctgttcgacatacttattcttatctttgaatatcccgaaaagggagtgctgtacgggtgcagcattcccgttttgcaaatactactataatatatacgctttatattgagtataatatactccattgggatcttagatcttaatatttttccatctaaccagtggtctcgattttgtcgggaccgcaatattatgaattgagagcatagtgacggaaattacgatttttacctccctatatatttacaattatcatcacctctctcactacacatctgctaagctaaaattatgtgtaataattattatatttctcgcactcacaaaacactaacagcgtattatcttattatttcttattaatcactccaacgtggagtaccgtattatttaatcttataattacctctaccatccattattctattaatacattcgtccaaatatattctcgtactatttttatgagatttctatccgatggttatcgaatcactctgtcatgtatgattcacttctaccttacattcgcctcaccag

SEQ ID NO: 14068 - DNA, 1075 bp, Homo sapiens
  misc_feature (1)...(1075): n = A,T,C or G
agtgaggaagggagagattgtnaagttgataggaagtaaatgtttgtnnttaataaatgaaagngnatgannagtatagttatnntataaaaaaagttaagaaggaaagacancaaacacacagattgtanngcacagacgnnaggcacatatttattttatattttattttgttctattttattttttatttttgttttttatcgggcaccaataaacatttattaatccaagaaagaagaaaagaaaattaagctcaccaacatgcataggaaacgtgtctgataataaaatcacaccaccatttgtaatactaaacaaacaacaccgacatgaggagtcgaatgaaggaaaaccagagtgccttcccagtagtgattaaagagaactgttctctctgagagcgnccagaaggaataccaactgcaccgacatataatcgatatttccactcaatgaaaagggatataggggaatgaaaatatagggcaataataaaatataatatgtgataagaatgtcagaagaaacgaagaaaggccaacactatccaatggcaccacgagaacgacatatacagaaacatttntcatgaggcatccccctcaatcttctgtacatatacataccaaataaagaatcgtaacacactcatacacgagcatgcacgcagtgcgtgacatcaccccatataccatctatctaccaccaccctccaccacaaaaaaccccaagaaaacggacgattacctcttactacaaactctctacaatacacaacccaaaaaaaccnccaaggtacataacatgctaggaccacacccaaccgaaaggtagcaacacagcgagaatcctacaaataacataaatgattacaaaactaaaaaatagacagctaaaataaaagcgcgataaaggcatgttcatatataaatcatgtatatgaatatctaatattgtgtgttattagctatagtcttatgagataagacattactaaaattagagttacatacaataaacaacataaagccctacaataaagtcacgacatatccgagtaaatatcctaaat

SEQ ID NO: 14069 - DNA, 692 bp, Homo sapiens
aagggattggaactggaacactattagcagagagtgaagagtaacaataagtgaagatacaagggttactggcaaagaggaattcaactctgcaaatatgttcttgtagttttgcaggcataattgcgggcacacacgcgcaacaaccagccaatcgatggtacgagactaggaaggcacatatgattgcattgacatacccgcccttccatgactgtgaacccacctgatcaaaacaacatggtgcctgtgagcccccattcttggcaaatcagggccccctctcaggggctgccaggtgtccaggaagttgatggcttggccaagcccattgttggggcccttttagttgaaaggcctaaaccaacctggaccctgcaccccagaagactaaagcctcagaggctcagatccgggttccagggccttgaaggtataccatgcatctctttccatccaaccctgcgatctttgcagcccagcttccacccctcacccctccagctcaaaatcagactgcctgcagtggaatcctttgtgactcagggaaagtcctttaacctctcggagcctcggtttcctcatcacacccaaggggttgttgtgaggattaaatgtggtaatatatatcaaagttccatacatttgtagctattcttttttttttttaattaaaaagtttatgggcccat

SEQ ID NO: 14070 - DNA, 854 bp, Homo sapiens
tttttttatatctttcttcatcttttttttattgttcattatttacatatgtggtcagtacacagttttcagcatgcctctgccacttggtaatagcaagatggtacataaagatcaactctgtgagctttaatccgagagggaaatcaggagtccaccagaatcgcaaaggacaacccagatccccaggcaggagaacccggcaaacagtccctgtgatggcatctgccaaatgaaagtgagcgaggctctcagttcgagagaaatgccggtagcctccctctgagactcaccttttcactgggcataggagcaacacatgccaatggagagcattgtgtttttaccaagttctggaggttacctgtgtagaggcttggatcgctgtgaggggacatacactgggaattgctgtaaactttttttcatacccttgagaccaagtgctcggtacccttgtgaattccggtttcccacaatgctgtgtgtttattgtctgctctcattactcatgcttgattctagtgttgcactagtctgccctgggtatggagaagagacccttcacacttaaatttttcgagcgctcattccgagatggtgctttcacttttgtattttctgttcgtcgccggcgggcgtatgagacactcgacatgccggattatttgctttggggatacatttcgtatctttgttgttttgatgacctgaaaagcctcggagatagacccattattaatcataatttcacgagcggtttggaactgtatttcttcagtgctattgtcgctctgattctttatatactgagataattagtgacccttgcatttatttatatatcgtgggtc

SEQ ID NO: 14071 - DNA, 755 bp, Homo sapiens
atgtgtggatgaacagcgtgcgaccacttttatcttgccggtaggccttggtacaggaaggccgtcttatttcatgcccagtgagctctccagacatttagaatacctcttcacttggatcagggggatgatccacggcacctgtcctgtgcagagatcgtggagcaggggaaaccctttccactccatgcacagccagatttccaggcatttagggggcccattctcctggattagaagcttaggttgtcccccagccttatgctgaggacttggaggcaaggtggtttcccagctccatacttaggcatgcctctaggcacttggaagccacctactggattctctctcaacactcgtgcttgtgcttgttaagtggacctggctggtctggccttgcccatcatggcccctactccaggtgcagagcaaagagctcaggccactgcccattccgtggatctgccttttggctgtggaaacagagagcttctgcctctgtaaacaagcatcctgtaaacaagaatcaaatatatacccagccacgtgggctgcagcaggctcttacctgcaagtacacctacgggcttacaggttgaactgcacagccccatataaaacctgccaaaagaagtgcacagggctatagaagcaaagccaagaccccatctagcattatctatgtcacaccccttagggagggggaaaaagagaaagaaaaaaaaagcaatactattacaaaaaaaaaaaaaaaa

SEQ ID NO: 14072 - DNA, 328 bp, Homo sapiens
ctctctgatgtagatatcatcacaattatctttttatacatgataaaattgaaacttgggagcctggaaggaagcaaatgaagccataagggcaaggccctgatgcaatagaactggtgtccttgtgagaataggaagatgccaggagtgtgatgcacaggagaaggaccatgtgagaatgcagcaagaaggcagccatctgcaagccaaggaaagagacctcaggagacaccaactgtgctgacaccttgatcttggactttccagcctccagaacagtgagaaaataaatttctgatgtttaagccacaaaaaaaaaaaaaaaaaa

SEQ ID NO: 14073 - DNA, 796 bp, Homo sapiens
  misc_feature (1)...(796): n = A,T,C or G
ttttaggagccaccagnanaattcattttatgcttatcaaatcaattaccttggatgaccaacttctacatgacctgccttcagcttctccatgtcagtcacctacaatcagggcatacctgaggccatttgattttttctaccgtaaatattttctaccttcctgcctgctttcaagtctctgaaaaattatgcctggagaatacaccaagatgccatcggtgttatattctaccatggatcctggttatcaactgggatgtggtacacatgcaggcaccctttgacttgttcctcacagcttgatgagtcttgattttcatgataagtcagcaccagatctaaacttcactctgtttgcatgaagttccttggctacttattctttactcactgctataaaggaatacctgagactgggtaatatataaagaaaagaagtttaattgactcatagttccacactgctggggaggcctcaggaaacccacaatcacggcagaaggcaaaggcacatcttacattgcggcagaaaagagtgaatgaggaaatgccacactttaaaaccatcagctttcatgagaacttactcattttcatgagaacagcatttaggggactgtcttcctgatccaatcacttcacaccaaggtccttccctaaaatgttgggatcacatttccagatgaaaatttgatagggggcaccaccaaaccttatcaccatagttttggtatcgggttccattccgtaaacattggtggggagagaagaacttccttttggcaccttctgc

SEQ ID NO: 14074 - DNA, 744 bp, Homo sapiens
aatcggtgaacctgattagtaacgcaatccaccccacagtcttcaagagcaatacatctgctgaatttgactttcatctctcagctgccaaccattctcatatcacccatcttacctgctgatactgccaatttcagcagcatcgccctcttaaggactatttgtacaagcctttaaatatttcattgcattttagcccttattaatttataaccatggatggaaaatggaaaattaaagtgctgatatgagtcatagtcataagaaacataggtctcataagccgggcgcagtggctcacgactgtaatcccagcactttgggaggccaaggcgggtggatacctgaggtcaggagtttgagaccagcctggccaacatggtgaaaccccatctctactaaaaatacaaaaattagccaagcgtggtgatgcacgtctgtaatcccagctgctcagtaggctgaggcgggagaatcggttgaacccaggaggcggaggttgcagtgagccgagatcgcgccactgcactccagcctgcgtgatacagcgagactccgtctcaaaaaaaaaacaacaaacaaacataggtctcataaacttaaaacacataagacgattccttggacatgccagaggctgtatctgtctcaatcagagtttccccaggcagtctaagctaatggactctgctcagttgtgaaggaagcaaattaagaaacttgtcttaaaaaaaaaaaaaaaaa

SEQ ID NO: 14075 - DNA, 819 bp, Homo sapiens
gccatcgagtgccgaattaggagagtaggcaaaaaaaaaaaagtcgcgggaaccttcagagttagtcgtgaaggccacctatggacgggcgaagccgatccgggacattcccgtcaccgaccaacagttaatagagaaaattacccaggtcgctgaggacaacatcaattttcagcagaaaaagtggaccctccagaaagagacccagctgagcaactccaagcaggaggagaccaccgagaacatcgagaagctgaggacgttgctggacagctgccaggcttgcatgaaaatatcctgctgcaggcatgacctgaagaaggaggccgaccttcttgggcaccttcaggtgagcccacctgtctcggggcttcagaagggggcgctggacgttctgaggaacgcgctgtgctggttgggaggaggtggagcagctactgcgggacctcgggatcctgtcctacagtccgtacaaaggttactgggacttttatatgtgacatgggtgcatgccgctaacgagttggggccgacgttggggatgtggggacatttagtataggagggctttcttggagatcggggccagggctaatacccgtatccagaaccccctgcttacttgctgtgacgcgtaattttcacttaaaagaaaatcaaatacatgcgggtgatatgcgataaagggtaaaaacggatcggtggaggagggaagagtaaacagctgcgaacgagtgcctaaacatccaagatgttaaaccatgagagcatgtctcgatggaaatacccgggtggtcccagcgagggacataccattgt

SEQ ID NO: 14076 - DNA, 375 bp, Homo sapiens
ctagaagaccctcctccttgttgtttttgatgaagccttactgaggagtcctacatgacaaagaactgaggtgaccagtcaacagccagcaggaaactaaggccctcaatgtaccagtctacatggatccacatcatcccaacaaccacatgagcttagaaatgaatccttccccagtcgagccttgagaagacagctttggctgagatcttttttttaattgaaaaataatttaatgatgaaatatctcatattagttaatatcttgcttgccacaatgtttcatattatcattggcctacatctcaaaatacaacatatagaggacaaagtttatcattaataaaagtaaatgtaaacctaaaaaaaaaaaaa

SEQ ID NO: 14077 - DNA, 399 bp, Homo sapiens
  misc_feature (1)...(399): n = A,T,C or G
aaaatcgaaccatgttatctaaccanntgcaacaccncgccctctcgagctcgacactggctaaagtaatctgtggcgacgttctggatgtactgcacaaacacctcattccatcagctacaactggcaagtccaaggttttctattatgaaatgtacgttctatactaacaattaacaagcgtacttcaataaatttaaacattctcaggaaaaacaaaaaaccagaaaggatatggcaataacaaccacaacttactactggaaaaacctacaattgaagggcctcgttggcctcgacgatggagctctgcgcccgatcccctttattaagggaaaatggatcatcctccttgactaacctcctgaacccggaactacggttacgaaaactcgcata

SEQ ID NO: 14078 - DNA, 1516 bp, Homo sapiens
  misc_feature (1)...(1516): n = A,T,C or G
aggagggaggaaaaaganaaaagaaaacagaagnnnagagagaacggtantgcagnanaagagaggaaataccagagcaaaaaacagagttanagatagagaaaacaagaaagcaaactgcangtcagcggcggcagcaaagnacgncacnccgactgcgcatgagtgtagattgacgtgactgtaactcgcgctgctgtaangtgagatgagccagagagaagtaagccgacgcgctatcagccccgccccgcgctgatatngtgccgatgtgtcgtgttgttgtatgagtagtgttactgtgttctcctcccttccgtccacttactnacgcacgtgagttcagcgccgtccagacgtgtgtcgacgagagagcatgtcacgtattgctacgaccatcccagtgagataatcccattaacnaatccaacacgccctacacgctactancccgcactaatagaactgataaaattacgtgcacctactgctncagtagaagctaaaancacacacacacacagctcgtcgtcncnataatgtactattcattctgctacacgcacgtcgtgtacgtatagtgttantgatcagcatcccgagtgantaccatacctaatgatacgacanacaccgacatctctatagtatatatcacctctcctccactcatcgttccttcatcacataacgagtcagcgcaggctcagtggngacatgctgagcaccgtatacagcatcagtagaactgtcantgttgtgcttcatgctcaccgtcgtgtccactttccgctcacgcagcantaaacgcagtacacatcaccgtcgtatcatacatcagcactgcatacctcaataatataacgtgtcgtcgagtgcnctatcgtntaggcggtgtatatgaggagtcattagcgagtgngcaccatatgctgcagagtacgcancgatantgctctagctctgcgagagcagtcttatacgcatcacgtcgttatgtctctctacgaatacacgctatcacacgacttagttgtntagtatataatccgcgcncacgcacagancgtaccaactncatnacatcaactagtcacaatccaccattatacactgactaagtgatgatcatgtanatantagtataggccgagtcgcngactctgtgcnagatcgctcnatatatggtaacncacntacatatcctatgcataangtagacactctgccgcaacactatgtntatatctntgttnctcacgacgatatcactcaagcgacnctcactctggtngaagataatacgaacgtcacacacacgtctntaccatgatcgtgtgtcgcgcgctagagtntgtactgtgtagctagacagcgaggtggacnaacagcgtgttnatagcgtcgcacgtccgctcgcgaggatggncgactctcatctctcgcgcacctatgtcacctgtcgtccancaatagcctagantgaacaatctacatacagcacantgatttatct

SEQ ID NO: 14079 - DNA, 709 bp, Homo sapiens
tcaatctacccttataaaaaacttaacaaaacaaacctcagtttttatttttagtttatgcacagccagcacacctacattgctattccgcaaatgcttgaagctttatgtgaaaaattttcccaatgtcctgggatcaccaagggacaaagctgtggaatttgtaaagatgacccaagctcctggagttatgccagtcatccttgatgagactggagatcagctccaggaccaaactgttcttttgaaaccctccacaccagaggtcacaagaagccaatctcctagcatggagaagaaggcagaattcgcgttccagggcactcagctcctcagtgacttgtgcttggatggctgaagcttcaaattgctatgctaaatacatcaagtaattcacataggtaataaatttaggaacacaacagtcttcctgcaaaactactccctcttctgcctctccctaagaaagaaaaatataatttcaactttgtcttctctctttaaattgttcatcattgctttagggtacacaagcaaacgtttgctttattcctgatctcaatttacaactgttctcttgaacttcaagtttcatagcagtctcgtcaatattatcttttccaaaggaaccaagcaaactgccagaatgcatttttaatggcctcctggtgtaaattaaaatgacattcttgaaataaaaaaaaaaaaa

SEQ ID NO: 14080 - DNA, 730 bp, Homo sapiens
  misc_feature (1)...(730): n = A,T,C or G
ccctagtgaaagcaagctctatgctatatgactgaagggaaacagaagggaatatgtaacaaaatatatacaggtagcagccccggggtaggctttccatgctgagtgttctattacattaatcctggcacacaaaaaatgcgacagccacatggatatcaatatgcctgcattgtttgtcttccatcggccctctctgtacacaggcatgcatttccctcgagcaatgatcaggctgagaaagtgatttcatttacattgcaaaggagacaganaaacaaacagaaaacccagaggccacgacttcccgggagtgctccagagtgtgtgtattgctagtagaagctatgtgcacctccacaccccggacctatttttgaagctttgatgtagaaacgcacaatacctacagcgaccttaaatttctgtaaaacaaaatagcatgcatggatgcaattgccatattttaaaaaattaacaattggccttccccacttttacaaaatattcctgcatgggggcggggcttggaaaaaacataaacagttttattgggccttttgcaaaaaaggccctggtttagggcccaaanaaacgcctgcagcatgataaattcgaccatgttttgcggagtgaatcctacctggcctgaaaaccagttggtctcttaaccagaaagtctcccccccctttaataaaaacggggttgtcctctcgaaaaaaaaaaaaa

SEQ ID NO: 14081 - DNA, 770 bp, Homo sapiens
ctcagaaagtcctgctgtcctcctctggctacctcttggctttaggagacacatgtcttctctccccactgactgagaatgtcagactcctgccggccagctgcatgctttccaggagcaccaacaaggaaattccctgacagattatttctgttgaaactgcaaacctgaattactgaaatctagaaaggcacagggacttactctgtcacacacagctactcatgcacacacacactgcttactaaaagctgagaaagtcctgctgtcctccacctggctacctcttggctttaggagacacatgtcttctctccccactgactgagaatgtcagactcctgccggccagctgcatgctttccaggagcaccaacaaggaaattccctgacagggcttcttccctgaatatcttacagtccctttctgtgaagagaaatggacacatcctgggaactattcctgtgcctctggactgtcatcaggaaatgactgcaggtcctgtgccctgtctatattatgtcctcacttctccatccatacaggtgggtccagtgggcattttattaattttaaactttttacaccaagcaatagaagtagaaaatactgatttttttaaaaatttaatgggtttcatgaaatctactggcaatccctttcctttcccctgtttaaattatttaggttttaattggttgtttggttctcttgcctggactcccaaggactaaaaaattacaaacaccttttgagtttagagaactat

SEQ ID NO: 14082 - DNA, 784 bp, Homo sapiens
tatgctcagggtgtacaggtaagacagaacttactgaagaagaaagttgaagaactgtgctcggagcatgaaagttttcttctgtctttggaaacttgtctgcaaacagcttgaaggagatgcaccccaagggctagtcgtcaaaggcgatgtcgaagaacacagtggggttgaccatgactggtagtacagggctcccagcagcggcatctgcaaagccaaagcagttattttaaaaacaaagacctgctagtttttgcaaagcaagtttatgctgattgttatcaactagagcttacaacttgtttctttattgttttggggggccagcgggtcttgcctcaattatgattctgaataaaaagtgccaggttgggatcaaggaaaaccatgctttgtttctagctgtgtgtgctctttatctctttgtacttctgtttcctcatccataaaaacatttcaacttttcatggcggttaaccaatttcaaacatctctcagggctcagactaaaggaatgattcacactttaaattatttgtatgggctttgacattcaggactttttaattttagcaatcttcatgagcatttaaacgtataatgcatttcattgcaaaataaccccaacttatattatctattgagtaacccatgatctgctggtagcttttaacccttatttattcggagatttaaaaaccttgtgagggtcagatcaatggcttgttacatttcccgtctttttctttaatgattcttggaactttaatagttcaatacc

SEQ ID NO: 14083 - DNA, 769 bp, Homo sapiens
catcgtgccagactcacgaagaccactgtgcagattccagagggggcctggacagcagagcatctttcccgggtaagtgctccatggatgggaactgtctgcaactgttgtggccccacttcatctcccatgaccctggaaccctccccttttctgcccagggaatcagttttgttcctccaggtgttttaggcaactcccaaggtttccagcaagtgccaaattgcacccgatattatgtgcattcattcattccgtttattcaacacatatttactaaacacttactgtgtgccaggcactgtttcaggcattggagacacagcaagaaacgaacaaaagatccttgccggcctggagctgacgttctagcatgggagatagaccgtaaactaatagataagaaaataggccgggaaatacacctgtaatcccagtaatttgggaggccaaagcgggcagatcacaaggtcaggagtttgagatcagcctgaccaacatagtgaaatcccgtctctactaaaaatacaaaaaaaatagcttgggtgcctgtaatcccagttgtttgggagactgaagcacaaaaatcccttgaacctgtgaggtggaggttgcattgagacaagatcgggcccctgcactcaatctgggcaacagtgcaaattccgtcttcaagaaaaaaaaaaaggcctccttgcctcaaccgtggagctttacggccgcttaccttaatgaggggtcatcatgatcctccctcactgaattcgtg

SEQ ID NO: 14084 - DNA, 292 bp, Homo sapiens
cctcagatgtgacacagatgtaatcatttaagatgagatcactggaggaggaggataactggtatgcttattagaggaggaaaatttggatacagacacagacacagagggaaacagccaagtgaagactgagactggaattgtgctgccacaagccacgcaatgcatggggctaccaggagatgaaagaggcaaggaagaatcttctagaggcttctgaagggcatgggcctacagacatcagaactatgagacaataaacttctgttgttctaacccaaaaaaaaaaaaa

SEQ ID NO: 14085 - DNA, 1228 bp, Homo sapiens
  misc_feature (1)...(1228): n = A,T,C or G
ttttnnnnnnnnggggggtttttnttgggngcgtcggtggtggtntntgtctcttgtngttgtcgagtttctataattcatcgctatcctccctctgtaacagagcactgagtcaacacaacaagagagagaacgaagagctacacatacacgatgcgcagagaggctgagacgcagttgcagaggtgaggatggacagacacctcagaccgtgctgttcacgcatatttataagttgaggcgtgtggttttgtacactaacaaagcgcgtgtaacctatgaacctaatgntttgccgtatgtcctgcattaatcattctcaatagtgcaccctcctgagtttgagtgacaccgcgcttcgtcttggttaagcgtgagcataaagtcccgatcaacacgaagcaatataagagctaattgatgtgtaagaaagagagcaatcagaatacagaaacaaactcaaactcaaacgaaccagcagtgtaaaaggaaacgcaggaagcgtcataacaaaagtctgtcgctcaaggtaccgcatataatgagggaacttgcgctacctcctgcgttataaattcagtacaaaataaacgaatcattgagctatatcttacatatcatgtggaccaaactttgtgacgaagagaggacaccagcatcattgtcaatgagtatcgcgatgtactacaaaatcagcagagagtattattacatgtgtatcggcctatcactcctaaactaaagtgtnatacatagttagcgttaggtacggaaaccgaacctgactagttacacataaatattaaagggaagttcatcatgtcccgcgaaataagttattacaattccgagacacctatagaattaccaaatagccggctgtgtgctgcccacgtcacattaccagtccgggcaatcatcaaaatacagatacagcaacgaaaccagcgctgtgttgtnttagcacgacgatcagtatataaccgacacgagtgctacgatataaaaactagctggcgtagacactacgcgagacgttctatagtgtaattagatttcggcgcgcccatatagacaacgcgcgcnagaaacacaaggtaaccacataaatgtgaagataccagcatatcaaccgaatagtggcgcgagattatancgatacacacaccgcaaaaattaagttacagtttatagtacacgaggggncatactctaagtgtaatantgt

SEQ ID NO: 14086 - DNA, 1016 bp, Homo sapiens
  misc_feature (1)...(1016): n = A,T,C or G
tggtttttgtcatttattatttgtaaacctttctagccggctgctgcgtcggggcgtggtcggtatcgcgcgcctacacctccgcgctgctgctctaatacacgcctgcngatattcaccatggtcgttgttctgatacgcacctggagctcgcctagtgctttctccccgccgttccgatcgggcccctaggacgctcctcctctcgtgtgttagtgttactcgggcgccgttgctcttggcaggtgcatggtttgcgctctgtcgttatgcattgcggtctggggcgttaggngggccgctttcacttaacttgtgagtgcgaaataatctgtgggggccgggtcgacccggtctggctcttttcggcgcgggcgttcgcggccgcgcataacgacccggttagtcggacgttcccgttatgggggtggtccttcgagggcacgccccctctctcagcgcggtccatctgcccgcctctatcctccgcgggtgcggcgcgccgcgctgtggaggcgggctgctcggcggcgcttaggttacatcctttanttcctcccagccccctccccacccccggcggggggcagggtggcttggggtttcaatgttgttaatctcctccactttgacgcatcagcatcatatcttctcttactcaggcgactcatcccccccttaacttctggacgctacctatatttctttttttacatttactcaaactctcctcttctcttaatcttccctcccttcgccccgcctcatatgggttngatataggtttgtagcctgcttggatntttgtcggtctttcgttcctttctccggtgtttgcttaggttgggcttttttcttccttttcccttatttccaaaaccacaacnactcctcacctactgtcccactataaatttctcgggtccccgtggcaatctgcgggctgtgtttcctacaggttcactcactctatccaaaccctcccccaatcccatacccctcccccctcctttcct

SEQ ID NO: 14087 - DNA, 834 bp, Homo sapiens
agatctaacattcacgtataaaaaaaattttgaaaaactagagaccgtcattgacacatgagggaacatatgtgatgaaagacacctggaaaacagccaggatgctggaattttagtcttagaagctagtgactttgggcaagtcatcaaatatgcatacgtcctctagtttccttactcataaaagtggacattgagaaaggtgatcaatgagttcttcatcatctctaatagactgaactgctgcttctgtacatctctgatgatatatttggaaacagaacagacactttggcaaaagtcacacctaccatgccggatgctgataggattgaatgagtttgcagctcacatggatgatagacctggtccatagtaaccacttgataacatctacctattattctattacatatatcatttaatcaatacttacctcatctatgaactccgatattatctatccacatacgaaaatggcatacctgcactaaagaatcacttacctcaatttatttttacatacactataatttcctagtcattacctcgccagcaaaacttaatgtgaatatagttactatcacacaactcacgtcgctctacaccgaaccccaggataattactgaaaccaaacaacgataatagtggaattacgataatacaaaactgaaatggatacgatctttatccgcacatattttcgatctgaatatataatgtgtaacaataaagaacattattacataaaactgcatcgaaatatctaaaatcattcatttacttctcctaatttttctaatacttctaccctaatacaaattaaaatatta

SEQ ID NO: 14088 - DNA, 748 bp, Homo sapiens
acagatacacaacgggcctagtcacctttttaaagccttaagacaccttatgcagaaaataaaaataatagttgctttcaaaaaaagaatgtccagtattagaaataagattaggaaaagtatccagcaacactcaatgattttatgaagccaaatgtcttcaaataattttcttctagtctataatgtaagaatgttaaaaccgtgtccctcaaggttgcaatatacattgcatgtgtaaattgtatgtataattacaacataatggaaatgaatatactacacatttctctcactttcaaatgttggttttgcaccaactatttttggtttccaaatagagtgaaatttacatccagaatttcattgtatcattaattatatcaacagcttaaggaaaaataattatattaaccaataaatccagttgttaactacatgaaatacataatcttgcttaggtgaatgttttccagaaattaaactagggaaaaagtccctaacctttataagattgtatacctaatgttgctggctgtttaacctgagaactaaggggccacaagagtttatctgccagatgataagccttctgaggtcaagtgagcctgcgcatatccacttctaccctctgtagtcattgcataactttattgaatgaatttggctgctataaggttgataatctcatgtgtcctatgttatctttattaaaatctttgattcttttttaaaaaaaaaaaaaaaa

SEQ ID NO: 14089 - DNA, 879 bp, Homo sapiens
tccctcttccatttagctcgcagttcaagatacattctattccccatcaccccactttctggctttcctatcgtaacaaggtaggtaaaagaggccaaacacggaaaccccatgcagtgactgcctcctttggatcagcatgttatgaaaagtcggtacctgccattctgattgactgagagcaacataatacctctgaggcctttcggctcagatgggattgcaatcgatagactagcaagattaaagcctgccccaacattagtttttactcggatgacaatgctcctttccaagaagatatgatgctgtgttgacgaatctcgattgaccacgttgatcctgtccatataacctgatctcactccgaatacttgtatacctgtgaggacgctcgtgttttgcttaagatcatgactccttccatggcttataaatttatttattcgtaccgcctatacttatgctgtctagttatttaatatcctacctagctgcgccccccttatcatcgatttcacgttataaatcaccctgcctgtgtctatttgttattatccagggctcactccccatttttcgacaccttgctcggccctagggtgcgtcattgctttcggttactaatgtacattatgcatcgctgtaccattttgttcctccacactccatccatcagtattcatcttattctacccctcggtatttttagtatatattatttttaatcttttattaacttatttaatctcgttcatctcctcgcattttcatcattgttagatcccgttcttttgaccctttcttagtcataattatttatttcatcccctagacctatatataatttttccctcttgagctgcacgtttccccttg

SEQ ID NO: 14090 - DNA, 740 bp, Homo sapiens
ctgtttttttgtgctaggggccccccccccacggggtttggtgggaccaccggttttcgcccccccccccgcccgcaggtttttgtcaaagtgcccgcgaagaggacgccgggggggccgaggaccagggcggggggaaaaaccaccccctcggggggggggggaaatttttccccggggggcgggcggcccccccttcaacccccccccctggggggggcgggggggggggccccctggggccggggggttttcccccccttcccccccggggggggccccccccctttcttgaaaaaaccaaaatccccccccccgggggggggccccccgttaccccccccccccggggggggggggggggggaaggcccttcccccggggggccgggggggggggtgccccaaattcccccccccccccccccccgggggcccaaagggaatcccccccccccaaaaaaaaaaataaataaaaaaaaaaaaattttcccccctgccccccctggggggattttgaaaaccctttttttttacccccaaaaaaaaaccccggttttttttttcccctttttttagaaaaaaaaaaaatttttggtttctaacccccatggggggaaaaaaccccttttagggttttttaaaaaaaaaaaaaaaaaaaaaaaaaaaaaaaaaaaaaaaaaaaaaaaaaaaaaaaaaaaaaaaaaaaaaaaaaaaaaaaaaagaaaaaaaaaaaaaaaa

SEQ ID NO: 14091 - DNA, 839 bp, Homo sapiens
aataatctatttaaacgttaaaacacacacggaaaccacaatctaactgaaacgttctccaaagtgtacagagtttctggtgggcagcatacagtgaggaccatggcttctgtgctgaagaaagcaaacaccaaacgcatcatgccatggatacagtaccacgaaataccaaactgaacttgactccaaacatgcgctcagttacaaactggatatgaagaccatttaagaatcatgtgtgagagaatttcattgaaagagaataatcatttaaaaactattaagtcctttctgaattgctatacatatattcaggaattcattgattcagcctaggagtgcacagacttgggaaattggctagctacaagcggaccttattcctcctgtaacaatacagcattcaccctactcaaacacttacttggttatatttacaattacttttcccacccaatctattaaaacgtacttaggaaacacaaatgaaaaatgagactaccatataataatgatccagcaatatgatcgactatatttatagaaatgataataatggaactcaattaacataaatcaatgaaaatcgactaaacaataggggaaagaaagatcaaataattacacagcggcactacaggtaataaataaatattgtgttaagcactgagccataactctagtctgctgcccactaatgaatattattcccatatatgttcctttctttcctttaattacaataaccctcaacatctaattccgcttaacaatattatcgtttaattattagatcaggcaatgccgatatttttctgactccaacccgtttcgtcatg

SEQ ID NO: 14092 - DNA, 685 bp, Homo sapiens
agaggggaatgggcgaactcaccatctctattgcgatatattactctaccacctggggacactcgatgtccatctgctcaagtaatccattatgaggatcttttctcaatcataggatgccaggtattaactctttccacagagtaactaggcactgcaaaggtagagacgtatgttcaatagggtacgcgcccaatttatcagcaaacccaaaattcaaaaaggcttttgtctttaaagattagatacacaggtccttagctgtcacttgaagtgggtaggcaaaggggctgctgtaaatagaactccaacagaaatccgcaaacctgaattggcaaacacagtctacctatcagagtcgtctggtcttcatttgaatccagttcatcaccagtgttatagaatgctactagtttataaatttataattttttcctttagctcttgaaaaatatgaaggcttgtttcataagaattatttaacttgtgaaaattgaatggatgaatggtaaatcacaaattgagaagttaattcttgatgggtctggagttacagttgatatgagcagataatggttccaatttgtagaccacccatatatgctatacctttatctaagtgtttatatacattatttgattttattttttaacattcctacaaaaataaagtgtattatgcccc

SEQ ID NO: 14093 - DNA, 869 bp, Homo sapiens
ataaactacagttattattctctctcacacggagcattaacaaaacctcatcacatctccaaatgggctaagagcacagtaggtggctctctttatatttcatgggcaaggcaacagtgactcaccagatcctacatctgtgtcaccatcataagcctgatgaagttgagcaacaaatgaagctgtgtataggctggagataatctttgtttttttctacgtcctctgattttctcaagccacattatgctttcctaaccgtgccaggttttatgatgctaactgcttacctataggagcaaacatatgctccaaaatgccagaagccaggagcgcacccgctccttctacatctgaatctgcaagcctgattgcttgcttcacctatgaaaattttactggcctatgaaaattcttaaggataagaacagactccctgtctgcgccaaatactatacattaatattctatcgtgattttatcactccattctttcctcaaaagatggattcgctcctgcatacaagcgctgtattatcccctaatatttatttgtatcttctctgaaaatttttactttaaccgcataagttttttactctcctacgtcatgttctagcaataatcgtcaatgagactcgtgtactatatctaatgtagcatcatattctttcgcttttccaatccgcctaccctactatcttgatattgatcttatgtcgatgtcattatcgcaccccacgtctcttcttttgtcgtatagactcaccgtttttactccgtactacctctatataactaataacattatgctcccactccctttctcccattttatcgcgcgtatgctctacctagtaacagaatac

SEQ ID NO: 14094 - DNA, 536 bp, Homo sapiens
  misc_feature (1)...(536): n = A,T,C or G
ccccacccncatgaagcaagaattttttcgggggaaaatcacttttgtcattcttgaaacaactcctggtggannccggattgttntaggnactcagttgccatggagnatttgcatataactcacgctgaacaacctcaacaaatcataggtgttttacacattgagcaatattaggaaaattagaggtcagttcctggggctcctttctcaacttccccagccaatggctccatcggagggtcactttgaaagcaacaaggtagaatcttttaaggtggctatctacctaggaataaatcaatttacactgcaatttactgctgtaattgtgcattcggaggtttgacagtttgatagtctctaagggttttgtcaagtaagaagaaaaaagctaaagaaatggaaaattactattgtgtggacaggacaatttgccccatgaatctcctttgctgctattaaaatacgttagaaaaaaggaaatgttttagtttggcttcatggcaaatgctatgataactagaatctgaaat

SEQ ID NO: 14095 - DNA, 554 bp, Homo sapiens
  misc_feature (1)...(554): n = A,T,C or G
ccaatanntntangtatttcaaacttngcncangtggaanatagaaangnnataanggnccttccnatttcccaaantncaccaanncanaangttggggaaaangnncccagaatanagggcnnantctgttagtcctcccanagaacatanncttnaacnnntatgggtacatagaaangcagcntcagangaccaaaattcgtgatgagcaaatcacagtacctggttntncacttcataccantgaganaggcgattgaanagggtangcantncagacagaatgtatntaatanatatttanagaaccnntcatcctanggcagcagaatantcattnttcttttcagnacatgntcattcttgaggatnnattttatgtcagttcacataacaattctcaanacattaaaaaaatgaagtactatcacagntcaataataataataactttgaaanctatacaaacacatagagattaagcantatgctcttaaatgnccagctggtcaatnaagtaattaagaaantaaaanaatnaatattcaaat

SEQ ID NO: 14096 - DNA, 591 bp, Homo sapiens
  misc_feature (1)...(591): n = A,T,C or G
cgnatgcctgactccccgttcgtgnaaaanaanttangnttancgggaagggnntnaacnatntaggnccncnanntnttgnaaatgntacccnccgaggacnncacngctnaagngggctnnantattttaatcgaggcnataaagccagnccagancgnaaggacccnancacnataanntgntcnctgcaacnttnaatccngcntccaatnnnagtntattaagttgtagcnggggaagctagnacatacangccatgcaagaaatgtgnaaaagttcttcgnagangnaggncaattatattaggtcagaanctgaagncctacntaangagaggaagnagcattggatgaagaaaaaataaataaagaatncaatattgnancctgcaaacanctcagnnaacattaaagagtaggaanatttcnatattttcaaagtnttcttttctggaagaaaataantattcctgtcatnttttcataaacataataacataatgatataaattgatnctagacatagaaaactgatgaaagtaactaatatatatttgtgaaaagaaacagtgtcactnagcatttnaat

SEQ ID NO: 14097 - DNA, 580 bp, Homo sapiens
tgaacatctccaaatgggcaaagagccagtaggtggctctctttaatatttcatgggcaaggcaacagtgactcaccagatcctacatctgtgtcaccagcaaaagcctgatgaagttgagcaacaaacgaagctgtgtataggctggagataatctttgtttttttctacgtcctctgatttcctcaagccacattctgctttcctaaccgtgccaggtaagatgatgctaactgcttacctataggagcaaacatatgctccaaaatgccaaaagcaaggagcaaaatgttccttctacatctgcgtttgcaagcctgtgtgcttgctacaaagaagagaaatctaatggcctatgagaagtctcagcagatgaacagccccactgcctgggccagaaacagatcccttcatcttccaacatgagcctccagccatcactttccacaaggaggagtgaaactccagacaagtaatcagcaccaccaggaagcagtggtctctttctgcaaatgccacctttgcacattaattctgcctactctactcagtacccacaaaattgtcaaaaaaaaaaaaa

SEQ ID NO: 14098 - DNA, 208 bp, Homo sapiens
  misc_feature (1)...(208): n = A,T,C or G
tgacagtatattattaaatcactttctatattattattgaaaaaagaaattttanaaccaacacctagtattctgttggtaaatttagatggaaaaagaaaggtcatggatgcataaacttcacattcaaacatcacaacatttcatcaaaggttgttaattgaataaaatataagcatttaaactcggttacacaaaaaaaaaaaaa

SEQ ID NO: 14099 - DNA, 773 bp, Homo sapiens
taagtgagctggagcagggctagcagcaaagggaaggctgcatcagcccccagcccagcctctgtgtggcctctgcacgtgcacgcgcacacacacacacacacacacaaacacacaccttggcagatgtatccctagaacgtggcagagactcaggctggagccacttggtacagggactcacaacctcaaaactccagatgccaccgctgctaggagcttatgtcgactgagcttggaccaattctggtcacaggatcttggaccatgttcttgcctgttgcacctcagagaagatccttcccataccctttctcctgtacccgaggaaaaccctagcctgcacttcccgtcgggcttcctgctgggagcacctccagccccccattacccagcaacaacttctccacggccacccagggacacatgtgaacaggtgatggaggccagcatggattcccacccagcccccatgcatgcctgctcctaggggttagacccctgctttccggaaactttctcttgctcggatatttggcaaactgcccaccgtgctttgaagtcttcatcttatagattctcaggatccaggcacgatgctatctgtgcagtgaaacacagctgcatttggcctttattctcagagcttaatattacatgaagcacgcagctagaccattagtactaacctttaccatttaagggaagagatgggctggattcacacttttttttaagggggtatgtgggtagggttcgatggagggcgtggt

SEQ ID NO: 14100 - DNA, 1223 bp, Homo sapiens
  misc_feature (1)...(1223): n = A,T,C or G
ttcttcttcccttatggtctcctcgttccttgttctttgcgggtgccggctgctctcgccgtttcgtggcggcggtcgcctctggcggcgccgggtcgtttgcgcgcgtcatctgcgtgtgtcttcggtcttgttctggtgcgctgtctctgtgggcttctctgtccgctcgcttcgttgttctcttcgttgtgcccgtgcgcggcgttgcttgcgctctcgcctgttgccttcgctcggcggtgtggtgggtgtgggggggcgcgtgtgctgttcgcccgtcggtgcgcgttgtgcgtgttctggaattcggcgtctcgtctgcttgtggcgcgcgtccgccggcgcgcggcgcggcgggtcgcgttgttgtctgttgtcgtcgcggcgacggggttgtttcgtgcgtggtgttgggtgtgcgttggtgtggggggtgggcggccggtgtggcgggttcgncctcgtttcctnnctcgtctttcgtgtcctcgcggcgggcgggggtgcgcgcgcgggccgcggccctggtgtcgtccgcgcgcggtcccgctgcttccttcgtcgcgtgcgggtctcttgtgcgtgcctgtgtcgctgtcgcctggtggccctcgctctccgtcgcctcggcgcgctccctcgctcggggcggtgcgcagtctggcgtgtgggcgncaccgcgcggccgttcttttctgtctcttgnggtctgtcttctttgcggtctgtctcggtcgccgtgccgtgttgcgttgttctgttgggccgcgggtggtgcgtggctggctcgtgctcgctgggcggttagaaacgttcttttcctctctcctcgtcttcctgcccgctcctttccgcttcctgtgcgggcntccgtctctcttcgcgtctgcgcgggtcgcgtccttcccggcgcgcgggcgggcgcgcgggcggcgccgcgcctggctctctccgtggcccgtgggtgggggcgctggtggcggggcgtgggcgttgtgtctgtttttctcgctcntgttgtcgcttctttttttctttcnatttctttttctctctttcccgctcctcgcgcgctctttccccccggggttgtgncccctgcctaaggctctccgctgnccntgttttcccccccaggggctttttctttttttttttttcttccctccttctctcccctcttctcctctctctcttctatcttcacctttcctccccct

SEQ ID NO: 14101 - DNA, 802 bp, Homo sapiens
acattgaggaattgcaaagttatttggtgtgtctgttgaccaataaacagatgctgagtttcctctgaattgtgcttacttgtctgcataaacatgatatgagtatgtggtggacattttagcctagatcatgaagttttacccaggtcatcttccagagaagtactcttgtccagatactgggattataggactgtgtatgtcctacacacacattatatgtcctacacgcacagtgatggggagtgacaaaatgaagactccagaatcctctttatcagatcctgaatgtgcactttctgaagtgaagtccactatgtgctgttttttcagagaatagagcatgaaacaaaagcaacatgaccctgccctcaccaagactacagggagtgatggagcatacaactttgtttcagaatgcaattcagatcttccctttcgcttggcttcttaaaacttcttttgaggatggtaaaattccgtgttatattaaatttcatgttgtaactgatgctctgggatgatgttggccaatagctagcaagacttgaaataatccactagttttatgcattgcttaacacacttccagctgacttcacaagttaaagcatgtgaagaaagaaggttttccggttacacagatggaggtggtgatctttctcattttggtggaaacatttaattctcattgtttattcactgacaatgagtgaaattccgtattgtacctggttggtgaacttgtgaactgtggatgtagaacttataagtaactaaaaggttgggctaggagtgtgtg

SEQ ID NO: 14102 - DNA, 740 bp, Homo sapiens
aatccgcaccatcttaaatattatgttgtagaatctggttcttgtttaatcctgtggtgaatatgaatagtttttttagcagtctgattagtcaaactgaaagtttaaaactgcagtggttccaatgtcaagtcagttttaaaagccttgcaatgttatttggatctactccatctgcacatcagctggtggtcagtttgggatcaccaaactgggtggagatctgtcttttagttcaactctctcttttatcttattacattttattttattgtggtaagaacttttaacatgtaatataccttcttgacagagttttaagtatacattattgttgattatagttaaaaggttgtacagaagatctctagagcttattcatcttgattaattgaaacttaatgccccttgattagtaactccccattttcctccccccaaccacaggcaaccaccattccactctctgattctacgaatttgatcattttggatacctcatctaaatggaatcatgtaatatttgtctttctgtgactggcttatctgacttaggttcatctatgtcgttaagattcattcatgttatcacacactgcagaattttctttttaaaatttgtataatatttcattttctttatgtatctgtcaatggacatttacattgcttttacatcttggatattatgaataatgttgcaataaacatggaagtgctgataaaaaaaaaaaaaaaaa

SEQ ID NO: 14103 - DNA, 298 bp, Homo sapiens
ttcaattaatttccttcatatgcctaaaataagcagcgtatacctcacagtgagttcattggaatggaagagatggcatatcgtggatatttctgttctgaaagaaataagttcaaggaaagaaaaagaagagtatgaatggaagattattcatccatcaatccattcttgccttctgtgcacacgcacatatacctatacattcatatataatgtgtactgtaatgtttcagctactctctcaggaatgtttagaaatgaaacagtaaacacaattttaaatgtaaaaaaaaaaaaa

SEQ ID NO: 14104 - DNA, 1139 bp, Homo sapiens
  misc_feature (1)...(1139): n = A,T,C or G
gttggaggtgaaagtggaatatattaacaagtagaacgtggggggatcatcgtgnataggtacagnaacatgtgatgatatgagactagtgtgactatgaatcttaagtattcatcgngggtanaggctctgtggtacgtgtagcgcttgtggtcatcgttatgtttgtatcggaggtgaaanngggctggtagtgnnnnatgtaacactttaacatgataatgnagttgggattgataagagagagtcagggccggtgtanaggtgaactagtgagttgagtgtggggggtcttgnnnnngcagtcatattcatctcgtgctggcctggatatcgtagcgagattgtgaatgtaaaccgtggaccgtagngctgttgagaacaaggaatcgctaagagaaattggtgagnatgagtatagtttaatcttgactgtgtgtnatggggggggngggtcaacactcaaaagcggcgggcggcggagnagagtagaggaaataggcgggnnggaatacgaagttgaagaataaaggagaatgtgagggaagatgatcatgccagagattttgggggggtgtgttctgggtgtttctgggtgtgtgtgggggnggattggtaattgagcacgaaggtagtatgntgggtaattagtgcttctatgtaaaactatataattttnctctataatctatttagtnngcacctnnatcataactaactattattnaatctatatatatcaaatataatattnaacttatanaatacaaaccaataataaatttcnnnaattaacgtcttctatctcctcttttttaattttacctacaaaaatacacacctacaaaatctcgcggttganatnnactaagtaacactaactttctctttgtctcttccgcttctgtgtaaatcgaccgatncctcgnncctcccaattcttaactttaacataaattaacttaatctannaacattctcaatacaaaatactaacaaaaaacataacctcctataatgtacatctaaacgaattaatnnacttacaatacaataaaataattnntatatttaattaatacactatatttcttnactatccatctatattnacacnaaaaatttaaccatctattcca

SEQ ID NO: 14105 - DNA, 970 bp, Homo sapiens
  misc_feature (1)...(970): n = A,T,C or G
ataaataaaaatacacgacccgaaccacaaccctccacttataaaatagaaggaagtattaactatctactctggatgccacttacatagacatatgctgtccaggacagtggctacatatggctatagatgcttgaaaatgtggctcattggaattgagatgttctggaagcaagcacaaaatacacaccgaaacattgaagacttaatccggaaaaaaagactgccaaatatctccttcatgatagtaacaatgatcacatattataaatgatcacaccactaaagtattcggcataaacaccacatatcatccgccccaactacacgaaaataccacactacaaaacccaccgaaatggatccaacatcaccattaatacaaaaaacacatcttttcctccctaacactttccaaaataataacctacgcatatacacacctgatactaaaattaccgacactagcggctaataatactatattataatactacccaatactgatacataacaaaacgcctatataccccatcacacgacagaataacaaaataaaaactacccgacctccgacatacacatccacgtacatcgagctacaacaaacactactaatactccccacacacaatcgtcatacaactcaaaatacaccagacctccccaagaatcaaataaatgaacatagcaacccttcccacgctacatactctcacagaaaccgacccaagcacaaaatcgcctaaacgacgccantaacactaacgaatccgaccatatagatacactaatgaatcgacaacaacaaactcagtcaactacctctacatagcccaaggatgaataacatgcgcacgaataagccttactgagtacaatcagatgaatcacccaccgcgctacacaatgcaattattgactacaacataatataccacgaacatatgatgtactctactctgacaat

SEQ ID NO: 14106 - DNA, 1154 bp, Homo sapiens
  misc_feature (1)...(1154): n = A,T,C or G
tctagctttcacttgtngcatgttgtaatgtgaggatcatctggttgatagtgaggtgctaggaagtctggtgtgtgctagagactctagggagtgtggcggtgtctnatatgtctcgtggnggacggcggtgctgtgggggtctgggctgctagcgngtgttcactgctcgtggctatgccttggactgtggtacggcgacgattgttgagttgtggaagttgtgggcttggcgagggtgtgagggtttcttgaagattaagttgcatggatgtggtgctgtggggactgatnganggnagtcgacgcctgcctctctgtctcttgctgcgggtgttggttaggtgggcttggagagtacggcggctgncctgctgggcggctggggttcggaggggggggggcggagaaacacgtgatgaggggcgcgagcgaagcagcgtgggaggtgggngtgtggatganngactggactctgagaactgggcgcgtgagggaagagaggcgatgagtggcggagcggcnaacccgaaacgtctcgtcgctgtgtgtggagcggcgccgcgtgacgtgtcccgctgtcgaggacgcgttgtgtcggcgnggcctctctctctctatttccctttactgcaatctcgcgtgagtggngcgtgcgtgtgagtgattttgtatggataagaaagggcatcaagacacacatctgaccggagagaaaatccataacaaccctaggnaaccgatgaattctttaanctccacttnatgtccactacaccgtaatccctaccctcatccatcaccaccaactaaaagtcatnaattatgataagtatntattatcttagaagttacctgaacanaagctgcgcctgcgtntctccttcgccagtacgtngtcattcttgacattcaaagctatagaaagatggatccgtgttcatcatcgtgggcagtatcacggangcacattagcaatacatacctcaatttgaataatcaaaaaaanataaacttaatagccaaaacaaaaaaaaacaatgcgcctcgttggccaaccgcggtgataaaaattctcttcagaaataataatctacatttactaaaactcctcctatncttcaatctaatnacttaatctaaaaccctataat

SEQ ID NO: 14107 - DNA, 1613 bp, Homo sapiens
  misc_feature (1)...(1613): n = A,T,C or G
cttgttgtatctatgttgaatgtatgatagtctcgcgcaanctccatatncaaactagtatcattatgctgtctgctcatgcgctacactattagtatccgagcaccctaattcctnatcacgtggcgtgcagtcggacaaacaatcatgcaagtaatatgctccggcctcaacctactatattacagtgatactgaacaggaatagcactgtctggatctagatgtgtacatgcgcgattacaactattgtcaacgcttgcgtctcncttagtgtgttgcacgcgtgccctagtatctcgagtagcacntgcggggcgnacgtattgtagacttgcacacctgatatagcagcactagcatcgactatcgtgaacacgtgacctagtagtcatctggntgaggatgacctctcctcagagcgtatactatctatctgtcaccactttagtgtgagattaacgcgcgtagattagggtggatggccgcntactttatgcgtcacactacattcttactatttatatatctggtatataaattatacgtacttcttagatcttgtcttgttatagtatcctgccagcgacgcgcagcgctactcatgacatctgtnttgatactcaataatacatagatagtttgctcgaggtaatctttatactaatcgtagctaagtaatcatacctctaattatgtgagtgagaccgtctaacctacatcacgcacancacagctcantgtcgtcagaactactatatagtgcctgctgttactatctctcacactnatgtcatctcagatatacgtatcatcagtgtctgtactanacttctctatatanatctnacgcacatntcgtataatacactgcacatatangatcgtgcgactanacactatagcntgcacgtcgtantattgagtatctancantcgaccctcgtnggtcggcagtcaaancaacacgtagatcgagtgancntgtatcgtatcnttatgctatagttatgagtgtagcgcgagcacgattntgtatatatatatgantcattnantgttgntgcgntcatattanactgtgacgcatcgacgctncttcaatctgaatagtgtatgcgtgtngcacacgtgcagacnttgaatagntagtatgtatantataccgtnctagcgaacattgnacgttaatcgtncaactcacgtcgcaatgctcaacaacctcacgantgtgacgtcactatacatgttcgtagatngatgcatcacgtgactactgacatntcactacatatagatcatataacacgnagtatnagtatgcagagcagcaacgcgacatagcnaatnantgatacgaagtaatatagtgcctcacactcacgtcgcacactgccaantccgatacacaccntatgttctatcgtgcncnagcagtacctatcgcagctcgctactatcntcacgtccacgctactcactacgangctcactgtagagctgtgactcnctctnctactatgtnanattcatgttatnacgccatacgcgcactctcgctatcagtgtgacnacagacaacatatacgatgtatcaagttgatcgcatactag

SEQ ID NO: 14108 - DNA, 1469 bp, Homo sapiens
  misc_feature (1)...(1469): n = A,T,C or G
ggagggaaaannananannnannnaaangaaaaaaaannaaaaagagnanagagnagananaggagagacgcagcagaaaagagaagagagagntacgtgagaggaggacgcagagcgnaagagannanagagacgacgacagaacctcatagcgcacgaagagagcgcacgnaangagcgcgcgcgcagacagagcttccggagcacnagaacgacagacggacacaccgcaggagcaggccgcagaagagagcgcagacgcagacancagcatancagtagcgcancgagaccgtcctctgccaagacaccgggagaacacgggagagagagagccgcgcgagcgagcgccncgaaccacacagagggaatgagtagcaaaaaacgaagnacagagnaacgaagatacagagananatcnacgaagcagaaaccacacagcacaaaacgaagacaaggagagaagagtgagaaaacacgcgcaagagaggagaggacagcacgacaggaaaagagcaaacacccccacaccggacgcacagacgcacaaggctccgcagcagccacccgcacacaacgacgacacagtgcagaagggaagggaaggaagagaagagtacgaganaaggaagcaaaaggcgacgcacgccggcagtggccggcggcaaacgcggacacggagagagcgcgcacagccaccgcgaagcgggggagaggaagaaagcaagcgagacgaaggcagacggggagcacaagagagcccgagggaccacaccggaacgaggagacggcgcgaagccgaccagccaggacagcaccaagcacaagcaacccacccgccgcaccgacgcgcacccacgacaagcacacacgcgcaacgggaaacagagaacaaaacgccgacaaagcaacgcccaaacgaaggggactcgagacagggagcagcggagaggagaggncgagggaatcgcggaacgggagcacgggggaagaaggggagtgtcgaccagagagcgcgcgagatagaggagacagagaccggaagngacgaagagagnagagagaggagagagagaggcgcgggaggcgaggagcaggaaagacgagacgacccagcacagcgcacagcagagccagcgaagaagctgacagaagaccgagagacaagagaaacggcagagccagaccgaggcggcgcgacagcacgagtaaaccgagcaaggcagacaacgaaagcccacaaatggaggagagaagcggaaacccccgcgcgacacacacgcgaccgcaaagaagcaccaacacatggacaggagaacgggacgcagagcgaccgaagaacgtacgcagagagaggagaagcagcagagaggaagagcgccacggacgccaccacgacagcacgcccgcagtcgtccgcgacccacatcgcgcgcacccgcagacgacagacggcngtacacaggag

SEQ ID NO: 14109 - DNA, 757 bp, Homo sapiens
  misc_feature (1)...(757): n = A,T,C or G
ttcaggcgtcgggtctttcatttaatgtggtctcacggcgcgttattttaagtaagacgtgggcgtctgagtgatcttcttnngactgcactagactttactcattgtaaccttaataccacccaaaatnctcaatacggngacgcctttgtttctattccttgtgcctgtattctgggaaacattggtcatactattgtccctgggatatatnngcgtggacctctctctcctacgactgattgcgcattgctcgcccctcagatgttgttctggtctcgaagcgcattttcttctaagatgaatgaacactctgtagtgtgccgttgtgngttaaaacatacgctctccggtaatgaacaaggcttggggnggagtacattctgctcaatatatatcttctggctctagactatcctnnnaccacctgtggtgccataactgtaaantcctcctcatccagaataaacttgaaggtagtacatttacgacctagccactatcattatttacccacccccctctttatattatcatcagctccttctagtcctttcaaacaacgacacctagatgcccatnaccaaactactctgcctccaatgttttctcataccgnagcttcttcttctcatcacccttgacaaacgccccgcaatatgtaatgatctttcagaggcaggagcctagccatttctcaacatgctagcacttgaataaagtcacttntctttcaccacaaaaaaaaaaaaaaaaa

SEQ ID NO: 14110 - DNA, 208 bp, Homo sapiens
cttcacataacaaatatagaacataaaccactcattttcctctcgtctaaggaaagctatatgagggaacagcaagagggcagccaactacattcctggaagacagccctgaaaccaacactgatggcacctagatcttaacttctggcatctggaactgtgaaaaaataaatttccattgtttaaaagaaacacaaaaaaaaaaaaa

SEQ ID NO: 14111 - DNA, 954 bp, Homo sapiens
tcaatactttacttaaatattattgtagtcattttattccccttacattcctggtagctggaagtgcaaaaggaggtgtcggcaagatcgtttttttctgagagctctctccttggcttgcagatggcagcctgctcctggcacagtcttttctctactcatgcccaaagctacgcgaggacccagcaaccatcttctgcagtccctggagacctcttgactcttctgtgatgcccccagtgatccacctgccctggccttcttttcgatggctcgaacatctggccttcattgaacacatcgcatatcgcacccccgccacattttcatccccactccaaccacccgcattgtttccctccgccccccaccgcgccacacctgcctacctccccttcaccgttccgccctgactatcccaagggccttagggttcccttatgacacagctctacattcggtccatccctccccccgcccagtatcctacccctcccacccccacaactcattctacaaccccacttcccgcctccccttctccatcctctacaaactttatattcgcacccccatgatcgcccagtcttcttttcctaccacaaccgcacctacgccgcaccaccctttcctgcccacctccgctcccagtccccattcaccatccataaccgcaaccactcctcgatctcatccccgaccccacccccgacccaccgctcgatcccccgcgagcgtcgactcacccagccaccaccgactcccacgccctcctacgccgtccccccaccgcttccctcaccttaccaccacctcacctctaacgatcctcgctcaccatccaaaccagacaacaccccctcactatacacgcaccccctacagacacttaccgttatcgtcataactcaccaatctagcaccgcatccacacatcacagtaaaaactacaaa

SEQ ID NO: 14112 - DNA, 723 bp, Homo sapiens
  misc_feature (1)...(723): n = A,T,C or G
atacaccaaggcctgtttcagttttacagagcctggtccttgtcatcttttatgttgatcaagggccatgtcccttaaaaaaagttgttttggtttcccaatcgaaatggcctcgctctgtcacccagggtggagtgcaatggtgtgatcttggctcactgcaacctccgcctcccgagttcaagcgattctcctgcctcagcctcctgagtagntgggattacaggcacctgccaccacgcacgggtaatatgtttttttttgtttgtttgttgtgtttttttttttttgtatttttagtagagatggagtttcaccataccgatcaggctggtctcaaactcctaacctcgtgatccaccctcaacggcctacccagatttttataatataatctaaacactattttaaggctattaagtaagatatttggtcattttataacaatttagaagtgatttgtaatttaatgtatgaatttttaaaatctgattaaccattaggaagtattgtattaacactaacatttaaggatgaaatgtccttagaaataacaaataatctacttaacaatctattggcacataacagaggcatttttaattatatttgatttgataaccaactatggaagaatcacagattattattttattattttctttaaaaattatgtttattttaattttaaataaatcagaagctgaaaaaaaaaaaaaaaaa

SEQ ID NO: 14113 - DNA, 559 bp, Homo sapiens
acagagtgttgctcagttacccagcctggagtgcaatggcatgatattggctcactgcagcctccacctcatgggttcaagcggttctcgtgcctcagtctcccaagtagctgggattacaggctggagtgcgatggcatgatcttggctcacggcaaactccgcctccctggttcaagtgattctcctgcctcagcctcccgagtagccgggattacaggcatgtgccaccatgccccgttggccaggctggtctcgaacaccttacctcaggtgatcctcccacctttgggattacaggctgaggaattaccaaggaggcaggaggtggagcaaaacacaccaagcctggtgccaatcattgacaatattatggaactgactcagcgcaagaagacagcttcgactccttgtgatttcatccctaaccaatcagcactcctggctcactggcttcccccaacccaccaaattgtccttaaaaactctgctctccaaacgctgggggagactgatttgagtaataataaaaccctggtctcctgcaaaaaaaaaaaaa

SEQ ID NO: 14114 - DNA, 278 bp, Homo sapiens
accttgatgtaacgcattacagatgccagaacctctgtctacctaaggccctcagtgactttgtgaagcagagtctcacctccaggctggaaacatcctggtctattacatgaacaagaaataaacttcactgtgctgctacttttggtaggtctttttgttactgcgatgtaaaataacaattctagctgatggagctagggatctgcatgacagaaacagtgctttaacaaaatggcgtaactgggattaaagaaggaataataaaaaaaaaaaaa

SEQ ID NO: 14115 - DNA, 438 bp, Homo sapiens
ctttgaaagagtcttgttctgtcctcagactggaatgcagtggcacgatctcagctcactacaacctcctcctcccaggttcaagcgatccacctgcttcagcctctcaagtagctgggattacaggctcccgccaccatgcccagctaattttttgtatttttagtagagacaaagtttcaccatgttggccggcatggtctcaatctcttgaccttgtgatcggcctgccttggcctaccaaagtgctgggattacaggtgtgagccaccgagcctggctggtagttttattttttaagaagctatgcctctatcagtgtagcctaagaagacattctccttcttgggtaccacattgcgatgttgactcacactcaactgactatatttatgacagattaaactcttaaatatagtcttcacaaaaaaaaaaaaa

SEQ ID NO: 14116 - DNA, 723 bp, Homo sapiens
ttttcaggcaatgtgttgcagtttggtcccataatatgcaactaggtatgtttgggctgacttatctgggttaaaatattcaaagtaattctccatttgctatccttcccaaaacactttgttaaaagttatcagtacataggtaaaatagcttaacacagtgaaaattctaattcagaataattatctgaaaggcttaagtgaattaaaatctgatttataaaattcttcttgatatctacgaatgtatttttaagttctctcaaaatatgagctgattctcagacattctcaaggagagttccttttggacctgttttaacaaacaggtaaaaatcatttttaattagttcatcattcatatgcaaataaatactgctacagaatttcaagagtgcctgaaaggacttcctaaggaaagctaatagttccctcgtgatttttttctatttatagtttattaatcaaacactttcatagaaaaagtacaaagatcgtgatcttatctatgctagaattatctcagcttcttaaatactgtttatttaatgagattttactggaatcctcatcgttagttttatcacacaggaatggtaattgtgtcatgtgtataaaccttctggaaaacattccagacctcagttccttgtggtttgattttagctatttctaggacatttattttaacattaaacaggattctgaaaaaaaaaaaaaaaa

SEQ ID NO: 14117 - DNA, 332 bp, Homo sapiens
aacaataacacaacaattttaatcgtccaaaaagaaaaaaaaaaacttcatgtctcgcaccctgtgctgcctgtaagagctccatctatcacgatgctatcatctggtgaggaagctaaaggcatgcagaaggttctggaggagatgccatctgaagaaagagccaagaagcactaaaatgccaaacagtgaagatgtcatcttggaagggaccctccagccccagtattgctcctggctgacaccaagtgccagctgagcccttctcaaattcctggcccacaacatgatgaacaaaataaaatggttgttttaagctaaaaaaaaaaaaa

SEQ ID NO: 14118 - DNA, 292 bp, Homo sapiens
aaccttcaccctcttaataccaacacccatcataatagttcaggatatactaactacacttgactcatagcggaaaatcgctgcatatattttgctgacatctattgcaaatccgcattgctgcattgtgctaaggaacacagatgaaggaaaggggagatttttatcttcaaccaaatagaaaattaagtcacctctacatgagttccttgactatgttactcttcaaattaaagggtctatcatatccagcgtcctcaaaaaaaataaaaaaatggcctctttggcctca

SEQ ID NO: 14119 - DNA, 138 bp, Homo sapiens
ttttaggtgaagcacattgaaatagccttggataacttgagctgtccaggagccaggatgaggactcagctccacaaaatccaaatgccttcattatattaaactgcctatatgaatgactgctcaaaaaaaaaaaaa

SEQ ID NO: 14120 - DNA, 367 bp, Homo sapiens
  misc_feature (1)...(367): n = A,T,C or G
agaagcaactacggcgcatcaacatttgaacgcattcnggaaacgcttgtggccaccaaaccagctttatggtggaacacctgctgatgaggccacatgggtaggccacatggagaggaggagaggtccactgatccagcattttagttgagcttccagctgactccagcctcaagctttatctgaatgcacctgcatgagagacttctaagcaagaccagcagaagatccacccgctgatcccagacaacccatggaaccatgggattttttttaaaattgtggtggttttgaagccactgagctttggagtggtttgtgatgcaatgataaataacaaaagcaatctcactgaaaaaaaaaaaaa

SEQ ID NO: 14121 - DNA, 1257 bp, Homo sapiens
  misc_feature (1)...(1257): n = A,T,C or G
tggtataaagagtgtagatnnnnaaataaaantagtaaaatatattatataatgatgtgtgaagtaaattntaaattagtaattgttaatgtnnaanntaaatttnntntatagattgtgtataaataatgtatttnattatatcnncannatacaatggtaatataatatttnanttatattnattnatattannatgataagtatcnccaaccatcaacagaatccncccaatggtcagatgtagagctaacgagctcatccgcaccagtcaacgcccactgcctacatatgtatcttgacattgttgcacatcacaggagacacgatatctattcgagaaccttgagcctgtgtttctctaacatattatggtcncattcatgccttgtgacataatatataatnaattataattatattcgtatagagtntattaatcacacgtgtagcnncctcttaccacaacgcatgactcntatgcctnactngcncatgatctcaaggaacgaaatacacaccgaccagatgtgttccgcatcttgttgcacgaccagataacctactaaatataccacatcatccacatcacgcacntatactgtcctaccgctcacagagtgcttacttttcatttctccctcattctccacacaccgctccccacactctcaactccgcctgtcttcctcccttcgggtcccccgcatctttctgttccgtgccatgacatgtcggctccacagtcagcctctagccgccatccaagtgtcggatagtcagcatagtcctacgaccacagactgtttacgtaagaagtggtgaggatgatacatagtacgactgaaattgcatatcgagatattatttatgagaatattcaaattatatatatttatcctcatttttgtattgtttggttattatatttatgttttatttgagatgctcntctttcgagcgcgagcttcagcatctggtgtatatgcgctctaggagagaactcctatnccgatactaacatctccgtgtatttccactatatttcatgtctatctcctgtaatctctcaatnagatcacggttcgctagtaaacgtagatcgtaatcgctctcnaccacaatgctctagacnacatcacgtctttcatagccacaaggtaccctcaccagtccttctctacgtgttcccgttattccaatgccatcttatctatcccttaagtctctagatcataacatcataaatcccacagt

SEQ ID NO: 14122 - DNA, 1481 bp, Homo sapiens
  misc_feature (1)...(1481): n = A,T,C or G
gtttcccggcctcttgtcgtgttgcgtttaacttttttatacttttttgttccgtagacttccaccttttttttgcggcgcccgcaccgatgtggttttggacttgcagtttgacttgcgatggattgtatgagcagtgacgggcgccccgcatgcataacgagtgaggggcgggaaacatgaggggatttgttggttgtgctagataagttttttagtagatcctctgcttctcttgcgttcgttcgcgcctgtgaacaaacacaccaactcggaatggaagacattgaaagggagtgagagagggaggaagaatattactattatccaacgtcccttcccccccgccccgccctgtgttttgttaccgtgcgcggccgagccgagccttactcgccaccgcctattattattaacgggtagtgtcgatgcactagggcgctatcttgtctcactcctcaccgtgaagtgggttggtccttgtcctcctcgtcccacctctctacccgcccggcactatccattcaccacatacacataccccccactctaacaccactattatcccacacaccgtccatcaatcccttacatcgtcccaattatatacactcacgccgnattaccatctcataccatattcacactagatatttgaccattttctcaccgctcattctttcttcgtgccttacctgctacacgttaacaactagtaatcgctatctccccgatatcgagtgtnatataagcttgacagacnagacaccaatagacccggctcccggcgatgtctattccatttgccattgatacctctgtgcctatcttctaccgcttcttacctatgcagtccgtcgcgtctctatcttacttatcgcgctcacatcaacggccacgattcgattttaaatattagatagtcgattatgaactaagtatgcgcgagatcatccgatgtgcgcgcagtcgattgcgcgtatttttttgtttccgcctcctctcgcgtccggtggttagtttgaatgctcagcgtgtcgcgtcatatacacacatccttcgtatgtttgtggcgggtctctagacttacttcttgctaggtccgcgtcgtccggcgctgctgttatcttactgcgacgaaccaanattaatttacacacagcagctantttgaagttctgtgtatgattatccatcctctcttacactgcatatatatttataaagtatgtgtacgacacgacacgtgatttatgctgcgtgcgccgagtagtaatattaccgacccgcgtctcgtcgtgtaggagatcgactttatttgactctcgcgtttcgatgagagtccggcctcctgtgcgcactcctcactctcntgatacagattcatagtacgcacgtgctacgaataactctacttcggaanctgcttaacttgtgtatanttatcataacattattgtacagaacacgcgcgcaccacg

SEQ ID NO: 14123 - DNA, 1376 bp, Homo sapiens
  misc_feature (1)...(1376): n = A,T,C or G
acccctcattcacatctctttttatgtaaccgcgctagacagttcttaaatacagttcagttaaaatcactcggccgaccacgncgtgtgcatattcanaagtaagcattggtgtacacttatataagcaagtatagttgtagtatcgctatagtcatctcagcgtgcgcacatcgatagtacncatgcagtcacatggctataatagtgtatatcgctnctagagtatcgtacatagtcgtcangtactactcctcagaagaattagtacgcgttatagcttccgcnatggcgaatagagttacgtatctcaccaatagttactcgaagctatgcatacagatacagtacctatccgaggtagtacataatcgtagcgtacagcatagaatatctcaatctcgcgccaactactaaatagacattcctatgatattcgtatcaacacgaactgacgatcccgtatcatcctcttgcaattctcttgcttctatgttagatgctatccacccacacgttcgtaatttcgtcgtctatagtactttgactactcatgtgcagacgctcaaccacaacatcaactcgactcatatattataatctcgatngaggagcaacaaccacgcagatccatacggatctcctgagttctcgcggaccataggtgtcacactgttagtttgtaatcattccatctctgtaatcgctngactcatctaccaccaattatcgctcgatctatcacactactattaccacatctcacacactttcaactcacttatacantatcacgatatcaatatacaagagaattgattataatattgtagtgtgtaaattatcagtattagatattagaacacactggactctacactcgtccactcncatatatgatacataataanactaattagcgacgacttaagcactacgncatacctatgctcttcancgcgcgacgcgcggcaagtacgtctctatcatataattgnctgcgcttctgtattnacgcacatgcactcacccntccagangtctcatcgnattaccatctgtgatccgcaccgatactgagtagttaatagtaaatgtgtgacagcctagacgaccttcagacgttctagatctacatcttatataaatccaccgactcacantcgtctctcgtcacctatgtacantacatacatcaaccactatgcattccgacatcattttagtgctcctaccacgaccagttgcgtccagaaatttataccataccatacacatactaccaccttnacactatagtatagatgatggactcattactaacaatgctgatatagttagatatattcatatacagtcatgcatcaatatattat

SEQ ID NO: 14124 - DNA, 378 bp, Homo sapiens
tgtgaggcactcaccacgaaatttaggacctcaagcagtcctgtggagggatccacctgggaaggaattaagcctcctgccaatggccagcaccacgttccagctgtgtgagcgagtcaccttggaagcaggtcctccaacccacagagcctttggatgactgcagccccaaccaacaggtcagaagactgcaacccaatgagagtcctgggccaggaccaccaattctctcccaaattcctgacccactaatattgtgagagaacatggtgttttattttattatgtttattattgtttattattattgtaggccaccaaagtttgaggtatttgttaggtgaaaataaatatctgataccaagaaaaaaaaaaaaa

SEQ ID NO: 14125 - DNA, 330 bp, Homo sapiens
ctacacgtgacctctggctggtttccaactcctgaccttaggtgatccgcgtcggcctcccaaagttctttgatgacaggcgtgagccaccgcacccagccaggcagactgatttcaattcttttggttatacacccagtagagagatggcgggatcacatggtagtcctctttttaatttttttgagaaaacttcatactgttttctataatggctgtactaatttacatttccattagcagtgtgccagggttcccttttccccacatcctcaccaacacttgttttcttttgtcttaataaaagccattttgacaaaaaaaaaaaaa

SEQ ID NO: 14126 - DNA, 1198 bp, Homo sapiens
  misc_feature (1)...(1198): n = A,T,C or G
acagacacgacaaatacnacatcaggaacgaaagaacaacccgtccaaccacacaaaccaanangagaacgaaanccgtcnatanagnangnacnaccgcacacaccacgcctttaggagagangnagncaacanannancnncagacacacacaaaccnnnaaaaaccaagannaacactttgttctaaggngnaanacgagaacaaagaccacagcacaacaacgcaccgcgcgaggaacagcaaccaacacggacaccaagcaccagacaccgcaaccacaacccgcaacggcnacaaccggggaaccaaagcgagagacgcgcacacgaccaaagnacagacagaaacgccgcancccaacaagaagcccaaacaaccgcacaaaccaccaagccgaacacaagcaacgcaatttctttgtctattacatcgaggcaatcaagcacaactagacagcaaacttttgcatctccacaaatcctaaacacagcgcatcaaccttgctaatagaggagccactaccaccaactgtagcgaacacatcttctctcatgaacttataaaggatacgccaaaacaaggaaatcccaatcacactttcaactgaacacaacactgaataaatccagtcaccacaacttaaaagcattccaagacacacacaacaacgccctcaccaccacacataaggacagagctcgtatatcaaagaaagacgatgaagcaaacaacatgattatacatacaaaagccccctgatagataggtagacttatgatgaaaggatgaaaatacacctctacacgccgcctgaaaacacctaacattgtcactaacatattaatataacccatgacttcagaatggtacttagcgcaccccacgttccgctatgacgctcgcaaaaagcacccacaccacgttagtgggcaataagtaacgtacggcaagcatgctatcaaccacattccaacacacgcaccatacacgtacgcncaccacacacagtcatctctcctccggcacgccgcacacacacactaaaaccaaaatgaccggcgcgcaccaaccaacaacgttccatacgcacaatgacgaacaccacaccaacacgcactagcacactgtcccacggacacactacaccgcactggcacaccgcancatctaacacgacgccacgaccgacattac

SEQ ID NO: 14127 - DNA, 740 bp, Homo sapiens
gtttggtgacaactgccacccttatatattgaagcgattcataattttttttttttcccggaacaggtttaagttctgtggctttcagatgccaatgttcctgtttcacacagaacattcggtccaggggatactttatgggacagaacagatagttgaaagctgattttacttgctatatctcccttgttattcgggcattaaggttgcattagaaggatgcaaagatgtttgatgaaagtgatctgtgctggggttggtgctctgcaaatgctttaaaggtgtggcacatgacattgagccagtgcatccaggtggagcctgggacagacataaaaccctaggttggtaaacacctgtcacaggaagcctcatcaaggaattcttggggagtggaacagtggagcaccctgcaatcctcacaggcagcagccatagtaagcaatgttcagcatttgctgtgcctcagagacacacacagcataaccctacttcagcagctcactgcagaaaatgaaccatatcccaccaaacgagcagtcaagtgcttgctaaaggacgttcccaaagagtattgttctgagcccaaggtgtgggctgttgggttcaggtgtgagaaacagacagaggcagggcaaggctgttggtatatactgttccaggaacaaagctttcccaatttaaggcactttatattgcagccaataaactcttttagtagcaaaaaaaaaaaaaaaaaa

SEQ ID NO: 14128 - DNA, 1770 bp, Homo sapiens
  misc_feature (1)...(1770): n = A,T,C or G
gccgatccacggtgtgctcgcgcgcagcactcgtaaaaaaaaagaatcgtcgacggacgagagacgattgattttatgttcatttcccttcaattctcgattgatgccccctctgctactgttaactaatctaaaccaccgaatgcgccgtccttcataccacagccagcacacatgctctacatcgcgccgaatacacttcagacaacgacgagaacgagacatacatcacacacagcgacgagatgatgacgacatagcgacncgacactnatctcagaagggagcagctgagtcgcgntgtttncgttgtcatacagtgcgatcggattgatgacgcgacgcgtaacgcgccagtcgtacgcctcgcactccacgtcacgtctatagtattgtcactacgcgcatagtcgtcacaacatagctcgagtggncgagtcgtgagtcgngtgcgcataaagtgagtcgatgtgatatacgcactggccactgacagtctacgtatccgtgctccagtgacaggacgnccatatatctctgatagtaggactctacantcgtagacntagacantatgatggcacgcactaccagagtagtgagcgagtntgcggcagagtggtcgcgctccgtgtacacgnacgcggtgcgacgagaccactntacgcgtgatgtgtnagcatagttcgtncatgatcctaagatagtttaagtctctgnatgtgcttgctncgagtagtaccanagacgacgacgcagtacagatctattatgtgcggatnagatctgtgattagtcgcgtgtgttagtgactgtctacttatttntccgcgcgcgagtatacagcccgagtgcaatatctaagtagtagtcgccagacncgcgcggcgtacacagactagcgtgacggcatacncaggggngtagtaaanactnacgcnanagtctagaacgcgcatcgcgcgccagctcatacgcgcgtntantntgtgaccntagtngcgcgcgcagatctctgatgtctagcntacgctcttagcgtcagttagtcgagcgaatgntctgctacagagncgatgncgctgtactcgcttcactgtgcgcgtcgcgacgctgcacatcagtgtgcatctntatcgtgtcagccactactatcctcagtaaanacatcacacgagtcgttccaccgcacaatcatctgatcgcgagcgtggtacgcgcgacgncngcgctggtgtgtgaatcgcgcacnanctgcatatggaantctangcatgcanaccactcgtgtgaaccactcctagcgangcancagaggtaacgtgcagncncacggtggcgagactatacacagactagtancgcgagagnagattcgagttttgatctgtgtagcntcgacgagntcggtcttctccnagacgtagcgacatatacgagtcggtgatcgcgtgntcntgctgantnagntcactgtagcagcgcnntcgcatggagactagngngagcatcgagtacgtancatcgacgcaacngttcgtcgcatntgctgagacancagatgcccgtnatgagctacgtgtntgctgtcncggcgctcgcggcancgaganagcnanacatgattgatgancagctgtgacantgacgctncggtatgtgngnagcagcagtgtcggcagtcagacgtcgcngatacangctagtgatacttctctatctggtcgtgcgagtatatcgacncgcgcgttgcaggacgtacgtcgtctg

SEQ ID NO: 14129 - DNA, 241 bp, Homo sapiens
aactgataagtaactttagatttcctattttttgtttcaactttatttcacgaacacgcagcagtaacccgacgtgtctgtgaagaagcagagcgcctgcgcctctggaaacacaccatcatctgcctctctccaaaggacgggggagacgcctcatgtgagatggaaattaagcctcagaagcagtcatttttctttatattgtttaggaattaaaaacatattaaattgatccattatg

SEQ ID NO: 14130 - DNA, 861 bp, Homo sapiens
ccattatcaccatcctaacccaaattaattttacagggccagagttaactttctgagctgcccctttacaaggagtctccagtggtacagcggattttcctccatcctccactccccctcctggctgcagcatccacagattattttcttgaatctgaccccagttgtttattaatataccccttttcatgacacgggaaggctaagatgaagctgtctgggatggaaaagaatcccctcctctcacatagaataaagatcttgaaaagtaaaaaaaatataacaaaaataaaaaaagattgagaacgctggagaagtaaaggaggtaacggaccgagattgtttaaaaaacggaaaaatatatggcctcatggggacctaatcggggaaattttgggggccgatgcatttatgtgggggataagttcagtttcctattttattcgcattctttaaacttagacccttatcccttgcacgagccggtctactatcttagttaaggggagacaatgagggatctccactctatatttgcgttatctccgtaactatacccttgtgttcaacgaggccttattatgttttgaacatctatacgggcctactctgttgctgcgtttcttttgattactgacttatgtagaggattggagaattacgcgcttattatagtatgtggtacaacccaactagaattattaaaatacttaagctatcctcgcatcaatatcgctcgcccgccgggtcctttctagatcattagtcttttcaattattttcgtcattttttcccttgcgcttatggggtattctactactcccactcccgttacgttactagatagtttgtattttatt

SEQ ID NO: 14131 - DNA, 863 bp, Homo sapiens
  misc_feature (1)...(863): n = A,T,C or G
aaatacgatttatatatattcttatatcgatcaactaatctttcacttacgaaactgagtgatggagtgtggcttctgaagctaggatagttcctgctctcttggatcactcattccatggaaagctggcagccatgatgtgaggacactcaaacagccctgtggagaggccctgatggtgagaaatggaggcctcctgcctgcggccacgtgggtgactcatcttggaagcagaccctccagcccctatcaagctttctgatgactgcagatctgggcaacatcctgactgcaaccacatgagccatcctgggacagatgtacccaaaccaagccacttccaaattcctgacccatggaaactgggtgggataatacatatggatcgtgatttggacattaaattaggtaattatttaatgcaggaaatatttttgtcacagagtccgcctacgttaccaactctttatcggatgggccttctgtgcccttttggttggagtttttcagagccctttccttttaagagaggggcgtaatatagaatcctgcgcaactggtcttatttggcgctgcgataacccggtcgtggcgaagcagtatcatcctccttataatgaccgctaaccgtgcgtcctcccaataatacggggaataccccccgcacacatgctttcgtatataagtggattggtcgncgcgccataaagccntaataaaatgtcctgctacgatcggatattatcactatattcctccagccctccttaagtagtacctaattaactacatccccctgagttataaggggagcggttctcacaccagactctttgatatcctcggtatttgcttatgttatg

SEQ ID NO: 14132 - DNA, 366 bp, Homo sapiens
atagatcccttttaacgtttatatatttaatatgtagtattttcgttaatattttcttagggaaaccacccctggcttccacacgaaggccatccagagcatcgcttcctgcaaccccgacctccagaaggttctctttggccacatgctactgtccggagggacgggctcctgccccggcttgcgattccggatgcagagagaaatatctgagctggtgtcccctacagtttatgtgaagctttctggacgactccaggctcttgtgtgtaatgaactttgactgaatcagaacagaaggctactgcttagcccagcatggaaaacaaattaaaattgaatatcatactttcaaaaaaaaaaaaa

SEQ ID NO: 14133 - DNA, 935 bp, Homo sapiens
  misc_feature (1)...(935): n = A,T,C or G
aacaaccatcgtcgtatacaacaatcaacccacaaaaaaagaaattttangggnaaaccncgcaaccnnctcnaaagagancacgccgagaangcgctacnacactccagccagggctanagagcgaggccaaaccccaaaaaaaaagcgcaacaagcagaggaccgctccgagaccgcccaccacaagcgcaccgcccaaaccaggacaaggcacgccgcccccccaagcccatnccaaacaccagggcagcgggagcagccgcaaaattttttatgcacaggtcaaagcttgaggctcttgcctttaaaatgcataacctgcgcaaacacatcatagcacaagtctgcacaaccagttagttcccttggaggcccccccttccaggcccagcaagtgaccagggtctcacccagccatctgttttgcccaaacgctgggaccctcaaccttcgaagacgatgcctcaacgtaactcattcattggaccacccatttcccttgctggcaaggaaaccggctttaacttaccaaaacacacttcttttacctgtctgcttgtgttttgaagtctgtccaagctcatccatgcctccgcaaataaatcgtgaaatcgccccttatcaaaacatcaccactctatactnaatttcaattatattgcgtcgaaaagaacgctacattcgttcattagatccacctccagaccaccccccctcgtcactgtccttaccactcgcacttcacactgagcagctantctgcacccctctaactcgtccttccactctctccttcttcccccaccatcaaacatatcgcaccccactgctcattcccgccatcttcacaacacctcacccactcactctattatacaatatattcttnacttcctgtcctctgtcgttacggccttacctcccctccttgta

SEQ ID NO: 14134 - DNA, 1825 bp, Homo sapiens
  misc_feature (1)...(1825): n = A,T,C or G
gagggaggagaganaggagtaagagagggaaaanagnnanngagaagngnnggaggnntagangaaggcgagncaagcgaggggnagagcgnaggnngnangnnnnaataantggnaagggnaantaagngacgnaganatgcgnatatttaancaggatcnannaaacacanggacagnccanatcntcgtaccgttttccattgcttgcagcagcactatcaacaatagnannaganagagactgtgaccagcaggtaaacgaaccagacanactgagacgctctgaaagcgtggattagttagtatnacgnannacgacgcagncgcgaacgataagtacagttgtgccagnctgcctcacaccnacgtctntagtgtntctagcatgtatatcacacncagcctacaactacgtgtgatacagatgtagaatnaagatagtagtagnatatttgagtgctncgcggangtgagantgtagagnatnatanagggtagcgctccacagacgccngcccngaacggcagcctntcactacattatacaagcacgtctacagtcagacgtgcagctgacacaccgagncnagactnatacctancatcagaagtcngnancnaccagctaggcgacagcgccagctcnactcatggtganacagnccncacgncagcaggtnatatgnagataagtagtannagtcgngcagtagntactngnactagtcncgctgtataaatgtcntacgagtgcatatgagagagtcacatacacgcaacttcacggctacgcnacagcaggncgacatggtncggatgagtcacagatatagcagactgaagancggagaactcatagcgagtacacaanagagaagcacagcacagcgagcagaagccgagccgggcgcgccgacgcntgaaggcggaagtatacaggtgnaagacacacactgacgagcctaaagaatnntgatagatatatagatgagtatgtccgaggaccgaacgagtgtctctgtcttctgctcagctaccgcatncgcgcctacacaaccgcccgcaccccccgtacgaggcatccacgacccggccgcgccgcgcgcagctagcgcgacagttcggactcggaactaaacagcgtgaagacagtcgaagcagatgctggagagcatgcgacctcanagagagaactggacggtagagactcgcngtgaagtgtgggcaatagaggccggatgtcngagagcgactaggacgaggcagcacagagttaagtacatacgacgagagctcagcagcacggcacagaccgatgcgacgggctaggccgcaccgcanctagagtagtgcgcagagagcggagcgatgcgcgagcaccacagcgtgggaagcaatgcgaggctgttctacatatatagctagnatntatntcagcgtcgtgcagatcgtcgatgcacagtcgacagatacgacactcacaatggtagaactacgagttctcgcatgcaagcgnanttagtntgcagactgtcagacagcatncacatcgacggcgtacaacagttgngtagtnagcgactagatctctagggcatgtacaactcagcgagacgcncgcgcggaggcagacacgcagtatgcgacgccgactctacagatcgcacggctcgagagcagcgccgcacgtacgtcctatagcagtctcgcagngagacgcgtgacacagctactatatagctgcaccgtgagcgtcgagccaagcanaactgacgatcatgacatgacaatcaggtagagtgccgcacggagctcgagacat

SEQ ID NO: 14135 - DNA, 776 bp, Homo sapiens
  misc_feature (1)...(776): n = A,T,C or G
tgatattgcgtgtataaatattaattattgtgagtcgctaatgggttgacatagaacggagaaattatagctacattaatagtatatatgggataagctttaatcaacgaaagatgtagagtcttcattgtagaaagttgcagatccttatgctagggtaaaatcatgagtaagtgaaaatggtctactagtactcaggattatgacgtaagtttagatgttcgtgggtgaagaaacccatatataatgagtcgaatgatcgagtggcgatgtgaatataacaagaaaaaagacggtacgggaagtcagtttaagtggggatgcgacaactctttcctgcggaatgtccattttagtaacatgcagcggagtatggcgaggtgatattctggtaggtattaatagagcaaaaaaggactaaatcaataaagatacaaaaaatcccgtnttgtcttttaccatcttatccaaatccactggtaacttgtcatcaggtaatgcatatagttggtggtagcagaaatattccatggttttattaatatgattccatataggctcacggatacttgaagtcggaggaaaaccctttgacgtttcagggccatatatcagttccctagcagtgaagcccacgacaatcaagaatttttgacatgacatgggaaaaggtgaaggagtcagtctatggggtgtgttttcatctaggaggtggcttgagatggattcaaggcaaatcacaatatattatttttcagataaaaaaaaaaaaaaaa

SEQ ID NO: 14136 - DNA, 635 bp, Homo sapiens
ccttgggcaatcaaatcggaattgtttgcctgcgacacacatgggggcgttgccacaggatgaaagatgttactcaatttagcctgacgaccacttcaaagtcaagaggaagaacagatgggttggcattggaaaattctcctacttgcttaaataaaaataactcataaaatactaaagatggaaaattgacttaaaaattaagcaaatacaattcaattttttgtttctattgggttttttagacaataaagttgtgtctgatctaagatcaatcaaaaagtatttgctgagggcctaatatctatgttatgagctatgtaatacaaaattaatgagtgttaaagatgtggactgcttctgaagagagtatgtataatcacctggacaagctacactcacatgtgtgtatgtgtatatatgttgtgtgtatacatgtaaaaatatgtgtatatctatctatatatctataaaattgtattagcagcagattttgtactggaattatatgtatatcacatgcagataaaactaaatgttaaattgtgaggttccatcatgaaaagaactataatctgtgcaatatgccatgcagatattgaaaataaatttttaaaaggagaaaaaaaaaaaaa

SEQ ID NO: 14137 - DNA, 336 bp, Homo sapiens
tattgaaattggcatctttgggagctcgctgtcatctcttcacaaaacatccccacggaaagccaaactttcccttagcaagcgtggcaacgtcccagagtgcagcctggatcccgtcaaggatatcacatgatacttcaaagtcatgtttccttaggctcatcttgactgtccatttctcagaccttccttgattttggtgaccttgacaatgttgaggaacagtggtcagaagtcaccatgtgcagcctacatttaatgagtggagagttatgccccgcctcctggaggatgaactatctacataaattatttgaaattcaaaaaaaaaaaaaa

SEQ ID NO: 14138 - DNA, 894 bp, Homo sapiens
  misc_feature (1)...(894): n = A,T,C or G
gttgtggggtatagtcaccctcgcagtgccgccgacggctcctcnccactgttctgaacacttcatgcctcatgatggttagaagatggctcacagaatgacgatcgggctggcccacctcgctttgctagtgaagagaggcgagaaattgctgaagtaaattaaaaactcaaacagaagaattaacagctgtaacaaattatggatcaatcaacaaaatctacatccggcatatcaaatgccatgttgcctatgacgaactaagctcgaacctaaacttcctgctttacacacgttattaccattgttctttccctccagaattttttccctgcgaagaacatgatttatctgcttttatcgttcacactaaaactaaagttgccatcttccacattgtcgcaccttacatcaagccatctaacttctcccacacgcactcctagaaggattattgccacaacctcttcatagggccaagcattccaggtcaaccctcctcgactcccactaatcgtcttctaacccacactnaagagtccttcgaccccatcctcaaacaaacaaataacctatattcctcccctctcattctctctcctcacaaatatgtcttatttacatgtttcatcttttnnttctttctgctccggatccccttcccaccccctcatcatccctatctcctctttcccctcctcaatccctcctccaactcgcacctctacccgcctctctaacacagcccctcctcacaccgcgcaacaccactctctttcagcccccctcacacgatgattancagtgcgaacgttggcgcaactctcccacacatactccccctccgctccccgcgnnacgggctgttttacttgttctgtggtcgctattgtg

SEQ ID NO: 14139 - DNA, 772 bp, Homo sapiens
ctgatactattcgaatcactacactccaatgatcaaacatgaggactgaatacctggataacaaagaatgataaataacaaagtaagaaggggtagattaaaatatatataaaatcgagccgatatatacgataggcctctacatattaatgggagcgaaatgtgtctatagagcaaaacagtgacctaataaaactggatgaaatggtaggtaactaatgggagtggggaggattagagcgtcaaacaattttctcataggtcgagattggaggtgggaacgtgctggatgtcgctgagacgatagaagcgtctaacagcggggaggtcgatagtgcactaaagtcgcagatttgtggctggtcaaaaagggagagaaagaaacaaatataacgccgggaaaatgatgaaaagaataccaaaggaaaaaaactacggaggtaaagccagtactttttttgtcaatagaggcttcgaacaataatgtgttaggcaacaacatcatatttccacacaatatttcaaccaagtttaatagaaaatgggccaaccatatgcagaaaagagaggagctcccttctcaaccgaacacggaacactccttgggacgacctgcccagcagagaggagctaccctccctgatgagagctgaacactcatcgggacaccctggctatgcagaggagctgcacactccaggtctactgtgagctgttctattgttcagtaaagctcctattcgtcttgctcacgcaaaaaaaaaaaaaaaaa

SEQ ID NO: 14140 - DNA, 784 bp, Homo sapiens
cttagagatcacgaaaacaaaaactaggccacagacacgagtgagaacatgcagacaggaaagcatgattttcagaaatggagagacttcgacctgggaatcctggggctgtgtggaagctgagtgggcactgtcttagtgctcctgacactgaagaggaaggaccaccaaatgatggtcatccacccatcctccattaatcttccagtctgaagcgatgctcatctctgccttgagcttctgctcaactcccatgcatctgtgcgtggacactgtctacctcttacccttggcaatccactgttgcattcccatttattgatgaaggagtgaaggtttcgagagggtgagcaatttgcctacaatttacccccaggcttgcaacgagaactaaggacatgtgagttcctgctgagcactctttccagaaccccatcatattgcctaaaacttgatttgtggatcacagtgtttgaagctgacagttttgtttctcattgctctatgggcaattactccttcctgtgacaagaaataaagaggatagtgacaagctcctgaggttgtgccattttcaacctggtgctctgctcctgcagcgagagacaggggtatttctggtgaaatccttggtgaaaatacactaattaattttccttacaaatgatttcaaatatgtaattatgaaatcaactcttccctaaacaacctgaccttgacataaatgatgggtgccgtaatattttaaataaagtttgatcagcctccattaaaaaaaaaaaaa

SEQ ID NO: 14141 - DNA, 862 bp, Homo sapiens
  misc_feature (1)...(862): n = A,T,C or G
gggtaaagggtacgtagcaagtcaccacgcaagagactggcnccgacgtttagggcaaaaacttcttaaactctctgttgatgcattcagatggngatttggttcaaggttggacacatgaactagaccttatcaattagaacattgcaacctcttgctgtctgtgattggctctggatggatacgtgattcacacttggccaattaaaaccacggaaattcaattctagggcttcaattgtaaatactaggagaaaaaactttcattcgaatgtggaactaggaggatgcaagcctagagctgctacaggccaccttgctatccaaggggatccccctccctgagagtgacattaataaagaaaagcagagtcgagagaggtaaagtctggttgacctcatttgaaccacagaagtctgacatgactgtaggcagctctattttgggaccctttctgattcataagtctatgaattctttctgttcgattgttcacatttaagacagttggcttcttaatacttcaagaatcctaactaacgggctggcaatttgcacaaagagtattacctcctttgggagaactatcaactttctggttatctttanactccaaatagcgcttaagtgaacattcctgaaaaattaactctctaaaactacctttcagtaaacgaatgacaataaacaaacaaaacctcaaaaaaaaaaagaaatcgcccttgtctggcctaaccggtggtacttcggccggccgttccctttcccggaaggtcatattcatgacactcactcactgacttcgttgcgctggggcgtctcnccctgccaagcggttttagttcactttaacccttaatt

SEQ ID NO: 14142 - DNA, 338 bp, Homo sapiens
ataacttctcagccgggcgcaatgactcactcctgtgataccagcagtttggaggccgaggcaggtggctcacctgaggccaggagtttgagaccagtctaaccaacgtggagaaacctcatctctactagaaaatacaaaattagccaggcatggtggtgcatgcctgtaatcccagctactcgggaggctgaggtgggagaatcgcttgaacctgggaggcagaggttgcggttagccgagattgcaccattgcactccagcctgggcaacagagtgagactccctctctaaaaaaaataaataaatagaataaaaagataaaaaaaaaaaaaaaa

SEQ ID NO: 14143 - DNA, 863 bp, Homo sapiens
  misc_feature (1)...(863): n = A,T,C or G
tcgcgaggttgagcntaataagaagttttacacggaaagccaaactcagcaaagcactttgctacctacactcgggagacaaggctatcaaatagaagcgggtgaagaagctgagaaaacagaagagaaggatggctgccagctcgggactcaaaatggccatctgggcgtagagacacagagaccctttgcgcagacgtgcgccgagggtcttgcaaagctttcgttttctttgtgtgccgacctgcccctagaagcggctgtcgatgctattttaaatgatattcctaaaatttccgaattgcttgttgcttatatatagaaatacactggatctttgtatactgacttgggactcggctccatgctaaactttgaattaattctaatggctcatgtgtagttagctagtcgttttctatacacaatgccgccatcagccaataatgacagtttcgccgccttttcatctttggaacatttatttctttcccctgccttattgcatggcccctgctacagcctctagaccaatgttaaacagaattacctataagggacctcttatttagttcctggatccactaagatattcattcttgttctcctaagaaacagaactataaacgcataacatcactaaaaatcctctgtccaattaaccagctatgtanattcaataaaaaaaaaatcggctcagaagtctgctctgtcgtctttctacaactcgcaatctgccctaatttatagtatatggtatctgccagggncgaagccgaactaaagaaagaatcaacgagatgttcccaccgaagatcacaagtgtcctgcatgtgtgtaaggaaggaatatagcaaatagag

SEQ ID NO: 14144 - DNA, 750 bp, Homo sapiens
atcatttttatgatcatcattcagttcaaaccccttgaaaatttcggcttctccaaaaaatggtggtgtacaaactggggttgggccctggattccccaagtacagattataatccataattgtaaacaatgattatgactttacccaaaaatatcatctctcctctatttttacaagttgtgccccattattttagctctgttaccatcttttggtgatactattgcaaagaataaagaacttagatgcttatcaaacttggtacagaaattcacaattaacaaatatagcatgttccattataaggttttaggcagaaaattgctaaatcaacaataaagatctaccaaatgtcacaatatttaatttgaaatcttaaaatgagagtagcagaaactgcttctcctccttcaaattatttctataatatctggtgtctggagtattgaaaaccattttacctggctatccacagtcttctcaggagtgtcaagagtacctgaaacttttttcttcttcttacgtaaaaccttaaaataaattttaaaacacatcaatttgaatattgatcagctacagtagtcttgaatatgttttcctacttatccttctctaatatcttgcatgtaaaatgataaaaaaaattttacctggccttttgtagacgtctgacgattagtttttgaaatactttccgttttctgtaaaatctttaataaagaagttagaaattgaaaaaaaaaaaaaaa

SEQ ID NO: 14145 - DNA, 764 bp, Homo sapiens
gtgccttttgctttggagaaattcaagccattggaaaagttgaaagacaagctgatgatcatcaagatcctgttaactagattccccagtttacattttaactttttccacatttgtcctatccttgtagatggatagatagatagatgatagacagataggtagatagataatagacatttttctgtacaatttgaaagtaaggtgcagagtttttgatatttcctcaaatatctcagtttgcacctcctgaaaaaacaaagtttttctccttcatagccatggtaccattatcacactaagacaatggacttaattcttacattaattatttaataattatcttactaatcacgagggcaaaactgttctgtggttcaacaccttaaccaaatgatctaatttaatatcaccagtagtgggacagtctgtcattatgtgccttctgatgtgatgcagtaagaaatacatatcacctacatagtgtctgtgccaaggtgtttaacctgaatttgatcatttaaaaaaatcagatgaattcaatacacaggacatgctacaagccagctggcctgaactcttcaaaagaaggcagtcacatgagttcacaaaatggagagggtgagcagtttctaattattagaggccaaaaagacagaatagccaaatgcaatgagtaaaatttattaaacacagattataagggagaaagactacttgggggggcaattgggtacattttatatagactatatgacatattg

SEQ ID NO: 14146 - DNA, 320 bp, Homo sapiens
  misc_feature (1)...(320): n = A,T,C or G
ctgnttggcccctgctttattaaaaatgttcctgaaggtccggcagggtagctcacgcctgtaattccagcactttcggaggccgaggaggaaggatcgcttaagcccaggatcgcttgttgcccagcctgggcaacaaagtaaggcggcccacacccgtcccccgcccctgcccgtctcttaaaaaaaaaaatttaatactaatgtaacggagttcataccttaaagattttttatccttaaagttcaaacatatggcaaattcatgttactccaagtatactgcaaaataaacagcactctaaataaaaaaaaaaaaa

SEQ ID NO: 14147 - DNA, 1131 bp, Homo sapiens
  misc_feature (1)...(1131): n = A,T,C or G
cccgnaattttcttgagnactttacgntaagactacgtcacttcgtaanaanananannnnancnannnncactganagnnangangaaagaaaggnggngcgcaatgaggagncctgcnancagngnagaaagcgcggaagaagggcggcggaggntactcangagcgagcatacnacgcgcatgtaggcattgcacatggctatcgagtggcgcggctggctaaccactaaagcagtctggtagcacgcatacacatgatatcagtctatccattaacgcgtgtgcgggagaacacccggcactcgacctagatggtcagcgaacaacctaagcaaatctcgcgcaccctttctttttttctcaccatggngggcgtgacgggaggagaccacangacgnacacagcgaggcgcanatggtcagcacgataaaaatcacctaccggaccttcatgttactcatgatagccactctctaagtagggtataacaaccctcatagacgcanacacttcaattcatagcgaacagaaacaagtcgttgtgttcaaccatgcaactcttcgttagagcctataggatccacgcaacggagaaccagattctgtgacacatcaacatcttagccactacaaccattgcgcatctttaggcgtagctaacgctatatctaagaaacccagtagccgatgccctcccctagccacacgcctatgacatcaacctcacatccttccacgaaagaagaagccagcaggccgccgctaacccagaaaccggggagtaagtatagatgactgcaatcccatgccatagtggacaacccgggcgtagaacttcgggaaacctatcaagaatatactaaacctcctgcgcacaaacaaaaaaaaaacaataaatgcaccttcagctggcgcataagtggggaagagtcttcggcgagcgcatttccctctatatagtgggggaaaactgtcgatgaccctcccatatactagccttcacagcgccgctatatactacgtggtgcgtgctcgcccccccacattctctcacaatggggtgtcaacccttatgttaccaatgtcgaccgggtgtattcctcagggaaatcatctctgtagtacaa

SEQ ID NO: 14148 - DNA, 631 bp, Homo sapiens
tttcttaaggtacttgattgggggagagctgcagtcttctcattgccacaactgccacctgaagatgtagcaagaaaaaggatgcctttctcctcttctgccttctgaggatggaaggaaagttaattaatacagctcttggggctgcattggaatgagactgccatcagaaagcctgaacctactgcagttttgattcctgacatcggaacttgttactctacagtctttattgtgctggcaaaaggagattaattcacaggatgaaaagaaaccatattaatgaaagggacaatataaatttgtattcagcaaggcaaatcagcagtgctctgcaactacaggagcaggaggcaaagaatggcatgttaaattactcctgtcttgggctgtcaatttaaaacaccttttgtgcattcttttctttgaccgaatacatgtgcatttcacacacagtgtgaaggcaatacatgctaacctgcagcaccagcccctcccccaatataaagagttcagtagcaaaggcttgtaagtttaactagagaaatcgcttttattggaagcatttttcatgtataaatgtaaggtagttattaatgtaaaaaaaaaaaaagaaaaaaaaaaaaaaaaa

SEQ ID NO: 14149 - DNA, 798 bp, Homo sapiens
  misc_feature (1)...(798): n = A,T,C or G
atgctggggggtgaaagatgcccttcagtgtcccaaatgagaggagagaattttaattgggagtggccaaggttcacaatttcagcctggaggaaagtaaattaaagagggaaatttggatacacaaagagatgccagggattaacctacccagaggaaaggccacgtgaggacacagcaagaaggtggccgtctgcaagccgagagaggcctcagaagaagccaaacctgctgataccttggacttcccagcctccagatttgtgagaaataaactactgttgttttaagtcacccagtctatgatattttgttataacagccctagcaaactaatactaggatattcatcattctatgtttttgtgcattgaaatgcataaatatttcagcctcaatattttcacagatgctgccttttttgttttcattcagagtagctttcttcaacanatatttcataagaacaacttcataatataaattgtctctatttatgattccacataattatgggcttccacaatttcgttntattccagtacagaacatanatttatctaattaaaaataggtgcttcagcanatgacttatccctgcagttgaaatattctannatgcaattacagaatttcaacattaatattggatactatttgagggcttattggttaatttgttcagtactcactgtgcttatgaaaggataaatttcaagtttctctgttgcaaatgatttttccaataaccgattttggtattcattggacaaaactttgattaaacttttataagct

SEQ ID NO: 14150 - DNA, 794 bp, Homo sapiens
gctggtaaaaggagtctctccccatagccgtcacagctggaaaacaccctgggtcacatctgaagccagcacatctgtgagtttcacccaaggtctgcagcgaatacttcctgacttccgctgactattcggtgcccaaggatgctttagtaagcaggttaccactgaccacacagaaatacaaactcagagactactaatatgcacacactgatatgcacctctatgcacacaagctagaaaacctagaagagatggataaatttctggacacacacaccctcctaagactgaactagaaaaaaaattgattccctgagcagaccaataataagctctgaaactgaatcagtaataaatagcctaccaaccaaaaaagcccagaatcagatggattcacagctgaattctaccagatgtacaaagaagagccagtaccattactactgaaactattcaaaaaaaattgaggaggagatactcctccccaactcattccatgaggccagcatcatcttggtaccaaaatctggcagagacacttgatacaaaaatctggcaataaagagaatttcaggccaatacctttgatgaacatcgatgcaaaaatcctgaataaaatacttgcaaactgaatccagcaacacaatgaaaagttaatccaccactatcaaataggctttattcctgagatgcaaggttggttcaacacatgtaaatcaataaatggtatttatcacataaacagaacttaaggcaaaaaccacatgattatctcaacagatgaagaaaaa

SEQ ID NO: 14151 - DNA, 732 bp, Homo sapiens
aggtctgtcaacaactacatgagcctttcaattcctgaaataacaagaagagatgtgtagctgtaaaggagggtcaacctctcctggtcttgaatcccttactcaacttccccaggccctgggtatatggtttctccttagggcagacctataagaaagtcaaaatgggtatttcctgcattgtctctccccacaccttcttctcgggaagatctttagaacacaccaatgcgtactcccatttatttagaattcaaatacaatgtccttccagttcaatcatgtgtaaaatggaggtttcctgactgctttcatcggtgagcaacaacaacaccaacaggaagaacagcagaggccacatcagccacaagccaccctgtcatctaatgaatgccaattaagcgccaaacactaccctaggcattttataaacattaatctgacaaatttctcacaatgatcctatggaataggcattagtactctcatttgttggatgagagatccaagtctgacaaagaaaacaagcagcaacacagctgttctgttttctgaatttatcttttaacttgattctcttatcatctatatggaattgaaagcttcttgagaacttattctattttggactgcttcatagtacctagcacagtaatttatttgggggttttctttacttaattattttaattgacaataaaacactgtatatgttaaaaaaaaaaaaaaaaa

SEQ ID NO: 14152 - DNA, 800 bp, Homo sapiens
  misc_feature (1)...(800): n = A,T,C or G
cctaggaccgaccaaaagagcaaatatacagatatccctggaagccagagttcttggaaggaagaaatacacatacagaatgggagaaggcaaggaaaaaccctgtaaggccttccttcatcccctcaacccttagctttgtggcctctatcttggactgtcaaaggccagtttaaacaatggtcacacagagattcacacttctcgcaagccccaactcaatctcctgccatgtttttcaggaaagcgttaacccagttgtcctgagttgctccaactttgcagttctcaagaaagccctattctgtggtgaggccttaaacagttcttgggaattgagatcttggaatgttctaacttctaggaatgctttaaacacttgggaccttgagccacattatgccaggctttctaaatagtttgtatgaggaatgtgatttatgaacaaactcatttcctttgnggacctggatcttcagcaactgtagccagtcctacggatactatatcccctattgtaccaacccacaatgaaaattgtgaacttataggcttagacaagtctctgtaatagacaaaactttacatgcaccttcacaatttattctttggaagaattaagggcatcttaaggtggattaaggggattttctagggactccactagaagaatatccttaaaggctggtccctgattttctcccaacgtacccatccccttttcttttcactgattttcttgggaacctttctattataaacccaatcttgatttaatgattctaagcccaaagcctgct

SEQ ID NO: 14153 - DNA, 1264 bp, Homo sapiens
  misc_feature (1)...(1264): n = A,T,C or G
cgctctagatatcatgtttacgatatactaatctcgtgtctctcggcaggtagatacgtantagcgtggctcgtgactgcgacgtcgtctgatctatntacgagtcgctggctacgggatacgtaagtgagagcgtcacntgacgccgaggataaggagatactagagacgctatgtactcgctaagatgaagagttggctgcttatacgcagcactagaatacanacgatcacattgatgaattatggtagaantcgattgttagatangaccgtcgggtactactcgntgcgncctacacacatccgacctactttgctcccgcttagctcgcgacttgtggctacgtggagccagcgtagtatatatgtctgtcagttcaacccanttctacctcccaccgtacgttgctgatttaatgtactgcgatcacaatacaggatgagagtcgagtactcgggcggtaaancatcgtcgggacggtgcgaggcagtatccggatcagagggtcacatgaggatagctgggganccgcagcacgcagacgcaggcgtcgtcatagcaacgatcgaaaccaagcgatgctgcatcgatatcagaagtagtataataaatactcacacagttgtgtacttaaagtccaatgtcccgttatatgtgtctnttgcgtgtctagttcccatcatacatcacaaaatagaaataattaggactatttcgagatattacgtgtaacgatcgttcagaagctgaagttccaatttattacgtatgttatcgttcattaatgagacatactcgaggccgttcctcacttacccacacatgtggaggtgctattctatagaaagcaaatgagttcttagttttctatcttatctataatatacccgcgtcgtagttatatgtcgaggtgcacgtgtgttatcctgcttgtcanaatatcacaatctgagttctctgatatctaatgtatatgtatcgcaactagagttcttaccgtagattacgtaattacatagccatagccgaagatagctgtaagttgatgcaacgcacgacgttagtataagaattacaaaagagacatacttttgatctgtctcattcgcgtagaaaagagaaagagagagaaaagtgtgccatcgttggcaaaagcattcgtgggcagatgtcttccgtccaaaggtgttcctctngtctttttcgcaaaatatatatcctaataataaatatatanaaanaaaagtttctccttccacc

SEQ ID NO: 14154 - DNA, 764 bp, Homo sapiens
aggtaaaaaaagcccagaataaaacgtgtgcttttccctatttcaaaagtgccccccttccccaaattcctaggggtaggtgaagaaaaattcttctgtttcaagaacagggttttaaacaaccccttgggaaaaaaacctccctccaaaggtgattttttcctccaaattaaaaccctcccgggaagagggatttcccctaaaaaaaagtcctcaggttttttcaacctttttttttttttttaccttgggaagggccaaaactataaacctatatcccgattttttttttgttgaaggtggtgtcaaaatcttcctttgggcaaaacatccctagctggctataaaaacaaaagggtcatcctttaagcccccaaaaggcagggaatttagcttccgccaaaaacaggaaaaaaactatcccgtataaaagtcagaagaccgatttccttaaccaataaaaaagacctccaaaatttttacataatccccaagaaatcctttttttcccctttttcaacgggggttcaaacgggctgtccctcagatttgcaaagatgaaaattaccccaaaaatttttttgttttcttgcctttttttccacccccccaaaactaaacaaaattttttggacctggggatcttttggacttctcaaaacccaaagtccggctaaaaaaaaaaaaaaatttgagagtaaaaaaaaaaaaaaaaaaaaaaaaaaaaaaaaaaaaaaaaaaaaaaaaaaaaaaaaaaaaaaaaa

SEQ ID NO: 14155 - DNA, 811 bp, Homo sapiens
gccggcaacaaacaacgtactaaaccgaaccaccccccccacacgaatagtctagtgaaaagaatctctccccataccatcacagctggaaaacaccctgggtcacatctgaagccagcacatctgtgagtttcacccaaggtctgcagcgaatacttcctgacttccgctgactattcggtgcccaaggatgctttagtaagcaggttaccactgaccacacagaaatacaaactcagagactactgatatgcacacactaatatgcacctctatgcacacaagctagaaaacctagaagagatggataaatttctggacacacacaccctcctaagactgaactagaaaataaattgattccctgagcagaccactaataagctctgaaactgaatcacgaataaattgcctaccaaccaaaaaagcccagaatcatatggattcacagctgaatactaccagatgtacaaagaagacccagtacccattactactgaaactatttaaaaaatatcgaggaggagatactcctccccaactcaattccatgaggtcagcttcatttttggaccaaaaccaggcacacacacttgatacaaaaatatagcaaaaacgacaatctaagccaatacaccctgctgaccctctagtcataattcctttaatatcagacttgcaatctggttgctgcgcacaatggcggtccaatcacatcgctatgaattaagctttattgctgacattccaggaaggtgaatacaaggtaaaagaaatgtaataatcggtaaaatatttattgcgtatcagt

SEQ ID NO: 14156 - DNA, 995 bp, Homo sapiens
caaataaataatgcccctctccacacaccttcaaagaaaaaaagaaagacctgaggtgcaaacaaaaaagcaaattgacagatgtacaccgtaagccatagctcttggaaggaagaaatacacatacagaatgggagaaggcaaggaataaccctgtaaggccttccttcatacactcaacccttagctttgcggcctctatctcggactgtcaaaggccagattaaacaacggtcacacagagattcacacttctcacacgccccaactcaatcttctgccatgttatttaagggaaagccgtcaacccagtctgccctgaatcttgctccaaacttttgcaagctactcaaaaaaagcctctattcctgtggttgaaagccctacacagcttcttggggaatttgactatccttgcaatcgtctcacacttctacgaaacgctttaaacccctaggcgacccttgaagccacattactgccacagctttactaaataactttggaccgaacgaatagtgaccctatcaaccacaccctacctccctcttggagcaccctacattcttcaagcaacttgcctgtcaagtacctacaggattaccattacgccctacatgtgatcccacaccgaccattgtacactttcgggaactttatacacgcctaacaacacatgtctaaccataaaagcaacaaacctctttacctccaaccattaccacactctacttatccgcggaacgaatgaactccgcctactcaatagcgcgtctcaatcatcacccttcctctacttgacctcctcacctacaaaaaaccttcctccttaacaatacatatggcgcctagaattttctttcgaaacgcgttaccccaatcacaccctcttcatcatcccaccataatactatcctttgtcaacccctccacctatctatctaaccccagctctactagtgttatctccgcctactacctctctccagacttct

SEQ ID NO: 14157 - DNA, 604 bp, Homo sapiens
atagggacattgaagcccagctgagagcaattaacttgcccaaggtcatacagccattgagttgaagaaatggagttggagctcagtttggccaatgttaatgcccaagttctgttttccttccctgtcaactaacaattgagagggtattcactctgagcatgattatggagaatgaaagaccttacaatagattatgagtaaaaatatctggatttctcagaactatgacagaaaattaaaagtatattagaaataaactaagactaaatttgacatttattttcttgatataaaaatcctgaaataaaaagagtgtaagtttgttgtttgttttcgtaatctagggctatttctggaaacaacatgaggaggagtatttcaaaataatagtcgttttgaattattaataggaaggtgcattattgtgtaaccttaatattactgcattggtcaatttatcaaattacattcctgtgttttgtcaaaaaaggaaaggttatatatgaactatgaatatttcaggtagtaggtactcaaatcatgtttgttgaaaattgtatgaattaataaaaataacttaaaaataaaaaaaaaaaaaaaa

SEQ ID NO: 14158 - DNA, 510 bp, Homo sapiens
  misc_feature (1)...(510): n = A,T,C or G
ctaggggacacgtgctaggaactttcagttggccatcctgctgatgtcaccatgtattttgcacttgatcttagccaaaaggccgagaagcaatcgtcaccacttattttgaaacaattatagagtcaccggaagttgtgaagaaatacttcatgcacccttcactcagactaccccaatggaaacattttatgaagccacagcgcagcatcaaaaccagaagattgacatcagtaccatttacagagcttattctgattccaccaattctacatgcacttgtgtgtgtgcatgtgtgcttatagctgtatgcaatttcatcacatgtaattttataaaactgctaccacaatcaagatacagaactatttggtagccaaaaggttccctcgtgctgcctctntataggcacggcccctcatgcccaacccctggaaaccactaatctgatctccttggctataattacattgtttcatgaatgttatataaatggaattatgcaatgtt

SEQ ID NO: 14159 - DNA, 120 bp, Homo sapiens
ctttgaagggacacgcaggtcttttgcatctgtgacaggataatgcagaacggctcatttccaactgcttgcatctatgaagcaaaataaaatccaacagatactagaaaaaaaaaaaaa

SEQ ID NO: 14160 - DNA, 775 bp, Homo sapiens
cttcaggctggctccaagacagtgttggaatgaaaaccaaatgcaaattggctagaaggaagggccagaataaacacaaactgaagaccccaaaccaacggtgtccaagcttgtgcatgtatctgcgctgtccccatggggccttccaactctgctcaaagcaatctccagggctgttctccaaggacaatgggtgagttagagagaagatctcttgtgcttccttctttgctttttaaatttaaggtggacatgatctgagggctttgtacagaaaacctctgagggtcagttgagtgacccacttaccctgccattccccaccctgctggggtcctcctgctacttcaactccatcaccacagagactcaattcctgcactctgaggttcaaatctgcatctgctgaagaatcttccagaactgcaactcccatctgcactgggagcatgtctggcccacaccagctcaagcactgtgtgaagggtcccagttattcagtgtgaaattgtgtaagactttctcctggagacaggacctttgcaatcacagcttggggaattgtctttacaataaccacttcctcttagggagtcagcagcctgggctcaaatcctgcttggtcattaagataattttgtgactctagacaagtcacagcacccctcttaacctacatttcttcatccattcaacaaatattcacatagccactaccggcaccaggaatagagaggggagcatgattgataaatattcttaaattatgattgct

SEQ ID NO: 14161 - DNA, 768 bp, Homo sapiens
ccttggtgagacctcgctaccttattagagcctcagacaaaccgtatagaaagatgaataacacagagattataagttggtttagaatgcaaagatatataatgaatatcaaagaagcatcaattcctggtatggaaataatggcattaagcaaacttactccttttcctttcagtaggttaaaaatggacacattgtaattaaaattatttgaaatggaaaacgaacttaaatcttctgtcctaaaagttgactatgagtttttctatgaatactagttttcaccgtctcgaagactttcacattaagagcatttgaaagcaaataaacagtaattattattgacctttttataatggtcagaatctgggagtaataaactctgtttaaatctttataggaactgaagtaactaaggagtctcatcctaattaggatgttttcgttgtgtagttatatatgttgattctgaaaacattgatcttgccgaaagaaaggaaaagaatggtagagatgcaggcagactgaagcaacagagcaacacatttccataactaataatctttcatagatatattggttctgataggagtccagatagacgcctgaaaaattgaatcaaattgggccagtttaaagtggggagtgtgtatcactggcagttggactaaatcattatggttgatgacaaggtactggtatttggactgggaatatcatttatgaaaatattacttaactggtgaagcctttattaactttattagg

SEQ ID NO: 14162 - DNA, 543 bp, Homo sapiens
ctggagtgcaatggcgcgatcttggctcctgcaacctccgcctccgggattcaagcgattctcctgcctcagccttcggagtagctgggattacaggcatgtgccaccacgccctgctaattttgtatttttagtagagatgggatttctccatgttggccacgtttgtctcgaactcccgacctcagatgatccagcctccttggcctcccaaagtgctgggattacaggcgtgagccactgtgcctggcgaaacttatatttttagcgctacactccttgtgtctagattagcacatgccaatataaaagtcttcattatttgttggtagttgttaagtgaattggggttagtaataaaggaaatgttagttacataaattactatgactgattaagtcactgcttatattttataaaatttattttccagaagtcacattttcttaagaataaaaaaagaaacaaaaacatgtaatgtaatcttcacattttataaataaaaataatctaagaattttgtattgtgaaaaaaaaaaaaaa

SEQ ID NO: 14163 - DNA, 168 bp, Homo sapiens
tctagatgggaccatctagttgcaagaaacaagctcagggatcccaccgattccacaagatgtggacacataaaataggactggattatgaagaaataaaaacaaggagaaataaataatgaagaagaagtttaaatcagtaataaagtctcattaaaaaaaaaaaaa

SEQ ID NO: 14164 - DNA, 782 bp, Homo sapiens
ctaggaccagaaaccagaaatgcaatttgccaagtatatgaagaatgtgtttttactggtttttgataacttaaaatacttcttcatctaaaaccaggctgatcttgagaaagattttaaaggagattagaaaattcactttaacaaaccactatcatatagtcacatcaatctttcgtagatatttttgcaaacaattaccagaattcttagagtttattacagatattttgttcttgacctttgacacttgccatttagcaattgcatggttttacttttgtggttgtagagtttctgtttttctttcattagaatgatataagtagaggaatagaaactgttatatttgcaaaaaaagagcaaagatgctttgtgaccttgggaattatatttgaaggttactcacaagagaataccttgtttaggaaagatggttaatttttttcttgcaagcagacttttttacaaaattagttaatggcaaatgtgttctttgctgaatattaatctatagtatcatttaagatgttcttaatttatgtttctggactttgtttaaatgtcaaactctagagagggtaaactagctcaccccactgctagggaatagctagtattgtcttcgctgcagggcattttacagtaaaattttgaagtatattgaaaaaagttaccagttcacttactatacaatagcttggaatgtgaatgtctgaaagaagaaaattcaataaatgactatgtaggtatttggtggaattcacaacataataacaaaa

SEQ ID NO: 14165 - DNA, 728 bp, Homo sapiens
ggcgtcatttttcagataccaaaggccctccctttcatttcactagtggaagggtgggaagacaagaacagaaagctctccctcttgtgtaaggcagttgctgtgaaaaccccacgggcaggaggcccccggccagcacatcctgtctgcttgtgtctgaagcagagttctgggtccggggccatgtgtccacacctcaatgctctcctgggcctagtgctctgcctggcccagaccatccacacgcaggagggggcccttcccagaccctccatatcggctgagccaggccctgtgatctccccggggagccatgtgactttcatgttccggggcccggttggggttcaaacattccgcctggagagggaggatagagccaagtacaaagatagttataatgtgtttcgacttggtccatctgagtcagaggccagattccccattgactcagtaagtgaaggaaatgccgggctttatcgctgcctctattataagccccctggatggtttgagcacagtgacttcctggagctgctggtgaaagggactgtgccaggcactgaagcctccggatttgatgcaccatgaatgaggagaaatggcctcccgtcttgtgaacttcaatggggagaaataattagaatgagcaatagaaatgctcagatgcctatacatacatatacaaataaaaagatacgattcgcaaaaaaaaaaaaaaaaaaaaa

SEQ ID NO: 14166 - DNA, 118 bp, Homo sapiens
cctagaggggctcgcaggtcttctgcatctgtgaaggataatgcagaacggctcatttccaactgcttgcatctatgaagcaaaataaaatccaacagatactagaaaaaaaaaaaaa

SEQ ID NO: 14167 - DNA, 809 bp, Homo sapiens
  misc_feature (1)...(809): n = A,T,C or G
ttaggaaaagacttgccctgctcccagcactgttgggatttatatcaggagtccttatgaatacaggtggtatgctgggccatgtgctgaacacattacttcatcaaataaaacagcaagtagtctgtagtggagtctcgtggcattcctagaacactccaagggtacggtagcaaagtacaaatcagtaaaaaatattctacaaggagtcaagcaatgaagttccagtacacagctctctgacagcctgcctcaatccagggatgagaagtaaaaagcaaccaaaacttttcttcaaatttctacactgcataccaatattgagaagaacaaaagtggagtgctccagctgaaagatggtaaagctccgttgcttgaatggtttttttctccaagagtggcctgttagatgattttatgaaacttttgcggcgttactagacacaattctaaaacttctggcctagagaactgaattggccacatttccttagagcanacatccaagaatatgacttgtcacaactgcgctnttgctaanaattagggcaaatggctactanattatagtttattctaaggcaattactagcttacatggtatttttgtgtgaagctgaaaaaggtagtccccctcctcaagtaaaaatatttttaggtagtatactattacaaaacctgaattgttctgacaaagagttcttttctggaactagtggacagcagcccagctctatgcccatccgggcgcactggaacccacctgcacttgtgaagattcacagacgcacacatcaccctcagggagg

SEQ ID NO: 14168 - DNA, 1391 bp, Homo sapiens
  misc_feature (1)...(1391): n = A,T,C or G
ttaatggagatgtttatgtggtggtgagaatggaataacggcgngttattgtcaattaactaatgtaagtaacaccttgaacgtgttgcgctgtggnatacgtgtgagactgaaangcattactgtgttgagngaatactgcagcgctatgggnagtccggtaaggatggcggtgggctcgagatgagcgcgagtgacgctttanggatactcaagaggtcacgaactcgtgcggtggatataacgaggtctgagnagtcgaacagaatatggagaggctatgctgaatcgaagactataattcaaggggtccgaatgtnaaatctatcctctttagcgactcggcatatacaaacttcatatttgatgatgatacaggaaatcaagatatangatcgctcaccaccaaacacatcacaaacccaccggaataaatgtaactgcaatagaacggggggagagaatgatgggatggacacgagacagggntaagtgaagggcaggngaggaggcgaggaggggcgagataaataagaagagtgactagtagangngagtgcgaacatgngacctctgtaggacgggcgtgatcgacataacgtctctgaatgaacatagactctgtccacccgtttccatgctcatatatatgtctttgcttctgtgcctattacagatcgactcctctantctcttattggtacacatgcgttggtgntgtcattctttcttgtctctgtgttcatctttctctgantnttatatataaacattaataactatgtccttagtgagatattattggttngctatggtcgctaatcttatattnntaaataacctcatttcactacttatctctcctctntnctccatcatcatttgtcttctttnnttctttacttnntattatacttcctcatacactttattattntaatacctatatactcatctcatcgtaatcatatatatattnncgcactttagtgtgcaatgtggaaatactgtcagtgtnatattacgttacggacatattagcatnnnagtcgcgacacatcattcgttggtgcgtntcctatctccgtcccctctttctctatcgttctctttactctatcctnntcttcctttnnggcgtccgctcttaatttacctctatnttcttgattaggagtgtcgtatgtnnnngaccccgtgngcgtcctccgttnncgggtcacntgtcttaccgtgggtgtnnnnnncctnntnnnnctctggntncnnnnnnctcatcnccnnnnnctttnnnnctctcctttctnncttcccttcntntccttcatttttnnctctnnnncntccttcccctctcatntctcttctcnttnncccacctntctcttctc

SEQ ID NO: 14169 - DNA, 292 bp, Homo sapiens
cctaggagaacaaggctgctgcctctgacaaagagacaaaaagtgatgacttactccagataaacagctgcagtctctggatccactgcggtgctgtcctgaagcacttgaagaagagcatgctggctttgttccaccccattttccctctgtttcaaccagtccctgagttgcaaaatgtagttccttcaccattttttttcaataatccagttatactaaataccctttgatttttaaaaacactagattaacttgagtgttaataaaaagaggctgcatgtaatttcaa

SEQ ID NO: 14170 - DNA, 333 bp, Homo sapiens
  misc_feature (1)...(333): n = A,T,C or G
cagggagattgtcctggattttccanatggtgctaatggatccttaaatgtggaaaagagaggcatatgagggtcagtgtcagaatgatatgatgtgaaaaagactcaacttgccattgatagctttgaagagggaagaagaaagctatgagccaagagatgtgaatgtcctttggaagctgaaaaaggaaagatatggatttactcttagaggctccagaaagaaatgcagccttactgacatcatggtttcagagtgagaaccacatcaaatttctaacctaacagaattgtaagttaataaatttgtgttttaagctaaaaaaaaaaaaa

SEQ ID NO: 14171 - DNA, 775 bp, Homo sapiens
agatatgatcagattgctttgaggactgaagttgacttttgtggagccgataaaatgtcccttggagagactggccttgtaccttgtctacatgactcccttacaagcttcctgattttgtgtctcagctctgtcaacctgcttgaagctgcaaggaatttggtgctcggggacaggcctccacaagtccaatgaagttggctgcgctcctgattcacttctctatccaagaataaaaataggggctgatctactcaaccgatcctgggagattaaaggattttgaagccaatacaaaacccgagataagctgcctacgtgtgcgtgaggagccatgtcaatttcatgagcccacagtgtcccggaagggccccccccattctgacaggacttgccccaccaacctcttacctcccaaggtcccgttacctccatgaatgctaaactgatgtaacaacccacctggaccttctgtaacctccccatcaggaatgacccttcacaacatctcattcaactcccatccaccctctccggccccaagagcaacccaaataacattccacatcatgctcgcaccacccttgattatataccacgaccacctccttccctacctttcttacaacaatcacccacttccccttaccctaaccctcccccgcccactaactcttttcagccccccccactcgattcccacaacaccccccccccgttctcccctcatacccgccttcctccccttactatctggtacaccaatcctgcaatg

SEQ ID NO: 14172 - DNA, 827 bp, Homo sapiens
  misc_feature (1)...(827): n = A,T,C or G
ttcactcacattaaaataactcactcccgccccagacaaaccncgcnannnctttaggatctgcctgtggctcaacttgtgccttaccacgtcgtgcatgctcaatctcctcctcatctctgtgcttgagggaccactatgacagactctatcttgaagaggctgtctgcgcttaatagcacggactatgactggatgtaaaacgacgactggacatcaatacctgcacacgtgccatctgctcataattgcccatctaacatgaggagagggagaacaaagaatcttcagttcagaggatccgatagggtacagactatcacactaatggatttactactaggtaataataatggagagactagagagataatatgcgattccacaaatctgcagaaggcttaactgtgcctgcctgaggggatgggaggggaacatcatacacataaagaactaacgacttacaactccctgtggttacggccagggccaagatacggattacgtgatcgcaccacatgaacggcatggttgcctaaacacacgaagataacagatttccttacttagcaattaccatgatgagacccccacagacaattctaaagaaagaatacccacaggccgttataatgataaaatggccaataagtattccccatacgaacactacatgccagttcactacactttatcaattgggccactccctacctgaaaacaaacacttacccccgccgcccgagctatgtacatattccacgccgccaaaagaaactccttgttcctgaactatctaaggatataccgcaacaacacacggccat

SEQ ID NO: 14173 - DNA, 741 bp, Homo sapiens
gcggacagggacaaaacaaaacctgcctaaggaatccccctcaagaaaggggaacgtagttgcttaggttaaaaggagccttcccgggtcgcgttgtccaggtctccgcctcaatatgtggttcagggactccttatgcagcataatcactccatgtggtggttggcgtttgtaagcccgccacgttaaggggattaaagcacggcttgtgatcgggctttgcactctgaacatgtgctcagaaatccccattggccagccaaagagggagaagaaagaaacctccttcagaggttctgttcggtcccacataagcgcgtcaactttaattgttatgggttgatataacgggtcgcgtgagttattaatggggattatagacgtcttcagatgccataccggtgccagcaagtggggttgaaggagttactttttcctcataaagcaggccctaagtcattcgctctcagtgttcgagcccgtgtttaataggtgatcccttgttgttatccaaagaaattaagggggtgtgtcactttcagatgcgctcttcctctttgtctcatgtcaaaataggaagaaatgcccctactttgtaagtaatttcaaaccccgcatccaaatgtaacgatcaaaaaccctaaaggcaaagtgatcatgcagagtatgccacaagttctaatccctttttgatataaaaccattttctgtttgatagaaagaaaaaagaataaaaggaaa

SEQ ID NO: 14174 - DNA, 795 bp, Homo sapiens
agctaaaaagaaacatgaaagaagtgaattgatctttaaccagaggaaaaaggaaaataccccacctttggcttatcaacactggcaactgttaccaagctctgggctcaaaagacctaataattaccttcagggtaagggacagtaacaacatccaaattcctcccaacagaccttccatgcaatttatcttattgcctcctggaaacaagatgtatatgttaggtttgcagtgtcagtgtgatcctttccattcttcaatgtgagaaataaacaggtagcaatatgtatcatggctaaaaactcaggcttgtattagaatgccgagagttcaaatctcagcaaccccacttacagaatgtatgatgctgggcaaactatttctctaaacttcagcttttttatctataaaataggtccacataaagggcttagaacaaaccctggtacaatgtaagtcctcaataaatagtaaacaataaaattattatcacaacttaattaagagtgacagatacattctgcagcaaaggcatgaatgaagactgtatttgtgtgactggacaaaggctttctgtttgttactttcagtcagaggagacagcattagagaaataagtgaggccaggattcagttcttagaagcatagaataagccctattttggctcccttctcccattagaaacagccgcattttcttgtgcaccacaacgcctgccacatccctgagacacaatgggtgaaggtaaaggccatacttcaccaatttggtatactgggtgcctggtactag

SEQ ID NO: 14175 - DNA, 1094 bp, Homo sapiens
  misc_feature (1)...(1094): n = A,T,C or G
aggaaaagaagggagggagagagggggggaaaagagagaagggaagaagggtggagaaaggagaggggggggctaggggggggggcgagggagagggggttagggggaggaggaaacagngnagataaaaagaanaggaaaaggggagaggggggtggagggagaggaagaagagagaagtagaagaggaaaaggagggggggagagaggggaaggcacggcagagggggcaagagagacgcaccgagagaacgggagcacaccagaaagagacgaaaacaggagaggaaaaggcagacgaggaggaagagcgcgagacaccaggaagcaaaggggagagacgaggcggcggagcggcgggaggagaagggggaaaaacaaaaaagcgagcaaagagcacagagacgacgaagaganagaacgccggcgcgggacccagaccacacngaacgaacgcagaacaggcgcgacacacgcaaacacccaccacgcacacaacaaaacacgccaccacaccaccccgcaagaaaaaccaaagaccaaacaccgccacacgcccacacccacaccgacagcacggccgagaggccggcaagcgaccgcgccaccgcaaagcccaccgcaccgtgaagcgcgcgacgcaagacatacaaacagagccacagcggaaccagaacaaacgagacacaagacaccggcaaggaacgagaaaagcggagcaacgaagcgacggaaaacgtgacaagacgaagcaacgcgagcggaggaagcggacacgcgagaacgacaaccagcgaggcagaagaaaagagggcagcgcaggaagagcagcgcggcgcgcgcaagccagccagacggaacgggagaagaggcaccaaacacgcacacacaacgaggcaaagcaaaacacagccacaacacagacacgcgagaacaccaggagggaagaccgacagtgacgacgacgaccgcgagaaaacggaagagagaggaaagacaatccaacaggcacgccagacagacagacagagcagaaaggcaagcagcgcaggaagacgatggaaccaagcagcgacacaccaccacacacccca

SEQ ID NO: 14176 - DNA, 365 bp, Homo sapiens
cttagagacggcggtctcagtacttacccagactggtcttgaactcctgggctcaagcaagcctcctgcctcagcctcccaaagtgctgggattacagacatgagaaacactggcctcaagaaaattcttgatctgatttgacaatgctcataagaacaccattcagtcacaagggaaaatggtattcatggagactgttttggatgagtggttgactttctgaagaatatgttctcttcgtaaaatatgtgactaggtttagttctaaaatgtatattcttctctttggaatgctttcatattatttgtgatttagaataccctactagttcaaaatataacatctgtgtggttatatgcaaaa

SEQ ID NO: 14177 - DNA, 847 bp, Homo sapiens
  misc_feature (1)...(847): n = A,T,C or G
attttcttcaacacgcataatcacagttttctcaccagcaacacaacacccacaccttccaggttttaccttncaaaaatatttcttggctcataaaatgactaaattgccagtacatgacaaaaaggacagcccagtgttgtgggtcatgcttctattcccagcactttgggaagctgacgcgagaagaccgtttttgaggccacggtgtacaagatcagcttgggcaacaaagagacctcatctctacctttaaaaaaagaaaattggccaggcatggcggctcaacagtcccagctactctagaggctgaagcaggatgatcgcttgagtgtaagagtttgaggctgtagcgagctatgattgacctcgagccattgaactccagcctgagcatcagatcgagtctgtgcattccaacaccagaaccgatttgccactcggaggcccgcccaatcaacctgcaaaatctgttgggtatgcctcgagagtaagcctttccgctctatattcgtcgcagaataatctcatccacctcgttggcatactggccgacacacttgagctacctcccttcgcagaggggtagtctgccgatcgtccttttatgaactctttcgtttctaatctatatcgcttctagccccctcctcatcatgagagcactccaccgcgtttttcccattcttttctccctctcgcacgcctactcttatattttcttagctcccaacccggcagcgtaaatttggaacgcccccccaccgttacagttattcttgctccgttctctgagattggtacgcggctctctccccaccgattgtctccgcgaacgacttaaatg

SEQ ID NO: 14178 - DNA, 514 bp, Homo sapiens
ctaggcgtggagtttagaggcaccttctctgctcactgcaacctctgcctcctgggttccagagattctcctgcatcatcctcctgagtagctgggactacaggcatgcgccaccacactcagctaatttttatagttttagtagagactgggtttcaccatgctggccaggatggtcttgatctcctgacctcttgatctgcctgccttggcctcccaaagcgctgggattacaggcatgagccactgcccctggctcagtttttttaatatataaaaagatggacaatcctccttcagactgattttttaaaaaaaatatttatttcctctttcaggaaatttggatacagacacacacagaagaaagcccatatgaacatacgcagagaagatgaccatctgcaaaccaacaagacaggcctcggaagaaattaacctggctgacaccttggtctcggacattttgcctttctgaattgtatgaaataaattcctgttgtttatgtcaaaa

SEQ ID NO: 14179 - DNA, 1516 bp, Homo sapiens
  misc_feature (1)...(1516): n = A,T,C or G
gcgagtcagcagataatatacactagattgcatatcgcaatgctgactcattaacgcgcgacggggcgcgagatatcttacaatatcattcactcaccctcatcgtcacgatagagagatctcgtcatgcccgctgactggtagttaatatttttccttgtcgtcatagcagtggctctgagntgcacgaccgagtcgatctcccaccattgacatacagtcccgactcgcatctatccgatcatatccccctatagcntagcctacatatgatgtagctagcgacgccgagagagagaagtagataggcgactattagagctgtcatgagatcgcgacacganccacgtcgcacaccagacagacacagaataagtctaccgcatctgcacacagagccgctccgcgagcgcgttnggcgcgtatgaaagaatggacgcacagagctacgagagccgtagcgctgaagctcgctgcagcntatcgtagtgagcgatgtcgcgcagagtaggacatggtgtgacgcagagacgtgaaggctcggcgatagagcgcagagacggagcaccaaccctggatacatttccagcagcgtcgccacgtcacaagctacgaactggtgcagcacaggatcagagncacgagaagtgcgcagcgagagtcatcctactgcggacagccacgcatcgcagtggtgggtcgtatattgagagggccagtatcgccacacaagnacaacacgtagacagcgccgccgcatagagatcggtcagcatgtgcgccactataatcatncgcgaggtatcacgactcgagaccactatctagctctaatnacgacgcgtagatgcgagagtgcgcgangtagtnagagagctagaatgtcgggtgacgtagcagtgagtagagacggatacaggctatcgcgaccgcagcggccggacgctnagcgccagagagcgttgagcnatcgaacagcnattantantacatcacatntgcggagcatgcacacaatacatcgatgngtagacggtggacagctcgtctgctaaggcgacatgcttcncgcgananagagcgacactgcgatatcaagagcataccncattgagcgacctatcgcacatgcatcagtggcgcggcnacaccgcgacgtacgcgatagttcgctgagcagtgcagtcgtaacaagcgtcagctagcntagagccantgcagggtgtcgacatgtaaaggagcnagataaacgtgcanagaccgtccangcanatgagagangagtggcgcagantagcagcgtcgcgagagtagtagtgtcagagtgagacatatcagatagttcgcagcngcncgaggagacggatgagactagagagagagtgatagaaccagtaatagagagtgtcgagcagtctaacggacacatgagcatcagnaccnctnagatcgcagtaacagacgnagtgataagctgacgagacagcacgcagttaggcgcaacgatcgtngcagg

SEQ ID NO: 14180 - DNA, 774 bp, Homo sapiens
  misc_feature (1)...(774): n = A,T,C or G
tggttcgctgtgatcctgagattcaagactgcgtcagtggcagaagaaacttcgcgaggccaagcacattcacccgcaagtcaaaatcttctgggccaagcaagaacaaaaagtgaaatgcaaaatggaggacgatgcagtacctgcagccaagatgaaaattccatcatcttaaccatagctaagacgtatctttgcccattcgagcacaagttaccttgtgcaaggaaaatgtccaaatgatgctctctctcttgtgatttctttaacaagacttggaacatgtgcaaatggaatcttttctgtacaagataggattcattgcaaacaagctttaatgcaaatagtttagaaaagaaaggaccagtcttcactttctgcattatccccacattttattcattcatccagattacttcttcagtgcctcaggagtattcctctacaccagctgctgttaaaatgtacaatgaactctagtcccaaggaatacagaagtgctcttattaccagttttcccacttgtggccgcctttgcaaagatccatattctaatttaagtccccaacctctgaatttggttttaagtttacctagtgactgactactctctttataaaanagaccttatacttaatgatcatttccaaaggagaccactccttaacttttactgcaaaccccacaagatgagacacttaaacccagacagatgtaacaaaggatttttgttggctaagtccacaagattatatagaaagtgcctgttttatg

SEQ ID NO: 14181 - DNA, 440 bp, Homo sapiens
  misc_feature (1)...(440): n = A,T,C or G
ttagnaggacaacgttattaagatctttaaaagttaacataaaacagcctcaagcacatccttcaggaagtatttcagaagaaggcattgttatcacaggagatgacggctccatgtgttattgcccctgaagaccttccggtgggacaagctatagaagtggaagacagtcatattggccctgtgtaggcctaagttattgtgtgtgtttgtgtcttagttaacaaaaaagcttaaaagttaacaaaattttaatagaaaaaggcatataggctaaagatataatgaaaacatttgcatacaaatgtacaatgcattcatgttttaagatgttattacgaaaaatgaagaagttttaagaaatttaaaagtgtataaagtaaaaaatttacagtaaggtattgaagaaattttaaaaataaatttagtgttacctaaaa

SEQ ID NO: 14182 - DNA, 1065 bp, Homo sapiens
tagctgtggcactcctgctgccagtccactgctgcaagccctgctgctgccagtccagctgctgtgtccccgtgtgctgccagtccagctgctgcaagccctgttgctgccagtccaactgttgtgtccctgtgtgctgccagtgtaagatctgaggctctggacccagaccttcaggtttctcctgtttggtgaaagcatttcttatggttccctgagtcagttcgtcccacacatcctccctgaggcacctgcacctgctctagctcaccgtccatgcacacacctccttccatggctcagctctcctctgggccctgccttcagcctcctcactccagaaacgtgtgtttccctgatgcgggaggtgtcctcgcctggacgcaggcacccagccgactgccacgatgttccctgcacttgggtgtggaccatcttctttcttctccctggggctgaacttgaaatgccaagggtcttgacccccaaccaaggcccaaggcccgacgtttttctggagtggatccaaccttaaaagaaacccagctttttttcaaacccaacccatttccagggaaacccccttggggatccccttcccctgggggccccgcttggccttggtttacttcccctgggggggccccccaaaagtgggtggaaccccaagggaaaagggggtccttccctttttcccccttttcccttggtttgggcccctcccaatttctgggggtttcaaagcaccaaaacgtacatttaaaaccaatataatattaaatttggaaaacggggaaaatttttttcccctttttggggccaattttaaaatgggccccttatttacaatttgggcccttgggttaaaaaattcccaaataaataaatatcgtacgcaattttccccttggggggactcctctagtttttaggggcccctttcaaaaccccggttcggaaaaaaccttttctgtgacgggaaacccccccttttttccccccttttttaaaaataaaaaaagggacttcataaaattctccaatcggaaaattcccttcctagct

SEQ ID NO: 14183 - DNA, 270 bp, Homo sapiens
ccttggactgacaggcagagcaatgtgaagcagaactgcagagacaaggattccaggtgcttggaagtgagggtggagccagcccgggaaaagattcagccccagacggctgcaccaggtggagcaaagatgtcttctcttttatacatgtcaactagaaggtgacaagagtcaggagcccatgatcttaaagctccctgtgttacccagcacccctgtaagatttcctaatcattcttttataattaaaaaaaagatattttcataaaa

SEQ ID NO: 14184 - DNA, 253 bp, Homo sapiens
tagggatatttgtcatgtctgttagcccttgcaattgtcaaaacttggagaggaggaggtcactactggccagagacactgctaaacatcctatggccccctctgcattaaataattgtctgacccaaaatgtcgtagtgccgatgttgagaagctgtgctctacattcttcttgctcctttattaaatcattactatgtgtgaagtgactgtcacataactagtagtaaacaatattttattgaccacttaa

SEQ ID NO: 14185 - DNA, 640 bp, Homo sapiens
cttagatcttcttgttgatggaattttcttcaagacttggcattcgtgcaacatcagtcttggtgctctttttcttggagaattttcatcctttctttatcctcaaaagtcttctggaaggagtaagaagaagctgcctcagaaactgtgaaacacatgccatgttagttctaattttagtcccagatcactcaattcagttgtgcagataaatgaattgtcacaactatttacagaaccaaattgagaacaatcctctcttatcctcaccttaccatcccgaatcaaatctgcctgggaacaaatctggtattagatgtttcttctttagtatgaaatcatgtcaatatgttaactttccacatatatcaatctaaagcttgtttctaattaagcaatagctacaaattaaaggaatttaaagcatcactgcacaggcagcagaggttttcttctaagccgaaaccctgtgggaatcataacccggatgatataataggcagcttggatttcctgctaggaaacccggctctatcattttcatggactgggccactttatccccatgtctgcattttaaactctcttttattctgattggaggtaacaaaatacatatgaaacaaattcataaaccaaa

SEQ ID NO: 14186 - DNA, 127 bp, Homo sapiens
tgttggactgactcgtttcttctggatgcacgagaagaaaatccattcttgcctattccagcttttagaggctgcatgtggccctttcagccatcttcaaataaagctgcataatcttttgtcgaaa

SEQ ID NO: 14187 - DNA, 775 bp, Homo sapiens
tttatagggtttcacctcagcctgtgtagaggtgcccagaaggggtgcagctcctatattgttaacagaagtgttgtttcaaaaacttatgtgactactctcagaaaagagctggcttcagaacgtctcagcagtgactgctgaccactgaattttcacgtaaaacatcaccagataaagttagccccgggtgatccagctcggcaactcagaagggaagggagcttcagaactgctttctatcctcattctaaagcctctgggtgggacccaaggtgaagacaatctctctgtatcttgacgcccacactactattataaaactccatggtattgtaatctaaagggagaacaaacagttgcacaaaacaaaagggtcaataagaaatagacatcagaggctgggtgcggtggctcatgcctgtaatcctggcacttcaggaggccgacgtggggggatcacctgaggtcaggagttcaagaccctgtctctactaaaattagcagggcatggtggtgtgtgccggtaatcccagctacttgggaggctgaggtgggagaatcgcttgaacttgggaggcagaggctactgtgagccaaggtcatgcccctgcactccagcctgagcgacagagccagactctgcctcaaaaaataaaaataaaaataaaaatataataaataaatgaaataaagatattaaaaaagactcacatgtaaaaaaaaaaaatcggccttgtttggcctcaggggtggagctctgcagccgcttcct

SEQ ID NO: 14188 - DNA, 231 bp, Homo sapiens
  misc_feature (1)...(231): n = A,T,C or G
gtacgaaaaggatgcgagggaggagaaaaggaggncctagcacgggaaaaggaaacaatgtctcctactcacctttggaggaatttcactaccaagtctccgtggttctatgggatccaatgatccttggctcagtattgatttttgtatgacacctgtagaaacagtctctccttcctttctaacaaaatatagcaacaaaaatcgtgtagtttctgaaaaaaaaaaaaa

SEQ ID NO: 14189 - DNA, 446 bp, Homo sapiens
atgctctgctcttccatttgagacagcgtctcactctgtcacccaagctggagtgcagtggcaccgtcatggctcactgcagcctccatcttccgagctcaagcaatcctcccaccttggcctcccaaaatgctgggattataggcgtgagctatcgtgcccgtcctaaagaactttctttagcgcttctcatagtggaggtctgctggcgacaagaatctctgttttcttttatctgaaaatagctttatttcatcttcattctggaagaatactttcactagaaaaacaattctgagttgactttttttttccttcagcattttagagatattccactgtcttctggtctatattggttttgatgagaaaagagtgacattgaaaatattgttctgtctagtctttaggatgggattaaaaaaaagaaaagaaaaaaaaaaaaa

SEQ ID NO: 14190 - DNA, 240 bp, Homo sapiens
atggtgacactcagttttaccttggtgaatgaattatctcttctggttccatgagatgtgaggaatatgtgaagagacttgagttcttgtgtgttctgaagtgtgaagacctaactggttacctccagctctccttgactttctcattcttcctaatgttcctgggaattttagaaattcctgcatgttttcaattctgaatagtgccgcaataaacatatgtgcgcaaaaaaaaaaaaa

SEQ ID NO: 14191 - DNA, 341 bp, Homo sapiens
atcttttagatactagactacaaggaagccattggaagctgatacaatggacggctcatcacttataattcctggactctaaactggatgcagaaacttaatgagactctggattgtctcctgggagagagggtgaaggtatcctatgagtgagaataagtgtgcatatagttacttatgtagtcctaagagttactccttgtcctccagtatccattttctctttcttccttttagtaattggagacagtcacaggtctacaatttagcaacctttcccacttctgtttccatgtaaccaggttcaagtcaataaaatatgagaggcaaaaaaaaaaaaa

SEQ ID NO: 14192 - DNA, 173 bp, Homo sapiens
tgagccaaagaagaatcatgtgaacacacactgggacagttctcgtcatctacaagcccagggaagaggctcagaataaaacctacctcatgggcagtttgatcttggatttcccagcctccagaactgtaagaaataaatttcggttgtttctggctgcaaaaaaaaaaaaa

SEQ ID NO: 14193 - DNA, 301 bp, Homo sapiens
aggaccaaatgtgaataatgccaacagcttgctgtcagccctgaagtttcctcagatgtctcataaacactggaatcacttcacacgtttctgaaatgtgaccacctctcaggaggagttgacaacactgagtaaccggaagggaggaacacttatcccactgaaactgggataaaggttgtcatgaatgcaagaggtgcctaaatctcttggcatggggacttaatggggccttatccctcctgctatatggtagcaaaataagaaaataaaaaccaaagtaatatgaaaaaaaaaaaaa

SEQ ID NO: 14194 - DNA, 359 bp, Homo sapiens
  misc_feature (1)...(359): n = A,T,C or G
gtttaagaagtaggaagcacatccgtcttggacagcatctcctcagtatccatacacacagcctagcgcacaaattggccttcttgatgggctgctttgatttctaaatgcaccagcatcgcagaaagctttggagcacctccaaaaggagtggaagaaaccctctgtggccttcttcaagcattccaagatactcaaagagatacctgttcctggcaacatgtgccaagttctttcagtctgcagtaatttacgttgttgtcacccagtcttccatttgtaatggttctgtaactgcaaaaatggtaggagggaagtacaccaataaacactgactacatagtcnaaaaaaaaaaaaa

SEQ ID NO: 14195 - DNA, 1449 bp, Homo sapiens
  misc_feature (1)...(1449): n = A,T,C or G
cgccttcgctcctcgtcnttcgtctcgtttgtctccgtgtgctgtcgtgtcgcgtgtgcttgtntgcttcgcgttgtctctgtcttctcgcgctctcttgtncgtntgtgcgctgcttnctctctcggcgctcgctcctgctgtcgtccgcgcgcgtctggtcggctgtctttcgntgttccgttctgccgtcgcgtctcctgctcgtctctntgcgtcttccgcgcgcgtcgtcttcgcggcgcgctcgtcgctgcgtctcttctccctccgcgctcctcctccctcgcgctctcgctccttcgtctctctcggcggttgctcntcgtctgtggncgcggtcgtgtgtgtgcgcgctgtgcctgctctngtcggctcgtgtgttgctctctgccgtcttcgtcccgtnccgtcgcgtctcgtgcgtcgcgtcgcgtgtggcggtccctgccgtcgttcggtttgtgcctcccctctcggcgcgcgctcgttcttctctgtctcgtgtncgtttcggtggtttgtnttcttgctccctnctcgtgtctctcntncntgttctcctttctttcntnttcctgctncctcgtcgtccggcttctcgtgcttctgctttctggctcgcgtcttcggtctctgctccgctcgtgccgtcgtgcgctccttctccctcggcctctctctgtgttgttcgccctctcgccgcgcttcgtggttcctccctgctctgctggctttgctggttctctgggtcgttgctcggtgtgctcgcgccgtcggccgtggctcgtccgtctcgttnctcgctcgtcccgcgccgcttgctgccttcgccgtcgcctctcgccttcccgcctcttcctcgcgcgccggcctggtccgcgtctgcgtcgtcttctttntccgtgtcgtccctctcgcgtgctcgcctccggcccgcgttttgttcgtcgctgtcgcgtcgttcgtctctcctcttcgtgnttcnttaaaaaaaacaantgcctgccttgtccgcgctgtgttcgtgctgtgggttgttcggttctctgttcgtcggctggtcgttctcgttctcggntcctggctctcggttgcgttcgttggcttctgtctgcgtttgtggcggtgcgtncctcgggttgtgtctgtcggtgcgcgtgtgggtccttcttgctgtgtttgcctggcgctcgtctgctcggtgttgtcgtgcgttgtctgttttcgctcgtgttccggcgtctctgtcttcgccgctgtcgctcgaagaggggttggtgttggttnttcttnncttnnnnntctgtttnccgncntnnnggttnnntntcccccctcaacgccttncggngggnttnagttcccctnatggcacgcttntttccccgtcgtgtttgtccttgccgggctccggcgccgtcgcctcggccctcgggtctgcctcgc

SEQ ID NO: 14196 - DNA, 166 bp, Homo sapiens
  misc_feature (1)...(166): n = A,T,C or G
catgnatgtggacaactggatgtatggagtcattaaaacacttgtccaaggtcatcattagcaaaagcaggaggtggaaaccagtgagtaggtgtccagtgctagatttggtttcatctttgttctaaacattaagtcaataaaagttcacataaaaaaaaaaaaa

SEQ ID NO: 14197 - DNA, 153 bp, Homo sapiens
cttttcgagaccacataattgctgttttggggtcttaatttttttttcaaagaagaaatattaaaactttctatcatatattttcacgagcttttaaaactcattctattctattaaataaatctcagaattgaaatgtcaaaaaaaaaaaaa

SEQ ID NO: 14198 - DNA, 771 bp, Homo sapiens
  misc_feature (1)...(771): n = A,T,C or G
tcttgatttatcctgctgctccgctctgcttcacaccaatcaataagaagtgtttccagctgtatctacgaaatatctctggcaaagatcaggggcgaattcggttcacatcatanntggcaattagataatttgtctgagtgactgtttaacttacctgcctctctttgtgactctctccctacaccatatcgggtgtccaaagtgttgccaaaaccacttcgaaaatgcacatctggtgctgtctctggctggatggggggtgccttcaaatcatgacttcttaaaatgatatgaaggaatttttacaggtgggtaaaaaattaagtgggagcctgctttataattggtcctgggcatgggccatgcctccagacttaaagaataaattgaagaactggggacagaaaaaaaaaagaaaaaatggcctaaatggcctgaacgggggaggaatggcggacgggtgccttgagtgagggtgaaaggatggtcctgcgtggctggcgggcgtggacagaggtgtgggggagcgagaatggtggggaaggtcggtggagggggtaagggtgcgaggatggacaccagtggggggagagcggggcaggaaaaatgtaggagcgggcggaggaggggccggggcgctgtaaaggggattggggaggagggcgggtgaaggacgggggcggttggggaggcgatgagaggtaaggatgaaaggcggaagagggggacggtgtaggtgcggggaagaacaaggcgtggggggcatga

SEQ ID NO: 14199 - DNA, 866 bp, Homo sapiens
aaggaagagggaggcggggaagggggggggggcttgtagcaaacttatggaggaaatactcaaatgttgaaaacagggacaaatgtgggtatgcaatctgacttcatgtgactggagctgcggtgtggatgacagagaaagatgaggctgaaaaaagcgacgtagtttccacgattattgcactaattcatataagataaattgaagaccctcatagggattgtaagaatgagttcaagagaaatcaagacatttgagaaatatatgaggggtgggggggacagaattagttattaaatgaggatataagaagtcaaccatggtgcctccatttttgctttaggaaactgagagaatgatagtgtcattttctaagtaggggcaaaaacaaaaggagctttggggaagtggttgggttcaatcgaaggtgtatttattatgcagtaactactagcaatatccacatgtactaggtgttgggatatggcgaatggggaaaactgggagaaatctattccgagggtatttgggagtttttagcatgtaaatggaagttgaagttacaagcgggattacatcaaccatgaagaataaagtgttgaaataaagggcaactaaaggtcctgggcccacatttttacagatccaaagtgtttttgttctttgcggagactcatgactgaaaatctgggaacaggtgggaaaaggattgtgggtatggggaagaatttttaggagaggtaatttgttccttaggaagtatagcggagggggagccatggttttttcttcatgaaaataaggggagaaaagacggtgtcccgtgtgaggggggaagtggtgttacccgttggaggtttgtgaga

SEQ ID NO: 14200 - DNA, 1078 bp, Homo sapiens
  misc_feature (1)...(1078): n = A,T,C or G
cgggtggaggggggaggaagcgtgacgggaggcggtgaggagtgaagctagctgagcccgggattctttttgtggagactggattccaagattgaaagtacaagctacatgttttctccaatcacggcttgggggacgggacttctgcaacattgttatttgatgtaaagcacagtctacaagacgcagagctgtgtcaatggggtggtagatgtaacaccctactctcttagaaggtggggaggagggatagtaacgatttgccaacgagatgctggacatataagctgacgttatacgattacttgatcaatgggggagaggagatgacacagcattcgatcatcgagatcgaggatgtggtgctgggatgaatgagatagatagaatgggagtgagtgcgaccggctcgggtaattatcaagtggaagcgactaggtagtagagggatagaagtggcagctggaaatcttcgcgtatgtatttgtgagtaattagggggggagcggaggacggtgagacaatggggggcgcgtggggatgtgtattaacttatggtgtgtacgagtatggaaatgtctatctgcgccaggattgtgtaagcgcgtggtcaaaggatggggtgtacgataggagacatagagaagggatcggggaaagggataagtggctgcagttggtagagagacaggaacgagttgtgagtggtggtaagggtatagttgtgggaggaagagtcgcgaatgagtcgagttcatgaggaagggaggcagtgaggcagaaaattacgcgccggcatgtacgccgccgagttgatgatgaggaggaagcgcacgtagttgtgatgatgttggctagtgtgatactgaagagatggctatcatcgaagaagtgctgaggggacgtcggatatgagaaggtgcatgatagaggctagcgtggtcgtcggatatgggagggtntgatggctgagatgaaagataagtgagcacagaggagttatatgagtagcttatgggangctagacnagttagagtaccgtagttagtggtgtgtaaagtagatagcgatagcacg

SEQ ID NO: 14201 - DNA, 1472 bp, Homo sapiens; identical to SEQ ID NO: 6080
  misc_feature (1)...(1472): n = A,T,C or G

SEQ ID NO: 14202 - DNA, 843 bp, Homo sapiens
atgagttcactcatgcgcattcatggaatattttcgaaaatacaggaaaaatgtaagagaagagaactggaactaatccacattcccacagagacactcagtgtcaatatttgtgagagtaatgtacaagttctttttcgtggttttacatatataatatgtgaattatacacatatatgtgatccaatcggaagtaagacctgaaaactagaggacagacatactggcgagcgatgaaaatagttgcagggagagtcagcaaaggcattatgaagctaaacaatgctatgcatcagactggccatttatgaagatgaagaatacggcccgctttgcgaaataggggggcatgcaagccccgtgggccttttgggggggagaacatctggactttgctcagtgatggcagacaagatggctgtctggttgggagacacactttaattttatgagaggggggtaaatcgttttccaaaataaaaggggttatgatggaaaaaacatgggggcaaaagggcccaaaaaggcccagaccccgaaaaggggccgggttggggggtttttcataaaggcccggcccccggtaggcattaaagaagaacctctccggcccttagggtggagaaccggcaaagtcttaaaaatatctccgggactcccctcggaagccccttgggccgcctcaaggggacaccctgcctcaaagcggaatccggccatttctcttttggggaagcggggggttttacatgggaccctgggggatctaaaggccggaacgggatagggcccagtgtggcgggtgtctaaagcctccgctccccgaagcgtggccaattcgg

SEQ ID NO: 14203 - DNA, 966 bp, Homo sapiens; identical to SEQ ID NO: 6236
  misc_feature (1)...(966): n = A,T,C or G

SEQ ID NO: 14204 - DNA, 922 bp, Homo sapiens
  misc_feature (1)...(922): n = A,T,C or G
ccctacattatatgacttcctccattatacggggcgccacctgtatctacactactgcctgctgttactcaagaggagttcttctgccagtgatagaatggtgtccatttaattaggtcttccaccacgtgaggacacctgatatggtgccatctacggggaatgagccttcatcagatactaaacctgccagcacgctaatcttggactttcagtctccagaagtatcagaaaataaatttctgttcttatgacaaaaataccaacaaaaaaaatataacccacattaaataaaaaaaaataaaaaaccacaaaaaaaaaaacaggattcaaataaatatattccagaattatatcacgacaaaaccattaatgctgagctatgcatatgataagtattagtctcttcactatccatccccgctctccataatcaatccctattacttctcactactaaagtactctctattagccgtacattagaacatatcaaaacttatattataacacctcatccacatgattacttcatattccaaccagcactaataacgaaactacgaacagtataattataaccctacccaaccacatcataaccaccaaacgtccgatatatataaattcattattacagccattcctgaccgtatgcgcacccataactatccctccggaattaattatacacttatacacaaatttacgacttcgcgccactatacaatacaccccaggctgattaataattcataatacccatctnctttatttagccacacgttactcacagtcacgtatcagtattatacacacgatatatanaatcaatattcacaccccgatgcccaattaatacgaacgcacgcggatctgtatcataccccctcacntactgcaccataaagaccccgaacag

SEQ ID NO: 14205 - DNA, 1195 bp, Homo sapiens
  misc_feature (1)...(1195): n = A,T,C or G
gggcgcgcgtgggggcgtgtgtggcgtctntgcgcctgtcgctcgcgcctccttgcccgcggcgtctccctcgtcgtgctgttcgtgtgttgctctctctgctgctgcgcgctcccgtgtcgtgtcccgtcgcgccccggcgtgctcgtcgtgctcgctggtcttccttttcgtgtctctttcgggcgctgttatcgcctccttcttccgccggttcctttcgctctgggtttcgctctggtcgggttgttgtgggcggcctggcgtgtcttctggtcgtgtcttgggctggttggccgtgggtccgcgttcgtcgcctngtgctgtcttttccgtctnttcgcgtgtcgccgcttccgtcctcgtgtccccggcgtgccgtttcgcttgtgtttcgtcgcctgtcctngnttggcgtccgtcttctccctcctcgccccgccccgctcggtctcttcttggcggttcggtccgttgtgcgtgtttgtccttggctgggcgtcctgctctccggcccggctcccgtctctccgccttggggtctgccctccctcggttgctggtcttgcttcgtgcgtcctgggctccgctcgcgcttcctctgcttctcccgtcgcgctgcgggttgttgtctccgcgtctccgggctctggctggntgtgcgngttgtgtgggcgggcgcggtgtgtcgcgcgctcgcgctcccgttcccgttcctcgtccgcgctctggggttgtgtccgttcgcgcgttgcgtcctcctcgtccgctggcgtcgcgcgcgcttgtgcggtggtcntgccgttccatggttgctcttgcgctcgttgggtgtctccggtgtctttgtttctttgttttgctctttttgctgcttgctgtggntccggtccgttgccgctgcggtccgctcgcgggcgtgtccttcgcttccgctccgggctcgggcgttcgcgcgcgcgtgtgtccgcgcgcgggtgctcgcgcgtgccggtcgtcgtcttgtcgcctcttgtctgtcccgctcgtggccggcgcccggtccgtgtcccctttctcgtcctggttgtcnctcttgtggggtttttccctcctctctaccgtcgtgtgtgttcgtctttctttggaggtttttcttttttgctgttgtgcgggtgcgcgtcgggcgccgtgccgcgccggctgccgccttgct

SEQ ID NO: 14206 - DNA, 137 bp, Homo sapiens
catgtatggacaaattggaaatttgcaagaaacctcccatttttaaaacctccatttcttcaacttgcaagagcaccaagggccttatgagggtccatcaatagtaataaatctcataatgagcaaaaaaaaaaaaa

SEQ ID NO: 14207 - DNA, 221 bp, Homo sapiens
tactccaatggagagtacgagtattatatctgtagctccagcagccatcttggattagaatatgatggtctggagaatgtaagccatgtgcagaatgatacctacagacaagggactgtgtactttcattgaaccgtaaagctgccatagttgccttggatactctccttgtggacaccttttatgtgcaagaaaaataaactaccttgtttaagccaaaa

SEQ ID NO: 14208 - DNA, 299 bp, Homo sapiens
  misc_feature (1)...(299): n = A,T,C or G
gtttggctacacattctgaacaacttgnccccaatcaacagactgtatactgacaagtctaaagccaagaatgtagattttacatactcacatactactgaatcacacttatatgtaggcaacagcaaatactgggttctagaaacaatttgttttagagtatgtgcaatataggcctaaaatggagtgtttattaaatgttgtgggtattcagtccattgctgaaatgattttgcctgtcctattaaatattttctaccttataaaaaatgaggcaaataaaaaactttgaatgcata

SEQ ID NO: 14209 - DNA, 575 bp, Homo sapiens
  misc_feature (1)...(575): n = A,T,C or G
atttgttttatacaattaggtttaataaaattaagaaacgaaangaagngtggctgtccacctatgcagtgtatactgtgttttaagtgtgtcaagaaccacaacaagtttaagaaggtttagagaaggatgagaaagaatttaagttgcaaatgcatacttcacctgctgtgttatgacatgaccctagttattggtctggaggcaatgaatagaagcagaggtcaatcttgagggaaggaagcatcaacctgcgagccctttcagcacctctaaacaaggaggagtctcactctttcgcccaggctagaatgcagtgcagcgacctcggctcactgaagcctaccactccgggtttaagtgattctcctgctttaaaaatcatcatatgggaatcaaacaaacagaagaataagaggaataacatataccctttcttaaaaaaacatgggatattaaacgatatgaggtaaattatcccttcgagtcatatattttggcatctaatttatgtaacacctcttccattaaaagaagtactttttaaaaaaaaaaaatcggtctcattggcctca

SEQ ID NO: 14210 - DNA, 315 bp, Homo sapiens
  misc_feature (1)...(315): n = A,T,C or G
acaattatatcacatattagaanacacgaaaaatgcaacaactaggcaaggtttagctgcatcgtaaccttcaattcaacagccctgcgattatggtgaaaccagaattccggcagccactggaggggagcagaacaggcttggatatcattcaaagcctcattcccagagaattgtcattatttgaactgtttagtggttttctggaagaccccacttgcaagaatgtctttatttgacctgacctgctcagtgctaaaaatctagggacatttgttgcgctcaattaaaaaccattgtttaaaaaaaaaaaaa

SEQ ID NO: 14211 - DNA, 485 bp, Homo sapiens
ttaggcggtacgagttcctacattgatttcaacccttcttgaacctacccatgtggaaggcagaagcgctgggacatgaccacccaactcagctctgaagcagccctcacacaatgacggggactgcaaaaaggaaattctttgatagaaaacctggacagaaacattttattttattttttaacttcaggcagacaaaggcatgaaagaaatgtgcccttttgttgactgattgacagctccaaaccgaaccagaattttcaaaaggtggacctgatctcgtaacattgtaaattcagtatctatacggttcatgaaaattgttttcccattgcttctacctttattgtcaagctgtcaaaatagcaacttcctacttaagttatatttatgcaagcatataaagtgctttttattaaatttacttttggttgaattagatggactattttagaggaaataaatcatttgtataatggtgaaaa

SEQ ID NO: 14212 - DNA, 687 bp, Homo sapiens
tactacttattaaaaatctacccacagttcgaaaaacacgaaaaagttcatagttagctgtgatggattttcttcaaaatctggcatttcgtgcaacatcagtcttggtgctccattttcttggagaattttcatcctttctttatcctcaaaagtcttctggaaggagtaagaagaagctgcctcagaaactgtgaaacacatgccatgttagttctaattttagtcccagatcactcaattcagttgtgcagataaatgaattgtcacaactatttacagaaccaaattgagaacaatcctctcttatcctcaccttaccatcccgaatcaaatctgcctgggaacaaatctggtattagatgtttcttctttagtatgaaatcatgtcaatatgttaactttccacatatatcaatctgaagcttatttctaattaagcaatagctacaaattaaaggaatttaaagcatcactgcacaggcagcagaggttttcttctaagccgaaaccctgtgggaatcataacccggatgaaatataggcagcttggatttcctgctaggaaacccggctctatcattttcatggactgggccactttatcccccatgctgcattttaaactctctgttattctgagtgcacgtaacaaactagatatgaaacgaattcgtaaaccgaaaa

SEQ ID NO: 14213 - DNA, 1524 bp, Homo sapiens
  misc_feature (1)...(1524): n = A,T,C or G
agtaaacacggttgaaaatangacananagaggaaanaatataattnntttaatattatttaataaanaatataaataaagtaantagtaaattatggttgnaaagttagnaatcatataaaaaagtgaagnattttaatagagaactatanaacagagacgaaagaaagtgtgacatacatgacagagaactaatatagagtaaactgnagaacatatcatatgtcactgtcgatatggcgcagtacatagtaagagacactgcccccntcacccatagtacacagtgtatatggattgaagaatgaatgcacnttantggacacacaaacatgtatctaatcttactagcctgttatcatgtaggacaacagccacatnacaatactagcacaaccacatatacacgacgtgcgaancacaccacacactacatcgctactatccacacacacatgttctactctctanacatacagacccaacaaacacacatacatcgcattgcaagtgtgcgacgtnngtnagcgacggacgacgaataactgtaccagcacagatataccattattcatacatatatataatcatcncctcactatctactaccagtcaccatatgagacgcgattcgcctcacctcacnagagaacatgtcacaacgtcgtactactctacattatgcacatcaactgtatgagaagacgacaganaacttgatcgctacaataatctacactataagtggacaatcacgtataatgaaatgaatatgttcatatcaaatatatcgaccctcacacacacatactaagacacgcactcgacgacatgcaacactgcatcaactcacataatcnctcactacncaccangcgcatgctacacccacatcatctacagacgaagacacccnctccctctntaacattcatcatcntctcttatatcccgctactatctacaccctacgcacagatatcctactacactccacagtacaccactctctaagtcctcctccgccaccacacaccgatagcacaatgatcagtgcaatacgaatcgcactancatctagcacatgaccatagatagggagannacagacgcacacatctctaatctatatanacacgacagccatatgatcgaatacacatatatcactgagatatctaaccacacacacattatacaatctaatctataatccacactctcaagcacacgcgcagcgactccacgaagacgcacaccncgacacactcaagcgtcnacttnaacaaccatcagagctaccatnacgagtccgacagaatatgatcnacntatnacactcagatgtgccgantacctctcactacacanctcatgtcgcactagatatacatnatntacagtaataacgatcaatatgcaacctgtacagtagtactgcaagcaaaaaaacaccngagcgacacatacgtagtctaaatatatcacgacgtacgactatgtacaatagnacactacanagat

SEQ ID NO: 14214 - DNA, 525 bp, Homo sapiens
  misc_feature (1)...(525): n = A,T,C or G
cctangatgaaactaacagccagggtcagtggctcatacctataatcccagtacttagggaggccaaagtgtgtggatcacttgagcctgggagttcgacacagaagaatacaacgatcacctagtggcaatcaagcagaccatccgaagacaaaactccttatctgaaaaattgaaaagtaattagacttctctattatctaaagccagcatctggtaccaggcttctttcccaaaaatttataagtaactagaatttctatacatctccagaatgcatgaatgtcaaaacttattttgcaacccttgctaacatcaaggcacccaaagtctacaaatgtaataatttaccatgacctacataactaatatggtccaaattaccctaaggtcctgctttaaagtccgtaaatacccctaaggaaaatccaccgcaacacactcagtcctttttgctgaatgaagcactgtactgcactctgctgcagcattctatctaataaaactttcctttctaaacctaaa

SEQ ID NO: 14215 - DNA, 159 bp, Homo sapiens
ctcagaggaaaggccatatgagaatacagtaagaaggtggctgtctgcaaaccagaagagagcgctcacctggaaactaatcagccagcatcttgacctggaatttgtaccttccagaactctgagaaaataaatttctgttggctaaaaaaaaaaaaa

SEQ ID NO: 14216 - DNA, 787 bp, Homo sapiens
tttggggcatatttttaacaaatctggggaccttgttaacaggcagtgattcttcattgcctgccctcctgtccacactcctgcctactgccacccacaagggtcatcatgtctcaggatcaggagagtccacgatgcacacatgatcagcaccttcagaccttcagtgagacccagagcctggaggttgcacaggtctccaaggctctggagaagaccctcctctcctcctcccatcctctagtgcctggcaaaccgaaggaagctcctgctgctaaggcagagagtcctcttgaggttcctcagagtttctgctccttttccattgccgtcacaaccacctcatcaagtgaatctgatgaggcttccagcaatcaagaagaggaagatagtccaagctcctcagaggatacatcagaccccaggaatgtgcccgcagatgctctcgaccagaaagtggcttttttggtgaatttcacgctgcacaagtgtcagatgaaaaagccaatagcaaaggcagatatgttgaagagtatcatcaaagatgacgagaaccacttctctgagatcctcctgagagcttctgagcacctagagatgatatttggccttgatgtggtggaggtggaccccaccacccattgctatggcctcttcatcaaactgggcctcacctatgatgggatgctgagtggtgaaaagggtgtgcccaagactggcctcctgataattggcctgggtgtgatcttcatgaagggcaaccgtgccactgaagaggaagtctggg

SEQ ID NO: 14217 - DNA, 738 bp, Homo sapiens
aaccagcaagatgaaagtcctggagtttgtggccaaaattcatgggtcttacccacattctttcccatctcagtatgcgaaagctctgaaagaggaagaagggagagctagagccagaatttgagtcagggctgactccatttccacagccactgtgagttccagtgctatgcctggtagcttctcccatacctagtgaagacaaggatagatgttttatgtaacatttgcagaaggcagttagtgtgcaaggatgcaggtccagggtggggctggaggaaaaatagtatatatcatctatatccctattttgtatgtgtaacttgacagtttattcttttattttttaatggctatattattcagatgatgtttcttttaatagaagtttaggtagtttccagatctcttaagttttgaataatattggtcatccatttaatgtttttcatgaggttttgtggcatatgttttgctgattttgtagaacagattgggaaaccatctatattgtgttctgatataggatgacatgacatcactaagaactctgcttttaaatatccgtttaatgttttgcatgcagtttagtagcaaaggtttagttatttttgtaaaacagattatgaaaaccatccatctatattgtgttctagtatagcatgacatgacattgctaagaactttgctttaaaatatttggaataaaaaatagataaaagatgaaaaaaaaaaaaa

SEQ ID NO: 14218 - DNA, 790 bp, Homo sapiens
ctaggttttgcaatggaacaaatatggttgctgctgcttctaacattagagtgcttccggggtctgctcagttcaacggctacaactgtgatgccaacctccacagtagatttcctgctgaaagagacatcagtgtctattgtggagtgcaggctattacgatgaagattaatttttgcacggtacttttctcgggttattcggaaacagatctggcactgaatggaaggcatggggactcccactgcagagggttcatcaataacgacacctttccagcagtggtcatttttatcatcaatctcagcaccttggagggctgtggaaacaacctggtggtatccacaattcctggagtcagtgcttatggaaatgcaacttcagtgcaagtaggaaatatttcaggatatattgatactccagacccaccaacaatcatcagctatctacctgggcttctttacaaatttagttgtagttatccattggaatacctggttaataatacccagcctgcttcgtcctcagcggctatttctgtgagagagaacaatggcacatttgtcagcactttgaacctgctcctttataacgattcaacctacaaccagcagttaattatccccagtataggattacctttgaaaaccaaagtatttgcagctgtccaagccactaatttggatggcagatggaatgttttaatggattattgctatactaccccatcaagaaacccaaatgatgaccttcgatatgatcttttccttagctgtgacaggaccctcag

SEQ ID NO: 14219 - DNA, 713 bp, Homo sapiens
acttggagcccccagagctcttctgacagcgcggggctcttctgctggtcccatcattaatggaggtgatgagactccaaccaacaattggcaacttggttctcccaagtatgcctcccttccagctgaacgccatcaccagcgcactgatatcaggaatggtcattctgggagttacgagcttttctcttcctctgtgctcactggcccttctgcacaggaagggacccacaagtttagtgttgaatggcataagaaacccagtctttgactgactataacagattcctgctctctggagaaggcttcgctgactaaactatgtgtgactgcagtcagtgttccgtctgaatttcatgtcagtccacattcaatatttgtaggtttgataaatttcacagtatagcttgtcagcataatgatagtgaaagaagtttattatattgctattgtcacttatgtacgtggcgagccgtatttttatgccaccagtgaatatattgacaataagtgaaaaatattcaggacttagggcttacaggatcagtaatatttcattttatttcagttttcttttgattgttggttaaaagataaaaggtgggagtagacaaaaaatgaaatgtgttgcatttcccccttaagcattaatggcatttagatttgcacacgtggtcctagaataaatgttgctttttgttttaatccggaaa

SEQ ID NO: 14220 - DNA, 384 bp, Homo sapiens
actcctacccaccgattacgtagttgtcatacacaactactcatgtccatgctcaaattactcctgaagggatgaggacaccaggatatgccaccggaccactgaagagattgctgttttctgccccaggcctgtgccatgagggacactttctcaggactcttgccaatcttttctgagagtacctggtgagctctgttgtgaattgcctgtaagtagataaaaattccctttatattatcctcccgaaaggtttgtataatctagcccacattttgccatactaatttagtaactttagctaggttcttcttactagtgatcagctgtgtctgccccaaatccccaaataaacaagggttcatgtctcgaaaaaaaaaaaaa

SEQ ID NO: 14221 - DNA, 724 bp, Homo sapiens
  misc_feature (1)...(724): n = A,T,C or G
ccccaatgtagagccgggggtttttgtgtcccgctcctcgcgagaggngcccgggggggcaaaaaacactgggggggaggaggggcccctctcagggggggggggaggggggttttccaaaaaaaaatcccctggggggtggggggggggggggtttttggggggtcccccccccgggggggggggggtggccccccccccccccaaaggggtgtccgggaggggtttttttttggggccctttttttgttgaaaaggcgcccccctttttagggggtttttggggggttttttttcccaaaaggggggggggtttttttgggggggtttttttttttttttaaaaaacccgggggggggttttttttaaattttgggggggggggaaatccccctttggggggggggggttttttttaaggggccccccccggggtgggggggttttttgggtatttccccagggggggggggtttttttttttttccaacattttttttttcccccggaagaccccccccccccttaaatttgggcccggcccccctttttcccggtttttggggggggagaaaatttttttggtttttgggggttttcccccccccccctcttgttttaagggggggggggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 14222 - DNA, 487 bp, Homo sapiens
agataatgaaggctactataagtctttatagattcaacatgcttactctcagcatcacccaggatgatcttgtacagtacaaatcagaaaatgggatattaaggaacatggatgaagctggaggctattatccttagaaaactaactcagaaacagaaaaccaagtactgcatgttttcacttataagtgggagctaaatgataagaactatgaacacaatgaagcaaaaaacagacactggggtctacctgaaaagggaggataggaggaggaagaggagcagaaaaggctgcagtgcagtggccagatcatggtttactgcagtcttgacctctggggcctcagtgatcctcctgcctcagccccctgtgtagctggaactacagaagtgcttcagccatgattgtaggcttcctgaggcttcccagccatgcagaactgtgagtcaattaaacctttttgctttataaattaaaaaaaaaaaaa

SEQ ID NO: 14223 - DNA, 365 bp, Homo sapiens
  misc_feature (1)...(365): n = A,T,C or G
cacaggcgagaaaataactttagcagtatagacaagaaaggaggctcagnaaaccacacaccccgttagcgggagaaaccattcctggaggctgcaaacaaagaagcccgtggtgcaggaggagaaacccaagagagctgctcagaataatcatctttatgtgggattagcgcacctctctgctcaagccatggcaaatgttcaacgacctgctgcatcactggtcttggctcatttcttacctacaggggtgactctggctcatttttaaattaatctgtactttggaggatctaataaaagagttatttttgttttaaaaaaggaaaaaaagacaacaaaatgggcctaggtgggctcagcaa

SEQ ID NO: 14224 - DNA, 1258 bp, Homo sapiens
  misc_feature (1)...(1258): n = A,T,C or G
agaaactttngggnggnggngggggggccgncgaacacaaacaaaaaaaaaaaaaaaaaaactaaaaaaaaaacaaaaaaaaagaagctcgcggggggccnaacggcccgccgcccacaacgaagagaaaaaacacctttcgggcgcccgccgggcggggcccggagaagaggggggcccgcacggcgcaaaacacacccaccacaagcccccccacccggccacaaacaacgncacaacaccaaacacacacgcgcgccccgaacgcccgcagaaggcacacaacaagaaacancacgcgcaccnnccacggacgggcgagcgaagaacgcgcggaagagaaaggggaacaccccgacgngccgaaacacaggaagaaacggccaagagnacagacacaagagccgcaaagagagacgcgagaccacaaacccaaccggaagacgaggggaaagaggagnccccagaccgaggacacgaccgcggacgagcgacaaaccacccccgaccggcgccgacccgcgcgncacaggcccncgcacgcacaggaggaacacgagacgcgacagccanncggcgcccagccgccgccgcgcncacgccaagcagcgcacacccacaagacgcagcacggagcaccaagacgaccaagagncgcacagangtaataaacagaagagagcgnnacacancnacaacacaacaccgaacagaaacaagagagaagcaacacaaggncgacgaacacgcagagcaagacgaatagagggagaagaaaaggaagagaacagacgacgnttagagaccaccaaacagagaacgacaacacagtaaggagtagaagagagagnatgagcgaagtacagaacgcagactaaggcgcccggcccgtgcgcgagggccacgcgacgacccaaggccgaccccaccataccgaaaaagcacacggcagaaaacaagcgagagaagaacggagacaacaacggaccaggagggtagcaacacagagagaggtcgcgaacaaagncacatgcgagacaacgtcagtacacaagagaggcgacgagaatgacaagcacaacacacacaaccacagaaccaacgcgaaacaataaatgacgacaagagctgaataatagtgaaggaagaaggcaacagagagcacaagaacgaggtgagaagtagagtaagtangannngacgtaaanggagagaaaggaacgaacaagagcgagagtaacaagagaaagaagaaagg

SEQ ID NO: 14225 - DNA, 355 bp, Homo sapiens
  misc_feature (1)...(355): n = A,T,C or G
agagatgccaaaaatggatccaaatctccatgaatctgntaatggaagangaggaaaaggcaggtnacttaagcaaaacccaaatggaccaaatgcaacgctgatggaatctaagtgctcagaccaaggnacggggactgaaataacagtggacaccacatggcatgatccaatcagattgagccctggaaagatcatcccatggcaagatccagttagattacacttcctggcatcacctcattgcaagatccaagatcatgcctcattaccttctgcctgtaaaacctgccccagcccccagctccaggagactgatttgagccaggctcctgtctttctctgcagccttgca

SEQ ID NO: 14226 - DNA, 285 bp, Homo sapiens
atacagcacatctcccctttggaggatgcaccaacacagtgccatcatggaaggagagatagggccccttatcagacaccaagactgctgggaccttgatcttggactctcagcctccagaacttctcagcagatgatcttatctcctgctacatctagaaaatggaagccatcagactccatcttctcaccactgaggctacaaaagatatctacacctgcaaccctttccctttttttcttcttcccttttgttatgatgtataaagtgtcccttatcataat

SEQ ID NO: 14227 - DNA, 825 bp, Homo sapiens
ttctctagcaccatcccttcgcgcaagagacagagtgattgagtataaggagtttggtaaaacctcttaacaaaacttatggacaccatggatactgcaagctcttctaaatggagaaaaatggtgtcctctcacaactgcagtttgaaaagttccaggagagaacttgattggcctgacttgggtcacacacccatcttctggacctaacgttctggcaaaggaagaaggccatggtcccattcagaacacatggctggtgaaagaaaaggtgaaatcctccaaaggaagacggaaaaacggacttggactttgtaggaatatctatcaagactagagtctctgccaagccagaattcttttggttgcaattgacaaaacccaaataggataagtaaaggaattggtggggtgttggtttatggaacccaggggcttttatgaacctggcctcagacactatggaattcagccccccatatatcatcgaaattctctgttctttggcccccacttctgtctgcattggggcctcattttgccaaacttactacttcccctcatattgtcttgcccgctcgctaacaccttttatactcactcttctcccgtttttcttataataaaaaatttatggattcctatggtatgtaccagctaaagtcacggagcatcgcagattacactaaaatctccacctcctgggccggctctctgcttctctggcgctttttcctctcgttattcggtgtttctgttcttgcttttacgtctatccgtatgtttctctatagtctatacccctttgtctcttttgtgtttttg

SEQ ID NO: 14228 - DNA, 754 bp, Homo sapiens
ttcataagttattcggcttggaggtggcagtgacagagcttcacagaaaatgtttttcctcagttggaagtctgacactctaagaaataaagtgctgtgtgacagacccttaaccaaggaagagtccagaggacttcatgatgactcagaagcatatggacaggtacctcctcacaccaggagacctgtctgtacaatagtgagacaagtggagaatttctgcgcctacgtttttcccatttcaaaaagagtctggcattgattacattctgtgatcgaaaagagttttgtgtatgttcttgtccttgtcaggatcacagataattcattctgcagagaggcggtgactgtgtgcataaactgggtcctgttgggatatcatgtgcctcacctgatttgaccctatcacaatgctaaagatgccaatttaactctgaaggacacatctagacaatgacaaaaatatatgccttcacacggtcagtgcaacattgggacagaaatattggcacacacacttttctgatggaagaattcaggtcaagtttagattagagccactggtgatgatgaaatgccacgtctgaaggattatgcggttacgatccaatggacgggtggtttcttcgggccaaaacccctccgacattttacagtgttttccatcggctaaagaacttccgccaccgccgctcttttctatcgcggggttgtagcctcttggcacagggtcaataaactcgtttacctttgt

SEQ ID NO: 14229 - DNA, 896 bp, Homo sapiens
  misc_feature (1)...(896): n = A,T,C or G
ccacggactacacctcaagccttctctccaggataccagtaactctggtatacccatctgccgcctggctggagtgcggtggcactatctgggatcactgcaacctctaccttctaggctaaagtgatcctcacacctcaacaccctagtagctgggactacagacacgggttttcgtcatgatggccatgctggactcaaactcctaggctcaagcaaaccagcgcgctctaccttccaaagtactggcattgcagcgcctgaaccacttgcatcccgccctatgcgaatctctatataatcctctcagaggcaatatttatacatatctccaccctaagactaacgtttttccaagttgagtgtcattctcacaaccctctgccgttatcgtaataacccggatcattttacgctatgaattaactgtcaaagacatagcaaagcttctgtcttaagaaagcactctcactccaccatgtcccactacgcattcaccgcaccaataaatcctctccctaccggaccaaatgacctagccgcanccacagaagggcggtaaaggctcagtgagtcgctgcgccgcgaagagccattccttccgcgtggcaaccaccatgatggagtagccccgcgttaacggagccgtacccatatggccagtagaaagaagaacaaaatcccgggaagttattacataagttctataatcctaccaatcacaagtgagaagtcccggtaagtcgtcatacgggtgatctacatgacccggagaggaaatgtgatgaggcntctgggtncattaaatgggcaaggcaanagacaatggtcgggtccnnatgtacgtaatgatccgtaggttcatcaaccacatagacacactccgaccccgtaac

SEQ ID NO: 14230 - DNA, 736 bp, Homo sapiens
  misc_feature (1)...(736): n = A,T,C or G
catatttaaaatgggaagccaatcctcgcctaccacacccttacaaaataaagggtgacatagnnnagtacaaatatacctagacaaggagggcactggagactcaaaaatacaaacataaccaaaaagaaaaaaataaaaacacaaaattaaccagaaactaactaaaaaaaagaacggatttaaatacggaataacttctacagatgagaagggcatctanaacaaactcgagaaccggaaaagaccccagtacaaagtaccaaccacggatctgcatagaatcagtgtcaattatttnnaatcaaatatttgcaaataacctaatttaaatatcatnnngaatatcaataagacaatagaataaaatgctaatatcctctctacacaggataggaatattgatgaatgctcacttcactgaaganagaacaaaatctttattaagaaggtaagaagattctcagtttcaggcctggcgcagtggctcacacctgtatcccaacactttggaaggctgaggcaaactgattgcttaagcccaggagtttgagactagcctagtcaacatagtaggacccgtctctataacaacaacaataataatacaataaaataataaaaatcatgctgagctccatcagtacacaagcacaactttgattaggtaccactgcaccagagggatcaaatttaaaagtctatttatagtgtgttgtaaaaaaaaaaaaaaaaa

SEQ ID NO: 14231 - DNA, 787 bp, Homo sapiens
aggggaacggctggggcacacagtgagaagggggccatctgcaggcctggaagaaggccctcaccagaacccgaccatgctggcacactgacctgggacttgcggcctccagaactgtgagactgtttaagccactgagtctatggaattctgttatggcagtcagaacggacaaataccatcaccaagctgcaaccaggtggttctggttagtgagggaacaacgaacaagctaacaagtgaagactctactcatttgttttctccagcatctaggagattggccatcctgacagacactttgaaagaaggaccctctgagaaaggtcatccgtgggagtctacatgtgggcatgaccagttttggctactgtaggaagcattccatgcatcatggggtgggggtaggccaccctctgaggcccatgtccaggatgaggcccctcctctctccatgccagcttctgtttgcacctctgggcaatgacaccagaccacgaagtccttttgttagagatgggaaaagcaaattcggaaggatgaaatccttgaccttaagaaaggagcagcatgggccttggaccacggggccttggattggaagtttttcctggtgggctctgccaaaagagaaaacatcccccacaggggtggattaactctttatacccttcagctggggggggaagatgaccttttactctatattggctatcacctggcaatgggagttaaatcccaaaatagcaagtgtctgggtgtatttgaggggaattgttcaaagaat

SEQ ID NO: 14232 - DNA, 1354 bp, Homo sapiens
  misc_feature (1)...(1354): n = A,T,C or G
aaactanacatcaaactacggannnngataccacaatacacatactgangnagcgcaagtacaagacacgagtagaaaacaagagaaggangagnanagatgctgtnnngangtatgtaacataccatcatatataggannagactatctagtgcaccaatcgtgtctacgagagctgtcgtagctatgggnntcgatacaggacagcgctcgagagctcgtgtgaagtcangtagngngacactagagcgatatagaggaacacagagttaatcatgtcggagcataangacactaccaacgtangggcatggacgataagatngaaaacacaggcaagaggangcagaanacgagacaatagaggagagagtatggnactagaagaacatagtgaacactgcgngagaagatgggacaacaatatnnaacaacatgangatcagctcagtcaatatacatagtctacagcatactcacacggnnncatacgccgactcactatnnaaccacataccataaccactcnactagctacacacccacacagcacacccacaccccaacnnnnnnnaagaaacagaatnacactacagtactaganaggcgcgacaccgttgacagtgagcgctatcgngtaacgcggcgcagtgcgngagcagcagcttaacgacgatgtggacactgtgtgggaacagtatctcagcatagcagtnaggnnnnnngatgagcaactacgagatgagcgagnaataggncaacagatcagaagaagaannncacaagcagancatagaacttgtnaccacatttncaacatgtatactgcacacatgttagtcatataaacgacnataatagtntaatacaactaaatacaagnaactagacacacacacgccacttctatnnnncacaacacacaaatataatatnacacatacatcactactctacaccactacctctcccnaccacttaaaacaaacactacaaaacaacaccaccacatccatatcccactccacaacctnnccaccacanccactcccctcaccttctcacacttcacaaacaaancctccatcacattttctatcctctaaacanagacacacaaaaacttantacaacatccatcatatacatntactaaatacttattnnncccccccacnccacccccctccctcctaaccncnnnacccnnnacacacaaaacacgataccaccctcttntcaaccnncctttcctcttcttgtctttcctttccaacatttcttttnncccataacaacaatacccaaaaacatnnaatacataataaaaatatacaatttataatataaaaac

SEQ ID NO: 14233 - DNA, 1742 bp, Homo sapiens
  misc_feature (1)...(1742): n = A,T,C or G
atagtatatgtatacgttcnactngngnnnnnacgtnagcgacatcgttaagtactagntatatatgntatgcaatagtctaatcatgatgacagcgtgaggaangngngtgtaggtnngcttcagctgngnnngnngtatatcatccactagatcgtatatatagttgtgtgtgatcgtntactagatntctgtgnagcacctactcgtnacattcgactcgtaactgctatgtattgggacgtgcgtggactgatcgctcgcgagcgcgtggagtgtatggtgtntgtagagcgtatgtgtganganctactgggagaagtagatnggnggagactatnggatcgactctgtatgtacgtcatgtntngatactctatacctgtcagngncnacacnttcatcgtagntcngatgcagtcagtcgtgnggtcatgcagangacagagacgcgcatggtagagcgctngcggtagtgctgtcgcgngngacatgcagtgcgactcttaggcgtangtagtccgcannngtgcgtacagtatgngatacgtgtatngannggcgaacgagcaagntcacgagcgtntatatttgagtagngaccaataactgctctagcaanagatntcgcatagcatatanntgcgcagtacangactattagcacattngngnngnccacancgcgcgaactacatctagtntgngancgcgtcgctcgcaacngctgtnaactatctatcgctgntgctattacttgatgcatnnnnngnacnanagatccgtgtgagtanatactgngtanatgcgcctctgngactctgtgcgagtatatgtgtcgatggaggtgctacgttagtgangngcatatgtgtgtnggctggtgggtgcgantatctgtcgttgaagcgctgttgtccgagctagtggcgttgcgtatgtctctacgtctattgtatgtggtgtggtggngngntgagagcgtgcagtganacgagactgagngagagcgatggcggaagcaccacgggagcagngaaggagagagatatttgcntgatacganaccttcgnggctatcttgtgncatctcgttggacctcacgttcagacgcgttacgcatgcggcttgagagcaatatgacgcatagagtagaacgactcgagacatatagaggctatgatatgataatctcctnnnntatatatcatatctcatactagtacatntgaaatnattnttctatctantncttctactntacttatacatntcctttctctatnntctaacatatcaactnatcacatncacangcactctcacacttctgtcttcttcttatatacattatnnatatataacaagatatagagantatccactgctctctcacttgtcgcctactctcattctctcctatccgactatcttctttnccacacaatataatattannnnatctactccatcatcatctttcaatnnaactttatttatactattnnanagatacatatactaatcttatatatcaatatacatttatatataacannnnanattatatgtatactatagcgtcctagtgcatatntctatantnaatctntctgcnccatcgcctttctcnccactaaatcactncttnnncacttatcttccttactacactcataatntctttnnnaatcatctataaaatcatctcttaaccattaatcatatcttttaactaaat

SEQ ID NO: 14234 - DNA, 753 bp, Homo sapiens
aaccccctgggcccggcccacttgtttttatattaccatttaaccttaaatgttagaggggttggtatttttaaaacaaggattcaccagccttaatttacttttttttttttttttttttttttttttgtgagacagagtctcactctgtcgcctaggcgggaggacagtggtgtgatttcggctcactgcaacttctgcctcccaggttcaagggattctcctgactcagcctcccgagtagctgagattacagccatgcgccatcacacgttactaatttttgtatttttagtagagatggggtttcaccgtgttggtcaggctggtcttgaattcctgatctcaaatgatcctcctgcctctgcctcccaaagtactgggattacaggtgtgagccaccacacccaggctcatttacgttctattgtatgtcagtccagattctcatctggaagaaataaaaacatattctgactgatattagtggaaaatagattcatgaaagtatttgggaggctcgcagaacctcctggaatgctcagaactaaaccaggaggctacatgcccaagagcaatgttccaaagaccctctacagcatggagaagaagacggcacagctgatttccagatgtggcttgtgctgccaatgcaaagaacatggactctcaatggtaccaccacatctgctgtccttgctatctctggaaatccaaaataaatgcaaccaattctgaaaaaaaaaaaaaaaa

SEQ ID NO: 14235 - DNA, 1037 bp, Homo sapiens
  misc_feature (1)...(1037): n = A,T,C or G
gggggtcccgtgtagcaccgcccggtggcacctccggacacagtgacgacaacaaacccatacagtttttggtgtcgttggttttttatgggcatggccacagacgccgacgacacggatacgcgagacgcagagggcctctgcggcaccccgaaaccaccctaccctgtcgcgcgccactatagtgaagtatcggtattattccatcaataccaccaggttagtatggaagtgaatacataacagccgccggactcgtcccacatcaacctcacatccgtctcacgtccccccgtatccaccctgcttcccccaccgcctcctcctcgcgtccatcatactcacaacacactcccagtttgtcgccccaacgttattatgcatcagtgtggcctacgctcctcgctcttacccacaccccacgaaccccattcagtctttctctaaccacacccctagggggtatgaaagtttggctgctnctccaccgatcagtccgcgttctccccgtcctacccgccacatccgtctaaactacccagcacggcatcatctgcgggtccagtcactattcgcccagcgacccccctggcgcagcgccctacggcttaacccctgactttccccaacagtccacccttccactatttaccccgtgccccagtggacccatagccgcacaacgatatggtattccattagaaatacgcggcggcgcgcatgctgtcataagagacgggatatacagtgacccttgcatgcaggcgactaggcatcataagacacacatctctcattttcggcagccagcacgatcgcttctatccgccgccaatacctcccgttgcaccagtgttatcccaatgacgccatattcgaaacgcatccctgccaaccgccgcgttacgagaggtccagcgcccacgcgcacgcccgcagcgatccgctccttatttgctgcgtcttcgacctgagttgaacctagagccaattcatgacagtacgtcacctgtcacgtaattctgcggcctgcggcc

SEQ ID NO: 14236 - DNA, 833 bp, Homo sapiens
  misc_feature (1)...(833): n = A,T,C or G
tcggagtttgcgcggccgcgcctctattccgaggacaaacgaaagctcganatctacctctgtctccatatggatggagcgcagtgccatgatcttggctcactgctgcaaccactgcctcccgggttcaagcgattctcctgcctcagcctcccgattagctgggattacaggatgtcccagtggacctcaggtccttcctgtttgctgagcttgtgtttcagctgcctttctttcccactgcaaaccctgccttcttccaaaagctgccggtagatccaaagccctgcagacttctactcaggttgcgacatggcaacgtgaatgccagtactctccacatttctatttgaggatttcgcaaaagctagtggcttccaaggacaaaggcctgataccgtgcacgaaccattcacccttgcatctggctgtgcaccttactcacacgtccctttcatatgtctgcgttggctgttgaagaactcctactgcaagtttgccagtgtggggagaaaagaaagaacatgagggaaccaccccctgatccctggagggaagcccccagggtacttgtctgcgggaccccatctgaggaaaaccgcttagaacccttttcttaagtagcttttgaaacacacaggggcgatgctggtgggagaaggagatttatctttccttcttcatggcacttgggaccgacatcttcatcttcgcgtgcgcgtttccgtcggccgtggccttttgcattagggttcatgaacccatatcaattcttgtgctcctagccttcggtcccggtgactgcttcgaacagtcgaaaatatttctcgacg

SEQ ID NO: 14237 - DNA, 1032 bp, Homo sapiens
  misc_feature (1)...(1032): n = A,T,C or G
gtacagtgctaaagatggctgttgcgtggtcgcgtcggcgcaaaagttgctacaggcaagctctgtgcttgttggcccatggatgtattgtgaagcggcactcacctcgcttgttactgcggaagactagcatgaaaccaaatagcatgatttccacccagaatgcccggctactaggaatcacctctgttcgttctgcgcacataagagtcgcgtgctacgcgagatagcaaatatctctgtccttcacacgtcgcagtgggtgtctagggatctgtttaatgtgttgtgcttnctagcaggaggtcatccgttcacagtgggagagtggccgttgttcacgtctcatacctgaggggctagacccgaatctagcgtagcgtgcgtttaaggtgcatttggaagggcatcgaaaacgttccctctccaagcggactggctgtagtcgatgatgttgtacatatgtggtgctggccgttcttccatgcatgcagtgggccagtgggatcccaaggcgctgagccaatttaaaggatgggcgggtttttaggaagagacgagtagtgtcgggtcagtgggagacgagtccgattggggctaggccttttttcgtgggtcctaaagaggagccgaggaggacgcaagcgccccgtaggtctgtgccccggggagggcgaagagtgcacaagccaggggtgcgcattgtgttttaattctccgtgtacggtggcgattaggtttaattatagttgatgaatgggtggaattgattgtgatataaaaaacagggaggaagacttttgtggaaaaaatagtagtggagttggtttgagttcatgtccggcgggctgatgctgaagtcagaggaggcgggccgcaggcgagtcgacttgtgacgtcaccgtgcatcggtctctacttacaagtgaaagagaattcctgcggttgtccctggtatggggtggggancttgtggagggctggataacgtgcnagctgtgaggccttagggatatgcacagtcttaagagt

SEQ ID NO: 14238 - DNA, 1415 bp, Homo sapiens
  misc_feature (1)...(1415): n = A,T,C or G
ctattagaacactacattctngannganaacacggatctacaatatctcncanngacatagacgngtgtagtcagtgaacgagatgaggtggagtgngtgtnngngctgtcattangnngctccatctagattatcgttattattgtactantcaacttatagtgnanacgcacatgctctcctcttagtgtaatantgaatantnaaacctaggacagacgaccgcatagatgtggagatctcgccgtgnggtcgataagacgagagaaggagncacacgcggcgtagagcgacgagcgngtgggacatatggacacggttagatattgatctanatgtggagaaagtgggtgagcggagacgacagaggnaagcgtcgacatcgcaggnngaagagacgagtatcgtgcaagtcgncgaccaggagggacctgcttggaggagtgcgtggcagcgcgctgagcnatganggaaatgcatcactggtgcacncagcggcaaacggcccagctgacgtcnggacacacgagaatcctttggtggaacacataataatcgtgacgctgacagtacacatagtgaanaggnnangatagtcagagggtggcgagtgcgacggggnngcggcggcgtgacagncctaggtnagcatggcgaggagataatgctgtgacttatggnnagtagccatgagagacgacaaattnnaacgttaagcggactcgtgtcctataagacgactcgtgtgtgggggatggagatatcgaagcgcgtgggnagtcagcggcagttcgggaggcngaagagaaagagacagacttacgtactcgntacaactcggagacgacacttatgtcanacgagcagaatcgaatgcgcgngcggcgggnggacgttagtgactcgtgagcgccaatgcacgctaattaactccaatngncacacttaaatttaacttatcttcaaacaattgtcatatctatctaacaacaatncaaccaccaagnnnaaacacanacatacataatactatgcacaacataagaacaacatganactactaaacatgtnggagccctccatttactgctctgggtacaaacattgaanacttcgnacactacgtgtttatannnttagttatcctatannnacaatcccatctttctactaacttacaattatactcttttnncctaataactctcccactccacaaacaacactcacatnaaacatttcnnnnctcttcctctcctcgttctcccttctttctncaacatatnncctcttcctacncttgtcatctctcnncacaaaccattaatattnncccattaccacctaaataatcaaacaaactnnnaacaaaccataactancatattaccacatcaacaaactatacaaaata

SEQ ID NO: 14239 - DNA, 544 bp, Homo sapiens
  misc_feature (1)...(544): n = A,T,C or G
ggcgcccaccaccacgcctggctaatttttttgtatttttagcagagacggggtttcacagtgttagccaggatggtctggatctcctgacctcgggatccgcccgcctcggcctccccaagtgctgggattacaggcgggaggcaccgcacccggccttaagtacattttttgacatgtttttaacttattctgagtttgatggggacataattccattgaaatttgaggagcatctggatattattaaccttccatggttctggtgattcaagtgccatcctttgttctaagttcttggacctttggaatatagccataaggtatctaatatccttggttactaaatcgagtattcggaatatttctggggcagtgtcagttgatagatgttttactaacaatggccttttttttttatntgggaggcttggaatggctggattaatacccaaacttgtggattatttttaatggggggggctgcgctcctctcctcttttacaaaatacattaaggagtaggagaaacggcttggagatct

SEQ ID NO: 14240 - DNA, 1657 bp, Homo sapiens
  misc_feature (1)...(1657): n = A,T,C or G
ttgcggnnggnnnngcccaggccccgtccccccgccccacccccgcgacgcccccgcgacccgtcgtgtttcgctccaccgcctagagttgtgtatccgccactcgcagtgcccctcccgcgcgtgcggnggcgcgccgccgcacacctcgcgccacctgttgcngtctatcgccccgcttagatgttctccggtcgattgccgcgcgcccnctcgtccgtgtcatagagagtccgcgacagccaatagcattaccgcccagcgcatgcgccgagtaacactatacatatctctgattctcttatgtatactaatttatattgatcatataagtaaactatatgacaccctcattacccgcgaactggacgaagcgcggcggccgcgccgctctttttgcatctctcgctcctcccagctcccatgtattagtatacacacacggacagagaanagaagaaggcccggcctaacagtgagagtgtaanagtgtagagtgnagacagaaagagaanatgangatagagatgaaatacagacactctcatcgcacacgaccaacagtactagacaatcattctataatgtattctgattctccattatatctattattctcctcattctattccacacattattctcccacacccgatacttccattcgatcattccgcgccaatatttcccacccaccaacttacctactaattccaatttatataccacgatcagtccacctcgcctctccctcccgtactatcaccatcgactttatcatatccacatctactacatgagtcgctacattatattaagctcgataactgttantatttatgaaggatatttatcttatnactcaatactcaagaggaaataacgatattagtctgcctcttggaagactgccgcgtccagcaagaccattgtgatatcccactactacgacattgatccgagactgagagatgtgtgtntcgtgcatcaggcggcggcgatgcggcggactccgcggttcgtagtatagctcgttctgactctagtacgaaacgagacgcgtctggagatctgattctgtcggttctgcgtcattgacgatacgcgaggtatgtatgtagtgtccgtctctctgcctgtttcgttcattatagtagatttcattagataggtgttacctgagtgagtatgtggatgangagttcgagctgtgatattattcacgagagtagcttactattacagtccgtctctcttctcagattatttcacgctatagccgatgtggcgtgcagacgtatggttaaccagcttacacatgttatatttgtcgtgcagtttctatctctcctctgacacgcgacacatacacatcaatnantgttggtattcagagatacgacactattcttatgatacacgagattttatnatgtgtactaggcatcgagcgactggctcttcataatgagtattcatttcacgtcacgtgatcgtcgacgnctaccantattcactgtctcgcacacctcacctctaagtctattgtctacgttcatagtgtctgcgagacgntaaaatngaagtagtgagcngcgagacgtcgatgtttagtgnggtgtgtgnatggaanatgagtgtgttggaacatgcaacg

SEQ ID NO: 14241 - DNA, 812 bp, Homo sapiens
ccgctttctcctcccacattgctcgtcctcgtcccccgcgtgccatttttccggtcaaaccagctgctgaagacgttgttcctctcaaggctttggcacttaagattcaacagtaagaaggattgaagagtgaaggcttcctggctaccccgtggcatcctgtgtttggtttgaagcgtgataagcctgggttgctcttccagtccaccttgtaagagactgatgtggaaaaatgtgtctcttctcaagggccaactctggaagcttgggaaaatattctagatttggatcacaataaaatgggtattagacctaggttctagttccatctctaagatctggatatgtcaaaatccttttccctttgtaggttttaagtttggcctctttaaataaagaaacaatcacccatgctttggattttaacttgctacttaaaacaaggagccgaagaccctggccattatcaaataactaatggacaatttccactgccttcgtgtaatttgcaggctgactcccatcatctctggcccttttttttttagcctttggctggggttgggaaactggctttgcaaagattatgagagggaatctatacatggccaactccatcttgtgttttagccctctgggcctggcttcccttgctcattcctaagcataggccaagctaaccatggggaggaaattagtttataggttaaatcttgaagcaaaaatgattcttttttatccccaaaacagaccccttccttgatagggctttgaatcccctccggccgaataatgaatcgctacaaaattgg

SEQ ID NO: 14242 - DNA, 1686 bp, Homo sapiens
  misc_feature (1)...(1686): n = A,T,C or G
acatctatctactaatgtatcgtggnaagatggacaatcacactctcacgnnnnacacacagacntactcgacattatctacntaacaggacnanngngcaggggccaccacgtagngnggcagctcacaacacctcngagcaccacgcctgcgatatcggccgagngctgatatagagtgtagtagcgcaatgactgtcatatagtctgatagatgagcatcacgtcttagtgggtgagtcggcagcgtcatgtagngtaacatacagagtgcgacaagagnacatatgttaactcgctgatacgactatgatgcactatcatgacatctacgaactttacagacaaataatgncacatagctancacaatagcgcacaataacagtaaacagatacgacggccacgcacgcgnngnncacgcgtgcgatcngtcgcggtgctcnctgcngngatacgaatngagtactgcgcatgacgngagcaagtcgtgatggtcgagagagtctcgagtatgactgatatgctcacgagtcgngactatgtagcgangtatctgagctacgtccgtcgannngcagaagcatagtagaatacanatgtggnagaacacgagacgagagctcgacatactgagganngcgacactgagagaatgngnnaagnagcgagagtgatgagnggacagaattgnggaatatgtgtanacacaggtgagcgtgntggagatgcatcganagtgatatgangtanagcatagcgtgtgngcagtacgcgngnngcggcgctgcgaggngatggcaaatggtgngtagctgcgtaccgngtactacgatactctacnggngttgagcggcgacgcgtgnnggnaganacaactcgtctagtanataaatactgagnagatgcttcagtcgacnctgagtgtatacgaggcaggagngnacagctaagagagcgcgcnatcgaatgggtggcacgtactgnagcgcgtgagcgngactaagatccgtacatgaaganctcttactngtgcgttgcgtcgcgatctgtngttctacatgtgtnctatctttnngagacgcagttgacatgataacgaacacatctctcgnnnntatatganaagatatacanataacatacgtgacacatctatctntnatatctntgtaatnttataatattaatttctacaatcgcaactgagcnagctctaaatcatatcaagaccacataacgctancaaacatagtaaatacataggantactatgacnaactattgatttgtactcagntgcgggttggtctttttgtctgcgtagtangagcagctgcctagacgcgcatgaaatgattngcccgtggtggtatctgaatattnnangattgaatctactttctattanatgntncaactcatagattgtctccatnncnatatacaataagctgtatagtacgtcactatgcgaatctnactcaatctnnnagaccagagtacagtgtgccactacgtctgtgtctaaaatatgcgtggtgcgaagtatggctttcttgcgtccttaaccttcttttatatntnattatataatagatacaatanactatttacttatnnnnnaccacctacattcacaacacatcttttaacctatatcatnacacaacatataacacacat

SEQ ID NO: 14243 - DNA, 1375 bp, Homo sapiens
  misc_feature (1)...(1375): n = A,T,C or G
ccatcatatctcaccccaccattactcccttcgatgttccccaacaccgagcaccaatctcggcgcgacggactcgtatttgtctgctcttggcatcgacccgtagtacatcacgtgcatgcattagcaggacaactaactcagaagtccatattgaaatgacaactcttggtagccacgatcaggaggcacatgctcaggctatcctaagagcagaagaacacgacagccttcctggttctgtgcacaggactcacatggagttctcattcctcgcggggcacaccatcttgttctatcaatcactagttagcaccactataactctcaaggtatcagtgtctccactgngtcttagcagtttctttctagcacagactcaactcgcngtgagtgctatcgcatcacaagcctccttcagggacatcttgacatcagccatcgtgtgtcgcgagccagccctagaaattatatcgatttcctgtgacctcgctcgttacagagaatcgtatagcacgagcgatgtagcgacctcccaatcangaggttcattaacagctcacactatacacacgtgctatgctagagcacgatcgcgcgcgttagagtcgagctttgacatagtgcatcattatctgtnattacctagatagcgcgctcgtatctctactagcaagtgttaggatcagaacattgtaggttcactgcgggtcatctgtgatgttgggcatagcgactcatcggacgcacccttctatgatatgttggtagagtccttatattatgcgatcagcacacacacccaccttaatctacaacttacgtactgtctctggatttggatctcaactggcgtacagcatccgtcgcaactgcagctagattcgtgacctcgcctcatagtggtacaagtgtgtactgtagtgtcgatagagcacagctcctcaactaagcgtctagcnaatcagtatcgctcactctagnagcgctctcgcatcacatntagataattaatccaccgcgcggcgtctccgagcgcacagcgctaaccgcatgtggctgactcacatctctcgagtctatcacatnacttcctactctgtgtcgatacatacancacacgctatgctgtaatacacctcatntagtctgaccgttanattagtgattctgtccggtgtcttgatagngtcgtgatggcaagctatatggtcttctctctttactcatacctcgacgctcgtgtagacgagtacactcgacgttacgagctgcgcacaaccnactcagatagactcacatcatacttgcctacctcgcggcnctcatattatntgactattncntatctatcactacaccactagcgatctca

SEQ ID NO: 14244 - DNA, 1215 bp, Homo sapiens
  misc_feature (1)...(1215): n = A,T,C or G
aacacaacatacacatngataaaaaacctaaacaggtgaatatagggatagttatagtggggttgagtgaggagggtaaatatgnngggagttactacgcatcctccgctgtggcagtaattcgggngcaatctcactcttcttgagcgagaggggtagacaacattcatctcaacacaacaatgagcatagtactanacctctcatattatagcgcaaaagtgnaacttacaccacgtcagttacacaagcactngcaaatataatacaacctgaggctgctgtggcatgcaatccataaccgtttgtcggaggacttgctgntaaccatgagtactcctactaacatcttcatgccatcagcactctgaatgaatatgttgtctatatactctatataaagagtcatcactaggataatacgttgagcactaactatataatnnnaacattataattctttgtaaagattgtaccttaacatattttaaccattaaactgnnnaaaaactcctgtaaacacttatggaccagnaattcatcgctgtgaagagtanatcgtagacggtccgcgttgctgtgtgtgtgctgtgtgtatatgatgggatgtgagnggtgtttctccggtagcggccntgnnngagcggatgtaggaaccaaggagagtgatagataatgagaaagagaaaaaccttagncttcacttagnctcctgtacacacggttcattatacagttggaccacttccttacagttattcaatcttctcgttgtttcgtactagaaaacatatatnnnccaataacttcactccttccaatcttacttcttcactcgcatcatctttattcaaactttnttacataactctcatccctaatattcttaccaaaacatacaaaggtcaacatcaacctattaatttacaaatcagaattgttaaacctatatacaaaaattgacaaaaatacattaataaaatatctctttaatannnggaactctttcttcattctctnccttttattccttnnatccaaataatattttctatatgtcttgtacatcaatttnacaataataatggcattctgttggcaaaacatcgagtgatagttgttattgtnacaaatatttatttntctttttttttaataatatatccaannncaccacataaccactcttcaaccttcatacacctttataaaatc

SEQ ID NO: 14245 - DNA, 789 bp, Homo sapiens
  misc_feature (1)...(789): n = A,T,C or G
ctcagaggtattaacagctattgaataccctctagacaccgcgttagctgcatcccgtaagtttcaacatcttatatcttcattttcactcgcctctaagtgttttgtaatttcccctgtgatttctttattgatgtattggttacatagggatgtgtttttaatttccacatatttgtaaatttcccaaactttctgttatggagttctagtttcattctattgtagtcagagaacatactttataggattttagtttttaaaaaaaatttcttgaggcttgttttactgcctggcatatggtctcttatggcaaatgttccatgtgcattcgagaagaacgtgtatcttgctcttgggtgaaatgtgtatttcaaagacctagttgatttatggtgttgctcaagtcttctacttccttgcttcttctacttccttctgctttgttgttctagccattactgaaagtgggatattgaagtctccaactattattgntgaattgtctatttttcctttcatttctgtttttgcttcatgtttttaggaggctctattattaggtacatatgtgtttataattattacatttttctgataaatttgatcaattttaatgttgtatttgcctttagtaacattttttgttttacagtgtctgaaaacagcggagctgccactttgtcttatgggtactgtcccatgataaatgtttttctcttttactttctactaattggattgtaagttcaaagggggcccctcccccagttatagtaggtttaattt

SEQ ID NO: 14246 - DNA, 745 bp, Homo sapiens
ggccccactttccaaggtctggggctctgaaggaaggagacgtgagccttgaagcacttctggagtgaactccttggagggtttgtggccgtcagctctctggggctgctgcataaggagccactgcattatttcttctgaaaaattagattttgcttgcaacccattaaaatttccaaagcttcatgaaatggattccagactatgtatcattgtaatttgcaacagacaatgcctgatcatagaaacaatagagatttaaagtgaaatatgttttgcctatgtctagccacaatgccctagaaaaggttgaaatatgtcctttctgatgtattctcacccaggttaaattccttcccagagataaccactgaatagtgtccccctaaaattcacatccatttaggaatctcaccatgtgactctgatgcggaaataagacgccttgcagatgcatgtagataacataaggtcatactggattaaggggggtcctaaatccagggactggtatctttatggcgataaggaattgagatgcctgacccacacccacacacagggaggacccctgtgggaaaggagggagctactggaagagcgcaactgagacccaaaaacttcatggcctgatggaacattgagagcgtaaaagaggttcggttggacacactgaaccgctgattcattgcacttggtacaggaagaatgtttcttcccgagttttttagggaacagtcctcct

SEQ ID NO: 14247 - DNA, 416 bp, Homo sapiens
ctccgatttatcagcgatgctggttagtattcaagaaagcttcaagcaaaggtccaaaaagactggagaaattttctgttgaacgtgctgcatatttcaggtgttatcataagtctctgctatgggacttatcatgttgttgtactccctacactgaagccccgagaggatgaggactggatctcattgtgtctcagacactgcctgatgcagaaagacactcattcaatgcttggggaatgtggggagagaagggaggggaagaagcagaaaacaggtaacagtggacgaagaggaagttctaccgatttattgttttctttaagtttgatgactaaattttcttagtagtagtgagattttctcaataaaaatagtcattgtgtgttacaactcattaaaaaaaaaaaaaaaaa

SEQ ID NO: 14248 - DNA, 729 bp, Homo sapiens
aaaaggggcgggaaaacaggggggggtttttttcggggggttaaaagggccggaaaatcccgttgccggggtggggttaggggcccttggaacacgggtggggagcccccaaatgtttttttaagagccccggggagaataccacggggggaatccaggaatttttttggccaaagggggccctcccaggagtgttttttgggaacctattggttttcccccccttttagagcccggttttttttttcccccgtctcggcaaaggtcccggggggggaaaaaacccgggggtggggaataagcccccctataggggggcgggggtttttttttgcccccaaatgggaagaaaccggggggtttcccccaagggggggggaaatcccaagttgggggtccccccaaaggggggggggctttaaaaagggggggggggggggatacatgggggcccctaaaaaaaggggggtccggcgggggggttttttttttgggccccaaagggggttgttttttcaaaagaaggttaaaaaggggggggcaaaaaaaaaacccccctttttgcgcgcccctaaacaaaaaattttcccccttcccccccaaaaaaggggtttgtttttttcctttgggaatttggtttttggccaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 14249 - DNA, 1508 bp, Homo sapiens
  misc_feature (1)...(1508): n = A,T,C or G
acgcgggcgggagaggcggggccgcgaagtacgaggaggaggagaggaggaaggggggtccttgtttgttngatnggagnngggggggcgctttaggnnggagaganaaccnagangcgagagagaagagaaggcgcacgcgccgcgagcagggagaggcgtacgacnaggcnacgcagcgaacagggccgagcgccgaggacggcgaagggacagaagcgcggacacaggagacaacgagcgcggcgcgcagagagcggagaccaagcggcacacacacacaacacgagagcgcggacgggcncggcgagcggaggagcgcgcgacaggcnacgagagcgcgcgcgcagngcgcaggcgcgacagccgcgcgcgagcaagaactgcacacacaagacgagggagaggagagagcggcggattctgtgacgagcagcgcgccgacggggaaggcgagcgagggagagaacgccgaccgggcgcgcaaagcggcgcacagatcagcgggaggacctgctgagcnagccacgacgaaggacagaagacgaagcggacggcgagaaaccgacgcaccgagagcaacgagacgaccacgacgcacgagagggcgcacgcagccagcccagagagcgagcatagacggagatgcgagccacgcgcaccaacngacccgaccaggcggcgcgcatacgcctgcggagtgaggagctacacgacggagcggcgaccgcgccgcgcacacgactcaggaccgccatcgacacaggacggcagagacgacacggcatgaacgcgccagcgcagacgcaccacacgcgcaccgacacacagtagatacgcagacacgcgnccacacacgccacagaactcgacacaacgcgagcgaggcggacgagcgagatgancacgcagaccgcgcgcccgacggcgcacgcggccaggcagaccgagcnaggtncaagagagtgatagacgcagngaacagcagcaggcagcgccgcgacgcgcgcgcggagagcgcggcaaggtagtacggagaganggcgcgcgagcgtagagcgacgagagcangcagacgaggcgacggcgcgtgcacaccgtcacatgagaacgcgtgaccacaanaacatgccggcacggcaggaacgatactacagtanatacacacgtagcaccaccgcgcgcacgcgctgtcgcgacacgacgcacacagcagagctagacgtagaagcagcagagcgacatctgcgcgacctccgacgnagcacngcgcgcgctangacgacacacncgcactgacgtacgcagcaacaaccacgcagcacgccnangcgaccagacanaggcgcacggagaatgcacgatagcatccaccgcgcacgcacagcaccagcagcgacgatgacacgagaagacgacancgcggcgtcgacgccgntgacgatccgagatgccnatacctcgacaccgtcacgnacgaccgcacaccacacaacacccccaacaca

SEQ ID NO: 14250 - DNA, 417 bp, Homo sapiens
cctagggccacttaatgcagtacatctgtgagcagtcgcttgctcctcacagcaggaccatgggattgatgccgtcattaccatcctccccatgttatagatgaggatattgaagagaggtggcatctaaatgcaagctggtatcctggattagatcccagaacagaaaaaggacattggtggaaaaactggagacatctggataaagtctggagtggagttaatatctttgtaccaatgttaattccttagttttgatgaatgcactaggtaatggcagatgctaacattaggtgacactgggcaaacagtatatgggaactcttgctggaactgttttgtagatctaaattgtctcaaaataaaatgtgcaaaaaggactaataaaaaaaaattggcctaattggcctaagagag

SEQ ID NO: 14251 - DNA, 425 bp, Homo sapiens
cctgatgctaggcctgtcttataccgtagaactgatgccttatctcacgttcatgtacaatggagcttccaaacactatcactgtgcatgtactacatgcaaggagaactaccttttttccggacgatgagcaagaaccacttcaacagattcacccccgagtaatactgtcgccttgctgccaagatgagcacagctgggcttgactacacgactctgctgtgcaagggagaaaaatcgagctagataggcaaatactatcctgattttgtcatatatgacacacacccttttcatttctatatgccctttaagaaagatcgttgagctatataccaatctacgatatttgcttgattgagagatgatttaatgaatctcgctttctcttacagaaagtggtgaccttgctggccttatcgtgc

SEQ ID NO: 14252 - DNA, 679 bp, Homo sapiens
  misc_feature (1)...(679): n = A,T,C or G
atgaacatattttagtgaaatactgtatggccatggtaaaatcgtcctctttgatgggactctgggcagctgcctccctctaaaatagtggtacccctcccctcaaagggtggttatcacttgtttatcccgttggtgtaattcccaggcccatngatagttcttaaaaaagggnttcacttttcttatatgcaggaaacgctgtaatatgcactctggccagcacacttaaccgaatggagacacaatccctttggaccaatcgtggcttgcgcaccccttcggtttaaacagggggatggggtccagtcccctacaaagggcttttttatttnacgttcgcttttcagggtttttgggagggtaggcccatttttttgaacatggagattttattgaaaacaacgacattaacaaccagcagtttttaagtactcaaattgttccagagtagatattcattcccccctctttccgaagccaggtttatttcaagttaagagtcttcagacctggatttaaatcctctacctttttttatgtttaaccccttggggggagtttaagcctcagttgctttttttgtaaaatgggaataatgggatccttttccaaaaatgttgtaagggtttaataaagtcatttaggggtaaaaacaaaataaaaaccttttacttgt

SEQ ID NO: 14253 - DNA, 866 bp, Homo sapiens
acaactgaaccccttcacagatggctcgccgatgtcaacacaccggccacgctcgcgggacaccaggccatacggtggaaggagctgaagggacattgggagaagtgaccagatgacaagagtacgagccctctgtcgcgaccggacacggacaccagagggctccctggtctagcggtcactccagcgcctgggaagccaccggttacttcgcacaccgggaaagctagtctgcctttccccggggaatttatagaagactgctccaccacctcttgtttttcgcgacatcagctatgctctaccgctgctacccggatgcccggcttccttgaatgctgtgcttcacaggtcccgctcctagaaaagaatccgttttccagcactctagaccgtgctcgggccatccagacagcacgtagtgggctagaatgaaaggtacaatagcccctccggccggcataccagagaatttgatggagagatgtcctcactgctcaatgcctcttagctaaccaacaagggagtgtaccccataagggggaaaccaaaacaccagtaaccctatcctaaaccccggccgaaggcccaccctcaataaattaagacacaccaccggtaaccacaaagccgacgagaggacaacgcgcccaaaggcaaacacaacccacccaacgcgcaacagtgtatatgactacaaacaccgcagcgcactttagagtaaagacgagataaagtacaggcgtcgttcgacgccctggcgggtgtagctatgagcactttccaccccaataatgtcgctcgtccggcgtctgccgtagctatttctttaacacctgttgatatacgtccagacacagaaccgg

SEQ ID NO: 14254 - DNA, 877 bp, Homo sapiens
  misc_feature (1)...(877): n = A,T,C or G
tataaaatgtcttgatttagagatagtaataaattgctgctcttctacttacacatctctggctaggccacagagcacttcttcattaccataagcctaaccctgtgacagacaaggcggaaatgagaattgaatggacacaatcaaagctgaggcaagccacacagagtgatagaagccactgtgccaccaggaatgccaatgtacaatattaccaaaaggcgtgtttatggtatcttggctgagctgctagatgactctatctctaacatggtgtgagaggtcacgagtttaatgcggtctccagaactctcgccgggctgaggtgaggcccttcattctatggttcatgaggtaatgaactacgtgcattcgtacattgatgccattgataagtgcttttttttcattatagcgcttagaggaccaacgcccttgtcgcttcttgatcgatatatctgtgacagtctgctggtaccagtgttcctactctttgccctggcctcgtccgtatcactagcgatgcgattgtntatttgcgtccattttgaggagatgtgttggcgcatagtatgtcggttggtgatagatcagtgatgttctttttaataggtcgcaacagctcttgtcgcgacatgccacttcctgatgcccgggtctgtgatcgaacgtcgtattacgctcctctctccactctacctacaagacggagtgtcgtcttatgtactggaaactatgtcattgatctatctctatataaatctccaatattacgctccttttatcgcttacttgacttatcgtattgtttacgtgctcggaatagtgacttctgttatgccgnacgtgtgaaagaggaggttgagttgtagtaagg

SEQ ID NO: 14255 - DNA, 1018 bp, Homo sapiens
  misc_feature (1)...(1018): n = A,T,C or G
cttttttttttgttacactctgccccccctggcttccgccgccctctgcgttgcgctgtactgctggggggtgcgcctgctctcgcgctgcggcctcgggtccccgcccggacgctggttctggtgggtgtggtctttgtgtacctctctccgctcagcgccgctctgtttatgtcgccttttagtctattccctccctcctggttcgctcttgtgcgtcgcctgcctccggcgtcctggtggtgtggctgctgtgcttgtctgcgtgtcgctctcttgctctggtctccctgtggtcttctggggtgcccttctctgcctctgtctccttggcctctctggctctctcctctcgcgccgctgctcttttttttctgctgtcttgctcttccccttcttctttgngtgtgctgtctccctcggcgcgttggtgcgttgtggttgtggcgcgcgcacccgggtgctggggtgccggggtgctcgccgtctggggctggcgtggtacgggggtgtgnaggccggttttgcccctggtcttctcgcgttgggtgaggggaatggggtgtcatagccccctcggcctcggtcgactgccggcctgtggtagggtttgttgccatctgttatgtcgcggccgtctcgcgccgtatcgtgaataagttatttaattcctctgcgtcgcttctttgtttttcttgtgggtgcgctctgtcttgcttctgcccgtcccccctccttaggtctctaaaattggatggttttattgtttaataatttgtggcacaaacaagatatacaagtaagaataaaaagaaaagaaaactcacacaagacaaggattaaaaagaaaaaaaacaaaacacgaaacgaacgtaaagaaacaaacaaaagaaagaaatggtcctcgcttggcctaacagtcggtggcagtcagttgcgtgccaaacattgtcccttagttttttgccaanttttttttttttcctccttcttccctttcctttcttccctctccctt

SEQ ID NO: 14256 - DNA, 740 bp, Homo sapiens
gttggtgggttcttggtctcactgacttcaagaatgaagccacggaccctggcagtgagtgttacagctcttaaggtggcgtttctggagtctgtctcttctgatgttcagatgtgttcggagtttcttccttctggtgggttcgtggtctcgctggctcaggagtgaagctgcagatcttcacggttgctagtaacacaataataaagctgctttattttccagtgaagatgtatgtgatagggagtggaggaagaaaaaggccagaaaattccatagttagcaaatatacctttcttacttaagattctttttccaatgtgagccttctaaagagttactgagaaattaggtgagctcacctcattcaatgcaggagatatggttctgaaaaattaagcatacataggacattggccaataaacaattttgatgaacaagacttttcacatcccaaagagtaaaattgaaaacgggccaaatgtacgggcttttaaattcgaaacaaattattttgatagaaaaatctcccttctataaacgaaaacggagggactgcttgctggcgcgtccgcaaaaaggaataaaatgcctgtcccagatccctgttgtagctcgaaaccaaggcatgggccttttcaggacgggttataaaaaccggcgggacaaccccccaacctctccttttgggggttgaaaacaaaacagcccacctctcccttggaaaaccacactgatt

SEQ ID NO: 14257 - DNA, 723 bp, Homo sapiens
catgccatttttgaaagacgtacaaggccagggccattaaacatgtataggacccggtatcttcacaggacaagttttaccatggccatttgggggcagtgtcttcattgagtgctaagagtgcattacattttggggttctagagtgtcttagtcctttgcggcgctggttcaaaagactctcagactggggcgctaataagcaactgagattctcactgttctgcagcctgggaagtccaagattgaggtgttggtagactttgtgtggtgaaggcccggttcgtctaatggcagaaagggtatggggtttgtttcttgggcctctgcttttctttatgaaatggtatttgtggtgttggagtctcctcccacggctcaggttggtttcaatgtattgcggcccaagctatcctctggcacaaaccttcccaagttctgggatgacacggcatgagcctccatgcatggcagcaagggcatcgcatccatatccttatgcaatgatcccatctccatcaggaggaggcattcccaaaagcaatggttggggggacccttaccgctatagacaagcagcatggattcttatcagtgcataatgattgcctgatatctcacactaagtgggtggtcttttcattttcccgatagtatactttgtcccagaaatctttttaattttgaaataaacccattcaattccaaaaaaaaaaaaaaaaa

SEQ ID NO: 14258 - DNA, 815 bp, Homo sapiens
  misc_feature (1)...(815): n = A,T,C or G
actagtccttcgctggatgcgtagcttgtgaatattttctctgactctataatttgggcttcttgctctcacaacagcctgctgccaacttggactccagtggaggatgtatttttcctatcctgattgggtgctcgagttctagaattctgcagaccctgaaatcagaaagtttgtattgccagaggaacagctacaacagaggaggggagctattttatttctgaaatgagacttcttccttccaattccattccttcttcctgtatcttttctcttggcccagatgctcttgcagggacaggacctctcgtgctctgcctccgctntctgcttcatggagtcatgcatctggctgtgggctcctgagaatagcaggcccataggcccaaaagttttgagagagcataaaaagggctatgtacctctttacctaaaataaaagttaaaacaaaaaaataaaaggtactttagtcaggaacataaaacactatttttattaagaggagacagggcagattcgcccaggaaatagaaataagagaagaactctaagacattctcattttaaccctgacctaatgtctaccacccttgtaaggcccggaaaggtgaaggcagctggctcaatggtacccctcttaatccgttatgacgaatggggattatgaaccccctttagtctaaagtttctgttcttctgaccccagtgcccttgtgggttaggggggagggatcctcttctatacactggaaaatgaaatttggttccttgcgaacaggataacccttctacttggaaantatagatcgcg

SEQ ID NO: 14259 - DNA, 701 bp, Homo sapiens
  misc_feature (1)...(701): n = A,T,C or G
cttccttctcctttgaatcaatcccagctgtcactctctggtacaaacgccggcgcgggcgtgcggggncggggctctctgttcgggtacctattaatactatgtcatttgcatacgggaccaaacaaacgtggcatcgataaagaaatctgttcagtggaaacggaactagcgatattaactctgaaaatgcgaagataaagaccagtcgagggtggcactgtacaaggacacagagtgaaataagcgcgcggaggccgggcaatcgtaagagcacacaataacgcagaggaaagggcggcggtagcggcgagtggccgttggtaattgcttggcagggggaggttccggggaacgaattcctttccgggctgggagtggtgggtcatgcctgtgattccagcactttgggaggttaaggaagaaaaattgattaagcccaggagtttgagaccagcccagacaaaaaggcaagcccttgcctatacaaatttttgttttataattagctgggcatggtgatacacccctgtagtccagctacttgggaggctgaggcaggaggatcgcttgagctcaggagtttgaggctgcagtgagccatgattatgcccctgccctctagcctgggtggcaaagcaaatttcagctcaaaaatgaaatgaaataaaatgaaataaaataaattgatttgaaggccc

SEQ ID NO: 14260 - DNA, 1257 bp, Homo sapiens
  misc_feature (1)...(1257): n = A,T,C or G
gtgagtatgatgangnnnngtgtnnntnntatgnnngtgtnnagttttntatattttntaatagaanttatgttatgatattatagattgntatgaagtgnaaatgttttnagattnnnntnaataatttnnnnnaaattatagttttgtatatntttataattaattgtnatattntatggaagnnnnatattatagaagtttngttntatatgtgataattnatatgtggntnnaatagttnagnntatataagagtannantnnnngattatnataagtatagtacatagtgtgtnatgacgatattatgtagctgttaagatatagtgtatgtctattatttntatganactagaacagtgntatgtagtatgttaacatttattctacgtannttatataaatatagtattaggtcagtacatgttagtagnttnttttgataataatatacttgnagattantaaagactataatntattagttatgtttgtattaattgattatattntgtattgttnntatgtttatatacatgtncagatannaaatgagaagaancaagataatagagagaagaaagatngagtgaaatgagaacgagaaacaaatggnatgtgngctgatgggtaatgtaatttaagtatcttatatattttaatttnttattagttatttctgttacgcctctgtttgtcggtgtncaggagagacactgtgacgtncagttcttgtcgtttatagattacgagtgntaacaagtcaaataatagtatgtatacgaatattagacacaatatggaggcaaaagaagnccgatgttatgacatanaagagaagatacgnaagataattanatgtaaagttaggatagtattaaaattggtttgtatacntagaagatattatgaattattanagtaaatgtgnaaattagatttagaaagtatggtatganaataataagtttnataatggnggaanaggaatcgctggcgtgaatgagcattcacctccgttcaccccccaagctcgcgcccccccacaatatcctttatctttatcccccccaccctttcgcttccgtacttctgtatattatcctagatattctgtaccatancccagacaagtcaagatccctcccatttccaattccacagtgccaactaccacttctccatcttatttcgagactccggatcacgacgcgcgncacagacgtatatagcaccctaccgttcacccgcaca

SEQ ID NO: 14261 - DNA, 1457 bp, Homo sapiens
  misc_feature (1)...(1457): n = A,T,C or G
aaaannnnaaggggnnnnnnnnnnnaaatggnnnaaaagggangaanaaannnnaggtnnnanganngtannnnannnnnnnaannnnnnnngannnnnnnnnnnnnannnnantnnnaaagaggnnnaagnataanagnnnaaataanataatanaatgagttaanacnnnaagagaggannnaaagnnnnaaatnacaagaannnacaaanagagaaaaaaganagacagaacagaaaaggggataagagagacatgcacgttacgatacattaccttgtacaacacgtccattatgcacaacctctgtatgtaagttacaggaatctataagtatcattgcgcaccctntttagggctggtctcaaggaaccagccagcaagaagaagaagcgtagaagaataanagtagaaacgaatcnaacaacgcgaagcacagannnngtgaaaagaaagaaaccaataactaanntatataganaataactaatagcgatcatagcactagcactcgcaccgccgcaacttgttggtgtctcccaataggcgcactatgatactcatatantccacgtatcacgcacatcacagcagataagcgttcctccacagtcatactcacatccccacaggatcatcccagcactcacctccactatttccacaccaattctcaccgtccaatggttataagtcataaaaatatgcatagatgtacataatataattnagtctngtatcttcttcttatcagttagaacgagtagtcggtgctcagcacgaacctacccgagtcgcacatgggcgagatggtgcaccaagtaagatatttgatcgtanctncagagtagtggttagacncgtagatgcatacattgagcgcaggagagtaanagntcaagtagttagatatcgaacacatatgtgaggatcataagtggttgtagtntcgtaacatatagacgtaactatncacangccgagangnagaacagagatatcggtgcattatatattagtggagtcactgtagggagcgcatatcaacaacctancantatctatatgatcaagatgtattgagtagataaagggtgtatagaatgtatcagatagccgcttgcagctggcacagattaacgatcccaagtctggcaccgcatggagatctgatgcgagaacgtgacgagaagtataatgtagatgcactgaattgatcaacgaaggtagcaggcgagantncatagactgccccaatgacgctgatggaggagtacgnnnacngtatgagagacaatgcagattgaagactggtgatagatctattaggagtagggaagccagcaacacgattgagtgtctcgaatgcaatgagagcggcatgtatgcatctcgngtacgattataacagtgtacacacgcatatctanctcntntacaancaagagatagcaag

SEQ ID NO: 14262 - DNA, 821 bp, Homo sapiens
  misc_feature (1)...(821): n = A,T,C or G
tatatatatattttgactagctaattcccgttttacaacacaggacgagacttaatgctttacanataaggattacattcttgtcggccacctcagggaagactcttcccacaccagactctctccagtttatatcatccgctccatcatttcagttatcatctgtgtgctgagatatccccagtctacatctccagaccaaacttgtcttcaatgttccagactcaaatatccacgggcacatcaaattcaacatgttctcagctgtgccgatcagcaagcctgaaagaacaaaaagaagagaggaaagcaagaaggaaagaaagaactcgctttttcatccctcaccttgtgaaatgactcagtggcccgtgcagctgctctgccagacccctgggaaccattggcgctcgtccctccctcatcctctgccagcacatagcacagtatctaccgctctcagtatctgctccagtaacgactgctcaccggtgctcagcctacatcccacacgttctgccatgtgatggatctgctcatgtatccaacaacctccctaacatgtatggtctcctcaaggataggaccccatttttctttgaatctcccgtgccccggcgccaccaggctgcaagactcctctgcaaattatttgaggcctgggcccattgggcctgaaggcccaagcactcttggttattacggctacatggggggaaaggaataactttaaggaatgaattcagtttacatgctggtaatgacatattttcggagaaccaatgtgagttactgattttaccaagtttttgtttgaaatt

SEQ ID NO: 14263 - DNA, 1130 bp, Homo sapiens
  misc_feature (1)...(1130): n = A,T,C or G
tacttatactaaatatganataaacaaatcaaagacatacagcttgtacatcataaataaaaaaagtctgaaatacggatcttacacaattataaaaaagttattctagaagagatatagatgtatgtggtatgaggaatgtaagagcaagtcctatcctctaccacaaaacacactccacaangtatcatgtactagacataatcacattaatgtaggagcattaggctaggtgatagggtagatgtggtcgtgacgaggtatataaaacaaaataaatagtaactatttacaattgatgactacttgcacaccaagctcacaatacagtgcatttctctacaacacggcccgtattatcaactagtacacgtcactcttcggnacactatatcatattgaatacgtacactgcatcttgcctcacttttttctcttactcaaacgttatagcgatagtaaaatgaacctctagcaattaaagcaacagaaaatataattatatgccatatatgtcgtttggtatgctgaggcgatagagtccgccagatgattctatgtgtagtgacggccttgctgccccctggtgatcgccgcaccgagactgggtggttacgtggacaccaccaatttcaggaaacattcaactaatacaaatccttgtcttatatnactaatcttaaagtggcacatttaatcgtaacttatannatatctcatttataaatactatanttcatnttttatataatatgtattactattcattttataaaccacaactttaatatcaaataactactcacacctcacactcaacctaaccaactccactacatatatttaaatatttntttcctattttacttttcttactcgcagaaaacaagaacataatcgtcactatatattactcattaaattctaaacatnnaaatacaacaaacaaacaaaaaacacaaaataactaacataaatacaaaaacagttacaagttcaccaaccncnnncaaccattntgttnntctatgtttttccctnccaaggnttttnttttttttcctctctacnaacaacctttnnnactcactcctttctcccattccaactnctnccccacttcccaatat

SEQ ID NO: 14264 - DNA, 988 bp, Homo sapiens
  misc_feature (1)...(988): n = A,T,C or G
taagttagtcagttaccctcatcattgtcgcactagggcaagagactgggtctaacaatctggcgtgtatcttacatctccgcactcagctgcagaactgcacaccggggctctcgagctgccacagactgacagcacagggctgagcttgctctagggaaggtgcatggtgtgtcactcaccagggcacactcacaggaccagactacccaagtgaggcacgcgaccatcaggaccaggagttacctgggtatgcaaaaccaaggcgagaaaggccacctccccacccactccctgggggccgtgctagacagggggagaaattgcgcccttcttgtgaacaccaccagcccccagcaataccattggcagctgtctgcggattgtgancagagggaaatgggacaggtttttgtaaggggcgtgtaatgggttcgttgagagtccatacgatcgctgtgaggaaggtgcgctccatctcaaccccacgcctgtttggcgactcgatgggccncacaaagaatcagaaactntcagacaccccacgccataatccgtgaacaacgaaccaggaaattctttgtcaagaacaacgggaattttcttaataaccgcacaactaggtcctggcgcggcgaagggtacctgaacacatggaaggggattggagtaccacgtaaagagcgcttgacctctgttccaggtttctcaggagcgtggntagggttggaggaaacgctgatgcgtgtggtatgtctactctgtaaattataactatctgtaatgggtacaacacctgactcagatgtcaaggagaggctcgccacttttgagcggcttcactcgtaccagtgcatgaaatatggtcaatagccgatcctgggtgtaggacggagaggctctcacacttctatgacaacgttaccctagtggtcattcaactaaccccgtagggtcgcggtatcctctagaggagaatgtgtagttg

SEQ ID NO: 14265 - DNA, 980 bp, Homo sapiens
  misc_feature (1)...(980): n = A,T,C or G
agagcgtgtagcaccatccataaagtcagtctctacttagtgattcaggggagacgcacatagacgctctgggacacccacggctagacgctgaaaacccacctggctccggaatcctgtcctcagcttcttagtataactgccttaaaactttaatccgacttgcccctgttacctaattaagagcagatgacccctcccctaatgcctgcggagtcgtgcacgtattaaggccaggccacggcagcctaccggcgatctccggccaacagctaaacgagagctggacaacacaacacggtctaccactgtcccgtttctagggcgcagaaaaacgacgccttgcccccgccaaaggtggcgtacaaacacactgngggagtttaaagggggcgccgtgcactacaacacggggtcttcgaccgtgcaccccctggcacccctatgtactttgtcttttgcgtacccgtggcatcaccggctcacctattcccaacttctttcgtggccacacttgatacctcgcagggcccactatcctttcccgatcaaaacacgaccgacgctggcgtcacctagttctggcgctacgttaaccccaccaatgcgtagccgttggaggcgaatctaagtgagagcggagcgaatacctcactatagtgcgaaggtgcgtgttgtcgggtaccgacgcggcttaggccgcggcgctggacgcgtgccttccttcctctatcnggagtcgtattatcctatatttcacttgtggctgttctaatattatagatccacatgagcaaatacagggtgatgccaagtagctagggactacgccctacattcgaggcgcctgagagtgactcactcacttcaccagtcgtgaccgtcttgctgctgtcctgctagcgccggaagccaccactcgatcatgcgctcagcgtcttcgcatgcgtgtcgcggtccggaggagtttatgatggaag

SEQ ID NO: 14266 - DNA, 1084 bp, Homo sapiens
  misc_feature (1)...(1084): n = A,T,C or G
cttgaatcctcttctttctcgcctcatgtgttatgaaatatcttaggtcttcacatgagaggacacacatgaggcactgaactcaagaggtctcacgtgcacttggacctgatttacatgacaaggttctggcctgattcactaacatgatacactcttatcgtggggtattcgcgaggtctgagtatatatttctccatgggcgaagacatgattataattccatggcaataaaataatatcgacttcttaaacaaaaaacataatccaactggccctctgttggcctccagcgggtgcgaatctattacttgaccgctctccctatctagcgagagcttaatgtcttcgcatcctcccctcatcttgcacttcgcttgctgctccagtacgcttcagttcgcgcgtcgacagcgagctttcacacttacctcatacatgcgcttcttttacatgttcactacccctacctcgtctcctggtcataccacccatctcccctcactaccagtatacctcctacacgcgcatctgtaatgcgtcccgccttgccgtcctcctcactctgcggctcacttattagtccgctgctacagtcgtggcacgaaatgcctacctcctacctgtaattgctctctatgttgttgtcacgtacgantgtcctctcgggttttatgttcctcactcctcagcctcctcatcatactattcaatctcacttatttattagtataacccaatgaggggcaccaacacctcatcggaagcgactcgaccgatcatgagctctcttctctcgcctgactcgacgagtctggcacctacnactcgactgaacacccatcgataccagaccgtgctctgttctctgatactactcagctactcactctccatgcctccatactgtacgctaccacagtgtgtctatctattatctcatctacntcatactcactcgtgngatttctctctcactgtatctctttcatactataccgctctctattgtagtttactctcacacacctcttcgtcacctcctaccacttgtatctgacaagtacacgattatatagattat

SEQ ID NO: 14267 - DNA, 598 bp, Homo sapiens
ctcaactaaaaccagctacggcgcataaggcactaggtatgggtagttaaccggatccggaggaaacatttctagggaagactccgggtggacgagggtaaagaagaggaacctgaggctgaccaagaacatgcctgaactctaagaaatggctttccgcatacccaccctaacctctactgagcctgactctccctaacctcttctcagatacactgtagaatcccttcctgtaccggtcacaggcgagagtacgcactttaaccaaccactagccctatttctctatgcgtggcaaacattataaacaaaataagagatggcggagagatcccaagtatagcagcgcggctgaaaaaatcgactgaaacccggagacgagaaggccagagcagggggcgcggacgacgcaacgcattgcgggaaaccgctagatacggaatgaccctataacgagcttcggcaccgtgtggccccggcgggcgaacacaaagcgacccgctccacacagaaggccggggtcaccaaggaggacaggcagacagacaagaggggtcacgaggagcagggaaggaagacgaaaagaaaaaaaaaaaaa

SEQ ID NO: 14268 - DNA, 806 bp, Homo sapiens
ttgtgcacacagactcgggccgtcaaggaactggacgcttgtgttaaacacagtgataccttctcccagtggacgtctcctgccagactgctccccttggtcttcttctcaccttcagaggcacctctgccccagttctgtccaaagctgacaaacactcactcatccaatcatttcttccttccgttgttatttctagtagaccttcgagtattctgatttctctgggtgtcagctcagcttacattagaatgaatgagagacagcatgagagagagaaagaaattatggaataatttgaactggacttattaccacaaagaaaactgtatcgacacttgcaggatttgaagttacatggaaaataacagaccaccgctgctcaggtatttgagcaccgtatctgtgcacctaatggaagggtttctctgtaccttctacctgactctgaagatgcacacatgggttcaggaatattgcctcaggatcccaaaaaattacactattgaatctggtctagtaaatagcaaataagacttggcccagagactttttagaagtggactgatgtacattctattgcttctttgtttcaacagcagattttattgttcactaaattttggattgaacattttaaacatgccagcttgtttgtgcatgtcagtgaataaatgagaatgggatcttcccttaatcagcatgatcagtggaacccggaacaagcactacccacttagggattcttactattactaaggggggggctttctttcccccggctccctaacttcccggcatgaacc

SEQ ID NO: 14269 - DNA, 754 bp, Homo sapiens
  misc_feature (1)...(754): n = A,T,C or G
cccctttgacagatntaaatggaagtatgcccttaggcccgggccttggagcccagccaggtcagcaaagccaaccctcttctctagacaaatcaaaccaaaccagaacaccaaaaaaagaggatcactaatgaatgactctggctaccactgtcctcagcatggaaaggaaaccaaagttaatacaatgtgtattgcttcatcttctcagtggccccattgttcagagatggtgttaacaaccacatacaccattttatatctctttaaattgcttatgttgtcattgcgtagacataccatctggttaaaatgaagattttggtcatttatatattacacaaaattgtataaaatatcttcctatgcatacacacacatacatactcatgcatgtatatgttttattttaaaagctgattgcaggatttttcaaaatacaccaatacataagtcatgtaaaaataatcatttccaataatttaaatgcctttgttaacattttgatatgttttctccctgtgttaatagataaaattcacacttttaattactacttaaattggaattattttggatttataactttctgtgctatctcttaataacactgagctcttagattgtctcttagaattgctattacaaataggtgaaagtcttcctcacactatttgaactctgatttatttttcatcatttaaaaaatgtataactaaataaataaattttacttgcaaaaaaaaaaaaaaaa

SEQ ID NO: 14270 - DNA, 750 bp, Homo sapiens
tggtccgggacaggcaaggccatggtgcgggtaactcacccccaaaagagcgccagagccaaggtctgtttctttccccagggtggaatgcagtgatccaatcacagcttcctgtaaactcaaactcctgggctcatatgatcctcccatatcagcctcctgagtagcaaggaccacagtcaatctttgtcgaagtaaggaaccacatctctagctgggtgtggtagctcacacctataatcccagcactttggaaggctgaaggaggaagattgcttgaagccaggagtttgagaccagcctgagcaacaaagcaagaccccagctccacatttttttttttttaaattagccaggcatggtggtgtatgcctgcagtcccagctacttgggaggctggggcaagaggatcactcgaacccaggagagtttgaggctgcagtgagccataatagcaccactgtgcactccaccctgagtgacagagcaaaatgctgtcaaaaaaagaagaaaaaaaaaagaaactacatctcctgggactgctgcaaaaaatacatatggattgattctattaagtcaatactaacagagactccgagtcagatattagagttttacagttaaataaatctaaccaatccttactgaggctagaatccttttaggcaaaaaatgtaacagaatacatccatggaaaaaaataagtgtgtaaaaataaaattcagctgtaaaggaaaaaaaaaaaaaaaa

SEQ ID NO: 14271 - DNA, 872 bp, Homo sapiens
tccaccctccgtctcttatatttcttgtttgttgcgccggtccgcctgttgaagcactgaggcacagagagtatctgcccaaggtcattgagctgccttcagccatagagctggaagaagaaaactatgtttttgaatctgcaaacatttgacagaggctcactcaccaagggagacagtgaatgaaaagcccaaagaaggctgactaatgactcaatgttatgcatagtaggagtgacatgcttggcctacctgctcatctacaacctgactgagtgcatcaccagtgtgaccacctggaataggaggacctcaagccagacaaataacaatgaccatggatggacaagagacagtgatgaagactctgttgttggataacttactgacagcggggggatgtctagatctcagagagttaaaaagaaaaagaagaggtaaggtaggagaagtgggacagtatgggctctggcatggaacctccacagttcatagcctgactcggctgcctctaaattaaactcagtcaggacattattaggaattatcccaatggattacagtgattggatgacgccatgtttggtaagcagacaataaagccgagcacctgggggcggacttaataaagaattcccttattattaagcatcccccattcctttcctttatattatccaagggaaaagccatgcccgacttttgttttgaccctgcacaaggaaaaaactatggaccaataaatcgagggtaccaaggagacaagactcaatttcatgcagtaagaaagaaagtgaatctaggtttcgaaattttcgaaaaaaacaaaaaaaatggcgctcctctgccatacaacgggggagttctagaag

SEQ ID NO: 14272 - DNA, 703 bp, Homo sapiens
atccataagacattttaaaatcagcagcttttttacctatccccccagtcaacagtaataacatgatggggatataccctagggcccccgaggtaaaaagcacctataggtcccagattaaaattaatggtaaaacctatgttacatggtaaactctatcccaggcgcaaggaaaagtaatttttgaaaataaattaatttgttttattcaggcaaatttcaggatttcaggggcaaagatgacattttaaacacacacttttgggtctttttttctttcagtttttcaaaaaaaaatggccaaataatgtaattttaaaaattttatagattactgaagattaaagaaggggctgactctgtttggaggcaagtctctgtggggtttttaaaattctggaaatctcccaagcagaggcaatagcccccttggttttgggctatcttttcaaggatgtttgtatagcaaacagttttggaagacaaaaatagtgcctccccacataacaaatggcaggccttataaaagattcagataccctaaggtcaggggtccttttttgtaactcaaccccctgcatgtgaaggagacacctgggtgttttttactccctctgtgagatttgagactcagagaatcaggacaagataaagcaaatgctctagctactgctattgctgtaataaagttttttgcctttgg

SEQ ID NO: 14273 - DNA, 883 bp, Homo sapiens
  misc_feature (1)...(883): n = A,T,C or G
tctatgtcatttgtcattcacatcagctcaacgtagagcaagaaaggagttagtgggaaatntatccttgttgtctccgtgtgaaccacccattgccagatgtattgaagaaacaaacgtagtggatggaatggtgactctcgggaagatgcttgcattctttcagctgtagagaatatgcggaaggcactgactccagcggctctctgcattgccatgggacttatgaaaggacagaacattgcattttctgcctataagcccacaatgccggcttatcctgtggggagcagttattgcacatgaacgtggcttatacggaagatgaattgggaccgaataggtggtagtgggcagtatattccctttttgctcacctgaattagataaaaaaaaacatttaaataatttgtttgaatgggttgtttgacaactatattttctaaaaagaaaaacaagcctaagagggtgtaacatgcacttgtcgtaaaataaggattgttctttctgtatgttccatggacttcaggcgattggtagtaggcctatttctaaaagggaaacggtggctacccggttggacaggaagggtcctattactgtttggcgtagtcataaagtgcatgggaaattaaggccaattcctctggcttagtgctctcgtttacgtctaacttagatatttttgttatacattgcgggcctatgtgtattttggtaggctgtgtttgtttggagatagaagccagtactccgggaaagtcctctagattgccaatccattactaataaggataagaaataacggatggagagtatggacnatcaaacgggcggaaggacaggtgaagcggccgcgcgcgtaggatgagagtgttagagg

SEQ ID NO: 14274 - DNA, 744 bp, Homo sapiens
tactttagttttatagcatacctgcatctttaacatgctatcatagtacatttagaatgatggcctttgattttttttttaaattctgtgtgtgtgtgtgtaaaatgccaattaagaacactggtttcattccatgtaagcattaaacagtgtatgtaggtctcaagagattgtgatgattcttaaattttaactaccttcacttaatatgcttgaactgtcgccttaactatgttaagcatctagactaaaagccaaaatataattattgctgctttctaaaaacccaaaatgtagctctctattaacctgaaatgtacactagcccagaacagtttaatggtacttactgagctatagcatagctgcttagttgttttcgagattttttagtcaacacataatggaaacctctttcttctaaaagttgccagtgccacttttaagaagtgaatcactatatgtgatgtaaaagttattacactaaacaggataaacttttgactccccttttgttcatttgtggattaagtggtataatacttaattttggtatttgactcttaagattatgtaacctagctactttgggatggtcttagaatatttttctgataacttgttccttttcctgactcctccttgcaaacaaaatgatagttgacactttatcctgatttttttcttctttttggtttatgtctattctaattaaatatgtataaataaaaaaaaaaaaaaaaa

SEQ ID NO: 14275 - DNA, 820 bp, Homo sapiens
cccactcgctggacgccgcacaacccgacaaccccacagagggttctgggggtacttttttttttttttttcagatggaccttcgctcttgttgcccaggctagagtgggatggcgcaatcttggctcaccgcaacatctgcctcccaggttcaagcaattctcctgcctcagcctcccaagtagctgggattacaggtctttaatccatctggaattcatatttatggatggcgtgaagatttttcataggaaaagccaattgtcacaacacatgttacagaagtctattctttctcactgagttgcagagccgacactatcataaatcacattcccacatacacttggatctgttactgggcactctattctattgattcctttgcctagcccggaaccgataccacattgctttaattactatccctttcaaaaaagtctttggaatatgttacgaccagtcctttttacttattatttttcagaccggactacttttttcttggcacttcgatctaccctatgaattaacaaaacacgtcgcctacccctgccaaaattcctgatggatattaattgaccctgagcgatattccctatcttcctggcgaagaccagggtccctacaagggagacatttcatactcaaccccaaacttctctctgcctctcctccacaccacggcacgcctacgcttaattccccaaacatcactacgacggacatgaaatcaatctgcaggagttggtccaccttaagctatatcgacaacgacacctcttaaagaccctcacttaattaccaaagaataaaaatg

SEQ ID NO: 14276 - DNA, 1235 bp, Homo sapiens
  misc_feature (1)...(1235): n = A,T,C or G
gtttatactcattttgcgntccatatatcgctgttcggcgtatgcgggctcgctggtgcgctggatgtgcagacgcgagcggaccctcgcgtatcacgatgtctgcgtagcgctatgctgctcggagcggcgcgggttgacgggttcgggctggtccttttcgtactatctctggtacactacgatctctcttctcgtgtccttggggctgtagttgcgtggtggcggtgctgtcgtgctatgagccgataactaccagtgtgtggaggatggttcgctggatacgctaattccttgcatcctgactgaagctgttttaacgctacatactgcgggtaaccatcgtgtctttncgacttctgcgctgctacgacctgcgacaccctcttctcttatgctcctgatgcccttcttgcgacgattgtcgtctgtccaatttcgctctcctcgatgtggccgcctccgcgtgccgcggttctctcagctgtgcgcacgcgtctggagaactgtggtagatgcgtctgcggcgttgagaagtggattagcgcgatagactggtcgcctgctcgcgacggcggggacgggagcagaggcggcgtctctggcctcggcggcgggtggcggactcgtggatgagaggagatgtccctagactgtactggtgtcgactgtcttagtggtcgaggagtctaacgtgctagttttggcgtcgagccggggactcctgaagccgtgtgtatcaggtatgttcggtgtttcnatntnctctctctgattctcacagctttacatagcnattgtcgtactctattcttcctacgtcttcttcatctattcngcncctcctctaccctccccacctgacttgtnactattaatcntctataactctctgctcccatctgccccgttatcttctgtatcatacactctatgtcactagatctctcgactcgccacgctccgatccttagaacctcgcactattatctctgtcttatgatcaactactctctcctctcncacctccttcttgtatcatcctcgtctctaaattctcacctccgtcttcgtcaattctcaacttctttctttctctgcattgtctccctcntttttctaaacctctttttnnttttttngtttctcttctntaggncttcttttctcctcctccctntcttcctcctcttcccacccttcncctctcctttncctctctcnccctttcacac

SEQ ID NO: 14277 - DNA, 895 bp, Homo sapiens
ccccgctatccccgccagttgtccaatgctttaaaagatttatgggggctgtaccggtgttttgctggtgagaacggaggctaatagagttcccaaaaaattatttccaaaggtgtctgtcccttctaatttgagttatggtgaatggttgcatggatttgaaaaaaaggcaagaagaatgtatggctggaacttcacgctcagaggacggtaaggttctagagcgcaagtcgaaagaagctgatgaaacgcacacatttgctacagctacagtgcgaaaaatacaaattcgcccttgcagatacagaacgaattctacagaagctaccagaatagtgtttgagcaatatgaacttaactggtaagtttacggtccatgaattccccaagactattaaccagatgccttgatcattttactcttcaaaacaagagctatagcgatcaatatgccactatcacgacctccgataccttgaggaggagaacaagtaccttctcgaagcgtgaactatcacatggccaagatggcccgacctcccctatgacacaagatccaagaccgcttgatagcttgtagtaccacaaacccgttgcgaaagtttacaacgtgcgaaaaagatcacaacactccaagggtctctgtgtgcctttgcattcgaggcctacaccttacttctgaacttcctcccatccgccagttagcgaatcacgccgtcagactacaactccctggtatctgcgacacagctgttcctctcccatcgaaccgcagtcttgttgaaaaagaaaatccttccgctcctgctcaactagaccttgtgccatcctttccctttattgttacgcgcccttcgatgcccccgccgccatgtagaacactaagccaactttt

SEQ ID NO: 14278 - DNA, 789 bp, Homo sapiens
tggaggactcatttccacaacttgtcagaaggcttctttgtggtctcattcgccagggggatgaaaatagctgactagcctctgattactattaccaattacttgatggaaaatgaaaagatcatgtacagaggcgcatggaatagaaaagtagaacaaattgttagacgagtatcacacgagatagtaaccaggcctacgctttttccagctcaagacaaatttcctcttgcaactgctttgaatcctgggcccggtgtgtgtgcagacctgtgatcaaaggtgccagataccctggaattcaccatgttaacaaaattggaagattgtaagatagagatgaagttgccagtgttaccactttgtaagatattcttaaccaatcatcatgtaagtccatgaatagatagaattagattggcattacattatttacctatgttcaatgaaaaaggaaaattagcattcttgtatatgaaatcaaattgttgaaaaataataataagatgtgcaaatgtgcgtgcatggagttgggatgggcttggatgggaagtatctgtctgggtctgtgttaagtccaggggaacatttttggtttgatagaacttagggtgaatttggggaacagattcatggttatccctcattgtatttctaccatgacattatctaaacgtttagtaatcaatctggcttccttttatcaggggtggatttaaaggaagtgcttgctcccttgatctttaaaaaatgaaggccccctgggagaaatcctccctaatatattgg

SEQ ID NO: 14279 - DNA, 752 bp, Homo sapiens
caaggttttttgttcaataaggacttttgcgcacttgttttggtccaactacggattcccccgcttacacgatcgctttttaatagtggaccgctaatgcatgatgcactggtggcagacaatacaatggctgccggaataagactctttataggtcgccattggggcagaataatgggaggactcctgatccgctggggtgggtcctggtacgacctagccctgctgtaattgtgagtggacagatgctgcaagcgcagctttagaagagtgtgatcatcaagggctcatacctctcaggaataaaaagttggttcacaccacctggcacctgcaaataccactggcccaggagcaccttaccccatgttgttggtttccggtcctctgggatttttcagttaacaaacaaaagcaggccggcacagtggctcacccctgtaatcccagcactttggtagggtcaggtgtgcagatcaccttaggtcaggagtttgagaccagtctggccaagatggtgaaaccccatctgtcttataaatacataaactcctgggtgtggtggtgcgaacatgtcatcccaactacttgggagtctgaggcaggagaattgcttatgccctgtaggcagaggattcagtgatctaagatagctccattgcaatccatgcatgggtgacagagcaagattttgtctcaaaatcagttcatatataaattaataaataaatattaaaaaaaaaaaaaaaaaa

SEQ ID NO: 14280 - DNA, 777 bp, Homo sapiens
gagggtaatggaagcaaagatagtattctcagtggaagacgtgtcagcaaaatccgtaggaataatacataagctgggctatgcattattttggagagaaggacactaaatcaatgacatagttaacctatcacagtactccatcatctagaagagttcttgtcatttataaactccatttgtttcaggttttggtatttaaaaaagaaaagttctcagagacctatgaagagacttaaattaccaacaataatagcaggagacttcaacatcccacggagagtagtagatcattgaggcacataactaacagttttttggtacataaattcaactcttgtccaaatggacctaagaggcatctgcagaacactgtacccaacaacaatagaatatacattcttattacctgcaaacagcacatattctaagatcagccacacacttggccataagacaattatcagacaaaatacaaaatatgaaatcataccaactacattcttggacaggagcacaaaaatcatataaatcaatgctaagagaattgctcacaaccatacaattacatggaaattaaccaacctgctcctaaatggcttctgggtaaataaagacattaaggccgaaatcaagaaaattattccgcactaatggatataagacacaacatgccagaatctctgggacacagctcacagagtgttaagagtaggtttacagcggatatgcgctattcaagaggttgaaagaacccaaattaaaacctaacccacc

SEQ ID NO: 14281 - DNA, 708 bp, Homo sapiens
ctttatctataatagttacaacatgacacaataaatcacagtatagatactctctaggtgaatcactcgctaccttatatgtaaagtggtaaagctgctctctaaaatatttcagacatttcttaaaaaacaagacatgcaatttttatagaaaccataaattgcactcctgggcttttattccatagaaataaaacttacattaacacacacacagacgcacacacaaacacacattattatatatgtaaaatacattatatttgtgtatacacacacacacacacaagcaccttgttggtatggtcaggtgtgggctatatccatatacacaaaatttagaacagttttattcataatagctcaaaactggaaacaacctagatgtccttaaaccttcaatcatgtgcatggttaaacaagctgcggtacctccatatcatggaatcttacctatcaataaaagggaacctgcatatcaaggaatcttacctatcaataaagaggaacatccctatcatggaatcttacctaatcaataaaagggaaacctccatatgatggaatctcacctatcattaaagggaacctcctttcatggaatcttacctatcaataaaagggaacctccatataatggactcttacctatcaataaaagaaaacctccatttcacggaatcttaactactcagaaaaaaaaaaaaa

SEQ ID NO: 14282 - DNA, 738 bp, Homo sapiens
  misc_feature (1)...(738): n = A,T,C or G
cacgccccccattnnnncgaacactcgggagacctagcaagccgccgagcggcggagatcagctnnngcacacatctccctcgggcagactttggcccttcgcagccctgcgaggagcgtggggcgcggaggtggnccccacggcacgccgccagggngccgagcctccgcggggtcgagagggctctgcatagggcatgggatcgggagggtgtgatgggacatatacccaggcctagggtcgcgcgctgctgcacctaggccacggaacgtcgctcgggcccgacccgagatgtcgggacagagctcctgaacgctccattggctnataaagacatgaaatagacacaatggnngggaatagcccgaggcttacgcccccttgtctgacgattaaacaagcaagccccgccccccggggcgggtgcacgcccccccaggggnnnggggtcgtttgtgctctgaaaaacagtagggcaagggacagtattaggtgggattatgacccagaaaaatcaagacgctaccggtacgaacctccatcctagttttaaaattttaacaccaagactatgtccttgtactcccttctaattctaacccgctgttataaatgttagttttcaaactaggactttctataagaataatgacgtttctctcgctcaaaaaaaacagccttgatcatcctattctacattacttaggggancagaataaaagctggtccccatgcta

SEQ ID NO: 14283 - DNA, 869 bp, Homo sapiens
atcctaacaaaatcaacaagtcaaatcactcacttatttattagtgttccacgacccattggcattcctggtcggacgatcatgcaagcctgcgtgtcctcaaggaggggactctctctccctcactcccttccccaccactctcagcatcttaaaaacccaacactattttaatgcagcatgacagctaattctaatgttttattagctcaagtgtaaaaaaaaaccacagaaaagataacacataacgaaagctaagcaatcatatatgaggatagattaaaaaaattgcccaaaaaattatttcctttcaccccaaaacgtctaatcatgtctatagcgcagaaaatcaggggacatttgctatttaatggacgcgaaaatcaaatattacttcccgtaatacatcctacttcccttcaggaggcctgacatccactataaattctgaagaagaaatcccattataagtctctgtccactcctggagaatgttacgaacgaagagaccgaaagatgaaacacccccacggacacaacctcaacatgttatacctcatccttggaaactcgtacccaggctctgccacatacaagaattcgtcaatactactggttaaccaacgactaacagtgcactcgcaattactctacaatattcctacctcttatcccaacattcttacaaggaaaacacatcccaaaatcgtgataccactgagaaaaatagaaagcgggcccaacccccctccccccatctcttcactcccaaatataaatcctcgcccacgaaacgccattaaataactcaaccactcacaccaatacagattcaccctcgcatcccaagcactccacagctacccggc

SEQ ID NO: 14284 - DNA, 696 bp, Homo sapiens
  misc_feature (1)...(696): n = A,T,C or G
agtaccccctctnggccacggcacgcgaccctcccccaccccccgcgctcgcgggcctgnncacacaccccctactcgcaccaacgcacagaccaatctataaaggcgagcacctcaccatataaccgattacccttcggtggccgaccgcgacccatcaagaaagtgacatcgtcagagccagttcatggacggcagaccgcaaattagggctataatgtacaagcggcaggacacaaagcacccaggccatcatctacatacaggagccacaatcccgactcccngcccctgctggcgttaatatctcccgataagcgggggggaaataacgtgaacaaggaaagcgtgcgccgacataatgataaagaacagtatacactccgcggttcaacctcccctgcaaagcgaatnacactaaaagtagtcccattaatacgtgttatcatcattaaaattactatggaatttagctgttaatatggtttcgcggtgtccccacccaagtctcgccatgaatagtaataatttccacatgtcaagctctgatggatttataaatgggagttcctccgcatgagctctcatccctgcatgtcatgtaattatgtgcctttgcatatgcttaaccttccaccatgattgtaaagcctccccaaccaaaagaaaatataagtacattaaaaatctatccat

SEQ ID NO: 14285 - DNA, 829 bp, Homo sapiens
tccccaattaattgaaaccaagataaagagaaaaacatagcaggcatctctccctgtcgtccaggctggaatacagtggtgtgatctcggctcactgcaacctccacctcctgggttcaagcgactctctccctcagcctcccaagtagctggaattacaggcgcctaccaccacgcctggctaatttttgtattgttagtagagacggggtttcatcatgctggccaagctggtcttgaactcctgacctcatgatccacctgtcttggcctcccaaagtgctaggattacaggcgtgagccagcgtgcctggcctgtcagatttcttaaactctgccccaccaggaaagattttggtaagctttatatcccatagtttgcattaagaaaaccatatactgtgtgaaaagattatagttggtataacattggcacataaagacgcacgctacaggaagcaaagaaggccaataaataaaaagtgggcgcccactgccccacccggtggaggccctaaaggcccttaccctttataggagggcaaatccatgaccctgcccccctgacttcatatccgcctcagccccccgacacgcgtaaccggtatacccccacctaaaagcgtgacacccggattcccaccaaatcagggatccgcgcccgacagatcagagacgcaaaagccacaaaaggccggaaccgctcaccgagccccatacgtgggtccactcaaagaccacgtacactgacaagaacccggatagccccataagtattgtgggatgtcccatggggtatacaacccaggtggtttaaggaaaaccgcct

SEQ ID NO: 14286 - DNA, 726 bp, Homo sapiens
  misc_feature (1)...(726): n = A,T,C or G
attatacaatagtngggtaactcaatctgtaacaaaaaaacaagacatgagtttttgtttggggncatagtcctccaacgttgcacatgaggcccggctgatcaggggtctgccacaacacacagtcttcagacagggaatcatctaatcctcaacctgtctataaaagttctgagacaactgttaacaaatagcaaatgaaaaacgggcctatanaatcaaagtgtctggcatctaagccacactcaaaatgcaacattgtataacgcacaacagtatcaacagtaaacangcatcagcctggatggatgccttcatactcattcccatggaatccgatcactacatttttgttttcagccccaagtttcagggtatgaaagcaatatcaaactatttcttgagatatttacaaagagntaaagaatttttcctgttctggtggattttattataatacccacagttatattgaaatcacaggaggacaagaagtacttttgaaaaattattttcaccagactctttattgtgtttcccagaatggccagcattgagtaatgggttgtatcgttacgtgtgtgtggctggataccagatactaaggtcctcaaaaaccctacagcattttctttcttcatgaaataaaatgggacataacatacggttgagcaaaaaataaactacagaaaccattaatatggtaactaaaaaaaaaaaaaaaaa

SEQ ID NO: 14287 - DNA, 817 bp, Homo sapiens
ctattataaaacgtatgatgccgcggtaacataccaaacaccacattcaaggagcagcaagtgccttctgtaactgctggactcaaactgaagatgctgcaaattcctgaccagactctatgacacattctagctctctgacttcgcagcattgcgcttgttccctcacatacaaaatgaagggttcaggcatttaaagaactttctgggcctaaaaacaggcagagaataatcttatggaaatgcactggatgctatttctcctactgctgctggtgcacatggacctgactggttttttctggacagtaaaaggcgcttaacatctgtgaacctttacccccatatccctgctactttctcaccatgctggctctgctggggcccgcataactcaggggcactaggccgtgggtggagattctggagggtgggtggagagctctgagttgatccagggcgcccagaacttatgcctcccgcgccatcaggaatttcagtccaacctcctgtacacaacatccattccctcgaactgctagcagtactttttatgtccagataccgtcaccgtccttcactgccaagaccagagctttgatttcacgatatccacaaaggaataacctgcctcacaacactcactgccggacgcactgaaccggcttttgcccaaagtagactatgtactaaactatcggaaagcacctcgtgctcctccccggaccgctccgcatacacctatggccccattcactcttccacctcactggggcaacaaagcccgccgctccgcgaatttttacaaataccaaat

SEQ ID NO: 14288 - DNA, 1496 bp, Homo sapiens
  misc_feature (1)...(1496): n = A,T,C or G
catactangnatcacacatagtnangnnnnacangcatnatacatcacatggnnangacatcacatgnaatatagaccaacgagcagagacgagtggagtgtnttngnnactactatgnnngcagtaacgctcttacttcgatctgcgatgcgagcacgcacgtgtcgtcgcgcagtctctntnggacgtcaagcattagtgagagtgtgtgnaaatatgtggacgagcgtatacgtgagagcgtgagaacagcaccacgngggcgacatcgctgtgcatggcgngcnacatggangtgcagantgcgcggcagtngngaacacacgatgcaggtgnactatctcacatacaatcatgacagatcactatgactcgaaagcagtagatgtgctaggcagtggagngacatagtnttgngatcacatgtaacataacgtgnatgacgcgcgtagacattagtgtgacagtagacgagngcacgccgaagtgaagacntagcttctactgcganantctatactcatgatangtcatactgcgtnggtgagtcactacacacantngntacctacataaaacactgaganggaaattataancactctctgtctaantagtaataattaaatagangnnangtagatacgagtgtggacccgcatgaacacgtaggacgcagtccagctctccgcgctcggacgcgctgcnggcagcgtacgcgtncgcgctgngccnggcgcgtgncgtgagcgtgtgtggctgtgccaagaccattaataactcgacaggatngtggtgtnngnggtgctctcgtangnacgcgtaggagacggagcggngagacaccaagcgatgatgggggattanttgtnngctacacactgtnncataccgntngctcatttcacgtgacccatcgtccactacgttggcgantggctactgagggcgtcgtcgcaactgnggaccaggacaactggagattaatatnnatataacatatgcnactattnaacttcganacgtangtncactaaacacgtctncncgatctgatcctctnntcaaacactcctatacacactctctcaaacaccatacatcttacnataccctatganaatcaaccanaaatanccatctnccatctgcncgcgactgttgnctgttgccgcagtaacacactgatccacgccacctaccaacctgngcgtcgtctccatgaatntnnaaccacatcctactccacttantcannaacgtctacaatcaattnnactatacacatccaactctctcttccatatctatctgacaacaatannnnaatacaccgcaactcatacactatagttaccacaatacatnccgctancctatcccacncntnccnnncncaaacatctcctctnnnacttctcccatccaataataacttaaacttnnnaactatatctcattatatctatcactatatancactatctaacactac

SEQ ID NO: 14289 - DNA, 1198 bp, Homo sapiens
  misc_feature (1)...(1198): n = A,T,C or G
tacacaaatagcgacttgccgacaacctacccgatactcccagatccaccacctcacctctatgtactagcatgcataacggcatgcgcataatggacggcaggaagcaaacttccactctatatttagtcgcacagaataagcgaagcatcggctatncactcaagtacgaactagcacacncatgtcgaaatccgccatgcggctatggagaggcacgcatctatgtagattcgatccatctattcttctcaacatagtaggcatgagttacattgatcggtaggacacactagcccaagcagcaatatatcctcgcgatcataaaagtggcaataaagacacgtctcgcctactactctagcacacaagacttcctcggcagcctgtggatatcgaatcactttcgaaatcatacaaacgcttagcccaaccgtaggccagaaactaccctcaacaagcacaccgcttatgtaccactaccctccgtcatcgccccaccaccaccgacgtgcatcccgcccaccgcaccatcatacatgaactttgatgcattcatctctgtcacgaatagcgtactcaccaaccggatcaatcctcacctggccacacacctccaacactcgccacaccttctcttaaaacgggacccgcactgattcgacgcgataccgcaccttgcaccaccctgaccactatcctacactcaaccgatgctcagttgacgcgactcctcataactttgaacaanttcgtacgctcataaacataccccagcaccccactcgatccgacctatcagaacccccatcgcgcttacgaccccnattcggacactaacacacctctcactagcctcgataccccatgcgcatactaaccgaccttatataacacaatgccgagtatgcgccctagtcctcacttacccatagtgtattcgcgcataccacctaacgaagactgtaattctctacgatcagtatctcctcatcctctagccgaatcaccgtcacacttcgtcgccctcaccacccatacaacaccgatcaatgctcacagacgccacatctccttgcggactattagcgcatataatatatatatcatacgcacgcggcgtctgtcacaacacgcaccctngccagcacgcgcgctctaccagacacagcattcgcacacagcaactctcgccgct

SEQ ID NO: 14290 - DNA, 719 bp, Homo sapiens
ctttcagcagtgagtctgagactgcctggtactgccttccaatcctctgcaaatccaactgataagcaacttcctgaagtcctccctggagatgtatggagaacaaagttaatattacaaacccaacatgcccctactggagccaactaagtgcagttatgagttcactgagttctagcaagaagtggggacaggccatttatttaacaggccttagtaacctctttttagctcttttattccctttttccagacgctatattgtgctacatcctacattttgctcctttccatgttgttaatttttccagaactctgccattaaaatcagaattgcaaggctgaggaaatagtaaatcccactctaattctagacagcaaagctctatgtcaacaatttattagggtaccaagttctaaaactttctagagttaagaactcttctaagaatctgttataccacagaccccatccctaacaaacagcatttataccttttcattaggttcatggccctcgagtgaagaatgcctgccttaagatgacagaagcggagggttcccttcatggccaggttaaagatcgttaccacacaaatatctgaccaaatcagctttatattataccctgtctaccaccacactagcatctagtactcaaaaatgcatgctgaacacgtgacaataaagcaaagtcagctttaaaaaaaaaaaaaaaa

SEQ ID NO: 14291 - DNA, 1121 bp, Homo sapiens
attaactaatctgatttattccagctcatataacctctatcgcaccatacccagacattacgatctcctctgtctctacacgtgtatgacgaagctctatcgtacatctgacaccaggtgcagtaattaagaaggcgatatgaaatagatacacctgacagtatacacaatcttgactcaaatataacaagcgttcgcacatattttagaacaaaaagagaacaatggcaccttctacactctatggaaacagcatctcctagagtcattttatacactataccgtacgcaatgcatagttcatattagccacaacacgactagtacatactacttatctcggccatataattcctagctctttctaacaaaaaatatactcgttattcggcactccagctgtccatgtcaacaagagactgcgcctaactgcgaatctctcttgttacaccttatactactcccgcctttcaacccatatcacaagtacctcgtccaggttagactcaacacgattgtactccacacaaccccccgcccaacctgtggcttagtttatcctttcatataacacacataacatacgagcgcatcacgctaacctacgcaacgatgtcacctcggctcaccacacacacaattttgtctcactctcctacatttctcgttacaggacatagacaagtctgccaataacatatcagactacaaattaaagaacacatatacataacatcttaatcattactaacaataaaaccaccaacctaatatccaataaaatactagctccgcgctctcggggtcccagaccataaacaagtatcagccatcggtccgtgcgacgacgactaaccgacgacgaaccaccgtccatgttatcccccatcacactgcatcgcgccatatactccgtaccctaaaacatcgcgtgttcagggactcatacacactggacaacaacctcataccgcgtactacccctccaatccacagctcaacaaaatacatccatgcgtccacttgagaccaccagcgatttataacatatcccctatattttccaaatatatacctatcgccaccatattacttccataatatctccatacttccccacc

SEQ ID NO: 14292 - DNA, 745 bp, Homo sapiens
  misc_feature (1)...(745): n = A,T,C or G
cctcactcatcactangaagtatacctaccttgactctcacaaacctgaaactcgcgcgggagacacaagggagcatctcacaaacaaaaagaactcacgaacatagcgtgcgtgtttcttgctatttccctccccccctgaatcagatgaatggagtcggatgcctgacattgaacttaccaggcccgggacgaaattttgagtctgctctgcgggggtgacaagactacggaccggcataagaaaccgagcttttcttctggcataaaaatttcgcctggacaaacatcaacgcggggcttcttttttnactctcccaagggtttcatcccagccctttatatcgtgnaggcagcttaatatgcccgaattttcagaatggccaaaaacccttccccaaatgtttttgggcacccaaggagtttccccgttttcttagggatcgggcctataaatttggattatggggccctttgctgccaccccaggattatcaaaattttttttggttttgagattcccaaagttttaagcaaaaccttgcttaaaaaatggagctccatcctttttttttttttcaaaagaaaacatttaaaaacccaaaggtgggatttagcttatttttaaggaaaaaactaattgttctccaagctttatttaaatgaaaaatataaaataaaaaaaaaaaaaaaaaaaaaaaaaaaaaaaaaaaaaaaaaaaaaaaaaaaaaaaaaaaaaaaaaaa

SEQ ID NO: 14293 - DNA, 739 bp, Homo sapiens
actttgataacagtgggagcccaggaacctctctttgcaccatggattcttcatctcagcaaccaacatctgtgggcaacttctcagccagagtcatgacttaaggagctgtactcctgtgtgaaattggcaggatctgagctcttctgcctatcaagatccatgctggctggcacaagcacagaaattccttttaaaattgaacatgtcagccaaattaatcccattaaactctaagtgaccttccactgaggaaagctcattaagaaggatattgctgtgttactattcctactctaccatagaaattttcttagggaaatgaaggttttttttaatgtcatagaatatcagaggtagaggtaatcttaaagatcatagtcggctgtggagctcagcccatccaatcattttatttcacaaataccttggcatttgtgaaataaaattcacatcagaatatgttaataggcccggggtgatggctcacgcctgaatcccagcacttcagaagaccaacacgcggcggatcacttgaagtcaggaattcaagaccaccctggccaactggggtaacctcgcctctactaaaaaaaacaaaaatcagctgaacatggtgtcacctgcctctaatcccagctactggggagggtgaggaaagacgaatgttttgaccctggggaggggagggtggaagtgaaccaagggtctcgcccataggtttacaagctggggaaag

SEQ ID NO: 14294 - DNA, 727 bp, Homo sapiens
ttgggccaaaaggcgtccgcgacaccttgttttggtgccccacacggatttccccccgttaatggaggcatgttttttgttcccaggctctggccggggtccccggggcagacaaaaccctgggtcggggaattcgggctccctatagggggccggggtttttcctttaaaaaatgcccaaagcctttgggaggtataaaaaggctgaggtatatttaaaattgtttgggaccccccagtcctttggggccccaaaatggtgtccttatccccttcccggttattttccttcctggcccccccccattacccaaatatttgggtgttaagcccgcaaaaaaaagggacagagcctccccccgaggtttttcatgaagggaaaattgaaattgggttcggcccccccaaaatattttaatatggaactccagaggctttgggtggggtgcagcctttcccggttccaaggtttttaacagaaatcagtttttatgagggtttgcagaaaattgttttttttgtcaacccccccccccaaaaagagggggaatttggctttttccgatttaaaaatttggaaagcctttgggattgccttcccactcccccagaacttttttcctttatccaggaaaaaaaggttttttttattttttccaaaaaaaaaaaaaaaaaaaaaaaaaaaaaaaaaaaaaaaaaaaaaaaaaagaaaaaaaaaaaaaaaaaa

SEQ ID NO: 14295 - DNA, 772 bp, Homo sapiens
ggtatctctgttgctgccctgagatcttgatggagtctcactctgttgccaggctggagtgcagtgataccatcttggcccactgcaacctccgcctctcgggttcaaacaattctactgcctcagcctcccaagtaggtgggactacagtgcacttctccttgctgtcaccatgtgaagaaggatgtgtttgctttctcttccaccatgattggaatcagaaaagaatctgaactccgatgacttgctgtgcttttggctttgatgtgctcctctggcctctgtggcggaagctccatgttaagtaacagacctgaatttacactaaaagtagtgaaaataccacaacagctaaaagaaagacttttagctgttgtgtctctaaatttacttgcgtaagaacacagtttttgtagtaacacacataatggtttcaactgccctcaaaattaggcaggtaaaatataacatagaacattttctagaaaatatgtagaatggcccatgaggcagaaagcataaacaaataatgggctcaccggaaacaaacagaaatatttaccaagagccagttggagttcaggtttatggataatactttaaagtttgacctccaaattcctggaataccaatgacttctatgtaccccttgactccagctgtggttttttcacatatcatttgcctaggatctgacaagaaaaccattcttctaaattgcacttttgttaaaccccaacatctaaggtggtgaaaggcactgatggttaa

SEQ ID NO: 14296 - DNA, 726 bp, Homo sapiens
tgtttcctctttgggggctcacccccttggaaataggcggactcttcttttttgggaggcggtggggcccacaaataacctccgtggaggaggaaaaggccccccgcatgggagtcatcccccccccggggaccccaaaagagagggttccggggaaagagccatcttcctcttcttaacccccccctttttgtttcccaacggcacagggaaggggaggtcttttttttttccgggccgccttttagggcaaaggggaggccgtggaggggcttaaagcgtggtaaaaggtccccctaattaatgtccccaaaaagggcaaacctttttaaaagtttttgcgggtgttccctaaaacaaaaaccgggtcccccaaacctgatgggggaaagttttagtccccccccctagcccgcaaaatttgggatttttaaaaagtccattgtggggcccccccaaatttccaaaaacccccctttttctcccgggaaaagggtttttggctccccttaacttttgttaaagaaaaaccctgtggccccccaaaaaatttccaacccaattcccttgggttttaaggttttagggttggttgcttttggcaaaaaagggacttttttttttttggaggccttttaaaagacccaattttttttttttaaaaaaaaaaaaaaaaaaaaaaaaaaaaaaaaaaaaaaaaaaaaaaaaaaaaaaaaaaaaaaaaaa

SEQ ID NO: 14297 - DNA, 1214 bp, Homo sapiens
  misc_feature (1)...(1214): n = A,T,C or G
gtatactacaatatatgtacagtctattagagatacagcaacgtgtcacttagaatctaaacagtatacattcctactctcagcacatctatcgttatagactcgcatacatatctcacatatcgactcactctcgatcaaccaagatatggctcgccacctcggtgatgagtnngcagttgcatcatanacgcctcctctatcacggctatatgtgtcgcactctacacgcccttatcataaagcacgactacatatatcactgggctagcggntattcctgcactttacctccgtactgtatttagttttatatactgtgattatggtaacggaatattccgcgcgaccacactaactatggacagcattagcgcgatcgcacactctctataagcacaatcacggcgtagaaaccgacaggcgttgatacttaccacacacacatcaacgaggataatgacacttgcaaagacgaataaccaaaatcacgtggctatccacatcagtgaatactctacatcctattacagcaaatttacagcaacctgttgtcagataacacaaacaatatcatgttaatctgtatactccagtccgtacactgtttgcagcacaacactccgacccgcaggatatgccatatattttgaattgtcattaccacctttacacacttacacataattcttcacactcaattacctatccatccttctctcacaaattacacaccctatgtcaacccttaaaactccatatccatcactacacaacacccatattcctaaccagtacttcgacatatacacggtcataccactactaacaccccccttctctacatattatccaatcccccatacgatcgtgtaaatcctggctccgctagactgccatctttctgatcaaccatactcccactccctctactatctcaaatacgaatgataatgttccaactcttattttcctatctctgcttcttaattttcttctaacaaagccgcttctatatcgcttctatcactctttcgtctaaatatctccacacacgacaatcgccgcgtctccaccgccgtatcacacacctatgtacgagactgagtttcttcgccgctacttctccctatacaatgcatccactgaatcacaccttactccccataccnctccatcgatcctcgagtcaattatcacctccatctctcatg

SEQ ID NO: 14298 - DNA, 722 bp, Homo sapiens
aacaaggtgactttagagaaaaataagggcagaacaataattctattggagagaaggaaaaggagagaaggagccaagtctatctgccctcatgtagctcctcacagagcaaagaaccagaaaggccgcctgaattccccactctcaaagggaagtagagtgttcaatttagactttgcttctatcagctttgtattagcctgttctcatgcttctaataaaggcatacctgagactgagtaatttataaaggaaagaagtttaattgactcacagttccacatggctggggaagcctcacaatcatggtggaagagcaagggacgtcttacatggcagcaaaaaagagagaatgagagccaagtgaaagtggaaacccctaataaaaccatcagatcttgtgagacttattcactaccacgagaacagtatgggggaaaccaccccatgattcagttatctccacctaggtctcttccacaacatgtggaaattatgagagctacaattcaagatgagatttgggtgagaacacagccaaataatatcaagctttcatgattacagttttactgtgaatttcattgatgcagttgtcttttctgtctcaaactaatttagcaatttcaatttatatttaagatactgtgggcaaaataagaccaacaaaacctaaataaatgaattaaaggcaatgaacaagtcaaaaaaaaaaaaaaaaa

SEQ ID NO: 14299 - DNA, 833 bp, Homo sapiens
attcttacaatgtgctttctccacgtataaacagcccgactcacactcagtttagggaggtaatggaagcaaagaagtattctcagtggaagacgtgtcagcaaaatacgtaggaataatacataagctgggctatgcattattttggagagaaggacaaaaaatcaatgacatagttaacctatcacagtactccatcatctagaagagttcttgtcatttataaactccatttgtttcaggttttggtatttaaaaaagaaaagttctcagagacctatgaagagacttaaattaccaacaataatagcaggagacttcaacatcccacggagagtagtagatcattgaggcacataactaacagttttttggtacataaattcaactcttgtccaaatggacctaagaggcatctgcaaaacactgtgccccacaacaatagaatatacattcttattacctgcaaacagcacatattctaagatccgccccacccttggccataggacaatcatcagaaaaaacacaaactctgaactcataccacctacattcttggacaggagcacaaacgtcatataactcactgctaacagagatgctcaaaaccatcacattacatggcaaaatatacaacctgctcctaaatggctttctgggcacgtaaagacattaaggccgaaatcaataaagtcacttcgaactactgatgttaaaggcacaacatggccaaaatctctgggacacaccttacagagagttaagaagaaccgctaactgcaatatatgcctatacccaacagcttgaaaagatctctaactaaacctat

SEQ ID NO: 14300 - DNA, 1206 bp, Homo sapiens
  misc_feature (1)...(1206): n = A,T,C or G
cgtaatcccctcaacaaccggctcccccgtaaaatcacgcacagaaaaaaantttgtagtntacgcacaacgcacctttccacgggacacaacgcaaagaggacgcgctgaacatcacagcggagctgccagaaactacaacacgagacgacaggacaagctgccaccgagggacactagccgccaccaccagcagagaccagccacagctcctgccgagaaacacaaaagcaacgacattgtctagtacctgcggatctgtctctctatcatggatcctcttatcccagtgccatacacgcacgggcgtgcacacgaaatattttttttctcaagagctcatcacgaacctcagctgctcacatggcgacatatatgcggtagatccccttcctccaacgctgtcatacgtgggctgcttgacaggtatcgcatttcagcaaactcctagcccagtaatttaagacttcatcgcatacgtgtgtattatctaggatctactacgtacatgtcacctttcctcggctgcggcgcattacatcacattacttaatgatcgattacctcgcacaccaatcgatcgatgttctcaatctcaagtaatgttgcgaacctacttcgtcacacgctactcacaggagtacgctctctaatagtgcctaggacagaacccactcacatccgatcatctatgtccggcgtgcacagccaccgctccactccaagcactcctccccactgtgtgcgaccacagataagctcacagatgtcgtcgaccgcttagattgcattctccattcctacgcagtctgatcggcctcgtcgatgcacgccgtccgtacgatccctctcgctgttattcgtcacctcgcccttattgtcatccgtatcaccatcacgtgtgctacccacgttcacgctgataacgcgccgattgacacctcttgatgtatcaccacatcgtagcgacacacatatatctcacacaccgccctccgattcctcggcnttctcgcgctctcatcgatgacgcctctcacctcattagatatcgtctcacccatatcacatcactgcgccgtctcgctccacaatcaatagctctctatccctctgaatcaatgtacatcatggttacactcgaggtcctccgctcgtcgtntgcagtgtcacgagtagatctgtgctacgtcgacgacccgtcgc

SEQ ID NO: 14301 - DNA, 1296 bp, Homo sapiens
  misc_feature (1)...(1296): n = A,T,C or G
ctctgccacatatctcgtnggagagctgtgcgtcttcctatggtgtcacgctgtatcgacacgttctgtcacggtgtngtatgacgtggagctactccggnangactctccgcctcgctctctccgcttgtggancgctctgcgtgangncggtcttcagagtgctgcagctccctaggcgcgcgacctctgatgcgtgggtgcgacgcttgggacgctgtctggtgagtcactctacgctgtctggggcgtctgtgccgtctgcaggcgccgtcgngctccagcgtctgcgngngggcatgtgtcagttagtcgtgtcgtggcggcgctgcgncatctgctgcgtcgtgtccctgcgcgncgtggtgngngccccgtctcacctgtcgatgtcctcgtagngtctacagtntgccacttcgctgtnggccatctacgttggcgcctgcgttcggctgtcgtgtgctctgccgctgctggctgaagcttcgctnggcgactctgtctctgacgtgttngagtctgctgtgtgctatgtgagtgcattgcttncacgtctcccatcttgtacaggcctgctcatcgangnncgcctcgctctgatcgncgtcgccggtgaccgtnaanggttgggtcgtggtacgctgtgantcgtcctgnntgctcctgtgcggtgcggnggtccgtggaggggcgtcggcgggggcgtgggtgtacccgtgcttagggtgaggtcggcggggngctgtgcgcggacgcgtgtggtgtctgtggccttcggtgtgggnggaagcgcgggactaccacgggccccgtnctctatgccgcgcccccctctgcctcggcgaggccgcggtctcccgtcctcgcccccgtgcctgcgcgctgctgngtcggtgcttattgttttgtgcttgtttcgtgtcgaggcgcgtcggccccgtggttgtgnctcgctccgcggctcgtgtgttattgctctgtgactactaatatctgtgaaataataattgcgcatgtgaagtattgaattgttgttttatgtggtattaagatataaaatattaataatataaaaaccctcctttaacaaaacgttaaaaaacaaaaacacaaataaacaaacaaacaacacaacaaaaccaaacaanaaagagagcaacatgcgtcctgcagttggtgcgctacttgtctggtgcgcagataggttgctgtgccagacaattttttntatcttttttgttcaaatttctatctttnntcccctttttttctctcctctctttcctcttcctc

SEQ ID NO: 14302 - DNA, 1304 bp, Homo sapiens
  misc_feature (1)...(1304): n = A,T,C or G
tagtttttaaagtgctgttttgtatgaactatattcgatttatactctaattttccttacatctggaacaccgggtatggttagttcgagccttgagacaatgtagactagctgcggacagtctagcagaagattacaacaacacattatctccacctatctcctagaactacgcgcctttaggcaaaatacattataattactgttgtaggatagcactggtactaacttcccacctacgtatctctcctcgttcccatcgcgattgaccagccacaagaacacacattgaactcctgcacacaattcgacatgaaacatatagtttctcgcctacgtggcatccctaccaactcttctacaccaatgtacaagaggctattaccattgtaaacgctcctctgactattctccatctccacgttcantcactctctatcgacctctcacggcgcattgcatagtgtagtgtatgcactaactacaaacgcagagagcgtcaccgaccccgtcctcggacatctacgagcagcntgtacaattttcttctcagatccgtcactcttcgcggtatcataccttgatcccatatatcacatgtacaatgcacgaatactgtcgccttcgctatcatctcctcgtgatgtattaggtcgcgcgcgctcgtttactcgtatacacatctacatacctacatagcgtcgtcgtatgcatcgcagcaatagctaggtattgttcattgtgtgcatctaatcataactgtagatgatgttcatgancacctatccccatgataactcaggtgcacgctactatctaactaatgcanaggtgaacggtgcacaattcagcaccgcctgcataatattctaggcatcntgtaggtttgtgacaacgcgctctaccggcagctacgcactatcttccacttccatacataactgtccgccgcgtactataatcctctatcctcaccatcgcacgtttcgcggtatccactnatacactcaatgtatatcccgttcatttatcacctcgattatgttgtcgtcgatacggcgcgctcgcgtctcccgaatgccgtccacatgtacaagagaatacgaacacgccctacgacatcctactactatgctgaaccatcacggcagtcgtacgcgattatactcgctcgctagcttttgtagtatgagctgcgcagcgcgtatatctctcatcagatcagctatcagtctatnacacactcgcgctcatctctctatgtatatctatattatagcataattctcgtatcgcactcgact

SEQ ID NO: 14303 - DNA, 251 bp, Homo sapiens
cgctgccattcctcagccccttcccgccagagcagaaaagagaaaaaaaaaaataaagccaaagaacccaaaaagagtaaaaaaagctcccctggttttttttttagaatttccctgggggtttaattttaaaaaaggggacattaaaatttaaaaaggaacccataatttccccccttttgttaaaagaaatttgttggctctataaaaacgcttttgttttggtttaaaaaaaaaaaaaaaaaaaaaaa

SEQ ID NO: 14304 - DNA, 956 bp, Homo sapiens
  misc_feature (1)...(956): n = A,T,C or G
ttccgtgttttccagtcaatgacaacgggagggcgggtttctggggaataggcaccnacctccaagggccgaaacttccggaggggaggngatggccagccaagacgatccactcgggcaacccaacagcgggaccaaccacacccgggctcaggaactaatacggaaaagtcagacatctttgtagaaaaaacggagccacgcgacatgcaacaccctagacggaaaccttgctgacagcaccttccactatacactttgagattacgtaagctagcggtgttttatcatccatatggaagaaagaaaaaacattattttgagggcggcaaaaaacactcgtactgtactcaatagatatggtcaactattatcggatgtccaacttaccgcaaacacccttatccaatgtgtaaaggatagaacgtccccttatagtcagttaattaccaccgtcggatgctcattactcgcgcttactagtcaacactaaataaataaaaatatggtcttgcgacggcctctaactgttagaaacttctcgcagcccgtcacccttgagaggagggtcaacataagagacccctacgatcgactagatacgtttagtcatggaacctaccctagaagatgtcaatgaagccctaccctnaatttgaagggcagccatttactgttattatagaacatctaagggcaccccgcacggaaataatcccctgaagctaacggcgcccgcgttggcgcggtgaccctcagtactagttcgctcagctggcgtacaacccctcagatcctcactacgcatgaccagcatcccacgccatgtgggcgccccgctccaactctggttacacctgcttccgcccctcgagaaccgtcaggttatatctacttcgacactcgccccactatctttcgcgtcactagtccgtcgtctgccagcgacatacacg

SEQ ID NO: 14305 - DNA, 1571 bp, Homo sapiens
  misc_feature (1)...(1571): n = A,T,C or G
ctgtacncgacgtctgtantcgcganaatcgncgacgactgtactcacgcatgagctnggncgtcgaacacctacactcgcacaaccantatcatagactacgtgananctcatctctctctcgttatgcattatgtanaaatcactcatactatacatatgtcatctatagattaactagtagtatagagatantttgaacagtagattatgcagagagatattggaacggtagacgcacagtcactggtaagtggtggtctatagtatnggaggtgatcgtatangagngctgcgtgatggtgattccgacgtngaatactatagactggtctgagcgatcaagtatgtaagtgcgattgggagcgaggtgtggatactgcaggatgcgcgctnctcggtgnacactaatctcacactgtgcgcggctgcgtgtanganaatatgtagtgataganannaatatccgtatactagatagctgataataacgtactgactcatcacatgagatatctacataacatctaatcgccgcggagtanttatcgaggcgcgaagagtagtagattagaacagattaaaggagacaatgcataacactgtaaatcacacaactataaatatagtgngncactgcatgcgatatagtgtacactaaatggaatcattatgtgtanacacgagtggcgcataagtgctaatcgttgaggtgnatatgtgacatatagtatattgatggagagaagatgtgtgagaatctttattggactgaggcagtattaagactcagcatatgataaatatactattaanangatacgtacgcatctaactattnnagtactcacgcttacttactgcacaccttctgtnnacatatttctctctactctgnntctcgtntcatgaagctcatgtatatgtncgctnacncntcttacatactcatcatgacttcaccatttanncatatcgtaagtnctcacatacancacttctacgcttctattttnnnnnctcactcttanntacaaattcgtnattgtcaataatctcataactttataattctatatttaatcnancncacctattcttncataaatactaaacaacataacnaatacatatcaataacaccacacatatatacaatctcaactataacctntctatatcctcatccattacatcatctctactatcncctctatnnnncntccctatttatctctctnctctcatatataacatacntttcnacctcactatacttgtatctttntntntnatgttagaaatattactcttcccactatctactancacacatcgcaacacctcaccaacaacacaccaccnncnccacaanaaccatttcacctatactacttnnttaaatattcataaatannaatanttttatattcctctttctctcctcttttccatatatctattataaaattttttttacatantgttatctnnattaaannnnatnnnnnnnntntnnnntncctttttntnnnnntctttttttttnnnnnnnnnnnnnnnnnnntttt

SEQ ID NO: 14306 - DNA, 746 bp, Homo sapiens
  misc_feature (1)...(746): n = A,T,C or G
gatttcacagtgctccccaggatggcccccatttattaaaaagaacattccaatcatcnccattgggtccgggatgacatagtagaagttctcagcatcaactttggctggagggcctcctgctcagctggtgtgttctggcgccaattgtccatataagtaataaaaatccttcggaagacgtcttccagcgtctgtgtgaaattggataaagtagacatgcttccctcctgctgcaatttaaataataaaataggcgaacaaggttaggaaaacggatcttttctggatttggctatgtaaaggtgggagggagatgccagggtataagtaatagtatttcttcttaacctggctggtgatttaatgcatattttgttagtctttaaactgactgcgtacattttattcactttttttacaatccatgattgttacacagtaaaaatttaaatggcagagaaaattatatatataccctttgatatttatatatgcatgtaaataaatgtatgtgtacatatgaaaatggagaaaatattagaagtacatagttcagaatgttaacagtgggtggtgtgcttaaagatatgtattttcttctttatgcttttctcatattccaaattttcatcagcagtcttgcattacttttgttttttaaaaaattggtaaccttacaagagctagaataatgccacattcataacaagcactcaacaaacgtcaaaaaaaaaaaaaaaaaa

SEQ ID NO: 14307 - DNA, 858 bp, Homo sapiens
acattcaagacaaagccgtcaactcggtttttccagacaagagatcaacgacttcacaatataattgagcgaagcatgccggctacgccctacctcctgcggaggaaagcacgtgacatgaggacaccaagaggaatgtgaacaggcttccctgattatttgcattagaccattgactttagtcctccagtccaatattgcacaaccgaccaaaaaatacagactccctgttcataagcatcattcatgaaggctcgagtgtcatgtaaagaccatatctaaacaacgattctatgacttctaaaagcaccaaacagaaactgagcctcagatggaactcataggtggagctctcgtggccgctcccctttgcgggagggtcgaatcctgagaccagttcactgactcgacgcatatacgaccgaacgcatccaccgagcggcacccccctataaacaggccggcctcccgacacctacatacctgccgggcctacccacacgcaacaactttcctatgccaacggccgccacacgcgcgatcacccctcaatacgtaggcgggctaaatataatctataggtctctaacctttagatcgccattactccccccataccatttccgtttcgatcacatacatcctcacgcccattccacgccctgccgggccctcttcagatatccccaccacccaatctcaagcttacaacgacgcataccagtgccaaagagttgagtcacaccaaaaacctcgtcaaacaactacatcacgccgtatttacactatcatcgcaccactacagtcgaaacaagcgcttaccgtctatagtcactatccgtgaaccgcgtcaaatag

SEQ ID NO: 14308 - DNA, 912 bp, Homo sapiens
taatcaaacaatccttcacccaatatctaaccatccccccccacatctccctagctctatcttttatcctccttgccagctatcgtttcatggatgatgacagaagacatgagactttaggatcttagacaaggactttatatactcgcgtcacagcaagcaccgcgagcatgcaccatgtttgagtcactgctcgttgtctaactctcatacaagggatcgaccgcagaccgcgattgaagcttagacacacagcagtactgcactcctgagagcaaccttgtactttttgacctgccatctcttcataatagcctacccgctctttctctctccaggatacaccctattagtctatctctccaatccttattctcaatcccatcacaccctggcaccacactactcaccaaccacaggcgctcgaccccccttgtgtactccccccgatcgattatcacaccgcccgcccccgttatgcgagtagctgtctcaccccctccacccactggccccttccgtatacccttataagcagagtatcgtattatacaccgcaaatgcgccctactcttaccactccatctcgcccccccccctattcccactaattctccccacacaactacgcaccacacttaccaccagagccacaaacatcccacacaccgtatgcgcgctcctctatttcactcatatatcgtgattagacatcaccaatgcataaattctatccctcccttaccagctcttcgaagcgcccgcacttgacctataaactaccagatcaaccaccccagcttcacgtctctcatccttatgtgaactctaagctgtcagatccactgacaagacatatatcaatataccacacacgcgacttgctacctgaccaccccgatcagatgagat

SEQ ID NO: 14309 - DNA, 855 bp, Homo sapiens
caaaacaaaatacacacataccattaaaaccacacaccaaaccggttagtactgggaactcttacgagccctggtaatgtatgaccttggtcctcttaaaaggctgcagaaaggatggactattcaagtacagattacataactctgcatagctaccttccctgccacccaacattattcgcttgctcgctacagagagatcactacttttctgcatattgaagatatgcggatggagaatctgaggaacatgatcgttcatttccagtgtcttcctatgtactccctaaacttaagattatccctgattggatactatcttaggggcacaaaacataagacttggcgaagcccagaacccactctctgcaattgcttccctgccgcgcatctcgatttcgcgccgatccccttttctcgtttaatcccatagtgaaaggcaaaatgcttccctttcaccaaattcccttggtcctaccatcagaaaccaagcaaccccatcaagagtacctgcctagacgctgacaaacacgcacacggaacgcccgctgttcttaagccacttactatttcctgagacaccgacaccatgactcatatcacttctctctcacatctatggctacccgatccagttcggaccaggcgtgagcacacacctattagcaatcccaccccaatcaatccgaaataaaccctcacccatttcgtaatatgactctatcaaacgcatataaacctctttataagaggacagcatttcttacatccatgccagcggaacattactctagcaattgcactaacaagaagaacaaacatcgaatcactctaatagcaaaaactgaagaaggt

SEQ ID NO: 14310 - DNA, 862 bp, Homo sapiens
ctctcccatctctttacaccattagtatctttatcatacacaggtctatattatgtccctgcggataacatcctgacgtgcgaatgaacaaaaagttaaacaaacaaaaagctagttgaaggcctgaagagtaaccagaagcataaactggagggtcaccttcccctaaaagaagagaacttcaagatgtacaagtttgcaccttttgcctgaaggcagtccttattcttcacaaggttaagggtggcataaagctgcatcttcacaggcttgagatgtcaaggactgaaatggggcgggccagagcagagcaaacgtcaagaatgttaggacaagaattctggacagaggggaactgaagaaggagtcaatttcaacctctgtacagaaattttgttcacagacctcagtaggattaagcaaattggcatactccggggggcccattgaaaggcacctttcgttagctgaaaactaatcacacacttagcttagctatccattatacggatcgcttgaacctctctctcaaccgtaacgtgctcgtttgacgaacaaacgtcttctatttatagatgaatcgacactcgagccattatctctgttcgaggtaccgtcattcctgcgcactctgctaagcagtagtcgcctcacgcccctcaatttacaattgctccgccgccgttactaacttgaatgaacgaaccatgatgatcattacaaaaatgtacccatatcacactgtcttttaatgcagtagttttcgagccctatctagcgcctattcggaggtgcctcagacgagtagctaacacaacttctgcattatatcaaactctcccctcctccctatactctatta

SEQ ID NO: 14311 - DNA, 1018 bp, Homo sapiens
tagaaacaacaatcccacatccacaatatcaccaaaccaccaacaatacgcataattattaaattctcatccctccttctcccctgccccatgcgggcaagctgataggaaagcccaaatgttccctcctttgacaccatggtaactaggagctcaaagctcacacttctgccatgaaagacaacctcagcgaaaaccttgacagtcgctacctccttcgggccgacatccaggattcacggacagcaccgaattacatctataccacgatccgcacgcgattggcatagcattaaccttctaatgactgatacacacttccaactcgagaacacactctgccgacagctcccacaaatattcgtgagtggccacagcaaccatgccactctcaactgcgtgcgaccgtatatttatcccgacctatctctcctccaaatacccctcgccatcagaacactgactaccagcaagcctgaaacaaacaaaaccacagtccacccttcctctattagctttcacaaaacctaatcttaactccgacccgtactaataatctatatcgcgaaccccctcacaaataaatacgtaccaaccgagtatggacacacacacatacacccaatctctattatgagatatattaaagataagagcgctttatacaccacccttaatgcctatgaccgagacgcctccattctttttcgatctctcactcccgcctctcgtccgactcgcgccacctccaccacactcagccgcgccacgcaaccattatactctcacacacacctcttagcgccacacagtcagtgactacagccacacagtcacgtcagggagaggctcatctaatcgcaatcatcgactgccacacaaaactaccagcctagtctcgcttcaactacttgtgattatacacatatatcattcccactccactctcacagacctgattccgccaaacctgatacggcgttagcactcgcacgctccctgcctcatcccgactgtc

SEQ ID NO: 14312 - DNA, 150 bp, Homo sapiens
ggctgactctccatgtgacgatccatagagaagaaacatgactggatgccaacttcacttttgcctgcaactccctggggttctgtgatctcattgttgcttatatttagcttctggtaatttggtaaaaataaataagtaaatacaaaa

SEQ ID NO: 14313 - DNA, 1400 bp, Homo sapiens
  misc_feature (1)...(1400): n = A,T,C or G
cgagcaaccatcaccgacctccaccaagtccgaagtagtgtcgcactcgtgaccctacccgcaccaccatcaatgctcaaatgtacatacgagatcgtatcgttactctcctcaccatacatccgcaccatgatggtaatcaacgatgtatagtgcctcgtcatgctntacgctgcgctccactctaattactccatatatgaagcgcattctcatgtcaacgttgctantctccgtgtacagctcagaatgagcgcatagtataccgtngtcccgatagtagacactagagtcccactagttagcttngcgcggaacacacatcgtctgccatgcatgcacgtagaccnccgctacaggcaccctagaacatacgtctacacctatcgagtatctccacacaatcgtgtacctnatctatgctgctctatacatagagcgcatagtccacatatagantcttganacactcgaacgtttctccatcgcaccgcgccggcgccttggtacactcgccaacgtcactccangtcaggctgcgcagcagtatagacgaggaccgaccacgaatggcaccaagactcagtcgcgttcgcgtagctcgccagcggttctggcgccttagtaccctccatcgaactatcacgtacatactgcctggcccagtctcatacacgcgacgagacaatcacgtacacggacgatgantcccctgctccacccacgcacatcaggagtcaccggcaccctaatccgagcccacgcaccacccccacactctatagctgcacaacacgcatccatacgacacaggcccgcatcgctcatgcgtctagttgacaccacgaactcacggcgtgtgagaatgtctgcgctaaccaatantgagcacagtctccactatatctcacacgaccgaagcttatccggaattctgtatcacaaacagcctttatgttgagacattcatcacagagatgctcaacagcccgctgctcataatcgtcctcaccctgcactatacgcgcggtcccttcacgagtcgagccacgctattctcgacgaccacnacgcttgtgcgtgcggaccgcgcctccctcactncactcgtcgctacaaccgagcgcaccggcatcgcaanaacagagtacgaacggatacgcaaacacacgtacaccgtcgtcgaatatacacactctatacgcaacgccctgagactcatcaatacgtcgcctcacatgtccgcacgacaccgtcacgtctgatttacccttgacagcgagctgcttcgcgttacactacacgacgcgccactcgaggacagtacgaccacagagctacacagctatcgccaggtacccgaccactctacgccgcgaccgcagagctcgacatatacg

SEQ ID NO: 14314 - DNA, 945 bp, Homo sapiens
cataaacacattaatacagcaacaccattacgcacccccgaccacaccccccaccccccacagactatactcgcctaaatatcacagtgccttcattctcgaatgagcataaagcatgattagttacaaacagaaaaccatttgaccttctcacaccaactactttatcaccctaaccctcaccacctcacaaacgctcggcagcataaagaacctagcagagcaaccaagggcaaaggaccccctaaaataagtgtttcgagcatcacagcccaccataatgtccttaacaatccgactagcacccctccaccagcatacataatgaacacccagcagtgcatcaaacacaacgaacccttttctcgcactgaccgcctctccccccgggcttagaggtcttcccttctaactatcactaacatcactcgccctacattccctgccattccctccttaagcagacacgaccccaacgacaacgaacgcacaaccaccaggctcgatcataacactctgcaccccatcactgcaatcacaggaaaacagttacacacacaaaccacaccctccaacctcgctcaccacagccatcgtcctcaccacaccgccaccacaaaaccgcccacccatcaactcaaccgctttaccctccccctggccctcaaagacaccaaaccccgagaccacaaacacggactgaaaaacccagccacaccaccccccactgacgcaatctcaccccaccctaaaccaccacaacgtgacaccggtcacacatcaacccgtatattcaacaaattagccacacacacaccttcacttccccccaacaacctcagccaactacatacaaaacaaatactacccaccacccactacacgacaactacccaccaatcaagacacgacctccttcgtgccgccctaccacagaacaacaga

SEQ ID NO: 14315 - DNA, 498 bp, Homo sapiens
cagtgtccatgggaaggacccgcccgtggcatgacaaactatgcaaacggatcgtgatggaccctcagatatgaaggtgcacagaacctgcccaggcatcgaagtatgttcctgcccccagcctggagtgtaggcgctgatcttgatttactgcaaacttggcttatgggccctccattctactggctgatcatctagtcgctcgcgcatgaagcacccacccccccccttggccatttctcgatctatttctaattaccgcgtttcacctttcttcctggtcggtcctcatttttttacccccgcgcccccatccctcctgtttccaaattcctcccattccactctctgacccactatactcccttttttattctcgtaagacgcgaccatcgaatcttttccttgcatcccccacctacacctcccccggcgcatgttctatacccctaccaaactctcacgccacctaccccaaaagtccttatccccaccgct

SEQ ID NO: 14316 - DNA, 580 bp, Homo sapiens
  misc_feature (1)...(580): n = A,T,C or G
ctgggcaaaaaagtncaggannttnccaanacataaaaanngatcttttaattgaaaagtttaannccnggnccaacccanaatgtnaaccccnagggctttttttttnatttcnncaaaaaagnttnttcccnatttggccaaangaanaaagagngcnaangtttgaatggtccanctccaaaaagntngnttttttaaaanaaaggtccaaaaccgcnttaaagncttgcttnctnantttaggcccgcatgggtgctaaanaaatggcttcctccttttttttcttttcctcctcctcccacttagcctcacaaatggttggcagactctatccttaaattgtggccagggactggagctgaaaaacgcctttgaggattcttntgcagcaaccactaaaatctctgtctgganatgcgaatgctgcctctgaggcttcagaacaggcagggaggctcagaaccagctacaggctactttctttcctttgtntggacaattgcaaccaggaaggagaaatcatcataggctgtttatttgtagacattggcttggctgttggtctcattctgaaat

SEQ ID NO: 14317 - DNA, 522 bp, Homo sapiens
  misc_feature (1)...(522): n = A,T,C or G
ggngcnanaaaccnncccctnatccattaacaggccgccctnaaattnngnttggtntnggcnataaactngggtaaagncccaanganacanttttaaaantnttaattcccncaaaaaggaaagctcatcnnnntgtaccagcaagntactgtgcacaaaagngggcncctaaatngaatanttatggcaanctcctaatttaagcntttagtagnagcattcccccaaaantgcaaaaataaagagaaagaaagctgaacgtggtaattcatgcctggagtcccagctactcaggaggctgaggcaggaggattgcctgagcccaagagtttgaggctagcctggacaacatagcaagactttcatctctacacaaaattattagctggatgtggtggcatgtacctgtagtaccagctggtcgagaggctgagacaanaagattgcttgagcccaggagttcaaagtcagcctgggcaacatagcgagaccctgtttctcaaaaataattagaaaaat

SEQ ID NO: 14318 - DNA, 1370 bp, Homo sapiens
  misc_feature (1)...(1370): n = A,T,C or G
acacccaagcacgaccagaagcaccaccggcccagcgacccacaaccaccccaagctaagggggggagggagaccaaagcagaagcctcaaggacggaagaaacaggcacaccaccgccaaagagcacggacagacaaccgacaaccgacagaaacagtcacgcaggcgagcacaacacgcgaacgacgagcacaaggaaagacacccgcacacaaccgcacacaccacgacacccagcacccagccgcaaggccgcggcacgcacacgcccacaaagcacgtcacgcgcagccgaaaacaaagacacgcgcccccgcgaccaagcacaataagaagaccagaaggccgccggacgaaaacgaacgcagcaaccacacaaggcccacaccgcccgcgagcaccgcgagagaacacaccaaagggcagagagaaaaaacaccgcgccacccgacacgcaacccgcagggaccgcacacaagagcaaacaggactagcgagcatgagaagaggncggcgagaggagaccgcacagcgcaacgagacgaagacaggcaacccgacgcgcgaagcgcacagcggggcacaccacaggaataacacagcaggaacaggcgcccgaccgagacgaagagccgcaccggagaacagagcatgaaccgnacggaaacacaccgcccagaaaaccaccgactagccagcgcgcagcatcaaccaacaccccagcacgcacagcacacagccgcgacacacgacaacaaccgagaagcgagacgagcgagacgacgaacagcgagcgacaagaaccacaccacgactgcgacacgaacacaccaccacaagacgacaaagcaagcggagtgagcagatagtaacggacgcaaaccgcgcagcgacagaaagaaggaacggcaaagcgccgcgccacagagaagcgggaccaagcacagccgcgcaccaccagcaaacggagagacgaccgagaaggacaccacgcagactacgccgaagaaagcacaaacgcaacgacagtgcacaacgcanagagantangcacggaccggcgaccgcgcgcgaccacagtcacgaaacccagagagaccgcagacgncagaccggacatgtcacgcaaacatcacttcagaagacgaggaagcgcaccaacagaagaacagagaggaagagaaccccaccgagcgcgaccactacccacgcacacccagccaagaacagcgccacaccgcgagacgcaagccccgaccgcgaccgcgcacatcacacacagcaagacaacgcacacgcgcgacaagcagacaaccgcggcgcacaccaccgcgnagaaggagaacgcgagatatcaaccagcacgagc

SEQ ID NO: 14319 - DNA, 1021 bp, Homo sapiens
  misc_feature (1)...(1021): n = A,T,C or G
gnnnnnnnnnnntnnnnnnnnnnnttnntnanncnnnngnnnnnnanacanncntnctcaatggcagccttgaagatcacagttcacactcctggtacaggtactcatactagaggaagcaaaacaaacctcacttgccaaaaatgacggttgtttgttttgactatctggtagttcctcagaggaccagcttaatggtactttctcacctaacttgaactcatccagtggtcacacagagtgggtttgttaaaaatgtttagaaaggcaagtgttttagttacagttacctggcactgtataacaagttgggaaaaataataagctaaccaaaaagtttaggaggaaagagtgaggaatgagaagcttttgggaataaggactttgaaaagttctggcagaatcctggggaatctagaaggtcatgtgcatccctagaactattcatatagctcaaaaaatacccgagaaagccctaagctcttatttctgatttgaccntaaggcgctacacaagcagaagtgagagcttaagccaagtccgtaaattgcctgaatgaacactgnaagtgtgccccaacacacattgcagaatncaacttaaatgactgagggagaaccattttggttcaagggcctcagaaaatctggtccagtcagtagcttaacacttaaggtcaatggaacccnangcattantngggcnccaaatggccaagaattcngacttttccaaaataaggttagaaaaagtgactnaaccaaacccanaactggcnccaatnagccagnattcaatccttgaaacctggggganaatntaaatttccaccattggcccccttttaaaattcnaaaatttcagtttttaaccanngaaatttgaggaatccnnggaancctaaaactnttgtccccntttaaaggggaataaancaatttatttgaaactgtcctttgnaaaacccccaatttgggttcttgnaaaacctttaaaggccnagggtttttntnaaaanaa

SEQ ID NO: 14320 - DNA, 510 bp, Homo sapiens
  misc_feature (1)...(510): n = A,T,C or G
ccnaacttgtaaaagccaaggccaangagaaaccncataaagncngccaagaaagaagcatctgctatctgcaggtcatatcaataaaataaccngntgttttctctccagaaccacctagaacccagtgggatggcatattcaaagtgctgaaaaaaaatagtcaactaagaattatatacgcagaaacatccttcaaaaatgaaagagaaactaatgcattctaatataaacaaaaattgagagttttttgataataggccttccctacaagaaatgctaaaggaaatccttcaggctaaaatgaaaggacactagacagcaattcaaattttaaaaagaaataaagaatgtagataaaagtaactatagaggtagatatataaaagtcagtgtttgtgttttgtttgcaacttctttttttctatgtaattttaaaaaatgactatataaaacaatattaaatctcaattaaactgtacattcgtgtaacataagaaataacaaaat

SEQ ID NO: 14321 - DNA, 791 bp, Homo sapiens
caggatgggaatgattttaaggagccctaccaagagatgaagtttttcatacctcagctaatcatgatcaaacttgaagtcagtgaacccattattgtcttcaatccatcttttgatggctgctggaattaatacgtgactctttcctggaaattattaagaactctaatgggatccccaaggtggaatctgtcctgttcccagagctgaaaggatataatctgctccttggaactgttaacgcagaagaaaaactgaaatatcttgtctaattttacactgctaggaagtggtgaaactgaaaatcagagccaaaattctgagttctctgtttaatgaaacttttgccacattatagttctctttcctggcttgggctacattttttaaaatgctactatgtcttcatttgccactctgactcatctgatttggttgacttatatttgtgtgtttgatttcacacccttcaatatggaagatatttgaatgtctacaaaaagtatgttgacttattggataacacggcagagcaaaacatcgctgcgttcctgaaagaaaatcatgacatagatgattttgtgacgaagatcaatgccataaagaaacggagaaatgaaattgcatccatgaacataaccgtgccttagccatgttctgccttgatgctacggccctaaatcgtgatctctgtgagcgagctcaaaatcttaaagaccgtctgattcaattccaagtggatgtaaaccgagacaccaataccagcacttgtaatcacttattcattcatt

SEQ ID NO: 14322 - DNA, 240 bp, Homo sapiens
gagtcctaccacgcgcccggggtctagctctatcaccccccactacgccgtatcgctcgtgggcggccgattgccgcgctttttcggggtctcgctggcgcgggccagatggtggtgcggggcactcacggtgatctcgctctctgctcggtcgtcagggtgggctcctactgactagtgtttgcgtcttccccccccacacagggggcggtagtgtatttttccaccaaggcggggtgt

SEQ ID NO: 14323 - DNA, 737 bp, Homo sapiens
gaagggaaaaataagggaactttttttttttttttaacatgcaatcacagttgtaggcaaaacctgcctgttgtaaattttatggaatgatcatggcatctctgtgactctcttgggttagcggtgttaaaatagaatagtgactgtgggctctggcttatgatagctaccaaaaggggtctccttaagagctatgccaggcttcctatctctagcctcgagttagtcacttaacctcagcatctttctgagtctgtgtttctgtatctgtctcattcactggggtgcaggaaacctaattaattcagacaataggcatcattgtggtaaaaaataatattatatttttacttttaaatttttatttctaacagccttattgagatatcattgacatataaaaattatgtatatttaaggtgtacaacctcacgttttgatatacatcatgaaattattaccacagtaatgttaattaacacatccattacctttacatagttaccgtttcgtgttgtgtgtgtgcgtgtgtgtattgagaagatttaagatctatgttctcagcaaattataagcatataacacagtatcattaactattttcattatgctttacgttagatctccagaaattgtcttgcataactaaaattttataccctttgaccaataccccttatttcttcttcttgtatttttatgttttctaattaaatgaattaagaaaaaaaaaaaaa

SEQ ID NO: 14324 - DNA, 793 bp, Homo sapiens
  misc_feature (1)...(793): n = A,T,C or G
aggtcctggctgtatataacccatgtattcaactctatcaacccaaacctggaaaatgcacacgaaaagaagagggaagagagcagtggtgatccttcttgactctaaggttgtagtgacttagcctttggactctagagctggcagttattagaaaacttaaaagtcctagtataaataccacagacattaaaaggatgaaaaaatataaattattgatgatttgatgccaattaaaattcaattatagagataaaatagacaatgcttgttttactcatattaccagaacagacaaagaagaaataggaagtctgaaaatccctttatgtgtcaaagaaattcaattctacaatacccacaactgaaagttcttggcctggacagatgcactgtagagttctactaaacattttaaggaagaaataatgtcaacattgaacaaactatttcccaatatgagcatgtacagtaaatgtaaatttccctcaaaggtttgttatggactgaatattagtgtaaccacaaacttcatatgttgaaattgaatttccaatgggcagtatttagaaatggggactttaagaggtatttaagtctgagagctccaccctcatgaatgagattagtgctcttagaagaagagaccagaaagctagcttggttctctttctgcctttcgagaatacaagaagtcagcagtcttcaataccaaaaggccctcacaagaacctggcaatactgggngccttccccttataatttcagcctttaaaactgtaagaaataaact

SEQ ID NO: 14325 - DNA, 1170 bp, Homo sapiens
  misc_feature (1)...(1170): n = A,T,C or G
cctgtgtgtggtgatcgtactnctgtgtgtgcttgtcacctttgtcctgctntttctgcgcgtgcgttgcgttcgcgttgtgttctgcgtgctgcgtgtgtcggtgttggtatagtcggtgccgggtgcgggccgtcggctgctgcgcgtgcgtttcgtntcttctcgtcgctacgctggcgcgttcgacgatcngttcgtctgcggtgcctctgcgcttgggtgtggctctgtcttatgtgctgtctgcgtcgcgaggccggtctctgcgggtggtgcggtcggtgtcgagcgtcgtgcgatgtgggtcggtggtcgtgtgctcggtcgcgcggccgcggccacgtgtgtntgtctgtcctcgtgtctccggctctcctctctgntctcgtgccgtctgcctgggtcgtctcgtctttctctcttctcgagtctctatgttctcgtatgtgccacgctatgctacctcccgtgctctgctctgttggtgtggctggtgtgcgctcgtcggcggatgttctccgtcttctttccggcggtggggcggcgcgcgcccgctcgcgggagctgggtgggtgcggtgtcggtttgtgcgcctcgcctgctcgggcggcttgggtgcgtgtcgtgtgtcgcggcgcgtgggcctgtctcgggcgcgtcggctggcgcgggctctgccgtggtctggcgcctgtcatctgtgctgtggtggtggtgtgttgtgttggcgcgtcggctgtttagctctctcggcccctcgcgcgggctgtcccgcgcgcgagcgcgtggtgtgtcgcgtgtcttcgcgtcgcgggtgcggcgtctcccgcgcagttccggtctcgttgcggtgccgctcgcctcgccgcgtccagcgcgcggggtgtggtttttctgtcgcgtcgcgcgggcctgccggccgccgcccgcctctgctctctctctcacgctcccgctgtcgcgctcggccgcgcggggcgctggctcgggcgcgcgttttttttgaaggtggttgtgcggctggcttgtttctcgctgctcggtgcgcccgcgggtttttcgccgcggcaggcgttcggggnttggttccctcgctcaggccttctcctcttccctccttcctcctcccccctcccnccccctccctctctccttttccctctctcc

SEQ ID NO: 14326 - DNA, 785 bp, Homo sapiens
  misc_feature (1)...(785): n = A,T,C or G
cagggccctcccacttcaaagaatatgattaatgtggtacatggatttggcaaacaggtttcaactcatgatgcaataatggattcggaattccggtggaataagctcaaactgatgatggcattttcaatatttatcgaccaacagtgtcttgaaagtgtggcagagccaatgggaaaggacctagagaaaaagctgcaggataaggatcctggggaccagaaatgacacaaacagcgatgcagattttcagtctacctttataacctcatgattgtgttgctttgaagcgatttctacagagatgtgtttattgcatcaacgcaagacagctgattttttagaatatctattaacagcactaacactggcccttcagttttccaaacaagaattcttgccatatgtttggcatttgtaaaacagtttttctctttgttttcaatcatgccagaagttccgtgatctgatgccaattcatttacatggctcttgtggtcatgatcttggtcttgttgggtagtattgtgactagctatccaaagcatatctcctgttttcatttcaactgtatttcaatgcaaagcttattgtcaaggtagcctatttaaattgttaaacaactttcaacctttttttggtcagtctcgagaactgtatgtgcaattcttttgtgaaagaaacatactgagtcacagccatcatgacattattcattgcccaggcggactgcttctcaagacccangcataattgntaattgtgttctaaacaaacttangtgt

SEQ ID NO: 14327 - DNA, 1661 bp, Homo sapiens
  misc_feature (1)...(1661): n = A,T,C or G
gaacatatattggagctccgcggttgtgcgcggcgcacgtccgancggtggtggtgcggggggaggtttttttgtgcctgagtggtaactcgcccagangaatantgtaggcgagagctagagagagcgctgaaanagatgtatggggagccgagtacgctacgcgggagggactccaacgcagctgatccgtactatgaaccatgtcttcggcggtgaattgatctggatttacacagagggagactagcgcctccgacacagtgcccgcgactgggataggacgcggtggtggtggggcgatctccccgtgattctcccctccttcatatgttatgattaggttttatcgtctctcagcggtgaacccaccgcgccttcaacggcacgagcggtttgctggtgcccataagccaccccaattgcctcacacaaggcttccgccgctccctccgtcttcgcgcgtccccttcaaggacgccgaggcccgcgaacgagtaacgaaagggtgctttttacgttgtcgcgacgagtatggtggtgcgatgagagaagagaggtgaggggaggggcgtggggcgcggtggggtggcggcggcgcgggtgtggcccccccaggttcgcccgccntccccgttgttctttccgcctccatccgcccccaataacacgctatccatatcagccagtccttcccctttgcntcgtgtttagcgctaacggacgagccgggccgtgtcccgacgactaccccgtaccgtcgacaacacggatattaaccgatcgatcatgaccggccgagcctacgacggtaaagatgcgggcagtcaccggtatatgtgctcngaatgggcccacaaaccgcgaggcggtgaggtggcggtgtgaccaggtggtgacgggtaccgtcttgcgtgtccggcgtacggtctatcgctgcttccccaactcatcctccctcggacgaggaaatggaactggctgcgtatgtgcgtgtgcacgcgccgcgttaatgtacgtggacgggacacaggctgtggaccatggattatacactttctacgccgctngtgcgctccatacatccacgtcgatcctgtcgtagaattcaatatgatatgagtatgtcggagaatgtgtatgtcacgtcgagagccggagcagacctgcgatacttatagcgcgcgcagatgagcgcgcgtttgantgtgngcgtcgacacgtaaacattatagcacatcgctttgtgtatatatgtcgcgcagagcattctgcgantcgcancgtgtcgactgcncgacagcgcggtgcgcggtcgtgcacntcntgaggcgaanctaccggtgcgaccgcgaccacaggctactagcaccacgntcacactcgctctgcgactctcgcgtacgtcgtgctcggctatngncacgagcagccgcatatatagctcgcgcacgaacgcgccacacgctccgcgagcagacgtagtcatctcgtcntgtgtagtnttaccacgagcagcgcgtgtcgtcgtgcgcatcacgacggctgttgtgccccgctactcgtcgcgtcgatcaccccanatagggctgcgagcacacgccatcactcgcttacgctcntatcacgcgnacgtgaaanattctcatggcacagancct

SEQ ID NO: 14328 - DNA, 992 bp, Homo sapiens
  misc_feature (1)...(992): n = A,T,C or G
caaaacaatcaccactatngaaatttctattttttcgaattccagactcactaaggacatgctcaaaagcatacaacactgcagatgactcaaaaggacctcgaatatttctaccgaatgctgaaaccatatgccccaaaacatgcatgggattgctaggatgcacactagagatggtctggaatattagcccacgctgcgacgaatcatactatgcttgaacttccatgggaatcaaaaagtgtgtgaggaacatactcaccgctatacgtctcatngaccatgtatggatatatcgaacggagaatggcatacgatacaatagacatatgatacatggctcgcttctatgtggaaggatgcacgacgcgacatagaagaatgcacggatccggatatatctaacaaatattgaacggcatgacatacacagaacataatttggacaatagaactgtatggcaggagaatgctcgtacccgcaaacggactctttgcgtggatatcgcgtactgccgctaggaggataaacatagacaagtgagagtggcagctacacacgtactactattcaatacacatgtgatctcataagcaaaaactagcgcatcttaacagtgagcgcatgactggtactcttcaagtatataatgcaactaaacgtgacacttgcactgtatgaacaagaaatagccagcgaatgtgcctcacgtcacagcattcaacaacctcgaataatgcatacatgaccccgcaaatatatcattgcattccgatatccacaatagacttaaaaaagcaagcatatctgtaaagggttagggcccacattggtatacgccacactttttttataaagaaccacctatgcgtaggaaactacatactgccactctgatcacatattgaacattggacaattgacacccatgattaacacaataacaattcaaaaaaaaaggctcgccagagcaccattatgagctactatt

SEQ ID NO: 14329 - DNA, 764 bp, Homo sapiens
tgaagtgaagccagtaataccttcagtcctttcaaggctccccaaagtgggctgataaagacagttcgaatgccctccatcatctcaaaagaagacatgtaatatacgagagacagaccagagcagagtgttttactctgaccctgaagagatctattttcactctagacagcactttctgtattaatactcagccagtgaaaggcagtgctttgaagaaaataaaactagtaagaaaataattattttaaagaaggcaacgatcaaaacttaatgccccagaagttgtgctatggtaagtaggactttaagggacatatcaatttatcttgcacatccttggccactaatggattgttccctggagcacatttccaattattttaaccaggctacttttaaatgactcaggtggagaggatttttacagcttccattgggggagagtattctgcggtctgatacacatcactgtttcgaactggttggtttggcaggaaaatttcctttttaaatttatttgttttgttattttccactgagaacctcctatattgagaagaattgggttaccacatgctggtttcgtatccttttcatttcactgtgaatctctgttctcatgaagtttcaatcacacttctggttatcacagcctgctgcatcaattctatccagtctcaagatccttgggtgaaaccccctggggagggcctcacagttgccatcaggaatgatttcgaccaacacctgcaggcattctt

SEQ ID NO: 14330 - DNA, 1504 bp, Homo sapiens
  misc_feature (1)...(1504): n = A,T,C or G
gatgaataggggtatannnanagataggtgatgtgngagagggtataggagtgtgggatgaatgatagggaagatagaaggtaggggaagaaggagtgtagagagtagaaagatttattaagagagagtaaataaatatgaaatagcagggattttattatgggtgtagaagagtcaaagagtgataaataagaggatggataagaanatgatatgaaggaagcgaactgtaatgatgagatggtttagaatgagagagaaagatagagaggatnatgagagagaagagatgagaagttaggcacaagaggatggnagcaagnanacgcgaggagataaggantgcaagaagaggacngagagcgaaatagagcgaanaagagaatggagaagacgccgcaacgtgcagcccntagacccgatgcccggagagggcttgncacaagcaagagaggcgcgtccatacacagacaggagtcgagtgcagaatccgaatgtgcccgcggctatncgagatgatggcaaacaccgtagtatatcttacgttctcttatgantcaggacnggtagctacgccactctncaacacccaccatccaacggtcacctcatcacaacgtcccgtgcgtaccgccacaaccaggccgaccgcgcgagagaggcgacgccgagacgtcacgagccgcggccgcgacacgacccaccgacccgcgaccgcaccccaacgcgcgcacgcgcgcgggccccgcccgcaccccacacaccaccgcccgccacgncgcgaacacgaccacgcctccattcctctcgcgctcccgctccctccgtcctctcacaccaccctcaccgcactcctgcatcagccacacacactcataacnanacgcaaacggcgaacanccagcacacacacgaactcaacaaccagccagacgcagcgggccgacagtaggatacgcgtgncgaagcggagcgtcgtanaggcgagcgaaggagcagtacgtgtatttaacgacatgatacgatctaatgcncgagaccttagatctccgacggtggaggcaggtagtgatgagagatgcatacgcacgttgcatccgattcgagatctcgacatatgatcacgacgctgccgcgccacacacgcgcgacgccacacccgctcgcgagcccacgcgggcggcgtcatctggatctcgacgacggagcacgctacatggcggatcagcgcctcgcgtccctcatcccaaccgctcgcacgtcacgcacgccntcgagcggcacgcagatgacagccaccngcgctctcactacagttcctctacacagtgagacgccacggacancgaacgacacgggcancagcctgcgagccttgaacgagcgcactccacctcacacccatacggcctccacgacgacgacacacacagcaccgacaccacacactcactctccgactgaccacatccaacgcaccacacgatcgccgttcatacgacgc

SEQ ID NO: 14331 - DNA, 812 bp, Homo sapiens
cagattattgcatcatggcccccaagacaaaaagaaagagaaaggggattaaagtcatcaaagccacgtgtcctgaaagaaatactcaatgtgacaggaatttttcatcaaattgacttgctgtaaaagactatttctatcaaatagcaatcaaatggttatgattataagtaatcaaaagctggatgttgctgtaatggtggtggtttctccagtttcctctggtttctattcagaatgcatataaatctcgccttttaattttgaggttttttctctaacccttacaattctattacttatttaaacctcaaactcggaaagcaatgatgtcagaaacaatcagtagttctactcatagcaagtccatcacaattttttttactctgattctgacattgattcaataactttgtaaaaattatttgtcacctgccaattgacttctatggtaatgagaatcatctggcgttttgctacagtcaccaaataacaaagaaatatcgtgaaaaatcacttattagaattatcttcacatttgtgaaatatttgttaaacattttgatgcttgtgacagtgtcagaagtaattattgcaactatattgcaactgtattaccaaactgagctggtgacaatcaattcttattacatgtaatggtgtgaaacagtatttcctgtaaaagagtggtatagccttttgaaattggtttccatgaagaaatttattttcatctccttatcttgataaaaagatattccagagataagtaaaagttctgcttaaatctttctttttgttaataaacttga

SEQ ID NO: 14332 - DNA, 790 bp, Homo sapiens
tagacaattgtgaaaatactttcttttcaaccccatgaagatacatagaagaaaatgccagatgaagttctttattgtttctcattcacagaatttgtttccactaagttattaaaaaaatgggcaaaagaaagtggaacttcaactgttccttaggacaatacggacttgtgtttttgaagaagcaaagtggaaatgattaggcagcagggactctttgcagaaaaacgtaaggagcaaagaaaaatttctcagaaaaggagatttgaagcgcaattgtcatcagttcacagaagaattttgaagttctgtttccagaggcctctctctgcctgcccagagactgtacatcttcagagatgagcaaaactctgcactctgcaaaatcagcaccctctgtctaatcaaaagttaacttggcccaggttttagtttctctgtaagttttgttggaaagtaatataataaatcttattacaagatacagctgattatgtatacattatgtctttggagaaatttgcattttaagaggaaggtcaaggatgccttaattacaaacattgcatttttggttatttaaatagtatctgggaaaacggtgaagatatataggaaggtaaaaaagatacctgtatctaccacgtgtgaaagattatctcagtaaaatagaattggcttcatattcatctattataataatcccagaaaagaagatttttttcttcaaagcgtcacaatttttgtagtccgcaaaatgaatggcaagataatggaagaataagattca

SEQ ID NO: 14333 - DNA, 560 bp, Homo sapiens
tagcagcacagcatatcggccgtgcaccgatgttttagaccatgtgaccccagctctttgggcagcgagaggcaagcggactcctgaggtcaggagtccaagaccagccggcccaaggaggcgaaaccccatctctactcaaaatatagaaacgcacgtgggcgccggcggtgcgcacctgtaatcccagatgatctggcggctgacacagaataagcactggaacccgagaggcggactttgcagtgagcctagacacgcatcgcactctggcctgttttttttgatgaaacttcatctgaacacatcagccacattcctcaaccgttccactgacaacacgacagttcttcatacattaaaagacacctaccacggtggctatacttcaggaaatagatagtctaagatagaacaacatactgcccccgatttattaagacatgacaaacctctggtacttgaatatggctttatggactccatattttttgttgaaatacaattgagaaataaaatccaaaacatgacaaaaaacacaatcggcctccttggccgta

SEQ ID NO: 14334 - DNA, 795 bp, Homo sapiens
  misc_feature (1)...(795): n = A,T,C or G
gtgttgagacactactctctccttgtcaggctgaactcaaactcctggcctcaagcaatcatccaacccctgccttgtgagtacaggcattacaagtgcgagccactgtgcccagctcctgtttctactttcttaagagaagaaaactgaggcatagaacatttgggaatgaatctaagactacacatctagaatagcagagatggagtttcacccttgttgtttagtcnnggagtgcaatggcgcgatctcggctcccggcaacctccgtctcccaggttcaagcaattctcctgcctcagcctcccaagtagctaggattacaggcatgtgccaccacgcccggctaattttggattttgtagtagagacggggtttctccctgttggtgaagctggcctcaaactcgcgacctcaggtattcgatgagatcaggagcatgcccagctctccactgcgggcttcatgtaagaggagagccatgataatgtattgcattattcttgtacagtaatcagatcataggtcaaaaaggacacacggtttctggcctgtctgcttggaacacttgctctagacacctggctgccatatgagaggccaacgtggaaaggaaccaacgcctcagacgatagccccagcagggctcttacccaagcgtctgcaccgtggaagtgagccaccttggaagtgagttttccagacctgtaaaggttcacctatctttttccatgagacgccgaaatgagctggccagcttgagtccttcccaaattctcgcaacactagaattg

SEQ ID NO: 14335 - DNA, 792 bp, Homo sapiens
  misc_feature (1)...(792): n = A,T,C or G
ggtanggtgaactactcgctacctngtgagaggcctaactctctgtccaagtacaaccaagaagatgtgtctttatcttctcccagagacccagtccagtgctatggtttcttctcaggaagggaagatcccaaactagcaattttcctctgccctaggtatatgttgcagaaactctattctaatgctaacagatctcaggcttcctttctccatctaaccttaattgtttttcagaacctatactctgaatgcagtgagcttattattctgggtcccatcattttgatccatctcacttatagaatgaaagtattcctacagaaccagaggctgtcatcccaacccagcactccactcatagagtagctatgttattccaagataagtggaagctgttcttcggagaagtagtgcagacattctgcccagggacagaggcagaccaagaacagagagctttgtagctgtccccaaggaggctgactttatttagaataaatcatggagatgtttagaacaaagtatggagaaaaaagcataacagtgctatagaaaacaatggtgactttggtcgtaagcaattaagtggaggtttatagccatacgatagtaaaaattgaaacgcttaacagagagaatcaaggaaaaaggctgctaaaaagagaacacctctggtcacaccaaagctcactaactgtcctcaaagactacatctgcaaagggactgagatgttaattggagcaaactgtggagcaacttatgccctgaggtattctcttaaataatag

SEQ ID NO: 14336 - DNA, 796 bp, Homo sapiens
caggaggcacattgacccctaggctgcggaggaaacaacgccctcgcccagcaagacgcacgagtgagcctaaggcctctgcatctcctgctgaggaggacacagggagccagacactgtacatggaacaacctacatgagcgcgcaacactcaccaccgactatctggagacagccgagactaaacacaccctgccctctattatgactgaccccataggccccactctcaaaagttattcttcatcacccatacactgatgcccataatgctctgcatgctacctatcctgcacgaatctcccatatctctaccctcacactgacgatactatggaataccggagctgcactatcagacgaaacttaagcaattgtaagaaatattgaaatgcttgttttagaacttaaaactttaggtgtattaaaactcaggtcttattgacctaataaaactgtaactttaaagcggctccatctgaaagaagtatagctactgactgctttcttccaactagcatgaccatggtatatctgtctccactcacggactcaatatgcatataggcggttatacggaaagcgggttactcggggacaccatatagatggacctgacttcatcatgcactatgacggtctttatctgtaataggggcatttacactactgatgttgataggatccctgacacagctagcatatatctaccatatctgaaaccgatgtctataagccgcccttgacttaaatactataggcgcttccacacagagcacttaaacaatttcttgtg

SEQ ID NO: 14337 - DNA, 779 bp, Homo sapiens
  misc_feature (1)...(779): n = A,T,C or G
cagttttctgtttctgttacatgttatcaccttggagctgaagaagctggcagncccgaaaaaacccatatgcccagactccccccaaaaccaaccagccaaacaaaacaaaatcctgttctctccaggcaaagaataaggaaagagacaatccagacagagcacattatacctagccaaacatcaccaaaaacacaaaaacagaagtaaaaaacaactctgtgcctgtagctcccactcccaccagcaaaggtgaagtagggagcctagatgtctgctctcctccggctgtaataaggcactcaattctccccacaatggtgatgtcagagaaggccagtagggagccagtccctgccacgtgataatgagacctccttttccacagtgtcagtgaagaccacatggagagcttggaccttcacctagtagtaacaaggtacccttctctctttctgccacaggctgtttttggagaagcctagcagagtcaggcctttcaccatcacacagtaaagagactatcaccctgtggaggatatgtggggaaccataatgacacattcctgcccctcccagccagggagaaatcaatgtgggcaagaactcccatccatgaccagcagtaacaaagaatctctccctaaattgagtgtcaagagaggcaaagtagagaacctggacttgtatccccacaggaaagtaatgaggcttccctccttctcatgccggggcagggccagagaaagccaactaaatcagaacatttaaataagacc

SEQ ID NO: 14338 - DNA, 801 bp, Homo sapiens
  misc_feature (1)...(801): n = A,T,C or G
caggtttttctggtgggtttctggagaaacaactgtcaacattctgcaaaacaatcactgactcaaaaaactcaagaagggagtaaagataattaataaagtttgtcaaagatcattcacaattgcttcaataagaataaaatacctaggaatccaacttacaagggatgtgaaggacctcttcaaggagaactgcaaaccactgctcaacgaaataaaagaggacacaaacaaatggaagaacattccatgctcatggataggaagaatcaatatcatgaaaatggccatactgcccaaggtaatttatagattcaatgccatacccatcaagctaccaatgactttcttcacagaattggaaaaaactactttaaagttcatatggaacaaaaaaagagcccgcatcgccaagtcaatcctaagccaaaagaaaaaagctggaggcatcacgctacctgacttcaaactatactagaaggctacggtaaccaaaacagcatggtactggtatcaaaacggagatatagaccaatggaacagaacagagccctcagaaataataccacagatctacaagcaattgtacatttttatagcaaagattatatatgtataaaacaaaaattatacatacagttagaatttgttagctagacagaaatacacactgtgtctttgtataaatatctgtttccttaatttattcttctttaaaatatntcttatatttttaaatttcaaagacatctctattggtttaaacatattaattatagtgaggaatagtactgaaataat

SEQ ID NO: 14339 - DNA, 834 bp, Homo sapiens
  misc_feature (1)...(834): n = A,T,C or G
cctagtaggaggcaagaagagtttactttacctggnaccaaaccacaggcatcctactggcaccacgtcctaagtgggtatggagacaatcagaaggaaaagatcaagaagaggccactgaatcagatatcctggaacttagggcatacaattttttttcactcaactccaaaataaaaactggagaagaatgtacattttttttaagctaaaataattttctcttcataccttttgctacaaaaaaaaaaaagggctttctataatttctatttgttttaaattgacatgtcatttttgaactgcctactcaagagccattctactcacctcccttaccaagaaaccccgatgctatggtgtggtaatgtgcccattaaaaactcccctgaaactgaaagtgtgggtgaaagatccagttctgaccaatgaaatgaaactagagctctccttagtgaggactctggctactggtttcctgataagaaggggtacacccttcttactggcatgccccttgaactcttcaacaatttcccttttttgccacctagaatgcttaatttgatcccaggagaatgaccacgccttttgcaaccttgagaacaaagtcacagggctccagaaagcaaaacaggaaacctgggagggagctagagtaaatgcaaggaattgctccagggactggcccccactttggctactggccctccattgaacttctttggctatgagaaaaaaaaaatggctcctgcgtagattcaaggtcactgaaggtgggttcctggggtgaggccacccaggattcagtacttgaagattataggggggcca

SEQ ID NO: 14340 - DNA, 633 bp, Homo sapiens
cctagggtcttgctctgctgccctgctggaatgcagtggtgtggtcacagctcactgaagctcctgggctcaagtgatcctcctgcctcagcctactaagtagctaagatcacaggcatgcaccaccactccaggctaattttctatttttagcagagacaaggtctcactatgtttcccagggtggtctcaaactctggcactcacatgagcctcccaaagtgctgggattatgggtgtgagccaccgaacccagtcctgttctttttagaaagataaggacaggatgactatataaaaaaaggttttttctttttttttttgagatgaagtcttactctgtcacccaggctggagcgcagtggcgtgatcttggctcactgcaattgaaccaatagatcaatatgttaacggtggttcatggtggataatgggaatatgcatggatggttattttcttttccactctgtgttttctaaatttgaaattattaaattacggacacaatatggactctgaagccagaatgtccaagttcaaatcctgactctgaaattgctgtgtaaccttgccctctctacatcaggcttcccaaccataaataaatattagagctaccaaaaaaaaaaaaa

SEQ ID NO: 14341 - DNA, 884 bp, Homo sapiens
tacgtgccgcgcgagacgacgccagaaaaaaaagttacgccacagaccgcagagtgggttgcactgaagccatgttcaggtcttccccagcattgcaacacagagccactctaacagaatctcaggatgccacctttgacaaatggtcatcaaattaaaaattttcagagctgctttggtgcaagacttgagaggacaggtgaaatgaactgcagtgccggggactgggtgcacgggcactgatgccggtggatgaccttagggagggagttacggacccgtggggggacgcgggacaaaggtgggggagtgggcgaccccggggagcgggaggtgcgcggaggcggggagcccgggggggctcccgaggcgcgcagggagccgagggccgtggcgtagcgggcggccccttcggccgtgggttgcgtcatggatctgatgggcgaactggttggctggggcgccgtccttcggtcggtgggttgtagcccactgacggccgtagacgtggccgactctcggctgccccgcccgatacctcgtgaggcgggagggccgccacgatgggcactctggaggagagagagtaggacacatgcattcaatagccaggcctctccgtccagcgcacgtggctgcgagagaggctaaaatcctggggatgttgtgggggttaatgctagttagagtttgaatgatccagcacagtagtcgagacaccagtggcgagatgttagctgccgggaacaccgaagtgatatgatcaaaagagtgccgagtgtgacgcttgtggcggaggtagaggcttgagtgattattaggagatgtagtgtcgcaatggcgagacctagtgcggtgtagtgttgttagagaaggggatggtg

SEQ ID NO: 14342 - DNA, 710 bp, Homo sapiens
  misc_feature (1)...(710): n = A,T,C or G
aggctgagctgcatcccttggttcatgaccccgttcctccatcttcagagccagcaatggagactcaagctcttctcacgtcacatcactctctgctgtctcctcttccacttttaagactcttgtgattatattgggcccaacccaggatattcttgttattttaaagttaatttcatttgctactttacctaagatattcacaggttccagagagtaaaatatggacatctttggaggcagaggcatatattattctgcctataccatttaagcactttgtaccagccattggattagatattgggtttacaaagaggaataaatctcaggggcttcccattttatgatataagcaaaaaataaaatgatgcaggggcaatgacagaaataatcacagcatagtatcaaaggatccctcccancttctgttggaggtggggtggttagcagaaggttttctgcacgacgacatctctggacgtactccctagggtagatgaggacgaccctggggtcagaacgcgggcggcgcagcccccccgcgtcatacgcgcgccaaggccggcagcgcgcccgtcctcgcgcgcgggctgagaggagcggctcgcccgcccgcgctcacggccgataggaggcgagatcgtgtagccttttttcggtggccaaaagcccctaggtgggccgctggactagcggacgaggcggcg

SEQ ID NO: 14343 - DNA, 807 bp, Homo sapiens
  misc_feature (1)...(807): n = A,T,C or G
cctangggccatgggagtggaatctctgctatgacttctgaatggatctgcttctggagatgagctctccgcctgttcccaggaggtctgagagataccctggacattatccgtgagagccacctgccaaggcaggagatattgcccattcgtccaactgccgctgtcctgccagtatatcgtctgagattaccatcagctaaatattgcattgtctttggacaattttcctacattgtgactcctcactacattttcaatgcttttctagtcccagacaagctacagactgttaatttacacttgcttttgccttgcctgaggaaattgaaaataaattttaatttcctagtcaagggctacgggtgctntgtgtggtttggaggaaaaaaaaatactggtagatggaattagggaatattaggagagtttctgaagttagtgaaggtacacagtaattgatcacttgccctcatagggagagggcattccaatgagcagaggttctggcaatatctgagatctggttgatacctggccctcaatctgtcgatcacgccccagtaccattattcataaggttacaatctgattttggaatggatcagaagctttcctctggccttacagatgccattggaaccattctcatagttgggcaccactcacccttcgcaaagggaggaaataccttccttgggggcaatcaaccttctgtgggaagacaaaaacaagggatgtttcaaaataccagaaacccagtctgacctccgggggcaatgaaaaagaaaaaggcttgtgggggaa

SEQ ID NO: 14344 - DNA, 717 bp, Homo sapiens
ttgatatatgggagtttgctgtatgtagtcaagacaaaaaatcatgggtcctcggttgtgtctccaggatcatcgttgcctgccccatcaccatcaaaggagcctctcagctgcagtggtggatccagcccatccagtggtccacctgggaggtctcagcctagctatctcaacacactcctctgcttggaattggtactatgtattatctttgttttaggatgtagggtaggaactgagtctattaatgtttttctcaacactgtattcccaggcctgggaaggctagtaggtgcagcaataacctgttggtagagcaaaaaagatggcataaggttgcctccctttgttgtttggagcctctttgaaacttttcatttgggagggaaccccaaaagggataaagctctgcctaccaacatctcttgcacaaaagactggcccccactgggagactgctcttccctcaccttgaagattcacaggctttcagccactaacattttccttttaaagcccgccctttcctgggggcaaaagcttttaattggtccagggtgcctacttgggaaccaccaaatggcttgaaaccatcccatccctgggtctggcaaaatgcaaactttagccgcccttactaaaaactgcggcacattcggcataaacccagggaccgaaacaagagctggctgtgccacttgggttggccccctcacg

SEQ ID NO: 14345 - DNA, 653 bp, Homo sapiens
aaccccccaaagtgttctattaaccctggggtattcccgcggggaattccccggcctttttggccaaaaggcccccccatgaattttataagtcaccattgggtttcccccaaaatggtgggccatcattttgttcacccggtcctgcaacactggcccgggggccaacacaccaggggctccagaaaattggcctccagtacccgcacagttggggaaaaaaaaggccctaagttttcccgagtttaaggccaaagttttaaatgtttttcaaaaaaattggtggggtccctcgggtgcatggcacccggaaaaaagggggttttttttaaccccagtcaatcgtgccacggtaaggagcaaattttctggcccgcgcatcctgtagaaaaggtgtgtcattcgcccccactaaaaaacaccccctgtgtccgaggtatttaaaaatctttttttgccacggaggttgggtttttaaaaggttaccaggagcctgtatttttgggctcccaaacaaatttggtagaccaaacctctttttttttcggccattctaaaaaaacctggtggcgctttttgtccatttttattaggtttactttgtgggggcccccgctcagcgcgaataaattttaaatgaacagttttttcag

SEQ ID NO: 14346 - DNA, 705 bp, Homo sapiens
tgatcgaactgtgaaagttttagcgttgtcatcataaaacaaaaaaaaaattaaggccactctgtgtccttcactaatcagaaacttttatattttaatggtacttcacaaaatcccctgagaagaaaagaaagaggcagacccaccaaaaaaaggaaaacccaaaggtggaaagacaaggactgaaaacaaactcgaccctggattgagttacagcatcaaataccctattgctgatatggaagcgctgggtagaggagggcgtggtccctccctagggctccactcccacagacctaggtgaggacaggcatttcctgcccaactgttgcatttaccaagaccaccctggcctgccatgcccccatcttgtgcctataaaaactcccaagaccccagcaggcagactagaggcagcttgacctggacgtcgagaggaacacactgacactggcacacctgcaggccaccgaccggcagaagcagaacgacacaaatttgtttaggacagttagaggagaatccaggcttgttattaaccatatttaggggaaaaccatttcccttttggctccccaatctgtggagaactatctccattcaaaaaaaacttgcgcccattttccatcctcggagtaatttgattcttttgggactttaggcaaaaacccagggtacaaaagccctctgtttttgaaaaaaaaa

SEQ ID NO: 14347 - DNA, 776 bp, Homo sapiens
ttatgtgtaatttaattattcgggcgcaccatgttcagcgttcttcttacttctagcctaacatgagaaggtcctgctacgacgcatcaagaaaatggtcaaactagcaagagaggcctcaccagataccaacactgacagcactttgatcttggacttctaacctccagagctgcgagaaaattaatttcctgttgtataagcaatctaatctgttggattttgttatggcagcagaccaaactactagaatgggttttccaagttcgttgaattcaacggaattttggagaggctaaaatacacgtggatccccattagcacaaaatgagaccttggtatcggttttcttattgtttcctgggtaaacgcgtgccgtcttatttacaataagattttcggcctcgtttgcctaaaaatacggcctgcgttgcgcccagaaatcgcgcctcggtaggctttaaagagttcgcctcgttggccctcacgcggggggaggctctgggctcccgtctctctttagggaggggtaaatttcacgaatactagggtcgcttgactgtcgctcagctcacgacggataatgctcctagcttagctatgtgacccgccttcactgcgcaggagggggagaatccggtgcatccacgagaattcggcggagcccaggtttgtagtctacactggtatgcgcaagagggcgaggacagatgaccggcacacctgcacggcgggcgtggtctggtcgttacaacgctacatatagacgctcgccg

SEQ ID NO: 14348 - DNA, 507 bp, Homo sapiens
aaataatttctcaattgtcctccttcttaatttaacctgttgattccgttgttcaccgggccctcatcttatcggggcatagacgatacttgttccttttgtgccccagggttcagattagcctatttaccttctccatgttcggcactcggtgagcgtcccgttgttccttggggtcccatgtcctgtacgcgcccaaatccccggggtgccagcctttcccagcctctcgttctgaaggagttcgtggctaacactcgtaaagtgtcgcaaaggtacacggtctttcactgaggcgcctctgattttacatcggcaatttttcttataagaccgaggatacccccgtgtcggtgcgtactcctccgtccagcttaaaatccaggtccgtgtttccggcgctcctgcctccgcatggctgagttttgctgttcctcctcttctccgcaggatcatatgggtgtcgtcctcgagccgctctcggtcccacactctcgcccggttgtg

SEQ ID NO: 14349 - DNA, 671 bp, Homo sapiens
gtaatgctgagtgtgaagcaactaaagaattggtctctatgaagactgtgggagaactacaggacagaatatttccaaagaagttgaggacacattaattcaatataaactgaagtagaatctgctacgatatgtcacactagtggtaaaacatatggagcggaaaagggcttagctgaataaattcacaaagcttgtgaaaaatgtaagatgtttaaagtctatggttattcaccatatttttcatcagcagatactgtgtggtaaatatatgaatctattgtaagttaataaatcagtagtgttaacagtggacttcattcacttttgtgaactttagctctgttaatttctgtaagatagagaagcagtatctgaatattctgtgttggaaacaatatccttacttgtctcctcacacaatagtttaataacttatcagtgataagtttttactgctatttttttagctcaagggataaggctaaaaattttcctgaatggctcattcaaaacacccaatgaccattggttcaacacaaaagggttctggaacttacttttttgttgccaaattgataatgtgcctcaataaaattcaccccacaatacttaatttgccttaaaaagggcttaaaaacctttatgcaaaactttatctgcaggaaagc

SEQ ID NO: 14350 - DNA, 668 bp, Homo sapiens
  misc_feature (1)...(668): n = A,T,C or G
ttttttttttttggnnggtttctccttggctcttttcccttcctcctttcctctgtcccgtttggccccccccccctcgtgtctctggtcctctgggggcgtgcggcgtcgctcccccgttcttgcgcgccctggggcttcgtgttccctggcttccccccgctcttctggccgtggggggctcctcctgcccgtgtggggcccccgctggctcccgcgctctctccccgcccccgcccattgttcgctgtgcgcgcgggtgggtcccggggctgcgcctgcccctcgcttccgttcgcgcccccccctgggccgcccgcccctccttnatttcctcccgcgttcctgggtcttgttcgcccccggggccctcggcgcttggcccctggcctgggttcgcctggccgcctttaggctgtccctcctcttccccgcggggctcctctctggccgggggctccctggcgccgttccgcctttctctttttttttgtgctttttttttttttttgttgttctgtttggccttgttttcctgcctcccccgtcccccccctccctgtgttggccggctgggtggttgtcttttttttttttttttcttcttttttgctttttttttttcctttctccccccctcgtccctgggtcctgagtaaaagaccacc

SEQ ID NO: 14351 - DNA, 713 bp, Homo sapiens
tgatcgggatggtttggactcggtggacgcgggaaggggcacggcacttctggtgaaatctggttttcttcttgttctggatccattgctggagacctagatacatcaactaacctgaaataagcttatgcaacactgcagaggaaagggaagacaaaagtgaaattattattatcatcatcatccttataatagagacggtgtctgtgttgtgtaacaagtactttgaaacaagtttcagatcttgagaaagctaacatattttatagtcaatcacttataaactgcttacataaagttgtatcatacagaatcagaagagtagagttcaccataagagagggtgaagagccacaaaaatgggaagaagcaaatgggaaaggcaagttaataaacacatcagagactgaacagaaaaacactgttttcctttggagctgagtattcccagatcagaatgagtttcctcctcattccttctcgaaggctcaccattccttattggattggcgaaaacagattttaaaaaggaagaacgcttgcaatgttcccatgggcttaaaaagtgtgggggaaaaggacggaattcgaaattttaaatcctggatttagcggaatcctaggtgtgcgggggggtcccaaaaacgcccattcaatttctgtttatgcggctttggagttaccaagggccctagaattattgtaaatttggg

SEQ ID NO: 14352 - DNA, 702 bp, Homo sapiens
  misc_feature (1)...(702): n = A,T,C or G
cttaatataatcatanatgtatatctgtgtagtataagagaaatgtttgtggatgagaatgtataaggggtgaatgagttgtaagtgtaagggttgaatgtaggatagaggtaatgagtaagaatactctgaaggttggacacttattaaaatctatgctacatgaaatatctatcgaaatatgtcgacaggaaataaaacatataacagtgtataagttgacaggcaaaaaaggaactgaaattggaaactacgaacatatctaatcatcaataacacacgcatagaataattagaatagacacaatatggatctgtttgcaataccaaaataacaccaatcccaccttctaaatactagggtattattctggctttaataaaagttataatggtttatgaatgttattgttattataataataataatataattaagtgtttaagaaattattgagtataatacgttggggtagagtgtgttagagaggagaagattataaaagtgagaaaatacacagacttatttatataactaagggggttttgcatggagtcaaggaaggtttcaatgtatttacctcttggtcgacccgggtgggcctcccaaatttttgggattacaggggtgaacccccgcgccaggctgtgaaactttttttttaaataaataaataagtaaatacctccccccccaaaccc

SEQ ID NO: 14353 - DNA, 702 bp, Homo sapiens
tacacagacagaccggccgccttccatctgttcacatcattttcatattttcagggccaaagaacaaaattggctactttgtcaaccttaaagcagactccaggaatgtcaccaacagcatgacttttttgaccaaatccagcaaccggagcttcatcgttttccttaccatcattgggtacaaaggctctgattttcttaccattcttgatgcactggaccctgacactcttcctagtggtagaatttggctgtttggcttcaactcctactttttccagcctcattgcttttgcaggacaaccacctccaaaagggttggccttcagcgctgtgcctaaacggcctttcttggtcgttataacgccactactggtcttttttgtgactaatcagcttccctacttcaccaaagacacaaacattgaccctccctgccaacgccaaaggcactaatcgaaaaaaagactctttaatttattacaatttatttattctccacaagcactttggggtttacataatcgatcgtagcgacacatcccctcaccccataaataccttttggctaataaaactatcattccccgctcctatcaggtccacttatacttctccttcacctcccattcaagaaccagggtacatacttccccttctctctcttcccatccccccgcctctcgcactctcgctttgctt

SEQ ID NO: 14354 - DNA, 741 bp, Homo sapiens
  misc_feature (1)...(741): n = A,T,C or G
ccccctggaaaattcagtaatgtttntgctaattccaaatttcctcctactatgcatgggaaatanagaagagaaaactaaagggtgtggatgagacagaaattcatggaggcaactccaccgctaaataaaaatgcaaactaagatgaggaaagattaatgcacccactgtgccccatgattaaagcacccactgcgcctacagggtcatatagaggaggcacagaccgcacccgggagtccacagttagatctgtctgcaaactgagaccaacaatcaaaaggcagaggtcctggaggtgccaaaggcagacaaataaacagacttggctgcaagatggcgaaacatggtgctgcggtggcttcagccaaggtgctggtcatgcctatacagggaaggtgtccagacagaactgaagaaataaaaatcaaaaaattcaaggaaaataaattatttcaagcaaaactatttcagtcgaaagcaggtctaggggctgaattcttaaagctttgccgcatgtcctcatttcccttggtacaatggcatttcagagcctgtttacactgctttctaaatggacaagtccaaaccatgtttgctacagtccgagaacatcaacatgttgaaagacagctttggttttttaaaatcctactgtatttcatttgcgactttgaaaaacattcgtgctttagtggactggattttttttaaaaagaagaagaaaaaaaaaaaaaaaa

SEQ ID NO: 14355 - DNA, 717 bp, Homo sapiens
gtgtgtttgatttttttgctaggtgatttctggattagatggcattttcagaatgacagcccagctttatgtggggaggagacggatcactcttttctgctcctacattgttctcatgagcaactcaaattacagtttgataaaaactaaatgttggaaactcatctatttgacacggagggacaatacctgcaaaagaacaccatgaaagaagcattcttcttcccctctgagtattcacaggcaggcctgcagtagaaagatattccagtagatgccagaatgttcatttcagaggctacataggcctcattttgcctcagggtcctcattagatcctgtgagtactggcagcaccaggaaacatcggtcagttgaatttgaagttattcccgcctgcgggaacaatggattacttaaccttgacctatgacttgtactttgttaatttccttgaatgtacttatattaattcttaacaatcaaaccacaacaattccagactctattcccttacacaccgacaatggatttctggcaacaattctacatggtctaggtcaaggaattcgagatcaggtagaaaaaaaatgttatcggattcgtttatgatagtttttgattcccctgttacctgcaatatcgtttagaagtggacctgttcgggtgtcagaagaagtcttcagacacctcgggatacattgtgttcccaacact

SEQ ID NO: 14356 - DNA, 696 bp, Homo sapiens
cactaaaaaaatatgtttaaacttctaatcccctttttgtgggagaaggaaattatcaattttggttttaaaaaagtagtaagtctttgcctttggcctatcaagtgggtttaacaaaaagaatgttgaaagagctatttagaagggctgtgtatcccccatgttgtttaggagggttttctataccttcattagaaaataatgtttttgaccgccttttagtcctcggttcccctactaaaatcatcatgttttaatattaatacaaaaagtggggtattgaaatatccccccataaataaaatgctctctctgggtttaatcagctttgttaggatttactttatatatttgaaagcctaattttagacccccccccaaatacatgcatgtataaacaaatttgttgtacattcccagggaaagaatttatgtattgttaaatgtccttttttgtctgtttgaagttttgacttaaaggacattttataaaatatgacagttttttacttaaaatgtagcttgggtaaaattattttgagctcttaaagatctaatttggttaatatttacattaaatttttacttccatttcccccctttcagtctttttttgtcattagatctcaactgacttttgtaaaaagtcaagttgaattttgatttcccagaatttttaataaacctttttttttt

SEQ ID NO: 14357 - DNA, 746 bp, Homo sapiens
  misc_feature (1)...(746): n = A,T,C or G
taaatgattgaaatgttagttaaggcgtagaaaaaaaggnaaaacttaggaactgatntaactctgtcttccaggctggagtgtagtggtacaacctccacctcctgggttcaagtaattctcctgcctcagccacccaagtatgtgggactacaggtgtgcactaccaggcccggctaattttttttttgtatttttagtagagacgaggttttgccatgctggttgggctggtctcgaactcctgacctcaagtgatctgtctgcctcgaccccccgaagtgctgggattataggtgtgagccaccatggctggcctgaacttcatattttttaatctgtaaggaggtgttaggaggcctaaattaaggcacccataaaaagggcattgcacatgccgatagtgtttagcagggggcttttttaatctgcacactcaccagtcagagactcaaatcttaatttttgccattatgcagtgtagttctggccaacaaaccctgcttccttttaaggccaaagaactggttttttgcatacaccatttgggaattgcatgaagatagggtgtatcggtgacaaggcgggtctcttttctcaacaagggggccggtacttttgactatgctcgggctttttcgctgagtgatatccggtaatcgtgttttataaaggggcccccgtcaatggtgtgtcttgtgtactttatgactcggggtgtagaagagcagttagtcctttcattt

SEQ ID NO: 14358 - DNA, 757 bp, Homo sapiens
ctttttgtctcttcagctcttttcattcttccactagcaaagcagcgggatggcgctcatctcttacgagtgaacacacaagaccgcactatagtttgtcacacgaaagaaggtcgcaatcaagcagaaaacatagcctcctcgctatttcacatcgataatacaaggccaccccccgcccaatttacttgcactgcccccatccatttacactaggggcctatcaacacaatgtcaattgcacagcataaaggactcatctctattcccgtcggtggtaacttacaaaacaggtcacatgctacacaatactaacttttatagtagtgagctatcattgtctggaattaaagaattttcctaaaattttataaatccgaacttcattttatgctacaccaagttagcaggatattaactttaatgaattttgaatctctaattattttagtttctttgtcttgtgagaccataatttttgcagttttcccttatgcccacacttaggtttttagtaatggctacttatttctttactgtttctgctttattacttgtgtctttaataatactgtttttggctctcagtttattttcctaggtacttatcatttaattcatttaatcctgttgttttttaatcttatgtcattaatttgttttgtttaattcgttttaagattttatagcctgaagtaatcattaaatgtactatttcgtttaaaaaaaaaaaaaaaaaaaaaaaaaaaaaaaaaaa

SEQ ID NO: 14359 - DNA, 1464 bp, Homo sapiens
  misc_feature (1)...(1464): n = A,T,C or G
ggtggagaggaagagagantgaggaganaaagngagtagatggngagagaganatnnannataaaaatgatatatggtgnannnnnttggnatgtgtgnnnnnnatttgttacatacatacacgaanganacnagttgagagcaaanataccccttagagcgatnaaganaggngtcttcctgtgnagnagctggatactagagagccacctttanacangagagnctngnnatatngacgcangcgcctncggagncatnanatgtcngagacccancgagcgttggnnagagcgtgcagcgtcgactgagtngngcttctttgnggagtggcntgngtgactgcngtagaggagtgtctcgtcgagtgagtggtcgtggatgtgcgccacactgatacctattcaccagcttcgtagtgtatagccatcgatagacactcttcgtcggtgtactcgatggacacgatgcngatcgcgatgccnagtccgacgccnacgctactcctgactcagcggcaccgccaccccagtccctccacacgtactcngtcgctaacacgccactgtctcccgcgaaccgatccatcatntatctcccacctcgctcanacaggttctcccntcacgtgaccgtctatgcatctcgaccgcgctgtgtctgctcgcgcactcctctcacactcccgccgccacgcgcagcgacggggccgggagagaggcgcggcacgcgcgcgccaccgcgctcgcccaccgctgcggcgccccagcgccgcccgcgncacctcgcatcgccacacgactacgcgngcgcaccgcgcncaccgcgcacgccgcgcgcgcgcgcagagtcgcgccctggcgcgcgcncgcgcaccagaccgctcgcacactccacgctccaccatacgcaaaaccacccactaccgcccacctctctcgcgcccctgtcggactcgcgccgcgccgcgccaccgtcgccccgcccgctgccaccacccgccctcccgccgccacctacgcgcgcgcacgcccgcgtacgaccgccccccacccgggccgcgggccgcccgtcacctaccgccccggttcggctagccgccccaaaccgttctaccacccgtaggtgcggcaccccactgcacccctctctcctcccccctctcccaccacgccccctcttcctcctccactccctctctactcccaccctcccaccccctctcctcccctcagccccccgcgcacgcccagccgtcgccccgcgcttccctcctccagacgtcgcactcccacacgcgtctcgcgcacctctccgtcggcgaccgcctcccgcgacacgtgcaccccgtccacaccccggtacctcccgcgccgtccgctcctccgtcgtcgactccgagcgtcccgccccccacgcgcctctcgtcgcccgagcccgacaccgcctcccctccgtcgcccg

SEQ ID NO: 14360 - DNA, 796 bp, Homo sapiens
  misc_feature (1)...(796): n = A,T,C or G
cagttgtttcatcatgaagttcaaagatcaaaacaaaatggtaactgccaagtactccgtatcataaagaagatgctatatcatccttgcggccagtgtcaaaccactgtgaaaataattctgcctgcgttacccagtatgcctgcctccagactgtatacgggagttgatgaacttggagtgtggggaatatttcagagacagttttcagtgttttgtgaatggaacatacacacgcacacatacatgcatacacacacaggtgtacacacatacacacaaaaagcgcggtagttttttttctatcaccacaggcaaagagaacacgctttagaagtacttcttagagagcttttaaatgttctctggaatttgggagacagaaagactagtatatatctgtattatatatggcatataggataacatatgtagcaaaaatagatatagatacatagatatacgagagagcaaataaattagaaagttatttatctagaaattgtagattgagtaaataataactattctacactcatataaggacactgttcagctattaatattaaaattatggtacatttatatttattaatagataaatactcgtacaatatttggaactaaaaacattagctatttgtgcttcatattcataatgtatgtatacaaataataatttatagaaaattatggaggacaacaaactaaaatgatagnataaattatctcttggttttttctcacatattattctctttttgattttgcttatccaaatttttaatttttaatt

SEQ ID NO: 14361 - DNA, 780 bp, Homo sapiens
agatggggtctactctgtccccaggctggagtacagtggcatgatcatagcttactgcaactttgttctcctgggttcaagcagtctgcgtacctcagctgggatctcagctcactgcaagcttggcctttcgggttcaaatgattcttgtgcttcagcctcccaagtagctgggattacagaagtgcaccaccgcacccaactaatttttgtatttttagtacagatgaggtttcaccatgttggtcaggctagtcttgtacttctgacctcaagtatccagctgccttggcctcccaacgtgctgggattacaggcgtgtgccaccccacctggcccctctgtttatacatttgagtaaattgccgacatgatgccactttacctctaaataactttgtaaaaacaatgatattcccttacataatcacaatacagttatgaaaatcatgaaattaacactgacacagtactataatctgtgtactttatctaaatttcattagttatctcactaatgacccctgtagcaaaaataaaaaaagtttttttaaaacctttggtccagaattcaatccagcatcccatattgcacttagttgtcatgcgtaaaaagaaaccaagccccagttcattgatgtgaggtgggaggattgcttgaggccagaattcaagaccagcctgggtgaccggtggagaccccattttactaaaataaaaaccgttttttgttggccttaatctcacattcacagagaagacttctggaccctgggcccc

SEQ ID NO: 14362 - DNA, 299 bp, Homo sapiens
cagactatacatttcggtttcaacatagcggcagccagagcggtcctcttaaagtggaagtgatattttgcttctctcctgcttaacaaccttcagatctccctatctccctaaaagcaacaaccaaagtccttccaggggctacatgaacacctgcatcgtctggagtctgctatgactcagccctcaatgcctacaatactcatgcattaagaacatattgagtgggtacggaaagtctctaaatcttctggtccacgctttatcaatacttctcaatatattctacttctacaaaa

SEQ ID NO: 14363 - DNA, 568 bp, Homo sapiens
aaggagggaaggacagaccattccctgtttgatgctcacactccttcagtttttgtgcgccctctcactactgcttcctggatgtctgtgagcccttctcgccaagccacacgccctgagaactctcctccttctcttctaaccttctgtagcctctgtctcatttccccaaggctctattcctagtgcaaaccctcacctccaaattaatatgttgcaaggagataaaggctgattgtaattcactgttaccgtgtgttacttccatttatcttctacagcccactttgtgtgaattaactaaaggaggagagaagtcagtggggatcttgtgcaggttccacaccagcctaagggagagacattttggagagagaggaatattcctcctgtccttcctgccataccccataaagatcagcccagattatgaaaagtactggttgtaggtattttcttatagccctagatgtattgggagcagaaacctgaatgtagaagaaaagaaattcttccatttaggctggagttcctcagaaagttctacgagtgatatgatattgcttgc

SEQ ID NO: 14364 - DNA, 451 bp, Homo sapiens
ggtacttcactagcttaatgatatgtggcacatgaattgctcgctgactgttgtcccttgtgatcacctgtggagatatgactattgagggagaacttagaggaatgccaagtagcagagcgtgaagctgtgggtgtggcccactgccttggacattttatggctgatagcacttggcaaggaaaaaatgcagccttgaaagtaggcttgcaaatagatttcaatatcagccatgcccccacaatcacccctatttgatttctcctgtaatatacgctttgtctttttccaatcttctaatacttacctacctcactggtccccttgcaaactacctaaataactaagtaaataacacttggagaatttctttgtttcattgcaaatttgggcacagaaagtacaggcaaggcacattaaacttcttgtccatccgctaaaaaaaaaaaaa

SEQ ID NO: 14365 - DNA, 799 bp, Homo sapiens
caattcaggcatgtgacaatgcaatgagaagttggcagtctgcagctcagaagagggtcctcaccagaacccgatcatgctggcaccttgattcccagcctctagaacttcaagctgggcaactaccatctccagaagtgtaagaatcaaatttctgttgagtataagccatgcagtctatgatacttcatgatagtagccagaactgactataatacagggtcatatacatattttatgcttaaaagtaatcatctgtaaaataaaaagtttgaaaacaaggatcactaagatctgtttaaaggagaaaaattctgaatctatatagaacaaaaacatcttatcaaagtgtttcagagaaagctgtgcttcagcacgaatgctatggaaaaacttacataaccaaatgacccgaattcaaatagatcagagtacgaacttttcaatgtccccatatggcatcatgtcatatctttaatcaaacagaaacaaaatcacaaattctacctggtacccattagaatcactagaagaggccaacatgcccataaacccttgtttttactctctccttcccaaaccacaccatgtgtatacccatgcatgggtgtggggatgcgcgcacacacattcacaatcttgccttctctcttgttcaacaagaaaaaaaaatatgtctatgggtctcattttctgacatttgatagaaaaacacaagtatttatctttgccactgacctaatctagaagattaaaaaattccaggggatgatatcttagatcactcatactttctcag

SEQ ID NO: 14366 - DNA, 763 bp, Homo sapiens
  misc_feature (1)...(763): n = A,T,C or G
ctaggctggtgagatccctcattagtctcgttctgctttatttcttgctagaggatactactgagctttggattttagatactgaaagctgaaagcggcacacctcctctggtctttcacgagtttgaagtaggcacggttgcccaactgtgtggaatggggagtctaacggcttcttaaacaggcctcgactactagtttcaccttatctcacaactacttccatgggtacctagaagtgccaattccaaatcctctgggagctcttctagacaactcggacgctcggatgttcccatttctttcttacaatgtagatttctcaggtgtttctaagtcaactaccattcacctattttttggagaggttcccaattttgatgctatttttaatcatcctggtggatttatgttttaaaaaaattccctgtcatatcaatgggatttcaggaggaagcantgggaaacagctacatctagctgtacatgaggctgggaaatgaagcctttattctgggaatccaagtgtccagctaaaaactttagattgtattatcacagatggagaaagtggctgatgaatggaactatcaatctctgcccataaatccagttagcttcaaggcaagagagactgaaaccgttcctgataaaatcctcgctgtgcaggatagtccgataggtggtataggttcccgtacatggattgataaggcacaatcccccggagcctcttacagatcgaaacattgccgttgcacac

SEQ ID NO: 14367 - DNA, 784 bp, Homo sapiens
  misc_feature (1)...(784): n = A,T,C or G
cagatttcccagcatcagtgtctacatgagtaggagagaacctaattcttcttagcaagtgttcctcatgaaacaaaagagcttcatgcatggcccactgatgcctttgcttctacaaagaagacttcacagtcgacctgttttccaggaaactcatgctggacctcttcctgtggcagtcctctgactcaagagactcaaggttcctggcctctgctatggggcaacccgcagtctgactcaccttgcagcctgcaccttcctgagcctcatccttatcaccctattagacttccactgcctgccaaccagtttgagacttcactacatggtgttgccagatctcactcctgctcttgagtgattccatcttggagcttggatcggtcctatcttatttcccttctgaatgacctctccatttcagctttgctttttatgctgataaccattcctattctgggttcatagatgggcttcagggggtcagtgaagcaatgggaaaggttgttgagtttttgaaaattcaacttactacgcaaatatgtagaatgatcattttatcctgcctttttgngcgtctccaaatatattctttaccctggttgcccattggaattgcctgggcagcttttgaaatggactaggccatatcaccaaagtcctgcttcaataggtcaaggtggaacccacattggtcattttaaaagattcttaagtggaaccctgaagcattaaaggcgggactttcattttcttgactgggtagtgggggcgggtcggt

SEQ ID NO: 14368 - DNA, 830 bp, Homo sapiens
tatgtgcagtatataaattgtgttattattttttttttctaagattcagtcttcactggattggtgtaactcacctacattgagaggcgccagagacccttggctggtgacaacccacctgggcctcgctcagccacactggtatgccccagtgttatagcctgtacccacaatcagcagttcccaagctcttgtactgcacccaagaagaatgaggatatggtgaacattgaagtgtgaggagggtggcctgaattttattgagcgacggaacagctctcagcagaggggatgcagtggggcgattccgctaccggaagaatccttggccagtcaaatctacagggtatctctcctcaagcagtaatcaggggtccatgattgccatgacagaagaagaaacagaagaataatgtttgctggctgttaacttcctcggcctggaagtcatactctctgctcacctctcattggtttggaccaacctacagtcccgtagtgaggagacaggatcttgctctgtcgcccaggttggagcgcactaatgagatcatagctcactactgcctcaacctcctgggttcaagcaatcctcccatttcaacctcccattaagttggaaataaaaggcttgtgccaccgttccctagattaaaaacacatcaatgaaggtcatgactcatttatgaacaaaaacattacaaaccatcacttgatgatggctcttcctctcaatttaacctggttagactaccaatgaaggaagaaccccctgacttgaggattcacacccttttcaaatacatatgatctaaatctggataaaccta

SEQ ID NO: 14369 - DNA, 682 bp, Homo sapiens
cctaggagaggctcaaagagtgagttaaaagacaaatgcaagaatctggatccaagagtcctggctagcagactagatagggatggtggagcattaacacattgcattcgaagcagtgcagtgggaagggaaggtagagagaagggccccagcctggtcgtgcctgcttgcagttcagccttggatgcccagtgatggtgcttcctgggggacttcttcacagaagcttcattggcagagaccacaccttactgtctaagagcaccaggagagtgatccccactgacacacatcagtttacctgcaaacttaccccaatacagtctccctcacagtgcaggcacgaacttgcccatggccacccctctaaagctttgatggcgcatgtgcagtctcctgctctctatacctcctgagacacagacctggggactcctggcccactccattataactagtgtttaaataaaagcaaaggcaatattatcaaggaaattgtctgattgaggtccccatatttttataacaaagcaagaagtggcatattggaagcagagaacagtcctcatcagacactgaatctgctggaagcttgatcttggacttcccatcctacagaactaggaaaaaataaatttctattctttaaaataaaaaaaaaaaatcggccttcttggcctca

SEQ ID NO: 14370 - DNA, 138 bp, Homo sapiens
cctaggtccagtaggatgtgcccttgcctgtgggagcctgccaataatgaaggaagagttgatcacctgctatgcatcagaccctttacctactgagctctcctaagttatcataaagactggttgctcctttcaaaa

SEQ ID NO: 14371 - DNA, 795 bp, Homo sapiens
cagaattatcagaatgatcactgagacctccaggttactcagcaaaggcagcactgcttctttggaacccataaccatggaaatgctttgacagcctttcttaaactcccaccaagacagacaagaactcagagcccaccaaatggcaaggctaaaagagcaataacagaaacagggctgagacatgctccttgctcaccacgttttgggtgaaggaaagaaagaagagctgcagtccttcggggaatcccagaccttggagcacccagagctaaggctgtgactccctccttaaggccctgcagttcctggcatctccaagcttccaggtgccatcatgttccctggtgccatctgtggaaacttcttgcagtacacctggtccagtggtagcctcacagacagctggcacgggtgttggcacctgaacctgtctgccccactgcagcagccacacagaggtttctggccaaaaaagtgacactccaaagatcccataacactacttcacaatatgacaaagataaaatttaaattaaagctaaatatttgctcttcagatatttcttgagtctcaaattgctgttcattttctccccatggcattatttttagttatacattttcatttaaaatgtaataactgagaaagattagatagatggacggagggatggatggacagatagattgtagcttatttgatgatagatagatacatagatacccaggaaaatagacagatgggtacgtagataagcgggtattttactaaaactaagaattggtcaatcc

SEQ ID NO: 14372 - DNA, 390 bp, Homo sapiens
cagatctacccttgacagctgtcgaaccaatacatgccattctgaccataatacctttaagataagtttgaccatttaacataagaagtaataaccagaccgggctcagtggctcacgcctgtattcccagcactttgggagtccgaggtgggtggatcacctgaggtcggaagttcaagaccagcctgaccaacatggagaaaccccatttctactaaaaatacaaaattagctgggcgtggtggcacatgcctgtagtcccagcaactcaggaggctgaggcaggaaaatcgcttgaacccgggagccggaggttacagtgagctgagatcgcaccattgcactccagcctgggcaacgagagtgaaattgtctcaaaaaaaaaaaaa

SEQ ID NO: 14373 - DNA, 822 bp, Homo sapiens
gattccgttgctttacttttcccttttttaaatttaatttacatttcgggccccatctgttgccctttcgctaaggaccaagtgcagtgtcatggctcatcgtagcctcaacttcctggggctcaagcaaccctcctaactcagccttctgcgtaggggggaccacaactcctggctcaagcgatccacccaccttggcctcccaaagggctgggattacaggcgtgagccatcgaacctggactgtatattgaaatggagtatattcgtgacaaaataaagatccaatgtaagcttgaaaaagaaaacaattttctttttggcctcaatgtcggaacttatggaccagatttcctttattgagggttaaataacgagcctgtgtctactcacttgatgtacttgttctttttagatgctttaagtgtgatacataacattcttcggtaataaatatgttatactacataattctacgacatctgaagaaattaaccacgcgatcaaaaggtcaacaacaagtcgatatatctcttgtggtctatctttctagaaatattttatatacttcgatcccttgactacaattctaatactgatccgcacaatctacaagggcaaaaacatataagagctaatatgaaaccatgctctctttcttggaaataataatatgtccataaacattatattaatcccactcccgcttacatattattcgttcttctgtagttaagtaagcaatatttaatatactacctcaaaccctctaccgtctgtttatcgtcagtcgcctcttataatagattatacttctccaac

SEQ ID NO: 14374 - DNA, 300 bp, Homo sapiens
ctcaggccctcgtgaagagaatgttatctgcggggcactagtgatctgggtctccaaaaaccaaaactcacattgctgatgggtagcgcagctaccaccgtggcagatttcaggataccaacgtgagctctctgcacaactgggaagggagcatgcaacctgctcctgtgaaccatacgagccagctctaccacaccactgaaatgcttctgaaacccccgtggaaaagactagaattattattacttatcagcaaaatagaactgaagttgagatcaactaatgatacatacacaaaat

SEQ ID NO: 14375 - DNA, 512 bp, Homo sapiens
ctagaaggaaataaaaggtttgttggaaatatacaatttaaaaagatgtttcaagtgaatatagtggttagcgtttcttcctgatgaataagccttaaatgaggagaagaccttgccatccagcaatggacaaaaaaatcagcatcatctttcacactgcaagaagcatgtagacttcagatgccaggagcttctcagtaaataccacgcctcaaatttgaaacctgggaattattaagagtcagtatagatgcacagaaatatgcctacaaaggtactatgggaataactgattatatacataaaagtcgccaggcaaattcagaaaaccaaatgaagccattttgaaaatttggattctatggtctgaagagtcataaataacagtcatcatactcgggagtgatataacaattttcttccaactagatctgagtgctttacaaaatggatctggttgctggcattcctaagaggtagctggcaattctcataatccccactttacaaac

SEQ ID NO: 14376 - DNA, 356 bp, Homo sapiens
tagccgtgcagccaccgcagcatgtgatgcctggattctgctgcatccaggctgcagatgcctgatacctgacaccctcggaactgacgtctgcactgagagcacatctcccaactgcagagcccaggtgatggtgctgctgccagcagaagtgctgatgggccaagctcctacaaagctttcttggtcttctggagccttcagtgtgttgaagccacaccaaagcagaaggcgctttctcattagtggaatagtatgttaattggacaccaaagctatgccataaaatcatcaacactgtataattgttgctattgaaatgcttatggttcattattaaacatgctcttattaaa

SEQ ID NO: 14377 - DNA, 227 bp, Homo sapiens
atacctttagcttgcttgcccttctgccttccaccatgtgaggatacagtgttcctcccctccggaggatgcagcaacatagcaccatcttggaagcagatggcagccctcaccagacaactaaacctgccaacaccttgatcttggacttctcagcctccagaactaaataaaatttagcttatgagaaataaagttccattctttataaattaaaaaaaaaaaaa

SEQ ID NO: 14378 - DNA, 220 bp, Homo sapiens
agggagtccaacaccactctgtggtaaatgatagcacaggaagagaagacaaggcaggggaactagagaatccagcaacatgcccttcaccctgtaggttggcctgtagcagccctaaattaggtaaagacccagcttttgtttgctttttaattgttacagtaggcaagacatattaattctaaaataaaactcttcttataactgaaaaaaaaaaaaa

SEQ ID NO: 14379 - DNA, 568 bp, Homo sapiens
  misc_feature (1)...(568): n = A,T,C or G
cagatgggggtctcactctgtcacccnaggctggagtacagtggcatgatcatagcttactgcaactttgacctcctgggttcaagcagtctgcgcacctcagctgggatctcagctcactgcaagcttggcctttcgggttcaaatgattcttgtgcttcaacctcccaagtagctgggattacagaagtgcaccaccgcacccaactaatttttgtatttttagtactgatgaggtttcaccatgttggtcaggctagtcttgtacttctgacctcaagtatccagctgccttggcctcccaacgtgctgggattacaggcgtgtgccaccccacctggcccctctgtttatacatttgagtaagttgccgacatgatgccactttacctctaaataactttgtaaaaacaatgatattcccttacataatcacaatacagttatgaaaatcatgaaattaacactgacacagtactataatctgtgtactttatctaaatttcattagttatctcactactgtcccctgtagcaaaataaaaaaagttttttaaaaaaaaaaaaa

SEQ ID NO: 14380 - DNA, 187 bp, Homo sapiens
  misc_feature (1)...(187): n = A,T,C or G
gggggcacagaaaacggcgccgcnnncctgcgcgnnctggcgccgcgcgcctctctnggtagagacaaaaaagaaaacaaaaaaagcgcgaatgncctgnaaanngnngatcngaaggngngnngggnctggngggnggnngnnggaaccngggggggggnggngggagaaaagaaaaaaaaaaaaa

SEQ ID NO: 14381 - DNA, 550 bp, Homo sapiens
  misc_feature (1)...(550): n = A,T,C or G
gggntaaatcntttttctttntacncnccnaggccnccanccttttttttttaacnaacccctnnttttttaaaaataaaaacntttnaatatttgccncggtgaaaacccaagnaanacnttgctnataaanaagaagggtaatccataaaaataaattccaaatgaaaangaaataattcttnaagaataaaatgtttaaaatcctagcttagacaatgttgtctgcactctctttgtttaaaagggaaattggncctgggagtgggtggctcaagtctgtaatcccaacactttgggaggccaaggcgggtgaatcacttgaggtcagtagttcgagaccaggctggccaacatggcgaaaccccaattctactaaaaatacaaaaattagctggatgtggtggcacatgcctgtaatcccagctacttgggaggctgaagcaggagaatcacttgaaaatgagaggcagaggttgcagtgagtcaaaattgtgcctctgtactccagcctggatgacagagcgagactctgtctcaaaaataaaat

SEQ ID NO: 14382 - DNA, 585 bp, Homo sapiens
  misc_feature (1)...(585): n = A,T,C or G
ataaanngccnaaatangnnttttttatannggagacngantcccnccatnagnngngantcntcncnnagcgggggnnttnttaaanaagggtaattanggttngaanngggccnctntaaagggaaagnagngggtnngattcccngattgtgncccaanaagnccaanggnaagnttntctattananncctttgaaagnaacngttacatgataangcaattgancagagcaaggnaagnagtanccagggtgtcaggnntctncaggaaaagacacngnnttacncggnncngggtagaaaaagatgacatnanctcaagngnatggttggaanngtnaaaagtagatggnaanatntnnaggtcgnccatngtaaggntgttaagaaaagtctgagcatgaaaatggnnaattctggaagatttttgantgggaaagncnaangctnnaaataagtatccttgaccaaaacaatctntngatnattgctgantccantctgacatcagatcacaagtacacanaggtanncaaagcaggaagtatatgggaaatctgatattcttcatcaagactcaaa

SEQ ID NO: 14383 - DNA, 667 bp, Homo sapiens
  misc_feature (1)...(667): n = A,T,C or G
attatttaaaagtaattccagaaggccgggtgcggtggctcacccctgtaatcccagcactttgggaagtgaaggcagctggatcacctgaggtcaggagttcaagaccagtctcctgaccaacatgatgaaaccccgtctctactaaaaatataaaattagccaggcatggtggtgcatgcctgtaattctagctgcttgggaaggctgagacaggagaatcacttgaatccaggaggcagaggttgcagcgagcccgagactgtgccattgcactccagcctgggcaacaagatcaaaactctgtctcaaaaaaacaaaggaattccagagattatatcatttcactggtaaatattttcatttgnatttctaagagataggaattggtttagcttggaacacaattaatatcanttatgaaacattactattccttaacatcatctaaacttaagcattggtaaaatttccctgatgaagtccaatcctanagtaatgggntttttcaaagtaaggatccaaacatgggctacataataatgcatttgggttggaaantttctttctcttttgaatctccaagttccttatccttttaatttccgctattacttattcagaactgggcatttatcttgganaattttgggatntanactggtaa

SEQ ID NO: 14384 - DNA, 523 bp, Homo sapiens
  misc_feature (1)...(523): n = A,T,C or G
aaaantaagcanttgttaaaaatttccccnnatgaggcccntnccctnaangatggtttttttccaangaagttcccaacnangtttncataaataaggcatatggggtngaantttccttctcttgaatctcccaagttcccctnatccntttttattttcccgcctattacttattcaagaaacttgggtcatttatcttggagaatttntggcatctagactgataaccagcatcctgaaatgtcatttaataagttcctctatttcatgtatgctgtataactggtatatgttggggcttgaacaagttcaattttttaaaagttgtgtacttagtattgnccatattagttgacatataacaactggctgtccctctgcaatgttaagtttcactagtggagtcatatgttgccacctgggtctatctattaatagtatcctgctccctatccacgtttcgcctgaggatattagtagccattgatgatcatttcctacagatattatgttaaataat

SEQ ID NO: 14385 - DNA, 290 bp, Homo sapiens
atgatctaaactcggaaggtagcacacagaaatatgccagccaatccagctcagaaggcagcactcagacatatgccagccaaaccagatcagaaagcagcagtcaagctgatactagcaaatccaaatcacaggacagtacccaaacacaaagcagtagtaaccagtgattccttcagaaggcaacggataacatcgagagtctcgctaagaaatgaaaattctgtctttccttccgtggtcacagctgaaagaaacaataaattgagtgtggatcaaaaaaaaaaaaa

SEQ ID NO: 14386 - DNA, 536 bp, Homo sapiens
  misc_feature (1)...(536): n = A,T,C or G
cctttttcccnanccgggtttgagaaaccancantttnccnaattttttgaaantcccacnttggngncnttntttnaaattccaacnnatttntttancccnaanaancncccntttttttttaaattgggggtnagtcattcacctgcnttatatacataagcagtgataaacntccaatgaaaaaatgaacgtttaagccttgatgtcaatggaatcatagtgaatgcattccgctctaatattcatttttctctgaacagtatgtgtggaattcatccattttganactggtggctatagtttgctcactttcactgctgtgtagtagccccattgagcgtaaatatgacaatttacttctcattttttctatgatggtccatttagattgttatcaatttttagcttgtacaaacaaatttgctaggaatgttcttgggcataatccatgataaacatgggtttatttaggttagctcctccaggatggaatggctaaaatatacgatatattcatcttttgctttataat

SEQ ID NO: 14387 - DNA, 528 bp, Homo sapiens
  misc_feature (1)...(528): n = A,T,C or G
caangccagtnaagggtttttaacacaaanaagttttggacttaaannggcaggganttttntnaaattaaccccccncnnccaggtgangaancgnntnaggggtgcnntgctcaaanccaaacnccaanagggnacatattnaggaaaaagtccttccttgatgaaagcaaattcagaaattttggaaaaaataactatataccagatgcagagatatcaatgtaaaggcacaggaaacatgaaaagcanaaacggtatgcacctttaaagggccataattttccagcaatagatcccaatcaaaaagaaattcatgaaatcccagaataagaaactaaattattgattcctaagaaactcagtgagttacaatagaaatctgaaaaacaatttaaagaaatcagaaaaaacaattcaggacatgaatgaaaatttaacagatagatattattttaaaanaccagagttttagaactgaataattatttgaataaagttaaaaatacatttgnaagcttcagcaat

SEQ ID NO: 14388 - DNA, 741 bp, Homo sapiens
cacctgaggccacaaaaagtacaaacagggaaggaatggattcttccccagagcctccagaggcagtacagcccctgattatgtcttttcccctctgcttttttgccatcgatacctaaagatgtctcctgctcttctctgctgatttctcagtcagccacacccaagttaaacccatgacccactttatttacatttggggacttttatgaaattgtcaattagcatattataaaggactcagactatttaccctgctggtaactttaaaaacttgttacatgctacaaaatattatattttatagtagtgagctatcattgtctggaattaaagaattttcctaaaatcttataaatccgaacttcattttatgctacaacaagttagcaggatattaactttaatgaattttgaatctctaattattttagtttctttgtcttgtgagaccataatttttgcagttttcccttatgcccacacttaggtttttagtaatggctacttatttctttactgtttttgctttattacttgtgtctttaatgatactgtttttggctctcagtttattttcctaggtacttatcatttaattcatttaatcctgttgttttttaatcttatgtcattaatttgttttgtttaattcgttttaaaattttatagcctgaaagaatcattaaatagtaatatttcgtttaaaaaaaaaaaaaaaaaaaaaaaaaaaaaaaaaaa

SEQ ID NO: 14389 - DNA, 807 bp, Homo sapiens
gtggtgccacccaggccaaccccttcctgggaccacagaggcttcctcctgcaggcctgtgcagagggggtcacctcctctcctcctcccggatctcagcaccaacatcacctcatctgggaaggcttccccaacatgcctcccagcaccctgtgcccatcccctccagcacagcagtgaccacttcctgaatctgcctaactctctccccagtcggatatcagcctcttgacaaggactacaaggaccatcagccataggacaaggaccacatctgtcttcctctctccagcaccgaacaccatgctcaggattgagcagacaggtcattaatatttgccaaaggaaatgaactcagctggtccctccaaagtttgagaaagcctgctattctctggctggctcacacttgctggcaacttttactccacatacagaatcaaagacctctcaggaggctggtctgaggcactggtcctcaagctgctgcgaacgtctcaatcaccttaagacgagtccagagtgctgggccacacccctaagggttccgtctcagcaaggtctggcgtggggccccgggaatctgcatctctaacaagttcccaggtgctgctgacactgcaggtcccaggaactactttgaaacccccggttctggaggaagaaagggaaggggagcaaaggtggcccatgccctatggccagcatgatgccctcacagagacccttttctaagaagttcccccggaaaccctcttccaagagtctggctttgccttaaggcgaaagctttcccctgcccttctt

SEQ ID NO: 14390 - DNA, 1894 bp, Homo sapiens
  misc_feature (1)...(1894): n = A,T,C or G
actcnnatactcagngacatcnaacacatgcgntanngtncggatcatcatctacgctagatgcggtgagcagcgtcgtcgtgngcngtcgctgctctcgtctnctacgcgatcgtcactcgcgcagtctnngttngtngtgtcgctcgggggtgctgnangtgcagctnggctgntctctctcgcgcacgacacgatagtgtcgcgacactctcgtggnctntgnanntgntagatcantgncggcgctgctgctacgtcgcggggatgcgnagcatcgcgactgggtacngncagactcgcagncgtggtggttcgtcgcatctgcgctctctatcntgtgtgtntgcngtagtctatgctgttagtagttagtctgnanttgtgcntgcatctgtcagtcgntgtgantctgatatctgacgcactcgcgnagtcggtgntgggacgcngcntcactagactngnggagtaggagaggtgagctgggtgtagtngctagtgcgagggggntgtgcgctatcgcgatngcgggtnacgtgagagtttgcctgagctntgcgtgagcttgctgtgnagcgcacatagcacgtgtcccacgtcgccgcgttactcgtctgtgagncacgactgcgcaccggctcgctcagtgtacgcggtataattcacacgtacatgcgtacgcgtcgccgcctcgtcgacgcgnatgcatgtcacactctgctancttgtagcagtgtttgtcgtcactctctctttgttctgtatatatctgatatgtggcccatctcactgcgtaatcgtgcggacagtgtangangactcactccgatctatggcagactgtacgcntgactgtgtnancatagacgcttagtgtgtgcgtgcgaatgtcgtgctgcgacgagcggggcatgacgctagtgtggagtgcgcgcgcgtcgcgggtgcggggtctggtgtgttcgagcgggcttgcgcgaggcgccgaggtcggccgagagacgcttgcgtgctcacgtgtctggcgtcgcggccgctcgttgcggctgtgcggcgaggcgcgcgtctcgcnctggctgctgnttgtggtcctgggcgttctcccgcgctcagatagctagcgcggtctcgacgtctgctccgtgaggtgctgggtgtggtggtgggtgtgtatcgtgggtgtcgtttgcgacgtgtnggatgatatggcatgtgtgcggtattaatctctgcgctcataataatatatagatgaatcgtatnactcactatancgtngtctctactagcgctantatcnagcgatacgcgntctggangcatcctccattgtnactgtcgcgtctcgttgtctncaccacattcncatctcaagtgctcgngagtgacgctccgnactatgtctggtctggtcgctgattatgtgtggcgangctcgcgtcgcgaggcagcgtggtgcggtgtcggngtgcgcntctggtgtcttctactgtagncttgtgttggatngtgccngtctcgtcggatgtgtgtatcatngngagtactgccgcttctccngcttctcagacctgtatcactcttcatctactcactctcntccgcgctatccgtatctccacgctatacctcatcttctccttcctcatacatatcgctcactgtantcncntctcgtggttgcgcnctcttgggcggtgcgattcgctctctcctcactctaaaaaccgtctctctnttnctntcntnttntgttttttncnccttctntngagggctttnntntcnctctcttcntcctctcctctctctctctacaccccttnacnctctcacccctccccnnctccncctnnttctacttatctctctttatctcttttctcctccc

SEQ ID NO: 14391 - DNA, 732 bp, Homo sapiens
  misc_feature (1)...(732): n = A,T,C or G
ggagagaggcggatacggaggaaccaactcaanaaaaaaaaaaaaaaaaccttgtngtgacncngcaaaactttccgngggggaccccagcacggcacccgacggancangaaaatttttnggnggcacgaaaagcccccagcaggcaccacgcaggaaccanggacancganggagcgaaaagngccagcagacccgggggcggaaagccagacggaagaggcgccgccccncagaagcgggaccgcggaaaaacgccgaacgagaacaagatttttatgaagaaatgtgactttgatgagcttccagtttttctagataaaccttttcttttttacattgatcttggttttgtttctcgatcttttgtttggagaacagctggctaaggatgactctaagtgtactgtttgcatttccaatttggttaaagcatttgaatttgaatatctcctttttagctttgaaaatattctgggtgatactttcatttcgcacatcatgcacatcatggtattcaggggctggagtgatttttttccagattatctaaagccggatgcccacactatgaaagaaatatcttgctttattcgccttatagatatgcccaaggttactgggcttgctctatttggaacctccttgaccatggaataataccttggtgatctcgtcgcctgctcgagaaataaatgaatggctgcattctggcgccgaaaaaaaaaaaaa

SEQ ID NO: 14392 - DNA, 732 bp, Homo sapiens
  misc_feature (1)...(732): n = A,T,C or G
catggaaaccacttcttgcatcagcatgacctggatatgagacatggagtcaaggangatcatttggagcttaagatttgactgccctgctggatttcagacatgcatggggcctgtagcccctttgttcagccaattcctcccatttggaatggctgtattcacccaatgcctgtattcactcaatgcctgtatccccattgtatctaggaagtaactaactcgcttttgattttacagctcataggcagaaggtatttgccttgtctcagatgagactttggactgcggacctttgagttaatgctgaaatgagttaagactttaggggactgttgggaaggcatgactgttttcgaaatgtgaggacatgagatttgggaggggtcagggtggaatgctatggtttggctctgtgtccccacccagatctcgaattgtactcccataattcccacgtgttgtgggagggacccagtgggagataattgaatcatggtggtggtttcccctatactgttctcatggtagatgaatcagtctcttgagatctgatggttagataagggaaaatccattttgcttggctctcattctctttctttgcctgctgccatccatgtaagatgtgacttgctcctccttgccttccaccatgattgtgatgtctccccacgccatgtggaactgtaagtccattaaacatttttcctgtaaaaaaaaaaaaaaaaa

SEQ ID NO: 14393 - DNA, 400 bp, Homo sapiens
  misc_feature (1)...(400): n = A,T,C or G
accgcgcattctaggaaggggggacagacttgacgtnacgaccgcccgaaccnaacagagtacatacccccngctgngctnntctcgagctcggataancccacacggaaccccaccacctccgattccatcatgatgccacgttgctttctactggattacctcctgaagcacttcagatattttatacatacgtctcgacatgccccccagaacctgcctcttgacttattgctttcctctaacaattttttttttaccagggggccagcacacccctacggncccagcccanccccccctacccccaacacagggacacccaccccaggcccaccccacccgacccacccccacgccgcccaaccccgcgagcgcggccacccgcgcaacccgggag

SEQ ID NO: 14394 - DNA, 1107 bp, Homo sapiens
  misc_feature (1)...(1107): n = A,T,C or G
cttctttgtttagtggcggagcggtgtttcatgctccggaccgatctgggcagcggcggaggcccccccgactgctggtggcgcgtgctcggcgtcgctcgatcctacggcgtggttgcgcggcttgttgtgatctctttcggtctacatctactctgctcgtgccgtcgccggctctactcagccccgagctgcgcgtagctgcggcggcgctatgtacgcgcgcgttggccgggcgtgtgggtgggcggtcgccgcccgccccgcccgccagcgcggtcgtgggcgggtgctggggcggttgtgcgtagaccgatcttccggtgcgtccattccgcgggtgatcgtccgccgtctcgcgttcgcgcgcgcggggcggcggggggaaggtgcgtggtaccgcgtggcgctggggggggtgcaggatctgcgcggggtcctggtgccgggcgtggtcgcggcgcggcggcgcgcgggggcgcggcgtcgcgatgtggtggggtggcgcgggcgggggacgggagcggtgggagggcgcgcaaggccgcgtgtgtcgttggtggcgtcgggacgggcggcgcggcgcggggtgagtcgctccgtctcgaggggagtactgggacccggccgcgcggccctctcgtcgcgcccgtcgcggcgcgcccctgccgtgcgccgcgctgcgcagtcgggcagcgggcgggcccgccgccgccccgcggtggctncggctctccccctcttagccgtcccggcacatgttcttctttctctcttccgcttacctttctcctccccttctctcccttctcttttatcttgttagagctcgtcctaccacctctggtgaaatacgctagctatgtgcttctattgcagggaccccaccacccgctccccatcactaaacgctatccgttagtttgttatattgttttctttttgggatattttcccagaatctctgagtattaatgcacagtcatctanncagggtcaacttcnctgaaatgttntgcgaacttcagtttgcatactcaggatattttctttttattttttctccctctccccctctcctcnctcctctcncccnccctccctctt

SEQ ID NO: 14395 - DNA, 1362 bp, Homo sapiens
  misc_feature (1)...(1362): n = A,T,C or G
ttccgtctggtctccgctcgcggcgtcgtcgctgcgagctgtccggtttctgtctcgtgtgcgtgctcccgcgtgtgtgcctgtcgtgtggttcagtgtccgtttcgttgtgcgtttcgtgcttccgttccgttgtgcgcgtcgtcctcgtcttccgtggtgctgcggcgccgccgggtcctctgggtggcgttctgtcgcggcgccggctgctccgcagtttctgtcggtcgccgctccgtgctcgcgtgccgctgtcgtcgtgcgtcgtgcgtcgtgctctcgcgtatcgtcggctggctctggtcggtccgttcgcttgcgtgtctcgtcggtctccgccttcggggcctgttggcgtcggttggcgcctgcttgctcggtgtgcctgctgtggtcgtgccgctctcgtagcgcgcctcgtttgctgctgtctgtgccggtgtggcgcccgcggtcgcgtggtgtccctgtcgcattgtgcgttttgggttgctggcgtcgcgtttgcgtcgtccgtcgttgtgggcctcgttgtatgttccggccgcgggtccttgttcttccctgtcctctcctttctcgtctcggtggtggtggtcgggcggtggtgtcgtgtcgtggtttgccggggcgtccgcgtctgccgtctgggtctgctgccgcgacctctgcttgctggcccgacggcttgngcgtggtgccgcttgcgctgcgtcggcgccgggccgtgcgccctctcctttccactctcgtcttcgtgtgtggtactgcgttntatcctcttgcntctctcgctctctcattcgctgcgctctgggtcggaccttttctgtcttgctctgctgctcggctgtgtgtttcgtgcctgctattcactctgttggcgtgggcgtagttgaggcgggtgggtggtggggagtcggtgtggcgtgggtgcgtgcgggtgtgggtggcggtgtgcgggtggcggcgtggcgtatggtgtttgttcgttcatgagttttgtgtctcgtcttctgtcgtgttgtccctgctgctccgcgtccgttgtgtcgctggttggtggggtttccgctttcgttctcgtcggcctcgctgctcttgcggtgccggtgcggctcggcgcggctgntgtgtgtgtgtcccgcccgcgccccctctgcagccgttctcgtctctccctcggtcgcctcgccgtaccgcttgggtgtgtgtangtgtgccctacgcttgngtcagngcgtgtcgngtggtagngtgtcgggccgtgcccaggnattttctctctttttgtttgtttccagtttttnntttccttcctcctccttctttcntccccccccnntctcctcttttcct

SEQ ID NO: 14396 - DNA, 841 bp, Homo sapiens
agtgtaaagagccagtaggagtgcaatcaaaacacgtaatcaaagtcactggacaatgaatgtttgtgttgaggaccgagaccagctgtgtcaatgttaactgctggttccaggattctctttcccaggtggatgagggtgaaaacaataaagaatgtcactcattcgcttcaggggaattcctcgaaaaccaattatccaggttctaccctggagagtgttccatatgcacttgagattattatgtattctgctgtgttggatggactgttctatagttgtctattaagtctagttgttttgtaatgtaatttaagtcgtttatatctatgtttatttaccatttctatatgtttttatgtagttactatatttcggcgtgtttgttttctttattcagagtcacatctttagcatgattttctatctgagaagtgctctttatttttccctatagtgtgggtctgcagggcctgaatagtgcaagtatatttatggttaaaaccattttattttgccttcccttctgaaagatattgtcactgagtaaagaattcagaattgacagttttttttatttaaagaacatgttttactggtacattataattggatatggttatgggggacaccgtgtattttgatgcatgaaacagtatgtaagaccggattaatgtttagattttcctccttttcagcacttgtcattttattattcggaaattttaaaatcttctatgtatcgcaaatgatcaataactttgtgaacttgttccttttaataaaaaaaaatggtctttatgccccaacgcggatctctcgtcgctttccttatgagggg

SEQ ID NO: 14397 - DNA, 775 bp, Homo sapiens
ctccgggtctcattctggagttctgtgatgtgatcacggctcactgcagcctcaacttccagggctcaagtgatcctcttacctcagcatactgtgtagctatgactacaggtgacaagcgcgaccacccacacatgacggtactgtgaggggccagtagtacgaatgaatcccaactgggcggccctgcttccctgcctcaacccagggctgtgtgcttcccagcaggcactgccatctatccagccccacagtttcccagcactcagcacttctgatgcttggcctcaacctcgccaccactggagaagatgaaggtgcattctggtggcttccacaggtatgacactgtttcctgggacctgaagagaatgcactgtttacaacctgagctacaaccctgcagccacatgctgaataaagtgcttcaactcacagctcaaaagcccatggccagagtgctcttgggactcctgctacaatttttgtttttcactcacaagtacaattaaggaaataatcttttgggtttagtgtaaatactaaaatctgccctgataaggtccttccccttgcatgcaatctatttatattcctgtagcaggccaggaacttcctatggttaatctgcttgatttgggggagaaggtaatcttaaagaaaaaaaaaaaagccgagctcaatccaaaggtcttgatctgagcttgaattaacttgcactctttggtagaaatgatagctttataaacaaataaatggctaattatgactgtaa

SEQ ID NO: 14398 - DNA, 739 bp, Homo sapiens
caagtgagagccagatgggctctcacttgcatttttttgtgaaacttttttggagaagcataagagaagcatccagatgcttcagtcaacttctcagagttttctaagaagtgctcagagaggtggaagaccatgtctgctaaacagaaagggaaaatttgaagatatggcaaaggtggacaacgcccattatggaaagagaaatgaaaacctacatccctcctaaaggggagataaaaaaagaggttcaagtatcccaatgcacccaagaggcttcctttgacccttttcctgttctgctctgagtatcgcccaaaaatcaaaggagaacatcctggcctgtccattggtgatgttgcaaagaaactggaagagatgtggaatgacattgctgcagatggcaagcagccttctgaaaagaaggctgcaaagctgaaggaaaaatatgaaaaggatattgctgcatatcaagctaaaggaaagcctgatgcagcaaaaaaagggagttgtcaaggctgaaaaaagcaagaaaaagaaggaagaggaggaagatgaggaagacgaagaggatgaggaggaggaggaagatgaagaagatgaagatgaagaacaaggtgatgatgatgaataagttggttctagcgcagtttcttttcttgtctataaagcatttaacccccctgtacacaactcactccttttaaagaaaaaaattgaaatgcaaaaaaaaaaaaaaaaa

SEQ ID NO: 14399 - DNA, 824 bp, Homo sapiens
gatatacaatagaaaaaatcgaatataaagagaagagaaaaacacctcaggatccacctacattagtttatactcatccaatctgcaaatgacagactcttgatattcttcttattccttactttcatcttcattgccacattaattgatttgggctaattcaagaatttttaacaactcagaaaatgtcatggagtaagagttctcacaaactattctgatactacttaattagaagaataaatttaaaattttggacaagagccggttttcttataacatcttcactcacttaactgaacaacttaaaatatgaccgctcttaaagagactaatacatctttaaactttgaaaaagcgtatctatacccgcttcctaacacacagttaaaattaaaaacttaccatacctgcatgctttaccggaacacctcttggacactgttgtctccataactttcaaataataaatcccaaagggtacaacaccacttacatgtttctgcaatggtgcccaaaaatggctcgctagactgagtaaaaacatactcgataagaacaatgtctcccgacgagtcctgagatgaccttgacaccttactactcatcttcccgactcctccagttacctgattacgtaccttttcataatgccccctgcgcacacgacaacccaccagtcattccacaggtctttcatcaacctttgtcgagaacatgcttcacccatccacacagaagcggcgcctcctccaactgattctactgtagcaacaagatgtcgtgcgttgcttttttgttacttacatacatctcttctaaat

SEQ ID NO: 14400 - DNA, 832 bp, Homo sapiens
aatataaaagtaattgaaattattaaataaaatacatcagttatgacaaccctcctccttttaccaggtggagtgcattgacacgaccatagatcactgcagcttcaggttcctgggctcaagagatcctcctgccccataccctcacgcataccttagaagatcattgtcggagtccagcctcctaaaaccctcgcaaataaagtagaatatacacaataaaactgcaagtttgtaatcggaaagcgcacctctctggaactcgggagtcttggatcctacacatgactctctgcataaatagaaatgaaattagctacctggatactaacctagtattaaacaggtgattctacataaaatcactcttgctactaaccactattcagcacgattctggttaccccaagaacattctgagacaactgtatctataattgataagacccgacactaattcttacttcctgaaccgtgctccaaaccttattgggttgactcttaccaaagtctatcgcaattaccacccattcaataattgtaaattatttttttgccatataaatgtccctcatattatcttattatcatttttacgtggatttttccgagaaatgagttaaaattccctaacaagatacttgtgaattttgagccattataatcaaactattctacgtttattacttcacacacattgctcttatctactcccctgccgttgagcgcacttatatttgtcccattccatttttccttaccccctgattaaaccctctatccttctcccaattttttttatagtaatttaactttttttcactctatattt

SEQ ID NO: 14401 - DNA, 725 bp, Homo sapiens
ttccgtgcacttcggggaaaaagcagcattaggtttttaatgcccccgccagttttgtcctttataggggcccctattttctgagagaaaccaaagagaggtgggaaatcgctttgggccccccccttttttaaagggtgccccttcctcaaaaattactttttttttaccctttccaaaactttttgggggttttaaaaaaaattttataaacttttacgggttgggttttttttaacaagtaaaaagctttaaagtttttttttaaacccgcccaaaaaaaaaaggtgggaaaattaaaaatcaccccctttttttgggccccccaaaaaaaaaaaaatgcaataaaccgggttggggtcagggggaggccccccccccctatttaaaagggttaggcaaaaggatttttggggcctaaaagttttagaccacccaggggaaaaaaacaaaaccctttttttttaaaaaaaaaagttttcccggattgtttccctgatcaaagacatccaggatcagcccctttttccatggcccctcccctccccccaaaagaaaggggtccgccaaccccgttttataatgcccaacccccaaacagttttagggtatcctttttggcaaaaaaaattttttttttaattttaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 14402 - DNA, 665 bp, Homo sapiens
cttaattaatgtgataatattaactatttaataaaagatattgagaggttttcaaataatttaaatcttgacaattataaaaatacaataaaattcaaaatcagtgtgggtttctgtctggcgaaaaacgcgaacataccaaatgcgtgataaggatataatgagaacgcaaaattaaaccaaattctcattcacctatataaaagaggaaaaaaacaaacccgtaaacaaaaaaatgtaggaccgccccgtataaaaaggatgcccaatttcgcaagattgaatccagccaaaagttgaaaaaaaaagccttatcccccccaatcggcagtacccccccggatataaaaaagtccgattttattcaggaaggagcccttagaagggcaatttagaaccataacaagaaaagccatcgtcattccaagtaggaaaaaccccctgcctgcagggacaccagcagcctacctcctaccccagctgtttttttaaaaaagagatgaccccaccagttaaggactggctgcaaaaaaaacttgttgggggtaaaacctgttgcttttatgtgggcttgaaaacatttttcaaagttacccaccaaaaaagccatcatattgtttatttttaagtgttttaaaatgttaaataaaactttgattgtttgc

SEQ ID NO: 14403 - DNA, 795 bp, Homo sapiens
  misc_feature (1)...(795): n = A,T,C or G
tagatggagtcttgctctttcactcaggctcgcgtgcagtgacatgatctcagctcactgcaacttctgcttcccaggttcaagcgattctcctgcctcagcctcccgagtagctgggattacagacccttacagctcctgtggagcacagtatgaaaacctctagtctgaagcttctgaagaatctataacaggaatgaagagtttgaccagcttgaatttcaaacatctccccattggcaagacatgaaaaccaagctttcacttgatcagacgagcaagacatctagtctttctggagatgttctcttatatcttgttgctttgggctgagtggaatacatacaggagccttgagacccaaagactctccctgctgctctggaggttgtagcctctgaacttactgttgccactgctcaggcctctcccatgagagagtggttatttgttttccttggtttctccttacccattgtctttgttactggtacagatctactccttggtcttctccaggcctacccactcttcagagcccattcctacttactcagagctctagagaggagacaaagcccttccctctcctcgaccttggtccaccacatatgtgcangtggttaacagtgggaatcttcctttccttctagtaaatcctttcccctctacagggtatcataggggtcccaaggcctcaaaaaattatcacaaaacattttgggcctagtagatttctccgaatctgaattttcaatattttcatgatcatcttggcaccttaataggttgggg

SEQ ID NO: 14404 - DNA, 196 bp, Homo sapiens
tctagttgaagagttaacaaagattggccaaacaacatgtcttcttggaacctattattctgctcatatctgacaaacatgataagatcagctgaattgctaatgtcaatgaattcatcttcagtctccagtgaatattatggacttcattgtactcaggataataaacactgctctacatttaaaaaaaaaaaaa

SEQ ID NO: 14405 - DNA, 631 bp, Homo sapiens
  misc_feature (1)...(631): n = A,T,C or G
ccactctgtgcccaggtgaagtcagggcacaatntgggctcatgcaacctcggtntcttgggtcaagcgattctcctccctcagcctcctgagtagctgggattacaggtgtgcaccaccgtgcctggctaatttttgtatttttagtagagatggggtttcaccatgttggacaggctggtctcaaactcctgacctagtgatcggcccacctcggcctccgaaagtgctgggattacaggcgtgagccactgcgcccggcgaagaaaggaatgaatagatctttctatcctttctcaaaacatctttctggagaaaaagtctaaattgagagaaaaaaaaaggcaatggctgtttctacagagcaccaaacatctgcacaaagaacaaaatgcaataaatcattcagatgtttccaaattattagaagcttggtatacagattaaaatttgctgagtatctcccttttaaatttgtgctatcctgacatcaaacagccatatttctgctaatactccatgtctttatactattccaacagttatggccaggaaaataaaagttaatctctcntnannntntnatncaaagaagactataaaataaataagatcggcgtnnanncctncc

SEQ ID NO: 14406 - DNA, 158 bp, Homo sapiens
  misc_feature (1)...(158): n = A,T,C or G
aanaccacnanaaannncccaccaagacnancggacnnnggncaaaaattaaanagcnannaggnnnaangncnanggaaangncccgcccggaaagntcacagacagcanctagcgctcatgagcngcttgtttgccaanggctcatgagcgcttgt

SEQ ID NO: 14407 - DNA, 396 bp, Homo sapiens
  misc_feature (1)...(396): n = A,T,C or G
acggagtctcactctgtcacccaggtaatctcgactcactgcaacctccacctcccgagttcaagtgattctcctgcctcagcctcctgagtagctgggattacaggagcgttggccttgacccttatgacgggtgaggaaggtatcacacctttctgcctctacagtagtaaactcagaaacacaacagcattttggagaagtagatcagacttcatctacatcagctcttcctggttctacagcagcctaccggcctttgaattcgaactggacacaggttctcctagatctccaacctgccagccactttgcagatattggacttgccagtctccataaccacatgacccaattccttataataatcccgatngnngttnanncatnncnncc

SEQ ID NO: 14408 - DNA, 282 bp, Homo sapiens
  misc_feature (1)...(282): n = A,T,C or G
ctgaaagaaggtctcaagagccacagatgtcttggatatttctgtatttcagactctactacccagacaccaaaagaagaaatgattaaccctggaggctgcctcggtctaggtgaaaaaatatatgtacgatgacagtgcaatcatactagaactcaggattaagaaactcactcaaaactgctcaactacatggaaactgaacaacctgctcctgaatgactactgggtacataacgaaataaaggcagatgcggcgcnnnngtttnannnnctcnnncc

SEQ ID NO: 14409 - DNA, 1007 bp, Homo sapiens
  misc_feature (1)...(1007): n = A,T,C or G
ggagatttctgcgacaaaaaacacgtgaaaattaaatgtgaggatggctgtcgggatcataaaacaggggcgcacagtccagcggttacacccggcgctagagggcctcccgcaactaaagggccgccgccaccagaagcttttaacacaacaggtgtggaactttgcctgggtatgagtatcttaaaagaccaccgcttcaagcccacgggagggtattacacatctatatagagcttgggaaccaaaaaacatttttttctcaggagcgtcgaaaggtacacgaaaagattattgttgtatttaagcccacaatgcagctgtccccgaatgtgggctccttgtggctaggtttataactaagccaccttatatgatgacaaggggtgagttgaaaacaggtctcgtgagggagattcatataactacctcccagtaagaaatgaacccggcgtagtccgcgcaacttcccctcaattggtatccttgtgtcacacacactcccttggagtatgtatggggaaataaaaacataaaccttgtacacatagattccccggttaggcataatagggaggttgccaaaaatcgtatgtgtggctagaagagaaaatgagtccgcaatttactcccctactttgttaaacgcaccatgggctctatgccctcactcccggggccacacctgggagaataaaattaaggaggtgattagttttgtgcatccacacaacatatgggaatacttgtagacaccaaaacacagcactgtgggagaaaatttctacaccatatagggggagtttcactgatagggagaaaataactatgccgggtgaaaaagtngttgtcatctcttattctgagacacctcattcgatgggcgcttgtagaacatagtatctacactgcactgttgtggaaccgtcctctctgcgcgcataataacaaatgcactctcgtcttcttaataagcgacatgcctgataaataagtgtgggaggtta

SEQ ID NO: 14410 - DNA, 451 bp, Homo sapiens
  misc_feature (1)...(451): n = A,T,C or G
annaggntnttcncatcnccngnataatgnaattgaagcccaanatnggtaatgtnataatgnctttnnnntntaatngcccnggtngaggnccaangnncgnntttngnccccccccaacctttgncttctgggntngagtgattntcctnccccaagcctcccaagnagctgggattaccaggcatgtgccaccaagcccagctaatttttgtatttttagtagagatggggtttctccatgttgttcaggctggtctccaactctcgacctcaggtgatctgcctgcctcggcttcccaaagtgctgggattacagatgtgagccactgcacctggccaaagtgaagtcttaattcctaattactttgtctcttcttgttattaacttcttttcacttcttgaatttactgtactaactgcaccaaaagaataatttcttgattatat

SEQ ID NO: 14411 - DNA, 839 bp, Homo sapiens
  misc_feature (1)...(839): n = A,T,C or G
cntccangggnanggacagggnttatttttaaaaaataagaaaatttnttgntttcgnccagatggattcnttatttttnncaaangtngtatnaaatgnacacnaagggatattttttagncnacaantaagaagttncccttttangtnanncaagggccaaanangggaaantttnncnaaaaaaaatnccctntnaaaacccncccccccanngnanttatncttttntanaaaagggtcccaaccaaggnngggtcccnctttggngaaaaccccnntttttggnggggnaatccccaaaaaccntttntnttttaatnnttaagcttgancttgnnggantttaganttttnanantgacnagaaaanaatttttggganaaactnattnntggtagaaataaatttntgatttagaancnanatccaaaagttncagttcataggatcaaaatcagggcatntngaatggtcantttctttngggccattgncatnntgaatgggtttggaanattcaaacaaacatcttcagcattcaacaaacnatatctgatacggactcttgttcttgagaataaagcaaagagcagatcagtgtggttgtttcaaccaagtctgctttacttgaagaatgacttaatttcattcaataaatagagtgaataagatagaaatnaattaagacagaagactagataatgaataaatggnatgccganatcggnnnatcaannncnactnnnnnanncacccntcnnncagaangganaagnncaaagagaanagnanggngagananngtaagaaagaaaannnnaangnacaananng

SEQ ID NO: 14412 - DNA, 486 bp, Homo sapiens
aaacagaaccttgaaattgctgactaacatcccggtgaagtaggcaggatcatccaatcagctaacaacactgcagaggcagaatgactacccttggctcaacacagcaaggctgctctggctcagcagctgagccctgaagcagtcagccccaagaggaagaggtgcttacagcggtggagaaagacgtggaacagctggcttctgaatatccttcaatggaatcttgctctgttgcccaggctggaatgcagtggcacaatcttggctcatggcaacctccacctcctgaggtcaagcaattatcctgcctcagcctaccaagtcattgaaattacaggtcttactgggaatgaagtggatcatcaattaaactaatcaacattggacttgggctacagctttgctggtttatagcttccaatggggaaaagtcactgctggatcttactcatttattctcacaaataaaaaaaaaacccgaag

SEQ ID NO: 14413 - DNA, 489 bp, Homo sapiens
  misc_feature (1)...(489): n = A,T,C or G
cnngtgganannaacnangttaattatgnnaanttnngtaacacnagncataagtgaagntggnccngaantgtcattttgnagaagnggataananaantaaaagnttgcgngtgtnatccaatagngtnaaagggcaaaggtnatacaanaanntccacaccaatgngttnanggnaaaaataataagnaggtganagnntnnncnntnnggnncctnnacnangnaaggntagacaagaanattaaagtttagncnnacaagtaagncnntcnantatangtgagtnaanagngnaaagcantagctatnagantattatatagtntngtccattgcncaatccgatataaanannnttttntantgnnganatgggangaagtaaannntantccgagntcaattnatnaagagaatnntgananngcgngcaaacaanagntgntnagtgnnngngngaacanatnagngantangnncgcgnc

SEQ ID NO: 14414 - DNA, 846 bp, Homo sapiens
  misc_feature (1)...(846): n = A,T,C or G
cgggntgntncgnnntnanctctnngnngnacanacaacatngaancgcncaanntntanttatannttttgggcccccaatatgaaagaccntatagacnncantgtnnattatannngtnaaccnngagtgnntngattgcattttatnagnannanacnncgntnntagtntatnatntagcgatgaccagtngaccnctntntttaanntttaaccncnccagnatcacaaaggnctacnnatnaatnccanactggnnantatnnnnnagcccttntttaaatgncttttngattaaggcanaacaatcaggngggantgggcanaatanancttaagacanacatnagcnaannnagngnaggaanagccatttcagccanagcccagggaccagngtncctnnangaatgaanacaagcntggngncnaannaagtntgcangaaaaaangcangctggcttntananaatgtgtgccctggccctgctctggaggtgcccnctcaaggatnaggcaatnccgtgcccttnttcngnanaattaaaccaagnccnnagnaactatttttttcccattggagncaaggctgcnatagggttatatggtttgatnctanacctacagaaaaccgacanttttccctatttaaagtagtcattnaaaaaaaaaaanaaatgccgatgagngcgtagagnananncncnnngaattannacgcnanatgtnganacnatactntnnanngnnnttanaataaagaatnatganaaanancnntanatagtnagngatatangagtnnnaaaannantatatanaagagttntgagaannnnga

SEQ ID NO: 14415 - DNA, 891 bp, Homo sapiens
atagccaaaacctccaagatcgaccccgaatatcacgaatcaacaactacctgcagtgaactctcttaaattattccaccgctacaagtgcctacaacagtcgcccgaagcacaacaagcattcattaaatatctgcagaatgaaggactctatcggtcccagcgtccagaatgtctccaccgtgccgatggcatcatcaagcttttcaagcaatatgactcccacgcgcgctagacactgaggtgactacctttctaacagcaacctttacatgaccatgatccgttttctcaaagggtctgtccacaagacaaaatatactggacccacgtcacgagctaacagaaagatcatgtcatcgacccattagaagagtacaccacaatatttattactctaacacggtacggaaggctcccaaagacaaagagctcaaaaagagacaaatatcccccgctttcacctcgtataaaattccatggacatctctctattgaagacaatttagcatcgctcaaagcatcagcacgagatgatttcataattattcgctactatttagtaggaggaatcaatggggctgaatccttattataaaacaataagacccctctagattcacagacacacctcatcaaaaatttccagcacaggcaaatcagcggtgcaccgccgacgccacacggagctaactgcgactacgcaaccacaaacatctctatctacagattctatcataacactccccacgtgctgtataccgcatatattatatttagacctcgcgtaatacttagataaacacgattcccacgcaaaacacacctcatcccttaatcgataccccgtatatatataaagcagaattacttaagacaccaatccgcggc

SEQ ID NO: 14416 - DNA, 614 bp, Homo sapiens
  misc_feature (1)...(614): n = A,T,C or G
tccttcnccnccntatnagataattgcatgtntnttgaaatcacctcaggttgccccaagntccagtctccctttataattccnaggagaaacnagtgatagccagttcgcttatcncaaattataaattctcntgccagctactacaattcagcattgatgaatccacaaaatgtatggtttaagactttcattaaatcctcctaatgtgggccagttgaagaggagtttagtagacagctgaagagattagagatagctagagtgatagagtcctgatgcccaggagaatggaagctgccaagatgtggtggcttacatctgtaatcccagcactttgggaggtcaagttggataatcacttaagcccaggagtttgatactagcctaggcaacatagtgacaccccatctctacaaaaaactaaaaaattacccaggagtggtgatgtatgcttgtggtcccagctactagggagtctgaggtgggaggatgcattgagcccatgaggttgaggctgcagtgagccatgatcacgccactgcactccagcctgggcaacagagtgagaacttgtctcaatataaaaaaataaataaataatcagatcggcg

SEQ ID NO: 14417 - DNA, 597 bp, Homo sapiens
  misc_feature (1)...(597): n = A,T,C or G
gncccatatcacatgaagagagaattncggaagtcctccatgcagagagccaatctcttcccggagaaaagaccatatgtctccaanagatggttatgcaactaagaatagtgatcgtgatggccacaatgacgcccgtggtagagatcattctgaacgtccatgtggaagttcttatagacatgtatttcagagataagatggagtgtaactttatcgcccaagctgcggtgcagtggctccatcttggcttactgcaacctccaccttctgggtccaagctcttgtcctgcctcagcctcctgaataactggtattagataagtgtgcactacagctggctaattttttgtatttttggtacagacagcgtttcaccatgtttgccaggctgttcttaaaatcctgatccaccctcctccgactgccaaagttctaagattacaggcatgagccactgctctcagcctatcagatttaattcatgatatgaatggaagcactttaaacctcatacttttgggaagttaagtgtataaaatgtaaaaccacagcataacgtttcagacaggggattgcttaaaggtgtaataatca

SEQ ID NO: 14418 - DNA, 776 bp, Homo sapiens
aaaaacctgaagcaaaggaacagccgagggaatgcagcagccatctggaaatcctgaccaaagtaggagatatgcccagttgtagtacaaacccatctatgtatttcaagcagaagataaattggttgaagaggaatatcatagaatccccaaaagctcacagccagaaaaccagactgaagctcagctctgaggttgattttcccagaataagagccaggtcactctgtcacttccctgaagatgtgatctacccacagcagggtgcatggagacagcacagttctcacagcacaggagacccagaaagccaccataggagcagcccaacaatacccctgactacccatgcccctccttcgtgttccaccaatgctgccagggagggagatttcaaacagcaccttcttcttcggtcctatgcctgtgtctagaagcaagggaggtagaagagacttacaggactctaatataggacttaccaaaatatttaaaaagtacttaagagctattaaagaaccgcaattatgacacagttcttgctgggtgtcaaactcaacccccagaccttcaacactattaggtctctgggctcaaagcagtggtttcccaaaaaatgcctaatgactgggtctttgggtagggggacacctgttccaaaatttgcctgtttcatgctgaaagtatcgcaccgagctgatctctagctttaacatggatccctgacaacgaaatgccaggaccccactagtggttcaccaacaatgattttaagt

SEQ ID NO: 14419 - DNA, 610 bp, Homo sapiens
  misc_feature (1)...(610): n = A,T,C or G
anttnaaccccaaagnccttccacacaataataaggttttanggggtnaaacaanggttttcnccaaaaaatcccnaaaaaangntttttagggnanggggaancacccttttttccnaanattttngctnntttcccatgctgnaaggnaatngcacccgcagnttnatctctaagcnaatnaanantggcatcactgaacacanaaatgcacagnagcccacatagtgtctccnccacacanataattntaagtttccttaaaagcaaagcaaatagtaaaatcttgtaaaacaagtaggaactgataagtttgaaggattcatcaacttttagtataatttatttaaacttgacagttatcttcatctgttcaggctgctacaacaaaataccaaanacagactggctaatgaacaacagaaatgtatctcacagttctgggtgctgggaaatgcaagatcaaggtgttggcagattctgtatctgttgggggccttctttcaggttaacaatggggcctttagctgtgtcctcacacggcagaaggaacaaggaagttttctggagtctcttttataaggccacacatactctcacctttatatac

SEQ ID NO: 14420 - DNA, 2116 bp, Homo sapiens
  misc_feature (1)...(2116): n = A,T,C or G
tgcgatgcacaacccagcacggccccatagaatacactcaccccaccatcagcctacacgacatanagagaccagccactctttagtctnagacggattcgaccgcgcagacgacagaagncgagctctcntcgagcacgacgccgcggcgagtagaacgagagacgcacaccaagagcagcagaacacgcgatacctcgtgtacagcacgaccacgcatacttcacaccgcagatcgcggcacagaccgcgnagtgacnanctacactgacagacctacgcgctgcacagagtacgcacacagacgctcgtcggagancggctgggagctgtcgacgtcaaccggacgcgagcgcagccacggcgacgngcaacatcaagcgagccacagtagcactcaacaagacagacggtaggcgcagcgaccgcgaccataacgcattaaactggtagtcaacgngcacgcgccggagcgaggnctcctnagcgcgcgcagcgagacgtcctatcagcacgtcacaccgccagcgacgaggccgccaacgatgctgtatacgacgtcatacgatcgacaggacataatgatgactcncagcacgcgcctgcacggcagcccgctagtcatacagcgagacacagnaaatatatcgggtagagagacngcagnatagatatgagagagcgatagatcacgcacatgtctgtncatccaggacacgcagcaggacggcagcgagcgagtatgtgtagaatncatacgaccgnagatgacgatacgagcgtcccgacatcatgatacgacgctacgacgacgacgcgatacacacgagcacatatgatagcgacgtcatgcgcagncgccagtgcggagatatcacagcccgccgcgntancgtcgactgacacacacancgcgtcgatgcacgtgtcacgcgcacgtccgtcgcgcgtcngcgctgctcgacatgcatgcgacagagantaatgagagnatgtactatgncacggcccnacgtcngcgtgcgcgacgagtactcagnactcgacgactacgtcacgcntancacagctcagcagagacaggtacgcgtcgtctgagcgcacnacncgtatcnacgacgccacgacactaccgcacacgncagcacataccgcaggantgatactgncgagagatgcagctgcgagacgacgtgtgacgactgcgagncnangcgncngacgacatcacggcacgcagtcacgcncgtcgacaagtcagcatgatgcacanccacgacgtcgacgacgctcagcatgntagtgagaaggngcgancaacacgagcngaatagcaatcgctaccccncgacggcgccnngngcacgtgattactcgatcatccgctatccaatccgagcaacttcgcccngntntgactcnactagtcgtcaatcgtctgcaggagcatcgactctcgtacgtctgcgacngtcagcncaacgacgactgattcngtcagnctcaacgcgtcagcagcngcgacagctgnctgcgtcgncngtaagcgtcagcgcatnaatcgagcgacntccagcgcgtcatctctactacgcagcgacactgctacacgcacccacatccgagtcctgcagntcgcagnaggcngnactgcagccgcagcaccatttgctcactgccgcntcgatacccgtatcnangccnagtacgcgancagtcntgagccgcncacactaagtagatgcgcatgcctcgcagcatgnagatcacgtcncgaatnatnacnatctctgtcagcacacgacccatgacgatcgaccngactcangncgatacgcacagtcggantcgactgangcgctgcagcgatagcattacgcacaacggacagntcnatngntntgattacggcagcgactgncgncngcacangatgctagtcagantantaataccggtnactgacantgnacgtcngtcggcgncactgctncaagttgntgntgaaancatatgaccaatacgacatnctactnacccncgtanacctgcaccatatgncagtnganatgagctccgnaaaacgcgacgcacgcagcagaccagcctgatcgcg

SEQ ID NO: 14421 - DNA, 697 bp, Homo sapiens
  misc_feature (1)...(697): n = A,T,C or G
cccagnncnnacaanatgctgaggcactanacgtgtaccctcctcnctggaaagccagcataataatttcttataagcaagaaacaagtaaacaagattgntgttctaccnnaagcctattgaatatgataaaggacactctccnacctcctcccccacgctcaggttgaagttggagaccaaatcgtgtacctcgctcccctggcacaggtgcanatgctgagagcactttctagtcaagtcctgcatgttcatttctgtctcaagtcagcttctctgagaatccaatttataaaaatatatttgtgaatgtataagtaaagtgacttggattttgtctacgtacaaggacttctatgcctgcataaaacagtctgactggttggaanaggcccttttcccagcctttgtgaaagagatcttcatgtaaacagagtccctcttattggctgaagtgaagagtcattctgaggtgagctaagcccagatacttggtaaatttatggtggctgttattttcataacaaagaaagtcaatttttggaaaaggatactaccatgacacacacaaaaaataattttcaaataanacccgtgcggggttcaacacngnnannaaantnannnagattaataatttattcccaaacaccananaagaagatgannantnnanaatganananaaaanannant

SEQ ID NO: 14422 - DNA, 447 bp, Homo sapiens
  misc_feature (1)...(447): n = A,T,C or G
actcannggtggccattattttanagagattttatgnanngataacgtctccctctaatagnntnttacnangngagataatatntctatttgacggggatanaatnagtgangtataatttctcccccncacacatataaannacttcngntggnnntatngnttccatnnggacantaanttncnctanganctttattttgngcananaacnannnnatatacaatnggngatnntncggntgnancagagantatanaccgaaatgaagncgnngttttntttaagtttttttggncaatatanaagggcccntatttcnannagttnatanaattngcttanacagnaaantcaagtgntttcatntantcnaacaanttantngaantnttaagcatcnaagtgacctcttattaatntaaccacnnntacnagttagcnt

SEQ ID NO: 14423 - DNA, 350 bp, Homo sapiens
  misc_feature (1)...(350): n = A,T,C or G
gacatggatgaagctggaaaccatcattctcagcaaactaacacaagaaaagaaaatcaggccaggagcagtgactcatgcctgtagtctcagaactttaggaggctgaggtggggagtatgagatcagtctgaccaacatanagaaaccccatctctactaaaaataaaaaaaattagccagacatattggcacatacctgtaatcctagttacttgggaggctgaggcaggagaatcgcttgaacccaggaggcagaggttgtggtgagccgagatcacagcattgcacttcaacctgggcaacaagagtgaaactttgtctcaaaaaagaaataaagaaagatcggc

SEQ ID NO: 14424 - DNA, 1574 bp, Homo sapiens
  misc_feature (1)...(1574): n = A,T,C or G
gaggcgccgcgcacgcggcccagggngcccccccgccacacaaccccaaggcaaaacagcgcctagacaaggagacaggagccggagggccctccagggagaagaaacccaacggcagcaggaaacaagcagaaaccgcaagacacaccacctcacgacgcaaccgcgaccaaccaaccggcaacgacgaacgaacgccccgcccagcgggccagcgacggcgnccgcgcacgcgccagcacaccgggccgacgagagaggacccgacaaccacaacagagacaggagcgccgcacacgcgccgcaagagcacagaacgacgacagagacgccgccacgaagaggcgcgcagancacaccgccgcgcaggacacacacagaagcacgacgccacagcgcagaccgcganaagacactactcaacagaaggncgncacaggacagagagagcaccaacacagcaaacacaccacgaccgcgcagacgacgcgacgagagancaggacagacgagccggggcggacgcgcgacggaagaacgagcaccagccaggcgaaggcagagcgacgagaatagcagacgacagaaaacaacgacccgcgacgagcgcgcgcgaacggcgcgagcgcgcacaagggacgccggcngaagcacgacagaggaggcgcgcgggagacacggaaagaggccgcacaccnggctcgccacgcatcgaagacgacgagcgacgcgcagcagagagagaaagagaactacgcagcangcacgacgcagacgccggaggangcacagccgagngaagagagaggacgagaagagagcggcgacgacgacagcgcgagcgccgcgcgacgccagcgatgacacacgcagcgagcacaagggacgagacatgcgacgcacnaccgcganacaacgagcggacnctcagaacataggagagaagcagnacaagaacgcagacgaggacactagacancgaccatatcgacacacaccgcgcacgngcacgcaggcaggaacacagagcggaccgagaccgcacacaccacgatagaagactcgagtcgcgcgcgaggnacgcgggngcagcgcgcgacacagcgtcaaagagcgcaagagcgcgaggtacagcgcaggaccgcgagacaagacgatgatggtagtgacaacacagagcgcgcgaagcgcngncacgcgcccgagacgccacgcgaccgcacanancgcgacgtcgccangacacactccgacgagacgcnacncgcacgcgacggcacgcggcgacgngcgtcgcgatccgacgacgagagacacacagcagcgcgactgtacgaacgacaaganagagcagagncncagcgagcgaganagacacgaataacacaacaacagtagacgcgactgcagcaccgacacgcgcgacacacgcgctacncaacaggcacacaccgcgatacccacngcaagcagctcgcagacacacacgcangcgcgcaggcgcagacgaccgngccgacccgacgccagcagccgcgcggagagagacaacacgcagcacgagcaacacgccg

SEQ ID NO: 14425 - DNA, 908 bp, Homo sapiens
  misc_feature (1)...(908): n = A,T,C or G
cgccaaagcacgagcngcttcgtnnncncaaggaanccggcaaagaaaagagcaacaacaaaaaaagctaaagaaaagaaaaaaaaaaaagctaaaaagggnggaaaagagagaggaagaagagaagaaaaaagaaaaagttaaaaagagaccgcgcgccccccgggnngcaggcggcgcccgcgcgcggcccccgcggcgcgcccgcccgcacaaccaaccagcggccgccagcggaagcagccccagagcacaaagaaacaggcaggacgccgaggccacccggaaagacgcgagcgcagacgcgccgcccccggcccccccccgcgccggcaggggggagaaaacacgcaaaagcggacgcgagaccgggccccgcgacagagcnccccaacccccgcccacgccacaacacccccaagaccgccgacacgcacccgagggaaaaagggncagggcggcgccgcaccaccgacccaagcaccccaggccagcaacaaacaaacccccaccaaccgaaccccccgcccccgccgcaagccgccagacccaggcgccccccgcccgcgcgcacgccccgcacgacaaccccacaccgaccaccccaacgaaggcgacagcggaaacgccgaagagccaacgccggcccacccacataacccgggccggcgggagacgacacgagaccgggcagcgcgcacgccacgcgcacgccagacacgccccaccgcgccccccccgcaaccccaaccccaccaggaccgccgggcgcccgaacggagggcagcaacaggccacccgcacgaaccccccgacgccgccgccacccgcccgcccacaaccgcaacaaaacacaccgaccccagcggagacgcaggcaggcaaccaaccgcgcaaacgcaggaaag

SEQ ID NO: 14426 - DNA, 628 bp, Homo sapiens
  misc_feature (1)...(628): n = A,T,C or G
agnaggncgggcnaaaacccaancnnattncnnnaaaaatnnacaaggggtgcnaggnccaaannaaaaccaattagggcccatttgtnagattttgggccnaaaagannccattannaaaanttaaatttgntaaccnaagtnagtggntttgtaanannaanagtctcgnaanttaagctncaagnggtctttnttaattaaccancggctanaggngctatcttcccaaatcagccattcgnaggtcttggcggttnaaacttcaatacngggatttggagtnaggncacagttcattccatacacaaagacaggatnggcttcatccagaacccggaaggtcgtgtccctctacagaaacccagatcnaatcgtgtcgcatcccacaccagatgggatctcactatgttgcccaggctagagtgcattggctattcacanacgatcatgatgcaatcatagtgcaccacatcctcaaactcntggactcaagtgatcctccctccacagcctcccaagtagntgagactgcaggcacacgccantgcncccagccctggactattaacttttatattttttatatccatagagtcnggcagcttctgatgcatagtaaccatgc

SEQ ID NO: 14427 - DNA, 589 bp, Homo sapiens
  misc_feature (1)...(589): n = A,T,C or G
attaaattttgctnaaacccaaggcnaggggttttntngaacanaaacngttnctggaaccttnaaagcctgcnaaggtggactttttntttnaatttaancccnccngctacaagggtccaaggattcccaaanattgaaaaagtccaaccattaaatggggnacaacntttntggaannggcaacangtggnanataaagcacnntcaacaagaccttgantgcaagttgaagcttccttgtccttatgttaaaanagncagncccaggagaaaggaccaagtctccttcttcatttactcgggtccccataactcaggatctaccaacgggataaagccagacgggattctggccacagaccccaaactccagctcccagtttgaagacccccacagaggaacgggatcagcatgacaacccagcttcttcagctctctgtcccatgacttcagtctgcactcttcaacccatctgccatctccacactttggccactccgaaacccttaaaaaccctagccccnaacctcctcagggaaatggattttaacaagggnnctcnccntgttcatgaccctatgactt

SEQ ID NO: 14428 - DNA, 151 bp, Homo sapiens
acagtaaattgaattcctgacggattcagtgaaatctgaaaggttatacaaccaataagtagaagatcccaaatcctgttttttaaatgaatatatctttgtccttcattatgctgtatgttattattgtatgttttgtaaaaattaaaat

SEQ ID NO: 14429 - DNA, 378 bp, Homo sapiens
cattagcctagtcagcggttctcaaagtgtggtcctgaaccaacaacgacggcagcttcaccaagagacttcttagaaatgcaaattcttgggcccatgccacacctacagaagcagacactctgggggtaggcccagcaatctgttttaacaagctctccaggtgattctgatacacagtaagttggaagaccactggcctagctgatgtccctttttattgttttagaaaccatccttccttacggcctcctatctgtagtgctactgacttcatttaccccaaacaaatatttacaaagtttctactatgtgctaggaactggggacaccaggggaacttacacgtctgctttgtgtttaagttctcatcacaat

SEQ ID NO: 14430 - DNA, 128 bp, Homo sapiens
  misc_feature (1)...(128): n = A,T,C or G
tctcctcctggttggatgcaagctcctgccaaggtgcggatctttattttgttttgctgaccatgtcccaaaaaccgagaacaatgccctagccccatattaagtgtccaangaatgtttgcttgaat

SEQ ID NO: 14431 - DNA, 552 bp, Homo sapiens
  misc_feature (1)...(552): n = A,T,C or G
aaaacnagcagantgcaaaggttagaaaaatttgttgaggcccatgtttgcagncaaactcccacacccagtaatatataaggtccattatatgnacttcctcttctgtctctttaaacagcaataaaagaatttgtccttatttaattgttttttaccttttcagcatgaacccacagggcatagagagtccattttccttctttttttccttctttctctctctctctttttctttctttcttccctttttctttctttctttcctttttctttctttccctctcttctttctttctctctctcctctcctcttttcttttccttctttttctccaagagacaagtttttgctccattgcccaggctgtagtacagtggtacagtcatagctcactgtagcctcttaactcctatgctcaagcaatcttcctgctccggcctcctgaagtggtaggattagggtgtaagccactgcacctagcctaattgtcacatctaaatgcagtaacttttccacaactttgtgaaggtagcaatttattttgaaat

SEQ ID NO: 14432 - DNA, 185 bp, Homo sapiens
tgtgatccatcaagatctgattgtcgccgaagaagtccgctgatgacacagccgttagtgacaggaatatcgagagtggacgaatgcttgagtattggataaaagctgtcaggattggtagctgcttggtttccttgtttttttgctgaggaaaaggaggaggaggcttaaaagctgttacaaat

SEQ ID NO: 14433 - DNA, 538 bp, Homo sapiens
  misc_feature (1)...(538): n = A,T,C or G
annggncaagccgtccctcctggagccatatngaagagagacntgaaccncatctccaaaaaggaagcagncaagtgtgcctttgacagcggtctccaagatcatatccccngaagcaagcatgntcttaaagaaggggagaagaatggccaatttcataagcggttcccctcagaccattggatggtaaagagggactctgccattttatgcaaatattctggttccctgggcctcagaaaggttggaagccgggtgggaaggttttccactctgaatggctttcgatgtaataatacttaatactcctttttgaaacagtttcctctttttctgaatattttcatgggactgtaacccatttgtatataaaattggttgaaagtgacatgttgaaaagtccgacaaacactacagtacactctgttttcaaggaatatagaattgggctctgtctgacaccttgagtgcgcttgtgaaaacagaatgtcacatctcaaagtgttattcttgatagttttaaaaaaaaaaataaaat

SEQ ID NO: 14434 - DNA, 286 bp, Homo sapiens
atacagcacatctcccctttggaggatgcaccaacacagtgccatcatggaaggagagatagggccccttatcagacaccaagactgctgggaccttgatcttggactctcagcctccagaacttctcagcagatgatcttatctcctgctacatctagaaaatggaagccatcagactccatcttctcaccactgaggctacaaaagatatctacacctgcaaccctttcccttttttttctttctttccccttttgttatgatgtataaagtgtcccttatcta

SEQ ID NO: 14435 - DNA, 549 bp, Homo sapiens
  misc_feature (1)...(549): n = A,T,C or G
tngnggnaattcncccnanccaaggantggccaanaaccaaactgcgggacccatctcagaaaagtngattganccaaagagataatgccccttgaatagcaaaaaaagttagtgaaggcccaattactatgaaaatatgaatccatgaaattcaatggcctgtgagcttggcagactctgcaacaaattcaaacatgttgacactggtgcaatcacatgcctcttttccagnatatgggccttcatcagaattcctgcccagaggtattcggattatatgtgcccaattacatcttctttgtgtgctcacatgatgaaacagtccaaaggctaaaggaactaaaactgaaccatcgatcaggcctattgtgaaaattggaaaactggtctttccctgcttgtaaatgctgccccaaatgtccccaaacaacctgttacaaagttttccttgggatttaactaagattcctggggatttaagatactgggctgtcagattgtaaaangcattaatgtttatagtgattatgattacgagaactaataat

SEQ ID NO: 14436 - DNA, 163 bp, Homo sapiens
  misc_feature (1)...(163): n = A,T,C or G
cttnanataatancgntgagnatnanntaaaaacananagnnaanntgnnaattaagtaaaaaagnngaaanangcnnncaattanccaaaccagccttnnatcaacgnggcanggtncggattcanntaaagcaagnntngnngaaaagggnaatngtngnt

SEQ ID NO: 14437 - DNA, 537 bp, Homo sapiens
  misc_feature (1)...(537): n = A,T,C or G
ttccagtccctaggcttggaaananagaatcttttgnaactagcaccaaagcttnagcaaaaagctgtgcagcactggtttncaatgccttaaaacntgnaagcaacttgtggttccaanagaaggggctgggcntnaaanaatctctcggtacatacatataaangaagaatgggggncactctctactgcatagacccatttccaagattacccgttaagtgaataatgcaaggtacagttttgaaaaacncattaactatagtcaccatagtgtgcaatagatcactaaaacttattccttctgtaccctttggccaacatctttctttccccatctaccacatcctcaccctctgatcaccaccactgctaaaagtagattttaaatgttctcaccacaaagaaatgttaagtatgtgaggggatgagtatgttaattgacctgatttaattattccacaatgtatgcacatatcataacatcccattgtaccccataaatatatgtacttatttgccgattgaaaatgtttt

SEQ ID NO: 14438 - DNA, 457 bp, Homo sapiens
  misc_feature (1)...(457): n = A,T,C or G
cncnatcanaaaaagaagagngtttnantacagggngtaaaatgaaaatataaagagctttatnanatanttgggagncccacaatanaanatagnntccntttttcatcccctaaganattttaaaaatnttttggnannaaaanacgacccaanatannaaaggtnnattttttgantagananaacantaancatatgttntntatanaaaaaattntataatatgtcntgnanaaagatngaannttantntntattaatatatanaaccnaacnagagntnnacanagatagagcatannaattancacanagntnggttgttannattantntaacgattatcgggaaaggngcntttaanaattatggaccccaagatgntaaaaatgancncncgananacaagnagcgtanttggtttcantttataccanncaccntancccancca

SEQ ID NO: 14439 - DNA, 542 bp, Homo sapiens
  misc_feature (1)...(542): n = A,T,C or G
tattaccncaaangatattgaaaggatttatgaaagttatcccgctgattccttaccaagatgaaagaaaagaaattaagccagaaaattctccagcagagctgaggcaagaagtgttcatatttaaaatcccatttgcttgcctagccccttggtgacctctgtgctgtgggtaacattcactgcctccaggaaagccgaggtcggtgggtgcagtgggtaggcgggaatgctggtgggtgagcacctctttccctcatcatctaccatccatcagaggcctgtctcccctgattcttatctgacactcatttgcactgcttggagagaaggtgcaaggaactaggagaagatgctcaaaaaaacacggatcaggaagatgactgcagcattggagaaaccaggcattgattttgtggacctctggggaagagctcttgggtgctcttacaaggatgacgagggctgtgttgatcttgggagatgccactaaggggttaggggtcaaaagaattaaattgcagaggcttaggtgtcaaaat

SEQ ID NO: 14440 - DNA, 447 bp, Homo sapiens
  misc_feature (1)...(447): n = A,T,C or G
ccaagaatccaagatgaaaagacaacataaatgggtacaacattctgganccgcaacagtgggacataaagcacatcaacagacctgaatgcaaagctgtagctcctgtcctatgttaanagaggcagtaccaggaggaaggaccaagtctccttctcattactcggtccccataactcaggatctaccaacggataaagccagacggattctggccacagaccccaactccagctcccagtttgaagacccccacagaggaacgggatcagcatgacaacccagcttcttcagctctctgtcccatgacttcagtctgcactcttcaacccatctgccatctccacactttggcccactccgaaacccttaaaaaccctagccccaaactcctcagggaaatggatttaaacaagggtcctctccttgtttcatgaccctatgact

SEQ ID NO: 14441 - DNA, 259 bp, Homo sapiens
agctctacacttaaaagaatccacgtaactacaaactccatcttaggatttccaccaccagctgagttgccattgccagaatagaaacagagtttcaccatgttggccaagatggtctcgatctcctgacctcgtgatccgcccacctcagcctcccaaagtgctgggatttacaggcacgaacccacttgcgcccgggcccaaaatgtaactcttgattgtccttctgtaccctatgctttgtcttttcaagttcaat

SEQ ID NO: 14442 - DNA, 545 bp, Homo sapiens
  misc_feature (1)...(545): n = A,T,C or G
aggctttcttttggcntatataataaaggaagaaggtattaggaaggccttgatncaagatccttccctttcaaaaacatctgcttggttgctcccctgactgcttggacttctgacatcacctggaggttgtaccaatcaggatgagctgaaagaagggcgggacagtgctgtagatttccttgcctctggctccagggatcctgtggatgaaacagatctttgggagttattttattttctatgccgatactcactcttcagaatatatcaagagaagccatctccacctcattgtagggtagatcaactctggaattttctcagactccttcattgccctaagaattgttctcttttctatttctcatgagactagagatgacccagctctcacatgcaaagaagtgccaaaaagacagatcaaatatacttggaaagattccaccatgcaaccatatgccctaggttaggttctgatttcccaaggcacctgcctgctccctcgaactatttctcggcattgatatttacagaaaaataat

SEQ ID NO: 14443 - DNA, 446 bp, Homo sapiens
  misc_feature (1)...(446): n = A,T,C or G
ttccttagnaancaacatctcttgccatggaacacatctggctgagcgagtacagagcagtgacattaaatgtaattgacataacggcatctctttgnaccacgccgaatgaactcccaaggtttccgggtctgtgttgcagcaaggctgacattcaagcttgncagtcatctggaacactgactcttctcctctcccccaggcatagaatggcttccagcgtttgagcaaatacaagtttcagatattttctctccaagacggagggctcaactgaaaacttttatctaatctggttctctgaatttccttttctctcntnccagcttctctcctttgcatcctantgccgtgaccatatttgtccctaaagatttacctcttccacctaaaattttggcccaagtatggaaaagacaaaatcctccttccttgtgccccttaat

SEQ ID NO: 14444 - DNA, 1395 bp, Homo sapiens
  misc_feature (1)...(1395): n = A,T,C or G
aatagtaaagagatggagtnaataaagagataatgtagtgagagaatgacaagtttttactgtagananagagagaaanagagagatagagaacattttttataggcatgtgtcagatgtgtgcagaggagagacatgtcgtaagagatggagcacnagacagctgtgagactgtgtgttacgatcgcagatcgcaganatcgatcgaatgtatatgaccttgtagacacatagcagcagagtaataacactactagcaaacaagcacacatcttcgagatagtgttctagaganatagtgcgctagggcacgagatccgcgcaagagccatgtcggtgcgacagcgctgagtacggtcgcgcagatacgcgcagcgtcgagagagaacagatgtgtgtcatacgaatgatatcaacataaacaagacgaggtgagagtcgtatgatacactcacgtcagtagacgtgccagcgccacgtcaccgcaactgtcaatcatgtctcggagcagctcggtctgcggtcctgcgtcgaggtggcgcgcgcgcggctcatcgcgcgcagcaaatgtacacctgagtagtatgtattagtgntgcacgacgaaacggtgagcactgtggtctacaccactaagactacgtgactacagatgtgctctcgagaacccttgaccgtgcgtgcggctgcggcgtctccgtcgctcataatcgatgtgcgcagagatcaagcacggcagcatcgcgtggagaactggccgcgtctatcacctctcaccccccgccgcctggccgtcgcgcgcattccgttccgcgtcgcactccaaatccggcaccgcaatcaatacctagtcagcgcgcgaatcacattgcgtaaatagatccgctccgtacggagcgagaaacacacatacgaaccgccatgaggcgagatgatcgccgacctaccctacagtacacccccaccaccccataatgacacactacaacccccttactcccgacgcacccaacatatccccatcccccggcccgcttcacatgttccccctacacccgagtcccgccacccgttacccggatgcgatccgcacgagattcgtataacccgccgagcagtgaccgccgattaatgccggtcggccgtctaagtgttgcgcagcgcgttggttcacaccggaaacccatacccgacccgtgtcccaacgcccacacccggcctaagcaccgcaactcgcataccggatatcaagagagaaccgcgcgccggattaagtcgcgcccgctaaattcgccgtccgccacataagttaggacgcgagtatcgaagcccatgtcccggcgatatcgacgcgcgcagccacacaacataacaatacgaccttacacacataat

SEQ ID NO: 14445 - DNA, 598 bp, Homo sapiens
  misc_feature (1)...(598): n = A,T,C or G
aaaaanaataaaaggccacnccccccnanagnttaaaagggttaacnaaaangnnggttccanggggtncnntngcaaattgnggaaaacttagaggannngcccntaagcttttggaattcccaattgaaaattttactgaaataaaccnttaaaagntcccaactaaattggttaancanaaacngaanggttnaaagccagacaggcccgtnagaaccaaaggcttntgcataaagggagngggtccantccnaaggcaccancagcaggcagcagagntctctggcctctggggaacgagcgagaagatagaaagactttcccctttatcctcagaggacttctcctcttttacaaagcaacctcctgctgttcccttctggggaatggagcaggggtcgcttcccttccngcaagacctttgttcagggactcaagtgggaggttgagcaataagcaagctttcttgcttagaggctccgcacacttcctgtggttgtttgttccaccctgcagttaggcaagcaagctcaccgcctgattcttatattgtcggactaagcagaagctattcttatgattcatgactatatta

SEQ ID NO: 14446 - DNA, 1685 bp, Homo sapiens
  misc_feature (1)...(1685): n = A,T,C or G
ggaggcacgcgaacactcccgcagatacctccaccaccacctataacccnaattatcgtcccacttatatattatcttcactagcgctgaatcatcaattatatcgcgagccacccttgcacagacgtagtnctatacatagcagaacgtnagagtcaacagcgacatgtgactctacctcgacctacagatggctgacaagtctattacacttcatgcgcgacacgacctagcgcgccagggcctacagagactctcgctaatctttgtactctatatacagcgtctctgcgagcccgcgattgtagngtcntgcaaccgacacatagatataattatgcccatacgcgcctctcttggctaaatagaagtaagagcagcgagcatagaatccaacctcgaacgctcgcacgagaagatatctcacacactacgnagctcgactaggcgcgattatactcaaatcacagtagaccacccacacgttgctagagtcgtcatnctatcataccagatagcgtcctcgnagccagacatcatgcaatgacagtaggtagtcggcaagagaagtacattgtgggacaacgtgttcggacaacgtctagtcgcgccagccagtaagccgcgcgatgatatatcagcagcgacgcatactacgcgatgcctactccatatcatgcatggctaccaacgcgagtcgagcgcggtgtgtaatccgcggcgagatccagccagtncagatatacgcacgacacacactatccggtgtcgcaggccgcgtagcgacgcactcatacntcactaccaacagacaagaacaacgcangtgtatatnatacgcacgcctggcgcgaaantcgactactatctancgctacgcacatntatantatagagtacgacgatcgagcntgatccaagtnanacgacgctcgcagcaagtgttcnatcacgacgtctcagtatgaanctagaagacgnatcgtagcgagcgagtacagagtagctaacacgtgactgtacgagccagntatatgatgcgacgcagagtcactantgtagcgatcntactatgcacancgcacncncacgtatcgcagacncagccagcgtcgacgcatcaccgctanacactgagcatcggacactacacacacagntagcananagacgagagatctagtatagngtacacatacgcgtcgcgagcgaggactcaganaagtgagnatgcgcgtgcgcgcatgtacagtacctcnacatactagttcncatacatatcacagctcgtacgacatacatctcatcactatccttccncgcccatagcatacgacaccatgagctcgantcactctagtagatattatacntgtcgagacgcncnagacngcntgtagctacctancntagctctcacacantcgcgacatatataccgctccagcgcaagttatgtgtgtatagtatagcaactatctctactactcactctactcgatcaatactaacgtactcgacatntacatatatcagatccgacacgcagnagtgagaccgcggacgacgcngctaaccacgttaagatcgagcgatatagcacgcacgacacancgatnacgcagtactacacgtcacagcctaacacacatgttgttagttcaacatcgaatacacacgacaac

SEQ ID NO: 14447 - DNA, 644 bp, Homo sapiens
  misc_feature (1)...(644): n = A,T,C or G
cnntaaganngannttaaganaaagganctaacncnttaatanangaatangggnttngggttanatagattancccctttngnaaaanagncnngcnaggtatntancaaggaanatngtaaatngcncccaggaagannnaagaatnatgagaactcngtgantngggntaaagatnanttaaaatatatggaaataagccatgaaagnaaancnangtncatacanggctnttgcntagttgcaacnataanaananggatcaaaatttaannnancccagtgnnnnttgattnaatacgancatctncngnnnaaacgattgtttttgaccnatntttaagtaaaaaaaagnaatgntcccaagaccaaggtnacncaaatnnntanttanttanggtaanatatgtnctatgtgngnaaagactaaaaaatnatgnganaatcaaaaaaattanaagcttatngnagtgttggtanacagtaaactgatntatcattcaaanaaaggaaaaanaaagactttatncanattgtttttanataagaattgcccagaaaatttttttcaaaatattttaattaaaaaaaaaagatttactcttttatttgtttgtcatactgcatagagtaaccagtcaat

SEQ ID NO: 14448 - DNA, 599 bp, Homo sapiens
  misc_feature (1)...(599): n = A,T,C or G
tttccaaggttttaaanttggtngaacccnaaattnccccancnatttncatccaggaaaaaaaancctttccggttgtaaagggggaccccgnggcccnaaaaaacanggaattttttgaaggaacaaagcncnccctcctnctngcccttntaaaagggactgcacccaatcaaaaattggggctcccctgcnttggggaatgacctgaagantccaagggggcctttgaaagccacttattcaccattgcttgggggnaaagaacagagtccccggaagtcttgtagcatttatggggtattgccctctgacaaaatctacacctgggagatttggctgtgattagatccccttcctgttgnagctaggatggggaaggtagggaggctgggttggatgcaagacatggagacagacagggaaaaccacttggcttaatgcttttgcatcaggaaatgcagattccctggtcttcttaggaagcctcatgttgaccctcgtaaccaaaacagaagttaagacctagaaatgaaaatgattgtgtttctgtggagattttaaaaaattaaataacgggtgaaagcaaaagataaaat

SEQ ID NO: 14449 - DNA, 1439 bp, Homo sapiens
  misc_feature (1)...(1439): n = A,T,C or G
tattacgagatcccgtaattattgcacccacaaatactaattaanaccgaccctcaattggaagcacgacaaggaaaaggcttacagaggagtaagaaaaggacgcaggaaaggagcgagacaagaacancngacaaaacaaaaacattttttacgcagacgaacggaggagaaggaagagcaagcagccagacacgcaggaacgagacaagagcgaacgcgacagttgnagcgnaggtacagtacactctgtatagtgtatgatgtatatgttacttgatctgttgttttattgatggcgctggtcgtcctgatgatgatatatgttatctttttnacatcgagagatgtattaagatcttgtgatagtgtagtatgcattcagtgtctcgcctcagtacttgacgagattggttttctttgttatcgtcagtcttatgtagtatgctctgcnattatgttgatcattacagcaatatatttaagagaagtgtntatgttaggtatctatatagtaatggcaagtctatgttatctagagtctaacgtatgttaggataattcattgctatagtgctgaattatatnttattacttcgtatgtcactatatgatgtatgtacggatgtattgatgtatctgttagagattattngtgtgatcggtatgagttaatgtgtgtctcgcatgaggccgcgctcgtagagttagttatctaattagatataattttgtttacgcacgaacggatatgcatataatttgttgacgggttagttgcggccgtgcgtatctttatgtatatctgcattcttntatattagtctctgtgtatatatacttaatagtatgtcagagtacatttactagatagttatatcttcgtanttcttcatagtcgctgaattacatatcaggtatagatgatcattatagtataattttcctcngctcagctactatatgntagttgtatattgtaagatgatcagtgaactactattatgtgacgnatctaatgtgttatgatttatctnagctaggtacaagtgtgctgtatagtaccgttataatgcatgcagatntcatatttatgntntttgtntatacgtcttncatcgaacacanatctgactttgacagataatatattctactatattaactaccgagcgtntatatcttgatgctacatatntgatatcatcggagaatagactcgcgctagttgtgtacgttntatcgagtgatatcacaattgtgtcatctattatattattcacttattcacattgactatcctatcctattatggatctgatcaccgctctatatgttaagttgtgtatagtatattgatcgcgatcgttatttgatatcctatcgtcangatatatcgcacgcatatatttgtagtatatcgtcagcatgttacgacg

SEQ ID NO: 14450 - DNA, 537 bp, Homo sapiens
  misc_feature (1)...(537): n = A,T,C or G
acncagagngantatttattncccccncnannttntnattaatncggaatntanatnaataaantntagnacggnccncataantatgtaaattnagcttaatatttccngangtannncttaactataanannggntaannaanattttagngnntntaaananggagagancccncccantcnaaagtgagtggtatatggtatcgagagttaatatncggnanctgtaggtataacaanatanagtgcgnccnattttatnanggggatncntgtantnactacgaggataaaaagatgtatggnttgatnctnnnantatacaaanananattnatnggnancacnaaanaggntgcagcgtagannctaaaaacnncannaggtaganttcctcntataaatanacccnncnaanttncaagttatgaatnanantncnnnnntnntggtaaatntnncagccgaaacngnaagagattaccantntggccnnagntnnnngcnaatgaatncnnactanaccaatannnna

SEQ ID NO: 14451 - DNA, 656 bp, Homo sapiens
  misc_feature (1)...(656): n = A,T,C or G
aaaatntaaaaggcccnnnnantttcccccntaaagggggttcncaaagccaggngaggttttntcccaaaacaattccctnggggggtnttttttaacttcaaagcggcnaaagnacccttgggggncctttttttttttttnnacnaccctttgggnaaaagccttgggncttgggggcacaaaggggaaaaaaaattgaagggnaagcccntcccttgaanggttttttnannaccgggnaagccnattcaagaaaaggggaacaatgtgggtgagcnttctgttctttaaaagaacacaggctttgaaaaagactttcanagaggattcatgctgcccctgcccttagaaagcccctcttcagctcntttgccaagaggccatctctccttaatctccgttttattgtggtaaagtgtacataaccgaaatctaccatcatacccattttaaggtgtacaattcagcagcatttaggacattcacaacattgggcaaccatcaccattatctagtcccagaacatttttgttaccaaaagagaagaccccatacccattagcagtcacttcctatatcttagcccctaatcccctggcaactctctctgtggctttgtctgttctggatatttcttataaatggaatcaaat

SEQ ID NO: 14452 - DNA, 1353 bp, Homo sapiens
  misc_feature (1)...(1353): n = A,T,C or G
gaggctggagagctcctgcatatatatacgtcccctaatttnctcccccattattctaccaccatattaatttacaacaatcgcgcctcctcctctcactataaactcacacgccgcctaactatgtctactctatctctttctgactacgagaagagcccggcagcgtccgcgcactcctacacagacagatcgccaccattagcgaatggccgtgaagtgatgtacgacgcgaatctgtcgtcgcgcgcctcttatagatcgtcttgatattcatcgtaaggatgtagtggtgtccgtgctctgtcacgaatatctaagtgcggtcgacagtccattatgatttattatgtcgcgccgatggcgcgctctatactgtcatgagacatatcaatatcaccataccatactcacccgcacacaaccactcccgccgtacatcattattcatacagtccacgcaccgtcatcaccggcgtgacgtgtctgttcttcccgtgtgtagaatgatatgactccatattaagaaccttattgtcatccgccttgttcacgatcatcttctaaaacaattacctgcatctccaatgacacaacaacaaacgagagagtcgagctatatatgctatcgacattcttcagtatgcgtcttgtgncatggaagatcatggttgtcatcaaaagatcccgcagtaccgcactacgggcgcgctctatgcttgctatgctgcacgttgccccgcagttctataccgtcaagtctaatgatttattgcgccgggcaacggcgtattgaccacacttggatcgtacgtctantcagatggctacattgcgcatcacgacatgtaacggtcagaggtcagctggtaactagatagagtatacaatatgccactccatacgcgttccgcgcctcttctcccctctgccactcccattctgagtagtagtagtatcagatagcgtcatgtgaagcgacgaacancgggcgcgcgactggtcgcggaccnactacatactcactcctgtacgcgtccganctattatagcatctatacatccggatctagcgcactcgcagcgcgacgtcccgatgttgccacgtgctgctccccgccccacngcgtctcctcgaacagacggccagtatctgctcgctcgttagataatatgttcacantcgatctatctgccgcgtctcgttacgaggcgtctccacctatgcgtcaccacgtatacgatactccgcgaccgaatgcactagaataggcatatccgcgcgtcgcagattttcctccatgttcccattctgctcaccatgtttattcctaagtgagagactccgtgacg

SEQ ID NO: 14453 - DNA, 774 bp, Homo sapiens
  misc_feature (1)...(774): n = A,T,C or G
cnnnanaaaaaaagcggggaaaaaanannggnncnccncccnaataantatgngcgcacaaaanacnnngccnttttttttttcaccaggggtgtgtgttttgggccccncaaatatnnacatntnaaaagccnccannncctgngngaaaaaaaaaaagggggggantntnttttgctcanacanaagggncgagntttataaagtnggggggnaaaaccncgnnacgaggggttttttttaccccnaagnttccganngacggttntgttanaaaacacggccgggcccncagttgaaattttgnttaaatatagaanccncncnatttntaggggcgaaatatttggggtaccncggggccnccccccntttanagggnttcgagacgggntantcgaanaaggnttacaataanggccnaanaagaggccncttatccncaagtttaaanttacntaaacgccagtcnaaggtgnntttattnacaanaacnagtcntcggnaactttaangctancaggttgnctcttnttaantnacccacccgctacaggtttaccataacaccaacccacnccaacgttagaacccggaacatagatggccagcatnagaaagtacgggctaaaccttgctttaggccaggcatggcggctcacacctgaatcccaagcaattttgggagnccgaggcaggaggattgctggagcccaggagtttgagaccagcctgggcaagatggtgagacccccatctttcgaaaaaataaat

SEQ ID NO: 14454 - DNA, 601 bp, Homo sapiens
  misc_feature (1)...(601): n = A,T,C or G
aattnnnttttatttntttcccggggaaanntanaancaaattccggggtggtnaagaannnttngtttccccccttggnacttttcctttnantntggggttccnnccctttncccaaaagaagccttttggtaaggcccaaggaataaaagggaagnccagtnaggtnaaagagntccggcccatccntttcantaacatttggattntnatgttctccagtaatttgaaaagatggnccttggaattcgctgggtgtcnaaaatcaaactccttctgaaaaaagaagccnccgtttttcagagaagtgaagaccnccacaccaaaaaacagacatcttccagtgtttcacagttttgtggccaacacagggtggcccaacacaagcagtcctgtaaacatggcccctcgaatttacctcaaattcggatcccagccgagcaggtgcttcatgtcatgaggaggcactcctccatcattttgggatttcgtcctgggacatagagtatgagcaggaatagggtcagatggggtggtgatacactctggtgaggcatggatggggtcccacaatttcacctgcaaaaaataaaataaaat

SEQ ID NO: 14455 - DNA, 698 bp, Homo sapiens
  misc_feature (1)...(698): n = A,T,C or G
cntaannnaagnaaaaanaaanagtngaananatanatnatatnttattntagtnaatngatgangntanagcattngnaanaggtanacannannttatttatngggnngaannngganntaagagtantnttgaagtgaatgaaaaagnacngtanctngnntaagntntaaanttatannnaanacgnngnnnnntgtcannnnattgtagtnnantttagcggtaatatnannaacncntcattantngatatantgaattnnangnacaagnannataaaanngaagatnatagaattanatananntctaantnatgcnaananatnntcngagnnnaatattananatnatnaaacactnntnntatntanacnnaggtanatntagaannaganngcnnaaananagannaattaaganttangtanntaatatnagtaaantaaattaattatgatnctggaaagcnagaagantnngangnaanantnagagagntnnnnaggntgnaantanaangtagccctnggncaanaaanntannagganaaanaaatgacgcngaacngncatnttatggggacacaccnccatcncggantactaggggtgaggcttttgtacccaaaaaaattgtatccgtgnctgaggatacaatttatatcccacctccaccctttatatgaangga

SEQ ID NO: 14456 - DNA, 648 bp, Homo sapiens
  misc_feature (1)...(648): n = A,T,C or G
ccncgnnatntattgtacncgcgngtttttnnattngaaagtgagcaanactcagcgcttaaagagngngaaaatatnttattccacnaaaagtanccgnantataaatntgtggagganacnnncncngngnangnttnnnnacccatgttnaangagnagggttggntanataangttngnncccaagattgaaattngttnagcgcgtactncaactntntaggggcgganttnggnttantaagaccccccnnancaaangnggaaagggttacnataaagacattatagctaaanaganctataaccnnttnnattcnagcgcngtcngtgnttnnnannntanagtntnnaattaaacacagtgctntnntnttttannaccnctgcantgnnctgtnagnaanaaccntnnntggacntgatgnggattcttcaanggagnatcganaatcatgagnccatctttctcancantctatcncaggggcaaagaatccantcacctcntgnngtcattnntagaancattgattcntcaagggacccacatcacaccaaagaagagtcatcatgcnaaaatncaactcgggcaattntgcnagctgcaccatatctccctcttgcacgatcactagttncaat

SEQ ID NO: 14457 - DNA, 1143 bp, Homo sapiens
  misc_feature (1)...(1143): n = A,T,C or G
ccaaaaagacagnagacntagggagaganagggcgggggccgcacaggccgggggggcggcgaaaacaaatgaaaaacttaaaaagaaaaaaaaagaaaaaaaaactaaaaaccggcgcggaaccacggacgccccaccagggcgggccaccgccgcaccctgtcgccacgcaaacaagggaaaacaggaggggtcncccaacaagccaagcaggtgggcgagcagcaggagagaacaagaacgcggaggggagatggccgacccgacgcgaagaaggacacaaacccaaacagagaaggagaagcgagcccgcacgaacgcagagacgcgccgcgagggcaagcaggcacccaccccccagaacagtcccggcgggaccacgaggagagacaagccaggggcaggacggaggcagagagaagaaggagaacggccgagcacgcaaagagagggccggggggcgcggagcacggcggtagagacccggggaggaggggggagaggggaggacgggcacgcggcagcgagggcggagcgcagggaggcggggagcgcccgcgccgccaacgcagcgccccgagacgcagacccaccacgcgccgcgcagcagcacggaaggcgaagacgaggcgggccggtgccgcgggcggccgggcgcaggcagcagagcacgcagcggaggnagccgcgcgcgggcgcgagatgagagcgnagagccagcgagccgcgggtgagagccaggggcacgaccgcgcgagcgcgagagagaggagcacagagagaggggagccgcggaggggagagaggagaggggcgagcggggaagggccagagggagcggacacagacagacacgcgcgagggaggtgggctaatgagggaaggagagcgagagggcgcgacgagagagagcgccaacggcagtaacggcaggagggcaaagcaaacgagacgaggagaacaggcacagcaggaggcggcaccacaaggacgacgacgactagancggaccgcgatgccggacggctgcacgaggagagcgggcagagacggggacaagagaagcgagagggagacggagcggtgagaagagagaacggggaagagcggagcacgaggagggatgtgagagaaggagaacg

SEQ ID NO: 14458 - DNA, 628 bp, Homo sapiens
  misc_feature (1)...(628): n = A,T,C or G
taatttnaaaagacaggnangntttttntaacaacaacangttttngaacttaaaacgntncagggnncttnttantaaantttnttttcttncgantngcttaaannnggnnaagaantangcnccttnttattaangggtttnagnntgagnnnaaaaaggaattgggaatacgggnttcctngggnattnagactatggaatacccntttttcnaaagagnggtcnnccccaaaaaatntnaaaatnatttnctttntcataaaaanagcggnttaaanttatnaaggaatgaaaagttnatgaanaaggaagggntacaaaaaagntggaggccaagaggaagaaanaagagggatganaaatnaaaaanctggaagaggacttgaaaaggatctggacttcagcagagcacagccccttcaaaaaatccagcttggaggcaganaaatanatngatggagaaagaaggaattaatntcctcttcatggatgttcnagtnttcagtagctcaaacanactggttttgctaaagttcancanacaacanttgtatcaaatgtatatatgactttactcttacattttacatatanntttgacagcatttgttcatgttaaaaaat

SEQ ID NO: 14459 - DNA, 241 bp, Homo sapiens
  misc_feature (1)...(241): n = A,T,C or G
annttanggntnttntannanaaacaatttatnaaanttaaaantancaggggaatttttttaatttnaanccncnngatataaagntancntagatntcnccngnnnngggtaaataaatttaggaataagggganggntancccntttnggcaanaagnngttnanaattaanaccnnntaaaacncaccgnttcaacggggntantngnntttattcannnnatnaatncataccana

SEQ ID NO: 14460 - DNA, 111 bp, Homo sapiens
acggaacaagaaaaccggggcggcggcagaccagaagagcgcgaccccaccacccacaccgacccacctacaacacaatacggttggggggaagaaagaaaaaaaaaaaaa

SEQ ID NO: 14461 - DNA, 537 bp, Homo sapiens
  misc_feature (1)...(537): n = A,T,C or G
gaattccgagcctgaatcccaaaccaagttgtttttttttttttttgaanaaaaangagattggttancccaagctcgaagacatgagcnttggcanggangtgngttgctccccttccccttcaataagatggaggtttcttgggcctactcagtatgatccaaacnagctgcagactgtnagttgaataanctcttttntttaataattacccagtctcaggagcttttatagcaatatgagaatggactactacatttctcaatacattctactgcaatttgttgaatcctatgggactttgaacacaaattccttcacacaacttagtcaacaaaagttgataatatggaaaagtttcatccgacctgtcaaaactacactagttagatccatcataaacacaaaccttgttctggctcatcccttgttcccctttttgatgagaatgttgtttaattttcatataattgtgaatttgccaaattttcttctaaataatgtgtattgtgttactgtttattattgtattcaat

SEQ ID NO: 14462 - DNA, 1084 bp, Homo sapiens
  misc_feature (1)...(1084): n = A,T,C or G
cgcgcgcccggcgcccgcccccccccccgcgggaggaaaaagaacggggaaagagaaagaaatttaaaaaaaaaacaaaaaaaaaaagttaaaaaggacaacacccgaaggaagggcaggcaggagccccaaaaaacttaagggcgggggggggccccccgcgcgcccccgcggccacggcggcgcgcggcaccgccgccagccgcggccgcggagcaccgcgggcgagcggcgacgcgcggcgccccggcacagcggcgagcaccacgcgcgagcccggcgcccggaggcgggagcgggaggcgggcggcgaagcccgacgcgcggagagacgaagggggcggggagcgggcgggcggggcgagaggagcgcgccgcgcgcgcgaggacggaccgcgacgcgcgcgccgcgggcaggaaacagaagcgangagaagggcacgcgcgggagaaacggcangcgggggggggcggaggcggcgaggggaggcggcgaccgcggccgcacgcggccgccgaagcggcccgcaggcgacgcagcgacgccgagcgcccagacccacgcgggcgggcgggcagcggccgcgcgcggccccgcgcaggtccggcgggcgcgcgccgcgcccggcggcggccggcgccgcgccgccgcaccgcaccgccgcgcgcgccgcgccgcggaccggcgccgacgcgcgcaggagcgcggtagtgtgcggcccaggagggggcggagaccagcgagcggagcgcgagagccgcggcggcgcagaagcgcgcacgcgccgaggcgcggnacccgggcccgcggcggagccgcgcagacgggagcggacggcgcggccgcgggcgggggcgcgggcggacacgcgccgcngaagccgacgcaccgcaggaggcccgaggggagacagcagaacagccgcgcgcgcacgcgcactcagcgccacgcgcacaggagcagacatgcccgccgcgccgcgcacgcgcagcacgcggacgcgcgcgcggcacgcggacagtcacgcggaccgaagacaggggaccaggggcggccgccagcgtggagggagcacacgcgncg

SEQ ID NO: 14463 - DNA, 352 bp, Homo sapiens
  misc_feature (1)...(352): n = A,T,C or G
cccancccccgaaaagggccccggaggccaaagggaaatttccaantnaaaccaaggaaaaagnggaaaaaaagccnccccnaaaaaccngcaaaaannngggcctttttnccnggggggggggtttggncccccaattnccatttaaaantcccaagcttggncaaaaaanggggggaatttntttntttcccaaagggcccgattttnaaagtttgggggntaaacccccccaagggtttttttncccnaagttccanggagggttntgtaaaaccngncgggcccaagttaantttggntaaanancgannttnatttaaaagggccnaaaatttggggacccgggccc

SEQ ID NO: 14464 - DNA, 2320 bp, Homo sapiens
  misc_feature (1)...(2320): n = A,T,C or G
ccgagccccccagcnnagggccacncannatatntcnacacnatactanctnccactataatagagtagtacagacggagntaggaatagagttnttcatgtgnggtgacgtgatgatacgtaatagnnanagtgacataatatttacatacgtggtggtgtgtactacttatatccatcccgcatatatcagtttcttctatacaacgagagcaagaataacacangtacncatgcgcgcatcgngtgctagcgcggagcnctggtgnactttcatccgccgcgcgcgacatgtctgcttggcgtcgcaagagacacacgttgaagcggtacnagctacggcagagtagtgatacgaggnacntcncntacctcggtctcgaatnanatcagcagatntagcactcttccgactacacgcacactagcggtagatctggcagcngagcgactcgagcagtagtcggcacgacaggacacacgcacatnacatagagacgtacatgagacaggagatntagacactacttncacatacacaatatatgatgagagtatnatgctacatcangcagaatgnagnacctgtgtngtgctatatatatacttnactcagaagctcagtattcactacgcaggatgatacagatatngantaggtgtnacagtggcgctccagactgtcgcgcgctgnatacancacgcntgtntgcactncgatagtcttctgtgttntgttactagcgngtntctctcgtgcagcatgcgagtgcgcgctctcggntatacagatatcatgaatcagtgcctgtcgcacgcagacagcgcgcgtantgagttgtggagntacgagcgagtcangtagcgacgcactgatcnganagagagagatactatgnangagacagngaggaggnnnagcgncgagcgcgacggtcancgagnggntgagtgagggaagacgcantcacgcngagctagatgtagcgatgtgatagangacgnacgacacgcgatgagcangtgagccagacatantanacagctacgcactaagacgctacaatangctcatgcagtacatcacacnanacactantatctantagatatcncacacnacnantgtcngctcgtatacagcagcgantcgtcncgtctgaagcacgcngtcgcngcgtcgatcncnagcacgccgacgtgctcgctcgncgctccagcncgcgcgtagcgctcacgtcgccacatgctcggnngtggcgnacngattagtcgcgaacatcgtagtcactactacancatctagtgatatcagagtggntacgctactacnagcagcacgactctatctgacacgtacngntgtagccngtcgggtgaggtatganaggcngtagntgcggntcgctgcgatgacgatgctgcgacgtcactgcnagcgncnngatcgantgntcgtnngatgagagcgtcgcgtagtcgagctncgtcgcgtacngcgnancancacgacggctacgatcntcgcacntgcgacgtcantgatgnatcagncgtangnatactgatatatgctcgncagcacgtcgctgcgngtcgtgctcacgtntagtcactctactgtgaggcntgcggtcgcaactgcagtcgtcgccgatcatcncgnctnagatcnacgtcgcagcanctgntantaaagntttcatnactantaganctcnagtctnantcaccaggaagtagacngcancngcggatcganacgancgntgctgntgacgagtcgnangacagtatatagctgnacgtaagatcacgatgcntacctgacnatntgtcacgtgtcatcttcantcacagtccnagnacagnctaatacgtcnacgcancagtggtnggtagnacgtggttgnagnnncnnnntganttanngaatgacttnncagatcatctcaacgtcntagtgctacggctacnnactgatatcgactcgatnatcngctgactcatncccnatcangtcatactnatagcagncanncgncanngtgacgangcagcctncgangtcacaacgtaantgcgtcggtangtaccagacngacgactnctantgatactgnacntactgatacagtcgtaatgtcagcgacncagtccatgaagctantacgtagtcacgctgatcagantgtacgatcgtntgcnnatancntggctgcantantanntacgcanntngntagtaactangtcgatnangtaggtggcatgnancgatgnacgataatcgatcgcaagccgatgtagnanncantag

SEQ ID NO: 14465 - DNA, 345 bp, Homo sapiens
  misc_feature (1)...(345): n = A,T,C or G
aaagtttcgttttttcactcagntggaatgaagtggtgcattctgggctcactgcaacctccccactgccccgggttcaagcgattctcctgcctcggcctcctgagtagctgggattacaaatgcccaccaccatgcttgtttaacttttgtatttttagtagagatggggttttgccatgttgtccaggctggtctcgaactcctgacctcaggtgatccacctgccttggcctcccaaagtgctaggattacaggcatgagccactacgcctggcccctaattatgttttgttctacaattagaagtctttcatgtaaatgatttatgtataaatatccaat

SEQ ID NO: 14466 - DNA, 515 bp, Homo sapiens
  misc_feature (1)...(515): n = A,T,C or G
gcttacaaagggcgnaaccaggtgacgggatgaaacataagagcggaccaggagcngtaacngtngcactnacgcttccgntagaccccagtntgctngangacgggtgtctttcccagatgctggcatcaccggtagnccaaggagccctctggtggccctgtccgggcatgacagaaggctcacgcacttgccttgtagtcacttgtcactcaccatgtcccttcagctcctatctctctcgtgccctccgtctcttgcctcggcacctggctggcttgccgcccacagtgggggagagagataagaaagctcatgctgctctacaagagaatccaggctatgagaagaagcccaagaaagaagttcgaaagaagaggcaaaaccgtcccaaaatggcctttgctcagaagaaagttcgggtagctcaaagaaggcaagcttccttggagctcaggagctgctgagagctcaaccgaacaattacctatgaggatttttcagatcaagacaat

SEQ ID NO: 14467 - DNA, 626 bp, Homo sapiens
  misc_feature (1)...(626): n = A,T,C or G
aggggggtttttttggaccccacccagttnttgaaactttaaaggcttnccaggtgacttcttcttaaaattaacccncccggntaacaggngagntacttngttaaacgggattntgcttcccttnaaganaagggcctantctnggtcagttagccagtcgaagaaagaangtttggtaaatgactaccaaccatncaaaaggcggaatttgaaancaggagaagaaagagaagnctatcnccaaatcccttaaattgtaggcttgatttttccagtgcctgttatgaagctggacntgctttccctttcattacctgggtggaataaggaaatgcaagaaagttttgaggctatttatagaagtaagtgctcaataataataacaataataataataataatgagaagaagaagaagaagaagaaagaaattgaagagaaaggaaaatgaggagtggtttaaaaattgatacctttgcacttgttctaagtaaacttggatgttacagtaaaattcaagttcaagaaacacatttggagcctgtaaccaatgcaaggtatggctcctactcctgtcctgcagaaccttacagttctacatgaaggcgaggtggtactgggaat

SEQ ID NO: 14468 - DNA, 173 bp, Homo sapiens
  misc_feature (1)...(173): n = A,T,C or G
agngngggaatttanccgacttttaaaggaagaatnnagatncggttagngagnagtnggaagcgacntaaggcnnagangaggtcagttgaagcgagaaaagnggaaagnagcgcccaaananggcaaanncggcgttttgancggcncantnggcnggnttcattnaagna

SEQ ID NO: 14469 - DNA, 140 bp, Homo sapiens
  misc_feature (1)...(140): n = A,T,C or G
aggggnggggggggagaggggnngaggangggntgnnttgtagtggnaaanngngtnttnggggaacgnccaggggttttngnnagnncagganngtggtaaancntcgggncagnnaaanttgtnnatagantcganta

SEQ ID NO: 14470 - DNA, 641 bp, Homo sapiens
  misc_feature (1)...(641): n = A,T,C or G
annttttnttggagcccnaancaagtttttggaaacntttaaaggttngcannngactttttctntaaatttaacccccaccggtttaacaggtgnatttnccntnnttccnnggttggtccctngttcttttttaaaaagccagttnntgaaaatgaaattctggcccccnannagcttgtggcccanaggaaaatggaagaccagatcattcaagaaggaacaccccaccggcaaagccttgtgtagattcgcaatgagccctcnttgatgtgagcacaagggacctccatgctcctacttctgctggtctccatttcaccaggcgcctccctccgacttccaattggccacaagcttcgtcgctctccctcaaagcaattttgtgtgtgagtatagtcagaaggaattggtacacccttaggggttcagagagcaccaaggcttcagagctgcactttctagggcaagacaaaaatgtgtatcacagaaaaataacgatttatcattgtaacagttacatcccactacggaaaccaccagagactgcttaacatttttatttcaaacacggttttccctagttttcaggtgacaaacggagacagatgccagaaggtgtttttccatttgttcctaat

SEQ ID NO: 14471 - DNA, 323 bp, Homo sapiens
cataatgcttgtttgtatccacatggctgtgctcctgagggccgtcctgaacagtgagctgatggatgagaacactttgggggtgacttccgggtgacagctctgcgactgcgcttcaagatcaccctgcttctactcccagaggcatacccctagttcgcagggaatttccatttcatcacagacctgggaagcagagagaagcttgttgccatccttcccccacaccttactactgctttgaaccagtgtgctgcattgaaagagataagtagaaatagttgaaccaaaaattacatgatcccatagtttgtgcttaaaat

SEQ ID NO: 14472 - DNA, 469 bp, Homo sapiens
  misc_feature (1)...(469): n = A,T,C or G
ananntntgtatntgtanngnnnannnnnagannaganagatngagaggagaagnntgaanagnnangnananagagngaganttnagantntggannanngagagacnncaanannnnagggatnacagagatantnantntttannnnanaggagttatngnanntgangngggnanaanntttngaatnnnnnnnggtttttnnagagatgngagntttaagngncatatgtgnagagagannannaatnnagagnnaganaaggatnntgtnagaaaatntatnnagntancaanngtntagntantgnnagagatnnaanccgncnggnnnananagttggnnntagatnnnnnnnagnaggngnnngnanaannagcnataaaggnaaggngnntanaccnanntganncncangaggtgnnanngaatgcgggngnganggagnggngacagggttnngnng

SEQ ID NO: 14473 - DNA, 539 bp, Homo sapiens
  misc_feature (1)...(539): n = A,T,C or G
ttttgggancggccccctnaggngngnatgatagtcaaggccnaagncagtcnctanagttatgcgnagttatcncagtaattgtacgcagcaggctctacacacagttngacttaagtcaaggctctttaattaccaccgtacaggtccatcttcttactcaagnagcagatctatncaactncaaatacctggaatacgaagaaagatttacttagtgtgggccagagatatgtgctggtgcctgggaancagagaagaagatgcattggaagatgtttgtcatcagagcaagatatctaacttttgctggattatctagtaacttatctcatgaagaccctgcaaggtggggttgtttcaaacctaagtccctggagcaatgtaaaaatactagttacaaagttccagtacctgatatggcctaggagctacaggcctttgatggtcttcagcaaagcttcttttaccaggatggcactgttggaaaatacccaattttcatcttctgatatcttacaacacaataggcattaaat

SEQ ID NO: 14474 - DNA, 379 bp, Homo sapiens
  misc_feature (1)...(379): n = A,T,C or G
atctgctgtctgcntgaaggcagggatggggctacaatcaatgggttccaaatactctgtgcttctggctgggtttggcaaagtgggaggccgtgcagagaaacagaaggaagttgacagtgacctcagcatattcactcaactgacacctctctaacagattacctcaggctgactgcatcccccagttgaagatgacatcttctctcaaggcagcctcctctatgtgactctccttccaggttctggtagctgcttccttccccaaagctccagacccagggatgacagcagctctgctgatatttgccctgggataatgcaccatctcttatgcctcctgtatgtccacagctccacaaggagtcactctgtaaat

SEQ ID NO: 14475 - DNA, 611 bp, Homo sapiens
  misc_feature (1)...(611): n = A,T,C or G
angccgaantgnctntatttggaaagngctgtntnttttatgttaataaggcnggggnataaannccccatacttggaacntagancactcaatgntgcctgtaactgagtccaacttattgtcactcaaccctgcattgccctgtnaggagaanggagaganaaccagnccnnaggcatgggcatgggctcaaatcnggcttctcctgtggccactgtaaaagttgatcancctataggtcactgttgtcanagccaagcanagttatgagaccacaggaaaaaagcacttggaccacgtaacattgctccaagagtataactgtctccaaccctggctgctggaacaagtgttgcaacctgaaaccggtttgatctaatagctacagaaacaacctgcggaaatctaagactagtttcacccactcaccaatcagagcttgccggatccccaaaacgttgctagtgctaatgaacttgctttcctaacaatccanaacatttcncatttttatgaaacctacaaccttctctttgctctttggacatactgaagaccacccagtctgtgtgtatgccccnaactntaaatcttgctccgcanatnanac

SEQ ID NO: 14476 - DNA, 612 bp, Homo sapiens
  misc_feature (1)...(612): n = A,T,C or G
gatgagaagcgagaaggagagaagagctgcggcccttcggggagcccagaccttgttgctctctgagccatggctgtgacaccctctttggagctctgtggttcctggtgtctccaagcttccaggctccaccatcacattccctggtgcctggaagctgcttgtggtactcctggtccatctacaacctcacagggaacgagcgcctatgcgggcacctgaactgcctgccctgccacagcgtgcctggttatgtgcaagtggcgggaccccaggctcactcactcacacagccgtcactgctccacgcctttctcgcccttggcaggcgtggaatccaaaccggtagcgtaagccaagcgcaacctgccangccaactgtgtgcaatganccccnntggggcctcancaaaaacttgngcaaaggtgccaccanccccnaattttttgggcaaaaaatgacnctccanggttctttganatttccacctaacaagctgggaaggggggctataactgntcaaaaagnttaaatttttattaataanncnatccgccttnctttatgagggtaatataaactccncttnctcttggcctggntgtgggggg

SEQ ID NO: 14477 - DNA, 611 bp, Homo sapiens
  misc_feature (1)...(611): n = A,T,C or G
ccnccgctacagggagaaaaggcaaatgaggagaggctcctttaggaaanagtcttagcagaaattggcatctactaaagccagactgatccctgctcccatagaggggccttcatcctcgagaatcttccatcancagcaagaatgttgaggatgggctgctccaagaacctgcccccttacagctgctactgggggctctgtataaatttcttttctaaacaagcagaaaacttaaagggcagatgatgatgatgatgatgatgatgatgatgatgatgatgatgatggtgatgatgatgatgatatggcgacaaagttgccaggaaacctcacatccttgataaaacnccaagtggcttccagtatttccagtatttcctttcagtgactctgctacacagatggacggggcaagtggaatgtccctttatttgttcagggcagggttggcaaactttttctgcaaagtgccagacagcaaatatcttaggctttgcggcccncacaatctctgtcataactactcgactcagccattgtaactcgaaagcagccacaggcagtcagtatatgtcttgtatcatggctgtgctccaataaaaacgatc

SEQ ID NO: 14478 - DNA, 894 bp, Homo sapiens
  misc_feature (1)...(894): n = A,T,C or G
tggaannccnttnggaannncccccnnnntttncnnnnnnnttggaaaacaancngnanagaccctctnaatttcngggagnaccaacccnaccctcncgccngggcaanaaccacnncncgaaacnccncaccaangagccccagngccgnaaccaaaacaccagacccacgcacaccgcctccanacaagaaanactaanccaaccagacacaagggccnagacgcanananggcccgccnactaanaccgcntccatccagacaatnaatccnctgcccgaaagctacanaccaccnaaacngccgcatnacccaggacccccgnnaccganggagcatgcgaanngccacaccaacngganacacaagcagcacacgaccaaganccacatccaagacnggncctcatgcaaacggccctccctgggcnccgcacactnngccccctccatgccaanccaaccntgcggancaaaaccctnnccagcgcncnctgggngcctcagcaacccgngtcagnncccnaaacncacccanccctcngnaaacgggcccagnanannnnnnnngacacngccggaccccaccnggggcanngaangcanaaangaaaaagggccccncaaaccncaannccacacaacanaccacgcncncctgcnncaanacaaanaaaccccaagncgccgcnnccccnnangnaaggnaaaaacacgaaccnngcncacngannccnncncncggncnncggngcnccnaccngancaacnacccaaagcngnanccgnaancccnaaaccnggaaaaccnngaaaacanngacaaangcncaaagccnaaacaaaaaacccnnnnggnnnncaanccccccccaaaaaaaaaaaanaccna

SEQ ID NO: 14479 - DNA, 623 bp, Homo sapiens
  misc_feature (1)...(623): n = A,T,C or G
tagtcactcaacctgnaagtaaagtctagcatggtttaaaatgcaaagatttccttggaatacaactattgttggaagaaaccttcactaaaggcctgggacttagcttncagatatagagaaaancaaagtcagattctcaagttacttgcattctcatgtatcctgctttcnacttggataattattatggactgaattttgttcccctaaaatttgtagtctgaagccctaaccttcaatgtgactgtattggtagataaggcctttaaanaagtgattatggttaaatgagattgtaaaagtgaggccctaatctaataggactggtatccttctaagaacaggagaagacaccagagatctatctctctccatgcacagaggaaaggccatatgaggacacagcaagaagacgccatctgtaagccncggagaggggcctgagaagaaaccagccctgctggtaccctgatcttggactttcagcctccagaactgcaagaaaatttcgttaagccacccagtttgtggtattttgttatggcagcctgtgcagactgagacaatcatgaagtgttaatttaatcagtaagaataaacccagatcgngcgttgantac

SEQ ID NO: 14480 - DNA, 636 bp, Homo sapiens
  misc_feature (1)...(636): n = A,T,C or G
ctgcaaagctcttgcaaagcaaaaaggcccatggaagatgggacatgcttatgtgaacaagacctcatgtcaactccattcctcccccagatgggaccttctggttgcaaaaaaacaagctcagggccctcactgattctacattctgttgctgnctcatggaccgagagttttcgctntgtctcaaanacaatttcngccctttnttnattccgaagnacanaaccnaanggcntactttttcttaattggggaaaccctcgtctattngcccaaaaagttaatcccttcccttnanccncaagctttttgggtnctcaaancccntttcatttttaanntntgggtntgggacccaaganacaaatctttttcacangactttnttggggaaaaattgccccntccatgcctgnggcaacaggananacnccttngtngaaaaactttttttgcaccaaaaaaggnggacactnttgnnaatttaaggggggggtggntaaanaantnggggncnnnttnnccccaanaanncncntttttnngnnntttttttttcaaaannntnnnnnnntggttnntttttttaaaaaaaccnnngnnncccccnggggggnttttttcttttttttttnt

SEQ ID NO: 14481 - DNA, 619 bp, Homo sapiens
  misc_feature (1)...(619): n = A,T,C or G
caggggttgctgtataatttacttgtgttctgtctgtccagtgaattccacattatagtcagttcattcattctacaagtanagtagtttagttgctactgtttctagactatgccagtgagcctccgtggtcagcttttaccctatgttcatgtagctccatggccctgggctgcacctttgggganatgtgcttcctctttagtgtaanaaatgccgtaatctattatttctcatctatccttattttgtaacaactccagtagttagtataaatggagaatatgagattntactacgaactacagaatcaaagattggaaaaacctacattttcaagaaagaggagagtcgaataaagcttggtacattaggaggataccatgctttgtttccatataaaagtgtgcttctgtaagtattgacatgtgtatacataaaatatctctgcagggggattaaacaagaaatctgtaaaattgaccatctgtaagtggtagggggttgggcactgtaaaccggtaggaaggaaggcttactgtcaaccatctacttacctttttaacaatttaattttaccaactgcgtatgttattttttcaaaataactagatcgccg

SEQ ID NO: 14482 - DNA, 901 bp, Homo sapiens
  misc_feature (1)...(901): n = A,T,C or G
gacatagccagcagttttcaaaccaactttgagcatctcnatntaggattcattaccctggaaaatgtccctcttatatccatcaatgaaaataagctgttcttgaaggagtcctcagaaaagtctacaccgaaaaaatggacctcagagtatattcagatttgaaacacctcacagctgggaatagataaccttttcctatcatcaacatgaaagctgtaangcacagggactggtatgcacctttccagaatcctntcgggaaaacacattcctttacattactccaggctggagatctgagaggagcaaagaagtgctttgccagagcccaatgcaaggaagcatatggatctgctgaccagacatnctntctctgcaccttcatccacatagaaacatggatttaatganaagatgannctggcataaatgagagaagtctccaattttaatgacttaatactnttacttcagaacccatanacnactaccatctggccttattntattttttaatcacacccgnataaaatnctcnanccttactacatggatttaatcanacaaatntcaganntcaaatttccngtttttctnttcaaccnccactttcagcttnttgagcaccagaagtttttgcaaagcaaatcnttccnttattattcctnatgggagaanggatttntggccangaatgantnnatgaaccccttangnangnacnngcaccaaaagggngttttngatttttcnaantnagggttnttggatnccacntngtttnganancaaagctngttcnctgaatcangatttangccccgttnggactnncagccttggcncctttccctcanagtngtccnanattncttactaangctcccttaggntnnnc

SEQ ID NO: 14483 - DNA, 907 bp, Homo sapiens
  misc_feature (1)...(907): n = A,T,C or G
tttctttgcaaaccagcttgaatagagaagaatgggagaacagttcactgaaattcacaagatctgaatctaaactacacctttctggatctcctgtctcaatctgataagagaaatggactgcagtgaccagcaaatgtatctacttgccagatgtcaagctggaactcagagaatacaccatcttttgagaagaaggagccctgtgctgtgacagagtatcgagagaaattcagagaacctcaggtaacatcactgaaaatagccttacttcatccttatgtaaatgaacatgttctactgcagattactttaatattttgacaattacagctaaaccatggagagaagacactgcaatgatctctaaccaggcataaataattcattttcctcaagctatgcaagacggaaagtaaaggatataaatacacattcttattttttttttggatgtatcaagtaatgaataaatatgaaaataatctttttgcaaataattcctatttataaatgcccccccaactgcaatagggaacctaaacatcatcctttaacatggattacctttttttaaattacatgataaaaggcagttacttttccttaccatgggattaatataagggagttacttttctttaacagtggatgaatcaatagccctcacaggagggccccagatgggcaaacacggaggatcttaaattgatattcttttaagagggcaacctctaccaagggtggaactcaaaacacaattaattagaaatnggggcgtaaatatatggtttgagattntaagggtntctaaacacaaggttaaagaatattggttctcgcttcggacacacaacaatatatggcgagtggggcgtgtatgtatataaacatcccttgtcatcag

SEQ ID NO: 14484 - DNA, 568 bp, Homo sapiens
  misc_feature (1)...(568): n = A,T,C or G
ccnccaagatggcaaancaggaaagattttataaaatgattatcttttaaaagggnaaacctctccaaaatgtttgaactcaaaactacaattaattaagaatttggtgcattaanatttgctttgacattttatgtctttttaaacnaggcttgaaaaatatttgtttcngccctttgtaacaccagaaatattttgggcagttgttgtctgttagttttatnaatttatccanttttcattcaagtttccgtattacctatttgagggcaaggtattgtctatacctagggaagctatgttaaataaaaaaacctgctccttctcagaagcaacatatgcaaacccatccagttaatattcaaaagatgctatttgtgataattgttgacaggacagtgtagtgcaaataacatgagttagaatcagacataaccagatttaaatttaggctgatgagggcagaattcaacctctctgcctctttggaattgtaaatggtagtttggttagtcgttattcaaagaaaagttcaagcatactgtaaactctcagacatggcaataaa

SEQ ID NO: 14485 - DNA, 1548 bp, Homo sapiens
  misc_feature (1)...(1548): n = A,T,C or G
ctctaaacactcacacccctcacatataatcactcactatgccatctctcttcgttgtatttattatctacgagcccacaacagctaatcatgactcgtatagaatcatcacaccaacacagtactgtcgctacatccttgaggatttgtccattccacactaaccgtcgtctgaattattcatcttttatctcacagcacacacnccttactcatactcttattatatacccgctgcttgccggttcgcgtgcggctccaatcgccacacaacccagataacactcacnatagcagttattctgtttattgtctacttattgtcaatccatcacaaatagatcgaatacagtaatacatgatgcctcacagcacacgccactaccactgccgtcgctcgtcacacgtcaaccacgctcacgccgcgactccctctatgttcagtagattagtagtgacagccatccgcacatccgaatccggatccccttttccttatattaccgtatcctgtagtgctcactatgtacaccttgtctacacgtaccgtctactctacattcgaatacatctaccgcctgcatacccaccgctactacactcactcttcatcaanatcttaactctcacaaacatatcacattgtttgaggtacgtatagccgtgagacatcctcacgtcctcaccaccctctccctctcntgatactcaatctctcgcatttgaatcacacatatagacatattgatcgcatatagagnaccgactctcgcactatagatgaaaancatcgctactccacacataatcttactacnacgatagtataacaagatatcgctgtctactcttgacactcatatatctacttcctgtcctctgatcacgactgctctgtccttcatacacacgcgcgtctcacactaaccttaatcattgctagtgacaccgacgagctcagcgataacnatacattcacaccacacgtagactactatccagctatattctacatagttaagtataacttctactctatgtattacatctacctttcctctctatctcctagtatctacacatcgactacttccatcatctcctcattcttnatcgcacttacacatcatgattatataacacagtcactacacgntcttagcgacatcatgtntacctattcactaacactatttacttcactctgtactccacntctcattcactgtaatacacctaactctgttctcgttgtcgatacctagatgcactcgtacnactatcacatatttgtatatagtaaacacacgactacatctcaccagacgcggacanagccgtctagntnatcntanaaatgtattttatngtntatggattatcttaaccnattgtctaattattcatctgagtgcnngctgtctatatacctctcgcagacagcagcgctattctgctagccttacagctcatctctctccgcaatctaantgacttccactcaccatataatantctgctcatatgccgtcagatagctccntcaag

SEQ ID NO: 14486 - DNA, 1441 bp, Homo sapiens
  misc_feature (1)...(1441): n = A,T,C or G
cggcaggcgagagcgangcagtgacaaacaaatatgtacnnacaccgatgactgcaccagcgcaacaanatattcgcctcacactgccgccaccgccgacacagcacattatatatacanagaatcacgaaatgaagcttcntntgttttcttatnntgtaacgaaacacatgtatactncttcattgtctcgtccacaattctgacgtttgtagtancacactatgtactatgcactatcagcagggtctcggatacggcgagggcggagacgatnanantatcacacgctacatacgcgatctctgtcnacgcagcgcagactacaatnctacgtagtcactgcgtagagagcaggcgaggagcgccgagtacgacaaanacagacgacaacacgagtcacatcaacgtataatcacgagagacgaatagagagagaggacatcccacgggaggagcgtgcacacacacgaccctcaccaacgccgcgacacaacgagcacaccgcacnacccncactcaactcctactatcagataaggatcggcacacgagatataanacgcagcagtcaggagcatatcaaatacgatgagcgtgcagagtcgagcagcgcgagcggaggcgcagaggtggaggagtacgaaganaggtaaagagagggcgatatgtacggcggtgctgcgncacggagaccgtacgagctgagcagngacggcgcagcccgcgcacaggaccgggcgcgacgcgcacnccgcgcacacgcgcgccgatcgcgatgacgtcaagtgtgacgtcgaggccggacatatctcgcgccgcccagtgacgctagcgtcacagataattatcagtagcaagctgcggactcaacgacccgcgcgccagcgacgnagcagtacgaggcgngctcgcgcagacgtacgacggtcacacgcactgctgaaaatacagacactcgaggtcgacctcgtctatacacacaccagcgcacgacaagcagcagcacgagaaatgcacacattgcctcagcacgagagatcagcatnatatcctacacacctcgcaccctagccaagaactatcggagcactcttctccctctcacctcttgcatccccaggatcatttgatacgcagacgtagacatatgatagacacttcgacaatacgcggagcgcgcgctcggaggaggagtagatacgtacaaagagacgtcctcatggtgcaaactccatacgtgaagcaacagataaccttctcgtaattacacgacgacacggccatgagcgtgcgcagctcgaacgcaagggcgcacgactacgctctcgacacgcataggaagtatataagagatcagcgtctaccacacacgcgtagtagaaagagcgaagtaagngagaccgaatcgagagatcactagactcgcaccatagctaag

SEQ ID NO: 14487 - DNA, 433 bp, Homo sapiens
  misc_feature (1)...(433): n = A,T,C or G
tgccctgctcaaccancaccataggtacatattcaggaaaaagtcctccctgatgaaagcaaattcagaaatttggaaaaaataactatataccagatgcagagatatcaatgtaaaggcacaggaaacatgaaaaagcaaaaacgtatgacacctttaaagggccataattttccagcaatagatcccaatcaaaaagaaattcatgaaatcccagaataagaaactaaattattgattcttaagaaantcagtgagttacaatagaaatctgaaaaacaatttaaagaaatcagaaaaaacaattcaggacatgaatgaaaatttaacagatagatattattttaaaataccagagttttagaactgaataattatttgaataaagttaaaaatacattgaaagcttcaggaanaacaaagatcgccgcca

SEQ ID NO: 14488 - DNA, 1183 bp, Homo sapiens
  misc_feature (1)...(1183): n = A,T,C or G
ctcttgtgtgcttgtgcgcggnctgcatcggaggtgatgcgtcgttcgtgctagtacctgctggctgattaactgaggacacggcgcgcgctttgccgtccttgagttttggcggtgctaggtcttcatctgtttgatatagattattcagtgcgtgcgctagtctcggtggatagctatttgaccaatccaccatattccttgcctgtggttcatccgaccgcggtatcggttgaccgcgacggcccgtgaacagtgatgacggcagtgaaatatcaagagagtgggtggtgccgagactctcggaaaaaaagtctcgtgttggcgaatcgatggatactaacgtgtgtgtgaggcgtgcgcgatgacaatacaccatcccaccactaattaatatagggtgagtctccggacacctggtggggtttcgatgtggtgccacattgggcactccctcccgtctcgttcatcgctgtgtgtatcgttcattctactctcactcggcccgggttcgcttntgtgctccagcgtcgtaatcaccgttttatcgctccgggccgctttgttctcggtcatgttctacttcctgtgtgtcgccggccttacagtgtatttcagcactgtcatgttgtttcaactacacgtggtcatagatgcactgatgtctagggatggttagcagctcggagtnatggtggagcaccgtgatactcctgattatattttacatgtagcatagcggccggcgcggcgggcgtaggccatatccatattccgtgcgctgaattccgggggacaattatagatactcagaccaatgctatgggcggtaatttcgcacacgtctccgcgagatcgcaatgtattcacgtctccgcgcagtgtcgatatccgtctagacattacaaatctatgtcttcttattatcctggctctgggtggttgcgcaagaggggcaatcgctagccacgcgccacagatgctgggagcactcgctaaatacgggtgaatataacagggggtctttgcgcgtcttcaacacgcctgtgcgcctgtgtcctcccaaagtcgccttccccacatcatacacggtactatggccggtttcaccgaactcatctggggacgcaccgcggcgccgagacacagcgcgcaggcgtactacatagcagcgctcctaaac

SEQ ID NO: 14489 - DNA, 585 bp, Homo sapiens
  misc_feature (1)...(585): n = A,T,C or G
actcaaagtctggggggtgactgggttagacactggatatactattcntgggcttggtttccatagtcaaaatgtcaagtagactattaaggatattttataatttttttgactcttcagaagaaaatacaaagcagcagattgaaagataccctagttgtctgagaaataggtcacttggggttttcatattgttggataattaatttttcagtctattttgtgtacttttaactctttaaatttcaattatggatttttagattaaattagtattcctaaatatttgacacatatttcaaaatgtgtgtattaaaacgtatactaggaacagtcttcctcttaccacatcgttcatctccccaactgtaaccactgatactagtttctcttatgtacttgtagagtttctttatgagtacataagcaaacataaataaagattcttatgctctcccctttttacacaaaagtagcttacaaacactgttcctcagcatcttgttttttgcagccaaacatttcttggagatctttccattggatcagtgttcttaagcaggagcaggaaaagggaataaaaat

SEQ ID NO: 14490 - DNA, 1058 bp, Homo sapiens
  misc_feature (1)...(1058): n = A,T,C or G
cctatggccgtatgtctcgaagggagtcgtcatagtannnannngannnaatcaaacataaagaacggggagaggacggccggggaacacaaaaaaaccgggagggggggggacaacggggcggcacccacgggggggggcggggctggacacaaacaacaacaagggggggggggcgcaccggcacaacaactgacaaacactgggacacaccaccaacaaaacacaggccgngggacccaacacacacaaacaacaacaaaggaacttttcctgcttttggggggggggnggagcacacaaacacaaattgcggnggacacaacatggcaaacaaacaccattgggggtcaatggggggcaacgcggtggtgttgctggcgcggggcgggaatgctgggggggggggacacaggactacacacacatcatggggaatacggggggaaaataataaggaacataggaaaggaccccaatcaggtggagtttgctggtgagtttctggtattgcggtttttgcttggccacacgggacagggcacaactttgggctggggttcttgggggcctgtgcttggggtttggtgcacaaaggaggggaacaaacacagggggacaacggcaaacacacagaccaacccaattggcggatgggggggggagggatggaaaancccaacacaaaccaagggtcaaacaattgacacaggtaatgacccgggggggggcggggggaaacagggtaagacaacaccaacaacataaaagggagggggggggggtaaacaagaacaaacacccaatgggggcaccatgaggcgacaccgtgctgcgacgcggcgtggaccacggggggggggggtcagggggacggacacactgcacacgaccnggacaaccacgatcactactgggtcgaacacaccacgtacncgatcgccaagtaacgggagacacagatccaaccgggtccacctccgtgcgngataagggtctcactgtgggcaccccacacagnggacaccctgctgtttcgtgaccataagagtggaagg

SEQ ID NO: 14491 - DNA, 608 bp, Homo sapiens
  misc_feature (1)...(608): n = A,T,C or G
tgtgactcaccnacttnttgcttcagggacagggacaaattgcnaaaatttttagctctttttnacanatggggaaattgggactcanananggatgcgatctctccaagctcacacagncaatntgtggcaggggaatgaagaaagtctggtctggtctcctctccccatggntggggctctctctgcagtcccgccctatgcccagcctgcaccctcacctgcccctggctcctggactggcaactcaagtcgtnacacggacacgctttaccgaatttgcctccacactttgagcgactcattagtataaaaaacacgttcctcaccacccttgccanaagattcttgacacaacacagttggggggttggcacgctctctccgttgttaagtatttanatatagttagtattggaatggtccccggacaccgatccaagtctcccgttttcagatggggggcaccaggcttagggtcaggacccccctggaacaattcagtagcacagctgagacataaatccacagagcctgccctgaactttccagctgctccttggcaaatgggccangggaaaaaanatnganaanagggtctgaattac

SEQ ID NO: 14492 - DNA, 343 bp, Homo sapiens
  misc_feature (1)...(343): n = A,T,C or G
tctntaggttgcttaaaagnggcccactcttggccagtgttcagctcacacaaaccttcctccagttgagggcatctacgcatggccagtaccatctctgtgaccagccgcacccatcaagagcccaggaagcatgactctggcgtgacattgcttaaagatctcctcagctatcacttntgcataggggaagtccactgaagagtgacctgctttgagtgggaatanaaattgagagtcctcagtcttgatctgggcccactgtaagctgtaccattgaaacgggaaggccagtgtattatgcttctacaggtgaaaacaggccttctnacacattttttcc

SEQ ID NO: 14493 - DNA, 854 bp, Homo sapiens
  misc_feature (1)...(854): n = A,T,C or G
acncgtagananananaattaagacagtganacatnantnanangtactttatgattntnaantgtttcagnagntatatataacantnnaaatgagtgagattggtnagnngataagatatnaacagnnanncaananatntgntatataagtagtaagnanaagaacncnnagngatacnatacnntttatattnagagnacnatgtcangncagngtataananaacnaagnanataaaggganntgaggtangatagtnntatacgagctaattgagnagaaaanatncnagngnnggantntaganntaanttnangaaaaanntanaangaagnatncagaagaaanagganagaaaannatagnaaatanaaaaaggngntaannaattnaccttgatcgttgggaacnggggtntaaagttcttccatnccaaaaattgcttccaaatnttcagtntccacntagccagttttantcttttcctctcntgagccctggcaacatttgaattcataantcaaactttagctgaaaggcagaacagaaaaaaaatgctttaggaatgaattcatattttggatccgnaattagtaaattttttagataaatgtttagagttttanntncctgacgtttgaaaataccanagaatttcactgatattacaatataaagatatgagttttaaaacatatgaattatgntgantaagaaacagatanggggaggngatncctntgccccnnnaannaaaaaatnnnaaaaatttaagnnagcncngnaaanaaatngnnattagganganagtagnatgnaataaatatatnanaannacnangaaganng

SEQ ID NO: 14494 - DNA, 910 bp, Homo sapiens
  misc_feature (1)...(910): n = A,T,C or G
acagacaccggggcaggcccacccaaggacgccggccaaggagtgacaaaaaaactatagggacaaacagggggtgaggaaaggcgggggccgccaccggggaacaccaccggggggaaggcgacgccccccccccccccggggcaggcgaggggagcacacggggcgcccggggcccccacccgaccaccaccccggggggggcaccccccgccaaaccagggcgacggagaggggcccaccgaggaccaacggagaaaaaaattttttaacacagaaaggggggggggggccccgggggggcggcacggcggcaccgcggccacaccggggggacaccccggcaccgccggcaccgacaccggaggcgagggggaaacgccgagggaaacacgaccaccgcancaccaaaggagcaggaacacgacacacagagcgcggccccaccggcgacgggcggaaccgagacccccacaggcggccacacagacgggcacacgcgggggggcggagagggcacaccaaggacacacagcaccacagacaccaccaaaggggggggggagacgccggaaaccaacaaggcaccggcacccgggggacaccacggcacaacacccaaacgggggacacggcggagcaggggcaaaacacgaccaaacggggggggacacgacagggcacggcaacacccccgcgccgaacagcgcggccgggcggcgggaccaccggggacacagggcccggcacaccaggcggagccacccaccanggggacaacaccggggaagggccccaaccaccaccggcccccgccggccacaggggccgcacgcccccggcacccgggggggaccaccacggggggccgcggcgccggcaatgccacacgggcacccgccgggccccc

SEQ ID NO: 14495 - DNA, 262 bp, Homo sapiens
  misc_feature (1)...(262): n = A,T,C or G
cccccagaccaatgagaacatcaaacaagatgaatgaaaacggagagacaaaagttttcagcggatccttactcggacattctccaaaattcgtggaattgatttctctctctctctcacccttgntcaatcccgacgcaggtgaaggtgacatagctggaatattaatttcacaattttgcaaagcttaangtacattctttctcttagttcactttaanttagttttgattgataaggaacagtcagttcngctttcaca

SEQ ID NO: 14496 - DNA, 618 bp, Homo sapiens
  misc_feature (1)...(618): n = A,T,C or G
cccttcagggtgaaggctaaggtgacgttcattgcccggggaagtaagtgtagggttgaatcgaagcaagtcatccaggacggatgaggtaggacgggatggagagatncagctactgaacagcaggactcaaggaagagagaaggtgagaagcaaaaagctctgtccctcaccccagtggacactcagagggctgtgtgggagacaccccagccacatttgcagctaaatttcaccgcacaagcaggaagtatctcattagatctagatgagaagagtacaagaaaaattaagaaagacgcaggttttactcacttgtgtgagtcgtagtgtgtgattttcaactccaccacatacatgtctgcacaagcttgtctggccagctttgtactttcaattccacttgtgagacttttctttgagacatgttgtgtgctttgctttgngccagganntnagaatcataaaatcaccaaattctgtattatctattgtagcatataaaacccgancggggtatananaaacnnnccnaaanaancncananngnnaangannnnaatnaatnaanaaggntannanaaaaanaannanaagannnaannnntnaannatna

SEQ ID NO: 14497 - DNA, 1235 bp, Homo sapiens
  misc_feature (1)...(1235): n = A,T,C or G
gggggacggaacagacaagggaggggaaaaaaaaaggaccctttttggtgaatnggagggggggggcctcnggggggcgggagaccggggggganggaacnacacnggnaaagcccccccacgaccggcgggggggggaacgaaacaaacgacaccgaacggggggngcggcaacacggggggcgggcggcacaaagggggaagggggggggggcacaaacaagaaggcagaaaaggagcaggggggggggggcaccacaaacccacacacgaccgcggaaaagcacagaggggggaacacncggacgacgacacggagggaggggggggtttcttaaacaagggaacnggggcgaaaaacggcggcacaggaaaaaaggcgacaaaaaaagggaacaggcgggaagacccccgggggnggaacacacggggcggagcaacgagggaacagggacacaacggggcaaacacgaccaaacaccgggggacagcggccggccccaaacacacgcggcacacgggcgggcgggggcgaacaaaggcggaccccgacaacgccgacgcgacacaacacaggagggagaggggggggcaaacagggacaacacacacagggagcgggacaacacagcgnnggacagaagaccaaggggggccaacgcaagggagcaaaaaccaaagacaacccaggggacaccaagaccgacaccaaaaaaggggggcggagagccgagaccaccgggaggcgggcacgggagcgggggcaaacgggggcgcgacaaaccacaagacaagacagaaacaaaggcgggggcgaagaagggcggggagggcggggccgggcccacccgacacccaccgggacgcgcgcgcaacacaccagcggggcggcggggnccgcgccaccgcgcgaccaacacacngcgcgggccgcaagggagggcgcgcgcagcacgcgcccacccgagcaccgcgcggcggcacgccgcgcggcggcgcgcaggacaaacccccacgcgggcacacatcagggaggacaggcgcaccccgccgcgacaccgacagacgcccgccggcgctcgaagcagcaagggatgccagtgacaacacacaaacnagaggaggacaggactgtgagagagacgaacggacaccggggcgcgcacgccagactggcacgacgcagcgagtggcggcacaagcgattacacagccacgcgcgcgcagccgaccaa

SEQ ID NO: 14498 - DNA, 510 bp, Homo sapiens
  misc_feature (1)...(510): n = A,T,C or G
tttttgtcatnaatctatttcgtcccatggctccaccaatatggcaaccgaattcctacagaacaagtggaggaatgagggagagagccagcaagttggacatcacagttttttgatccaaatttgagggctactctttcatctctcccaacaacgtggctggagtgcagtggcgcgatctcggctcactgaaacctctgcctcccgggttcaagcgattctcctgtctcagcctctcgaggacctgaactataggcgcatgcaatcacacccagctaattttttatatttttagtagagacagggtttcaccacattggccaggatggtcttgatctcctgacctcgtgatgtgcccacctcggcctcccaaggtgtaaccaattttgaaattaacttagcataatctcttaaatttgaagacaaatgtactgttctttccagtaatttgtttgctagtattttaatcatacaagtatttaaaanactcaataaacgatcgcggttanc

SEQ ID NO: 14499 - DNA, 1132 bp, Homo sapiens
  misc_feature (1)...(1132): n = A,T,C or G
cggggcaccgggaccggacccacgaaacaagcaaaaaagagggtcgtgtggangactaaggagggggggcttagggggcggaaaccgagccagccagagcccggcggaaaggcaacaacagggtcgacaagccaccacagagagcccccgacacagagaacgcaagacgaccgacgaccgaccagacggggcaangccgcagctaacaaacagacacagcaaaaacgccgcacgcacaggcggaaaacaccacggcagagaanaagagcgaaggacggcagaacgaggacaaaccggaacgacagacaaacaccagaacacaaaggttgtgaggacaganagncgcgagcacgaacgcgcgcgcacgaaccaagcgagcagagcacagcgacaggcgaccgagggacaaagagccccgacggccgccacgccccaggctcgccaggacgacagcgcaagaggagaggagcgcgagggacgacgggcggcgccacggcgaggcgtacggccgaggaaagcagcacggacgacgcgcgcaccgagaaaagcggagccacgcccggacacgacgagacagcgaaagcccggcagcaggcgcacggacacagcagcgaacgagacgcgaccgacgcaggacaggggcgcgggtcggggcgatggagggagggggacgaagaaagcgcaacggaaaaacacagcgacacggagacccagcagagacagacgaaccgccgcaccgacccgagacatcgcggcgacgaacgaagacgccgaggcaccggacaacgcgcagaacacccccggggccgccccagcaaccagtcagcagcgcgagcgccgaacaaagacaacgtagcaaaaggaacaacagatggcgccagacaaacacgccgtccgagggcacgcccgccgncacgacacagcgccagggcacacgcgcccgccacgcgccgggatacagacccaaggcgacgggcggcgcgaacacggaccagacgcgacggaccgcgcagtggaccgagagcgggcgcgcgccgcgcagggccagagcgacggagaggacgaaaaagaagaaggaagactaaggcagacgatacaagcccagaaggggaaaacaggaggagcagaaaag

SEQ ID NO: 14500 - DNA, 619 bp, Homo sapiens
  misc_feature (1)...(619): n = A,T,C or G
tttaccaccggntnaattcatgagttttcaagatgggcctngcctttggtattntcatttctgagcctggaaatcacccagcacaaagtatanactccaataaaggttttcctggcagatgctgacacaatagcttctaaaatacaggaatctgccttcctgaggaactctnactcatttgactggaacaacaagttcacatgntaatgtgtgggctgaggcacgtgacccctcccatagaaagacagaaaatatatcaatgtgactttccttcaacacgcattaagaaatggctagttgttntcttatttattttgctttcttttccttttgacacagtcatcttttgacctgcacctggtattctgtgtaacccccatgaattggagacaaaaatatcaattgagaagcaggaagggatgagagaaaaagagagtgggagaggtctttatcattactcatgatatgaaaactggcacctcatttataattttaagtacactatgtgcacacatttacatatctttagagtgttgactatatgggtgtatacttcatcaaaattcatcaagctgtacaattaatatctttgtatttcaccttatgtgtactatatctc

SEQ ID NO: 14501 - DNA, 420 bp, Homo sapiens
  misc_feature (1)...(420): n = A,T,C or G
ttgaagagtgcatttggagctgtgaggcaataaatagatgaccaacacatccttcatctttagagcttcttagttcatttggttccaagacctatggaacccaagggtgattagtccctgtaaagccaggaaaaggctggcctggtgtaacctcangcaaaacactttcctcctatgaacttttttcttcatcttataataaggggttnggaccacntcagtggttgtcaaataccaagcttttgtgangtgaaaaaaacaaaatccagtntttttgtagagttgaagcccattcagtttnaaaagtttgattcttttttnctttggttttccnnggttaaaacttnctgttctttatgaaataangattgnnaagtgggaaaaaatttttttctttcttaanaaaaanaaaaaccggag

SEQ ID NO: 14502 - DNA, 1277 bp, Homo sapiens
  misc_feature (1)...(1277): n = A,T,C or G
ctgttgtcttaccgtgcttctgctgtgtctattcaaatctagtggaaactcaaaacatggcctccatgcatcgtcctttttcaacagtcacatcctttatccttttcgtgggcggtgggacctactatctatacctaccagtgttcttcaatcgttttctgtcccattctttgccttcgcggtgctacaacacaaatcacttacatgtcatacagggtggggatatacaccaggattatagactgtgtccggtgtcgtgtcaatctcttatattaaagtattgaatatatgatggtgatcaattattaataatactctctctgttttagcaacttaatatcacctgtactctgatataagttcatataagtcagtgtagtatactgcgcacacaactcgtcgttctgttattcgtcctgaccatactatacttggtacatgnggacaacaagttgtaaaantacacacataattcggtcaactataaggtagtttaataatattagtgtgttaccgcgagcaggtggatacaacaaactctgtttctcacaacgcgcccgtgaccatccaacgctatcatcgcgatcgattatctataacaacacttgtggtggtgcgcatatatcactcctctagtattattcttattctctcctataatgcgcgcatagcgcgactacttacctgttatgtgcgaattatactcctcacgtngcgctatacagtcgtgcgctgcgctggcgtatgagctgggatagagacactacttactctctcgtacatcatatagcgtgtcgtcagataacataaaacacacaanacataactacatatttngtgctaatttttgtgctatatactgccagcgcacatatcaccctncnttctccctactgtgcgacctcacatatccatatgtgcggttgtctactatacattatcaaaatataacaaattatatatcaaccncacattcggccaccagaccgcaacattgacaacacctatttctatgtactactattactttctgctcctatacacatattattanatgccacaattttcgcgtcgtcatctcttcacctaccacaatcgccgacatntntcatatcgtgttctaagctagagaggntcacgtagtatatcatatatactctactaatatctatgtcgtatatnactntacgtcctatctgtgtcgcactgtatcgtgcccgcggatcatatatctcgtgacatctcntggtggatcacatctctagtctcacactaat

SEQ ID NO: 14503 - DNA, 869 bp, Homo sapiens
  misc_feature (1)...(869): n = A,T,C or G
gncccnntntngnntannnnaagggntccantnnnnagnnanccngnnnggngggngcccnaancggntggnnagggnttcnnaanggggggggncanaanaattgcttcannggnatannngggttanccagcccccccaagnnnntggccnannccnttngnaaaggacnatnntcccnncaaaaaggccnggnaantnccgggcaaacccaagccttangccntncngccntccaagggngncggntgccnnaggatnncnnatnagnggcanttgttaganttttgcccaaaggnggccntatccccagttaaanttgnttaaccgccagtcaggngntttngnncncaancagtnttggaantttaaggctgccaagtgcnttttttttaattaacccccccgctaccagggctatgaaaaatgatgttagncaaaaagcaaattttgagaaatgttttgatttcaagttcaaaatgggtngaaagcagcagagacaactntcaacatcgacaatgcatttgactcaggaactgntaacacatgtccagtgcggtggtggttcaagaagttttgccaggagacaagagccttaaagatgaggagcncagtggctggccattagaagttgacaatgaccagttgagagcagtcatngaagctgatcctnttacaactacacaagaagttgccgaaggacttaacatagaccattctatagtcattcggcatttgaagtgaattggaaaggttaaaatctcgaaaagtgggtacctcatgagctgggcaaaaattttaaaaatcatcgttttgaagtgtcattttctcttattctacggaaaatcaataacagaanagccgtcaaa

SEQ ID NO: 14504 - DNA, 651 bp, Homo sapiens
  misc_feature (1)...(651): n = A,T,C or G
agnagccctctcttaatgnaccccgctacagtggaacagcagatgaggctatctcttcagcactatgtcaagaaacagcagcccagaaaattcttaacagctgaacttcagtttctaattacttctcacagccacttcaatttttgcctctctgaggcatatgctgaaatcaattatgacatgcgagcggttacaccatggcacagtgaggaagctgccaatgactagactgtagtctgtgatcattgacacagggaagggacgtgacggcaaagatcagagagagaaaaaagtcttcttctggcttttaagtttcaaagattaaaaaacaaaaagaagaagaattgcagcccccaacaaggtctcctaaccccaggccaatgctctgtccgctaagctagaagcctctcagcatgagtgccttcacgacacaacttctgacccttcctatgaagaagtgactgagccgtcactctcttgacacgtttgtttggggtttaaccagtcttccaanncnntanattaccccccgctgaanatnnngnaataacctaaanaaagtaacactantggaaggttaaacttgtaaattacacctttaaatggnaaccncttanatcgattttttccaacncanacncnccacatgcc

SEQ ID NO: 14505 - DNA, 666 bp, Homo sapiens
  misc_feature (1)...(666): n = A,T,C or G
ctnnacaggctgtttggggtttannantntccaaagacgttnattanagccagctgaattttttgtaaaagccaaanaagaacncatattaaaggttanacatgtaaataanccctnttacatggaancacatagatcggatattttcaaactcagacacacacacatgcctgcatgcacanacacaaagccctattccttcacttgtgtnttgatagcagacngctttgtttttnaaacgtagtcactgctaatagtaaaaaaaaataacatggagcggaaaacatgaacaaagggagctgcacagctgatattccattctgaaagctttctctttgatcctggctanggcagggcatttcttanaacgttttgaacatcatacacatctggctgggcatggtaaaagtgaacactgaggtggagaaatccaacaaatagatgcctttctctccttaccggaagaattcagtttcctgacagctcgcagaactgcaaatgtagaacacactatatagctttctctttttaatgtttaactcaaatggctttccctatttctgttctttattattcataaatattaatagaatagctttgcaggctaataatactcaggccgaatattctctggtaaaataanaatanagnggcgttaatacnaaa

SEQ ID NO: 14506 - DNA, 1364 bp, Homo sapiens
  misc_feature (1)...(1364): n = A,T,C or G
ggaggggacgtgagaacggagcaaggcgaggagagagcgcgggaagggagctcgtttctntgttgaactncggggagggagggggccctcncgagcggcngcaaaccncaggacggcgacggagcggcgacagacggaggacgagcacaaagcatgcaggcgcgggggggccgagcacgcggcagcccgcgggacgcgggcgtgcggcaacggcggggtcgcccccgcgcagcgggcggcgccggggggccgaacaagaggagacacccgccaggggaggggcaccgcgggcgcgcgggccccgaccccgacagggggggcccacgcccacagacggcggagttttttgcagaggggcgggggacggggagagaggggcgcggggcggaccggtcacgggccacccgggcagccacaccccgggtgggcgagcgggggagaggggggacggggaaacacgccagaaaaccggctacggcggccagcagcgtgcgccgagacccgcccgggcgcgcgcgccgcgagccaagaaagagagggcgatgacgggagtgcgccgggcgagcggaggggctgccgggggtaaggagggccgccgcggtgcggcgggcagcccagnggtggagacggacgcaggaggcggcgcgcgcggcgacanacgaggggtggcagcaggagcacacggggtgcgaagcgcacagacaggacagtgcgcgccgtgcggcggtgcgcgngtcggcagcgcacacggagngngagagtntggcgcgcggcctggcgcactcggcgcatcgcgccgcacctactactacgacagcgtgcacncgcctgntacgcgccgcgcacgcatgtacgagccagtcaccgcgcgcgcgcgcgcgcagagcgcacgtagngncgtcagccctacacanatacgaacctgaccgcagacgcactagacacggtgcncgcgcgncggcgcacatcgcgcgtctcaccacgacacagacgagagcggcgcaagagacgcgngtcggcgcgcgcgcgccgcgcgacgcaccgccacancacacggcncncgcgacgcgcgcgctgtgngcgcacnggcgagcggcggactatagagcagggtcgcactgacacgcggcagcgcactcgncggacagtcacgccgcgcggtcggtgcgtcgcgcgcgcacacagcgacggcgtcggcacgcagcgcaccancacggcgacgagcagcgaccgggcanacaccgagtgagacgcgcgtgcacacagacgctcgtcgcgtgcgccgcaagactggcggcagccgcgagagaggcggtgcgcgcgacgaggagagtcgaccgcgcacctcggagccgtcgctcacg

SEQ ID NO: 14507 - DNA, 114 bp, Homo sapiens
agggccattggagggacaaatctacgacccctaccctagccttgaattgggcacgtttgcggcggccacttggacccggatgatttgcggcggttctggattggagccttttgg

SEQ ID NO: 14508 - DNA, 454 bp, Homo sapiens
  misc_feature (1)...(454): n = A,T,C or G
agggacaatggtagggacaaattctacgacacctcaccctagcctcgcaacttggtcacgtctgcggtcggccgacttggcacccgggatagatttgcgtgcaggtttctgggatttggagtcctcataggattctgggacttgaggttccttgcgcgtagggtgccgcgccttcccgctggtgaagtctgtctctccagcgtgctccctggagctgtcggggtggaaaacctggatccagcttgggcatctgaaggtcctggaaatgactgggcttcctcacgttctagactttattaactgatgaagtctcccttcttctaattgcataaatcgtctgaattatacatgtcttttgggggaacaagaatttggttacctgctcagcataacctcttttatggaaataatttaataacatatgtaacaaaatataaggcgatcgncgttanca

SEQ ID NO: 14509 - DNA, 1632 bp, Homo sapiens
  misc_feature (1)...(1632): n = A,T,C or G
gcgcggtgctcacgcgcatctgttgttagtagtgctctatatttaatagagtgtgagattgtggtaggtatctcttcgcggcgncgacgcagccggagtacaggcgctgttcttagagtgccgagcctggcatctcgcacggcgccgtattgcacangcacgcgccgtacccacagaggtttatgacggccatgngtgatgacgacaagcgtacataccgagcagacacttcacttagagcatagcgcagtggagagttcgagctgcgtcggagtcgcaaagcgcgagaaacgtctatcattaccacacctatctaccatatacgtgagcaactgaagcaaatagaatcaagattcactataatgagagtagagtgtatgggacacgagtgcgtgcagagacgagcggtacctggcagcgtcacagtgacgctccagcgtctgttcctatcttatgcgcgtcttcgtgnacacgagcttatttaaatcccttctagtcagagatatgtatagttcatataagatgaagtacagatcatgtatgagctgaagcggcggagaacaactagttagtgagatatggatggtgatgtagtcactgcgagtgtgcgagtacgcaggaggcaagaagtgcagtgctaggaggagtcctccacatcgaggtacactacatgagattgctgacagaacacgcagcgtgagatcgagcgacaggagaaatngtagcantatagaagacgtgaagagcagccgagaggaagtgtgatggtgagatgaataggtgatagcagcaggtgagagcagacagagtagaantgtgcgatgtgagtgggtacgagcggaggatagtatagtgagtagtgtatagttgggtagatatagcgttctgctatcgcacgccattccgcatgcgtagtggtgaggttcgtgctgctaccagtctcacgcggtatcgctgctgtntatgatctctgacagtatcctctagtcgttcgctgtctagatgcatgagctgagntgctggttntatatgcactgtagatatgtgtatgagagatctgtcgcggatatggatgtggcacgacggcaaccgtgcanacatcatagctctcaagacagtgctagagcgatgaggtagttagctacaccgcgtccgcaacacgactggtctttatagtacagcatacgtctntcatagcaccactcgcgacactactaattaatccgtgcgtcgactccgtcgccagagactcagacgcgtacatatatgcgctatangagatagatncaaaagcgtgatactagctnagattgctctctgtggatagtggcgcgagagataggatntgcnttataagctagnaatgagaactctcgttctgtatagagagcgagngtgtgcnatgaganattgagagactactattcaaattacatagcgatgagaagtgagatgtgnaggtacgcgaagagcacggcgaaggagagagcgtgngtgcgagacgctgagctgtcgatncacgatgctcactgtccttcatgctanaactacagtaaccaccgacacgatcgatctcaggtagagataggaacgcacgagggaagagaagaagagctagcaagtaagatgagg

SEQ ID NO: 14510 - DNA, 1882 bp, Homo sapiens
  misc_feature (1)...(1882): n = A,T,C or G
ctatataccatgcgactgtctgtcgttccgagtgctgacganaatatacantacncactgataganaatcatctctgtgttatatctcgnggtgactgtatnagatatcngcgcgtatagttatcgngcactgtgnagacgtcgacgtatcgnggtggtggatgatgcactnccagagtatatgattgcgacgctgtcactcctcacatntggagctagcatacaccatncttccaccagccggcacngtagcgtagagtctaatgtgcgtatatacaaccgcggtactggctgacanatgtgcatgtgatgatgatcgctgcgcgcggtgcgtgcngtactagatgatgatantcgtgacggtagagctgcatgtgagcatgcgtcgacacgcagagagagancncatatanttcggantatgtacgcgcgacntcgtntagangacagatcacacagatgagatggtgtgtgtgatcgatgcgtgtgatgcgtatcgcnagactcaatnacagcattnatcatcgcagtatagctcgcagcgcatgcgattctngtactatgatctcgacncncacgtanacagcgacgtcgggcgtgatagtctaatattactaatgctgtcgtgcgcatacgagaggcagtgatatagagatatatcatatgttctgtancntcgcgcactgtgtgtgtgtgtgtgtatctcgacgaaagacgcgcgacatgncatatatacatatgcgtcgtgacgtcagttgccgaagttggagtgtcgaagatattgtaatttctcaccangttcnggactcgangcatcgcagcactncgcgacnacacancgcacgtgatatctgantgacgtagatcatatcgacagctgacgcgagacgatacgtgacgtgtgtctcnanctagtatcgatgacagaactagcagagagatatatacagagatgtcgagcgngcgnagcgcggtgtgannanataaagagtgagtatagcgcgagatctaatnggcgnacatgcgtgcgcgnggcgtgatcgtataantagcngnagantcatcaggagagngctcgcgtagagcgataatagagatngatngcgtgtaagatgagtcgcgactataancggagcacggctctgcggagcgtgtagacactgcgcatcgggctgatgtatgcgcgcgtgtgcagcgtgacgntcacaggtagtatacgtgcattgtggcatagatacgaggatgttgatgtacttgtatatagcggcctcaatgcaccatgaatcgaccgtgtatatcgtgtattgtgtctgangctganctagatgagtatcatnaactcnagcgatgctgtacgacgcggcggactcgccacacgaatnagtgatgtgaggcggagatgatgagtgtcatctgtgcgtgcgaaacgctgtcatatactatatatattgtagccagcgactagtcattcatnagatatangtgatacgcatgtggaatgcgcgaaccgtggctgcacggctgccgtacgctgcagatattgctgtgtgccgacgcggtgcancatatcatagaacgcatcatcggatcggttcagtaattctgtggcgatggagtgttctgatatggtggacattcgattcgtgcgtagcccagttgcgacataagatgtccagcgacttgatgtgcgatataaatatatgtatcgaagatggcgtcgagtcgacgcacggcgcgctcgtcagatggagataccatacttacgccgggcgagtcagatgcagaatattatgatgcggcgtgcgcatcgtataaagctacgctgcgatgaatctacagtggccgcattttaagtgctgaatcacacnctgtgcagtgcgcg

SEQ ID NO: 14511 - DNA, 368 bp, Homo sapiens
cttcgttttcctacaccccttccccccatttttttccctgtcctccctttatcctcccattttctttcctccaaccctccatctttccttcggtccccttttccccccattttttttacatttttgatccgttttcttcctctcccccttttcccctttgtcagcatctgtcaaggacccaccacccccccattccattacttccccccacaaccattttttttgtgtgttcaatacgtttccaatacctacactctttttttttctgaaccagcattatccttcccattgttggttcaccgatgggtttgttcttgccacccccccttgtcccattaaggccaaattccccccatgttccttaagga

SEQ ID NO: 14512 - DNA, 910 bp, Homo sapiens
  misc_feature (1)...(910): n = A,T,C or G
ttctttgggacttaggatccaggtttgagcctctatcgagactacagatatgaagataagtccaaagcttactcttgataagacccgcatctagagcccattcttcaccaccactgtcctgtccgatcctttgctgagtgaggtttacaacaaatgtctgtgctctgatgcagaatgcaaccagacaaagctcaacatcggtctttgcttaggctccctgccatggagaaatttttttttgcaattgctggacacaagccttggccagaaggcactcttggcaaaagtctcatatccaagtgtttaagctttccaaccccccttttttcggtttttccatcaattccccacaatcgagggagaaagtccttgtgatcttgattaccttttttatctagacacactctacacgttttccttttattcttctctgtgtggtgtagagaatttaatttatgtatttttgttctgtggtttttaatggtttatagtgcttctatacaacacactctatctctttgtttcaagggtgtgataatacctatgatgttcgttggtttttctcccaccgaactcttagcgaattacataagttggtgatgcggctcatggtggtaactaggtgggctgtcagctgtcatctatcgagaacaactttgtgcatccgtggcgtcttacattataattggttgtctgttgatataatactcgttgtgcaggtgaataggtatgaaggatcaattgtgtatgcattcattagtttcgtgtttggtaatgtaaaaactattcttcttcttactctatactattgtaagtctggggtgggagattatatattctgtttttgttatcataattcatttgacaatntaacactcggtagagtgtagagaangaggttgatacaaag

SEQ ID NO: 14513 - DNA, 642 bp, Homo sapiens
  misc_feature (1)...(642): n = A,T,C or G
cttttngnggaatncccttaattntaaaatgncgagttaaatggggngcangcncaccnaaccngggccaatggaatacatangtaccaaaccntgcaaggttgtggancatgtnccntaaaactttaaagaaaaaaaaaacttctcagttagctttaatttnccttaaacttgttgaacttgccaaatgctaaaatgcatgagcacggttttggggggcatgtcaaaataaggaagagccaacaaacctgccccccaagctttttcagacatgtgttagcctatcactaggcacacttnactcncctcaccagagggccccatcccagagaancagagtaaaagagcaaaaatgtaaccaaagaagtcctcagagcaactatcccttctatcgtatnacaagctccctgctcacaactggcaaagctacccaagaacaactcaaattccaccttctcatgtccgcctctgagctctggggctattggaaatccgggccatcaccagtcatggcctctagtcacaaccagctcctcaaatagcacagccagccttgattacttccctagtgagagaaagctctactccaggaccactcttccnagccttcccctacccttntaaaaccctcnagacattacc

SEQ ID NO: 14514 - DNA, 839 bp, Homo sapiens
  misc_feature (1)...(839): n = A,T,C or G
tctgtggcagcatgttaccatcgtgttactttgcttatcactgtgtccatggagctgaggaccctgtctgatacattaagcatgggctcagtcaatatggatggtataagaggtgtggccatggaaggcaccttacttcacagggtaccaaagatgagatgccaccaaagggtcgccccgttttctcatgcctcacacatcttacagaagaattgaagcccaacaccctgtctgattgaggactatggatagccctgagctggctctcctctcaaagaatctaagaaatgtgtattcatttgctctaaagttatgaggagaaaattctgcctgctctgctaacttcattccgagattgccaaacattggtctcactgcctgtgccataaccttgctgaagccaggacacctgatagctcttatcacagacatagctgtaccccatcatcactctccaccttgcctggctccccttcaggaacatggcttgagtggctaaatgctggttttcattttcatgttaaaagtcaaaaactattctaaagttatgacgtatcatggtagatacatctttttaaaaacaaaataaaaaaatagcatttatactttaaaaaaaatnagttatgggggggggattattattttaaagggggttattggtttttccacaaatggggggaaccccaagaaaaatttttggtccaaccccttcggcgcccccccccggtagaattccgggcttttttcttttttgcggggtttttcccccctcgcatataaaatattggcctttatttaggtttgggaaaccgttatattttttaaaagcggagtttctt

SEQ ID NO: 14515 - DNA, 273 bp, Homo sapiens
  misc_feature (1)...(273): n = A,T,C or G
cggntttaatantgananngtnnttatgcgtanntgtgtngtatacnnangagnataanngtttcgtanatagtnntntagtannggnggtnantaagggtagnncattttntncnantnnacngnntnnanngtnttttnaanggcattnnagaatttncnanaaaaggnntntanntnaggcggggaangaatgtnnnaataaagggncggattaaaagttgaggcnttaattgttttttncnnnantttnanaaaaggccggaaatnntc

SEQ ID NO: 14516 - DNA, 487 bp, Homo sapiens
  misc_feature (1)...(487): n = A,T,C or G
cgancagaagagtgccaccaancttaacccttgccttgaagcgctncaggnaacnttcatcatggatgttttcagtgngcctttcgtgaagtacctcttttattctggcaagncaacctaatgcttaaatgtgtgacccacggccaggggtccctctcacagaacacctgttgatactgagtaagcaagttgttggaagaagcaggcaggtactgcagtgcccctcatggcctcacctctgcagttacgcatcatcaccttccccgtattgaatgcnccacccagggcagccctggctcagtatgggaggggtctgagcaaggcacagacatccaggattgaggatctttgggggccatgggaggctgactaccacaggaagctcctgatgaaggtgccagaaaaatgggagaataggctgagggcaaagaaaatgtaagaaactgccattgtgattcaaataaaaaatgatgcgggccgccaccgc

SEQ ID NO: 14517 - DNA, 1498 bp, Homo sapiens
  misc_feature (1)...(1498): n = A,T,C or G
cgatcgcacgctactctccacagttcgacagtcggcgaccgcaacctntcaccaaccatcttgtggatacaccaggnccanctnctnaatgtatgcttcattgctcgggacgtgcacggacattcctcagaaatccgaatatacacaagtattgtgttgcgcaccggttgttatagggggccgcttgtatgtcccgcgggtcaccttgtctttcgaatancctagtgtgttatcttaccccacgccgctcgtcccgccgttgccgtgtggtttgcagtgtgtccacacctgatctatgttgtcaatccccgcctgatgatgccggcgataggcaacgcgtgcacgagtgatcaaccgggggatagttgtgttcttacccagtggtcgggggcggtcacccacgattgtgcgtcgtagtgtgctctagcaggcagngtgttgtacgattaggcgccgtggtcacaccaccgtcggtcttcacatctatgcccgactcagccggatgaccggccactagatatattgccgcgtgataaggtgaggaggaccgccacatacaccggatgatggcgcccaccttgcggcacagagattatatgcctccgatgcacataccgatcacaccgcctattgttgtgttatncggtgtaagtactacgttcgcgttgatctacatgtcgccccacgtgtgagaggagaggaggctcgggcgtcgtgcgcatncgcacgcacagctgctgcctggtngcagttagttgagtagcttagaacccaccaccagctacactcgcgagggtgtggggatgtcgcgccagacacgcttgatattgtctcacccgtgtgtgaatttgtgcgtcgataacgtaaccatatacggtcatggacgtagaagagggcacggtatatcattactctcatcttgcctcggtgtgctttgntggcccactccacatacgcgcgttgataaatcgtctgtggttccgctccaccagtgtggtggataagtgcagtaaacaatagtcatgctggtgtgaaatcaccgcgcgatatcacacgccatacggcgcttatgntgatcntcgcgcaagatgcgtatacgcgccgatatatcatctatgtgacgngcgccgctcacacccgcgcttactgcgtatgttgacctcgtgtgtagtcgatcacgtgctcgatgnantaatgagatcttantcatcgcgccgacgctttatgtcctatatcatctgatcgcgtgcctgtcggcgcacgcacagaggtgacacccncgtagcaccangatgccgcatctgacgctcctcgctctcntcccgctgttattgctagtgctgtgtgccgcagcgcggcgctacaatgttgtgcctgtggttgtcccgggtgatcnggcaagtcatagaagtactcttgttagtctacagcgtacttgagtatcatcacttgagacaccgatatttaanataagactggcgcagggactgcgctgcag

SEQ ID NO: 14518 - DNA, 1102 bp, Homo sapiens
  misc_feature (1)...(1102): n = A,T,C or G
gcacgtctgtctgccaaaacgtagtgaacaattgttctaagtacgttgtatatttgatctgcttgcttatcctctttaacacacgttttcctatttactgtcaaatcttctggccccgccatactaccttacctactcacctggggtccctaaacttccctggtgaaaattttttccacgccccttcggccccccctaccgactggtacctaccaccccggggtgatattcctcatcgtcttgacaaaccacccaccacccctcactatttgtgggcgtgtgcatgaaatactcttattgtgaatcgaatacggcaaacactgtgtgacactcacgtcgtccatggtattttgttaaaacacaaatccaaagcacacttgtagtgtcactgcaggattcttcattccccctggttatcatcaatatacagtggtaaattaaaaaacggtggggttaactaagccaaaacgggtggtacgcctcggccggcacctgtcccctgtccgtgtatttcataatttcacaactcgtataccaatcgtacataaatgggctgtggtgtcgctctaaactacgtgttccattgtacctcctcttttcttattatccttgtctattctaatctcgggaaccaaacatacaatgtacttgtggtctattgtagtttacacggacatgtgtctcgcaatggtggtttgttgcacagttggcataaattattgatacgggtatggctaatgataagtgaaattgngtctatgatggaagatacacgggcataacaaatcttgaatgcgggcgtgcaaatctataaaataatttgccaagaggtgaggggcaacaacatcggtgtgtacataaacgggcaacacttaaaagcaaagaatgtggttggatgatagtgggtatctccaccgcatattgctgttggtggccaactagaattaaatttaatgggtgcgtggcaaacaacgtggcgtaggcggggacgtcactggtgtgccaccctaagtaataaatacgtaatgaatgaaaagaagaatgataaaagagagttatacaataaaaaaaacattcctcaacgggtgactgggagtcgcaa

SEQ ID NO: 14519 - DNA, 462 bp, Homo sapiens
  misc_feature (1)...(462): n = A,T,C or G
taccgatgaagnnaaggagcaaggtgantagaaggtcagcaagaaaggaatgaganaaagcaggagtgcccagaacntcaaaagctgagagaaagtgaacttcaaagaacagaagtgcatctgggtagatatcctaaagacttgaaatcagtatgtggaagaggcatctgcattgctatgttcattgcagcattattcacagtancccagatgttgaatcaacctaagtgtctatccatagatgaatgaatgaaggaaatatgatctgtatacatnatgaaatactattcagccataaaaaagagtgaaatcctgtcagttgcatcatggaactgaaggactataatggaatactatttagcctgaaaacagaattcatactccaagccccacaatacgcaatatacctttgtaacaagcctgtacatgtacccctgattctaaaataaaaccagatgcgcc

SEQ ID NO: 14520 - DNA, 214 bp, Homo sapiens
  misc_feature (1)...(214): n = A,T,C or G
aaggaatgaattttatgggtttgttgaggctttttaaatgcaaaggatcaatgttgcttttggttgcttgtacaaaattatgacattcttggagagggcaaggaggattgtttgatagaaccatgtcagtcaagaagactgactctgtgatattatttctaccagaaagaataaaggcaaaaaagcgcgatcggccgccaccgcggggagnntg

SEQ ID NO: 14521 - DNA, 138 bp, Homo sapiens
  misc_feature (1)...(138): n = A,T,C or G
aaaagnagngcntccnancaaaaactgtnntnaagttgacnaacttancgganttttcccccaccatttaatacgagccnnatgtttaaatttgtcaanaagntccantgnattgacgntcccggaagnaaanaagac

SEQ ID NO: 14522 - DNA, 224 bp, Homo sapiens
agtgtcccatcagcacaaagtttggcccaaaactctggagtagcggttgaatatatggaagacgaaaccaagccaagttctccatcacaattataaagatataatttgtatccctattgatgcctatgttgttgttctgttatttgaatggcaattggaggaaaagcctctttagagagacccttgacacaaataaaaacactgaagaattaaaaaaaaaaaaa

SEQ ID NO: 14523 - DNA, 441 bp, Homo sapiens
  misc_feature (1)...(441): n = A,T,C or G
ttctgcaggctgagaattccaagatcaagacaccggcagatttagtgttcagtgaagaccactctctgctttcaagatggcaccttgatgctgtgtcctcacatgatgaaagggaagaaaggttaaaggcacaaatagctccctcaagcctcttttatatgattattaatctcatttatgaggactctgcccttatgacatcctaaaagccccacctcttaatactttatatcagtgatcatgtttcaatttatgaattttatggggacatattcagaccgtagcaataagggttggagaaatcatttaaattaaataatatatagattgataaaagaaataccttgaacatatgaatatttactatacatttatctttaaggcattctcttttcttgcacttttacaataaatagcgatncgngcgctnnnnnnananaa

SEQ ID NO: 14524 - DNA, 1112 bp, Homo sapiens
  misc_feature (1)...(1112): n = A,T,C or G
gcaactccagctataccgacgaccgatgtacgtgtcgcgatgattacgacactttcatcggggaaacttgtcaattataaaacgtccccccagacgcaacccgcccaggccaatcccacatatagcaaaattccagcccgtgtgagggcgccctgttataagacggcccgnttatttattgagtgcacgagttgtcactaaaatgcgtgtagttccacgcgacgtagcacgacgggattattgatgtgtacacaacgtgtgtgggatttcccgaataatgggggggatcggagcaatacaaagaataacacgcatgtgtgataagtacgtaagaggtcgtggcccagtatcgatatggtacgtacgggcgaagtggatgccagatatccatatgtcatcacggaggctcaaataacaactcaaaagggtgaaaaactaagaccgagattgatgacaggccaaaacacgttgggccaacgcggcgaagataaggcacaggtacaaaacacccacgtatttatatgttaagaagacgacgatgaaaacaacccaaggcggattaggtgcgtggggacaacacaacaagaggtccgttcagtatggtaaagaacaaaaaaaaaatagtaggaaggagtgcccccccactgggtatgtttccaccgggtgagtggggataaaagacaaacaccaagcgaaaaaagcccggcagcatcttctcgaggcacgggggagggtcgcaaaaacatcagcgacaaaacattttatatcacccggtatttacatcataatatgagtattgaggagttatccgggaattcgcgctacggacatatgagtccgaaagcatgcgtaataatttattaatccaagagcggtgcagtagatggagtcgacacatgtcaaaatgagttattaacacatgataacccgaaagaagatccgtagctcaaagacacactctatgggcacaataagatgatgactactacccctccctacattaaatatagttttgcccgccacgctatattcagccgtccaatgaactgtagaggttatgattagattagtgcggacgatggaccgccagaatacataaatcggaataacat

SEQ ID NO: 14525 - DNA, 1049 bp, Homo sapiens
  misc_feature (1)...(1049): n = A,T,C or G
ccaccggggtcgggccaaaggtgcgcccaagtgggaagggagnacccctttgttctgggactcctgctttttttaattgcgtccgcggccccggggcttccgaagcaacagcactccattttaagtcggggggggcgtggatgagttaaccaccgctacgggtggcttagtcccgggcatcgggggactgggataggcaagagcgtgacatatggcgggctaatctaccggaaaaggaaaaaaaacgatgggtcccaagaacgcgggtcaggtaatactaaccatggcctcgggaaatatggtgccggacccaacatgtcagtgttcgaataggaatcgaggggcacacagggtaacacagggtaaaaaggaaagcggagcgaaagggagaaacaatggggtgaagagacaaaggtggggggggacaaaaaacacacggggggcacacgagggtgtcaactatgggagatcgcggcggctgacaaaaacacaaaacgggaactgggatgggtaaacattgtgggggttgtggaccgtccaatactcctacccttgctcccacaccaccaccactcaattatcaagtaattcactctggccaaaaatattgcggctgctggntgcatgggaataggtccgtggtggtgaaaggatgggtgtgggagggcacgtaaaaaatgaatgtacatttgaatggaaatgtcaatggacacgagngggggttgacaaaatagaggggtcaaaactgagagggggggcggggcaacacggacaaacagggcacatcggcgggggggcacacatgggaagggcacaacgggacaaggaaaacaaaaacggggtgacgggactgagggaaatgcaaacaaaaacacacaaggcacaacaatgggattaaacatcacggtgggtggtggacaaactgaagggagggaagggggacatgggtggcactggaaaaaaacaaggaaacaaccaatgggcaaaacaatggaaaaacacgggaaagggcaccacagtcatcgggcgaaggtggggcaggcaaccga

SEQ ID NO: 14526 - DNA, 1337 bp, Homo sapiens
  misc_feature (1)...(1337): n = A,T,C or G
tcccccactaacatnagactcatctcgtttccctctctaggtcggtgtcgggttggttagggaagacacgnaggacgagaagacactctttcgcnagtgagacacaagcgcgccgcgccttttcaaaagaggaagaagaatccgtgccgccgcgccgcatgcgctcgcccccgccggcgaactctgatacggaggacggtcctgacatggctgatgcgcgnccacacccagacgacaccacaagacacacaaacagaacgcaccccaacccaacaacccgcgccggcgcgcccgcgcacaccaccaaccgcaacagttctaccaaacaagagttacgcatatagtacaccatatccgcaatataaacgcaaaagagacccaggaccacctagtccaaccacgcccccctcgcccacccaacccctcgttaaatatgagtaataacaacaaatcacgtgatcgaaatctttcacgacacagaagaggagcattgtgccacacgttcgcgagcgcgtagcaggatgtgaccaagagacaaacaagaacgataggagatagaggaatagtgaagacaagggctgctacagcaacaatacgaataccaccaacatacaaccacaacncgcacctcccgcgcctcctcacacaataccccctcacatcatatccgctccgcgtcacttcatggtcagttccgcacnctctcaagcagcggcancgacgctgtagtctgacgcccaaccacgcacatacacacctcgcaccacccgcacatcgtaacacgtcctgacagcacgctgccacacgtcttggaagggtagcgtgcaccgcggtaaacggtacagcagtgtagcgcgacgagctcggcgaacgatgatcgtctcagtgtgtacanctgtgtacacnagacacgcgcgcagcgcagacttcgcacacgaaacgctctacgcaatgcaccgcgagggagagacgacgcactctcagtcgagcactacacacactacacgaccatccatcattcncagcactaagtggctgaaggatgcatctacacgtcgtacatatacgctacggtccgtaacaanaccacgctgatataatctagttcaacagtcacacgccccgcgactgaaggagtcgtcgtgcggcacagctcgnctcgcgcgatcancgagangcgcatccggacgtcgtgacgcgtacatccaacgacgcagacccngtgagncgcncgtatacacgtagatcacgctaaacggacagcaagngacactgcgtatatataggaagagtgcggtacacagagtgctcacattaaccttacaactatatcctcg

SEQ ID NO: 14527 - DNA, 587 bp, Homo sapiens
  misc_feature (1)...(587): n = A,T,C or G
aaggaaananngtnctggtactggggaagattcanccacttagaatanccanatgaggaatcctggatccaaatnatgttttgncaaatgttgttgaanataaaagcaagttgattgctgtgtttgaagancaagaaccactccacaagattgagagccccagtggaaaccctgcagatcggcagagcccagatgcttttgagacagaagtggccgcccaactggctgcatttaagccaattggtgagagattgaagtaaccccttctgctctaaaactaggcactccactgctggtgaggagaagcagtgacccagtgccaggcccacctgctgatacccagccaagcgcttcacaccctggtggccagagtctgaaaccggttgttccaatattaacaaactgattccaaaattaatatggaaatgcaagagacccagcatagccaaagcaatcttgaaaaataagaacgaatttggaagaatcacacatcctgatttcaaaatttagtacaaagctacaataattgactgtgtcgtactgacataagaatagacaggtatagatcaataataaatcgatcggcg

SEQ ID NO: 14528 - DNA, 1245 bp, Homo sapiens
  misc_feature (1)...(1245): n = A,T,C or G
gcgtacctgtatgctagcagtcgacgtatgtgacggtgtccactctgccctgcgagggggatacggaagaaaaagtttcttcgccccgatcgcgccccgccgttcgaacacacagggagcgaagacaacagtagtgtccnccaggtattggtccgcttattacgggtacagagattcgatatatggttatataccataccctgagcaggtgcggagagggggattgacacacacagatgtagtatcacgctccgagtgcacggacggcaacgcgtgccagaatacacaacgagagtgtaggagacccctggtaggtacaggcgccaccacttcgaatgtgctggtacgggtatgtgtttatatcatttgtgcccgttcacacaatcgcggggctcaatgacatcccaagtggctcaacacagtgttgcatgagttttcgagacgcctataccagtattgaacccctgacgttataatgccctgcaagctgacccactgtgtgagttcggatcatatggggcggtaccataacacaacgccagagatacgtggagttgtagtaatcaccaatgtgtccggtagagtgtctgcacgaacgccacctgtatactggcgctcacggttgatccctacaccgaggcgagattctccacacgagtggtatgtgcgacnatactgactccatacacagagtagaatatctaagggncggatacttataactaacatgcggcgagtgtggtgtgggccggcgcgcgccatcggcgcggaacgncancgcttgtggttcgccgccgccgtagttggagaaagtggctacatcatttgagatgtatattatatnacccgcgcaatacatcgcgtaacgcagtctatatatatagngagatatcatcgctcgcgataatatatatatattaacgagctgacaagcgtcggacgtgcgaagatgagtccagatgtcgctacattctgcgcagtggagtttatgtctcaaaattcgcagcctcatatagaatccaccacgnttaatacggctcacacatacatgtgtcncncatataagtaatcgagatctccactctcaagcgtcctaccactaacgtagtaaattatggtaccacagccgcggcgctagtgtcgcatcgtatagaagtcggtctgcagtgaggtatatcactgtctgcatnatagatatattcaaccgcacacacgccaaacagagacttaacccgaattgtgact

SEQ ID NO: 14529 - DNA, 1205 bp, Homo sapiens
  misc_feature (1)...(1205): n = A,T,C or G
actagcacggaagagcactccacttttgacgaacaacgagtgcccaggacgcgccaccccggggatgtgtgtggtgaaaggtgtttttttctatcattgaacggggangccancgacaccacaagtggggacacagacaactcattttctaaacaccaacangtggtgcccaatgccacacacacggaccaacaccgggttgccaaaaagcaacaaagagggtcgtgaggaggttgatagtgctgngaaaaccaaanggtggatataacatgcactggcttctttcctatccgcacacctacaacactcctcggaggtgggcacatagggcacaccagtaggctgaggataacagcacaacgtgacatatttcgngtgggtgaaatacgtgaagggaacaaagtagaatatctgacaacctacactccacgcgttgcctaaggcctgtgcccagtgagtatcctgtaatgctctgctgccatctgcactaataacatactggagtgaatacacactaatctgagtgggaggtacactacccaacacacggcgggatcactgcgatgcagttacatttgggcggtttcctgttgttcttacttattgcctctttctcatttcgcatccgtgtctcataacctgtggtgtgntgttgcccttcttctttatcattcttatttttttccatcttcttcttcttatttcttcttctccttcttccgggtctcccactttctttggtgccggttgccttgagcttgtctctgggcggcttgttgcatggcggtggtcgtgctcaggtcttcttatttatccttggtatgcacttgttatgaatctggtggtgtgttgtgatctcctcctgggctactctcgggtggccgggggttgtctcttttcttctaccgcgctttgtgctcgggtgttactctctgtgttcggcccaccctggtctttgccttactctctatttgggtgctgtcctcctgtgtcttcatctctccccatccgttcctctgtcttacatctctggtttataatgattggtgtcggtgtgtctcttccgtgggggtgggtcgacggtcggtgggttttncttacttttcttttcttcttctccgtttgtctttttatctcgctctccccncgcgtattattcatataattctattaccgtaaactcgtggcacaggagcgacgctgat

SEQ ID NO: 14530 - DNA, 393 bp, Homo sapiens
  misc_feature (1)...(393): n = A,T,C or G
tatgagaggcttttgaagaccaaactgtcagctttacatcacttattatgaacaagcttctttggganatgattatttttgttnaagaacaattgttcagaaagaaacggacctcaccctccaatagttggcactaacacacacacaggtccagggggttgctccccacttaccttcttcctgcctggaatgatgttacaccaccaggagctgcagcaaccatcctataactgtgaggtaaccagcatgtgaattaaagtcaatgtcctaagaatggcagaggaaacagaaagaacccagtttttagactgttgagctcctgcaccagccctaagctgtcttcctctggacttcttgatatgtagaaaaaataataaataacccggatcgncg

SEQ ID NO: 14531 - DNA, 1551 bp, Homo sapiens
  misc_feature (1)...(1551): n = A,T,C or G
acagactcgcctctgcatgaatgcctgcaacccaggttccgacagatatgtctgtacagcggcngagagagcgacgcacancccttgcgntggcgagcagatacaagcgccncaanngagtgagagatctttcccgcccgcagtatccgcatacgcgccgcgcctcatatcgcatatccacnncacattcgatagcagtgatgacccgtcncacggtgttgtactgtactcancggatatgtcacagagtcgtgcccgcngtgtatgattccgcgcggagacacagcgcngtattgacggagacacatgtagttatnattagtacaccgaatccgtgcgagtgcgcgggtgtatgcatagagttttagccgctatggtccacgccgtgtacatgttnttgtcagtagcgcgactcgtgagtgtgcgacgcgagtcggcactacgtcgtcgtatagacgaatcagcgcatgcgaaagtgtagatcagacctcacacttatagttgagtctctgctggctcattgcatttcatggcatgtcttgatgtcgtgagcgagcgatgtgtgntgtagacacatggtagtccgactgtgnatacactcacgcccagcgcgctgtngtgtcaanataaccgacacaagagcgcgcggagacgcgcaccggagagcgaacgccgtngcgtgtgngttatgagcacgcgccagtcgatcaatagacgagtatgaagtcnatctcgngncgtgtagcancatagtagataacgatantgagtgtaantaatgaaacacgtcgcgtacgtgatatagtatatggcgtgtatttnantcaacgtctctcgtgaaaatagactacnccaccgagcgggnggtgtcgacccgatgagggtggtaacacanacatacaacgattgngccgcggttgagttgtgtgttacaatagcgcaccaacagagtagcagacgctgggagtgggtncgcgtccccgacggttagtaggtctcacggttgtgtttggggaagagatacgctangtctggtggtactactacagtgacggcgtagatgatgatacaggagaagtgccgtatacgattgatgncgcgcacaccctagacgcgcatacacaccagggatgccgccgcgcacgtgatggtatatagtagtaaaactaacacagtgggatgtatactcggagcaattgcgcttagtgcgtactaatatatggcagaaaaccttcggtgacttatatgtatatatatngcnactgctgcatgtcgctaagggaggtccgccatcgaatgagcgggcattctatatagaaacaatagcacctcatagatcttacagcgcgcatctcgtagccaactcgtgtaggtacattgattggtgctgatcgtggaccaggctgcgcacataatgtgaatattatactgcgagtgcggccgcagtgccgcgagctcgctcatagcgccgttgtggcattggatgttgtatanagcaccgatacggacaatccacgcgcgcggaaatactatagtagtccgtactagaag

SEQ ID NO: 14532 - DNA, 833 bp, Homo sapiens
  misc_feature (1)...(833): n = A,T,C or G
cgaccgccgcgatcccacttgaattatgaaatttgtaaaagagaaaccattttgtttttctagcaggacccatttcttcttgnaataagcacccagcaccaccagcgccttatagatacaaacaggtcctctattctagagcgggggggggacggctacttatctcacacacacctgttatcagttcccccgtgtctcatctgcctacatctccatatctctagcaacattgtagcgggccctgctatctagcgggaggcaataaagaagcgcatgccggggtaaacgaaacccctcgacaaacagagggtggcgtaatattgcgtgtaaatgaaaacagtcgaacacggtgggcggtaactacctactcaccttatcgagtggatggggagaacaacaatgaaaacatgagaagggggacacgagcaagtgggggcggcagcacaagcaaatctaggggtatggaacaacatcgaacactgtgtgagagcacaagcgtcggaccaatttgggcgaagcgtcatggggttgcaccactctcagatgaggcgtagggaacgaatgtcgagacaacgcggcggaaaacgacccgccagtgggtacacacgacaacactgtcgaagcaaaagggacagtaattacaagaaacgggtggaacggaaagagaatagcataagaggggagtggaaaaaaagcggnggaaaaacaagggacaaacataagagggctgaggaggcggaacacacgtgggactaaatgcactctacctttccaacactgggggcaaggaaagagcgaaaagagtgaagaataaagggggaaaaaaaaaaaaa

SEQ ID NO: 14533 - DNA, 1227 bp, Homo sapiens
  misc_feature (1)...(1227): n = A,T,C or G
acaccacagaaccgcgggggcacgcgggtagaccaatcgcggagaaacgagagaggaaagagcacaagagaaaaagaaaagaaccttaaaaagaggaaaaagagaaaaagaaagaaagtttatgaggggcggggaggagagagagggcaggcggggcgcggggcgaggacgagacaagcacaaacaagtttacagccgcagcagagagaggcaagacacaacgaggacggnncgnacgcacgacccgcccgcccgcaccgccacagcgcacacgcgcccgcgcacaccgcgcacgccgacggcgggagcggcgcaccgcacccaagacaaggacaccaagaacgaaacgcggagaactaacaacacacaccgcacgccgccccaccctcgaacacccccgcccacacgccgcccgccacacgacaacagcaccccgcccccacccacccaccggaacggagaaggagcagaggaagaaaaacccgcactacgatcagaagacgcacganaagaaccggagcaacgcggcgcggacacgggaagagaggacggagacacagggcacagcanaacaaacgcgaaaagaacgaccagcagcgccgccacccagcagcacagcagaagcccaggccaacgaagagcagagagagaagggacgagacagcacgaacccgccgcgcgagggccacgcgcgggcggcggcagcgcgcagaagcgcgcacgccgccccaccagcgggcgaccgcccacgcgggcccgcgcgagcgcgtcgcgcgccagggcgagggcgcagaggagacgcggccgggagataccaacccacgccgcccgagggcggcgaagggcgcgaccgcacacgccggcgacccggcagcacgcaggaacggcacggagggagacgcacacaagaaccccggcgacgcacgcacacccgcggcgaggccgccgccaccccacgcccgacccagcgcagcacgcacgcgcacacaagcagaagacaaggaaagacgagcacgcgagagaagccgacgcacagagaaagcgaagcgagcgagcgcgtcgacctcccacacacgcccagaaagggcgaacgacacgaagacagaagcgccagccacgaacgaaaccgcagcgcgcagaggcgaggccagcacaaaaccgcgaacgcgacgagcaagaagcgacaccggagaagggagcgaaacggagacaaaggagcgcacgggc

SEQ ID NO: 14534 - DNA, 804 bp, Homo sapiens
  misc_feature (1)...(804): n = A,T,C or G
aaaaaaaannannggngncgnanagnccagntnattttnttgtgggccctntaangggccctccttngnagnaanctntntatnagttgncnaantantcggattttncccccnctttttannnccgaaccngnntgttaattgntnnancgagttnnatngcaangncgtcccggnagcanccannannccantgggctcaagtnnttacggacntcactatagggcgtacagggctgtgngtggcncaagggagaacactangggganntgggtctacttgcccaagccgtccctcagtgcctggnccagntcggtggtccctncctccatcatgctggtcacaaagacccaaagactcaaagntgcnnacatagnagccagccaaaacctgccagaatccgaagatggcaacaaaagtgacttcgtggtcgtcctcnctgcaacattatttgctgattataatgcattatangatgctaaaanaccctcccngcntgcctaccaagacagcttncagatgccatggcatcttccngaagctanncgagggagggtctntcagttccaggganatcccctcccctttcctgnaaatctcatnancagtcctccccttgtttngcatgcgattcnagaaataagccncgataaagggcgttcaaatgnanntnntctcnngnnnnnnngtnaatncttcgtgaaggaanaatganatatngnanannatnnngaataantncnnnnnnagnanantgttgngtnntaangnanaaatnnnnnangaanaaanggnntggggaa

SEQ ID NO: 14535 - DNA, 1519 bp, Homo sapiens
  misc_feature (1)...(1519): n = A,T,C or G
ccatagccgttcatctaaatgctacagacgcggatcggacaagctatctgtacgcgaactagaagataccgncntgttagttgtgtccgagctatatattaacgagaangtaatatatatgatacccctccgccaatatcccatacgccattccataacgcgattcgcccctatgttagtgtataatgtaccactctcgaggcgtgtggcaataccctggctgacactatatgacccacgtantgtttccaggcgatggccagatcgagtatcgcagatacaattgtataaatgtaccgccatcccacttcccagcgagtttggtgggttggtaaagttgccacgcatccacttgtgatcgttccccaacgcagttgcggtgactgaaacaattgaacaagatataatactgggaccgtggtggagagccaccgtagaagagcggaacgccaacangagtgaaatgtatagactgagcgaggcgtcgtggagtacagtataactacgagacattacacccagtgaggataacgagtaccacacacaagggtgtccgcatcaaaaatgatgcgatggggagctcacgtcccaccacccccgggtacccacgacgggacacgattaaagccagtagtgtaatataaacacaccactgattattagttggtatggtaattagcaatggcgcatgactaacaacaccccccaccagggcatcattcaccatcccacgttgtgacgcaancactaacacatcgtactctcgtgtcgncatgcaccatatcgtaatgtatatagaaggacggagtcacacgctagcaccggcgatatcgaacgagtcgccgtcacccgtctgtagagatgtgtcacaccgctaggcgtgttgtgtgtggtctatccattcactagtccgagcggcgaanatatagtacgtcggcagaacaactacacgatagacactatgcatgcggatgtgcgtagtgtcctgcgcacaaccgcatcacgtcggcaccagtatcaacagtaattatgcagcctcgcccacgagtgtgagacaagctagtgaccactaagactgcgccggcagaatacacanggccgctatagaaccacgagtacagcggtcaaagatatattcgcgatatagacacatctcggccataataanatatgtatgatcgccggcgcatgactggttcgatcgattgtgatatccagagagcagcgaccactagtggatagaaataatataataataagtagacgccagcgaatagcgtacgcaatcacgatgcggtgccgacggacacgtaagtatatctacacgaatagaatatagatgctacacacacagtcaatgaacaccattttggttagtaataattaggctcctccactgtgatagttgtccttatgcctgcaagtgagcggcgtacgtatgctcatccttctgtgtagtgaatcatatctttatgtctccaagcacgccataataagtagaaaacggactagaacagta

SEQ ID NO: 14536 - DNA, 891 bp, Homo sapiens
  misc_feature (1)...(891): n = A,T,C or G
cccttctttcttttttttctttgtttgcttttctctttctcttctcccgtccccttttttttttctcttgggtgtgtgtctgtcccttgtttctgtcgtgtccgttttttttcccctttgttttgtttgcgttcccccttctgtccctttggcctcccagggggctggcgggggtgtccgccctcccccttgtggcctctcctgtcccggcccggtgtctccttcgggctccttcccttcccccctcgggtggtgggggtctccccctcgcccccccgcctgtggtgcctgcgccggtcgcgggccctgcccggggtgtgggtgcccccccgcccccgttgtccttccttcttgtccctctggccttggccgtggtggccctcgtggtggtggggtgtgccgtggccccctccgggtggggctgccccgcctgttggccaccgctgctccgggtgcggcccttgccccgccctcccctactggggggctgtgccccaccccctccctggtgctgggccccccctgggcggacccctcctgtgccccactctgggttgtaggggccgcccccctggggacccctgctcctcccccctccccatggtgccgtgcttgtggccctcgctcccctcctgtgggggtgccccacctgcacccccggcctggcccttgcctcctcggaccaggctggctgggtggcctcctgggctggcccggggggccacgggtggggcccggcccatcccccccgggcggtgcccggccctgttggtgcccgggccggcctgcccccccggccccccccgctgtgggccgcgctggccgcaccnggggcacactggggcgcccggggggggggggccggggtggctggggcccgccccccccccg

SEQ ID NO: 14537 - DNA, 1779 bp, Homo sapiens
  misc_feature (1)...(1779): n = A,T,C or G
gtgtttaaatgaggttttattnaaagtgntnnaaccttattttnnntnacaagcctctcacaccgcacacctctccnncatgttctcagcaacattgcatgcncctcctattcctctctagatcctcctcntactttcttttntagtatattggagtatgacgngcnagagtcatnncaatatactattccagttatgtattgcaactctctccttacgtcagcgtattacgcgntatctcncagcgcgagtgcagaagatcagactgaagcacgaanacaaacgcaacacagcatgaatagngacaggacacgcacagcagaggctgacatattgtntcgccttctcnccttataaccntccactcctctcattgcatctgcacttatataattnnccactgatatctccatcgcatcagcgctactatanntagtatagaagtcctcgcgctcttctatcttctatctcagtatcaccccaccacgatcgatcctcgtcncntatgtagtcacgtcatnacatcaccaccatgtcatcaacgtntccagcaccacatatccaccactcctctcacaccactcctcagcgatactcctcactgtctcatcgcactantaattntagcgatcgacgccggttcatatgtccgtnctacgcagtcttnatcgcttncttctgtagtacgactnatagtgttaataggatagataggcngagaacgaacaaaatcatggantacacacgtgtgttatataaggactacgtctacacaaatagatgctctagagagcgtcactctgtatatagatcnaccgacagtacacatgatagcatataaagattacctccncataccttcataatatcacgttcgtacagtgcnctcattacactctataccatatcgtactcgtggtcgcntctatacctgacgcagtcgcatcatcncacgagactccatcnacacatcactcgactagcagatcacgttctcacattcntcagcgccttcgctcactttctcnctcaactttatctatctcttcactgcatatgtccacacgtctcttcatttcagtaactattactcacctgtgatncatagcggtgagcatgtcgatcgacttccntcacgactattacatagcgtcccacatactgctacacananctcagnncntatcatgtntcgtgtactcntcaatagtagagtcnntacgtacacagaagatattnntatatagtactatgtacttaatctgcagtactctcgccacgtacatgtgtagtntcnnntgtcgcntgcagtatgtgcctctcgtactcacacgtatcnccatacactntcncctatatgcntgcgcctcacgtggcatacncagagagatcacatcatatatcgtgcgctacacgctntccnctctagcgcgtctcatatgtctcatcctnctgacatatcgcncagcnatcactcntatcnancatacntatacacacatcatacatgtgtctcactctctnctactatccgtatatagtatcgtnctactgagttnnncatatgtatcgatggttnngaagtgtgacattatatagatgactacacgatatatacatntgtgaggtacgtntctagagtaagtattncgatactaatacatgtatagtatantatgtggagatattatgtcntcatgnacatatgatgattnantatnagtgtatgtntgcttntctgntcgctatcgatgttaagntgangantcttgtaatacg

SEQ ID NO: 14538 - DNA, 349 bp, Homo sapiens
  misc_feature (1)...(349): n = A,T,C or G
atggagcatcntgcntattggttcagcctgcntnaaactcaacagatggcgcacagttcccaacttgcaattcttgagagctggtgctggtgctggaataatctgtatcggnaggaggattntgctgtacatctcacctgtgatcnantaatgcaagtcaatcntgagccttcccttgagagcagacatgaagatcaagaggtgctgagaaagtcttttgtaggactcaggaagaaaacttaatgagacaaagtcattcaaccatcatcgtgtggacagagaaactattattatagcacatgcctaaaagaaagtaaaataagatcaaagggaatgttccaatgaaaat

SEQ ID NO: 14539 - DNA, 308 bp, Homo sapiens
catatggagtctcgctctgtcgcccaggctggagtgcagtggcacgatctgcgacctccacctcccgggttcaagcaattctcctgcctcagcctcccgagtagctgggactacaggcgcgcgccaccatgccagactcattttttatatttttgctagagatggggtttcaccatgttggccaagatggtctcaaactcctgacctcatgatctgcctgccttggcctcccaaagtgctgggattacaggcgtgaaccaccatgcctgacctcaattttctttaaacctaaaactcttctagaaaat

SEQ ID NO: 14540 - DNA, 383 bp, Homo sapiens
  misc_feature (1)...(383): n = A,T,C or G
ctggaaatgactctccctgaagttaattcctcaattgtccttgcactgtcanatgcctttctttctgaaggatttccttaatccgctgtggtactttaagtggctgtcttgataacaccaaatgtcatctggcaagtgaatgaccttacctgctatccacatatattgtcagagggaactgtgaactttgttttggctttaattttaagagcctgaatcccaaggcagatatcacaaacatgaagacctatcccattcctgcttctgtacattgctggagaataatagaattattgctctttttatttgtgtttatttttctatttttggaagagctactcattgttaagtgatagagaaagaatgccaataaaccaataaac

SEQ ID NO: 14541 - DNA, 1194 bp, Homo sapiens
  misc_feature (1)...(1194): n = A,T,C or G
cttatactgctgctaaattctcaaccactccgacaatctgtcttcccgtntgntacttcaacatttatctgtccaggttgtgaagtgtccacaatgttagactccctctccgattgcgcantcgccngcccgttatcccagctcacccagttggaccagctcaaccaaacaagatgtagtcagctcgctttttcctagtgttgcgacgtggttgaccagtgtgcaattttttccgatacttcttgtgtgatcccgccacacgtggccggtggacatggtgtagcaattaccccactacttcttataccagtcccgccacatttggtgggaaggcatacgggaaacataacgggcacatgtgagatcaatgtgcgtgtgtgacctcagtatctactagttcgctgctggcatgacagaggccgtgtttgtagcggggcatgagttcagaaaaaggccgcaaaagacgaaccgtggtgggcgcgcacccaccccgtgtgcaccccgttcactattatcctatgtcatggtgcaacccacggagtggaagcgagaaatgaaggacgcaaaacaaacacacccacggatatagcattatgtaagtccacctaccacaaggtgtgccgcgtagttggtttgacttgacagcacaacaaacatgggactgggtgtcgacacccgaggtgtatcgcccacctggttttgggtatatcaactatgacgatggatatttgagcccggttattctcacagtntccccgttgtcgtgttcccgccacacgtcccggcaccgcctcttatggtctgcgcccataattgtaacatatttctataagctgttgtgtgtacccgcgcgataagtctancatcggactttatttaagcgaataacntacacgtatataataatttgcggcgaggccctgcgggatctgggtgttccgcggcgctatgaacgtatcatacgtacatagtccgctgactcggcggtatgctgagccgcgtgcttctaacacacagagtgtattgcatcattaataatatgtcctcctaattcagccaatgactctataatatttgttaattttcgcacacatgtctaagatacgttccttccgattagcgagttgggagtatttataattgatagacaaacgacccgtcagaccactgagatcattcattgcggtatgtggg

SEQ ID NO: 14542 - DNA, 896 bp, Homo sapiens
  misc_feature (1)...(896): n = A,T,C or G
ccaggggctggaagaatggggggaaaggagagaaaaaaaaacctttttgtggcctgggagtttcttaatgcactcagggaangggaagcggccgggtgcccacatctcttgtttgggactgatgggaggggggtgagtgaaccaccactgcgggtcccgtgccaagtgctacagtggtggggtgcactggcgcagtgcacggaacacgggggggacacacgaatggacggggaaacaacaaagaaaccgggaggggaaggcaacactaaggagtggtaaggggggacagaacaggatgcacgtgggattgggtggcccgggaacatggcaggggaagggggggggggtgaaatggttgatgtgtatgttggaggcaaaagaaggggcacaaggagggaacatggggacggaagggacaaaaaaaagggggggagggacaaaggggaaaggggcggcaccccacgcctggaccaagcacacgggccgacactgtttacatgaccccatgggggggggaagaagagacagggggtgggggcacgggggggtgactggacaaaacgaggaggggaacactgggacacagacgggacggcaccaaaatggggctgggaaattgggatgtggggaggaaaaaggggcgaaaatacagaccccgggggnggaaaaagggaaaggaaccacgggggaaatggtgacaaacaaatggtggacatgggtgagggttgaaaaacaaaaacaaaaaaaaacgacagggacacaacaactgtggggggggggacaggaagggcggaccgggacaggacgacagggaccaaaacgagacaacaaggggacacaatgggaagacatgggatggggaaaatgggaagggggctggaggggaacggaccagg

SEQ ID NO: 14543 - DNA, 1427 bp, Homo sapiens
  misc_feature (1)...(1427): n = A,T,C or G
attttattgtatctcaagtaacccttggnngcgttgttagggttgtgggaatgtcgtttatantacgaagcagggagtacgccggnatgttataacgacaaatacagcacgnacacatatctttcaccatttgtacagtatgacctcccctgcaatattgctattttctttccgtcgccgcnacccggcctcacagacggcccgccacccctctagtcgtcgttntctgcgccgtggctctgtgccacggtgnaccgagccgactaaacccacttcactcaaagaacacctcctcncattgttttctatttatttttatatagctgtagtagccccacaacttanccgcccaccanacattccgcatttgtccccacaactaggttctcgatagcccacactgttctagaatctctatacatttcccaccctcatctctcctcccacatcgctacgtctggtactagtctgttcactcccacacncacatttgaattttatagctatntcacaagtccatcatgncgcgccaaggtgtatacgattctgtctcgttgactgtgttagtttcattctaaggtaatacgtgacatgttctgtttgagagcatttgttagattggtggnttatgtgttatgaattgcatagtttctcattatgatatatgattttcatatgacatgtgaggcccgagtctacacggcgcatcaattaccatacatgctcctactactcccagcatttcattattctcattctcctatgctgtctgttgcttcagttgtcatactctgtctgtatgtctgtgtaatcagtctgtgcatgtcgatctcatgcttactgtttagcactgttagattgtagactctagtctatccacatactgaattgtancgncatctagcaatccactgaccaccaccagttcattacgtccccgtacgttgtnccgtatcgagtctcctacgacgatattcncttgtttgcatgtgtncctcttactcgacatgtcnctcatgataagttgcgcgctgccttatgtgntntcagcgtcctctactgccntacgcctnagttctcgcgaacccagtaaatgtagaaagtgctctctcatcgacgntcctacttctatctgctataccgtggtctgtancaccaatacacacagngtaactcagtcatgactcnnncgtcatgtacagcgacgancgtattgcgcttncacattgtcacgctgntccnctgattatttgtgacgtgactncatcagaccgttctcntcagtgctacttcntatcatagtatctcagaataacacttatctctnatacattccctatctatgcagtcttcatctatctgctccntgtgacacatctatctatcatcaccatcttgtcactaatatttncatatttcgagtcatt

SEQ ID NO: 14544 - DNA, 355 bp, Homo sapiens
  misc_feature (1)...(355): n = A,T,C or G
ccctgttttgatctggtgccattttccttctgtctgaaggactttggcgaacatttcttctgatgacctgggcatgctctgggcattaagtgctaattcagaagatgtgtactcccaggagagacagaagggtgatgctgagacaggagaccatctctggcacccaagacaaagcactgggagacacagctctcctttgtgttacatcagaggcatggagaaataggccataaaaattcaatgacccagcttcgccggttgcaaaattcagatgtcgcttttatagggaggagtcactgaagtttcagggctcattctacttattaatttgtgaataaactaaagcagatcgncg

SEQ ID NO: 14545 - DNA, 344 bp, Homo sapiens
  misc_feature (1)...(344): n = A,T,C or G
atggctgacccanagctgcaggaagacagaactggggaagggaaaagtctggatggaattgtttcaggtcaaaggttgatcttccagaggctacactgattaggaatacaaaaggaggaatcactggaaacctaaggttggaaatctggacaaaatcagacctgccctanaagatgatgctgtggaaagtgtttgccttttgtcttataaagaaccatctataaaatggatcattttgtcgcttgtctctccagactatgaaattggcattttgataaggtgatggaaagaaatttgaactatttaattactgattttgattcatacaagccttgactctttta

SEQ ID NO: 14546 - DNA, 1774 bp, Homo sapiens
  misc_feature (1)...(1774): n = A,T,C or G
gatgatcccccagactaactactccnctcgagtcccatcatactcggcagtcgagatntgnactactccgcanaagagttttgtncttatgtgtggatgcatgccnaacatgctaatcctactttctcgcagtacgtcgtacccgctctgcgtgtcccactccncggccaagtgagccattactataccaccgcntgtggttgnggagcccatgtgtgtccctgcgtgcgcgcacggtgttgcggcttggtcctcttgtgtgcggggataaattggatttatgtaacccatcccactgtggacgagtggtgcatgtggaggcacggtgtgccacacctataatttgttatgatctcgccacacccgtgtacacagcccatgcaaactaggtcgcatgacagaaaaacctcgggcacgtgtgaggtgaagacgacctaggtagcgtgatgtgcgatacttacagacgcaagtcggtcctacgacgcgtcgacgnagcagagtgcggattgtggagtgcacacacgtagtgctcancgtgtaatcgtctccgcgcaatgcctgcaacatanatattacacaagactanagcagcgtacgcgaactgagatataaatatgntagatatcgcgtgtgtgtgagntgcgctacgcttctcgcacataagtcccacgatgtgtngtcgaccaccgtcantggcacgacntgctatacatggcnctacttgtcacatatagacgacccacgcgacgcgtcaggtgtgtgttgctcgtgtgtaacgtcaatacgcgatgcgtggagatctctgagcgcgacaccacgatgcgctaagagtgtgcgncgcggctgtgaggagacgacgtacactcacaccnangagtcgctgtcgtcgngaatgattgtgtgggctgtacatgatgcacgatcacatcaagaacactcacggagcacganagngtgtgaggtgntgcctacacgaccagtgtcgtggtgtgcngtgcgaccaccacgtggcgtgtgtggtgtggtagtatataacatgcacacnacacacgaggatcgaganagctnttctcgcggacactagatgcgcanactcacatctacgccacaccgtcgagcgatgtattgccgcggcgacacgcagtgagcgcgtagatacaactcngctattgtgtgcgtgatcacacgtgcgtgtggtgtantnangagttagatcgcacggcctcgggtcgcgagtagatcacgcgcggctcttaatatcgcaatagggtcgatactatgtgattcgcgagtagcgctgcgcagccgcnagatatagtatgattantgaccgcctcagccatgcagcgactactctatancacatgattaccanagagacgaatctacatatagtgcacagtgatgatactgacagttgtctcnactanagnacgcncgtgacgaaagtgtgctagtcacgtagagtgagtataacgtgcaatcgacgcatcaganatgtgcgtgcacacagtagcgattgntgataactgtctgcgtgaggagcggtaggcagtcatgcgacgagtantagaatagtgacgctgcgnctatcgcgtacgcgctgatcgtgtacgatgtggttanctagtagcacgtgcgcctggatgcncgtatctatgtgcgttntgactctgtcgtcgctgtcagtacgatcgacgntacatnactacgcgcatgctactgcggctntntagaantatatcactatgctgncgactcacagtcatgncnt

SEQ ID NO: 14547 - DNA, 178 bp, Homo sapiens
gcgggggcggtgggggagggggatataaggacagggatactcttggcctcgcactgcctatttcacttaaaccgctcacgcagaccgggctactgacacaccagtagtcaaacttaagcgggggtgactgtattaattaacacaccggatacaggtcgagtctctctttatcggattt

SEQ ID NO: 14548 - DNA, 1492 bp, Homo sapiens
  misc_feature (1)...(1492): n = A,T,C or G
gcgtgcacgtcgtctnccacgtcnaactttctttcccgttattcatttcagaaagnnnnagcgggcgtgtgtgcaggttacagatggagtatgattccttcctttttttgactaacgatagagcacggccggtggtctttcgccacacagggatacatacgccctcctccactaaagataanaaagcccgcgccatacgcaactccttatcctctccatgtcagcctgatcgccctcactctactgaggtnaattttcttgtatgtcgtatccgtaggtttaattatatgntaataagtgtnttgacggtattggagatcatgattagatgtannnaaagattggatgatagaaatgtaataggntgcccatacatctcctatcatgcgttctctatcaatagtacaacaccnncacgatcgttattactccactagactcacctccgtactatactcatctcactcttatatcttattntacatcttattctctgtcctcttcttgtttaacttaggatagtatccaagattaatgagacgatgctacattactgacatgtccgtctcgctagagcnacgcgcatcgttccatcgagctcattcncacctgncacgcatatataacaccttactctaccaatctttnatcaccactntcacacaatntgagtgtaantagtgtgccngntcgtcgtgtcacgtgctganatgatccgtttgtgattgttnctgctattcagtgagtagtattgatatattcccactttatcatacttctagtatgtcttntagttnaacacttataatanacatgcgacgataactatacatctcttctcagacgagatatgctcgatcattcctcacacagataagactatctcgattctccttcatatatctaattatcatgactatattcatattctatcacatatataatatgttacgacttatgtacatcgagagagttctaatatatgttcagagtattatagagtttntncgtagatagtccatccgaccgcacaccataatatattctcaatagatttgagtgagacactaagtatgcnnagactcagcaatnccacgtcataaacactaagactgcgctgtgcacctctcatctacncacactagatcagttcacgcgacttgtgccaccacgcctcttttatcattatgcctagccgcatncccgactgtgagagctaactcatacgtcacacgccatacgcatctccgaccaattccanctaaccgctcttataataatagtcttannnattgtgtgtgaaagagttacattagtaacntagcgcagtaggccncagcgcacnactaagcctccaaacatccgcaacactccacactgcagaccgtccgtatcactgttctatatattcacattgccgtttctcatttatacttatatactatcgtcactatatcgacaccacatccttatatcntatattttcactcat

SEQ ID NO: 14549 - DNA, 493 bp, Homo sapiens
  misc_feature (1)...(493): n = A,T,C or G
agggttttctcttgctacccaaaagccntcatttatgaantgncnccatagtgaatataatacatgacctgcncatccagaaaaatatcccnacctatgatggaaatgactttttcatatgacaccatttttggaatatccatgtgactttctgagtttatagaaatgatcaagaaacgtatatacatcaatggagaaaagatcttttatgggcctgctatttttgcctgctgcttcaactacaagtctaaataaaaggaaatcagagaaatgtttctcaaaaaagaaaaatactgaagatcaaaatagttgtaagatggtacaatgttctccatagacttgaccttaagcattctggtagagtggtcatttattttctcaaggatttgattttcatgtcataccgctcttcagcaaatgccacccaatgtcatctctgttaaagtcctaaatatatgcattctaaaccacagctcaaaaaaaacgatcggcg

SEQ ID NO: 14550 - DNA, 1346 bp, Homo sapiens
  misc_feature (1)...(1346): n = A,T,C or G
ccgctccgcggccgacgtccgagccgacgcgacgtaccgctatcgcgtgatcgacgtgacggccgacctttcgagtgcggnagagaaccgtnggccgagctatgtgtggccttctgcccgcggtatcacgtctccgggccgtgtgcgccatgcatcaccagtgtatccataatccacaaccccgattgttcgtccccccgtgtgtccatttgcccaccggtttgccggcggtgccagtgctgttggctttcntttgggtggtgtcccctcncctcgtggncggcgctaggtgtgtgtatgtcgtgccccacctgttcgtgtggtcttgcgcgaccgcggtgtctggcgctgtgactagtggcgagaggaccccggcgtgccgtggtgattagncccgcggggtcgggccgggcccccgtgttgcgttgcctcgccgtctgccgtggcggtgggtcgtcagggtggcccgttntttccccgctgcgcgcggtcctgtaaccgtccttcggtgctcgcgacaacgagtgtgtgcgggatgtattggctcgtcggcgccacatccacgtgtggagccacgccgccgggcgcgcggtcaattgcacgcgggacattactcaccacccccgaggttatggtgcctgcttctgaactgcgctgtaactacagagcgccgcgcggcgctgcgaggggcgcgagcgggcggccactccgcangagtgggcccggtagcgtggtggtgtctgtgttggtatcagagtccacggcggtgcggtggtgtgctccaccccgggcgtgccccccctggctggttgtggtactctctccgtttgcatgtggggacgcgagtggcggatatactttgtctctcttccacgttgtcgtgtatccgcnccccaccgaccgcctccgccactctcatgtatgtcggcgcacgctgtggggttgtatcatggtccacgcactacatgtagtagtggtatctgagcgcaatgtctgtcgtatgtgggattagttattctcgcgaggtgccacgggcgagctgattttatttgtattcgcgcgcacgctgcctgtgaggatgctggttgtttgtcgacgggagattgatccgtgcgtttcgttatgtgtctctcttctcgcgcgcacgaggcgtgccgcgggcgggcggccgcccgcgctgtgtgcccagtgttatatagatatctgtcgctgcctcgcgcgtggtatcgagtgtaggtcgggcgctaccggagtggcccgtcgtcgccatcgcccacgtgttcggtcgtctgatcgtcggtctgtctggccgagcgcgagtactcgtcgattgtctgattttctct

SEQ ID NO: 14551 - DNA, 1249 bp, Homo sapiens
  misc_feature (1)...(1249): n = A,T,C or G
acgcgccgagccacactgcgcaccgcgaacgactnacagcatcgcgcgcgagtannngtnnnnncccnnnnnnnnnnngnaatttatctctctagnagactcattcagcnacgctctcgtaatttcatcaagcttntgaaanatctcggccttacagccgcgacgagncacgntagactgtacctngaaacacgacacgacggtacgttncaatatcgtatacangacgtggatgagatggaacatcnttatctcacatctacatcacaacgcgggcataagcagngacacngcanatacacacntgatatatcatcacactgagaagtacaagtataatcactactctcttatacgtacatctgtgtggaacaccgctccacctcattaggttatattccgctagatctacacgcacttatgagactctgaagtataactccactccatcatgacttgatgaggataacgaataccagtgcataggtgggagggacgtgctaatgttcgctccatatttcttnaatgtattgctatccgatctaaacctacacaccgtttcttatgatttgaggcctcagacagacaaaccacaaagccttgctctagtgctatcactaaataaaataagcatcggcatatgtgattttccccgcaaaaaaacataaattagataaatttattcatgtacccaacaccagctcttgtaaattgatgcccatcgatgaactaacataacatttaattgggaaccttcaatgtggcttaaaaatctaaaattgtggagtgcgttcattaccacccttaaaacaatgggatcatgctcttaattcttacatttcatcaaacaatgggggtatagtaattttgtatcgcatcctttatctaaacagaagaaagagtgttcgttctcattccctcgaactcaatatgaanagagtggttggccgggaggagaagaaatcgctactctttcctctttttgattaatgtacggagacataacatgctgagaacctacggctctaagtctgttaggaatccgggcgcgcccccttggtactgaggagtgcaattgacaatattacacattagaatcgctcgtgcggcgcacgtgttcggccctccgccttataattattggtacaaggttgattattagataaagacatggtacccaagatattcagccgggcggtcattcgagtcattctagctacatgataatcttaaggtgtgtgatgcaaat

SEQ ID NO: 14552 - DNA, 1669 bp, Homo sapiens
  misc_feature (1)...(1669): n = A,T,C or G
tttttnaatctgtttggtaagaggtnagattatnnntatacaacacgcgacgcctccgcgaccatactacggagagatacactacaccaccncagcccccgcccnnncatcctcattntaagtacaatacagacaangnctgatccttttcgtcttntatgtatgtatatgtcgtcggatacnggtatacgtgcgatgaataggncattgatcacctctagttaattgtatccctatcagantacattagttctaacagaaaaagaggaacaaccccgcatgagaagcgcgagctcaccccgatccgacagacgctccacccccgggaacaacacgcacatgtttcagctaatgactatacacgcttagattcaaacaatcgtattaaatcgaagagtatgtacgaggagtaacgacagaggtgctacacagcagccccggggccgtctccatcaccgcgtctctcctctcgtcccacgccaccacactcacctcactccaagatagtctcgagatctataatgtatgacngacgagacaggngagagttcagagtgccgtacgagtagacgcgagaagccgcangagtacnntcggnacatgtatgatagtatgatatatntatnaattatacataagacagaattacngatcacagatcgcatagncgctcnacactaccatcgattactgtcaatccgatcatcactatctccgtacgntncactcatcgactctagaatngatcatncgatgtgatctacacgcgtactctgagcagtctcgtctancncnatcgacacacgatgacaaaacatanatgacatcgtacacacatncaccaanantcatacagacactagtctcgttacagtatantcangcactgaggatgactgtcatgtcntatgcgcacgctgttgtctgtctaccnctccaccattcnactcgctctnctcgtgctctgtcgactcgcgatncacntaccagcctacagcagcagtnacacactncgcgtcacacagcacgatctcattacgcacatntacatatgcgcacagacactcatcacgacagtgtcagctactactncatcaatctgtantaacagagtctctagtgaatgtcnacacgatactatactcgtcnnnnatcactaccaatcgcnnagcgcatccacgtgatcagctccacactacatacgagtctctanctntcgctgtcagtatctcnatgatntctacgtctcntagccactgttcntcattaatgtgcagaacacagccagactgncaggatcnagatcgcactctctccactagncgacctcncgagcgancatacctngtattntatatcatgtcacatacagtagacatctcgacatcatanaacactacagtcagtgagtagtantncctgccgcgatgagtatatgataacacgcgtagtcgactagcgagctgcncacatcaccgacacgcgatgagtgcnncaatagtatagatcctacagtgtaantagacncagcagtgaatcttcaatagtgtattagatgataacataagctgttattcaagntctatctaactnatancatanatangatgtgctatagatctnctatcctccgcatcggncgttctcatgcagcntacnagcnagtatg

SEQ ID NO: 14553 - DNA, 359 bp, Homo sapiens
  misc_feature (1)...(359): n = A,T,C or G
taaaaaaaacagtcttaggagagggaaaagaaagttgtttattgattagcccaaatttgcccctacctatatgtaatttgaaaaagggaagaaaaatgaaataaagcaaaaacccaactcaggtgcacagaatatatttttaaaacataaaaaacaaaacgcttgtttttctcctcccaccctagcctatatttattttggctgctcacacctccctccaaatggttgatcaaaacacaaatccttctgggaaaaaaagcttgaatatgatgatttcagtctcagaattattttctgaaaatcattcaaaagtattaatatattttgtatagataaaaagcggatcgncgtnnnnnnna

SEQ ID NO: 14554 - DNA, 185 bp, Homo sapiens
  misc_feature (1)...(185): n = A,T,C or G
cgttcgcgctgcccagcaccggagcggaacgaagaacaaacacaaaacttgcataggtagcgacaactgttatcncttcgaattccaaccccccttatcgatcaccacattatacatataccaaaacatgaatgcacaggtggaggtgccgcgttatacgccggacccggttgtgaggtacagtg

SEQ ID NO: 14555 - DNA, 403 bp, Homo sapiens
  misc_feature (1)...(403): n = A,T,C or G
gggacaggagaacatgagaaacagtttggcttctcatcctcgaccctgctcaagtactcgctgaagcgcctccctgcagggtcaggagcagcagaaatacggtgacttctgcttcagttttgttttagcccatggaaatctgcccacctgccaacagagcaactgtgcctttcccagccctgagaacaagcttttgggaatgaggatttgagtccattgccaaccagaaaagtaataaccttgatgaaggatgaaagtattggaaatgttaggtaaatagcatgtgaatgccacattgcccctaaccttagcaaacagattagatggagtcaaaaactactatgttaaaaaataaaaaataaagctagatgcgnccgccaccacggtggagntnnnnacgatc

SEQ ID NO: 14556 - DNA, 895 bp, Homo sapiens
  misc_feature (1)...(895): n = A,T,C or G
gcncngagtatganntataaattttnnggaanaaaatnnanagcttttcagaanggccgttatatangnnatatgacatggggtgaagtcacaagagnncactangtgatnnnctagnngngacnnntannaganataaattanagagatcncntnccctctttaanttngggnggcgaataccanatatacagtngtacagggacagtgtacnataannntaanttnatncnatatntatacaananagggnattggggccatcaagaggnagagtnnnactataanaccaagtaaangcaacntnggagtgatttgtanaantanancataannttcactngtccacncancatnnaagggnannttatngatntaaatgangtnnacncagngcaaaatngagcncaagatannacnagnnaggcncgggaaacncgtggtcattccagggctntaggcagtagaaagtgncacattaaagggaagtgncaaagaaagccctccctctggaaatgatttggctgtggctggcatcacccagntcccnncaaaangccttcctttcanntgtaccccgaggcccatcttggctacntacagtccccttcctataagcancaagttattntccatancagctgcaaccactatnanttntggattcncctcactncagtccaagcagtgaagtaagacagtcttaccggctccctttttctgnaacgactctaaacatantgtgaagactaagtnaagagagtaatataagannngtagggttnntaatannaatagnanntnnaccnatnatnatntnnngaganaaagtangnatanaanagnaatattnatnattanaatagananaanatanannnnaanacatgaanga

SEQ ID NO: 14557 - DNA, 736 bp, Homo sapiens
  misc_feature (1)...(736): n = A,T,C or G
agaancttntttttagntgnncaancatttcggantttccccnccccatntaatcngaaacccgaatgtttnatnttggcnaaacangcttncaaggcaatagcgggccccnggggaagnaagaccaaaggcccnatggcntcggangtaaatacgncntccacnaataggggggccaagacggaggtctcccttngtnggcccaggctggagtgcaagtagcacgatctgggctcaatgcnaagctcctcctccctgggttcacaccattctcctccctnnacaccattctcctgcctcagcctcccgagcagctgggactacaggcacccgccaccatgcctggctaatttttttttgtatttttagaacagaaggggtttcactgtgttagtcaggatggtctcgatctcctgacctcatgatccacccaccttggcctcccaaagtgctgggattacaggcatgagcccccgcgcccggcccatcctggaacatttttaactcatgagacatcaacatcaattagtagtcttgcaactgttattttcaaaatgtaaaataattatatagagatgctgaaataattttttaatacatgaaagtatgaaataattttttcaatgcaggaataaaacagngcggcgtnatnataanaaagaanaaaaacnntaaaaaantnnnaaaaanaananaatnnnannaaaanaaaaaaaantnnagtaannantnanag

SEQ ID NO: 14558 - DNA, 590 bp, Homo sapiens
  misc_feature (1)...(590): n = A,T,C or G
anagggnctggcaccaggnccnataattngtttcnccctccctggggagggctncccttgaagnncgnnaaaaaaggggnttaaatgggcaactngnaaaanccccccaaaaaaaaaataanaaccctggaacaaaaatggctgagcagggaaaagctggggcaccacatgcccatcatctttaagagtacaatgctgctctcattcgcaagctagaggatccccttcttagcaatccaccttagtctttcatactccgaatattgatagccttgttcttacctagccttacctagtctaattattttcatttttaaaaattgttctctaaaaatgttggctaatttgaaatcacaccaaaagatactttattcttttatatttttgctgtgtaactcctgcttttgaaaggatgatctcatcttatggttctcaaactttattgtgcatcagaattacttggagggctgattaaaatacagattccttccagagattctgacttactcgttctggggtaggaaccaataaattgcacttctagcaagttcccaggtgattttgatcctctgtaatcctctaaaaataga

SEQ ID NO: 14559 - DNA, 642 bp, Homo sapiens
  misc_feature (1)...(642): n = A,T,C or G
gggnaatatattatccccncccgggttggggtatanantccccaaggtgtatttttttttttntggnnccaanaaaganggccccntcccntgcgcaaaaaacncttggtnttntaagggggccaaacacttttccggatttttnccccncncccnatttaatnaccaaagnccnnaatnntttaaatttggccaaccaggctccaatggcatgacggtccccggaacaagancaangnccatggcctcgaagtaaatacgncntcactataagggcggnnagctgtattcatccatgaatatanagtcaagaatgaagaggaaaagaaaataaaagaaaaagtgaaggtatccttgtggtacatttttaagagacaggcttggatattactcctgctcaagtcccactggccananccaagtcacttcactccaaaataaaactgcaaagaggactaggaaatatcatatgtcaaggaagaggtaattgaaanagttgggtgagcaccaattgttaccgctaaaaagatacctatgttcaatgctaaattttacaatgtatctatttttaaatgatttctgatatctacttttgggtggctgacacttatgcttcctacaagcatgttcctctttgggtac

SEQ ID NO: 14560 - DNA, 591 bp, Homo sapiens
  misc_feature (1)...(591): n = A,T,C or G
cggcnnacnanntaaanaanggaaggngcnnattggcncaangaaactngaattcatttaaaaagggngcaccangantgaaacagtgtggnaaagccatggcctnaatccaaccnatnncnntttcttggaccagaagataanaaattggngggtccccaagntgnagaactcccttgntcnaagttgnaaagctaaataaggntcttnanctgggattccctggnccancangtgtggntccaggactggttttctaanttccccttcttgncaaacacctttcacagaggaatgcaagaggggcccncatcaccanaanagaaagggaatgcnaatatttgtctttgatggccagcagggtcctgaggacatgaacgttttgcaaacngaatgaggtcttcccgactgacacgagcgtaaagagcaggtggatttaacagctttcattccattttntgtttagtttaatcaagataccagttaagancaaggggagnctgctcccanagcttctctgtccntttangggttgaccctactggctcggctggctgtggattagaccacacctncttcaaatcagcaaat

SEQ ID NO: 14561 - DNA, 539 bp, Homo sapiens
  misc_feature (1)...(539): n = A,T,C or G
anatnaagcaataacggtccccnggaacaaancaagtccnatgggctagagtantacggcntncactataggggcngcanaatcccagaatcactcgggtaaantcagagcaacctttagtcacatagggtttcttctgtggaatcttaaacgtanaaggnncatctggtcaaaggaggcttcttgtctctccacagttatcctacctgtgccagcatnnactgggacgtcttgatcttccaagtctgtggtcctcgtcatgggtttaattgtgctctctcaaaattcatatgttgaagtcctgactcctagtgactcagaatatggctgtacttagagatggggtctttaaanaggtgattacattaaaactgaggcctttcgggtaggccctgattcaatatgaacagggcgtattgggacatncagagaaagatacgcaaggggagggcgcagcacctgcacatcaaggagcgaggccttgggagaaaccaaacctgccaacatcgtcttggacttctagattcaaaactgagaaa

SEQ ID NO: 14562 - DNA, 741 bp, Homo sapiens
  misc_feature (1)...(741): n = A,T,C or G
ttnccccnantntancaagccngannttaattnnccaccaagctnnatgcaataangtnccgggaaccaaaacanganccnnggcccnaagnaantantgactncanttnggggcgtcaaaagcatanaaaggtccctntaanacnnttccaatgcgntnggctnttggnattnnagtcaattcaaaaaacccanggtgtcttcattcncanttcnccctctanaaattgttacccngcctgcncaattgcgtatnaactgagtctggaggctgaggcagcaagaattgcttgaggctaggaattcaagaccaacctgggcaacactgaaagaccccatctctacaatttttcttttaattaactgtgcatggtgacatgtacctgtagtccnagctactnagccttccgagtagctgggatcacaggcgcatgccaccatgcccgnntaatttttgcatttttagtagagacggggttttaccatcttggncagnctggtctcaatctcctgacctcaggtgntccacccacctcggcctcccaaagtgctgggattacnagcatgagccaccgtgcccagccgagtctcgattgtttaatctacaaaattcaattatataaacntgagcgaacgnaaanttaacnaaaatnacnttnnncagatcanaatnanaantgtannaagatagtntaaaaanaantaaatnnananatangngtaatngatangagannnaag

SEQ ID NO: 14563 - DNA, 558 bp, Homo sapiens
  misc_feature (1)...(558): n = A,T,C or G
cttaatatttttttccttgaacnagcaaggaaccanggaaccagaggtnaacntngctaanaagcnaggaaatccctgggnctggggttttgtttttantaaaaaccagaaaaaagtggggttattatgaaagaatcnccagangacgtnagaatttggggtaaccaagaaaaatcctagatttgcaggtatgaaaatcnaagtagctggaatactactaaaatgcctttctgaccaaaagaaactcttgcaaaanaacctggtccaggaaaacccaactaatttaacnatggatttataaaaaaaatcaatattagagcttggatttaaaaatcaccataaaaataaaataaaataaataagtggcataagtttccagtagatgaaggatacttatcaggaaatgttgcaactctgctttaaaaaatgtaagaaataattgtccagttttatttttgtaatgaaggaagacctcaaagcagaaatgcaaaaattcagggacaaaatggaaataacatgaaataaaataaaataaaatgtgatctgctagaactctcc

SEQ ID NO: 14564 - DNA, 792 bp, Homo sapiens
  misc_feature (1)...(792): n = A,T,C or G
anaccggggtngggnntaaattattcccnaggtnnnnttttttttttttttgggcccccaataaaaggggcccctnccnnttgnnaangaatnttggttttnnttanntgngaccnnccttnttnggaatttttnccccccccccnattttaataccggagggcccganttgttttaaaatttgtcaaacaaggttccattgnaatggacgtccccggggtaacnaagaccaaagncccatngggctngaaggtaaataccnacctcnncttattagggngnncangttcaanaagcagagcccaaccttgggacagggacaagggnngatccacacttccaactcacagaagcatggaacccagttaggganagtctcccaaagccttaaggtaccacagggcaccatgtcctctgccaaaacttttggaaacagggntggttctactgcagcanaacagatcaccctttgaacaaaaagctccaaaacttacaagaaagagaagatgaaagctgcagctctcttctttgaattatanattatctatgcctagaatgcccagaggggtcatgaatttagagaattcaacaacaacaaaaagtcaatatctgacaccttgtgtttctaaaactcattacagctctgggaatgaaagtataggaagaaaaaataaacagtgaataaatcagatgcggccgcccgcggggagcgtcgacgtaaaatnaatnctcnancnggaaaaatataannaagnattaaaaannannaangangannnannnnnntaaaaa

SEQ ID NO: 14565 - DNA, 908 bp, Homo sapiens
  misc_feature (1)...(908): n = A,T,C or G
cngnnattcnnancngcantccattgngaagnataagngattgggtaatctcggaannnntgnntaagaagangnattaanantcccannatnnnatatnttgntagagtcccaatgagaatnanaggganancatnnnnanaccncccctanccatgnnagcccagaannattttcntcnagnnntaaaacnaataaagnnnanatagnnacccagtaaaagnccantngacnccggantcaanaanaggacntancacnatntnaagaganttncccccttttaaatattgaagnggggngccacatttgnaacanataacccaantgtgnttgtgggaanncgaanaanatagtatnattnggaaanaggtgcncccangnnaacaaccccantangttngtggccntgccnagaataggtaccacnttgtgtaaaggnatattgcaangttnacccntagggnaaccaagttatcatgttgccctgggtaagcaangggnanccagaaatcccattggggncatgtacccagctggtnaaaagttctcganatgtcaggtaggttctggnantcannagaaatnagnangnttactcaaancaaggtncaacntatnagtggaaantccctngctgtaagcaatcnnaanccagacccctgtcttctccaaaggacgtgtctgntagtagttttctaaanancccgttctttcagnattaagcagtgaaagtagatnaannatagtcacagatacgaccnccaccgcggtgnagcgntgngacngtanatanngattnntancnttacnatnatgntanantataatatttcnatcataggaanantanacanatatatcaaagancattntnnataatncaatanatagtnanatantcagat

SEQ ID NO: 14566 - DNA, 638 bp, Homo sapiens
  misc_feature (1)...(638): n = A,T,C or G
cnnantggncaaannatantngattttccnnaccanatnaattngaagcggtatnttntaatttgtcnancaggtntccanggcatngaggntnccnggggagnnannacaaaggcccaatggnntcgnagtaaaaaccggctancactaaaaggngnancagggcttttccntancaagnatnnannaaaaattngnnaacttgaatngctcccccncaaggctnntcnagggtnccnacttnannaaagtatnntgtaaaaaggcaaggcgggnaaagcccaaaccntcncttcccgggaaggccctncaaccggcnanaagtncagggtctccaanaggatangatttnaaagaggttgagggggaagataggagggaaaaaagagtcctacaactgncagnaatggggcacctttccctgtaactaagcaaagctccctcttcccactgccctccccagccccagctccctgtcctccccaacacctagtnagaaagacggtgcgtggaagggagtcccatgggcagatgcttacacggcctctttgcgaagcttcttctgggtttaacttcattcatcaatttatttttatgtcaaagcaatgaaacgtttctttctggagccagataccaat

SEQ ID NO: 14567 - DNA, 614 bp, Homo sapiens
  misc_feature (1)...(614): n = A,T,C or G
cntccggagttaatnaggccnccnanntataaggggcnccaagggttngaagtccaattggtngngattntcagncancanctgccaatttttcnccncnttcantgggttccaaanggnaattanatgnttgccntaaagccntccccaaagattctgggaattaccagaaaanangcaaaaaatgtattgcaggaaantgggggaagncnatnaangccnttgcaaacctggcaagccaagtggtcnanatgtcnatttaananattttgggaagggtttcaaaanantgctttttaagatacacctatgcntaaacaccnctagnaatgacacaacttatttctatcccataggcttgaaataagtaagagagagttgctatgaatttggttaaaanagtaaacctagtganaaaaaaagtagtttagatggtcgtcattttgacatcaaatgatggcaaccaaataaggttattttcaccatcatnccatcagaaaagaaagattcgggatttggaaatcaatgaaagcagccagaaaacttccctattgtgcaacaaacaagacgtggaaacactcgtgagttgactctactcagaggtccagaaaaat

SEQ ID NO: 14568 - DNA, 1296 bp, Homo sapiens
  misc_feature (1)...(1296): n = A,T,C or G
caacagctaacattctaccactcacgtccgcgtcggaatgaaatagcaccctttgcctgcgataatatcagagcaacatgggagcttcccgcccagctcacaacccgcatcggttcgaactccaagatattcttgataccaccgcatgttctggcaactttttcttggtcactgtatttacatatgtgcacattgttcgcgttaatttatatttttaccacatcgaacgtgcagcgttgtggtggtttgtcgcgtgtccaccacgatccttatgcatgacgccgaatattgtcggtggttgacaacggcgctaaagggatcacgtgtggagagtgttgtgttgctacagtcgctggtcgactaaccatatgttatccttaacagaatccgcagactgtttgataaccgatgttcccttaatacaacacatcgattaaattagcagaaacaaagtggggattgactatcttcatacgnggaattggtccagtcacaacacaacacggtgttggtatcaggcgtatactaattatgacccttcacattcaaacacccacatgatgtacttttggtatagtacagtagcgatgatagagaactccactgtgcgtataaagtgtgtgggggtgagtaacaccacngggtgtgcggtgtttgtcgggtgtactttggtctatactccactcccgggtgattgttcggtccgcacacttgtgtttgttcgcccccagagttgttattgtcatacaaaacaaacattggtataatattacgcgcggtatgacanacctacactgcaggtaggcgttaatggccgcctcgctcctcggatgaactaccgttgtgccgcaggccgttagtggtaaaatacttattatattcagtttggtgtagtgtacaccagcccattcgccgcgctcctcgtcatatagtatatgcttatccctacgccgagtatgtatatttgtatgcgcttcgcaagctcgccatnattatgtgtgtgaacactcctcgtcctatagtcgatgaattatatgtgagttatcggccacgcgatgatcgtgnctagtagagtgtaccgacgtacatcgtatttatgtgtgtagatggtgctcgctcagctcgcgcatgatgctcggcgatgtttgtggttgttgtgttgccgcacgcgacctcaagtggcactattcagtctcngggagacccatctgtacgcaactgtgtttataagcgttagctcatactatcatatcgcatcatatgattaatatattatagtagcgcacgtatctccgt

SEQ ID NO: 14569 - DNA, 946 bp, Homo sapiens
  misc_feature (1)...(946): n = A,T,C or G
atatctaataccgntcacccaatccgagctaccgacacaccagtagtcaaactaacgatgaggtgactctatcacatacatcacaccggatacggacgtgtcacatctactctggcttgcatttctatcgcattgtaataaaataatacaaaagactcagtgcacaataacgggaaatctaaaggctggtgctgcatcagaaaaagacagagaaaaacatgggcgtagagacaactctggggagatgggaagatacatgcatcagggctgccctctggctaagaattctctgggccaaggaatgggggaagggggaataatagactgacccataaacctaatggaatccaggcaaaggggctaacagggctctcgaggccataaaggaccctgggagctggggataattaaatctattaaggagtggccatatcctttcacggggagggatgcgggaagatgtccttccaaactctttaaatcatagtttggcgcgcactggcgaacagggtgttcccccatcaaagaagcaaccttgaacctttaaagcaaaacctttcccgatgcgcgttgactcgaaataaaacaaattcgttttaaaaaaaagcgccccggcccttggcctattgtatatccccattgaaaataaaactcgcggggcgtaaggtaaaaaaaatctggcccttccgcgccttagaacaacaaataaacaaattgccacgtgaggtgttcttcgtggacaaaacagttttcgcctctccaatattactggtaaacctaaaaattttgcaagcgtggaccctccaagagcacccttcaatttgtattaaagagcagcctgaggatattagagggagatggaacatgtaattacccaggggtgtcgcacaggtggaccagagataattatgattgtgctcggcggcgagaagaagaacagctgaag

SEQ ID NO: 14570 - DNA, 1185 bp, Homo sapiens
  misc_feature (1)...(1185): n = A,T,C or G
tattctactgctatctcccnctcacgctccgcccgatatatatcaccatattattgtgcagattatacctcgcagcgccctttgtattcggtcacccattcccgcgccgcacagttttctcttcgtagtttcactgagccgcgatatatacccgccagcattagtactctcaccatagcatattcgtattgncgcacgacctcctggcgccgacacgctaaactatganagttttcttactggtgcaaatagttgtagtatatactatcgacacgcgagcatgactgtcagacttagatccttacaatcgttgctcaccgttagaacccctatgctcaccttactactcgttctattacgccgacataccgccctacatcactaagtctatatcactcgtttatctcccctcaccacgctattaatttagtatacatctatcttcgcccccccccctctactgcgagttacatagagttttcacaacagctcgtcatacacacctggtgaatagctatcatagtcgacgtgctagcacgtccgtataagatgagcgtcagacaccgacaaaccgcgccttaccgcacacgtatttcgttgctatataatgatagaaccctccacatgtccgactcgattaatttaggtattgcgcgcggaattccatatatgtcttctcgacacgcagtcagacaatgtaaatacgccgtgatacccaatagaatatgggacgcagcgcagtggaacgatatatatgtatatcagaccgtcacctccctatactacgattatttatagactgttcatgccctaccgcgtctgcgcgtcctaggtatccagctgccgtacacgcggtttagtacctatccacaatacgccatgcccacaatattgtaataaatacgacgtgtcctgtccgcgtaagacgatataatagcacttaacattcagaagcaatagttaggtccctgcatgattaacttatgcctcgcgaaacactcgcctccatagagcgagtttgttaattgtgatggacttcagtggtagtgttgtctgctactttaccgtccttgcgagcgatatacacgtatctatcgttccgacatacttcttctagtgttaccgccaagagtgcgaaagacagcgcatattgctgagtcaccgtagtcgtcaaatcactatcct

SEQ ID NO: 14571 - DNA, 586 bp, Homo sapiens
  misc_feature (1)...(586): n = A,T,C or G
ctcatcttgnaaaaactggagccctgctaccttcanaggntggctgnaccctgcttccatgttcaangctgttantgcaagcaaccgnacactgttttcagatctgccatgaatgggcccagcaggtgaatcatcaccaagatggggcagtccaattcctgacctagcgggcccttatgctgtnttctacgtgagaaattcatctggattttcaaagagtaactatgaatgaagctgccaagcccaggtagagagcaagctgaaaatgtctctttcaactaggagnccaatgtgtttttctccagtttcctgtaaactcaaggggccagtcataacataggctacccatgagtaacaattcctttgcacatgagctttcaggtcagctatacaccaaatgttttataactaataatacccgatgcgggncgntanaaangaatanaaaatagnatacnagaaatcnnnacnnnatncanctgagacaganntnaangtanaaanagtnnanananaaaaatgagaganagnananatnanaaananaaannaaagaanaangnanaanaacnanacnangagnaaa

SEQ ID NO: 14572 - DNA, 562 bp, Homo sapiens
  misc_feature (1)...(562): n = A,T,C or G
cnngggncggagtaaataccganctcacctntagggcnacaagancnnggttttnactntaagtnaccnaaaantttgtgnngcaannggnggcgatcnagggcctnaatgcaacctccacctcttgtgttnaaanggaattcttcctgcatcagcctccngagtaggntgggattaacaggcaccccccnccatgaccagntaattttcatatttttagtaaagacagggtttcaccatgttggacaggctgatcttaactcctgacctcgtgatccgccctccttggcttcccaaagtgctgggattacaggcatgagccaccgcgcctgacctgtgccactttttctttatccattctactgttgatggatgcttaggttgcttctaaatcttgtcagtagtgctgtaataaacatgggagcacagacatctctttaatatagcaattttctttcttttggacacattggaaagtataaatttggtgtgtnaacagtctctttncaatgcctttgcaatgacagatagtagatagacaataaatattccttgaattaat

SEQ ID NO: 14573 - DNA, 1402 bp, Homo sapiens
  misc_feature (1)...(1402): n = A,T,C or G
ccgttcgacacaacatccaacaaaccggacgacgagacaggaaacntatcccgccccttctttggagagacatatagacaagcaangttcttcgctccgcgcatcgcagtcccggcccaatacgacactcacaacagtgaatcattatcaccaacacgtcattgcttatctccatgatataattagttcccacatattaatgcgcgcgtgtcacgttttgtgcgcgtgacacttgagtagttatacccaatgcctgcgtgcagtggtaagcgttgggttgtcgagtggacgacacntgacatgtctgttcttagacgcatctcagtgtgcagctgacgcgatacgagggtactagcaagtagaccngtagcggtgggtatagtgcnccgtcggtgcagtcgcgcaaccctgacatcggtctggtatgtgaagcgagtcatgagggatacaatgtcgcccgtaagtcaccggccgtggtctctaatttacacaaagcaggttcggctgacaagagatagcagctggtaagtgtccgacctcacaacttgtggtatcgatacagcgggagatgtgaaatgcactgggacaacgagacccacaccgatttgttatgctgtgatatcatctgtccagtacacaatccacacacncgtcggcgtataggcgcggctgagacatacaacacaaaataatgtcgggtaagattggtagatcatagtatcttgcccacaaaccaccgggataacagtgngtgcgccccacaccggttgtgctccgactggtgaggatgtgtgtgcaccactagtatatccgatggtggtgtcgatatgcggcgactatatcatactcactggcctcgtatatcgtgtgtgcgccgcgacgccatcaacggactctctacgttagtngatccgcgcgaccggtgtnggtgaactgtaggacactatatacgatgtgttggtgaagaccccgcgaatattaatgagcgcgtgaacagtagtgaacgggaacagccagcgcgcgtgatgtttattagatccgcgtaccgcggacgtgcgacgtgatgcatgacgccatcgacaacagagtagttcttagacgtatatgtacgtagaggatcgcactacagagtagcgtcagacgtacgctagtatgancgacacgcgcgttactcgtactctcattgagagtgtgtgatatgtctgctggcaatgccgcaatcctacatgtcntgagtaaggtatggtgtccgacgcgcgcgcgcgtgatcgacaccgtcctcgccccntgactcatgcgcgctgtgaacgctcactacantattctgganangacatgcgtgagtatnatgcgcngngcgcgcgctctctcaatgatatatctgcgcctataantatatgat

SEQ ID NO: 14574 - DNA, 1067 bp, Homo sapiens
  misc_feature (1)...(1067): n = A,T,C or G
gccgacaacaagcggggggcaaaggtggaatgcaggggttttttttggtcgtccccgattttaccgaccccctcgccggcgcgccggtgaacaacagtctctaacttaaactgggagggagagtcattatttaactcaccgctacgcagagtgttcgcggagagtagattgtctctgtctgaactgacattttaatcagatgaactggtacaataatatagaacggggcgtgccctctatttcgcgctcagagggacatcaacgaggagctatctctcccggggtataatattcgcgtgggtgcttttgagcgcgcaaactaacgcacttggatgatacgcgtggggggcgtgcaatggacacgatcgcggaaggggggctgtaccacgcttgtaactgagtacattgcccacgtggataagagattgaaaaattggtccgggtgacttgcctaaaacgtaacaagggttgcgcatggataaaaggagattcatcccggcgaaaattctttccgtttaggaccccccccacactccgtgtggacttgagggaagccccacatacctggccctgagggggaacaaatcagcgcccgtaacaccccaaatgtttgctgtacgctccaccagaagaagggagagatgagaactccaggggctaacttcgccggcacctgggggggtgtggagagagaagcaacgcgggggtcctctgacaaagctaataccagaggggggggtgatcgtacaggtcaacacaggccggtatgaagggtgggggtgggcacccgcgccacaaagcaccgggggtggagacgaccgtcctgtgaagagactgcttttccgacatgtgagcacacacgggcgccccgggagcgggcgagcaaaaagacgaactaacgggtgtgggatatgggatttgggagcgcccctgcgaggggagagcaacaacacaggacggataatagtctcggtgcgtgtgggtgtgcggaagaccgtggggctagatgactgcggacgggtgaaccagggtacnggcgtggggacggcacccgcaaaagaccaccg

SEQ ID NO: 14575 - DNA, 1709 bp, Homo sapiens
  misc_feature (1)...(1709): n = A,T,C or G
tctttctttgttgtccctgcccgcgccgcgccgcgcgactctatagccagtttattattcgcggtcgcacctcgatccgcgccgcgcctttgnattgcncgcagaagaganacggtcgcgcgcgactccgtatgtctctctttatganatatacgatgacaccaccgacactacgagcgcagtaccccagtaacgcgctntcgcctcgttcngtgtgatagcgatctacagttgcgcgctctttatctcgcaacncggccgagtctagtgatatgtcgtatccgtgctctcattcgcgattggtatcacgacgacactcactcacacacaacgtcgctgatgcgtgatgctgcactctcatatcggtatagtagattgagagccctcacgcggaangccgcaccgagagcacnacantgtaacgttcgtctacatcgacgtactcgcgcgacgcacggaagagactcgtaaactgcggagattcgcgtaccggttagatatctactcgcccctcacccgcgcagtattagtgtaatatgtgccgccgcactcgtcgtancgtatatgcacccactcgccgcgttcgctacgacggagcgagcagaagatatagagtgaaatgctcgtatccanangtaatacgtactacatcgaagatctacatatccaaatctgagntngtagtgtacacttgntgcgcagaccacggcgcgagatatgatcgctgcgcgatgtacaatcaatgcttcgtcgatgcatggtgtgagcgcgacgaagtctccggcactatattaacgatgacgtaagcacgtaagcgcgtcacgcgaataaagtgtcacctctccgtcgcctcatactatntcagacccacgcgcaatatcgatgtcaggaggctgtgatagtattgagagcggcgcgtcgacttcagccgtgcgatgagacagagtcgagcgcggctgtaagagtgtgcagtatacacgctgcacgtnttatgccgcccacgattagatcgaccacgctacgataatgaaaacgtcactaactncagcgagcatagtctagtatagagtatgtatacgctagacaggctgatcccactcctactacagcacatcgcgcgtcagacgcacactctaggtagtcacatagtgtacgatagatgatgcatatgtcacaacataccactcagcatgtgagaactgctatctgacgatctacacacgctcgattacgttagtgcgcagcaacacttagatcagctatcncgtcgtcggaccacatggatgcacactagagccacgctgatnacgcgacgactactctcgacatagatgattngagtgcgaccacacatnacanngagtcgttgctgcgtcgaggcagtagagcgaacgcgaccagcggacgcataatatagacttgcctacgcgaagtgtggagcggcgacgtatgtgcatctacagcgatacagaaggtgtgagtttgagtctcctgcgctgagaccgtacgcatgagtgtattactcaataacgagccggtctaccgcgacgacctcagaacgtagtagacagcacacgcaagcaatcagtctctcacgcgcgcgctgagtcacncacttaatagacgccacgcggatgatattgcacacgaagtgagtatcatctatctacgccatctcgccgcctcaatcacccaattgcacatacgcg

SEQ ID NO: 14576 - DNA, 779 bp, Homo sapiens
  misc_feature (1)...(779): n = A,T,C or G
cgngggttggnaccntcaaaaagaatgttccccttgagttcngacccatttcnntngntgnanctaannnggctnntgantnnggggcnntatganatgncaagtccccnncctagcaacccaaccgggnttggcnnntntaggggccctccntaccctttgngcanctattggncacaaagttacanngcttctctcgaattaggangcnncngncctatngnntggccatggaatctccttnagagagnggtgagantttgacagganccaagaagaccagncagagggtacgnggaggccagaaaaaggncanaaatcaaggctggtgatttgcaaatgcnagagcccatggcagcatccatggngtngantggttccctctccagctcgcntcantgncagttgntgggctatagcttcatnggcgtgatggtggccgagcaccacctccacccaagcgagtcactaaggagcacggtnaaaaagcctgggctttggggccagacagtcctgtgntcggatcccagctctgtcccttagaagctcngcaagtttgaggtagttccatgggaaggtgatactctttnagccttanacttcctagcaataaattgggatgcgagncgtnnaaaaggagtgagtgtaagagnancnnaangacnnccnngnncgattcgaaacgaanntaannatatgaaaatnantaatnaaagannntnngaanaaatttnangatananaangnagaatangananangntnanantanaaanga

SEQ ID NO: 14577 - DNA, 1519 bp, Homo sapiens
  misc_feature (1)...(1519): n = A,T,C or G
ggggntttttgtgagttttttgtnntattgtgggngnnncgcgacagcgctgagccacgtgccaccaactccctntcctgtgcgtcccgctgtgcatgttcgcgtctcctcctcttgtgtgtcgcatgtaggtagagtgcgtnaaatatagttctcctgtngcacgagtgtatatgtcgtccggagttctnataatcgatgagattagttaatatgcncacatgctagtgtctgtgtagtacgtcggtcggacaggttgtactcagtcgttccgtgggttctctctatagactagttaccgtgtgtccttaccaccctcacttacaatcacacgtgctttccattcttgatcacaaataacttttatgagtatattgtccatctgttctcgcgttttcgtttatgataatttcgcccgggtcggatcgcataatccgacgtggtactcgcgcccctccacctcttcctcacacccncgcacccccgctcccgtctctctatgataatattagnttcaaatcacatcacccacacgctcagctgagcagtgaacgatcgagcgctacaggagancgcngcgcgagctcaactataggtatttctctatgatgttcgtactctatacttattactcattgtatcgagtcnctcnctctcgtgtcgttaccgcgtatctagcattggagaanatatgatatgagtgtagctctccgcgttctctctcgcaatattgtcgacgtntcgagatcgcgactgacacatatcgacacncaccgctacacataacagagactaccacgatgtcctcgaccnactcgccgtctntcttcttgctaccgtccgtctcctcgcgccacttcccgtcacacacgcgccncatcgtctctcagacgtgttctgacctnatattgnatgttcgcncatgtgatagcgcgctcgcgcgtgtcgctctcatgncgcccgtatcacagcgcgtcagcggtcgctcacacnagtgcgacgctcgcagtctctagtgtagtgctcgagtatagtacccncactgcatcttgtctanntgtcgtcagaactccactgttctgttgtctctgcgcgtgctatgagtagcntnnngttgcgtatgcgcctctctatctctcgagtacgctccaccactntgcagcttctctcactcatactctcgtggcgtcctgcataggaaacagatcgccgccacgactgtcatcactatctntattacgtcttcagctgtcgcgncctcgntgcaatttctatccattagcgtctgtctccnctcatctcgcatgagcgcgcgcgtgaagttcgacagacgcatgtctgcgctgcgtcacggtacgatgcgtacgtcgccgtgcgctaacaatcgtcacacactattcttcncagttcatgtgttactcgcgctctcctccacttcgtaaatcatctatctctctgtctatcnctattatactatctcatcactctcacgttgccttcgttccatcgcactcgacag

SEQ ID NO: 14578 - DNA, 482 bp, Homo sapiens
  misc_feature (1)...(482): n = A,T,C or G
ccaggccncagccttngacatcaagtgtgnatngcctgctgactaaaggcnagaagcaaagaanctgaatagaggganggnttgtggnacccctgcnttcngnttgcttattcttagaggccacccntccncaagaagncttattaggacattgccttnntgtggntntgcaccagttgntatgtntggntatgaaanaattccncgcgaggttnctcggttacattaatanncnnnancncgacanttntnnagcncaataatnttnanacaagtttaagaaaaatatccatccatttgganaacaaatgtttttgaaacnntatgcaaactnttaantacgatacanttttacttttcatnanagtaggttcttagaggacttttacttcatagcattttatacctgagttatngtnattattgaaagaaaattgnaanaaatttcactatcctttgccataataaaaaaaaaaaaaaaa

SEQ ID NO: 14579 - DNA, 1290 bp, Homo sapiens
  misc_feature (1)...(1290): n = A,T,C or G
gggggtagagggggggagggtgagagaataatcaagcggggcgcgccacccccaaaaccccgcgcgaaagcgaacagaggcaagaggaaacaaaatttaaaaaaaagaggacagagaaaagaaaaanttttgagggangngnagaagaacacacacannaggagcaaggaaaggacgaacccacgcaggnngcttaccaggggggcgaaggggaagaaaaggaaagagagaanngacgggagagccgagacagnccaaaaacacacagcgaanacagacggagcgcaagagaagagannnccnacgaacnnaccgcgggcggaggcgcacggagagaggnncggggaggagaacagggagaggagacggnncgccgcccacacccgcacagcccgccgcgcacccccgacacaccgcaccagggaccgcaccgcacagcccaaagaaacccgccgacagccacacgacgcagaagacaaaaaaanacaaggagnnnnacaggagaggcaacaacagnaacacacagaaccgaaaagcacgcaccgcgggaggaagagagagggagnaggggaggcagagagggcaagagcagagagaaggaggcgaaccacaagagagagggtgagggangtcgntaggagcgctcactagcgcgcgaagacacctaacaatganacctaacagcataaacgancaacgtcgcgaacgaccncaaacgcacacgcanacaagctcacngaccgatcgcacgagacgacgcgtcgagagaggacgcnacaagcacgcacacaacgcgaagcgaanaccgccacaaccaccgcaccacacaatccccggacacagcaggacgagaggaacgacagggcaagcggaggggcgcagggccagagagggcacagcgaccacaggcgcacacccacgcgccaacacggccacgcgccgaacgccanccacgagcaagcacgctcaacgcgacacacggggactnccacaaagagccggatcgcaccacgcacagagacagancccaacaaataaacaaacacacgcaccaatnaccaccccacgagagcccagcggcgcgagggaaggcggcagcggggacggaagtaagcgcgggcgggccgcgggcgccgacacgaccanacaaaacagggaaaggaatccagggcaggccaagacacgcgagcgcggcggggccacgcagcgcaccggggctggagggggcgcgcgagaccggggggcggggggcccagagggcggcaggccgcaagatgaaacgaaaagggg

SEQ ID NO: 14580 - DNA, 481 bp, Homo sapiens
  misc_feature (1)...(481): n = A,T,C or G
aggtgccatattttggaaggcaactgnaaaatgacncatggcaagcttgcagcanaacagtcgtaaagcagttcatgatcagccttggaaagttgcagagagatggcaggcaatgacagtgattcaggccttccctgatttaancaggaaattaacatntaagtggtgngtgnacaaatttttaagaacaagtgatcctgatggaaaaaataatatggaaggtaaaatttaaaaagaaaactnttagacctataaattgatcattttgttttcanagaacttgaaagtgagtttgatgcttagtttaatcaaattagaagttgaatagggctgtatgattnaattccataatggatcataagttagaagtaaaccatcattcctattaatgtttctataaatctaatcataattttgtggtactctgattcataatgtacattaaagtataaaaacacagaaaaaaaaaaaaaaaaaaaaa

SEQ ID NO: 14581 - DNA, 695 bp, Homo sapiens
  misc_feature (1)...(695): n = A,T,C or G
cnntgtncaatgncattntntgaacnaaaaaantanggaataccnagcncnnngcaaanaanaatnttangnaatnatttnangnatnncctgcaacagnggntgcggttttnntttataatgaaantgangccaaaanaggtaaagaacnttggcctaaagtctcatggggcactgggnattntttnaagcagnttttttttttcaaaaaagtcangaagaaacannnntnaangcctcttcctnacaccctncagatanagctntgaatctcggcatctgtgagatagtttnttttggncttnttaaaaaagtnttccaanattgtggaatnggatagtttcagttaaaatatcngnttttgaaaatcatgaccaataataaaaatcaagaatgtcctattacaaatttcatacctttaagaattttgttttgctcnaattggtcntattggattaaatnatttataaggtacntctntgggtcttcanaaaaaaaaagaataaaaagnttgatagcgnccanttattgaatcntataanaagatgantnatcntantatatatnataannatancctctcctctccataaagnaaaacgagtaataanaanttatttannatagaatncgntganatngaangagtnantgananganaaatgagngnnnaaaagtttttaattagnnanna

SEQ ID NO: 14582 - DNA, 2253 bp, Homo sapiens
  misc_feature (1)...(2253): n = A,T,C or G
cccccccaccgttnnnnnnggnnnangagangcgtngtnngtaggattatgtntaatntnatctctatcgtacacagcacantatatgacacnaanctgcngctcgtcaccntncnatncnctcaaatgacgacgtccgtcatgaagngacncanncnaaggacgncnccggatcacagctcaggcacacgacnncncttcgacagcagcacgagagagagaggnaatngtanagatcgnnaggagacgnnngacgagcaagtngnttttcgctgtacgagccggnggngtgaagagatgaagnagtcggtagtaagctagacgnacanntagnctactgatgcactgcagnatagagtnctngcactgnntactntctntcnncttttcgtgtgtcgtcttgnctatcatcgttgnctntgtngtnactgctgangatnacgtnctacgtatgcatcanactcagttgactgtcancagatagnnatncaggatcatgcccgcggcccaggagatgngtgataccgagagnagtctnntnctngtangtctnctacgacacantgggtacnactanacacttnctnatagatagcgctcctgactacgatatcnagacatacgtcnnnncntcgcattntgcnctacttaatgctcagcagcgatcnatangctgtcgtgtcgntgaggnagtgngtnntnancgagcgangactgatgtacgtagtgatcgcgcatagtgcgntgtcgacgcngncgctacagctgtcacgccncngcccgctgctgcgtgctcccgtcgagcgtacttcgtcaggaagtggcacanctctgctcatgatgcngcnncgcagncactcacacancgacgcnacaatnangactagcgngctacaggtncccancgcagatgccngtatgcatgantgantcatcgtgatacgcgataaatgtcacancggcatgatcgtgcgctactcnctaantcngtactctctcangtaatcatacgatcgcgtcagacntgtntatatatntntnanantatagtggttactannttgctgtcgtgatctcgtngtnatatntgcncaaacgacatgaantanttagtagcgtcncnacgantntgagtnatagtatgtgtgncnagtactgattgatagatntnaggagtgnnnnagtgtgctgtgtgagtgctganctcgncatcatcagaatcgntccngagntagctaatncatagtatgcgactatntacgcgtccnagagcnaccagagcgacacacgcaacncagncngntacgtctcgccgcgccacgcgaacacagaggagcgctncgtcgctgnatctgcntccgcgctgacgantncnacacccacnatgtcgcantgtgntcttatngatactactactccntncatcgatgctgccaccaactgactcntctgatcagtcctnctntcagctcganctngtncgantgctatgatcntgctgtnagctgcgctgcacagatgagnctctcactgtgtnactangatctgctcactccagctactatcacgctctccgtncgcgcnnntaccgactcgccatatctacttccgcacgtcgacgcgctctcgatcncgcgcagcgatgacncacgatnctanccgtgctgtacncannctcatagcatgctgtgcncatctacgcagaggcgatctcacatgtacctcagcacaccgcgctatgacgatagtagtngcgnaatancnagtatgagangntatgctgcacgtacggntcgcnctcataggtncagtatgttgattcgtaagatggtacgcactnntaagactantactagcagtcgaacatgagagcgactnacgataggcgganacgattgacgtnatcacagacgtcncncgatngacgacncgctncacgagtgncgtancacacatgacgtaccagaacgtcncncgtacgttanactcaatagtaccatagatatagatctaacatgatgtagtagacgtacncacatctcactcgtacgtcagagctgcaccagccgtcataagcgcnatcgactcaantcacacagacacgctagntntcanacgaactaatgcacgtcattgacatcgtacgcgcnactatatagtcacaccgaagtgcacgacgcgatcgtatctagagagangtgcnaccagcgtactacagatactgctgcgttnctatctcgtcgcactcgtgag

SEQ ID NO: 14583 - DNA, 261 bp, Homo sapiens
  misc_feature (1)...(261): n = A,T,C or G
ccatgtgagtatacgaagagaatgtgctcaccaactactgaatctgctggcnccttgattttggtcattccagcctccagaactgtgaggaaaagccatgtgtgattgcactgagaaggcaaaccaggaagacagccctcnccaggaacaactggccagtacctttatcttgcacatctatttctataattgtccttaataaaacgtacttacactcttataattattgaataaattgtaagctaaaaaaaaaaaagaaaa

SEQ ID NO: 14584 - DNA, 657 bp, Homo sapiens
  misc_feature (1)...(657): n = A,T,C or G
ggaanaaaaanccgncaggggngaaagcccnngaanaaggcctttgnattngatggaagnngcncncggnagagttcnnccataatgtttattaanttcaancnaggtaantgaaanccnnagtaagtaangcagcatttnnagttttcaatttaaccccnttaagntcaagaaacccttaaagggatttaaatatnttcaaagttgcacaangaaacccnngcntnntntgtnaagantnttggaaagaaaanacttcttgcacttaaanantgcccttgccgtnctttgaggttngtctnaatnntgaactttaaaaccnaattaantatgaangcttttgtttccnaanaaataatggcatggtttnanatgtnatactttngacngncanagtttttatccaaggaattattttttctttcaagcctcntgttatgttttgaacnaacttgaatnatgaaagtattananagatatccagttaaagagaantaanttantaaaanaaagnntganagcggnncgtatgaantatatgnatngaagtagatnaatagatgngtcccccagcanntcncacnacaanaatcnaatanataanngantggatgtgaaanggntnagnannaatananacangagtannanngntaa

SEQ ID NO: 14585 - DNA, 638 bp, Homo sapiens
  misc_feature (1)...(638): n = A,T,C or G
anccntgggnttngagntaaaacagtctcncnaanaggggggaagggttttttttgtnaanaanggaaangntcaaacaanaatttcatngnttttggcatganngggattttaattaaatnatangccaaaaagtagagnggnnccagtcnaaactcaaaaaatagtggcaacaaaatcaatttnaaaatnagcaccagcnataaangttacctanntattttaggaatggaaanantgagaccaannaaggcattntagtntnnanagccttgggatcngaangccaagaacatacnanagaacnnagccttggaatcagaagaccaaggaaccanttaactttgcccctntanagntttnanaacttgggcaagccttttaccctctgtgagtttcagttccctcntttatttaattnaaataataatncagatcccctnaaatgtaatgaaaattaaacatccttatgtaggtgnaanaaaaaaaaaataaaaataaaaaaaaaagattgatagcggcngtntnananaaganttaaagaaataagagtnngnnatcctcgnncnanatngagggataatacaaganntngngtnanaaanangagtataanagagatanatntnnantgagna

SEQ ID NO: 14586 - DNA, 482 bp, Homo sapiens
  misc_feature (1)...(482): n = A,T,C or G
atagccagatttctaagaaagtatatatgggggtttggagatgtttattccagtaagacagnannataaggccatntttcccatcaaagnaattgcatagaaganaangncnaccccaaagatgttcatntccagctnaggcttcccagggnatccctaggngcattnngccaaccaaagtaagtntcaantgatcanntntgcnattttntnaaaatcaactgtgaaaatttaaaaaanantnancattttggaanccataatgaatatatttagatataatattagcagnatatatagctaggnaaagtacataatgggattgnnagaaaatataagtatnttatatttccccattgttctaatgttttatctgtttanccnactaagtgtaaaatttatacccaggncaatttgccttacaaggtctatattctcaatnncantgtatanttctataccaaggcaaaaaaaaaaaaaaa

SEQ ID NO: 14587 - DNA, 1330 bp, Homo sapiens
  misc_feature (1)...(1330): n = A,T,C or G
ggggaagggaagggaaggggaagganngnnnnagagtagagagacgacgaaaaaggncaggggagagcgtgacagcgaaagaggtgcgggtttgggggggggggagcggggggggggggcggcagctaacgagacacaaggagagcaacgtaacacgcgacacacaaagcaccacgaagaccccccccgagctccccgcgccaacaccgcgacagcgcccaagagtagcgagaaaacaccactcggcgggggcgcgaagagagacagatgcgggcggctgtcagtcgccaacggcggcaaagaaccgtgattagactagcagaagaaaagactccgcccgcccaaggcaccgcatacacagccacaagaccacgacacacgcgcccagcagcagacaccccgccagcaccgcccacctaacacacatccgcatacaccatatcaccacacccaccacacaggtcggcgcgctcagagccaatagcaccacggatgcaagaaatacgagatgtcagcgtaaagtataagtacacaaataagagcacgaacgggcagccagccaacacgtgacagtgaatcgtaagaggagtagtagaatgagtgcagaggaggatagagcctgccgccacgcaacggaagacggcacacaacggcgcagaagcgagtgaggccgggccactaccataacaagatagctacgagacaacgcgacaaccaagcagacgcaagacaccacaccacagaagcgagagcaggacaatgacacccacaagcacgtgaaacagagtccgccgccgaccagccgccccttcgccacgccaaagcagacactagcatggccacgtcaggcacgaacggtctgagcggagcacaagacatgacgatccagccacacaccataacacccaccgacgaagcccgaccgcgcggaccacangcacagtaatacacagcagaaagcagtcaagaagacccaggccaaggacagcgccaccaacgggcggctcagcgcagaccgacgccggagacgaccgaagcaaccgcgcactcgcaccgagctccaggactatgccacaccgaaacacgcaccaccagcacgcgacgnacacaagtcaaacagcggcgcgcgcgctcggcgagagaggtacggacggcaacgacggcgacaatatcaccacacaccaagacgcaagcacgcagagaagcgcnccggcacgggcgcgcaaccacaaacgagcgcaacagaagtcaagacggcacgaggccgagccacaagtagcggcagacgagaatgcaaaacgagcgcaacaagaggaacaaggcactacaa

SEQ ID NO: 14588 - DNA, 229 bp, Homo sapiens
  misc_feature (1)...(229): n = A,T,C or G
attgtaagtggtacaaagaagtcagtgacacacttgntgaatgacaacgtaatatacaanantgggattgaaatacagattttcctattttnttagntttnaaaatcaactagagattgctcnaanatattaaaagtagnaagaacttttcatactatgtgcagactattatctgataataagcacaaataaaatttgattgccattaaatataaaaaaaaaaaaaaaa

SEQ ID NO: 14589 - DNA, 1629 bp, Homo sapiens
  misc_feature (1)...(1629): n = A,T,C or G
aggggaaggaggnaggaagaaaggaggagagacggccggcgaacaaacacacaacaaaaaaaaaaagaaaaaaaaaacctagaaaaaaagaaacaagaagaagagaaaacttaacnnncgcccccgcggncgcnccgcccccgcgggcgcgcgcggaggcggagcccccccaacgcaccttccccgccccgccggcggcggggcggccngncccgcccaacgancanncnnnccgcgccaccgcgcgaaaggcgaaccacaggcggagcgggccggcccgcgccgcagccggcngagcgacgaagcgcgcngccgcgaccgacgcgcgcgagggagcgagaaagagaaggagggngagaggngngaggcggccgcgcacccgcacacgcacacacccgcgacacccgcaacaccacgccgcgcgcgccgcggcgcccgcgccgcgcgcgacgccaaaagccaccaagcgacgcgccgcacgccacgaggacacacgacgcgcgcccgccgcacagcaccacaccagccncagcngaggcgnagacggagacagaagaacangcggggacgcgcggagagcagnanaggagacaanncaagacagaanacgaccaggaggcagcaaacacacgaaaganaccgccacacgccacgccagcagcccgacgggncgagcggcgagcgcgcgcgagcgggacgacgcgaccgacgagcgncntcgcacgcccacccgccgacgcccgcccagcccccagcggcgaacgacacacncacacacccgcaacgacagcgcgcgaccgagcacgagcatgcggcgcngcgccgcgcgcgcgcgcgcacggaggaacgcaccgcgcgtcacgcgacaaccccacgcgccnagtcagcacagacgcgacgatctacgcgcacagagacgagacaccagcnacgcagcaggcacagctaccgacgcagcgcaccgagcagcgccgccgcgcgaccacgcantaccgactacgggcngccggcgaccacgagtcagcgacacggcgcncacgcacacgganctacacgacnagcgcgcacggaacgcgagcccgccgacgagcagcananaccaggcacgcggcgacgcgagcagcngctaccgcgcagacggaatgagaagcgagtgcncgagcgcagggcgagcgacaccgcnctgcgaccgcgnacacgagagagcncgncgagagcgnggnacacagacacgagccagcgaaacgcncngcaacacagcacgcacgcgacgtagcggcacgcggtgcgagaagaatcagaganaccgacagctcggacgagaggcgagncacgccgcggagcagacagtaccgcacgcagcgagacccacangacgcacaacgcgngacgcgactatgagaggngacgcacgagacagagacncagacaagcactcaagcaggcgctgccgcacacgacagcaggaccacgacgcgctcactcagnanaccgngaccacaancagcacgcgacgacgcgcacagacacccacgagcgcgacgcggacaaccacgagcagcgcacgaactaacgcnacgcgacagaagcgacggcgaactgagagcgagcacgcggcacgagagccga

SEQ ID NO: 14590 - DNA, 484 bp, Homo sapiens
  misc_feature (1)...(484): n = A,T,C or G
ctntggcannaaaggaaagnacnaagaanttcngntccagnntnantanttcagctcntgccnnaagcacngcctttnagggntgtgtggncaaaancccnatgnaaaaagaaaagggaggtcccaaaccctcacccgcagtntggacacnaatgtatttcagcaatatggattnaagcctcanggtcattcatgtntcctttgaaactggcattacacttttgggaaaagatcttgaanaaaaaantcagagntatatatagaaacttaggncaaaggtatttaccacaggacaatttntggcagtganaaattanatganaaccttaataccctaaacaaanaaacaaagatccttcctccttatgatggaatattagttagcaatcataanccaggtttttcnaaactgttaataaaattctcaaaatgttnaatgtaaaaaacnaacataaacatnaaattacatagaaaaaaaaaaaaa

SEQ ID NO: 14591 - DNA, 503 bp, Homo sapiens
  misc_feature (1)...(503): n = A,T,C or G
gtgacaactatnngtttttcgccacnntnatnngccacccgaatgtnatngtcanantggncaaagcaannncngncggggagcaagtcaagcncaangggnagaggtaanangnactctnattntaggggnnanagganaatcgctttntcccagcaggcgnnggntncagtnancnaagatcacgccactgnantccagantgggnggnagaacnagnctccatctnaaaaaaacacatgaaaacntatgtctttgtgaatgagttattnggggctattcatatggaatattaatgtggnagcagtttaagagatggattanaanagcaagcaacaggacacanagcncaaaacatgcaataaacattgnttatgataantntttgaggatcaagaaatataaatcaaattggacaaatntatttttnaaaagaagntntngctcncaatttgtaaagaanaataaagnatganaaattatcncaaaaaaaaaaaaaaaaa

SEQ ID NO: 14592 - DNA, 807 bp, Homo sapiens
  misc_feature (1)...(807): n = A,T,C or G
cgncacactacatgagtgagcttggaancanactcccaagttgagcattcagatgagaccncagcccctgctgacagtttgactgcaacctttnanagtccttagccagaggccnccccaagttaagcttgccncttaaaatttttttttgaaccccnccncaagaatttggtggaaggattaaattaaaatnatttttggtgggggtttttntaatgggtttggtnaaggggttttttttgggggggttaattaaatnttggccccaattggtnggggcccaaattaaaaaatnaagggtnttaaaaataaaccccattttaaattggttaaagggggtggaaaggaaaaattccccccnttaaatttttggggtncccttggnaaattaccccanggtttaaaaatttaaattggnaaaaaagggttaattntttgggaattttttttttttcccccccttnggggggtttggtttggaaaatttggttggggggnccccccaanttntccttttttcccaaaaaaaaaaaaccccccaaaaaattnaatttgggtnaaattaaaaaaattggggtnaancccaaccccaaccccccccccttggggtgtttggnccntnttttttaancccccntttttnccggttnnccttttttcccaaaanttttttttttnccnanggntntttccctcttgggccntttttaaacctttccaccttncccttttttttcccccncccntggaaaccccccatttggnccacccnncccataaaaaaaaaatttccatttcccccccccc

SEQ ID NO: 14593 - DNA, 626 bp, Homo sapiens
  misc_feature (1)...(626): n = A,T,C or G
taattnnttctntgtatggaccctgtgtaaccntgttnttaattagcaatctcccaancaggggctctttatgggcnatagggttatgatcaaaactgtggaataannaagagncccagananccanaggagggcccactgggaantgttctaanctgccaagttctncaacgacgtgccatcctcagtggtnagtctcattgtcttatgagcataaagtggagttttccagagactatacaacacacagtgttgaacagnctgaatgaagaagcnaatatnagnatcctgaccagcttntatcaagccatgcatgaaaganatttgcaaagaatgtnaancaatgtgactnttctagttccnttattttagtttttgaaaanagcnatttttacgaaatttgntttnatatnaacnaacactatgtttattgttgttattccnaaataatananacgttttttacgctttnngaanaaaantaaaaaaaangattgatancgagnnagtanaaaattnattatanatatnnatggtaganntcctnnnanngagnanngtnggccntggntatagtnancnntngtagncatnanntnggngaatgnnaagacgatattaggata

SEQ ID NO: 14594 - DNA, 125 bp, Homo sapiens
  misc_feature (1)...(125): n = A,T,C or G
aggncactggaggtgaanaaggaagctcttgactctcctaaagctgatcccnaantgaaggctttgaaggccaagaaggcagtgctgaaaggcatccacacagccaccaagaaaaaaaaaaaaaa

SEQ ID NO: 14595 - DNA, 1409 bp, Homo sapiens
  misc_feature (1)...(1409): n = A,T,C or G
aagaaaaagaggaagagaggagagagaaaagggnannnnacagggagcgagcggaaccacacgacaccgacgtgcgggaggagcgacagatgagcttgnaaaattgaaagaaaaagaagagggagaggcgctcgcgcgccgcnnccncncacnannnccccacccagcgacccgnnacgtccaggtcgccgcgccgcgccccgcgcttttcgcacccgnaacaggccacctcgctcaccacgccatgtgtgttgctctcttcttccgcttgtagtcgatagtggattgctgagaactttctggtgtccttacatattatctcagtcttatatattattgaatgatgagtgtcactcctcctaatgcacgcacactcttngnaattctactcttatagtgcattatcatcactacgctcttctttttaccattatctttgcggctcgttgtatctcttcgcttgttctgttcgtctgtatcttattctntcaataacacgcgcactctatctctgcttgttgctttttgtccactacacgcgcgttatgtgcgtcagagtcgtcgtgttctcggcattccacgacncgtggctgtgtctatgctgattgtatttttgtgtctatatattatctcgtgttttgttccgatcactcgatagtgctgcggagtgattaagtgtcacattacgtgcgtcgtctcactcgccatatnctgctcctgccggcgtctctgcctcgccgatacccgcacccgtactcctcaatatagctccttcttatatctcttgctcgcttcttctgttttgttctatccttcattcttcctcctcctctttatcggcgttgtcccgatgtgtatcatgtcgttccgctgtatcttgagtgtcccgttctgctactgttgatctactcgtcgcgtcccacgcaatctattcgtcttgtctagttcgcactcgcggccactgtctagacgttctaagatatgagtattantgtacgcgcgcgncatgctgcgtcacagtcacaacgtgagttacttcgacgtcatgtgcgcgacttcgctgtccgctactccgccgccgctctccgcggtccgtagcttctcttctctcatgcgnggttattcgatatgcagttgtcgccgcgctcgtcgcgtgcgtggttctgtttcgatgtcggaggtgtgtatcagtcctcgttgtgccgttgtgtattcgaatgcttttactgcgtactgttctacactgtcttcgcggcactactgtcttctcttgttcttctgtgtttcaatcgtcagtcgtcattagattcgtcngtatgtattganatgtatgatactagcgatataattaggaggcttgtacacgtctctcgtcatatctctantgatgatatttgcggtaagagatt

SEQ ID NO: 14596 - DNA, 488 bp, Homo sapiens
  misc_feature (1)...(488): n = A,T,C or G
tnataaaaagagagcctgttngagaatgaatccatttgaaatgacaccgagaagaaattttactcaacncaagtttactgtttttcacttttcatacgnttttgagaactttcaggaggatgaatatttgagttgacaaaatatantgcatgagaaattgtaactctcttcaaccattcactttctcaagataaaaaggaacaagtgacttcgcctgtcatcccagcnctttggaggccgaggcgggtnaatcacttaaggttaggagctcaagagcagcctggctaaaatggtgaaacccattctatactacaaataccaaaaattacccaggcatggtgatgcgcgcctgtaatccctcctacttgagaggctgagggacgggaattgctggaacccgggaggtggaggctgcagtgagccaagatcgcacctcggcactccagcctgggagacagagtgagactacatcaaaaaaaaaaaaaaaa

SEQ ID NO: 14597 - DNA, 346 bp, Homo sapiens
  misc_feature (1)...(346): n = A,T,C or G
cagaccttctgacatattgaacaagaataatggatgggaaaaaacagccaagtctcctaccccggattcaaaatactcagcagtaagaattcatttgcaacctgcaattaagtagaaagaatggatccaagaacgagtctggacatttttgaaaataaagcctcattctcctgtcttgtacatgtttactctttggatagcatcttaaatgtagccatcttggtgatcttgggtctacatctttaagtgactaaaaaggaaatttcccaattgaaaatgaacaaaataacttttaaaagcagaacntctcagntgagtttnaacaaccattggaanaatgctgatc

SEQ ID NO: 14598 - DNA, 1467 bp, Homo sapiens
  misc_feature (1)...(1467): n = A,T,C or G
agggaaagaggagagagaggaagaaagaaaaagagagannnacccagcgtgccacgcacgtccgcnnacgcagagagcgcgcgagactaacctactcttaacttgctcgctaggaaacacacaccaagctacaaaacgcgcaagcctcactcnccaagagacccacacgcccaccagcagcccaccccacacaccctcatacgccgcgacactccaccactcgtctcatactccacgcgcgtctacaacgcacagcatataacaacatgagtttagtactacactcagcacacatgcgatccgttaccagacagagtaatcgaccatagatgggcgtggttcgtaagtagtgacatgaaggtgagatgagcagactcttctcttcnatactattgacagttatcatatacctacctctcactcctcttcatattctatcaccatacctacgcactcgatcctgttccctcctactatacgcctctgtgagcagaagagatatgtctaacgataagcataatagatgaaagatnagaatagtgcatggagtggcatgatagacgagcgcaggcacagcaaaatataggagatagagcaaatagcagacacaacaaagacaggtggatataatcaaccagtatatatattcattaggatagattatatatccagctatacagtcgtatatacgtgtaatagacaaatntgtatacattataccaacaccatacccacatctcgacctgctcacaacgaacctactcattctctgtatatctcgcagtatcgacacctcttctctgtcgtaatgcactgccgcagcagagctctatgctncattatagtatgctatactagtatcttcagtctactatgctcccgtactcttcnacgtctcntcagctgtatctcctcacnatatcatcacnctcatcatcatctacgatagcactaatctataacnacatagcgcatcgatagtcgtataagatatgtctactntagtgtctgcgctactagatctagtcgcatatatagtacgnagtataattatataccatacttcatgctcagcgagnagcactctctgcatctctctctagcatccttcctacgctcattntgtcttattgtatgaacgatcagcgnacactacacacatacgagatctctcgtcatactcacgtccacataatcgatatcaaccgtagacacaagnagagcgagtaccatgctatccgacacacacggcattctcacatgtcgtacgtgcataacaattatagacagatcatcttcatcnatcaccatattcaccatcgctctattacaacttcactatagtatagctctatttgacagactatgtcctgttnacataagttcacagtatcatactcatatcactgagatcttatcaatagaatagctatatcccgtaggtaggtaatatcgacatgatatata

SEQ ID NO: 14599 - DNA, 343 bp, Homo sapiens
actcgacacgtaaacttgattccaaggaaatcaaaagctgatcgtcaacactggactttgcaggcagctcccaaacccacatgcatatttacaactaagaaatgccagttcctcaaagaatgttagcctctgagatgcatcaggagaccaggaggcaaggggttaaaggcaaaccgtggcattccccaaatctgtccagttccctggcatggtacagtgtcgcggagcccgaggtggcatcttttgtttggctgctgatggcggccttcgggccttggcatccacgttgctgcaattttccaggaacagtatcatttgaaagtagagctccacggttttgctc

SEQ ID NO: 14600 - DNA, 436 bp, Homo sapiens
  misc_feature (1)...(436): n = A,T,C or G
agganaaaaagtatnaagtgcttgcttggncctttcaactgngcttataattctgtcttcncctcatggnaaggatggggtcatgctttgttgtccaggctggtctcgtactcctggaatcaaggaacccttccacctcagcctttgaaagttctgggattacaggcatagttcatcctgcctggccaanaatctttaatgctctgctcaggcaactcttcctctgaggatccttccagtgacaattcaagaattagcgactcaattcccagggtcccttagaccttcgacctgcttgtgggcaattggaaacaaggattgtgcctgaatcacctttgcattcctagcatcgtttttcctggataataatttgttcaatatatgttcaataattgttcaattattcaataacaaatgttcaaaaatacgatcggcg

SEQ ID NO: 14601 - DNA, 850 bp, Homo sapiens
cctgctgctgctggcggatgtacatgattgccttgcggctggccttccacccaggctaccaggggcggattgttactggaggagaagagcctgacgtgtaaatatacaagcttttaccactcatcagatcaggacgagcgaactacccttatcgagaactcacaggcaagctcctaccatttgctgccttgtggcctgactgtgatcccagggctgttggctataactacatggagcacagtgggctgctccacaacagacatggcctgaagacagtcgactgatcattaggctccatgaacatccggtttctgacgacatatgcaaatgacaccaaccccgaggctgtcacaatagagcgatgagtctgaggagactgctgtctgtgggctaagagaagatctcctaagcctataaggtccaggctctaagacctatggctaagtgaccagactgttgagctacccacaaacactcatctatgctgcccactagggctaaatctgtctatacaagaaacacttacttccgataaagacgcgattcttacgcttccgttatctgagggttaaccatggacttagctcacttgctaggtgctttgaataggaaacggccgcaagcgggaaaactttaatagaaggtgcaattgcggtatccacaaacccggggccaatcaggaaacaactggtgtcaaatgtcttacttggccaggaccgttgaaggcccaatgttgcggttattttaggcttttgtccttgcgggcataacaaattggggtcaagccatgtcgggaacccgccagggttgaagatcccgcgtttcccatgaagctactttgtgttactgg

SEQ ID NO: 14602 - DNA, 523 bp, Homo sapiens
  misc_feature (1)...(523): n = A,T,C or G
cggggnttccttttnccaancngannagggcaagttttttnggaagaaaanaacnagtcgatgaaaatnaatcnagantttttnncantacatcagatcagnanatcccgtcctccccattangagttcnnaggaaaagtacccanatntnccaccccntggnctgactatgtacccagaactggtggagagaactncaangagttnagtgatttgctccccaatngacngggcctgaagaaancctgnatgntccngtgtggtccaagaacatctcgtctctaaaggcatgngcagatggagccaagggcgggcagtcancagagatttaanaggagtganctgatggnctggatntgggctaanagaagctctccagagcctccaggcancaggntttnagtnctacagcaagcgntcnggccttcagctnnncaaaaacntcattcnagnncncccncnntggtcntnnttttctcnnaaanangcccnnacctccaaaaagccgatcggcgtnnannna

SEQ ID NO: 14603 - DNA, 542 bp, Homo sapiens
  misc_feature (1)...(542): n = A,T,C or G
aagcnnnagtgacnctcttaaattaaccncccgctacnagcacttcaggggccaaggagttttaaaaaggtccaagtagagcnntctgaaaaaatcctctggagggggttgatcagaaacnttntnccnccataanaaagggccccaggaagaagctaaaatgggccattgagattgtctttattcatcaagcctgaagttttctgactctatctttcttttcccgtggccactgttacctctccagaacagaccccatcacctgaattctgcctgagcctcgacagatatgctcagctgctctcccatgctggctgttgttaccccaacccacttaaaattccttgaggtcttagaagctctctcccaccaaggtgccgaaagaagtatttcacaggttctcagtgacaattgtttattgaaatttacactgatgagaagtggtccctattaagggaattcaatccaangagattggctctanncnttngancatcnnganaaatcanatcgncgtcgtnnaananaataanannnnctcc

SEQ ID NO: 14604 - DNA, 1333 bp, Homo sapiens
  misc_feature (1)...(1333): n = A,T,C or G
ccctccacctcaaggcacagcgtcggcgcagnngatccgcccgctcgtgcctccttcacccatccccgtcggcgtctcgctctacgctctctttcttcttcccactcaataaaaacataaaaaaaaaagaaaaacttgtcgancgcgccngaagactatgaaacgtacaacccacnncccacaggaatctatgtcccaccgcttgttttccctcccatggcggacaacgggtcacagcatntaatattnntttcttccctgagtgatctcccgtgtctcaagtcctgtggcgtactctcgtcccccgctttaccatcttcntccgcgccatccctctcccttaccacttttttacatcatattccactgtgtgtgagtccgcctcgtcccctccttcttcccgctctctccccgtactttctcgttcttcccccctctctccccccccgcgctccctgctgtgttgttgtctgcctatatccttgttcatgtatcctattgcactgcctctttctgctgatagtttaactgcccgctcctggcgcgttataggtagtcctccgctatccctgcccccgtgatcgctttgtgttctgtgtgccctcttctgtgcgcttacctgccctatggtctcttcgctcccgggctgctcgcttggtgtcagcgatctatgtattgcgtatgttcgtacctttgccgccgtcctccttcctcgtctcttcgcgcccgtcgcccttcttcgtcttctctttattccactttacttctatctcctctcatgtcctccttgtcccgcttcntcgtccgctctcttattgttgcattggcctctctctggtgcctagtcgtctttcgttctcgcggtagtgcgctacgatggtgtgcgtcatccggatgtggtacangatccacttggtgtctccttctcatctgtcctctcttactcgcctgctcgtgcactcgctcgctcnctccatgggcggtgtacatctgtgacgctgacgtgcgcctgggcgttatgtntatgactctcgctactgcgcctcacgcatcacttctcgtagtagtatgtcgtccagcgtncgcaccacgtgtctgcgtgcgtaagatcagttcagcgtgacatccgacctgtcgccngccgtncacgccgcncgtcaccctcgagtctcggntcgtgcgtcaatcgtatgtcgctattaatctctatatccacttattacgtcgtctcgtcacacaattcnagacgtacgaccgttccatcacgtatctctctctgacgtcgttcgccgtggtccgctcgatgtcgtttggtagctctcatagctcgcag

SEQ ID NO: 14605 - DNA, 491 bp, Homo sapiens
  misc_feature (1)...(491): n = A,T,C or G
ataangcngcaagtgacctcntcttaaatttaaccccnccggntacaanatttgtcncnagancaaaaaancnttgcttattcaaaacaanaattggaggncaccagacccccaagnctgacnatttttgggaagcatcgggcttggcctgntantggaggtntggcnagtncttcccaagaaaaagnaaaaccattttaagggngaggggaagcagcctccaaagagaggagcaaanttgattgaatttgcagttctgagaacgatttccttcccagcctctgtcactgtttcttatgtccactgattggagtccttcagattcacttcagaagcaaggaagagagagaacacttcagaacacagaatatttactgaccatctttgccgctcataacgactgttcacagaaactttctcntgacctggccagcatccagcnaccacagttgttctagcttcatccctctcaccaatctttgggtttcctt

SEQ ID NO: 14606 - DNA, 631 bp, Homo sapiens
  misc_feature (1)...(631): n = A,T,C or G
agttgaagatgttggaanantaaganaaaangtacttgagtccctgaaacaccacttnnaccananctgnncattantnangatgaactgatngggaaanatangnacnttaccactngagaccaaccgtnatacattgtgaggaaatttgctatttttntngtgccaccaanatgccttattaaaccattgctagtgtcacagtntccttgncattntaaatgganctcngncgnnatatgccccnacnagcaaaaatantnngctncccttcnggacctgtntagngaatccaaaaagangttctgaaaacnctggaaaagaatcatttggtatcnacagggggatatcttnnnagcntctgttctnaaananttgntcaaantnanaannatggnttncntgccttaaaatctggtntnaactgggcggccccnttcccttgganggaaantttggcccannnaatnttnncattccatttnaaggnganggggantatngccngngtatncnnnanaaagggaattaaaacnttcnttncnanntnccntttngnnagggnaantnnaagatccnnnaaactttttnanccccngtnatncnttggggnttcngaancantncctnt

SEQ ID NO: 14607 - DNA, 473 bp, Homo sapiens
  misc_feature (1)...(473): n = A,T,C or G
ccctttaaancaccncaccttgggagncaaancccggncccattnantcaaggatnaancnggtttggggaaatatnaagtaacattttancacctttaagnccaaaccagnaaatncattggttaagaaattggcttattntttttttgttacagcaggttggcttatnaaaccattgcttgtgacaagtttccttnanantttaaatgganctctnccaagatatgccncaacnagcaaaaagaatgtgcntcccttcaggacctgtgtagtgaatctgagaagaagtttctgtgagctcttnaaaagaatcattttgtatcaacagggggaaatccgcagagcttctgttttaagacattgtgttcnatagttaagnatttctttcaagcctnaccatgctgctctcatgtaggngtccccgttctcttgnnaggcagtgtgttgcacagacaatatgcagaagccccac

SEQ ID NO: 14608 - DNA, 1334 bp, Homo sapiens
  misc_feature (1)...(1334): n = A,T,C or G
cattcatatttaaatcacatcgatcagtcgtcgtatgcgcgnangatangtcgacatacactaatctatagttgataatgacaantaatgctgcgcctgtccncatatcacatctcacgctgcaattccgaagcaccaccaaatgtacattattaacatacgcgtatatacagcgaccncgttatcagatgtgcacgctgtatatccggacgttaccgtgtgttggatgtacaangtgttgttgtaaccaagccatcggtacgaggtgacgtcgtttgtacttgttccccctagcttgttgtgattcacgcaactgtggttggggaatagaaatcacgtacaaatcatatcactgaacagtggttggtacacataggtgattgatcacccaaggatctatgtgaccgagtgtttgagctgcttgagatcagtggtgccgtccttttctgcacacgtatgctaattccacacacggtgcggcacagaatcggagatcagcgtaggtgtcaagcgctgacaaccaccgtggtttaaacagctggcaccttgtatatattctgtgaatacgtacccccacgttggtgagtgtcgtttgagtagaggtccgcttacaaatacccacacgcgccctctgtaatgcgtgaggcgacgaatcaacacagagtagatgagtgtatgaggttggtaacaagacatcactcccgcacacagcagggatgtgcggcgtctccacagttgagatgttcaccctcggaggtgtgggttatacacagaaaaaccttcttggatacatatcggagaaataactataccagttgtctcattatattgtgtngcgacacacactccacgcatagtactccagttgttgctgctcccgtgcgtgtgtaaatatccantcccatataagtgcgtgtgtaacactgggacattatcggcnatctcgagacagagattatcggtattatgcaccggcgcatactaatataatatatgccatcggcgacctgtcttcgttctaagtattgacgctcgttcgacgacacgtggtgcggtggagtatgaagatcaataataacgccacagagaacatatataagantcagattacgtcacaagctacactttcatgtcatcgaatagtaatatcncgcactatcgccatccatctcacacctgtctgtgtgatatgttggtgtacgcantctgcatcacataagcacatgncatacacgagtggcactgagtaagagtcagagcgcgttctactatcgacgacagcgaacacggcatcacgcgcacaattaacatagatcggcttgtcataggagcga

SEQ ID NO: 14609 - DNA, 676 bp, Homo sapiens
  misc_feature (1)...(676): n = A,T,C or G
ctgtgatcggacgcggtggtgcaggaatccacgggatctcgggatgatcgctaaatccaaatggtttgggaaaggagcttgttaggggcgttactgcggtacgcggtggacctaggagcaggcccgataattgcgcatcacggggtttttacaagctcggtagaaaatattcgcaggacggtatgccggcctaattgttttttcatgcccgtgtggggagcgggcgggcgggattttgtcgtgataaggaaggacgatgtgcaggaagatggaggataggggggcggttgtatggtagggggaagaggggagccttttaagcgtgtgcgttgtggttataagattgcgaggcgggttcccggtgtgcgtgggtttttgttgtccatattggggggtcnttgtgagaccgcactttgtgtttttatgcggtaaggatccaacacagcgagtgttcaggcgaagcgggggatggtttgatgctatggggtgacgtgcgagcgtattgcgacgggtggtgcgcttcttgtgaaggggcgtaagttttgggtgtgggttaggtggatgtcctcgtagccgtgaagtatgtattgggatagctagtgggtgtaagtggcggaggtctgggggtgagcggggggaggagcgggcgggggcgccggggtgagctgacgccgag

SEQ ID NO: 14610 - DNA, 1209 bp, Homo sapiens
  misc_feature (1)...(1209): n = A,T,C or G
gagggaatggcggagcgacgcccgcgccgcgcagaccacaacgactcagagagaaaagcgagaaagagagnaaggcgcggccccttggtgatagannngaccgagggncngggagngangcccctttnngaggaagggagacangaacanngancgcgncggcnagnagagaggngnangngaggaaggnggaaggaaagacggggtctttaggaagangnggagagngggagaagacgcgtctttcttttaagaaagagggagggccggcggccagggagnaggcggaaagcgcaggcacangaggcaggaagagcagacgagcgangaaggacacgcgaggagcgcgaatagagaagagcgaggggagacccgcagggcgggagacggaggggcgaggaacgcggcgagaaggacgagcgcgcggggcagagaataaagagcgagcggcgcggcagagggggcggcgcagctctctttctctttctaaagagaagggacacggaaagaagaagaagaggagaaagaagagagagacgcctccgctcacacaaaacgacnaaagaaaggaggagcagaacggcaaggagagcggacaacggcggcgacgcgagcgagcgaagcggggagaagcgcgacgaggaaaaggacagaaggagggggctaagcgagcacgagggaaacccagcgggacgaacgaggaggagagagcgggagaaggagagggagggcggggggggggagagaggaaagcgcggcgaccaggcgaagagggcagagcaagagaggagagcgagaggcggagacgagagcaggggccgtgagagaagagaaaggacgacagggggggggagcagggaagagacgcggaggaggaggaaagggcccgcgacgaggaggcggaaagaaaagagaagcgggacgacggccgaggagagaaggcggcgcgcggcggcagggagacaggaaggagagagaggacgcgaagagagagacggcacgaggagagagggacggaaagggggacaagcgcgagaagaaacacgggaggaggacacgaagacagcgagaagacgaggaagacgacggagcgggacgggaggagaggaggacaaggaaccacaagaggtgaagagagggaagacgccacgagaagaacaaggcgagcagcggggcggaaagcagcggagaaccgccggccagaagaca

SEQ ID NO: 14611 - DNA, 259 bp, Homo sapiens
  misc_feature (1)...(259): n = A,T,C or G
caacggcattataactttattcccaggggataagccntttnccctgggtaaattttgcccaggnaaancggggnaaaaaattncccatttgnccngtttantcaaantggtgaaccccccaggntggntgngcnaaanaatttnccataaccnttaggaanaggccggtttcccgtacccncccttttggatatatggtaaaccgcgaaatngtggggtttcnctccaaacaagaacgttcagttgtcatgaancgngt

SEQ ID NO: 14612 - DNA, 1263 bp, Homo sapiens
  misc_feature (1)...(1263): n = A,T,C or G
acgacagcaggaaagcgcaccaggcggaagcgaccaccgcgagagacagngcgcaggccttttggcggggggaaaacaggangggaagagagcgccctccgnacgggagcgaaacaacgcacgacggacgcaagaccgaccaaagaagacaacaacgcaacgcgcgaggcacgcacccagggaagaaacggcgccacgacagacgggaggagaccggacaagggcgacacagagaggaagagacacagcggcgaaccaggcaagagagaggacgacagaagccacacacgaaagaggagcaagacccaacgcaaggagaggggggcaaaaggggaaaagaaaaacagggcacagagggggagacccaggagagaggcggaaccaccggaggcgagggacacagtggcagggagcgcgggaacaagggaggaccgagagacacaccagagcacggngagaaccaaacagaagggcgagcgacaagcgaggggcagacgaggaggcaaggccacaaccaccacgggaggcaacgccggggaccaaaacagaccacgggaacaaaacccgcccggagagaggggcgggagaaagagcggcggacacaacacccagcgcggggaagggggaggggagaccaacaccaagagggccggagagggggagcacaagagaacacggagaggcggagaagggaagcgcacccagaggggagcccaacgggggagggggaaagcacacgaagaaaagaggcggaggggggagagaagcagaagaacgggcccaggggcggaggaccaaccacccacaccggacaccaccaccggaaaggcggcaccggggagaggcngagggaaaacgacacgagaagggagagaacagcgaaggacacgaaaacgcgaaaaaacgaagcgagagagcggagggagcagaaacaagatagaccgcgagcgcgaaggacgacaacagaaggcagaccaaaggcggagagaaaggaggagcagaagaaagacaaaacacgcccagccagaaagcggcagggcgagatacgangcgcaacccacagagaggagggacgagaagggagcagcgacagaagacaacagagcgaacacggcaatgagtgagagtgagcccgccgcagcgaagagagagcagaacgaaactcggagaggcagccgcaggacacgagcgtcgaggagaacggacgaagagagaacaggaagagcgcgcgcaaataagacacatgagcggaagaaggcgggg

SEQ ID NO: 14613 - DNA, 795 bp, Homo sapiens
taattggaatacgcattggcgaactaggtctctgctccccttgccaagatttatgacaacacagagggataggatcctgagaacacaggactgaatagtgacacaaaatttgaagaacgcctacctgcctcactgaaatgcatacccaatctccaagaatgtggaatgatgaaccctttcttactcagacggctaaaactatgggacagcctggcagagaataatgctcacaaaccctatcgcattcagttccccttgagaaatggaaaaatcattagccctctatactggactactgtggcttcagaagcactgcctgggggtagccgatttaactttactaagagcgctgtgggtccgagaatatcactggattttcggatcatcgatagaaggcagcgcgattgggatacggagaggatattgttcggcccatttcagtggagaagcgcattgtgggctaggatccgtcccgtgggcctcgcgttatcacgggccttatgtaaagagcgtataagattaatgcccagtgtgatactccggtctttattgtcatccaccgcccggtttatgacgcttagactcggtttgggcttcggaagatacagacgtgttgtttgatataatagcgcacttaactttgatatggcgagggagacaacacgcatgtaatcacgcaatctataagagcttagcacacgcatctctcaccgatctaaagtaagaaaaacattatggaggtgaagaggagactagtttatcggttgaatgattcacatatacgccttgtccccg

SEQ ID NO: 14614 - DNA, 1638 bp, Homo sapiens
  misc_feature (1)...(1638): n = A,T,C or G
atattttctgctccccgcgctgccgcccccgccgcgtgatctagccgtagtttattacatacactttacacgccgccccttctattatgtgatagcnatcgatcatcacgccgcgcatattttccgttttgataccacanccacgagttgtgcgctcgcccataatatgacgctgacatgagagcgcatgtactaccgtcacgcctcgcgccgcgttgctacgtgatatgttgtacgtagcgtgtcgtgtaagtgcgataacagcacgccaatgatcacntacatattaactcggagcgagttgtagatatgcgattactgcgggctgcagctccggcacgcancacactgatgatattacagctgcaatgaagtcggcacgggcggttgcgaatattcagtagatagtgcgacgcataaggatctcatccaccnatctgcatcatanactattatgcgcgcacggcgattatagtattcgcgccctcnccgcactccatcgatatagacgagaggcaatacggaagctcgtatccatcgttagagcatggctcacagtcatctgcaattgccgagtgatgtttgtacatagaagtagcgcggcggtcatagagatttgtaccttatgtatcggcgtggcgtacggtgtgtggacatactctatncgcgcgcgtcagtgagatagccttctgctgcatatgatagccgtgatctcgtctctgtagacaaacgtcattgcgcgcatgcgtagacttgataatattcctaagtgtcggtattagtncagtgacactaacgcgccgccgtaacgcgctgcttagcctctgtacattattagcctcatcgtcacatgtcgtcgtagagctctcttatcgcgcgctaacctcatcgtctcgtgatgatactgtgcgtcctactaccgtgaccgagagccgtctactggtgatcagcgacgcagatctagatgatggcccagcagcgaaacgacatactgtgtgcgagatgatagcatcagtgagctgtgacagaatgacacacgtgacgttaggaggcgcgacatatgcagtgtcatacagcgccgtgcacagcgatatagatgcacgtgtgcgctctcgatacaactcctcactgcctcctgattaccatgtgtcatagtcgatctcgccagcacgtcgcgcacntgcngcgagtctcgatatcgcgtacgagcatgcacgatgncgcatggactggcgcacggtcctcgtttctctcggacacgtatacatagcatgatagctacgatgcataccgtcgtaacancatctntagaccgtatgccgctgctgcacgtgntaatgatgcgagatgtgcgagctgtgcacgngcgagcagattcactgtgagtgagatacntgactcagcagagacacntgatcctccgtagcgcacagcgacaggctcggtgtgcnagcgcacttctccnangagtctncactgcgacgcagactgtatgcgtcatacgcgctgtctgtatntccggccaccacagtngatattgcgcgngcgcgtatcgacacggctgacactcagtattatcgcagcgtcgtcggtacgnagcgacgcacctctcgcgcacatacgaatcagtatcacgat

SEQ ID NO: 14615 - DNA, 827 bp, Homo sapiens
  misc_feature (1)...(827): n = A,T,C or G
atacttcctgcagatgagaccttaattttaattatttgtctgcatgatgcaaacatgagcatcaactggggatntgagccaccatgtttttgagattgaggcntaacccacctccacaaatccatccctcacagggagaaatggagacagggggataccagaggcactagaagaaaggcagaattctcatcaatcccaggagtgacaagaccaccctcaccactgtgtctgtggaaaccacttgggcgtaataatgaagcctttctgtccctcccagccaggcactatcaacagaagcctagagaggagtcagaatttctaccctcatctattactgggatattttggtggtccaggctgggtggataatgggctcaactgaaacccagtggggacctgaattttaccttttcctaacagtaatgagttggtgccctacccctgccactattacagcagtgtcagagaaaatcagctagaaacataagtttttacgtaagatctagaatcttgtaaaataataaatagtatgggtttaaactgatatcactcattataccaagaaccaggaagacctcaaactgaatgaaaaaaaataataaattatatgatcaagatgacagagatattataattatctgagattttaaagcagccatcataaaagtgcttcaatgagcatttacaaacatacttgaatcaaaagaaaaaataaagttttagcaaagaaataaagacttgacaaatagacgaagatgcggncgttcaannnnnnnnnnnnnnnnnnnnnnnnnnnnnnnnnnnnnnnnnnnnnnnnnnnnnnnnnc

SEQ ID NO: 14616 - DNA, 959 bp, Homo sapiens
cccactcactccacgacgtgcggacggaaaacacgagggctcgtgggtgaccgctggctcaacctgagaccaacaggccagtctaaccgcataagaaagaagctagagagagccgccactagcgctcaagagcccggagagacgtgtcggatacatgttattaccataagattcagatgatggtgcaaggtcccactcctggaatggccattgattccggcgcaaacgcgtacatatgactgggatagaactgtgggattatcctggccttagaccatttttcagtgagcaatgcacagtaaacaacgggttatgtcatcaaagggggataaataggggtttagttaggcgcaacactggtccacgctgctgtaaactagtaaaaacaccccatttattggtaactgactgcgtgaacggcccacatcggtgaagcgaattgaaaaacaaagattgcgtatttggtgtgaattgattccagatagaggcatgttctggtcccctggtgtggctcccctgaatgtttaaaaacaacacatacattgcaaaaagtgcgaattaatactcagccagtggggtgccgcccgacacctgcaccaaccagttttgcctcacggtgatgtcaaactgtaaaacggtagggttataaccctccattatcctaagctatttttatttagatatcatccgcaaatattgttatccagcgcgccgtcgcaattgtagaagacctacaattagatcgggggtacataatagtatatcggcggaagagggctaggcgatttgtaggatgaataatagtagttcatgaattatggatccgatcacaccagtgcactttagtgtattttttgtcgcacacatgcatttatccatgctcgaccatctcatagttggatatgtataattaatatgatagatcacgcctgccccacatatattttcggtattctgct

SEQ ID NO: 14617 - DNA, 960 bp, Homo sapiens
cggcggaatacacacgcgagcgaacttataaaaaacagcggggatttctcttgtgccatcagcactgccgaattttagcttgaatatctcgctacagcgcagatcacgtagactactcgacacacacacgtacgtcaaatcttacagagtgggggtggagtctattcaattaatcaccggatacagatcggctctctatccaaaagactccaaaaagaggggataacctccgcccataccctaaaacaaaacagattcctagcatgtacaagaggcctaaaacaacattgattagaactaagatgtagaagaaaatgatatggccctactctaccataggctcactgaagaactatttttcgagcctttctaagaacacacaagcagggttagttttcttcctggacctgtcatgaagacttaggacagattttttaaaagacacctattagccgagggtccaacttaggattaatgaacaaagcagcggcaagatcacacaggaaaactaacccccttgatacttggtggatcaaagacccgtgctttggtgaaaaaaaatacaccgggaggggctcccttagatattttgcgggcggtggcgtattgaggaacaaaagggaccttgcgtcaagggggatgtaaaaattattttcgcaacctccatacccggtgccgaaataaaaaaaaagagtgtatgtaagtgcttaaaacatccggaaaaattgtcctgcggggactcagcgtcaagagttgagtggttatctttgttagaaatccttgaataagtttgagactgccccaggagcaacagggaggggtttaggttaggggggggagagaacagcacattcttttagaaacaaaaacagtacggccgctacatgagaaaaggaagagatcgactgggaaatcgggagtgtgcgagaaaagcgttcaggagtttatatattaagcata

SEQ ID NO: 14618 - DNA, 1576 bp, Homo sapiens
  misc_feature (1)...(1576): n = A,T,C or G
gttttcttgctgcgccgcgcgcgccgaataatacagaagaagcggaaaaggagccgcgctttgttagaggaattaggcgcgagaggcctcgagngggcggaaaccaagagcgcacccgattattgaagtacgcaacccagtgcgtttgcggcgcccancgtgtacgttcgtgtgatagaaagatgaatggcagcgngcgcctcgacacgcgttagagcatcgatctctgagatgcgatgcgcgcagcgcggacacgcacaccgtacgcgatatgtatcacagcggatagaggacgcgccgccgagactcgaaatgcgcactaagacagcacgnacacgaacgcatcccgcacgcagtcgagatatagaatattatacnagagagacatataagattacgcaccgtcgtcgtctatcgctgaggatgcgggaagtatcgagacnacagacacngcgcgccgtgcatataagatgcncgtctatgaactcgtatacgcatagtatgtctcatntgttgtagcgctctcatgtgatcgcgaggcatacgcgcgatnctgcgcacttatctgntgatatcactgtacagaantagaggtcgcgccgttgatatatgagagacagttcgacggacgtaccgacgcgccgtaatnatctgtacaatgacactcgccgggtgatataccgtccgatgtatcctcactcgcatactcagactgatgaggttcgccgctgctcctgtcggatgatgatggtgttntccgaccgcactcatagctcgttctcgttcgtacgcgcacggcgnctctctctatcgtacagtacaaaaagcagtcaggctactcancggaganccnacaggtgcncagtatcatgtcngtatgacactacacgctcgtatgncgcacgtctcgcgactgatcagcacgtacagcacgcgtgtactcgatactgatacttcacagcagttactgcacaagnatatagttcgatacactagcagacagnatatgcnacgaagctacantagatcctcactggctcggcgancgtcgatcgcgnagtacggtagatcggagtanagatgcgacgtgcagacgcagtcagctgcgcacgcgatacagtagaacgtatacgtctgcgtgcatntggaccgcggcagtntgtcagantgatagacangagtctacgtgcnagtctcgtcactagacactantgtacacgcagcatgtacgtgtaacatggcagtnagtngagtgtcacgatcgccgcgcncacgtgcacagnagtcgcaccgatcacatcacacacgcggacagantcgacagagcagagcagagtcatcgcgcgatctcgcggcgaccatcacttcgacacgagacatacgcctctacgtgcacgcagctgcgtcacacgtgtatgctcgactacatcgtactactgcgctctacgatcgatgtcgtcgtgtagcactatgtatcccccagccagctntntntgtcactcttatacgtcgccgctcgtcgntcgcncgacacatgttgccgcgcgagtcccncgcagcatccatcagtatgcga

SEQ ID NO: 14619 - DNA, 1358 bp, Homo sapiens
  misc_feature (1)...(1358): n = A,T,C or G
ccgggggggttttttttttntttccgggttttttaaaaaanggcccggttaatttcccnnnttnnaccggnttngggttttttaggggcccccttggggccccnnngggnnttgaaaangncccncnaaaaatttttttttttttcccaaagccccctttggggaattttnttccnaccggggggggnttttttccccnagggnttttttttttttgggccccaaaaaaaggggcccttcccntgcccaanaaaccttttttttttaaggntgcccnaacctttttncggtttttttcccccccccccctttttnttcccngaanccccngatttttttttaanttttgtnccaacccaaggtttnccaagggccaatngacccggttccccngggggaaanccnaggcccnaagggnccccnatggggnttncggaaggtnaatttnccggacctcccccttntttaaggggnccgccccagggntggaggttaccttccgncttccccnttaaangaggtttccnatttcccaaacttgaaacctttttttttattaaaaaaantttattaaaggcgaagtttttttccaaaggttgaaaattaaatggnatggtttaatttaggccccantggagcatataactttttaaaaaaatcccctgncaaaatgtaagatatggttaattttagaataatttaatccggtaattgtagtgcataaatcnctttttactatagtatgaataactatagctgcaataaattgttaagaaaaaactatagctgcaataaattgttaaataagctgcgatgtaaataacaaaaatgccgattggaaaagaagtaaaggtatagntcttncagaaaaataagaagtgcagttataaactaagattncaataatactggttcttaatttgccaatgaatttacatttaacagagatctttatatgatcatatggctttcagttaccgtctagtgtccttttatttgaacctgaagaattccctttaacttttcttgtagggtaggtgtagtggtgatgaagtggccttgtttttgtttatctgggaataccctaatttcttccacataattttaaactcacaatgcacagctaaaatattacagataatatatacaaaaaagaattagagaagaataagtaagcagatattaaattgacctagaaaaaaatagattatcaaaagctcaataaaattagatatattaggaaaatcttacaataaaaagcaaatatttcataaaaaagcaacattaagaataaaagtagatgcggccgtnnannnnnnnnncnnnnnnnnnnnnnnnnnnnnnncnnnnnnnnnnnc

SEQ ID NO: 14620 - DNA, 896 bp, Homo sapiens
agacatcgagctccaccatcacttcactcgacaagagacgaagctatatgtcaaaatagtatgaggcttcacagataacccctcaaaaaagctgcgagcagaatatacaagaagccaatcaagttttacagaaatgggagaagacatcccttcttgctccgtgccatgacagacttcaaaaatcttcagagcttacacattgcagtggatcaaaggataatgcttcatgttttgagcaaaattaagaaaatcacagttttgaaaatgaaactgatgagactacaactaaaaccttactctctggtcactggctgaaatggaattagggcaagatcattcattatgttgcgcaaatatcatcatgccatgaatagaatatcctagatacacccccacatagtcatatgtgacttgtattatacccattgtggtaagcatataataacattacactggcctttgggtttctttacgaaaaaaaatcggatagtgtgctctcacattgttccccctttttttttaataagggtttattcattgaccccgcgctacctaactcttctgactctttcccccgtcatcctccacccgatttatcccaccttagtggcgtattcctcttctcttttagccccggctatccccgcgtgaatattcttcgaatacacctggcctcataaagcccggaaccaaaaatatgtctgccaataacagaaaaataaaaacttctacaccacgagcaaacttatcaaatttgaccctaactttaagccgatatatcatactggacatataatattaatttttatttttgaacttcaatatacctatactctaccgctcttgcataattataccagacccaactgcctccccaaaaagtaaatcttatttat

SEQ ID NO: 14621 - DNA, 400 bp, Homo sapiens
  misc_feature (1)...(400): n = A,T,C or G
tgggaatgctggacattggaatctatagaggttgcaccctttggttggtttcttttgactgggctatttttgagctctgtcgaggtggaattaagttgtagaaaatgagagaagtgtatataattcttattcttagcaatgtaaatggattttgtctggtaaggatatacatgatttctggcctgtggaaagattatgccaaacattacattttattacctttgagcttattaaccagctttgcgtttattagcaaatacatttaaatatctctgattgctcggtctttgaattcttcaaactctccattaacatcttattggtttaccctttaaataaagagagancggcgtnaaannnnnnnncccnnnnnnnnnnnnctnnnnnnnnnnnnnnnnnc

SEQ ID NO: 14622 - DNA, 2466 bp, Homo sapiens
  misc_feature (1)...(2466): n = A,T,C or G
ggggnnggggnnnnnnnnnnnnnnnnnnnnnnnnnnnnnnnggggnnnnnnnnnnnnnnnnnnnnnnnnnnnnnnnnnnnnnnnnnnnnnnnnnnggggggngaannnnnnnnnnnaannnnnnannnnnnntaannnnnnnnnnananngnnnnnnnnnnnnntnnnnnnnnnnnnnnnaannannnnnnnnnnnnnatttttttttnnnnnnnannnnnnnnnnnnnnnnnnnnnnnnnnnnnnnnnnnnnnnnnnnnnnnnnnatnnnnatnntgtngtntnannnnnnnnnnnnnnnnnnnnnngnnannnannnnnnnannannnnnnnngnnnntnnngnannannnnnncnnnnnnnnnnntcnnttaanannngangngangnnnnnnntannnnganagnntntaannaannnttgnntnatnatttnntgtntnannnnnannagannattancngaagnagnntgnnanagannanaaagngtcagaccnnnancnnannanngnagngngnnnnnagcgcagncaancncacagctagagcgaggtcgncnagcatngnagtagncggtagngnnagancagangcngagatgcancgcnatnacatcatcgncatctgaaatcncgacnctgcctnanatcgaacatcnancctnacacagnatnncnctnatcatgcgnctacncaccacatagacagacgacnctgccagacaanctaagttcaacngagntcacnactaaannnacgagacgacagtgcaganggtcagnggtacggcagagacatantacgatcgataggaattgangatgaacagcactgagcagacgagtanngattnacgcgtctangttnagntnnctncagcatanaaagcanatgaatttngtaannnannnagannnagtnnnacatntnatnnnangangtntattatnnattgtnntctttaantattanatgaanatntgntgnanntantntnatnactcntacagaaatgtctattacntcgcgcttattantngactatcgatgangcataangtattaatctcgtacctgtcactgcatcagatanctggtaacatcagatagcagtactagtagtattagtagacatcgtatagtactactactcntantcacttcantngcgctcnctcgcgttatgctacctacgtantcgtctatangttgtacgnnnanntnttattntntntcttatgttcttcatattccncagtctactagatcagtacatgactcgtatccacnagacaatcgtcgcgcganctancattctctctcactctactatcttacactanctgtaatcgtacacacactatgncacctancgccatcatactctaccatgcgtatatatacactaccancacctntatagatacntcctactgcatactctccatcacatagtgtaatnctgacantctacaagtatatagtgacgtcgacacgtacanacgcgcnccgcacgnctcagtcngtgntgatcgtattgctcatgcttgattgtgacgataacgtagcatatagtgatcccgacgatcagtngtatatactacgtcagtaagtgtatgataatcnagtcantgagananatgttntanaggtattcatngtgtatagtactgtacgcaccgtcacgcgacgacatnatgagtatatnatagttgagtangntactcgagtantcatatagttangtcagtgnttatgagatgatngaatatgtgtatgattgttatgtgtgtngttnganatgnagcgnctgatcgttcgtagantatgttgatgtagatctgagatgacatcttaccaatgtcatcgctacatgtcntnctatacatacagacganaatgtagtcnagtagatctacnantcgtangncatgaantacaaacgagncgtcgtacatatcgtcgaacatantcgcacactttaacagtgagtccatagtactntagactattatactagtatattggatgtaccagtnctacgcacattcntgcttactatgatcnagaancangtctcgtctgntgcttccgatgtagtncagactancancgntcatcnacgttgtactatantgatcgtagttantcgatcactgcgcgnatatncgtcatatgcattgatgantatctgcgtcagtatcacntgntacgtgncaatangantanacganactgcgtctancagttaatactatgangcnantaacgagttctcgnatgcataccgtangtagcgagtcgtgntctacatgacgctacggancagtcacnggntcttangtcatgtatgatcgtatattagtagctcgagccgnagcgtgantacgtcgagtatagttangtctactntcngatncactnctgcgctacgtagtcgtntntatgnagtcgtncgnang

SEQ ID NO: 14623 - DNA, 1201 bp, Homo sapiens
  misc_feature (1)...(1201): n = A,T,C or G
ggcccccaggcanaaaagagaaaaaggtgggcgcggatgactccccacacccaacaccgcaaccaaaagatacatagaacggacttttannaccctccaccaaaatactacacccccccttctcaccggtgttgggaaacgccgcgggatacatcacctcatcacctatgaaaaaatgtacacctnccattttcaacgagttagtgaggttggtagtcctttctagttacacgaaagnacatgaggacaggtgcctggcgntcaagaaccaccggatagngggggagcaggaggatgcattcacgaccccacacgcgagctcacgaaaccaacaacaataataaacaagtaataanaggcaatagacagaaccaccgccactacccaccgttcccctccgtctccttcctcgctcttcgtcacacgcatacccctccacacgactaacgaccaagacacacaacagaggaagagtagatgaaaagggaatgaaagaatcgcgagagcacacgtgtaaggagcgaccgataaagaaacgaagagagggaagagacaatttanatgatcagagatcggcaccgccacgatttcaccaatacacgccgcgacaccccgggagtgggagcagtgtcaccaagtgtagccatgtagcaactcagactaaccgcccgcacgagaagagaagtactcaatcacagcatgctcgctctctttatctctctctccgcctcttacgtagcaagaccacgttagcttcgtgtcaggccacaatcatcgacgcagctttcatttcacatctatatatctaccatctccttactttcacgcacagcccgaggcgctcactgctggttcccgaaagtggggccggtacggagcctcgtcgcgtccgatgtgtactgctcttctgtggtcacatcataacctcgcgcacgtaagttcagtgctagcagtggtcgtgcgcgcaacggcttaccgctacgcgtccacacgacaaataattaccacgagataagacggtacagcacgacgaaacagcatactgaaaccaaatagagagtacgctaagatgtaaaaggccctccaaataaacaacacgatacaccctcccagcacaataggctacataattatctatgccccgcgtgaccgtaaagatagnagaggaaaggcggagcgaatgtagtacacacacgagcaa

SEQ ID NO: 14624 - DNA, 184 bp, Homo sapiens
  misc_feature (1)...(184): n = A,T,C or G
agctgcctggaanactccccccttaaaaatggaatgaanattttcaaatntcccccttttncctaagtttggatgaanaaaatttaggtttataacgtttcatttttaggaanaagcttttgntgaanaaanattcctggnanananaaantatnttttaaggtttccnaaaaaaaaaaaaaaa

SEQ ID NO: 14625 - DNA, 905 bp, Homo sapiens
tcgaaacagcacacggtagaaaataaacaaaaaaaaaaaattaaggaagaacaaaaaaacactggaagaaaaatgaaaataccaatcacgcgggcaaccctaacccataaaccacaggcacccccataaccaatctggggacgttcacctaacactacaaaatccaatcactccgtgcatgatcctcgattaacgaacacaacaatgatgagggcgaacaaaaatgggaacgaagagtagagaccaaccacaactgaataacttttctattgatatataaaaaaaccgcccaaccacacctatttgaggtccgacacgaatagtccactaaatcaccacaccgtgcccgacatcctaacataatacaactacaccacacaaaaaattctttagatcacatacctcaacaacgcgaaataacgctacagtatcaccatacaaacaaccaactccaccaacacttttaattatatacttaattaaaaccacataataagccacaaaaccttccctccattaataatcttcatctactccccacccacacactccacactttaaacacaaatcaacaccaaacttccatcacactcaccacaaatttaaataaaaaacactttatccaaatacaccaatcataacaacgataaaacacaaaattctaaaattttaaaaattcataacattataaaaattaaaattaaccacaactttccactatgccaaacattctccccacacactactcaccttcattatactatcaaacccacaataaattatttcactaccaatttcttataaatacgacatccaacgtataacaaattcacccaactattaaatccttcaaccttatcctccacccatcccccaaccacacccctacatacaatatatatacg

SEQ ID NO: 14626 - DNA, 1287 bp, Homo sapiens
  misc_feature (1)...(1287): n = A,T,C or G
cttttttttctccgcccgaccccggggttcccgatttagtttagcttcgccccattatgcgacgatcatcgcctagttatatgccttcttattccgacccgtattatcctcccgtgtcgtcgccagctccatttcacttatcctatcgcccgttcgcattattgcagtatagcgctatcttgtaatttatagggagtggtcgcaattagcgtatttatctcatcattctcattagtacgcgctatcgcttgcccacgttctatattatcgcgctggagagcagcgaccgggaggtcgtcagtggattccggcgctataatcctcccgtgcgccatctaataagatccgcgatagtaacttcccgccccccatcacctgatatggtggtattgctgtgctgccaaagactcagtataacgatgtcattggtcgttacgtttagatantgcggaagtatgatacgtgtacgagtcacgtcagatttaagtgcggttaagccggatcattgcggcttcgcctgttgagcgccgcgttgatactaaatcgtagcgattatgaatatgtttgatatcagggcgtgcattagatagtatccgcgtcgtgtcgtgggagagatatggtatcacgcttattgggagtctactgaagcggcgcggctcacggcaactatactgtcgcgggcgtgtacacgggtcatcgtcggtgttgtgagatctttacttgacgaacagctcaaactgcgacaagagccattatggaacgcacgaantatgaggggggtgtggcgctgctcctagatttgcggcccgggcatgtgtatatgtgttgtagcgataatgtcgctggaagttagctcttgtctgtnttgtatgtagagaactgtgctaatgccatgttgcgtatggctgcctctacacttcgcgcgacgtgagatggctgcataggtagtggacggtgtcgattgacattgtagtaattagtgagaggagactaatanagatcgtctcggagatcgtttactcgtagctgtaggctagcgtgttcgaatacgatactctatagcatgatgatgtcancaccatactatacagtcacgctcgagagtgtaggaatgagaatagatcagtgcgtcagtatgagcatctcgnatgatgaccagtactcaatcgtcgtgagaatgtctgcgcgagcagattgcatatagtcttcgcgtgactagctagcaacnagctctcgatcgagcgcggacggcgacgctaccancgcgtgatatctgcgtttaatcct

SEQ ID NO: 14627 - DNA, 313 bp, Homo sapiens
  misc_feature (1)...(313): n = A,T,C or G
aagaaaggatagggaancaagtaattccagagcacccaccttccctcagagactgagtgtagcctctggaattaaactaagtggatcgagactgaccgctcggtgtcttggacctgctccttggggtctggtggagacgaaatgagataacactcataaagcccttagaacagtgcctggcaagtagaaaggatacaataaattttaaagaaaaagtaagaacaagacaaaatccaaataaaacccccatgactctagtgtactgtttgtctccatattccaatcacagaaactgaaactcagggaaatcaaa

SEQ ID NO: 14628 - DNA, 747 bp, Homo sapiens
  misc_feature (1)...(747): n = A,T,C or G
ccctcttctgtagggctgttccggttttctgggattctcttcaggccctattcatctggttcacttccgcacccgtatatgtcactcaaggaggttggagaacagcaaagatgagtgtgtgctccttcttcttggatctctgaccttgaggggcaccaacctgatgccagtaggaatgctcctgtttagagtgtctgacagcccctgttggagggtctcacttgggtggcacagggagcatgacccatttaatgaacattttggctgtcccttgatggaggaggtgtgcttcactgggggtaaacccactggcctgggatgcctggattcctcagaactagaaggacgaaagactanggctgctggtgtgtctggagtttggtccttctggtacgctcgagggctcacttacttgaagattgaagctgctgcccatacagggcggggttgtgttgacacaattatttaaggaccttccgcgggaggacccggactaggataatggccttaaggccctaaatggacccctagacttagtatatgtgctgggtgcgcctaatcctaagaggaactagatacgtgagaaaaagaagagggttttataacccctcttgtatgaccggagcctatgtccgaagtggcgaactcaaagccaagaggattattcgattgttgatggattaactcgccaggtcctacaggccganatgtattcgcgatgacgtgaagacctttatttcaaatcta

SEQ ID NO: 14629 - DNA, 931 bp, Homo sapiens
  misc_feature (1)...(931): n = A,T,C or G
anncaaattantaganangnnttccnaaacnnattnnngagatnntatacnngnnnngnnataagagnanggatgngtttcaaccccnnataanantnnnacccagcaaannnnaaagnaannaaaaaaaaaaagggnnntnntnatngaantaacnnnaanggggccnnccncaaaccaaannaaatcnnnttnnaanagtntatncncccccccnangaaagntntncatttnggggncaagggnggnttancccattngaatannantttggtgnnnccntaaaangaanaggggcttaccatgagggnagancaccaatnggnaggaaagcannnnntcctncaagaantanaaaggacaaaannnaangnttgtnaggggagtnttngaaaaaannntcncntgtnngaaggntnnngagtaaccnccngantannaaaaaaanaaagcntgcgggacaatnnnaagggcaggtattttgtgggaacnaaaaaatgaaagggctcccttctccngganaccccnaggntatnaaaaattgtcnnttagaggcaccttnaaaggnaaaccnngccaattanaanagggtnnngggggtccacnatgaaacntagttgcaaattaaaacgggaggtagagaaagagggttagatgaacccacatggagnaccgaaacccagattntcagcatccagtcctgtnacntggaggantctatgatctctaagtggatgaactagacctcatactgcctcaccanatancccttttcctttgtctccaggaacctgtcggaacnaaggaaaacnctgtgtactgaatgccatntctgggccaggcaangttataggcactttacctatgttcactcacttacttctcataaaantcatgtttccatttcacacnatgnaacctaatagggcg

SEQ ID NO: 14630 - DNA, 716 bp, Homo sapiens
  misc_feature (1)...(716): n = A,T,C or G
aagntgggtgggaaggtaanttcccncccatttttgttgcnggtccattttgcagnaggcatccntgcccactgtcntgattagccactacccggccantgctccttgggttacacagacttcaggcccagcaactttttcttttttctcttccccatctttgacttagtcggcatgcctccccactgatactcttcatcacacccgctatcattcagggcacaaggttttgtgctttgctacttccttgggtacagaatttcttctccctcccgtaacccatccaccaggctctgagttatagctaccttttcagaatctgttttttcctggtttagttttgggaacttttctccccatcttatcgaggctggagagcaggacagtgtcccttgagcagagagtggctggcgactgtaacggtccatggtgcctgggagtggaggctgagcataggcactgaggccccgggaaggctgctcggggccccgccagcatcagctctgtggctgacactctaggacctggctgcagccagagacacagccagacagcgctcctaagtgccactcaggacaccatttccatgggacagttcattctgggatcctaataaccaatcttcaagtgaactttttgaaaaagacgcttttgtcatcaggggactacttgcatttggagacttgttcaaatnaannnnnncaaagnnnccaaaa

SEQ ID NO: 14631 - DNA, 715 bp, Homo sapiens
  misc_feature (1)...(715): n = A,T,C or G
agntcacttgaataatttttggtgggctttgggatattggggctgtcccaagttgtctggaacttggccctgtgttgatttcgggcaggggaaaaattcacttggtatggagtgtttgataaaggagatggttgggtgtataggctctagactgattagtttgcatataaacggtatattctcagggagcacttttgtaagaattgactagccctaggaagggcaacctttctccagccagcaaggtcacaaatgctagagcattaagaatacagaaaatagtctgtaatcctagcactttgggaggccgaggtgggcggatcacgaggtcaggagtttgagaccagcctgctcaacatggtgaaaccctgtctntactaaaaatacaaaaattagccaggcatggtggcgggcacctgtaatcccagctacttgggagactgaagcaggagaattgcttgaacccaggaggcagaggttgcagtgagctgagatcataccactgtaccccagcctgggcaacagagcgagactccacctcaaaaaaaaaaagaaagggattcagaaaataaaactgggcatggtggctcatgcctgtaatcccagcactntcanagnnttaggtgggcttgnnattgaacccaagngtatnanngcagncnggncacnncggnccncnanagcnaacnnntnggnnnnntccaangntntcaaa

SEQ ID NO: 14632 - DNA, 1620 bp, Homo sapiens
  misc_feature (1)...(1620): n = A,T,C or G
atgtatatgtcacgtatgcgctgcttcgcgatcaaataggcagacatacctaggtagtgtgatgcagaatcacggtaggatatcgcctgtcgctgaagaagtcatggagaggagtgccatattcgatagacgggaggagatagatgagttagaatatgacgcgtaatgnatctggcganagcctgcgcgacatgcacgaggggcgtggttcgcctggcggaggagatatatagcgaagaacactgtctggtgcacggggagtgaacgtcggacgtaaggcagtcatcataattgataaagactagaatcatggaggaagactaagaacaacacgaacagaaaaattagaacgaaagataatatacagcgccagatgcgancatgtncgtacacataaatatgcgtaaactagccggcacaggcaggtaggcncaaagcagtatgatcgaggtcngnttangtgcgatcaattatacttaggtatcacaattgagtgatactagatcacacaggcanctgaaacattcanctacgaaagatgtacgagataaagccaacaattgtgagatagcttgaggagcacaaatagagacagtggaggacgatagtaagatgaacatacataaaanaagaacgtagtaagataatgacaacgcgcatcgngttaagagaccagtcacacattggagccataaaactagaagnagcgtgagcagtactaaggaacgagcaaatgctgcggagcgcgatgagtatgaggagagagtaacgaacatcacataatataacaagaggagggcgacgcgagtcgtgaataggagagaagacgatatatgaggacgcatcagcaagagagagngacgaagaagatgcacatagatactaagtagtatgcagttagtaggagtgatcacgatgaatagtgaaagtgtcactgatagataagtaatgacaacataatacacacagaagatttaatctcataccgagacgcatatagcaatgcaaacacaagcgtaataagtgaatgtngaacaagtagccagcacatcttcgcaataagcagtgatatcgtagtaatatgcgcaggcgtacattagggactactcgatacgttagtagcagcctcactcttgatgtatgtatagacgagtgtgattcacactactctatatgctcatctaataaggacatgtgcgcgagagattacgatggctatacgaagcgaacgtacacaggtagcagggaacatgatcgacgtgatgatgagatgcatagggcataangagcganggacgtcgagcggacttcaacacattatggagcgtgaagcacaccttatcattcgattgatgtccgcatgatcancatagaataggngaaagataatatgtatgtaagcagtcgacgactacgcgtacacccttgctgctaggactcgaggatatatggcggcgnacaantnggtgtaatatgacataatattacgcggngacatcgattgctcnatgtagggtatnntctcatncngtaatcataaaacactcntagctcattactacnatggtctcgctcngcgtacgaaggcatcacatctacactatcgtgacgcgcgctcac

SEQ ID NO: 14633 - DNA, 1242 bp, Homo sapiens
  misc_feature (1)...(1242): n = A,T,C or G
ccgcaaacaaaaaccaacccacagagggggacaaagaaagactttgctgtgctgtncaactnaagcacaacaggagggccgtgcagaagcggaaacaaccagggagaggcgaagngaacacaacacaacaccaaacagaccggacggcgcttcctgcacgggcgggcaccaacgcacaacaacaaccgcgcaaagcggcgcggagcggcaacacagaaggccatgcccacatagcgagagcggggcgccgggaacggcgaaggaaaataaacagcgcggagcgcacaacagaaacgacgcgcaacacaacgggacgcacgcggcacacgcgaggaggggggccggccgaaacacagaacgaacccaagctttttttggtgaaacgcagacagggggagcagcacagaaccaccacaggcagaggaggaagagaggcgaacgaaaccaacgtcgaaggacacccgcggaacagcgactaggataagaagcagcgagtagaaacacaccagcagggcggagccaaatcnccaccctagcacgagagaacgggcgcggcggccgacgggggcgcaaaaggacagctgaccgcacgcccgacagctcacatacgaacgcacggggcataacgcgctccagtacaaagcacatgcacagatcgccgaagcaaacagagaacggagcgaggaggcgggcgaaagtaanacaaccgacacccgagcgcacgaaaacagccatcacgcgagccacgaggccgaccagcggaacatcaccatcaggagcgcgacgccaaatcaacctcgcccgtggacgaccgcaggaggcaaacgcgggaacacaaaggggtcgtaacagggagccactggatgccgccgacggcccggcccgtacacagacgaggaacaaaaaacaaaacccaaaagggtagcccgggagaacaaaaggccagaaacatgagcgcacacacggagccacgcgagcacacaccagcaagaaccacaaggacgcccaagccacagaccgccgcgaataaagcacgcgccaatgaatgaataaccacacaacaaccaacgaattacgggcgcaacaaaacgcagcggcgtagagccacacagantgagaacacacggagacaaacaggaacaacacgagcggcgaagaagacgagcgaccacgagagatcagagcacaaggcgagcggtagcaaagagcatacaaaacaccgagacgcggacccggagtacg

SEQ ID NO: 14634 - DNA, 1127 bp, Homo sapiens
  misc_feature (1)...(1127): n = A,T,C or G
agatgcgcgggagaggccggcgacggagagagggagaggggggagggggcctgngtagtaggaccgggcggccgggaggctccgnnggggggaaaacccggncgggagaaaggagaacagcaaacagacaagaccccagttcccgaccgaggcgcgagaaccccgcgaccagaacggagcccacgcgccggagaaagcacaacacggccggccggcgccccgagaagcgacggacgagcagggaggacaaccaggacacgccaccggcagcaggcaagagggggggcacgaggcgaccggaggccagggcgagagaggcgagcgagcgcgccctttgtctttgaaggcagggaggcgagcacgggcaacgcacacgctgatcgtacacgagagcgagcgccgacacgagggaaccaccggcgcccccacacacgacggaggaacgcccgcggagaagaaccgcaggaggacgcgggatcagaccaggggaccacggagccacgcccagaggcagagccgagcagggaggggacggcgcgacgcgcgacagagaaaaggagagcgcacgcacgcgaaaaaacgaccgcaaaaaggagggcagaaggcggcaccccgcacggcgacgggcgcgggacgccgaaccgaacagtcgacgcggcacctgaggaagagaacgcggcaaagagagggccggctagggcggcgccgcggaggagcgacccccagcgacggccgaggcacggaagagaagagaacgagccgagaatagaaagaaaaagaacgacagtcagtgtgggagcgacgtgagaagggcgaacgcaccacaagaacgggcaccgagcggcggccgccagcgcgtgagcggccacgatagacagcgcccgcgcaaccacgcgccgagcccacgccgctggcggaggcgcgacgggccacgccacccagcgacccaagccaacaagcntgagcgcataagcagcccacctccacatacgagcgcggcgggcggccgcgggacacacaggcggaagccacaccgagacaccggacgcgggacagagggacagaccagacgacacgacacccggcgccgccacagagccgaggggagaaaagaaggagaaagagcg

SEQ ID NO: 14635 - DNA, 681 bp, Homo sapiens
  misc_feature (1)...(681): n = A,T,C or G
agccnatcntntggaacagnaaaggnaacaacncntcntggaaagngggatgaaaaaactgtngggcaagttanttggagntgtngattgggntatgttccncagccctttctgtnaagtnaaaggtgagntggccnttntnccagatganagacagggtganagataagaatatacccncccttagagaattcccgtagtatgngggtagtagaaccaatgaaanttcatgttttcaaagtaantacctttgtcctttgttnaagaaagttttgnntantactanntatttttttgnccctagaaaaattaagtgaanggtngnatntatcantaaaccaaaaccgtatgtgcaaagcagcagcaaacttagagaagtccatcacaggttggcagttggtttcntaagaacctgaaacanatgttcagagtgcgaaggntggctgatataaccagcaataactgacatagatttttggaantggtatttattcctttggcncctccanaagtggttagggaaaggaaccctgtacgtttanattcctgctttcatattcnaaatatcagntaatattattgttacctggntgttgccatgtggcttgacccttgatggntggataatgtaggacnatgtggctataataaatggtaaataaactttaaaaaaaaaaaaaa

SEQ ID NO: 14636 - DNA, 719 bp, Homo sapiens
  misc_feature (1)...(719): n = A,T,C or G
actcagccnatggtatttggttccaatacaataattcnttttagaccagcagtttaactccttacttgccaaacccaccagacatttttcagtcctattttaatttgtttagacttgaaattgttgatcatacctccctccttgaagctttttcttcctcacttttcttgattccatcacatgagaatatgtatgttccttaaagacagagatctgtctgtgtttttcactaacatatcccaatacccagaacagtgcttgacccataatggactctaaataaatatttattaaattaattagttattcgttcctcattctcttattaatctagacattctctcagtgtccttctacctcagtgctcagctttgaaagaccaaataactagcctggcgcagtggctcacacctgtaatcctagcactttgggaggccgaggcaggcggatcacctgagggcaggagttcaagaccagcctggccaacatggtgaaatcccatctctactaaaaatacaaaaattagccaggcatggtggtgcgcacctgtaatcccagctactcgggaggctgaggcaggagaatcacttgaactcgggaggtggaggttgcagtgagccgagatcacgccactgcactccagcctgggcgacagaacaagacttcatntcnnnannnnnnnnnnnnnnnnnagnggttntcnncaaagnatcnnaang

SEQ ID NO: 14637 - DNA, 1046 bp, Homo sapiens
  misc_feature (1)...(1046): n = A,T,C or G
ggtgggggagctagcggacacttgcaacatggaggggtggcgccaaaacaaagttcgtttctggattaactagcggcaangnggggcctcngcaacggcacngaccccgtggacgcgcacacacccncacacaccgccacnnggggacgacaggcaggacannggggggcacaacacactaagcaccgcgcgcgggggggggggcgcaaacgggggacaggcacacacaactgggggcgggggggggaaggcaaaaccaaacaacaaggggagtgggggagggcaccacgcgccataacggacacaccaccaaccccagggggggaccacgaaaacaacaacaggcaggtttttccggaatggggcgggggggggcgaatacgaccggcgggaataagggaaaaaccatgggggcagggcacccggcggattcaaggcggcgcgcaattgggctggggaacaggagcaacgcaaaagggggcccccgggtggaacaaaacgcgcacggggcggggcgacaccgggctgaccgcaacggaccaaaaggaaaacggggcggcaaagacgaagaacaggggcagggaacaatgggcacagaaacaggggggcctagagggggacaagcccccccggtgtgtaaaaataaagagacacaatgggcggtccgcaaaacaacggtagggaaggggggcgcggtatggtagggcaaaaccaaacgggcaataatttcgcggcgttttggccgttgggcgcgcgggcaacttgtaaacaacacacacaccggcaatggggggcgggggcaaaccaacaacaaaaagtgggggaccgcggggggaacgcattaccgcgcaacaccatggtggcgctgtgggggcgcgcaataaatggggggataggggcatgggtacaacgctgggtcgtcaatgaacccccaggggccacacacgcggtgggaacaacggacaacaagcacaacgtgggggtatacggtgataacgggggcgccaaccggcgggaacacatcgaacacaaaccggagggggggg

SEQ ID NO: 14638 - DNA, 2043 bp, Homo sapiens
  misc_feature (1)...(2043): n = A,T,C or G
ggcctgtcgggtgcaggcngancactacagtacgncatctgtctngcgccactacaagcctgcagnagagncgnagagcgagagagacaagcgcccctcnagcgcagagaggcgngacacgangacgtgacgncncagacgngaagatgcgcccttcnnccagcngcgagncatacagccacagcagcncagacgcatcacgacagcaccccngcgcngngancagcacgcnactaanccagcgccgcangcacgcagaccnagcanaggttnattgtgnagatcgggagacgcagncgcactcatagagatcataggtaacctccgcagcngagagatgngagacaggcacgacacttccantgcactgtgaccaacgcgctacagacgcagcccgcctcacgcgctgcgcgtcgtcgagctctacgtcagcgccggcatagcagcaacagacggcaaccaccgtagcaccgacgaccgtgcgcggcacgatagccacgcagacctacgacagacgacgcaccacgccaaccacggcgccgcaccgcagcgcagcgcctcgcganactcaggcggntgtataacacgacacgcgcagctacctctctattctttgtgacacgacagaagaagaagcctaanacagacngagcaacagcgacatgacgcattgtagcttggatggcgtggagcggtaccaacgcgcacgaagagtatacctgctcaacagttgcaaccgcacggcggacgtatcgtgtgaccacgtccacacataatatacgagcgngnacaggacgcgtagcagaagagttgagagancacacgccgacataatagtcacncagacgactcgattcagtatatctctcgaaacgcacgcatgcactaggcagatgngacgtcgcagacactactagcgacgcatccacatccnacantgcacgcacgctgacgatagcacgaccacanacatcgaggccacatctatcgcggtgacacggtgagcgacgacatgagcgagctattgagctagcagacgcctctccatccgctacacgtgcagagacaacgcacgcacgctgntatactacnctcgcgtacgcgcgtgctgtcgtacgcgacagcgatcgngcagcggcacgacacacatcncntgcacactagtcacagaccagcgcgacgcnataganagatgccgacggnanactngcgtgancgcgacgaganagtcagncgntgcagatgatngaacagcagcgntgagngagacgcggctgcgagcgtagtcgcagagacgcagagagccgcactgcgcgagcgacaactcacgcatgctcgtacgccgcgtcacgcatcaacgacgacgatcagcatgagcgtgagagtcgcagancacacgtgcgatcaggagtacggnatgcgatgnagtgatanacgttacgtacgnatcgtngantgtcaactgtnganctgactgcgacgtcggctgtcagcagangatcnagtagtatgangagcatatgggaacgagacngacgctgnagacgactactgcgactgncacgacgcgtagccacgcgaggcacngcgtcgcgtacgatgcgcatnagcgncgacgtatcgacacttcacgactccgacccgcactcgtacacgcancntgatagtcagcagcatacgcnaccgcgcgcntcgtcgacgcgnancantnactnatagcggactccgatgatcgacgctcttcngccagcactgacatctgctcatgagcacgcacgcancgatgccgcgacgangtggtgccgtctctacatcatcgcgtcagncatcgcgagagaagntgctgcgcgacacagacgnangccaatcagcnantatganangcgacgagccgcncctgcgtcgcacgccacantgnttncgtagagccncncacnctcgcgcgcacacactactatagcgacgcgcgcacgntgctcgacgcgtaccgcncgctaccgctacgtcgctagcgcgcngagnacgccnctgtcgacgcgcgtg

SEQ ID NO: 14639 - DNA, 775 bp, Homo sapiens
  misc_feature (1)...(775): n = A,T,C or G
ctaaatgccccaaggtttatattataatttttcatccagaacagaatgttcaaaaacgcaagaggagtttcaaggctgtgggacagctccccccatgcaaagcaanctgatccaaaaggaaatgacagaccccaatggggaggtgaaaaagtgaactctgtgagagtcttgaaaccaacacttcctctaccaagacaacatatatcagttacagcaatcattcaatttgaaacagggaaatggcacaatctgaagagatgtggtatatgatcttaaatgatgaacatgagaccgcaaaaattcactcctggagatctccgtagactacaatcaatcaaatcaatagtcagtcttgtaaggaacaaaaattagccatgagccaaaagtatcaataaacggggagtgaagaaacccgttttatacaataaaaccaatgagtgtcaagctaaagtattgcttattcatgagcagttaaaacaaatcccaaaaggaaaactaatgttagctcgtgaaaaaaaatgctgttgaaataaataatgtctgatgttattcttgtatttttctgtgattgtgagaactcccgttcctgtcccacattgtttaacttgtataagacaatgagtctgtttcttgtaatggctgaccagattgaagccctgggttgtgctaaaaataaatgcaatgattgatgcatgcaattttttatacaaataatttatttctaataataaaggaatgttttgcaaaaaaaaaaaaaaaaaaaaaaaaaaaaaaa

SEQ ID NO: 14640 - DNA, 1573 bp, Homo sapiens
  misc_feature (1)...(1573): n = A,T,C or G
gcggtgtataacttnatataagccgngttgcccagaccgaggagngcagggtcagacgaaaagagatgncgctgncnntctggctngtgacntagaagagagagagnagaggggnncttgngagagtngccatgtcgaccaggagntgctggacgagtgcaggagaggacgcagttaatgttntgtaggagaatcgagtgcgtgctgccgcgagtgattcgttagtatgatgattatataatccgcgtagtcgagatctgtagttcgtcataatgagttgatagacggatccgcaagatatacgttgtgtcggtgacgggcgtggcgcgcgcatgactaataatgaccaaaggaacagcgatgagtagtgagacgcgagagagtgatgagcagcgcgtagtaggatgctgtgggtagtggatagacaagtgatacggtcgtgataggtgtgtacgcgcgacgcgtagcttgagatanctgatctgacggtacagttatatataggatgcaggtgctgtgtgatgtntctntatctacgcacatagctgtatcccttcgcggcggagcgcggtgtagtgtggtgttaggcgatgtgtnagctgtggtgcagtaataattcgcgagcgcactcacggatctatatattagctgagacgagggagtacgctgctgcgtagagagtagcgtttgtgtaggtgcagatccagcgctaggttgtatgggagacgatggtgagtcgtgtcggcagcaatttacacgcgagtatagttctggacgacatctgagcgagtgtagccagtagaattggactttttgatgtgtgcatgatcgggcgtgttagcgcagtagtaagtggtatggcaagtagtcgtacagcgaagtgtaagagtcgagattgaggcgtcatgagtggagacgacgtaaaactcggattatatgaagtcatgaccgcattatcatcagagctatatagaatgagaaaaagatttcagtaatatgatatgcgctgggtcggaagagcgtaagtgatgtgaaagagtggatcggaggagatcgcggcggcgggcagcaacacggngatataatacatgtgcgggcaattttccgcggatgggacacggaggtatcgcaggagtagtcacattttagaagagatacgtactattccactgactcgattgaagcatccacagcagtaaggagcggatatacgtgaggatactcctgcgtaatcgcgcaaccgtcagacgtgactcnacgaagaatacgnncgtgaccatagtagtatgtccttcacacagcgtatagaatcgcggagctgatagaacactcgatgntnagcggcgacgcagcggcgcatgcggcgagacacagacncacggaagagatatgtcatctttcccgactgcgtcgcgtcagctaagcatgtcgagacgggcgatgattgagacngttgtgctggtgatcatcgtagagatcgctcgcagtcgcgcgtcgcgcaccaaccgagtagatgtgtcgcggcggactttgcgtgagagcgtcgtagtcgctcaggtagtctatcntggcg

SEQ ID NO: 14641 - DNA, 1434 bp, Homo sapiens
  misc_feature (1)...(1434): n = A,T,C or G
gacgcagagaggagacgccacgacataatcacaccnagncnncgagagggcttaatcgggagaaagaccgaggcaaggaagcttttccacggggaaacacccacagccgaaacagcaaggcgagcacggagagcaagagcgcaccgttaggaggcgaaacgcnagaaggcccgcccaacgagacgacgaaggagacgagggcacgacaaccagaccaaacacagcacgcaacgaaaaaccgcacatagggcagacagaaggcaagaccaggtaggagcccgccacccgacccacgaccaaccaaccgcatcggcggcacaacacaccaaaacacacagcaaaggcactttttttttaaaaagagaagggcgagaagagggcagacgcacggagagtagaccaagaaaaacccaagccgagccacgcagaagagcgaacacagagacggccagcccatacaagactacgaaccacgacatgacagagacgcgacgcgcacaagagcgcaaagacaaggagatgaggcacgcgcacggcacagaaatgtacagacaaaccacgaacncgactacgcgtcacagaagcggaagcaggagaggacgacgacangagacgcgagcgtgtgagacggcgcagccatctctccacgcctgagagagagaagacggagacagcaagatggcacaagcaggtgagggcgctgcaaaccgcggcgcggcgcagtggagcacacagacagagcacgcgaaccagacacaggagcaaccagtcgcaacaccgcaaacgcncacgcccgagcgccgcgcggcgnccggagcggtgcatcacgacgcaggcgcgaggaggaacaggcgtcagcacaagacagccgcgacgagagcagaaagcgagcgagaaacagcaatcagcaacatgcgcagacaccagcagaccgacagaacacacccgagagagcgctcctacaccagcgtgacagcgaggagagagagcagatcttctggcgaagatacggatgaaccgagccggacgaggagcggtggcgggtggagtcgagcgggtgangagactgcgcgcacgtacgcgcacgcaatcacgacgcgagcgcaagacgcagacatgacagagcgagcgagtcacacgcagacgcacagagacagagagacgacgnagacaggacgccgtagcgngcnagacgcacacgcgcgagagnagaggcgncgacgctgagcgtatcagnacgaccggcagcgacgactagcacacatagcgcgacgcgacgacgagcacgcgcgacgcagcgcgtcgcgagcgccgacgtacgnagagacgacgncgcgacgagcannaganatatagcagctgngaaangagacagagacgatacgtagacagatagagaggagcgagagtggacagcaagacggcagatgagcg

SEQ ID NO: 14642 - DNA, 708 bp, Homo sapiens
  misc_feature (1)...(708): n = A,T,C or G
ttggnaattnccacaggagaaccctccctttctttctgattattnctgcaggaggagaaagtattcactttttttcttctggaaattataaatttccctttacatgcttatgaaaatcttatttcttgactggcagtttgtagaatcagttcgatatatatatatcgtaaagaccattatattaatatcataacttgctttcaaatgcctcataattcaactgtgcttactttttaatgtgcctgaaaaaagtgtttaaaatgcattagatagcacatttctttaaaggaattgtatgataaatttctttgcaaaacaagaatgtctgacatcatactatgaactcatttgtgggactggatagtcaaaattacatttcattaaaatgagataattatttcattaattgactacaaaacatatataaacacaaagtcatgtttctatttgttcattggtgtaaagtacattcttccattgtaatagacacacaataatgggttatggtatcttttctctcctccattaatgaaattcagccaaactcgaagtcagttctgctataatctcctattaaanaaatacatgtntaacatatagtgaagagcggaagcacctnatntagaacnggggtgnancnnnntntnttaattnnannangnnnagnnnnancncnnnnnnnannntnngnnnnnccaaggnnncaaa

SEQ ID NO: 14643 - DNA, 1227 bp, Homo sapiens
  misc_feature (1)...(1227): n = A,T,C or G
ctgggggacttatctgccgatacccatcggatggtgtgaacgaaacaaacagccttctgagcgtgatactgaggaagaacgagcgcgtttggcactctgcatacaggcttggtacagaccgattcatctcgtcatattctatcctgtcgggtcatacgttcgcgtccncgggtgtgcgtcactacaaagaatacttacgcgccatcctgttgtgtctggtcacaaacagtctgtcgggcaccacattatcgggcggcggcgcggtggcacacatatatacactcaaacaatctcgagtgggtgctcggcnccacagcgaggacatatagtggaaatacatattcgaatcatggcgggggagacagttactatcttgtatcacccattgtattgtactcgaaagtgattgtagatatggcgataaacacgaccgaaaagcgatattatgtgataatcaaaatctgtctgtatccacagcacatccctgttttgttatatctgttatgctggtaattttttttatggtaatttagccgcaatatcacacaatcccgtggtgaacgtgttgctattattttagagtcacctccgctgtgctgccaacttgttcttttgatatataagttgtaatataaatctattatatcggtctttataatttcctcctatcgcgcggtgttactatctcttgacgcaaataaatgatcggcaattaataggatctattccgacttctctttctaggaataatctttattggctacttgcgtgtagtgtattaatactatgctagcacttttcatcgcgctggttcccttctattatatataacaaaatcaaaatttgcactgatattacgcccaaatgtgaggtctcatcactctttctcctacttatcctacctcatctatgtcgccttggcaggtgaactctaccttcaatacttttgaccgaggacaaggngcgggtctcgccacttccgtcacctcaccactagcatacccgcttttatcgactccccatatcttatagggccctctttcgccgaatattgttttcactttttaatttctccgntcactgacttgttggtcgacatatctcttgtcgcgctgatcttactgaaccttatatcacgttttgtattatatccaactctgtacttcgcagcacaactaaaacgctgacccacagtattgtttaaactcagctctgtagcatgaatat

SEQ ID NO: 14644 - DNA, 1268 bp, Homo sapiens
  misc_feature (1)...(1268): n = A,T,C or G
gccggtaggtaacacgatacgagcggaaaaggacaagaaagagccctgntctgtctaactacgaangagaanggcgtccgcaggccgcaaacccgattaccgggacagagacaaatacgcggcaatacggagagggtagccctgaggcgccaagataccatcgctccgcgaagcagaggatcgcggaacgttgtcgagcgccaaccagatgcgggcgcgccccacgcgaacatgacgcacgcacactacgaaacgcggtggggagcaggagggaggagaattttgcccgcgacttgacgtcgtgtagcgaaaacaccgccgccagaagagggcagagcgagctatttttgcacgagacgacgcgagagcaaacagcacacataacgcgtcgcgtcgaccgcagaagagcatacagatggtggacgtgtcaactcgccccacaccaacgctgctaggataatatcaacgcatcgaacccaactaagagagcgcgagcacagacgcgccacgcgagaggaagacgagtcggtcgctagcggacgctgttgtcgtatattatataatgtaacgtcgaacgcggaatgagaggtaatattaccggtcgtcatcaccgacagagaccacaaacaagaaggataatcgacgctggtacgaggtgtgacggggcgtgacggcgaatctcattgtgaggccgaccatggcggcgacgggagggctagcacgtgtaggagaggacgacgagagaggaagaaacgctgatactaaggaacagtgttaggggcggaagaggatggaccggagaggggagagggcgcggccgccgaatcgaacgagcgggaagtacagcaggatgcatagcagattcggcggcgaatctccgcgcgagcacggccgcgagatacgcaagacatacaaatggaggtggatagaaatnatagtatagacatacgaaaaactacaaacaangcataactaatatagacgggaggaggggcccgacagcacggacgaaccgccgctgtcagcaagatantcacgacactgagatacgatgcagtgtatggcgcggcacattcaacacgatacgagaccgagcaggagnagacgacgactctacaccgcggttacttagcgagaatcgaggcacggcagcaccgatagtaccgtagcagccctatcggacatattatcaatgagagcacgaaacacggggcggggcgaatcgacgcgagtcagagccgatgggagagcgcgctaacacacctaca

SEQ ID NO: 14645 - DNA, 1206 bp, Homo sapiens
  misc_feature (1)...(1206): n = A,T,C or G
ggaggaggaggagacagccgagcgagcgaggagaggggagagggaggaggcccttggctagtnngaccaggaggccgagaagccctccacgcggggaacaacaanggccgcgggacgganggagcagagagagagggcacaccagacgtctgaaggcggggcagcgcgacacccgcacccgccagaacgacggcacgcgcgngcgaggaagagcgcccaacggaagacgaaacgaccacaacccaagaaagcacaaagacgcagagcgcaacccagcgccgcagagacggcagccgacgcagaggagcgcccggcacgagcccagcaacaggccgcgacgacaagagagagcggagcgacgcccgatcttttttatgcgggcgaaggggccgggcgaccacgaagacccgagcccaccgccaagcgccgccgaggacgccagacagggcgacgacacgcgcagcacacgacgaacccgcggcaggacgcgggccgaagcgccgcagccccgaccgggcggcccagagcaggaggagcgaagaaacgnagagagggccgcgcggcacagaagaacgacagagaagcaaaggagggcaagcaaccacagcccagaagcgcgccggagacgggggaagaggggcgcgcgggcgcacgcacaggacaacagagcccgggacacagagaagacggagagaagcgactccgaggcatcacaaggaagcacgcagggcgagcgcaagcccagcgcacgggaggccagcacggccacgccagacggcggcgacagagagcgagcaaaagcaaccgactcgcaaagaagaacggcacgagcgcaacgaaaggcagcgcagcccaacacaacaagcgaggaccgagaagcggcaaggacgaggcggaggagacagggaggagcgcgcgccccacccngccaggcagacacgcaacagatgccggcgaccgccaacagcgcgcgcgcgcgccgccagcacacacgacggcagccaatgccgacggactgcactagaaacagaccggacagcgcgacgccaacgcgagcccgagggggcacacgacgcgccggcgggaatcgcggaacgcgagaggcgcgccatacggaggacggcgcgagagcgcaacgcggcaccgacgccgaccngcgaccgcagacgcaacgccgggaacagagagcgcacancgcagcacgag

SEQ ID NO: 14646 - DNA, 339 bp, Homo sapiens
  misc_feature (1)...(339): n = A,T,C or G
cnaaatttnttnttttttttaaanttccaggttcnaaacnnttttttaaaatggngagngccaggnggggttaaatccaaagggccctccanaacttttttgttttnatnngggactagggccccnaggntttntngtaaaaagaggtttaaaacttggatttgggnccccanngccaattccttaagggaccccccaggggnttttggggggggantccaggttttccnaacccgggttaggttcaaaagnatttccnaaaanancctttttnctaagnttntaaanaggttttaagnattccaccntttggaaaatatttnaaaaaaaaaaaaaaaa

SEQ ID NO: 14647 - DNA, 1357 bp, Homo sapiens
  misc_feature (1)...(1357): n = A,T,C or G
cgtgaggacggaaagcggtgacgaacgaaacgagcagggaggagttcgtgtcgtttactgaancgcgaagnccttccangggaagaaaccaggaaagaaggcagagcaaaaagaaggaaggaagaaagtttaagacgagggaggggcgaaccaaagaaacccagaccggacgaacggcccggcaggaggacggcgccgagaagcagaaacgcagccagagcagaggaaaagagaaacgagaggcggagggaacaccacggcgggcgagaggggggagacgagagganngcggcggcgaggggggggaggagacgcggcgagcggcgcgaacagaagaacgagagcagaatcttttttctcgcgngagagagtgagaagaagggagncggagagagagcgacgcgcgggatgtagcaatgctcaagaagacacagagccagaagagtggcccaacacaagcgcagcgaacgaataaacaggagctaggcacaaagagagacaataggaagaccaatcgccacagatgaacgacagaagtagtcggagcggcacggcgaaccaccggagaggagacggaaagaggacgacgagaacagcacacgacagaagaacggttgcgtagacacaagagcacgacgacaccgagccgaggtacgcggagcggcaggacgtaggcgcagacaagcgacgcggccggagcgcgaccgggcggcacgcgcgtacgagacagcgtgccgtagcgagcacngtgagtcggagagtacgcaagaactgaccaatagaggcgcggtcgacacacaacngtggagcggcgtgcgggtgtggacacgggcagaactcgacagacggcgacggcgcgcggggcgcgacgcgcgagacggcagcgcgaaagtaggagcacatgacgcgccacgaatacgcacggacgggacgcggggaagatcgaggggataggaacacaatncaccgcatgcacgagcagaaaggcagggagcaaagnacgcagcagcagtaagagcaatcataacatcacgccgagngaggnatggatccgcgcgcggcggagcgccgcgacgaggcacagcggacgcagagaggagacgacccgaccgacgaggagaggaggcacgaagcggcgcgacgcgcgcanncgcacagcgcgccgaggccatggcacggacacccagcgtgntgcgcaccgcgacgnggngtacggaggagaggaggagacaccacagtaggcgcacggcaggatgtaacacgtcaagagtgagggagcgctagagaagcgacggcgcggcagataacacaacgaggagagagtataatgcgcgcagaacgcgaaccgcgaatcaat

SEQ ID NO: 14648 - DNA, 354 bp, Homo sapiens
  misc_feature (1)...(354): n = A,T,C or G
aaaggngcangacntcccaaaagagattttcggaangccctnggaaaancctggggggngccnttggggtccagganaatccaacttgggccatttccttagtttttccaaaagaagggatgantattgnccgaaaataaaaanggggaaaaaaatttcnangcgnagnaaaaanaattgcccccaatttcannaaaaaaanaaaaaagnactttnccaaggggaaaaagaatnccctttttnaagnntttttnaaaaaatggnnccntnttgaaaatttaangccttnngaangccccgatgattcggggaanttttcccaagggnttccaatnttnttgattccaaaaggga

SEQ ID NO: 14649 - DNA, 839 bp, Homo sapiens
  misc_feature (1)...(839): n = A,T,C or G
cgctatcttccaattcagccattcggaggtcttgtcggttgaaacttcaagacaggaatttggagtgaggacacagttcattccatacacaaagacaggatcggcttcatccataacccggaaggtctgtccctctacagaaacccagatctaatcgtgtcgcatcccacaccatatgggatctcactatgttgtccaggctagagtgcattggctattcacagacgatcatgatgcattcatagtgcaccacatcctcagactcctggacttaagtgatcctccctccacagtctcccaaatagctgagactgaacgcacacgccactgaatccagccctgtactattaacttttatattttttatatcaataaaatcattgtacttctgatgcatattaaccatgctatttaatgttgaatgaataattcgtaatgctgatttttgctttttattgagggttatttcttgatcctcgctcacttgatatctgtgcattaggctcgcacagttcgatattcctgaatatcgttgactctaaggcggatattctggtatatccactttattacgctgttattgccatgatattaccttgcgatcactcgcgcatccacttgcgccggtcctctaacaaactgccttgatctccagtataactacaatatgttccgctccttttgtaacgtactcatatattacagatctaatgtagagatgaaggtaaagacgtacgaggatatgaagatatctagcgttttactcctaaaacgcacccgtgatcaatatattcanacatccatacacttcacgaataattggtcacaatagaacaaag

SEQ ID NO: 14650 - DNA, 1292 bp, Homo sapiens
  misc_feature (1)...(1292): n = A,T,C or G
ttgtagatgtaaacaataaacacggaggggggggggcaggcccccttttaagtctactncggcgaaggggcccttccgagggagacaaaccagggacgcagancaaagcaacataggataaaaagaaaaaatgtttggtagtgatgtaacaagacccaatcaaacccacacccaaaagttggcaaaacagtgttcatgcccacaaataggagcanggggcgggggccaacaaaatatactcaaataatagaagtcggggctgtgtgtaagacatgaacagtataattgacgcgacaaattcagctgaaaaagngggtatacagcataaatataaaccagagcaaggtttttttttaaggaaaaagcagagganggtaacacagaaaaaacaacgcgaaaaacaatataatttaataataaaaaatgtttataagaagtgaaagaaataggagttatttattagggggaatggacatcataatcggtaataacaagaaataaaacttcaaaataaacataatattacccgataaaataacagtgtccaataaaatatacaatacaactagagctaaagacaacagtgtattaagatatgctaatgcagagtacgaaactaagatatatatattaatcacatagaaatataataaatcaaaattagataatggaaatacattnaagaacaaagaaataagttaacgtatagtttatcatatttcctggtacacaataatcacaaagtatgcctattatcacagcaaacacagcatgaattagtctatatacgatatgcaatcaggaggagcatgagaattaagaccgcacacgcaacatcgacgctacattaaataaaacaattcatatatatacatgatcgcggaagcaatatgagcggagtaattcataaacaatacacataataacaaccttgcggaaccattaatttatgcaagtgcacggtatactaaatataaataacacataatataaacacaagacatagacctatcataataatagaacaccactaacnatcgacaaatctcantaaatcagttcataaactaaccacaactaattaatcagtagcaatagtaacacagatatgcacaacaacaactatcaacaacaacaataaaccaaatattactaaataactaatatcacatgaacccacatatatacaaatataattactgtgatatattatgtcctcgtgtgtggtagacctccgtgtcaaatcttacattctgcatatctccctttccacagttacactgangcagact

SEQ ID NO: 14651 - DNA, 798 bp, Homo sapiens
atttccttggctactgggaagtgaggagcccctttgcccagctgctgcccgtctgggaagacaggagggcctctgcccagctgctgctccatctaggaagtgaggagcgcctctgcccacccccggcatcatctaggaagtgagaagcacctctgcccggtggccaacatctgggaagttggagcacctctgcctggccactgcactgtctgggaagtgaggagcgcctctgcccagcgccgcactgtctgggaagtgaggagttcctctgcctggcctccacactgtctgggaagtgaggagttcctctgccctgccgaggccctgtctgggaagtgaggagcgcatatgcccggccgcccccctcgtctgggaagtgaggagcccctctgccctgccgcccaactgactggaaagacaggagtgcctctgtctggccgccaccctgtctgggaagagaggagtgcctctgcctggctgcccaccttctgggaagtgaggagcacctctgccctgctgcccaattgactgggaagagaggagcacctctgcccagcttgccaccttttgggaagcaacccttcaagtgtggagtgacagccttgtgtgtaatcttctgccctccccagtttgcattttttgcaccaagtttactttttaattaaaaaaaattcctttgctttagggcttttattccttcaaattttaaaataattttgctagttcttgaagaatgtcttggtaattaataaaaatagcattgattcttaaattgcttgggcagtttggccttttaag

SEQ ID NO: 14652 - DNA, 1089 bp, Homo sapiens
  misc_feature (1)...(1089): n = A,T,C or G
gctgctacacagggccagtcgaacagaagggaggggnnagggggcctgcttgtttgacacnannaccgccgcgctcgcgcggcgccaataccaggcggccacacaagtcccactccagacgcggactacgtgtgcaggggggaaaaaaccaccataaccgccacgcaggagggcggacaccgggcgcggccgccaaacgggggcgggcacgggggacggaaaaaaaaagaaaaaaggaggagagggggaaatccaaacaaaccacacaaggtccaagaatagccaaaggggggaaagacgccaaagaaccaagggagaatttttctaaaaatacgtgaaacaggggaagaagggggacaaagggataggagggaaaaatgacggcataagggggcaaacacacgggcgaaggaaaaacagaaaaaaggcggcgaggcagggggaccaacccgtgcaccacggacggccccgggtactatgggtttgggtctattgccacgctcggccccgaagggtggaactcaaaacgcgaggcgagcgacagtataattccacagacaatataccacaccgggacgggacaccaattcccgtggattgatgttatcggcagtcacactaattagacacccctgggagggaatcatcccgccagcaaaagggtgcgggcgtcacaacaacgagaagggagtaggggggggcgcatgccagcgggtacacaaaaactagacaaaaaatggctagggaatcacgcgaagacgcgcgggtgtaaacttggacacaatacctaacaacaactaactggggagagcggaacaaaaacataacaacaattnggagcacatggggggggaaacaaacaccccaacaataacantgctccacggggtggagccaccgaacacagcgggggaacccagggaaaggagcggcaccacgcgaacactcccgggccacatgggcgacacacaaggggcgcgaaatacaaacatgaaatacaaaaagtgtgtggacacatacagttgggattgggacgcggcgccccagagctgcgcactacagcgctacaaaacatgtggtgcgcggacg

SEQ ID NO: 14653 - DNA, 762 bp, Homo sapiens
  misc_feature (1)...(762): n = A,T,C or G
gaaggnngntntnannntngnggggacacgtnggggtatagaanaanantntttanttnnggnaagaggnganngtaanngtgcnacngntnnaannccnnnntgntnttnagagtaaggggtnannttnaanaanncacnattcgangntntnttngttcaangagtgagacccgnntttaagcagttctggtnagaaatggnncnnanttcngcttntcttgntagnaattgntacnnaantcaagcnggaatnnggaggtgtgntggaaantaaggggaataaaaagnnggnccacccnaagccnggcgggcagggtttnccaaggtgntgtctcttttccacnttgtaggagcttttgttcttttgttctttgcaataaatctttgntgctgctnncgggtttgggtccacgctgcatttatgagntgtaacactcactgtgaaggtnngcagcttcactcntgaagtcagctgagaccatgaacccaccagaaggaagaaacttccgacangtccgaacatcagaaggaacaaactccggacacnccatctttaagaactgtaacactcaccgcgagggtccgtggnttcattnttgaagccagagagaccaagaacccgccggttccggacacaatttcacaaaagacacctccaaggagttntttttggtaaaacgaacaacgcagcagcataactttgtgcttctcaatcccgcggcaatntttcgggcaattggaatttcnaggggttcaacc

SEQ ID NO: 14654 - DNA, 746 bp, Homo sapiens
  misc_feature (1)...(746): n = A,T,C or G
gnnnnnnttggnnnntntgaannctttgnaannnccnttttttaaccccgctacaggacacttgctcttgaaatccagacaccatgccctgattaaacccaggccaggtggagaagccatatgtaggtgttttggctgacaggtttcactgaggtcacagaggacagcaacatcagcatcggtcattagacatgtgagcgaagaagacatcaggaggctccagctgccagctgaccacaactgcatagagactcctgactgagaactacatacctgagcccagtgaacctccaaaaccatgagcgataataacaacaacaaccatgtccagtgactcaggcctgtaatcccagcactttgggaggctgaagtgggcagattgcctgagctcaggagttcaagaccagcccaggcaacactgcaaaactccatctttaaaaactattcccaaaaaatttagccaggcatggtggcacacacctgtaatttcagctacttgtgggggctgaggcaggaagattgcctgancccaaggaggttgangctgtaatgagccatgatcgggtcactgcctccagcctgagtgacaaaacaagaccctgtnttaaaataatnataccnccaccaaatgtttggtgctgttttacctaccgagtancaggcagtncatttttgtanccaataggcaattgaaaccaaaaatttccattcttaaatttgctgnctgagccatnctttgaaanaaa

SEQ ID NO: 14655 - DNA, 625 bp, Homo sapiens
  misc_feature (1)...(625): n = A,T,C or G
accaattttttggaaanttttaaaggggccccaggggancttttttttaaaattaaaccccccccggnnanagggtccaggtgggtcccgaattaaaaaantgttttgnaaaaaaattcaggggttgggggaagccaattttttttcaggcncaaattttnnttttttnttcaaaaatttttcccaaaanccacccgatttttttaatggatgggaacatgggctttagtaanaagtcacgtggagaactcatctggctgggtgtggtgagtaccctcagatccaagaatggagtctggattggaactcctttcttgtaacatctttctggtgaccatggaaggtactataatgcggaaacccctgacccaaatgctaactttgggtaagtggtggggtccagtaacttccttctggagaaccctgaagggatgatactgagagacctctcacccaaaggaaatagacagcactgattggatgactttgggtatatgcatacccaggaaaagaatggaattaggttagaggcttaactcaggggagttagagtgtctcctaagagagggttaaaggcttctctcaataaacgggatcggaagtntcnaannnnnnnnacnnnnna

SEQ ID NO: 14656 - DNA, 1118 bp, Homo sapiens
  misc_feature (1)...(1118): n = A,T,C or G
gcagggtgcggagtgagacgatattaatcgaagaggggaaaaagaaagnaggttcgttttagttctactnggncgccgggggcncctgcngnggcnnccaaccannnacngcagncaacgcaacaaacccgcgcagggcggaggacatttttgggcggggggacagagaagacacttatcgcgacagcggncgggcggcggacccggcaccgagcccccatagcttaggagggccggcggcgcacggaaagtaacacataacacaagggaggagaggggcacagggaccacatggaaagaaatcacgccgaggggcggggggcagaagcggggaaacatggggaaaaaaaaaagagggaaattttttcctttaaacattaaagaggcggaaaagggggcaaagggcgtagggaatcaaggggcagcgggcaacacggcggggacaccccaacaaggcgcggcggcgcggggcaaccgcgtctaccggcggatacgcccaacggagtaagcgctattaatccacgcacgcgcgccggggccatactatgcttttgcacacgcgcagcgcgcacacaanacgagcgaaggtccgcggcgccacacataccgacgcgcaaccctgcgcgcgcgtgcacaacgatgctgagacacatcaaagactcgtgcgcacgggcacggcgtatatacgaattcacacggagggggacactcatcgtgggacaaggtgagtgggggcaaaaaaatcgggcccgtaccgcggcgcggcatgctgtgccaaaataaaaacaaggaataatatagcgcggagtatacggcgacgcccacgcgaaccaaagggtaactaattcaacacccactcagcggggggggggaaaaaacaaaacaaacaaatggcggtacagcggcgcgccacacagtaccattgtacaaggggaacgcgtggggagacccgcgataatacggggataatccggtgctgaggtcaaaccggtgctccaggcgcacaaacggtgacaccgaagggggggcaccaaacacgcaagtcctggcgtgatatcccaacggcagcggggacggcgcaacggtcgtcccgaacggcgccaacaagggtcgcgtcg

SEQ ID NO: 14657 - DNA, 1052 bp, Homo sapiens
  misc_feature (1)...(1052): n = A,T,C or G
atagaaagaacgaagggcgcacagacgcacaccanaaaaaagagctcttttttgaaatcgcctaaagtgtttttgacgacgccatcgggaaagaaaaccggggcgcatccagggatttatcggggcataggagccaaccccaactaaagggcggccgccgcctgggcttttaacacaaaactccgaacttaaattgtgatgacacgcttaaaaaaccacccctcccggcgtccagcataaaactgagcgcccaaacagggccccgccctcttaggggtttattgcagcggtaaaagcagagactacaacaattttctatatatgtgatcagaagctcactggggggttatattttgagcagaacgaggggtttgctggtagaaaaacaataattctttgggaagtaaagtagtatanngctccgcgcgccccgttagggagacacactataccctagacccaaggcgtcgcccttatcatacagggagaaggacacgcgggggcgngcgccgtcttgcaaccttgagaaggagaagcccttaagagacccaaatntatgctctcccgtgacccgccggtaggagagccggggaaaaaaatgtggggtgtctccgggagccgaaaagccacaccaaggaaacgcaatgtattcctcctcacacctgtactgaggacctggagagaacaatctctctccctgccccgtctcaccccccggataagaaaacgaggcgacccgtgagcacaccctcggcggtgggataccaggcgcgagtggtggcagagcctgaaagacgcgcggcccttaaccgattcctaaaacctctattgatccataagaggcacggtggcatgcatagaaaacacactagctctttcgcccgggtgagtacgggggggcctccgaagaagcgggtacagacaaacaaaaggacagggcccccgcgcacggcgaccggaattacgcacggccggctgaagccgtggcgatttttatctcaaacccaccgccgagtagatggacttgcgaagcgaaataagcggccggcgcg

SEQ ID NO: 14658 - DNA, 974 bp, Homo sapiens
  misc_feature (1)...(974): n = A,T,C or G
aaagagcgtcatactattgttactggagtcgtctatagttnnnnnnnaaaacnaaancnaanagctanaaagacgaccgggagagggcttttgcgggggtgaccaaaatacctaaccctccccgtgtgtcttcaatacggcatccgatccccgcatgtggctcgccgcttaatcataattcaccaagaccttgggaggaggacgggctcaataatgagactagtggccgcggtgttcgtattcgtcgggcacaaccacacatatactaaacgaaacaatttcctccttatacactatacacgcgaacatggggactcaaacgatattgttaacaacagtgacagggcgattcaaccggtttggtatacaccatccatgcaaatggaacggtacatgacgcgattcgcgttttgcgtttgtgtgatatccgaacataatcaacgtcccccccgcacaatatcattgtaatatgtactcgatgctcaaataacgtctgtgtgtagtgatagttacaacaaaaggtggaatacattgtcacatcatgttatatttgcgttgctatctatatccaattccacttgcgtacatatacgtctacagcaagacgcatgctgcggtgagtatcctctcacgtactgacccgcggttcgtcgagctaatcgcgattggttcttaattcgcgcctattccccctctccccctccacgcctattatcatatttaacaaactactcttgcgtcgtaatcagcataactcaatacacgggcgtttgtcgtgcgccaatcgcgccatttgcggatttcgccgcactcattcactctatttttgtgatattctctctaactcacctcctaactaccaccaacacactttctcgacagctctgtatgcgttcgaataattagatttttatatatgctcgtccccctttctccgcttattatctcttaacttttcaccggtctatccatat

SEQ ID NO: 14659 - DNA, 1128 bp, Homo sapiens
  misc_feature (1)...(1128): n = A,T,C or G
gagttaatgagatgcgggttttagaagaggaggnngggaagagccctagtctgcnaacgactacggcnaaacctttccacacggtgacagcgngcgcccccacactggattgagcagaagggggctccctgctctttatagccgtggggagagaacgaaatcgctagcagccagacgatgcacaatgaaacaatatgtagacacgtgcctcagctgtggctgggcgtcactctagcgctagtcagtgtgtaggatgagtgcacgcctatttcgtccccatacgacatgtcgctgctccagatagtgcaatgcgtcgtcctaatcaggacagcaaggtctttcttttttttcgacggagtgaaggaaagggagtgtaacatagtctgtctgcactagtcttgagtagattggaaggacgtgcaccgaatggaccatccgacgatctcctctcattgactcttaggtgggcgagagcaatcgccacccttgcacatcgcgcacctaatggcctaccagttgccacattgaccactgtcagcaaacttgtgatcgccgggttgttgtttttgcctcatagactaggtgtatataattattacaccacagtgtcggctcatcgtcatatccttatcggttgtcagcttccgaaaaacttgtatattgtcatgcgtgagatcttctataccgtatacttacctttgtttgattttcacaacatcgtacatgaccatgcacgcttagccggcgtacccactcactacttggtggatgtcgcaagcgtcttggtctgccgtataatcctatccctcgacccggcaagatagactccctctatataccctaccgctccattcatctttccctataccatcccttgaacattgtcatacgatttaggcaaacattcgcctctgtggtggtcgacctcgcaacaacaagacccttatcataatacatatcttggttggtctactggtggggattagattaccgccgcctgctcaacagcgacccctgctagtcgacatcccttaattacctcacttgttcactgtttatatataagttctgtttagagtgtagagtgaacatcaaatacatatatnactgtggtgtgagcaagcgcat

SEQ ID NO: 14660 - DNA, 399 bp, Homo sapiens
  misc_feature (1)...(399): n = A,T,C or G
cataagacactcatttcagaaggggtcctgcntgatgcctgggaagaanaaatgntgcgccnagatgccaagaaaaatagagacaggcctcagngggtttcctcnnntagtntattagtattngntaataccccttttgtccaatcacatctgtacacagntatcnatcangcctatcaaatgcagtctccagagaaggcttaagaggaaggggtgttaagagnttntggacagntgnattcatggaggnttgcaggaaggagaacgagaactcatcatgtcccaaaagggtggtgcaacccaactccacagggacagaagctcctgtgctcaggacccttccagacctcgtcttgtatgtcttttcatatggctgtttatttgtatcctttaaatatc

SEQ ID NO: 14661 - DNA, 470 bp, Homo sapiens
  misc_feature (1)...(470): n = A,T,C or G
gtcggancctcttgaaatccnaanncntntgnaacgacccccgnaagttanaccgctacagagataaagtncgactaagncgncnnntttttatccctcangcctntncncangctagctgccgccagacccncccncagcgcnatcgattacagggcangaacacacnaagcanncngatggggcggaaaancaatnaagagtccgnctanaaaatacatcttataacatgaaaaacatcgtgtgaanggaagannaaagaacantgttacntaaagatnactaacatgtgtctccngnctgaccaactgtaaataggtggaaacatttacttctaaagagaagatannnnaaagctagnttattagaagaaggatgtntaatgaaacattattaaattggagtgggcctganganacaaatncangttgnnaaaaacnctggtaanaaagctatngaataaacaccga

SEQ ID NO: 14662 - DNA, 802 bp, Homo sapiens
  misc_feature (1)...(802): n = A,T,C or G
aagannccacggaaaacaacccnnttgaacnacccaccaattgacccngcacccntncnagactaccacacggnccnttnttagngagaccnggntncnagagacaaggcacggccaaaangnntanggggagnnnacncctncnacnganccccaaatggaagnatgaacaggacaatcctcacganccagaggacggncatggnnaaaccaacgccacaaaccagaaacggaacccaccgaagcccgaccaggagaacaacgncagactgnggactccgctnatcggcccagcccagacgagttcaacaanaaaccaanaaagaccccgnaagatggcaccntggcccgatcgaattcacaagcancggggcccacaggaggccnnggccccaacaagacnnggagaanngnaanncctngnngantgcatgaaccaacggcntactggccganggcccangggaggagaattngaaaaagcccaaaanagnggggaagaancccggannggncanacccnaaaaagagccccgngaggaaaggaanggccaancnggggnccccganaaaaaaccacccccaagcnggaaaaaggccnngnntacnngggaaaacccgggnaaattnaccnggacnacacccgggaaaancccccncnannnnaaaangnacnggggggcannnntntnnggaaagngnccnaaaaannccnncggaaagncccggangaanggccaaaaangggncccccggnggnnggnggaaaaaaagaagggggggaaancccnnaaccaaaacc

SEQ ID NO: 14663 - DNA, 301 bp, Homo sapiens
  misc_feature (1)...(301): n = A,T,C or G
gnacggancccttgaaaanannaactcntctngnacngacccnngaganaganganaagacacagacacanagaaagccanggccntttnaggatggataccttttattggagacatgcatttntcaagccaagganctcctggagtcaccnaaagcngnangaanccagaaaaattctcctctagggcccttggagggagggaanccccgcanacnncgagannccnncctgttntcnacantnaagngcaaacaaataaaacctgngngggncacccaaaaaaaaaanaaaaagctcga

SEQ ID NO: 14664 - DNA, 878 bp, Homo sapiens
  misc_feature (1)...(878): n = A,T,C or G
tccactaaggtcctgctantgctgngnctgnnatgggaccaaacttganaatcacctgggaggagggccangatgcggatggaaatggaantcctggaaaggaacactggggacaggggcatggaaggacctaaanaaggcgttgattcatgctcttcaaaactcatgctcagctntgggagtgcanttgggttgcctttgcangaatgaccttttgagacgtcacccagctgcaagctggctctggctccttattgccccaccacagctattgcccaactcactgtagggaaagagtggcttggttttttttcttcaaaactaaaactttcaggaaagtgagctgcantatctggaaaatccaaatatgttaagtcacagtataaaagtctcttttactctttcaggaccatttttccttctcttctgngacaccttcancctttncaaaaanattgngggcanganacctgtnacatgggtgtttgnctctagaancacancanaaaccaaancagggcncagncntttccaccctggcttaaactgnctgntcacncccngactgggggtacaagggctttgggtgnanttacctctacagggttactcttaaggnctcctncatggctttnttaaccctcanggnaattcaattccntcngntntggaaanttnttnnctttnnacaaaananngncnnctnttaatnntcccntannnnnngatttnantttcncntannttttaanntaannnggccttnnggnacggggnnnccnnttttttnttnnnggncnaaacctncnganctggnnnnnaaaannnanncnccntccttnnnngggnntnnnannnnnnnnnnnnnnnnngnnnng

SEQ ID NO: 14665 - DNA, 613 bp, Homo sapiens
  misc_feature (1)...(613): n = A,T,C or G
cgngcaaggngggnncngggtcagtattgccccaccgnnangtnattgccnagctntntngtaagaaagagttagnntaggtgttttntntttcaaaattnanactttcaagaaaannganttncagtatctggaaatccnaatatgttaagtcccagtatnaaagtgtntntnactntntcaggnccattttgtccttctcntangtngcacnttcaagcttangcaagagattgtggcagnagacntgtgacatgggtgtttgcttntaggaagnanagnagagcccaaagcagggcacagtcatttccaccttggnttagactgtactgctcagcaccgtgactggaggttacaaggccttaggcngtaagtttacctctacaggttttactaattaaggaactcnttgccaatggacttttcttaagcctcaaggtcaagttcaagttccatgctggctctgtagagttttcttgtcctttgcaacacaaataatggccagtctctttaattgattccccttagttctgcttgatnntcagtttttcaccttactctctgtaagattaacagtgaccttcagggaactgggttgtacctanttttctag

SEQ ID NO: 14666 - DNA, 813 bp, Homo sapiens
tggtggataacaacagagactcctgatcgaaagagagggaaataggttaagcggcggatgttaaaagatgggatatgaaagaagcaagcgaaagacggtgcaggagagaatgatataaatgagactgacgatgttatcggagaaggtaaatcgtgtggaaggtggggaaacgataataattagcatggtaatggggagatggtaacgaggaagggagaacagaaagaagggcgcaaggaagggtgcatgtggatttataggtccgactaaacgtaacaaaggtagggatgtggagtgaacgtaataaggaaaggggagtagaagggggcgctataagtgaaagaaggggggatgatcacggcagggtagatgcgcagcgagatgaaaaatcaattgatatattaattaatcatttcatatcaagatacaaatagtaagtaacatagttacgctaaattcacagcacagagattcatggagatctgcccaggggtaggggccaagccatttcgatgatatgtatatagtaaaaataatgtaggagcttgttaaaaatgcagattcccatggacttccccctgcagattcagattcagggtgttaaaataattcatgcggaggccattacactggggtggctccattgctctgggtttctactaaacaaactgaaacccaactcagtgttaacaggaaaacaaccaatcaggaactgccagctgacctctagtgggactttatactggaatcaccaaataaggtgtgatccactaaaccaaaaaaaagtagggccagataaaacttttttaaata

SEQ ID NO: 14667 - DNA, 351 bp, Homo sapiens
  misc_feature (1)...(351): n = A,T,C or G
gnatnacaaatactctttnacagatnccttntcnnattcgncaatccnatatcagatnantnaagactgcanancnacaatncnnnnctnnatttncnnaatcnanacacganatntnntcnancnattcactntatannattnctancncnantngaanatacagtatcananaganntntnntccgtnngggtgnggnncccntncnccanncannaaattatcatanacgaaaaatantaanattncaattanctttnggnggnggngggggnggggncgtcttttataantaaaataaatnncanatgggngngcccccccccccncccntccccntttcgaaaaaa

SEQ ID NO: 14668 - DNA, 179 bp, Homo sapiens
  misc_feature (1)...(179): n = A,T,C or G
ancaaaaaggnaggaangncnnaaaagggatnanggnnnncngncnntnctttnnnngggtattnnaanntnnnagngntnnnngcnnnnnnnngtnngnnagnntnantntnaaggggaancngttccnnnnggnnngngnagaatgnnnnngtnnangcnnaccgaaggcntttntt

SEQ ID NO: 14669 - DNA, 695 bp, Homo sapiens
  misc_feature (1)...(695): n = A,T,C or G
cnaaaaanganntaganatttgnccnnnccncatananngngctttttntntannttcccaggnaatncngaanngngntttctnngtnnanaaaannnaataanacnnccccnccgggncanatncaaaggccccattaaactnacgtatataaagtaaccgatttatacataatatagaatggcattncaggattaaatggggaaangaagagcctatttcggntgaaagannaaacantggttattcatatgcaancaanaatcaggtaacatccntgttttcnagccaccccagatcattagttcntgnatagttaagaacttaaatatcaaaatcaanattcaaaaacttttaatagaacataatatattaatcttttggacattagngtaggtatggatttctcnagacatanaaagttagaaatgaatcaaaacaagtaatatattaaatatacaggcaaaataaaactatttttttcaatgttaaagaaaggagaaactcaaaattcacaatagtggtaatcttttgcaggaagagagaagaaaaagatagatatatgataagataaccaaatacatagatgtaaattactcacaatgttntaattctaggtgtatgtatggatattcattatatcatangtnatttgtataagatatataaggcannancaanggnnnttcaaacg

SEQ ID NO: 14670 - DNA, 688 bp, Homo sapiens
  misc_feature (1)...(688): n = A,T,C or G
cncccncgcccnccttatnaagggggagntanngttnccncncccnaaaagggggggagaaagaacnntaaattaccttggaaantntttttcnaaagggaggannaatncaattcctantccattnaatcattaaaatcaatagggactcatgggatgggatttaaatacttttgtatnacatccccaagactgtgattnatttggctgctggagttggcccaggttggggcactgggagctctttccagtgggcccctgctncgatgacacatgcgcccatccctgtgtgtgtttctgggcacttccttcctttctggcaactataanatgcttcatgctcatcttctgtcttccttgttccagccctggaatcagccatttctccaaggagccttggttcctcttactggagaatggtgtaaacccaatttctgggtgntgatgtgctccgtgctgctggaactgagaactgtttttaaagaaactagtagatagatatcttcattgtttgcattaatcttcttggagcatggaggtgattctttggagtataaaccataattctctggtttgtttcttaaacaaaaaaaatttaataagatagaagagatgatataggataatatggcaaaagcgagngtgtttggcagacgataaataaggcgcttccaaagggttttcaaat

SEQ ID NO: 14671 - DNA, 860 bp, Homo sapiens
  misc_feature (1)...(860): n = A,T,C or G
aggaccctccattaaaaatgcttatagaaagacccctactatggggtaatcccctccaggaagccaagccccagtactcaacaggagaaatagaatagggaacccaccctcaggatggctagccaannaaggaaaaatacttttgcctgcagctaaccgatgaaaattacttaaaacccttcaccaaaccttaaacttaggcattgatagcatccatcagatggccaaattattatttactggaccaggcatttaaaaaattatcaagcagatagtcagggcctgtaaagtgtgccaaagaaataatcccctacactgcaggccatacatttcaatccctgtatctttaacctccttgttaagtttgtctcttccanaattgaagctgtaaatctacaaattgntcttcaaatggagccccagatgcagtccatgactaanatctactgcanacccctggaccggcctgctagcccacactccgacattgatgaccgtcgaanggccccctccccnaggaaatnttaacccgcccaacccctactatgccttaatttgggaggaagctgttcagcgggtggcggccaacctcccnacngnacttgggtttnctgntnagancggggactganaaacaaaactacctngatttcctangctnantaaaattcctaannctgggtgggaaggngacnnttcccctttaacanngggtnggaanttattnnaccngnccatnngggnaaaananctnttnantnctattngnaaacnnnggnaaaaanncntttttttgccngnacccncgggnnntgtcnaattacccggtttnaccnncggtccnttnggccccttngggg

SEQ ID NO: 14672 - DNA, 674 bp, Homo sapiens
  misc_feature (1)...(674): n = A,T,C or G
aanntttnngccccccaagangtttannggaccctgaagnatttttnngtaaataccagctttggnaaagtggttggtgcattgggtcaatgtcttggaaaatgtcactgnacttgttctctttagacagccagcatattaatggacacattcagcaggcaaaatgccacttatctgtttgcccagcatttatggggcatattttgcaagaatggcaactgtatagcacacctgtgctcccacctccaccaactgctccgttgtgggcatcccagagatggcctcagcatccttctctacccaatgccccaggctttcagagctggtatttaaaatgaaatctgtaatctcagagactcaggaagccaagacaggaggatggcttgaggccaggagttcgagatgagcctgagcaacatagggagaccccatctctacaaaacttttaaaaaaaattagctgcttgtggtagcatgcacctgtagtctcagctactcaggaggctggggtgggaggattgcttgagcttcagagtttgaggctgctgtgagctatgatcatgccanngtgctctagcctgggccacanagtaagattctatctctaaaaaaatanaaaattaaanaatnangacnnttgngaaggntttcaaganattncnaangganntcaaa

SEQ ID NO: 14673 - DNA, 419 bp, Homo sapiens
ctatgtcattcgttaagaatgtaatgtgttacttatgttaacgtgcattgaagtttttatgatgggaatcaggggaaaagggggatgagacaaactgtcggaatcgaatatgtaatatggggtctggtaagggatgtggaagttacaagtgtgataagtgagtggatgaacggtgggtgggtggggaatgagaaaagagagagggggataagctggtctttattgggcctatgggacaattactgggtgcctggaaaggggtgtatggttccattgggacaaacagtggggggataccacgagttgtttggccagttggggcctttaccggttaaacggtaaggcagtgagtgcatctgacccactagtgtagaacttaagagtccagtacgtttccttaattacccacagatacaggg

SEQ ID NO: 14674 - DNA, 684 bp, Homo sapiens
  misc_feature (1)...(684): n = A,T,C or G
tttttttttctttttttaagcgcaggtcgcgccgcgggagaccgcccggggggtctccgcgcgccccgggggggaaccggggggggttacgcggggaaatagggggcgaagggcttttccaggaaacgaaaagcacggcaggggtttggcccaacagtgttggacgatcaccgccggtcctctanaaaaaccccccntcaaaaaccccccagacttaaaaaagcatcagaaaaaggcccccccgaggccgagagggagccccccccccgcgcccaaaaagggtcctccgccccccccccgaaaaagcaagggggggaggtgcgggggcccccccagggggggggggctgggtcccaccccccgacgcgcggggccaaaaaaaagagccatgggccccccccccccccaaaaaaatgtcgggggaggctttctcccgggggggaaaagggggggaaaaaagggattggaggaaaaaaaaaaaggggccaaccccccgccagcgaagccgggaaaaatttttcccccttcccaaggggcaacaacgagggaatttttttttctttttgggggggttttaaacccccccaattttgtaacaggaccccgtagcccccacgggggggcccccccccccgcccggggggggggcctcccttttgaaaaaaaatgtggttttgtggtctc

SEQ ID NO: 14675 - DNA, 811 bp, Homo sapiens
atcagtcagcaaaaacagcaggaaggcagctggagatttttgtctccatcttttcccaggggaagttcctgcctcgaccatcgacttaagtttcgagctttggattttggcttacacaatgatttgctaggggtctgggcctcggccacagaatgaagctgtaataatggctgtcctacttttgaggttttgggattcgggctggcttcctgggtcctcagcttgcagacagcctattgtggacttcaacttgtgatcctgtgaatcaattctctgaataaactcctccatatattcatccatcctattagttctatccctttagagaaccctgactaatgcagaggtcatttcagtgtttcaacaagcagaactctaccactcaggagaaagacgcttgaatgcataatggattcctggagatattcagtgatcactgaggtgtgattcctcttgggcaagctaacacataaaggcctaggaggaaaacaattggcttatcagcagttcgttttcaaagctataaatcaagagcatatgctggtcataccacgaaatttagtgacttagtaattgtaaagtcgtaattgccacccaaactctcctcatcaaaagaatgagaacaaatacttttatttaaaaattttgttcagggcaaatatttcatggtaattaaatggccatttttttctgtgcaaaaatggcaaaatgttgtggttttaaccaagtatctggtaaatcctataaagggtggtcatatatttggatgattaaatgtagcaggtattcaataaattgtgatgcggccagg

SEQ ID NO: 14676 - DNA, 532 bp, Homo sapiens
ggctgctacctaggaggtttcatctacacgacagggccacctctgctagccaggcctcctcttctctccctccaagaatctttcttgccaccataacctgattgaccaccataccctgtttttggtcgggctctgagccccattcttcctataacctcaggatggtatagaagcttctgaaccccattggggggttggggtaatcaatctgcatgcacgttaataaagttgtatggcatttctcctattaattgggcttttgacagttgatttttcaggggaccatcagaaggcgcagagcaattttcccttggcccccacagtaggggcaaaaaacgacgacctccaaaactgagggaaacatgcagaaaccttgctcctggaaaacgcttctgaagggcctgcctctctatgggggtgaagcttgcaggataaatgagctattttaaaagctatgtatcagctttgctttaatgcccacacattattcatcaatggacaatacgccttataataaatgcagatgcggccg

SEQ ID NO: 14677 - DNA, 830 bp, Homo sapiens
catagttcttaggacccatgggaaaaccgcggggaatcccaaggtttttgggcaaagaggctatgccagttgtaggctaacccagtagggggtctgccccacagtatggaactaaaggtgcaagggctctcttgataaccaccgtaacacaaaagtccggggtgggccacagcgtagagcttccacagtgacctctaaatcccccacaagatcctgggatgtcatcactgtcacaagcatacgtgccaaagctctctatgccggggctcctgccagagggcagaggaactgcaatttaagctgatggtttgcatttttaggatactatgagcaaaatgcaaacaggaggccagcttcttctgtgtggaggagtgcatttctgcagaaatgggaatgctcccttgtgtctgcagcttttcctccctaaacacatcatttactactttgatcaaaaagaactgtttttgcagcacgtgatttttttttaagccatcattctaaccttctacgatttccctcttccacaaacaaacctttgggaacgtgcattctaaaatgcagaccacagttgatctacgtaaagctcgaggcacagatgatatacgtaaagctcgaggtgaccactcagtgtcacctctcccatggacctccaaaggtagtccagaaagatctatagacaaattatgtaaaaatattcggcagtctttctagagggggataaatcagaagcttacaagatcttattcatctatattctgggtatatttcaatactactcttgtaaaggtaaatcttatacatgtttaaaaaataaaacaagatgctggccg

SEQ ID NO: 14678 - DNA, 837 bp, Homo sapiens
ctgtttagcggtaagaccttcccatatatgcgcattttctggttcactgcgccactggcccccacacagttggctcagggtttttccccacttgaagggtgagagtcaaagagcattgcccagcaatccatggaaaattgcggattttggacaagaccaactccttttccttgggtccttatccagggttgttacaatcagggttttgtggtacttaactcccaggtctttttatattttttagacttcaaatcagagccagagcaataatgaatctttccaaagatagcatgccccccaccggttaaccacccaatgtgaacaggagctcagggacctccatatgcctctgtttggttatccgtggacaacagttaacagcctgacaaggaagtccattccagtttggttgtctttaattattagatgccccccccccaacactttctgtgaaaactcataggtttctacttctggaccctgaaatgacccgtaattaaacatgatcccttgtccacaacatgctccgccatcatatgtgaggcgattgtttctctcaattcccacttcaagttcagaattccctgcttccttcagctcttcctagtaaagaccccctttcagttccttcagcagctggtctccctgcctttggatacaaggcagacttcacatgtaatatgagtggtttagatcacaactccctgagcaataattatgctgacactccttcaatgcagcattcaggatttttcttaactacataccttcacagcacctattttcttggcaaaacactaaaaataaacacaaagcccaataaagctagatcggccg

SEQ ID NO: 14679 - DNA, 127 bp, Homo sapiens
cggcgcacatgatcacatgccgtgtgttggggtttgaatctgaatggtgcaactacacccacataaatggcagcagctggcttattccgcaaaccctggtttggggttaggtccaatgacactggct

SEQ ID NO: 14680 - DNA, 361 bp, Homo sapiens
caagagaaatgggccatctttctgggagcaggaacgttagctcattttgactgagaacagtgataagaaaaacaagattcatgcttggtgcacatgtcaacaacattcatagactcaagctggacttaatcagccaggtcttttgccccatgtgttattgtgcaaagttagtgatggaaagattgcctttgagaagactgacgagccattctcgttccactattgaagaccctgcttaaagttaaatgtgtcaactgagtgtttctacagaagagaatatggttattattacattattattgcacatattaatggcttaaatgatgaaaacagggtattaataaaaccatgatgcggccag

SEQ ID NO: 14681 - DNA, 318 bp, Homo sapiens
acaacaccttaagtgcttcgggtcgagcgtgtatcactacccatgtccaagtaaaggtaactaaattgagattgcggctatgggaggtggggaaaaaatgtgaaatctaacattgaaaaggcgggtaccccctaacaaattggtatttgccaaggtttcatgtccttggcagaaagttgcccgcctgtgaagtagtaacaaatcaacggtttgttcatacgaggtagtgttctagtgctttccactaaagtagataccccagcatttgcacaagcagggggcaaaagatatgtctacaggctcggtgtccaacgcact

SEQ ID NO: 14682 - DNA, 823 bp, Homo sapiens
cactaggtgcagcatcttttttataacccccgttcagcgcccaaatagaaattacaaccccccgttagtgttagagtccaatgaacctccgaaaagatccagggggtcgaaaacccctttgatgattctctgagggtcctttggcacaagtaccagcaccgcccccatttcgcaggttgaaagtccaaatcaagaggcctttggaaaggtaattcctctaccttctcccattgagaagcaagaatggaagacaaaactttgtatctttcaaataaagaatatgtggccaggttccgtggcgggcagatcatctgaggttagaagttcgagaccagcctgcccaacatggcaaaactttgtttttactaaaaatacccaaaaaatagctgggcctggcagtggctgcctgtaatcccagcaactcaggaggtcatgagagggagaattgcttgaacccaggaggcaggggtgtcagtgctccgagaacgcacaactatactccagtctgggcaacagagcaagactccatctcaaaaaaaaagaaaaaaaaagatgaagtatgcagagaagaaagagctttcacttacttacatgaagtactgaagatgtgacctcaatttcacttgctgcttgatcagactgaaaggctgagacattgtttgtgccaagctcactagcactagcaaatctctctgggctctaggtatgcatggagctggcattggtgtcatcacctccatgatgtagatcttgctcatcaaacactccaaccagctggaaatgaaacataaatatgcatttataaataaagacagatccgcca

SEQ ID NO: 14683 - DNA, 912 bp, Homo sapiens
ccttgacccccaaccgatgcaaaaatatcgcacccccctaccccctctcctgcactcaaaatccattttcgcatggccccccccgaacggagcgcccccacgcggaaaaagggtttccttcccccctcccgtttgaagccccagctttggattaactctgcctacccaccccttaaatttcggtttttccccttacccaccctaaaagtgggatttatacccccccttttaggtaaacacaacaggggctggccaaaatcttgcctgaagtccgaagccattgaaagggggggctctttccccttttttccgtaagcccatttttcccctcgttatagcccagcctttcaccagggaagccttcctttattttaacgcccaagccgtaaaccagtctaaggagggccttgttgtttgcgggaggggcaatagagaaagcattacggccaccaaatggcgggcctcccaaggattaaaagatgggtcccaatttgggacaggagtatccaaatataaactttaaaatcagaaggggatccttattatcattagggcatcccttttgaaaatatttatatttggagaagaaaagtttccaatactcaaaaccttatttttagagggagaaatgatttccaaaaaaaaaaactttttttcccaaaaagctgatgcataatcaatcaccgcgcatgtcactttaagaaatgaagcccctgcttcagaaccctcagtaaagaaggagacagtgcctagagtgagtgttcacttttgaggtttgagtgtgatatgattggaaaagcttgagtaataaactcctgaaaaatggcgccctgctaatgagcaagcctttaactatatagacatgttgccaggtaccactttaataaactaataaatgacgatgccgccgga

SEQ ID NO: 14684 - DNA, 958 bp, Homo sapiens
actgtaaagaaactctgtttttctccccgctcccccgatggtaaacgcacttccaaggttacccgtttgtaccacgtcccctttcaaatggcgcacgcccaaaattatcaattaccggacccaatcttatcttctctaaaaaatacaatgcctccccacccccaagttataaccccccccctccaagtttattgtttaccagccctccttctttcaatatcatatattgaagaacccacttcgtagcccctatatttgacccaaatttcctttgttaacgcttacatgttcttcctcttttgagaggttcccactcactttttcattccccaacaaatttgatttctcaatgttctagaatgtatttcttgagacggaaaaatgctataacacctttcccatcccttctcaactcgaacaactttaatatatgctgcagtcccagattcacaagagaatatgatgtaaatattgggatgtggtatggcaacattcatagtctttggtattcaagtgactgcccagggcagagaaagaatgtggctaacagatgattgctagcaatgcagtacctaaggaagaagaaataaatattttccatgaagcaaactgatttctctgaaattaattaagaatggcaaggagaggatacacattattatgttaattttgtacttagagagagattaaacacttttttcaaggtcacaaagccaataatcattacccccccccttgaatccagggttgtcttatttcaagctctgtttatattttaatatgtcataactttccattaaactaaaggaacactttaaagataaccactgtcgaagaggctgaagtagacatgtaacttccattacatcatctcccaaacgtgttttgttaacaacttgcttgtacatttaagagtcttctgttactcattaattttaataaaaagagatcggccgga

SEQ ID NO: 14685 - DNA, 919 bp, Homo sapiens
ttcacccccccgctcccggtatactttgtccgcctgggggctctcaccgcttggccgtcctccatgctcgacgcagattcagtagtgtatgcaccggcaattcacactgcccacaagttatcgcaccaaacccgcggcccccgccccctgttatgtgaaatcggctccgcaaaacccctgttaaaaaaaacccaaggcaattgccaccgtaaccagctcacaaaaaaaatcctccatccattcatagtgacttaaggagccaatttcttaccccctatttccaataggcctaaagcaaaatccgcctacccccctggtttatttacattaagagttctgtattccactaagtttgggtttaatcaccattaccataaaatatgggcgctaaatcaacaaaagcaatatatattcgggatcatatcactgtcatttctgtatggtcagcacctaatagttaaggaatatttgcttgttgaatgaatgaaattatcacgtgtcattcagcgtttcccatcatagagattatctactattcgttaccaaataaacacaggagaggccagagagtcctgtttatctgtaatacttcatgtacacttatcatccctatcttgaattaaaacactaacatgagctcctaacttggttttttaatagaaacaaaagacttttataaaatattttcccccctaatctccatgctttctttatccgatctaacctggcacctaaccaggcagaaatgtatgattcctgccatagcaaaaaaaccaccttttaatctctagatagctgtactcattgtcaacttattaggctaatatccattacccactcatcaaatttgaatagttaggctacttgctggattttgaaggtcaaccttgtttattaataaaatgcgatgccgccggac

SEQ ID NO: 14686 - DNA, 210 bp, Homo sapiens
  misc_feature (1)...(210): n = A,T,C or G
cacgaccgctcgcagacgcggcgctgcaatgtggtccctaccaacttcgcgacactccgctccaaccctatttgccactgtgcgcgtcgtcgccatccacatcctcacgtttcgcaacctactacgtgcatatgctcgatgttcttaccagctcctctgctctctccccaccataccccaccggctgtgctccccgtcccncnnnncccg

SEQ ID NO: 14687 - DNA, 920 bp, Homo sapiens
atacaatgtcccccttccgaccccgatattttcatggcttcccccacccccccccttcctctctcgttggtcccgcgacccccctcccatcttcccaaccccgcttgtggggatgtatcagctccactacgaatccctcccatagggtcttcccggcctgcttctctctccgtccagcttcccctcagcgtaaagccattgggccccgccctcaccctcaaggggggctcaccaaggtttctcccctttaagagaggccagggagcgcaatcaggccaacaccccaggataagccccccacgttcgcatgcacatcaagtccgtggaatccaaggccaatctcattcaatgttctaagtttgctagtcccctgtaaccctttcagttgcacctttgaccactcccttgggggcagccctccacccctggtagcggcctaaccttagtccaccccaccacaggttcctgtccttcccctccttccctcaccctaggcctgccaagtccacatcccaccttgggattgagctcgtttggggtgtgagctttattaatccaaaatgttgaaaaacctttccatagactatgactcagaatatgtttaagccatcatcctcagcaaactagcacaggaacagaaaaccaaacacctcatgttctcactcataagtgggagttgaacaatgagaacaccccccccagggaggggaacaacatacaccggggcctgtccgggggtggggagtcaaggggagggagagcattaggacaaatacctgaggcacgtgggacttaaaatctagatgacggattgataggtgtagtaaaccaccatggcacccctatcactttgtaacaaacctgcacgttctccacatgtatccaggaattaaagtaaaaaaataaaactcgatctggcg

SEQ ID NO: 14688 - DNA, 258 bp, Homo sapiens
  misc_feature (1)...(258): n = A,T,C or G
cttctgttcgcctcctcccactccgcccttaacactccttccctcccatcatcgtcataccaccccaccctaatccgcttcagcctcgccctcgccacatataaccacccctatcccgcctcaacggtgtcgcctanctccaccacccgcaaatcggttgttttataggacattgacactgcattaacccttcacatttcttacgaagccattggatatataccggtggtattccaggtattttttgcccataaagcc

SEQ ID NO: 14689 - DNA, 125 bp, Homo sapiens
tacctcttgctggcttcgcctcctccgttactattggatctgatctggtaagttacacaaccatcaccatcccatcagcgtctcagcgcttcaccagatgccacactctgtgttggttatggaca

SEQ ID NO: 14690 - DNA, 994 bp, Homo sapiens
  misc_feature (1)...(994): n = A,T,C or G
atatgtgtttggcgttacatcggtgggtggccaanaagagaaaacctcggtgatggagaaacagacggggggcgcgcttcgagatagagagtacgcctcaattaataccacaataaatatattgatgaaatggggttgattgtgaatactaaagtaaccgaacagaagaagtccgatcagggaagggcccaaaacagtgggggggaggacagaaacaaaaccacatgggaaaagcgaggggactaactacctaaatggcacccattcagacatgggtgtaaaaaaacactaatcccggtaatttacaaattttttctggagtactctaatatggcggttcgatatcatttaactaaaatcgaaagcgcaccaatcgcgtgagttatcaccttttaaaatagtggttggggaaaccgcgattttacatctttcgcccttcagattttcatattatagtattaccgagcgtactctaatttattttaattgcgacgtacaattatgttttctcccatagattataatcataacccgcaccttaagttacaataatatatgctattattgtctatttaattttatcatgacatctttttatattctttctcctgacgcatcccattctgtagtctatttcgacggtacggatgccctcataacaatgtgatccattccgctcgattgcgcgagacggtgtgattccctttacaatatgactaatattaaaaaggattagggggcgaccatatgaacaaataaggcggcaatttgatcttccctcacatacaaccatctacaacgaatagcattctctgcaaccaatatttatgttcaattttctgtattcccttctctctccttcactcacgtatatcatgtcgtaccacacatgtcttgtcacatatctattaaactatacctcgttctttttctctgtcgggctggtttgctccactgtttgtcacgcccatgttacccaatacgattgctatat

SEQ ID NO: 14691 - DNA, 207 bp, Homo sapiens
aaatatcttctgattgttgaagaagacaccatcaacacattcactatcaggaaagtatggcacctctagatcattctaccggcactgatgacgtctcccccaacaacatttccacagaagaattcctcaagattcctcagaacttctggctcctacttctctagctttgtttgggtaatttctttcatactgagaaagataaattca

SEQ ID NO: 14692 - DNA, 1085 bp, Homo sapiens
  misc_feature (1)...(1085): n = A,T,C or G
aacagagaccaggacaatgggaccagggggagagaaaaaganggactcctaggagaaccncancggggggcctcatgggacaggacacgcggcgacgaacaaaatggacaatggagaaaacggcgggcggggcggcacgaaacaaccaccgcgcccgggggggcgggaaacaggggagggccccaacaagaggagggacgggggcccccaccaacaccacaacaagggaacgggagacgggccaacacgggacacacagggacagcaaattcaacaatgggggaaacaccagcgccaacccacctggacgaacactcatttctttgcgaaggacaggggcataacaggcggaaggggaacacggggaaacccgcaggagaggtagagacatacggggggaggaaacacagggtacatagccacaggaacaaagaaaaaggggcaacacgccaaatacaggagcccagcgagggacaaataacagggaccccggggggggggccaccaatgggtccgactngacgagggcaccaaccacgaaatgccctggcaaacaagaccacaccgagggtgaacacaccacgggcacccacaacacctagcccctaaccggacaacaacaactcaactacgggtaacttcactcgcacccaagtggggtggggcaacacacccgatagcgaacacggggcagtgaatccgatcgggacaaaaaccacatgtacatacagagcgggggaaatgccggaccacccgacgtgctccctgggtgctcacatgcacccccacaaccctacgggcgggcggaggaacatcaaaaacaaacaaaaggcgggacctggcgggggccaaccacggcaccacctggcacaagcgatggacggaggcggggggcgcgaacacagcggcgcgtacataccgacatggacggacccccccgcgtcctcacccccgccccaatggtgccaccacaaccaaggtgagaaaccaacactaacgtatccatgtgtggctcggaacccagtatacaaggggcagaacacccgtggggtcacaccatcggccaccccacgcgtacggcgggg

SEQ ID NO: 14693 - DNA, 262 bp, Homo sapiens
  misc_feature (1)...(262): n = A,T,C or G
gcatattttacaggagaataaatgaagtagaaattgtaggttcaattgatctgaatgccatgaaccttgcaagaccaccatattccctcctctcagaagaggcccctaatgaaggcactgctgaagacaggagacctgacttttatcttggcttctcctaacaattctgtgactttggctaagtcacaagacttctgtaaacaaatagtatacatgtaaaatgctagccctacatctaccaaaaggnnntcatannnntnna

SEQ ID NO: 14694 - DNA, 1381 bp, Homo sapiens
  misc_feature (1)...(1381): n = A,T,C or G
gcgtcggacgatctgagcagaccgcgagctcgcacacagcaaagacggagcgcaggaagaaggagcagaagnngcctgcnctctccgtcntngaacnnnnannagnncgngnngcgcgnccccgtcnnncngcgcgngnacgagganacacanacagngcgagcaacgagagagacnacannacgagcgacgaancagagacgaacagaacaagacgcctcttagcgagaggaggngcgcacagcacatgaactatcccgtatcacgcgaaacagagagcgacgacgaggagcagaanacacggcaaangcagcgngaccgcacacacacaccagggaagacaagcggcgggcgcgtcgcgaccacgacgacagtggtacgaggacngagacaaggcacgagacaggtgggatcgtgggctggangcagtgaaagagagagaagaggaatggagagcgagaggtcgagaaggagaggggaacaagcatctgagctaacaacagagagagcgagagaaaagaaatctttctctacaacgaaaataatgcgggagagaagaccgcncaacagggagacaataagaaaaaacagaagagaggggagaggaagaaaaacgcggagtcgaaccaccggtagaacggagcggtaaatcgcaaaaaaacgacacaatacacggcgaagtaaccgcagcgaagcacagggctcataagtgacgaggaccaccacgcagaagccggaaatgctcgagatacagacgcgggcgggacatagagagcgagaagggaaaatgacagggcccacacgcacggcgggcaccaactgagtcacaccaacaagcccagacaaccacgcagcgacctaacaaagtgtacaaacaagaaagaaaattagagaaggaactaaaggggcgggaggacaacgaaccgatagcaggaagaacgcgccccgaggacccgagcacgagcgacacgcgccantaacagagaaacacgagagagatacacgccgaaccgaggtgcggagaggaccgagagtgagaaagatgtctcagcaacgcgcaaaggaagacgcgagggaacagcggcaggcaggtacaatatacaccgacagagtggagaggagccgcaacangcgcacggagagtgaacacacacgcacacccgcgccacgcgcgaagttcgcagcgacgcgcagcgtaaagacacaacaaacgacaacaggagccaccacaaacacgcgaggaacgaagcgagagcagtgacacgcaagacagaacacaagaaagggacgactatggagacagaagacgcgagtaggacgacgaaaggacagcaaaatagagtacgagagaaccgacagcccgaggactgaggcgagagct

SEQ ID NO: 14695 - DNA, 508 bp, Homo sapiens
  misc_feature (1)...(508): n = A,T,C or G
ttccccaagtagctgggattacaggtgccccaccaccacaccntggtaatttttgtatttttagtaaatatgggggtttcaccattttggccaggctggtcttgaactcctgacctcgtgatctacttgtcttgccctcccaaagtgctgggattacacgcatgagccaccacatgcccagccagcnggngggnnnnntttaattgcttnaaacttttacagctgctttcctncccttggttaagatacctttcccagtgctgctcattccactaaccttccaaattgcatcagatggcttcaggccttacagatcttgcagctcccaacccccatgtttctcctgcttcntcaaggcctctaataccttctgaaaatctctcacattccctcacctgtgttcttcctcttccccatatcattgaaaagtactgagatcaaatgcatgaaaanntccagttaannnnncannntanntnannncnnnaannnaagnnntcaaaagnnt

SEQ ID NO: 14696 - DNA, 449 bp, Homo sapiens
  misc_feature (1)...(449): n = A,T,C or G
ccaacttcaaaaaatgatgtaaaagaagtgcttttgagagctgaaagctgtggccacatggaacaaaagaataaatgaaataccctgagagattagagatttggatttaaaaaaaaacaacgtcctaccttctgctaccaattataccatccaaattccttctatggttaaagacatgtaatgggtactcacaatattttttgaatgaatgctgctgtaaaatgtaatacatttatttgnatgtattataagaaaaggnttcatatatgagggggacttncnaaactttnnccnagaaattttaactttaaaattaaaatnngngncggcccnttncctttnggnnggggaaattatgaaaccctcttcatgaactcttgccctggnnttngggntnggggaaanggtttnatcttatttnaaggggggaatnggttttccaaaaangg

SEQ ID NO: 14697 - DNA, 139 bp, Homo sapiens
tttctgcctcatcggctttcccaacgtcccccacagttcactttcaacaacaatctacggtgtcaagaattcacttcgaaatggttcagaagtacatgtgaaggtttgttacatcaataaactacggatgcgggccagt

SEQ ID NO: 14698 - DNA, 1093 bp, Homo sapiens
  misc_feature (1)...(1093): n = A,T,C or G
aagagtcgtcatgtcatcttgatgtagagtcgtcatagannccnanaaaaaacacacaacacacccaaaaggagagaacgacagcaacggcccgccagggaccctacaactactcccccccacggtgctctacactgtcgctccgcataccgtggccggcgggggcaacaagatgctgaacgagctccaattgtcgatgggagagggtgtgtaagtttgatcagcggcttcggacgtgcggtagctgaggagaaagacgaacccaggaaagagcgcatttttttttgggtatgctgcgatcgccgcgccaacggaatactttacattacacacgtgttgtgggcaacccacccgcgtattgtaatcgcgtgtccacgcctatgcttaccgtgccaactacccaatcttcgcgcttgtagccgctccgtcactgttaacgtttatatacacagcgcgcgccgagtacagccacggtcgcgtgtgctatggcatcacgcgcaaaatctattatcgccgctgccatggttcgcgcattcaccgggccttaccataactagaagcacgaggagagcgtttgagtaggtgtcgtatgcatgccggcacgcatccctaccttccgccacgctaccatccgcgtgcgccacagaccacggacgtgttctatttaccgacgcacacgtcgtctggcgccgtgaagttctaatgtatgatgtagtattcgctgataatatgccgcacccgtgcgccctctatacctcagatcgtcacatgcgctctcatctatatacgaccatcgcttatattcactatctataaattggtattagcactgaagtgnagcagtccacgtatcggcgcccgaattaccacgatacttctacacaagacccatcctcatcatcttccgctccactttcagctagccatgcttcaccaaccatgtcatcctcatcacccacgtctgcacacttcacactatacgaaatgcgctatatactaacactcaagtttatgtgagtgctctgattgacgcacgcgtgccatcgcgctctgcctgcgcataccacgtttcctaccaatctgattacactta

SEQ ID NO: 14699 - DNA, 147 bp, Homo sapiens
  misc_feature (1)...(147): n = A,T,C or G
gnnanncncnncggngttnantnagaaanatgnnaacccccncntagganaggnnaaaggcagaanaaaaatttttttngnaanncccnntnaaggngntangnncaggggtttnnccnnntannaacccccacnttnttngngaaa

SEQ ID NO: 14700 - DNA, 510 bp, Homo sapiens
cagatgcaggaaatcatgcaaagaaattgagaggaagaaagaaaaatgtggggaaaaacatatttgctgtgtccctaaagaaaaggataaactatcacacattcacgaccaaaaagagacaagtgagctatatatctagttgcgactcctaattcagaattttaagtcattataatgagtcaatgaaatggctatcgggggcacctgcattttcctagatctctgtcaagtcttcacagggcccgttagaaaaacaagctcattcctgctatcaatatatctctctagcctgctgtagcccaacaatgctctaagctgtccttggatatgactaataatagtggttttcaaggtaagaaaattttataggatctagatcttgaattcctaaacctctgtccgggtccctgaatgtagaagtttaccaggttaacgcaaattggaccttagctacagattcttacctaatgtctcatcctggagagttgcaataaaacacgatgcggccag

SEQ ID NO: 14701 - DNA, 929 bp, Homo sapiens
  misc_feature (1)...(929): n = A,T,C or G
ctcgcgtatagtgagtcgtataatannnnanaaacnnncttccccctcattgttcgccttcgttgttgcttggactacaataattccgtacggtgggaacaatactgtaggaacaataaatgatcgggtcggcgaagaaaataatccattaatgtcaaagtgtttgggcacacatacaaaatgataccgaacataaaaaggcggcaaaagataaaagaaccaacggtaacagtatttttttttagtggataacccaataatacaatgaatagtatataatgtatataatatatgtatgtcatataaatctcagtttatattatattctattttcttatcatatacaatcgcgctttatcgaaattaggggttattggttgctatataacggactaaggagcagtgataaaattgttatgaattgttacggcaaaaattatattttgcgtcatacacaaaacaaatgcatagaaacaaatcgaaaaaactaaattacgcttaaatgccatattcaccctaaccttgttcaaatatatccacctaagctgattattaaatctccttagtataatcccctcctaatatacacataataaaaatataattatttttggccaattcgccaacactagagattttcattgttcattatttctctctattatctgtgacgcggatccacctccacatatcttttagagtacaaaagggtatacctcatcacctccctttcacactcatatcgtcttgtgttaaccaaaatcttggtggctttagactattgttgtaccctctatttcctacttcctctatttgtaatacaatagtattcgactaactcacaaaaaaacaaatgttatttataataatccattatactgttgtgctaaatattcgttcataacactaaccactattctataatgatc

SEQ ID NO: 14702 - DNA, 276 bp, Homo sapiens
ttccatgtttccaactgaacccatgttcctccactaatacttggattttcttccaccacggccgttcctgagacagcaagaccagttcctcctccttctgctcctcctcagcccacttgacgtgaagacgacgaggatggagaccttgatcgtgccccactcccacctaatgaatagtctgtagattttctcttccttaggactttcttcataacattttcctttctctatcttactttattataaaaatacagtaataaacacagaaaggccgtt

SEQ ID NO: 14703 - DNA, 1417 bp, Homo sapiens
  misc_feature (1)...(1417): n = A,T,C or G
cactgctgtatcatcgtcgtcgtcatcgtatctatattgtcagagggnaccactctaccacgactacaccgagtactaataaacagagggaacctgcagaccctgtnacgtgcatcctgatnaacgctacactacaactcttcacccgtctctgnnacacgcacctgctgtcggtatctgcggangacataccatcatcactacctgctacagagcctgtgcggtagccggccagtctccctctatgcgtnccatcgtggactcgcgccacaatcgcatggatgactcgaccacatgctactgggggtcccatctccgtcctagatagannagcgcttgtcctagtacacgaggnaccgctgcgaccagactatggtgtactcagantacgctccgcataggtatcacactcctgactcactactgtcggagaaccattcgcatgctcatcattgtngcnantcatgaccacacngcacgnaacgncacctactcatcctactaagactaggagcgagtggcagcacccgancactgaccacgcgacagtccgtggaaccactgaggngacctgcgcgactgtgtagtgggctctgttatggtacggtgnggagtcgaacagcgcgtggagacgccgtggtacgcgcggtgctcctncccccacatccacgacctngcctgccctgggacaccacgagggcgagngaccacactgacctcatcgccctgcagccgcgcccacgngctcgctgtgtgcgctcacaaccaataagatgacgtggactacatagataacttctaaatcatcaagaactgagnactcactacgacgccctacaccagtgcgccacgatgnntactcgcctctccganaatannancacaccacacatctctttnctcctacatancnaccacactaccacaccaactacaccaccacacannaacgcactcantctcatacctcatccctccaaccaccccacctacacacacttactctcatcacaccacatgnnnnccacccacctctacacctatactcatcccaacaaccacacagccacncacacacactcntntccactactctctcttatcccatctcnnnncactcattctaccacncacacaccctnncnnnccatcctccacctcnntnnncacctcttcacnnnccatatcntactnnnnnnncctcacctctccnncccctcttnnncccctcctctcccttnncanctctcattcattcnnnacactcttcnnnccccnctccctccncttatttacttnncctcctntnncntntttactttnnntnatntntatccaattatctcttactctttcttnncatctatcctttnnnnnntatnatttntaaaccttcnaanatacaaatacaatacat

SEQ ID NO: 14704 - DNA, 762 bp, Homo sapiens
  misc_feature (1)...(762): n = A,T,C or G
agtcaaggaaactnattttgaactgtttacagcctttantaattaaggccatcaaattccaaacaggcaaccagagcctntgaagatggccccttcttctggggatcctcacataggcctcggaggaagctctgactgccgtttccccaaaacagcgcccccgtctgcagaaagtggttaagattggtcttagtccttatccttaatctaacgggagttagatatacttctttagacgggggaatgagacagccaggtgggagggggtccctggagaaactccaaccagcctgtctactgaggtggagcctgggaagttcgagcccttttgcagtagggaggagctggccttgncctctttctgtgtggaacctgggattcggacgttgggccggaagtgctctaacangggacttttgaacttgcggagggacccctgttccccccnttttttttcctgttttacccaataaaaccccgatnnggcgcttcccttttnntganggggttatcntggancctnngttanttanttncttggcctnngnntnttcngttnngnnaaacgnntttttnctcctcaaangngggtnttnnggtttcccnaattntngggaatnccnngtaaaaantttatcntaagtnccntanggnccntanctnataaggccnnnnttnngnnnttctanctccnccccctnanatatataanatnnnccnntntnaagggtaaccnntgcctttaatactngttctcttant

SEQ ID NO: 14705 - DNA, 1243 bp, Homo sapiens
  misc_feature (1)...(1243): n = A,T,C or G
cgaaaatngaagacggagaacggacagcatggaggagctcctaatgaacgagctgagaaaaaaacagaaggncaacacgcccactaaaagtcacaacgctaaatactaaacacgaaggagaaggggaggtggagaagtgcgtctaaggagagccccgatcactataagaagaccagggaggaaccaaccatgaacgagcagagtcacggngaggaaagaataggaatagagagaaagagagcgagagaggacgggacagacggtaggtgcagcacaaacactgcacagtgacagatgtactaacgggggcacacgaagcaggaaggggacagaacacggaacacagtgaaagtaaccaacactgcgagagaaatggacaaaaacgagcctggcaaaacgagaatgacataaggaggcgggagaggaaagaaagacaaaaggagagaacaaaagatcgaaaaaacaatagacaacaaaagaaaagaganagaagagagataggaatggagaaggnaacgcaagggagaatgagaatagatacgacaacagacttcactggcaacatcaaaacaggatacacaacatggtagacacagcaacgaatagggacgatnnngcactagatacacaaatacagaaatgacaatgaaacatctttatcaacangcactcagcaagagagctacggaaacgtgaatagggttgatagngacacggcagatgnacaanncaaatcagaacgcgangccatacctggcgcacggatcggagagggcgctaaggatgggcgggtgcgcnaccacacccgggtgaccgtagtccctctctttggccatggtgcgtgactcgtctttgcgtcgtcgcgctgcgacatatngcctatcggaggagcaagacgnnaggagagcagctggtggncacaacatggtcaaatcgagcagnnnagcncgtcganacattcttcttattctnntntcgacttcttcattnnntnntatatatcctcnntgtctaccccnctnnnntnctnctcgctttactctnctccttcttctatcaatcattctnngcgtactacanagccatnttaataccacatanatcataaacaatctagtcatctcncttnctcaaannnctntcnccctctctntcttctcttcatctttntattcctcntntctntcctctccactttnnncnctcttcttcttccccctcncccccccctcncacacacact

SEQ ID NO: 14706 - DNA, 766 bp, Homo sapiens
  misc_feature (1)...(766): n = A,T,C or G
gcntacccngccgnttttnttngnaanattngccanggggggcgngnncnntttgntaaanncgcntananggngtgggcnnttcttaaggttttanangctttattgcggggccntttggnccaanatnttcctttccntggcntgaatccccntnatttattgctnnntaccccggtanngnccnccctttannntgagcngaaancggttnggcngcaacacnggttnggncccaaggcgcacnaaggtcatgtnntgggnaggatcattnaanttaacccnnncaantaaaggaaaangngccnggccanccnggangtttatttttantctttcattagggngtgcagatcantntnattnnggctccctatttntatagaaaagaaaaataaggttggtagatagntaacatcatagtaaaatattaanntatntattnatggtangccttncttccnanagnatgaataatntttcaagtgntgctggccaggcacggtggctcaccgccagtaatcccagcattttggcaggttgaggtgggcagatcacgaggtcaggagatngagaccatcttggctaacactagccatctntagtaaatatacaaaaaattagccaggcgcggtggcgggngcctgtagtcccagctactcaacaggcngaggcaggagaatggcgtgaaccccggaggcagagcttgtagtgagccgagatcannanactgccctccagcctggaccacagaacaagactccat

SEQ ID NO: 14707 - DNA, 281 bp, Homo sapiens
  misc_feature (1)...(281): n = A,T,C or G
atcccagctgnaatggcacattctatttgtcatcacatctccttaggctcctcttggctatgatagtttctctttccctgtttttgataaccttgatagcttcaaggagtgntgatcaggtaattggcagaatgcccctgtagtggaatttattccatattgctttttaantattnacttgtangnatttntnccatattntcctatgatgttntgaagggaaagaccnagtcctttgtgtatctcnnncatttagcattcaatannnatgatnctggnag

SEQ ID NO: 14708 - DNA, 702 bp, Homo sapiens
  misc_feature (1)...(702): n = A,T,C or G
angcnncgggacnctcttaanaccctncgttncananaccntgcactnnnccccnggggnccctncngttncagccngccacngnaaaggnctctccanaggnnntacccctgntgncctgactggcccttngggaggnancnggatgatctgggaganggcancctttaaaaaaacnnntnnntgttcagaanagnactntacggagacagantagacgcggncgcatcngctggnagnatatcccngcaccnntgananantgggggnatancancnggaaccanattcacggacctgcccnnggnnccccgatagantcgactagggggnnnccgcaancngnnaaanccntatngnntggggncgtgnccgaaanaactgannccctgatggngggngatncggcggnngtgcctgnntccaaanaaccctccagagccttcaggtttttgctgngtanaggaatgacacctacncncnngactgaccgggattgttgaaccccctggtgcgaccgactgnggacagactgataggcggttaaaatggatcgatncccaagtgatgnttacatgacngnataatctttaganccataggccgctattttgcnagcaggaccncncangnnttngttnaaaccgaagttntgtgaangncnnagnttcataancttgattaaaatcaaggtccattttt

SEQ ID NO: 14709 - DNA, 329 bp, Homo sapiens
  misc_feature (1)...(329): n = A,T,C or G
acaccttcttagagacattgagattcctgacttggggttaccaatgccttgtggcctcaggatgctgccaggtgaccaacatcattcttgacttcacatccagaagaatcggaggaactacaggtccaggttctgtaaagtaaaataaatccagaaagtcagacctcttggaaatgtcccacctctcctcaaagctaaaatgagtgatagctctgctgcaaggatatgaaaatgaacacttggtaaaggccaataagtaaataaaacagaccggcngtcctaangnnccctaagcgtccnannnnnnncctnnnnnnnncnnnnnnncc

SEQ ID NO: 14710 - DNA, 1732 bp, Homo sapiens
  misc_feature (1)...(1732): n = A,T,C or G
aggaaaaaacagaaaaaagaagnngngannnnagaggnngtggngnnngngcgccacgcgacgacgacagccgcagacacccgcacaacgagagacgnanaacggagacgagaggcagangccctgnaagagaaagagaaagaaccagagaagaagcagagaacganngcctttcgcngcgcgcgcgcgcnncaacccncgccgaccngggacaccaggaggcgagagagacgacgcagagaacacacaccagcgacccctttcgcgacccacgccgcgcgcgcgcgacaggcagcccgcagagaangacacacancacaancacncgggncgagaggcagcgcggacncgcgnaggaggcgcggggagggacacagaggacgaacaggagacgcgcgggagagccgcgggagcgagcngcacgcgagcgcgcgcgcagcgcncggcgncgcgcngcgaccnncacacaacacggcagcacancacacgaaacacaganacaccgacacgagaccacgagcagcgcccacgancacgcnagnagcagcgccgcagaccgcgacgacacggcacgcaggagagcagncagacgaccagacngcaccngacagngagngcgacccanagcagcaaggaagccacgagcgngagccagcgacgacagacgcagagcacngcagaagacagcagcaggancagaagaggacagcgccgacgcgcaggacgacccgagaggcagacagcgcacgggcaagaagacgagacgagcggccggcgcaggangaacgncgccgcgcacagacgcacgacgcacgcgnccgcacancgcgacagacgcacgccacgcgacccccncgcgcgcgcagccgcacagcgcagcgcgccacanacgagcgtcgcacncaacgcgcgcgacgacacggccaccgacgccgccacacacgcagagacacgcgncacgccgcaccacaccacccnacagccgagacgcgccgcacacgccaccgccgcnccgccgacaggcgcacgccgccgcgagagcgacggcgngcngcncgacgagcngngacaacgcggcgacagcgaagncgacgggcggccacgcacgcacgnacgncacacgggacgacactgacgaaggcgagcgagagaacggccgcgacgaggaggccgcgcgcgcgaggcaggacgcacggagcagagggtangaaagcgccgagaggagcgccggcnacgcagagcggagaagagcctcagcnacgtcagacgccgcacgagccacgcgcgcggagacacgcgcgtccagcggcggcaacgacacagcagcgtgacacatagtacgagacgacgaggcaacccacacacgcagacgctcgaacgcgacgcacgcgaccgnacgcctcccagccacggacnagagngagacggaggcacgggacacgaatcagcgagcacagagtacgcgccagagcgcgcgactccacgccacacgagcgacgcngacgcgcgaggcgaacgcacncgacgagacagccacacgacacagcacacgncgtcngccaggcagcaggcgcgaagggnccgnacgaagcacntgcagcagcncagnaactagcaagagagacacgccgatacggcaaagagcagcangaacgacgagagaagacaaggcnantacacaggacgacgcncaagcagagagagagcgaccgaccgacacagagagcagaca

SEQ ID NO: 14711 - DNA, 793 bp, Homo sapiens
  misc_feature (1)...(793): n = A,T,C or G
aaaaatnacnaanaaacaattngnncctttccntttccaaaaaaggttccannttgggggaaacaaaaaaanaaaagggaattgggaaaaaaaaaattccttttnaaaaaaaaaaaanaaangatttttccccnagggtttntccttattccaaaaaaataaaaaccnttccccnnngggtttntggaggttccttntnnaccccccaaacccaanaattcccntcccnttnanaggngggaaaaaaaanncccccagggncctncaaattgganccaagnccttggttttttttggaccatgcnanaaattttgggttgcccncctggcataagccaacccnaaatatttggttaactttgtaggaaatgtgccnatgaattttgtgattaattttttaaatgttttctattatgtaaaaaaaaaaagcaagatagaaaactttatgggcctgcctgggtggctcatgtctgtaagctcagtactttggggggccaaggcaggcggatcgctcagatcgcttgagctcaggagttcaagaccagcctgagcaacacggtgaaaccctgtctctacaaacaaaccaacaaacaaaaaaaattagctgggtgcggtagtgtgcacctgtagtcccagctacctggggggctgaggcaggaggatagcttgaacccaggaggctgaggctgcggtgagctgagatcacaccactgcacttcagcctgggtgacaaagtgagaccctgtctcaaaaaaataaaataaaataataaataaaataagatcggcgttaa

SEQ ID NO: 14712 - DNA, 1490 bp, Homo sapiens
  misc_feature (1)...(1490): n = A,T,C or G
gagagaagaagatacgagagagtgtnagcgcgcgagagagngacagagcatagagctganagaanagagaagagcagagagcggncgnngngnnngagngggnngcggccctgnggntganaggannnnngaatctnncacgngngnncgcgngngngagagaggccttttngnngngaggnngnngnnganaaaaccgngngnngnnggnggnngggngnggaagaggagaangnanagagaggganagaacaggaggnaggagagagagagttcttgataggaagagggggacgcganaggggnagaggcgcgnaggcgaganaganganaaganaagggagagagagcgagcgacagagananaggaagaggcagaagaggaagcagagacggagaacaagaagagagagcggagacgaggaggcgagagagaagagagggagaaaccaggnagagagaggaaaggcaaaganagagacagaagagagacaagagagcgaagagcggcgagcacgcgagcagaggcggcaanagaagcgcgagacagagagagagagaaggagagagagagaggagggcanagagagggaggaaagagagtatntgangagacggccgaaggngngaganagacgagaagcanagagagcgaagagaagagaacgacnagagagaagagacgaggcacagagcagaagaccagcangcacgacgacagcagcgacgagagaangagaagaaaggggcgaaggacnacaagacagnagcagagaagacaaggcagagngacgagagaagagcgggggcgacagancgaggagagaaaagagaaaggacggaggaggaacanagagcnacgaancacggagacgacgagaggagaggcagagcgacaacgagaggagggagaggaggaggcagggcggcggacgagagagggagagaggagacagagagggaggaagggaggaggagaggagagaaggagaagagagagaagagagggaacagggaagaggagaagagaagggcaggaggaaaggaagcaaagagagaaagagaagggaagaggaggcgcaggaaaaagagaggaacgagaacaggaagaggagggngaagaagaagagggaggaggagaggggaggagaggaagggagacgaagagagggaagaagacgggaaagaaggaaggggaaaagagagagaaggagaaaaagagacaaacagggcggagagagggagggagagaggaggagagagagaaaaagggggaagagggagagagcgcgagggggggggggggaaaggagaagaaaggagaaagagagaaggggaagaggggagaggggaagagaggggagacgacgagaacgaacagcgaaaacaaggagaaacgggggagagaaagaaggaagaacagaaaaacaaagagaaaagaggagagaaaagaaaaaaagaaaggggggaaggaaggaaaaaaaggggcg

SEQ ID NO: 14713 - DNA, 1297 bp, Homo sapiens
  misc_feature (1)...(1297): n = A,T,C or G
cttatctatatgttcgcgtcgcatcatactcatataacctggaaccacatacgcggcagatacgtgtggcggatatttgcgcgacagacgccatctgnattatatctgatcgcgaaaatcgagcgcatagcgagcatagaatatactattagactcggcatagtattctgtatagtaactgcgcgtctacgaccatnaactggcgacggtcattctccgacgtattctcgcctcatgcgctcatatatctatagtcattnctgagcgtcagctgatgtctagacatttgaatatctcgtgtgtggcgcggctacactcaacgatgggcgcggcagcaagtgtatcgcctcacactcctantacattacacgttgcgtgctcgcgacgaactggtctacgtactatctacggagcgctgcgagattactaaatcgtcgcggcgatgcagctacgaatgcacattacgtatatatccgcgtcgcggcgccggcatcgtatcgcgggcggaattagagttcaccgccacctatctgctgtagaatcgacgtcgacgaggctgaggcgagccgtcgaatattcgtgtatttctcgcgttcaatacggcggcaatcgatgctcagtaaacagtcagtaaattaatcgccctggcgcgcgatctacccgacgagctcatgccgctggtgcgtcgtctatctgttgggtggattcacaacatttccgtcagcagcacgcgtatatcgccgcaaacgtacgcgaatgtaatgtaatcgtggcgttcgcactccatcatagcggtgtgcaggcgcttccgaaactctgcttctacactctaatatcttcacgatcaacgtaaccgcacaggcaaggacacatgacttttctggtattgtcgtatctttcatccattccgacgcgtaacggtcctcggccgcgcatgcgcacacttcatactaatcagctcaccctccgatgtctaggggttcatgatntcgtactctcatgcggctaccatctagcacgtttcattctaatacggtcttcgcctctcactctcaactcatcatcagcgtcggagttatacagtagcgtgcacacctcactgatcgctgcgccagctcgcggtcgagcgaatacaattaggcggactggacgggtaaagctacgtcgcaccctccgctgttcctccgaccgagccataagctcgcctgacgcattctccgtcctgtccgcatgtatacccacgagagtaccggtccgcngtctcacggcggaatcaggaagtacagtggcgcggggc

SEQ ID NO: 14714 - DNA, 200 bp, Homo sapiens
aatcttgtggataagagacctggagcagaaacaggcccagcatccagccagcactgtcaccagacttgcaaatgaagccaccataaaggataaagccagcatcctgcctgactggtcgggccagcagaacaacccctgccaaaaacgcccagccctgattgctgaccatggagtaaacaaataaatggtgatccggccag

SEQ ID NO: 14715 - DNA, 800 bp, Homo sapiens
  misc_feature (1)...(800): n = A,T,C or G
cttaaggtagcaaggttacaagacaggtttaaggagaccaatanaaactgggcttgtcaagacagaggagactcttgcgtttctgatggacgcctgttangccactacacccagacaaataaggcttttaagtaactgaagacttcaaaaaataaaacaccataacctggaataggtgttaattatctgtataaaaacaagaaatggtggtcttacacttttagacaaacttatgaataaaaattttaagaataaagcttcaatattttgtattaaagtcgcaaaggttaatcttgttatcggttcaaggtatatatgagataaaaatgatcgtactgattaataaaaatttgtgtattttatcgtcaaaaaactcttatatatgaagcacgcatcagattgatagttttatttggtatcactgtaatagcagacgatattattatagtaaagtgtgatatgggtgtgtaaagagtgggggtgtgcggtgggaaagtggttcctggaaatacgtccacagttaatttatcggggttataacaatggggggggcggtggaagttttgattatttgtgttgtgtgtgggaaaaagaaacgtgtcgggtgtagaaaacagagtgtgttgtttgttgttttttgtaatttctttttatcgttttgtttcgctgtttgggggtataaaataaacggtggcgaaaagaacaaattggtcattaggtctgatatatctatggtggtttggtaataatggaagatgttatattttacgtgttttttttaatgtacgttttgggaaaag

SEQ ID NO: 14716 - DNA, 319 bp, Homo sapiens
  misc_feature (1)...(319): n = A,T,C or G
gtgataggcncntattggccatttgggccngggccaantcanccttttaagtaactgggactaccaagtgtgtgtcaccaggcctggctaaatgtttttttcttttngtggtagaaatggtgtctcaccatattgcccaggcttgtctcaaactcttggcctaaagcaaccctcctgcctcagtctcccaaaggtgaaccaccacaccaggcccaaaatacacttttaagaggtaaacgttctgtgagatagagttgtcaccgaagttactaactcattctatgattatccacccacgacccagtaatctagatgcgcc

SEQ ID NO: 14717 - DNA, 1309 bp, Homo sapiens
  misc_feature (1)...(1309): n = A,T,C or G
aaaaacaagaaagaaaaaggcaggaaggagcggcgccggacccacacaccgccaacccacacaacagagaaagacgcttaaaaagaaaacacaaaaagaaaagggttttgggagggcgaggaaccaaacacagcagcacaacaccccacgaccaccccaccaacagtttcaacggagaggaaaggnggacggccagagaacgcagaaaggcacgacccgcacccgcggcgcgccacacacaggcaccaacccgccgcagagcgcacacacacacagccacacgcacaagacacacgccacgaagagaaggcaggcaagagaagaagagagccaccgccccccacacacaccgcccacacgcccagccgcgccccaccaggccaccccccgagacgccagacaccgaccaccccacacgcgccacggcgagcaccaaaagcacaagcaggcacagaagcagaaagacacacggcacgagggcgggaagacgggaagagaagccgagcaacgaagcgtagacgaggagcgccaacgggcaggccacgcccagcgcacaaggaaccagggacccagcgagagacgacccagggcgagaggcccgcaaccacgcaaccgccgcacacgcacccggcgaagccacccgacgacatgagcagcagcgccgacccacgggagccacgccggcccgagcgccgcgacgaccggacgcgaacaaagacgaggagacgcgcagcaccacacaccacgcccccacaccacgacacacagccaacgagaacngaaccggcaaccactgagcacccgcacgcggaggcgcgacacaccgcagaagcacgcaccaacgcagcagcaccgacgcagctcacacacacgagaccagcagcctcgtcgaccncgcacacacagacgcnaaagncatacaccacacgcaccacacacgccaccaccaccgcgacacacacacaccatcacccgcgcatcgcaacaccgacacacgcgcgcgccccgacacccacagacacagcagaccacacacgacggncgcacagccgcgcacgtcgcgcgcggcacgccgcgcgacagacaagcactctnacaatcagatacgagagacaccacgcgacaccacgcaacagcnacgcacgcgtacacccacagcaacacacgcacaccagacgcgcaacagcgncacgagcgacgaccgcgacacgtcacgcagacgcagaccgcacacacacgagcgagacacacaagagacatcacagacacgacacacactgcgcgagctcagacagcagcagaagagcag

SEQ ID NO: 14718 - DNA, 890 bp, Homo sapiens
  misc_feature (1)...(890): n = A,T,C or G
aggctntnngnaaaaaggggtttttnaaagcccttntcaggtaanngggggttacnctccnngggnccccnncccaaatttgnncaacggnatttttttgaagcntcncaangggaaanttgganagnnggatntnaaaacnttaccggggaatnnttctgnnccccngggnccatttaaaaaccnatgaggttnatggtccccccntccaaggggntctttttaccctatgnaagggggtccatnacctcnaggcaggatngtcataaccttcanngcatgatggtcnccttgggaaattactagatttttttaggttttttcgatttcctccaaatttgacatatttaaatatatggatcaaaaattcacacttacaccatcaccactgatatcataagagaaatatgtagntactaggaagcttcaagatcncaatagtggttccatgttttccaaaattctgtcacttgaaagctcaaatttatcgggcaacaaatagatctgttgttttccttgaagtgacaggatcagtttattctgtttaagaaaatgtctactaaatacccatgtctgaataacctaagatttcttgttagctattttttcaattgaaaattattttccatgaaaaagtaacaaaatcaactcacaactgtatcacacaagtgctgttccttaaaataatcatcatactttgacttccagaagctaagtatgcatatttcccagctatcacaaggaatgttcnaaagannngtactgaagggtcgatattgtaagttaatttattaaagtgctgtttcttaaatgaagtcaacacttgattcccttttaatgttntaatggatannaataancnatgatacgggccgcaaaaatnnaaaaaa

SEQ ID NO: 14719 - DNA, 697 bp, Homo sapiens
  misc_feature (1)...(697): n = A,T,C or G
gnnnntttaagncctttnaantttcggatccttatcatatctgggatcccnaaatatttatttgggggaaggctgtcaanaaggatggcattgaaactgctgggaaatgtaaatttggagcagatctggaatctgctgcaagtgtgaacaccctcanatgtttttgactggtgtttgganaantgaccagtttctcaccagccaactgaanaacagatttaataaaatctggattctccatatcttcactaagaacatctttttgtagagtaaaggagaatataaagatgatttttaacaatcanctagttccttactaatgtttttacagaaaactgnactgaacctccttttaccttttgggagccttgcaattcagttcantanatcttacagataggttactgacaaacagaaaaagtcaccttcctttaggcaaggtttntcaacctcaagacnattgacaagnngggctggataattctttcttgctagaagctgacttgtgnagccntagggagcttaccatctntgccttntatcccttatatgccaggnacnttccctttccctgtctgatcaaaaanaatggcttccaacctttccaaattcttgggaattnntcantcctgggnggangncccngggttncanattnccctgntgnattttgnaaaattttntcntncttgttanc

SEQ ID NO: 14720 - DNA, 823 bp, Homo sapiens
  misc_feature (1)...(823): n = A,T,C or G
ttcaaaagttatgcaacaaaaanncccttccttagcaagttttacctcaancaatgccatttggggngaaattttttttgtaaaagtacttgtgaggtaggagttagatttntgccttttatccataangccagtacatccctttccctgtttgtcacaaaaaagtcttcagacattcccaaatgttgggacatagtcatccctggggaagtccactgtttcagtatgtcatgctggaattttgtagattttatctacatgttagtcttaatagataatgtggtattaaaaaatgcagtgagtcctgtgcattgtgaccaattaaaactctagaacagtagttttcagtctcgaactcagcctccaagactctgacataaatgatgtgggtgtcacctaggtagattttgttgttattattgttattgtgggttgttggcttgtttggttttagactccaaagtgattacaatattccaccagggacaagagacactgcattagagaaaagttagtatcctactttgagtccatgtaagtttgtggacatgtgactgtcaccgaagtactgagccagggcaaacttggacaaagttccagtctcctcatgccagcaatagtcactccctgccagacttaggcatcatctggccaatgtctccaacagggaaggttacaattagtaagacagaattatctgcagattcagagatcaatcctagatctggggcaaatatggaaaaggatctttataattagcctgacaaaagacattaaggaagaattgaaatgcataacaaataaatgacgccaangccgtcca

SEQ ID NO: 14721 - DNA, 330 bp, Homo sapiens
  misc_feature (1)...(330): n = A,T,C or G
ttagnnctttggngnttnggatccnnaggccaaactcncncagtntgatagncgaatctnatggaacacccacatgancngattngncatgagaggnatactntacnatanaagctngcntnnctnccntancgctncntgcccaacncttttngttgttaacatancngganagangtgaatnaaggncgtaaccnattaatcactgtcagcttggggccaatatcaactttgatgtnncccacngctnncngctttnttatanttctntgcaaaaagaagccatngtgggcacatgtggctaatactatnataagactaacagatana

SEQ ID NO: 14722 - DNA, 182 bp, Homo sapiens
  misc_feature (1)...(182): n = A,T,C or G
cgagcnnttcanatgnccacagntngagcntcagttagnntatgatgancnaggtattnttcnnggnccgncattcnctgccggcannaancgggnttncgnactnatcagactntcnncgttgtgccgngtgtcaagtatgtttagccagcagatcaggnnatggngntcccaaagngtcc

SEQ ID NO: 14723 - DNA, 1395 bp, Homo sapiens
  misc_feature (1)...(1395): n = A,T,C or G
cagcacacaggcgcagcggcaagagaggaggcacagggcggcggantacacccccaaccacccagagacccgccagcagggagaaaagttagaaaaaaagaaaagaagaaacaaagaaaccgttacgaaaggcaggaggaaggagaaaggaggagacgcaacagacaaagacaaacagnccgaccccgagggttttcgggccgggccggacgggaggaagccgagggagcnagngacaccaaatcagaacggacgaccaganagagcacacagacaatccgcgattaggacgcacgacaccgaacaccagcgagataaagaacacaacaacacacataataatacacgacgaaagacaacaagcaagaacgcgcacacggaagcaaacatagaaagagcagataaagtagagctcagacacaaagcagcgctcgaaaaacgacgatccacctgccagggagagcagagtatataatacaaagagcanagcagagaagaagcctaaaagaagaacagtacgcgcgcacggacgacgcgagcagtgacaggagcaacatagagccagtgaaatagaaactcaatagccgcacgagctcagagagagagcgagagnatagtagagagtagagagagnaaggaggagagaatagagagaganagagagagaaaagcaagacggcagcgcgcagagcgaagaccaccaaacgcacagacgctctacccgacacgacagagcgcagaacacncgacaacaagatacaatacgaggcaagagcggacgactcacgcagacaagcgacccatatcagacagcgaaagagataggcagatgacacactattagaacggcatcgaccgcncacagacgcagcaagcaaacacagcactcgcagcccgaagagagcgaccacgaatggcaagaacgaagcagtatacgcagagacgcacaacgacgcagagtacacgcgaccacgtgcacataacacacaccgaggccaagagcacgacaacgagtcggacgaagctacgcatgagcagacgcaacgtgacccgagacagcacgcgagaacaagagagacggcgagatacncatcgcgcgaacacgcgccccngagncagcatcgagaataagagaagaggactacgaggcncgacagcgcgcacagnagcgcggacacacgaacccacgaccacagnaacatacaagaatgagatcaacaagataggagagagagagaacacaagaagcgagcgcagtatacaaaagaatcaagaagaaacaggaagaacgcacaccacaggagaccaagcgacccagngagcacagaacgaggagtcaaaacgcngagagaacagagaagacaacacagcagtcgagaacagcaaacagagaat

SEQ ID NO: 14724 - DNA, 1320 bp, Homo sapiens
  misc_feature (1)...(1320): n = A,T,C or G
cgcaaacgtcgatagcacgcgtgcgacgtcaaaatgtcttacagggattcagtatnttgtgggatgcacgcgcggcgcggtaggcagtgtgtgtcggcgacgcgctgcgctcgtctgcgggtcgcgagtcctgtgccattgatcttgttattgtctcgacgtcgtagcgaggctcatacgacgccgctccggcggagacacgcgcgactactgcggccgcgcgcttttgctggtcttagcggccactgtgaactcctcgttgtccgcagtgctacctccgcgcagaggcgatctacgctagcgcggggccgcggcgcgtcataatgggtgaggcgtatagtattacactccacccgcatgccctacagatggggacgtattggtgtacgcgctacgtgggggatatcatatcggagtgggggctaccctgcacttgtcgtatgccctcaccctgagcggggggatcagtcttggggcgatcgtgatacgtcgcagcgaattcgttttctttcgcgagcacctgcggggacggctggcgcagtagaggcaattgggcggcgtatcggggcgcgatggggctgagacgacatgcggccgctgttctttacaggggcgacgtgcgagttcaaactgcgcctcgtaacctccaacgctggggcgtctcaacttaggctggccggacacgaatccgcgggcgtgtcgggggacatcgcggcgttcgtggtggcggtacatccggagttacgtgcgggactagactccatactctcggctctccgcccggctnctgagtggancgntccagtctggcacactcggacggcgacgcgagtggtggtgacgcctagtcacgaaatagtggcatccgtcgccccttctcctgcgcgcacagtcggtccgtagcgcttgcggctgcctaacctcacgatcgtattgcggcggcggccgtacctcgctctgcgtcggtacgcgggcgcgtcgcgtncccacgcgtcacctcggtgtggtgcgcgatcaagctttcgctagctgctcgaccggccgtagagcgttgcagcgatagtgcgcggatggtgttgaattggagtcggcgggggcgggcgcaatcggcgggatggcgtcgcgtctcaacgaagctgtctcgcgtccgctggcgccgcggcgctcggcggcgctcagacgtgccgtggcgtcacacatantcggcgttgngggatngtgtatttacctaatacaactcgcgcagtgctccgtgagggctgagtgtggtggtactactgcgccgcactaataacgtgtatagacgggtgtggacgcggg

SEQ ID NO: 14725 - DNA, 163 bp, Homo sapiens
taaggcccaaccacccttaaaaactcccccccccgcactaccgcgggcgttgtatctataagattctccccatgaaccattcaaaggcagatgcctgattcgcacgggcatagcccctgtcccttcggataaatttcccctgtgaaacggggccaacaggtgc

SEQ ID NO: 14726 - DNA, 1019 bp, Homo sapiens
  misc_feature (1)...(1019): n = A,T,C or G
catccccttcaaaagactcgcttgaactncccacccccccacaaaagtctgctanattaaaaagagaggaggcttgaagaaaggcggggggacgagacccccaaaaaaacaaaaacgtttaacaggagggcggctaaaaggaggagccgccaccagcacggcaatcgcgggaagacaacgggccaaaggggcntcttccaaaccctccaaaggggtgttgcaaggggggggggcccccgcccaaatatataaaaaagataatcccacaccaccaaggggggggagggggaggggaggccacccacatctctacaaggggntctcggcggagcagcacgcaaagcacaaaaacaaacccggcaacagacagaacagagaccaaccggccccgggaccaacagaacacagagcnaacagagaagcagcaccacacccggcccacaagcgataccgggccaaagagagccaaccacaaaggcaagaacagaaagggcccgcggcccagggagggggggcgcgaggagcgcagcacgcgggacgccggagagcgaccgcggacaacacgaagagcaaggaggaaacacgggaggaggagaacgaggcagggaggcgcagcggcgggcggccgcgagacgggcacggcacgaggcgcgccaccagcgnacacaggacggggagagctgcggccggggagaaagagcgaggggggcgagaagggagacaaacaaggaaaagaaaacgcaagacacgcagcaggccaacaccggagaccagagaggccaggacgaccaacgnaaccacgaagggacaacacgagaagaaaagctgtcaagagacagaagagagaaagaagaagaagacgaacggaccggagggagcggcgacagaaagcaccgcaacagcaaagaggaagaggggagggagacccaaaggcaacacagagggaggaaaggagggaagaaaacaaaggaacgagagaccgcggcccgaggaacgancagagagaggaaaggaggaaa

SEQ ID NO: 14727 - DNA, 1316 bp, Homo sapiens
  misc_feature (1)...(1316): n = A,T,C or G
gatagagtagcggatcgngnggantccagttgttcattgaganagggggaggaagaggattcctttatagtnggactnggcgngggngggaccctcgngggagngnggngatcangnagngagngagaagagggaaggagaaggagatagcagnagatgtagttctatacgaganggagagatgaggagtcccgancgcgtcaaagatagacagcgatgcggccacacacacaacaacatagacttgtcgcgtcccgacaactgacgacatgaacgngcgacagcgaacttgtgcgtaaggacatcgactagtcggtcgagcggtccgcgatgcgctctgaggcgcatactagtgattaacagtcagtcattgacgcgacgagaggtgccgcatgataggcacgaacatatgtagaagacacacgagaagcctgttttcttttatgagagcgaggagagactagcaggacgatagagcagatcgacggcactaccgccacgggtgacaggtctgtggtgggcggataggaccacggactagtaaattgtgttgtacacagatccctacatgtagtgcgactgatatattatagtcgcgtgagagcggagtgaagcagcgcagctgcggcacagtgctgaagtgacgttatgagatagcgggacgcgcgnacaaacacgaaattaaaagaggtcgcggcagatacgtatctgatataagtattgctgcaatagtcaagtattgatcgaatgtgcgtgatagataagaacgcatagtatagaagcaggctaataagccaggagatagagatagacganggttaacgcgctagcgnagagagcgaagcgcggagcggccatctaggagatctgtagaaatataaggaagtgcggcgtatgtgatgcaatgaagcnaaggcctgaggagaggagtggcagtagtgaagagtgagatttacagtcgaggtacgcgcacgggtgatggagaatggtccagtccggcaagagacgaagcgacgaagatactgtcgaaggagaggaataatagagtcagcatcgaggtcagagacgagtatctcaganagattgagtagaagagatgacagtgtgatagagaggtataatgtagtgtatagagntacagactcgcagaccgacaatatagatcgcaaaagacgcacaagaaggttgcagcatcgaatagaccgacacgcggacgagnagcaactagctacgcctacattacgttcacgatggccagatcagagagagagacgtccgtgtagattcattcaatagccgcgaacatgcgcgtccgg

SEQ ID NO: 14728 - DNA, 1753 bp, Homo sapiens
  misc_feature (1)...(1753): n = A,T,C or G
tgcgaagaggcggccattactgcctccattactgtnggtcaccactcgactgccnacggaccaagtctatgcgtgggaacgaacctccactagacgaagcggagtttttaagaataggcacgatttccagaacgacaggctcgtacctgagctgagcncagacacgccgatacttcggccgctttatagagtcagagagtagctccgtcacgtgtgtagcgcggtcgtttccaataggttagtgcaattcagtacgcgtgcagctcgccacacatacacgacatacctcacagacatggagcagtncnataggcagagtctccatggctgataatcacatcacaccgcanagatcagacagcgaatcgtgatgagagatgcacgctctcgcggcgtgccgttagcatcgcaaggcgtatacgtcgatatcgtgtcgtagctaggatgtgctgacccacccgtgtcgacggacacatgcatgncntctataagtccctganagctatcaacacgctatagatgagcaatnctcgaacagccacactcgacaacgaccaccgtacatgcctcctctcnctccgcaatgcgcgcctcagcactcagtgcacacagagtgagcatgacagacatnagcntacaagcacgtaangatatgncanatatgagcgcgtganacatgcgaagtgaatatctgctagagcgatntcgctcngagacgagtgagncatccntacatgcgcatgcgaantcgcacgtctatcagcgcgcataatctcagctgcctacattgtgatagacgcagncgcgcgatcggatgagaccgtcgcgtctgcatataagacttctcgtcattagagtatgcgactcaccataatatgtnatagacgtgggatntgacaatacacgtagtataatgtgtatacactgtcatgtctnaacgtatgctcacacggtctgttaggcgtatcacgcttaccacccnactctcanctatcatctgctctaccatgctgtgctcgcatagccactcgctctcgtagagtcacgtgntatacacatgatagccgcacgtatctagtatgttctcacgcacacatcggagacggcttccncgagagcagtcgactcgacgagtatctgatataccgcagcgctgagtactcgtatgcactctanttcanctgacgctagtattnangtgctgtaagtaatagagtacctcgagtcncgtagttggactctcaggcgcnccgaggtgccgacgtacacacgacagagagtaganatnctntcgtctagattaaaatgtgagtcntcgataagctacatantcgtatgatggctgcgacaccactggcgtggtacgagatctntnttacttctttccgagtgaactcatacgagtatatcatacatgatcgcnactcatatgtcttatgcgcgcnacatcncatncgtacgtctcnctagagcgccgttcggctatactctatcacaccnctgcatactcgntctgagccatcgacttgctacagcaggcctccagcggtttgagtcgatcgtcctgacganagtctacgttacgtataccacttanacgtgagcgtcgatcgagtccnaatgnaanaagtaacacacagagacgtcgancatgactagtgtagctctntntcgngcgatantctctcggtgtcatgtagtacgtcgcatctcactcatatacgcgcggagatgcgtacgacatatgacaant

SEQ ID NO: 14729 - DNA, 1750 bp, Homo sapiens
  misc_feature (1)...(1750): n = A,T,C or G
ccgagatatacatacgtgagagagcgagggagtcaagctcatatcgagaaagcaggagagacgtttcgctctatgattgggcaggtcgtgatcacgccggtcaatgatacttgtcttcgcgttcggtcgaatgagaggtacagtcacgtgccgatgcagataatagcgtgatcgcgactcaagagagcgcgaaatgtgcatacgcatatcgagtaaacgtaggttctagggcgagcgtgcgcncgtaagcggatggcgtgtgcactacggatcgaagaagattgaggcgaacgaataagatatggagagtatgagtagcgcattgtcatatatctgacgtcatgcaacgccgcatctgagacgtcgtagtcacgtatgattgttatacggacagcgcgagtagatgtgacgccggcaggagcgtactactactaacacgagtcgtgctacgattctcacgcgtctgncatgtatgtattacgagngtatgatagtcgcagacgcgcagagtagatgagtatgtctgatgtacgtgtgcgcggaccngcatgtggatagtggtatgtgntattgtgcactcatgcgactatatgntgatctgatgcgtagagagacagagtgtagncagacgcggcaggcgtcgctatagtgatgtgtgtagcagcgtgacgtcgcgatgtatatcgantacgagtgncgccaccgcgcgtactcgagtagcgttgactcatctctatctagagtggtctacgtcgcacgatggacgcantagccgcatcaagagcgtatgtatcacagacatacgantatcagtgtacgagtccgagtcgttctcgaatcgtcacgatccctcgctcgcgtctatggcatcnttgatgcgtcgtctgatatggcgctacttgatgtcacgatgtggctgatatacacgatcgaccgacgtatgatataggtatggcagtgtactcagatgtgtagtcagtcgcgccgcgtcggactaggatttcgatctcgtatgcggtggncggaccacgtgtagaatgataggctgnanatctcaatgacgcagaggagcgcggtgtggagttatatagtcgcgntgcggcgatctctcagacgtcgtggtgctactctntntgtgcgcgcgtgcacgctcgagtctatatntgagattcagcgtacaccatcanggagcggcacgatatgagaggatgtgtgcgaagatgttgtcgagtctgcatcgagtcgtacagtcgcgctgatcacgcgatcatttgtcgatccgcatcgatagctanatgcgtcggacgctgcattgatagatacacnacatgaacgtagncgagcacgagaacgacgatgagacagcgcgagactgngncgtcgnancgtcgnagtcgtgcctcgcggtgtgncagtcgtgtgtgtgcgtcgctanagcatanangactatgtgcgnagcgttcgacgcacagtcantatcgagcagacgtgcgtgagatgacgtcggtgagagtgagctggcgcgatgcgatggctctgcatgangctgatagcgagcgtggnactngcaggttatatgtaatgatnctgagcangaaggcgcgcgcgacactaagtccgcacactcganancaattatgtgntggtctaactacatcttcatgacattattantcgtagagtcggcgtgatgttcatgtngtcatatctgagacaccgcgcatgtcgacatgtatgagagacgagatgg

SEQ ID NO: 14730 - DNA, 1737 bp, Homo sapiens
  misc_feature (1)...(1737): n = A,T,C or G
agcancatcgcgacgccaangacgcgcgcgtgcgcgactgatcanagtgactatantagtgcgccacgcgtagatatgttncgagcngcgactctactcgcgtgcgcgtgagtgantgtgctcagcatntcaatgtctcgccacactgatctcacgcagccgtcgcgcgagtancgctcgtcccacgctcacgtgacatgtgaccatcantgtcacacgacacacgactacatgatagcacgcatttatncctgctgctaccgngncgcgcntctngtacctactngacacacntcgcggcgtgncgcgcgacagataatnatgtactcacancacatcgcggtgcacgtgtcacactacactatatgtaatacactantcatgacgtcgagtgtctgcgcnacgcgacgcacancgcaccantctcgcacacgtntcacctatgtgctgttgcatcggtacccggcgcgantnacagagcgcgcgcagcgccgggatatntgagctgtgatgtgaccacgcnancgtaccatanatgtatgcgatagatagtcgcgctagctgtctgtagtgtagcnacgagcacttactacgcatcgcgcgcacatcgactatctnacgtctggttcgcgcgactacgacgcatgctaagattacgatganctgttcnctatgtcgacgnttctcgatcngggttactancatnccgcgcgccgtcaggattctgnactctagcgctcgncacantcaagtcanctgtcatcatagtctatcatatgagccctgcgcggcgcgacaacggcggacgactccactcggatattgtatatgtacgcgacatcaagtangcgcgtncggctcacttgtgctccaccgncacacattcgagctncgcgtgataacagatcancgagtgtgcacgtcgtncgctgtgcgcggacgtcgtcaccacgactataagtctggacctcgtcgacgcgtgctngactatacgtctcattgccgtacagcgctacgctcatagtcgtgtacgcgtagcgtgcggtgnacttcacgacgcacacgaagntggttgcaatcatctacgttgcgcatctcacgcgtcgctagcggtattgtatgatatatctggctcgtcgtcgtcgcacgcagctacatgacggtatgtcggctcagcgtcgatcgatgactctcgatgtcctcatatgtctatgcattagccgtcgacgtacatacatgagagatcagctctcacgcgtctatacgctcgtatatacgtgtatacgaacactgccttcgcgcctgcacctcctacctgttaagttctatggcgtcgtcccgccgcccagtgtcanaccttgtcctacatctcgantttgcagcgcgaacgcaaccctgataattccagcatagcgcctgcgcaatacacgataatgctctgctccaatcgtacggaaatcgttggatcgcgaatccgctaggcacgttagtcgatctcngcgcctgtgatgtggcgagcgactcgggacaatgacatcgcataatcttgatacgtatctcgctcgccatggtagcgcgaatctgctgcgcggtctgcgtggtcgacttaccgtatacgcggcgcgccgcatgtgatcatgtcgcatatcacggcactactgactgtgcggctgtacggctgggctgtcgtgccttgcagcagtacactggacgangaagagagcagtggagtggcgc

SEQ ID NO: 14731 - DNA, 563 bp, Homo sapiens
attccaagcatcacgctgcaatcgtcatgtataccactctctaccctgccccactccccccagacttcgaccccactcatgcaagttggcgcactctgtcgcgcgcctgaatgatcgtgacgcatcagcccgttagctgcacccccaccacttacccacaccgctcccacacccaaactctttcttgttcattccatacaaaacaactccaccctcacccgcggcgccgccccgaaacagctattcattgttcgcaattattcatattaaactcaccacccactaatcccccgcccgcacccctaatgtctatccacctcgtggctgtggtccctgcgatctcccggccgcagcacacacaaactttacatacgcgggctcccgctcagaagttagcagcgcgactgacgatcatttaattgccagccctccccgtaagactattttatgacgaatcccagacataccaccaatcttttataaattggttaactgccgctccatcgccgctcttgcctcggggccgagcattgttcaaccggcgcaccatatgaatactgttc

SEQ ID NO: 14732 - DNA, 1943 bp, Homo sapiens
  misc_feature (1)...(1943): n = A,T,C or G
agcggaggagaagcggnagagaganncngnngagngnntngtatgangttaagagcncaacngcgcgntggangcgngacaccagacgcgcgaccagtancgaagcagncgaccgcagacgatagganagnacangcgcagacacaggcaaagagacncncttacnaaganacagcagnagnagaaaananagacaaaanagnaacacaacaangcgngngcttcngtcncagnagagtacagcgcacnacgacagcantgccgcagancnctcactanctgcatctncagactacacgtnactgactctcccagtctctatcntctctcgagctcancatactcgcttttacgcagtccgncnctgcgtgtcgacgctcgtgtgtagcgactacacacgcagacgacngatgntgtgtgnttgatgagtctatgcgtcagtgtatacgtatgtcgacagnatagtagnanagaagacgcactacagatatgagacggcatactcgtgatgccatcgcagcagtgcgatactaggantcntatgatnatngtatctntgaacaatctactagtngacacacnatatanatgaactntatagttngaatgtggntgcgagtatgtatganatctcagacggtgatgcattagagacggacgtacctgagcagtgtcancagacagtcactntcgtctgcgcactgcgacgcgtcagagtctaggnaanctctcctatactatanacagcgactcacgctatacgtgcgacagtgntctcgtctcgtcagtcctactaacgatccgngtcttctgcagatgtcgangaataagatccnatgcntgagnacaaancnatcaagcagatatagagatgtagntaganagatnataganagcgctgcgatgtatatgtagagtaatagagagtactantggagtataatatgtctagtagtcgtatagagtatcgntagtgctagatacacgnacgcggagagaatctcgcantgcagagcgtgaagctagcagagagaganatggagacatgcgactgtacatgngatgtgttgctgatgtgagttacgtctatatactagtaggactgacggtgagcgtctgagcgtgcngcaagagcgaacagtctncgcgcacaccncgacgagcgcngcgncgcagcgagcagcgcgtcgcagatagcggtgtcagacacgntcgcatcgtcgccagtntccgcactcgggctcgactgtcgagngtcgctctcatgcgtcatactcttatctgagacgcgtcgtatgtgtatacnctgagacgtgcaccgcgcngatagtaggcagacagaggcaagtgagcgagatcgcgcgacgcgtgaagcgtgcgcgcgcnctacacgactcctcactacgtccactcacgtcagnctatagtacgacgagagacgtcagcgttagatcntangcgtgcgtagtggcaactagcggagctaatctgcaaggtccgtgtgtcacacctgccgactacactcagaggacgacgtcnangtagtatatacatatgcgcgtatgacgagtacaatactgtcatacgatctgcagcgcgtagtgcgtagacgatattatacgcgtcctcagacagctcacgcgtctgagctactatgtctagagatggcatccgtacacgctctcatcacacagngncacgcacgacagccncgtaagagatgtgggcagtatagagctgagatcgacagtagtgctacactgctccgactacgcccgacgtcggcatgctgatctagcgtcctataagcacgactcgatgagtgagctatagcttatcggagtatcgtgacaggcgcgcaggacataacggacgcagtgtgatgaggtagggtgtaagatgataacagagcctgacaaccagacancgtctcatacgaagcg

SEQ ID NO: 14733 - DNA, 775 bp, Homo sapiens
  misc_feature (1)...(775): n = A,T,C or G
aagggcctcggaaaatgtttntttcnnnaaatttnttaggttatttccaaanaaaaggnccccnggaaacncacnccctgccttaatncctgaagaaaaaaagctgtgacattactggaagaaaataaagaactggaatctgttttgtgctatacagtatcaaatatcctgcattctcggagtcattctaggaagaaacaaccaggaccaacttgctattaaaactggtgaagaaccacgtgagatttcagccacccctgctttcccagtaatcaaacaatagaaaaggacattatcatcattgcaaataataaacatttacacaagaaacattatacagagaacacagaattgaacatgttctgaaggcatttaagtcacaatttaaagctgggtagagagaaaacgctcaaaaacatgccttcaactttccctgtggggaaacaagcctgctgcttgttaactttctccaggcaaagttaatggcttcctcttccatattctcataatgctctgtctacattgtgtttcttctcactgtgttttgtgtatatccagtggcctctcagcaatccctctggactgagacctcgagatcaggaactcaaattttgtatatcctcagtatttagcataacaattgccacatagtaggtgtgttactgttgtttgttttatgaataaatggatgctgaacaacatctcctttttatccctacaataaaaccatggcctcgttggcctcagcggggagcttgcgggcgtcancgggnag

SEQ ID NO: 14734 - DNA, 761 bp, Homo sapiens
  misc_feature (1)...(761): n = A,T,C or G
ccggtccccaaggttggnnagcccccngttaaacccccccagaggnggggaggngccctccagttccanagccnangaggagcttgatggaagggcagccccagntttgcagcactgctgtcagagccaataataagcaaatagggccaataaagaggggaactccctgagtcattcctctgcctgaagccctgctttgatgtgtttaagagtccagtagaaccgaaagttcataaagtggtgtatacttgtatagcttttgaaggaactcaagaaacgtcacccagaaatatcccacattggtctgctgattacttcaaactgagggaactttgggaacagcaaatgcagggagagactttctctgaacttacatcatttgcctaaagatggatcctacaaaaggaatgaaatgaaagaagagggaaagtctttcttcccaaacactttcaacctccaaatcaagaaactccctaaatccagttgactattaaatgacaccagttcatactgtgcatgattacttatacgaagattttcttctgctatgctgctcctgaatcaccaagaccaactcctcctcttcagcctactcagtatgaagacaacaaggatgaagacttttaatgatgatctacttccactttatgaataggaaatatatgtcctttcatatggttttcttaataacattttttatctattttattgtaagaataaacaaatggcctcgttggcctcagcggggagtctgcggccgt

SEQ ID NO: 14735 - DNA, 211 bp, Homo sapiens
  misc_feature (1)...(211): n = A,T,C or G
gngggnnnggggncnnccnncccgnnncgtttnnccacggatnngngggntctcgnnggcaanangnanaagncggnaaantngggtnttttntncggtnttaaangccggnannccnntnncggtnggtntaggncnttgngcncngnntnaangcccnnaatgttcttnngagccntgggaantcnncgggggannccagngatttttt

SEQ ID NO: 14736 - DNA, 940 bp, Homo sapiens
  misc_feature (1)...(940): n = A,T,C or G
tnnnnnnnnnnannnttnanacnnnnnnngnnannnanannntnnntttnnngttnnncnnnnccgnncccntncccnnnaannnnccgnntnnaacttannnnnanacntttttcgnnnntttanggtncttnagnnaatttnacaaanaaccntnanannngntctannagccgtnatncttacattaaantttccnatntcnnatnnatngggtcncgnnntacaanntngtccnantttnnnacccttnttagaaccntatanaaaanttccccagtgttcaaccntcgngnatanaagtntccgnaaantgaaccncccgannnntgtcntntaangatangcgttacagtcagtantaccctttgtcgtccngtccncnttcactgtncancctacacccaangttntccattacacacccggtttatgccgacattgtgtgggtnaattacacngttcatanaaantgnatcgtctcngtggccgtcnaagnaattgtaagnaaaaccccgggtaaaactaaagaanccgtccacacaanncccattggggggcggggcnnttannngannattatcaaangngaaaccangggtggtggggggnacacggtgggnacncnaacgtcgncaacnattncaanggtggggnggantcnggggnancantccacgtntatcncnnnacncgctctccggtaaacnaaaaaaaacagtggtcngtnggggcnancnnaaacacangtnggtatcnccgggtcncggaaggtcgnccccgtcgtcggnacacccgggttcaaacggggtantagttttcnccantcggtaancgtcngaccggtcagcagcggantcgggcggggcgggtagcngcgcncgagcggngcggncgtnnttcnncatanttcacccngnattcttnncnnaactntccg

SEQ ID NO: 14737 - DNA, 1892 bp, Homo sapiens
  misc_feature (1)...(1892): n = A,T,C or G
cgtgacgagtcttcgtctgcagtcgagcgaatgacgatcanactcttgggtgcttcatacgactgacggtgactacctcacacatatcgtctctacgccaggagatcatctgtctctcgtcatgatgtnagcgctctaatatanaggagactcatgagtctgtntatgctctnacagtacgtnctnctagtctcganttatgcatgtcgtgcagcgcatatgtcagtacgtgtgctgngatgaaggcatatgagctcagactagagctcgacgacgtcgcgcatgaagacattgctnggtgtatgnacggtgtnctcatantatacgcctatatagagcgcgctgacatgacagtcagcctgtactacgtacgtactgagcactagacactaggactctgcgtcatagtctacgatgcgagngcgagagaggatgcagacgatgctanaatatatactgncgtgatgactaccatgcgactcgcatctgccgctagatagctagacntcacgacgtcagtgctgcttcgctcagaangtnggtgttgtctcgataagatnatacgcatgtctagtcagtcgcgagtcactagagtancgtttagtagtgtcgacatcatancttctcgacaaatgacgagagatactgtctactgctcgtatgtatacgactggtacactgtgctgagggacgccagctcatctatattgaatgatcagcgtgtctacaccaaccgagtgctacgctactaccgagcactcgtcgtatcgtagcagtcaggctcatctagtactncactgcacgagncgtnatgtacgtctagacggcgacgcacgcttgaatacgagtatagctaaacatatctctgtcttactacgtcggcgactncgacgagtnacgagagtctnntcattacacacctaatacgcatacatcgtactatacagatcaanactactcctgacgcntcctcgtcgctntcactagacaacgtcngtgtctgatgttcatcgccgtnatgtgtcgtgtaccatcgtagtngtgagatcaggcatcctatgangaatgcacgantattagatttgcacatctgacagacgactgattaatanananctcatcactagtctganctacttcgatactcatcgagtgtcatgcgcgagtgatcacagcagcgngtcacttngnacgtactgangccgccattatgnangcgtacaccgtgaatatctgcatgcagtcgcagntanagtcgcgtgtgactgtcgagctgtcatncgcgagcgcagcatagacgacacagactacactagataagtcaatgcgagcagactgatgttaaatatgtatacggtgtgagtgtcgtacacatgctgaatgtgngatcagagtggcatactatggacgtgacgacatgcactataactccgtaagacgcatcgagtgttcattgcagtgcgtgagtaccagctcgtgtattgactagttagtctgaatatgtgggaaaatcctgcgcgcgttacttgtatgatcgagagacgctgngcatcgtcgcgcggcgtcactagctgcgtacacattgtaacaggcgcgcattgacagtgcctcgatgacgctattacgtgtggcgttgacttcattggcaatggggatgtctactagcggacatagagaactctctcgcgcatcggactgctcgagagtggatacactacagcgagtacgtcgtctcaatattcgcggccgatctaagtataaaatcaggagagcacggagagcaactcgagagagaccagaacgacgtactggtgcgcctacagcagctgctgtgngcagtcgtaattgcgacgatactngcatagcttcggaaggcgagaacattcattaat

SEQ ID NO: 14738 - DNA, 129 bp, Homo sapiens
  misc_feature (1)...(129): n = A,T,C or G
gntgttttcacggcgagccaggtgagggcgggtaatacgggttccctataaggggagaatgggtgaccgggcgccctctcctccagggtttccggatatgaataaaggtcataatggccataaaaggcc

SEQ ID NO: 14739 - DNA, 1544 bp, Homo sapiens
  misc_feature (1)...(1544): n = A,T,C or G
gtatctgctgtcgtgatgatatagcgttgagatgacgtgncgtagctcgtcgagtcgtagtgctactgctctctgtgatgngtggatgctatanctgtctngtcgacgtgtagtcagtncnatntcggtacgtcngtcgcgactcgtgagagcctagactacaggcacgtgtaaccnacntacgataacagtctacttatnttgcgtatgantatatnagagtcaagcgntgttacacatcgttaccatgtatatcgagagcgtcagtgacgtcgtcgcgtgcacatatgtacgatgcgtagcgtcacgcgacatctgtcgagatgactaataattcgagtatcacatacgagctgatgagagaccncntcaacactaacctggcactctagttcgcctcgtatacgctcaccgtctcgccgcatacgatacgctgtcatcgctactantaatagagtgaagcacagcacgtcgcggaactgaacatatcgccgacgcgatacgcatnctantcacagtgcgtgtcgagcactcggagagagtagctactgtaagagcagatagagatatatctatctgctgttcgtctcgtaccgtnttcgtcgtccgtagcgtcgcatagcagaatacgagtatacattcgatggtatgcacatagacaatagttatagcatctaggataatcatacactgactaactcacgtagtgagtatcgtctcagcatatatatatgattatctcgaagcctnacgcatgcantgtcagcgtgtcgcgcgcnttctgtcatagagctccttacataatcatctgaatcagaggcggcagctcattaaattctaaataacatatagaaccaaccacacaacttccttcgcagctggccaccttagatctccgggagtcgtaatgagcagtgtcccgactcgtcagtatgtctatcgggggtcacttatatgcgcggcacccaagtagcgcgtcgcgatcggctgcggtggcctcagcggctgcctgcgggtggcacatcggatggctgtgtaccgtggaacacgtacgaaggtcgtctgcgcgagaggtaggggcatataaagaagactctgttgcatgacgttgtgaacagtggtgtcgtgttgcatctgcccggagttgtggctggaggtgaaggacgctagttgtctgatccatcggccaggccgactccgtactactgttacgagcgcaacgggtacgctaggttcgaaggacgggcgtagagactcacaatcacgcggnacgatgacgtcatcgacgtcaactaacttgataactgcgcttctcattctagcgggtcgttttcggctttatgtacagtacttaaggattcacgcctcacatctatagtagtcaggcgctgactccacctgctgtgctactgctgatataccggtcaggcacgacgaaacggcgtgtcagacgccgcgggggcaagtagcaatgattgcgcttcgccgtgcctgcgaagcgcttgcgtgacactgatgggtttctcttgctcgatctatcattc

SEQ ID NO: 14740 - DNA, 1719 bp, Homo sapiens
  misc_feature (1)...(1719): n = A,T,C or G
acagtgtgatagtaccgcacatctacatcatcactgcgantactgcgcagtcgcgatagagtcacnacnatacncgcaagagacgtgagacggtatcgcggaggctctcgctatcgctgtatcagcagtgtgtctgcctcncatacatacagagagataggagcttgcttntatgctgacacgctnatcagacagancactctcatactctcgtactacgactacgctncngtatacatcgtcgcaccatangctgatngcagagctcggagtatactaacactcgtcacatcataagtaaatctaatgtgtctatangagtgtgangtgcgagcagtgagcgcgacanctactatcgatgcgtcgtcagacagattgtcccacgagatacagtagtgaggagtatcatngcacagtgtntgagagtctatcccgcgtnanatagnctctagcatatggagtcagatcgaacacgtacctcgcgatgtgcagtgcggaggtgattatgtactgattgtatccgcatngntcctgctactaactgatcgtatgctcgatntagattaagatatattctantgatcatacgtatgatttgatcgtgangtaccactgcagctccngacatatgacgaggnanctgagcgaaanattagacgcacatagtagtcgtgagctgtangcgncagngnatgcgcgagnacgcgacaacacggatagtantggctagcggtcaccgntggntgcacagcagtctctacgttgttagatgatgtatatcgcttatgaataacctcgtagacactcgcagcctcanccagccgcataggcatcagtgcatagtgcgtgtgaagaacgcacacacaccgcnagcatcgtgcgnctatacgtattgccancacgcacgctcattcagactcagctgtcgcacgccaccagtatcntgcgtgatctcactcgagacantatacgcgcggcatggttgtaatgantgcatagagtatgtagacagaacgagatcattaaatgaccgcgactagtgcccgtacgtaccgtcctagtnngtgagcacacgcgacagcgcgaaancagacgnactcacacaacgacntngatgagtggtatattatgagttngagtcgtctaccgatcacatcatgtgtatgtgacgagtagtnttgcgactcacctcaggtcaacgaggagtcgagtgtctgctctgtcgcacgnatactcattacgctatactacttcatatccacttactaaatatcaatcctcatattcagcanagttatgcgaatgacgccggtggaggcatacacacgcgagagcngctaagtccgtgtcgagtgtcgagtaggngagtggtggcactcgtgagtaatagatagagntcatcacacgactcagagagtcaggtcaagtgagagaccntactgtccctcgttttactcacgcacacacactagattcatgcaccgagcgctcacactatgcatactgatggtgtcggtataacagcgttgntgcgtgtcgtagtactcatcagtcacgagtcactgttctcacacctacgtgcgacgtagcatacgntcagctgcgagatgtgcagcaaccatgatgtatagtgcgaagtgcgatacgtatacgcactcacacggctcggcagcacaggatttagtgcgtgtccgtgcgatacgcgcgtattcacagcca

SEQ ID NO: 14741 - DNA, 385 bp, Homo sapiens
atgcggcctcttacacatcagtgagggaacttaaactatcctgactctcttactcaactcaccttacagggtctgctggagttatacagaacactgtcacataaaagctgtccatctgatattctatgcctccagggatttctcaggaacttctcctgggggtattcaccatttcatgaccttcttctgcagacctctcttccccctcacagacaggctgcagcctggagccaggacacactagcaacctgagggcatccacgcgaggctctgggctgcaggtggtggagacccagggaccactcagcattttcaactcgtcatatgtcatttgggaggggtcccccccctctcatgggctcattttattgccaataaagcacga

SEQ ID NO: 14742 - DNA, 1336 bp, Homo sapiens
  misc_feature (1)...(1336): n = A,T,C or G
ccaatctccgtctagtgtcaaacgagaacggacacgtgtgcctgaggtcttatcgacccgatagagcaggcgtggctaacatcaccgccgatgacacaccgcatcgtgctcacaacctcacatactgcagtaagacgtcccatccccatacacttttctctanggccgtcacctttacgtcacgcgcttctgcggcgacgtctctacatctacttaccactcctgtgctccgctactcacctccgccctacgtcttgctgacttgctctctctctgcgacatatagccgggaggaccttggcggtncttagtggcccatgcgctctcattcttgagcattgacttagtgtaatggcatctatgtgcgcgctcgtcaaccacgtgcggcgcctccctgcagcgcgcgtcgatctgagtggtctactgcgagactggtcgcgtcggcttctgcggtgctccgagtgcgggaggggacggcatctgccgcgccgtacgtgcgtgaggaggctgtgagatgtactattgtctgccgcgtctctgacggacctgcctactctcacagcttcgcattactactcttctccataaaccattaacgacgcatacctctcccgcccacccgcccggcagccgggtatntcttctggtctgcgttgacccgcgacatctcctagcgcatataatcatcggcggggattgacgtcgtggatttatttaccgtgtcagctctgattgcctgtctccatacgtattgcaatcttcttcataaccgccccgtatctcctgtctacgcgatcttcgtcatggttatacttagttctagatcagcttcggaatagctagatcactctgtgactagtgagatatcatactcgtgtcatatttcgagaactagctgagtcgcaatctagtgcgaccatcacatccctatgacttacgtagtccgcgatacggtcatatcgacacgtctggactcgaatatgctgccgacagtatcggagtctcatgccggagtagtggggactantgtcagcgctgtattcgagctgtgactgacaatgagcaggacgaaggtatgttaggatgactctcgatagcgctcacgcgattagcgactctgtgtatttccatctccttacgcgcactatcctgtaattgtggatgccagcactctgatgattaccgctgtgcggtgacgtncatgtgatatcggtaatagggtggtgacgaccgtgagacgtntgctgcaacgtcggttgcccgtgggacgtgtcgggcgcagcggtgatgcgacgagaggaggcgcagatggtgtcgagattgtattggcaatgag

SEQ ID NO: 14743 - DNA, 1614 bp, Homo sapiens
  misc_feature (1)...(1614): n = A,T,C or G
actgactgtacggntcgccgacactcgtacgnctatagcgctangnatngnagccgctcgtcagcgatgctgacgagctcgctgctgnanacgcgctgnggacgacgnctgtgctgcggccgctatcgcgtgtctctcacgctctcgagatgacagatcatantgactcgtatatantgactcagacacgacactgnagtatagtatactatctgantnctctcgatcctaacgtagacagtgaacagctgcactatcatacttatagtatctagcagtactgacacactgatcntatactggtgacacacatntacgcanactgcatcgagcgtactacgtngacgctactggatagtacgtctccatcagncatcatatctagtagctgcatctgtatctcgcgctctgatgtacctgtcgcgangccaagatatagtgaggacgagcgtntctaacggatcntngggtgtacgatcagctngtccatncgagactatcgagncgtatgtgtnnggtgtcgtgagtctcgtaccgttactcagtcgacgnagtcagtctacgatagatgtacangacgtcgctctcacgtcatcatgcaatcgacagcacagcanctgtatactagcgccgacaatcanagctacatcatatcgatctctgcgtatgtacggagagcgactgagagatcatattgtatgactcactgtgcgtactcgggcagcagnaagatcgatagacctatctactcgtatgcgtagacgagcgacgtgatgcgacacgacgcagcatactcgctctacatcacttctctcaactaccgtcgacaacagtggtacgcagtgcanctcagcgtnaganacatatatatatatagtgagacacacattctcggctggtcatggccctgcatgtgccgcagaatgtacggcgatcgcgtcgagctgttgaggcgatangncgctgtctgcgacgatctatancgcatncgtgtgataagtacatacgacggcgatcatatcagcctggagaaacgggtgcgtgggtacattgatatcagtgtattctcaggtgtcgatcatgcacgcgttgtcatgcggaaacgtgaaagatgatactcgtcataagatatcaagatcaatccgatcagcacanctcgatcancagctnctctacatgactactgtcgcagagacgaagcgagttatcgatatgcgatacacttctcgtcgagtcatacgagacatcgctattatgttatacgccatcaatgctgattgcagcctctgccgagtacgtcgacgaatatgggcgtgatagtgttcagactctacggatcttcggcgcgcgtaggctgcgctgttgtgctgaaagagcgacggtgttatgtcgcggggtgtctgctagactcatcttactggcgatcgagnggatggagagggagtagcgggacnagtccacgtctcgctgctagtgcgactggcatgctccgcactgtatagaaatgtccgctattggtgagagtgacgtgagtatccggatatangcagcagccgccgtagccatcagtggtgacagtgtacatactcggctaccggccggatgctgagtatc

SEQ ID NO: 14744 - DNA, 357 bp, Homo sapiens
ctagcgatgcattgttcggtgtatgaaaggaaacaagtggtggggggggagatagatcgttggggtttgagcgatctgggaatagaatcgggtatatcgttcggtacggcacgaaatgatgccgtacgtagggcgtattgtactgttaatgtaatagataggagggtgacggatgacgttagatcaagggcgttcaagcgtaatggaagaaaataggctagtatgcacgtgagtgagcactctggttatagttggaatggggatgtcgatacgtgcgagtgaaagaggttttgatggggaatagaaggggaaatttatgatgtaatacggcgggccagtggacgcgaataattggat

SEQ ID NO: 14745 - DNA, 1966 bp, Homo sapiens
  misc_feature (1)...(1966): n = A,T,C or G
tgcactctgcgncgcgagactctcgatctgagcagctggagcgtggccgtgtgcngagcaccgagtgctctgacgtgactcactactccataggctnagctcgacaccgacgcgncngcgctcgtctacgacacgtcatgctcgacgcgtgccagtgagacatagatgtcgcgnactgctgcgctatctctcaccactgcatctcgtcacgtantcgtacatgataganatacgtagttagcaaggtcgacanagcanatctagtgaactatatatgagtcagatagcagangntgggancgactgctgcacgtantcgcatagactgacatnttcgatantccgcggttactgctttgacacgtagagcagtntctcgacttacatatacgngcgctctgtcgtgcgacgcgnangcgacgacgagatntcgtgtgctcatcatgnactanctgcantnagangangccgtatgcgcgcgtgctaagtcgtgactgtcgacntcgtcntaccatcgtatctctctctgtgattgctctgcgtgntgtgtgcactgtatagatactatatagatctgttcantcgcgagngtctggtgcgcctagcattaannaanatgatgtgagtgtgctcgnacangcacatgacatacgcttgccgcatacttcactgacgtcgtcgccgtgcgatagcgctagacatacgtagatacggcgtcaggtgtaaagtcgcacagactagtcatgagnggcagnacggtgacagtcactcactctcatgtgcattcatactgactaggtgtcgatactagcgcgagtgattagagcactgatgcgntaatgctgccatgcaccnacgagtcacatgtgatatacgactacagatgcggtgtgacatatctagcgccgcacaggtggcgcnctgcagctatcncgactacatacctactatgcgttaatgcgctactacatctcgtgcgcgcgccgctctgctctgctgtccattgacgctcctgctgcagtctgtagcacacatctactagtacgatgagtagtcgcgcctctacatggattagtncgatgacagtgcngctgtctagcgaacgcgcgacactatgtctacgtcgctaacagcacttncatacgctactatagcgcgtgactggtcatataccgagttctcaggtactgataacnactgcctccaacgctgcatactgagatgcgtgtnctnctncggcctccggagcgagccgatatacggctgtatccnctgcgcatatgaatatggcgcgcggtctagtatccagcctcggcncacgtaacgagtgacgtacaatngnatctacatanctgactatcatgacgacatacggcacacgtcaccgatacgctagtgctcacctgtatctcagtaatagcgactacatactcagacaggcnctcactcgcgagataacacgtgtcatagcattacgcgcgacgttcatgcatactcgatattacttcgacgtcatcaagatctgcactgcgacgcgctagcggcgtcagtgctgncgctcgcgcantgncgagtgcactggcgcgtggcgagtgagagatcgacgaggcgatgangcgtatacgtagtgactgagtcaatngngnctcgtacatagacgtgctgtgcaggtgcgctatgtatngcgcatcgcgcgtcgactgtacagaggcgcacgcagncacgatgagactcntgtgcatctaggtcgtatcagatcnactcgtgtgcctactgtatgagatagcacgagaccgaactgacgcatgtgccaagacgtgtcngctgcagtacagctagctgtgactagtgacnggtgcagtgtgngcgtgtgggcgacagcgatagactgtgcagtgngcgtacgtngntggctcgcgtcgtgtagcagagtcgctgtcgcgcagtgcatggcgagtctcgcagc

SEQ ID NO: 14746 - DNA, 1684 bp, Homo sapiens
  misc_feature (1)...(1684): n = A,T,C or G
ctcatcagccgtcactactgtgtatcgtgatgtacgcgtcgtctgtctagatctctgcgagagagncgcntctctgcgtctgtgtcggtcgcggcgactcgtgcgtagtgtcgtcgcangttagtctgctcataaatacgcgtcgggcactgcagacacnacctacatgtagagctgaggagcagcgagtatcgtntgtcatacnagcatgagcgtccatatggctcgctcatgcactcatantcatacacgtcttcgtcttcggatcctctagatcgtcgaggtagacgctctgtacatcttcgctaccgcactcacgagagctcgtgcactcatcgtatcgctttcgtagcgtcgctcgtcgccgacatataaccggtatgantaacactatgccatcctcggcactgagcactgcacatctcactgttctatactgcactgacgggagagaatatgcagtggtacaacgtgttatatagtacagcagtcgcgtgcagtactcaatagagagatctgctctactgncgtcatntcgacgancgnctgtgcaccgcgcgtctccagcgggcgaacgagtgacatgatncacgtagacgatatgagtctcaagtgtgcactgtgcgtgactgcggcacgcgttcggtaagtagagactgagtttatcgtgatcggctaccgtanctatcatcggcattaagacgtgctggtcatacatctccgcaggatcagctacaatatacgaatgcgacactgcctctctcctacacgctcaatcatagaatacattatatangnaagttctaacgaacgcatcggagctgacatcacgcctcttccggctgcactgagatggttatctcgaggatgatgtgttcgtcaattagtagatcgtggagtcgcagcacagtgaatgaccgtgcncttaggctacggagccacgcgcgtcatccgcgaccaaccgtaactgtcgcatcactggactctanctacatgcgtgtctagcccgtagcgtgacagtctgcgagcacagtagatacgtacgagcanatggagncgtagtgagtacacacgccgacatatacatgacagatacganccgactgcggtacgtacnacgcattgnactgcgatctgggtgncacagcgcgggcgcaagtcngncgcaccgtgtcattcgtgagtcatgcgnatatgctgtctgttcgcatagggtagtaatgtgatatcgcgctcgacagagcgataagtgcgtgaacgacgacggagaacgcgagactacatgcgtgtacacgtctggcgtggcaacacagacttgcgctcntacgatgcgangcgtgacggcgcgtgactcgcgcatggtatgcgcgcgtcagtgcgaactgcgatcgacttagtagagcaggtccgacgtcaagaagtgcattagatgtgtcactcaatagtagatattgcgcgctggctagtttctattacgggaatctgctacgcaatatacgacactnacatcatctgccgcgctcgtcatattcttcttctacgagtgatntaatataaatcttcagatcgggacgtaatcagagtagaatgtagcatgatagtatttctacatgtcgcgtntagtantcgacgcgatattgtgagacgtatgatgcgtgggcagtgttgagcgaaggtaaagcga

SEQ ID NO: 14747 - DNA, 1741 bp, Homo sapiens
  misc_feature (1)...(1741): n = A,T,C or G
aagtatatacatagacgctagnacacacgtagtagtgagatntagttgcagtgngtcatgagtganngtactactgtatcgcagacgctacgagaacgtagtgatcganaganagntagtatgtnngnnnntcgnacgacgatcgcacagtctatcgtactantatacgtgatgtcgggttgntagatcgntngantctgcagtactctctagatatncgttgcgcgnangaggatgtgtcgtacntgnagtatatgatgtgtgcgagcgcatcgtgctcaatctgatgtatgacgtcatgtgaangatcantgctgtggnagatggcgtcatcgagaggtnctagtgagacgcagnngnagctagagagagggacggacatacggcgtgctnngntcatgcgaagtacatgacatcacaacagtcagcagtctanaacgactgtcacacgcagtacatggatgtggngcgcgctcgtgagctctctcgaaggagcgaggnacgagatcgtgtancagttcagcactcggagcggagaagtacggttgtcgcatgtgcagcggtggtngcgcattcagctgtcgagngaagacgtgtctgttgatttatcgtcacatctgtgtgangnagtggagtagggggtagatcagtgatacatgagggagtttantgngcgcgacatgcgacagacagtattatgnagacgagagagacgtgtgaacgagcagcaatacacgcaccgtacgagacgagtagagngaacatcttnangngnagaagctangccactcagctgacagagaagngacgttcacgttgntgtcgatgcgtnnnngcngacggtgactcgtagatgtggtgagttactgagtgtgtgatgactgtgngggacgtagtggtgggtgagagagagagtgtaagatgcaggcagaggtgnagactagagcacggangggtgnngtacatcgtgtgtctatagagggtgtgagtgagtaatataatatggnggtatcgaagaagagtaacgagtataatgtggangncaaatangaaaattatatgaaatttatagactaatgaggagtcatgcattgatgtgtgnaatcatacttaagatgnagataatnnnnntatactttctgctttctatacncaacactcatccacatttcnnaacaatattatnntnactatttaattacatatattanaatataatttanagtattatatatcttcacacatatataaanaatctatatctcttatcaanaaattcatctatgacccacacctcaatnnaccacataaccatcaactttataaattcatctcatgaacacactattnnnnnatacaacacactannnaactatcattctataattatctatttnnnnatctttctcatctttctattncccaatctttntntnactaacttactcttaanannnnnncacactatattatnntacatctctntatcnnncnnnncncttcttantcnnttncattcnctnnnntccacttcttnttctntnnnnccctaacacatcacttnnntaaaacattttnnatcattnacacttaccanccatctctcctnnncctaaaannnnctctcntccctattttctcatttactacataacaannttatccttcaacntctnncataccacctttnnnnnntctcctctcnccacctctttntatnnntnatattttctcttttcct

SEQ ID NO: 14748 - DNA, 551 bp, Homo sapiens
  misc_feature (1)...(551): n = A,T,C or G
gtattagacgctctggtcattgactcaacgttaccctgttcttgtagcccattccccccgacaggcccacactagtaacgccctctgcgtatgagggcacgcattctgtgttccgatctccttgtcactaaccataacacataaatgtcggcgcgctgctccataatttccaccaacaatattagtcccgcgcctcgtcattattttaacataccatgacatccttgctgttgagtatgtcttattagttcccaacatcccctctacgtttacaccaatatgtttgaggtactaggtcaaggaaaactacacaaacttaaataccaccgcggtggtgtcgtaggcgaccggttgttgctactaatcattttattgtacacagttgcgcctacagtcatctcccatgcataagatcaccgtaacacatcatgttcagtcctgataaccctgtcccncttctcatctctggtgtgattagatattacaggaccctatttgttatcgcgtcaacaaaaattttatcgtttccattccaagtcgttaccgcgtgc

SEQ ID NO: 14749 - DNA, 1333 bp, Homo sapiens
  misc_feature (1)...(1333): n = A,T,C or G
cacacgcactaatcagcacacacaatatgactcccataatccacatcctacacagacaacaatatcttcaatattgagagactgttcgtattcgaccggtgagtgagttgtaagctgcaggcgctatcgtacactgntccggctgcagcgtgtagactgtgagcatcatcgttgagctggtatatcggagtaggacatagtcactcacctagaaagagatagacgacgcagcacaactaaataacagcaatatacacgtatgcagtcaacccgctcgttgncacggccgatagtgantgggcagcggctaataccggtctggtggtgtgatcgatcgagacggagggcctgaaggaggtgagcaggcgaagtagtgaaggggagacaagcgggcgcgggggtggagtggaggttgcggtgggatggttggtgtcggcctctcggccggtggtgaagtgtatccctaaatcacttcactctctgcagcagaactgcacagggaacaacgcagagggtgagggagggttatgacagtanctctagcacagacgacagataggtcgatgcccggtgcgatcgtagagtacccagttatcttaccgccagtgaaacgccgagaggcgccataccactatggaactacattaatcacacaggacacacaacacatcgccaccctcgcgtggtggcggcggcgcgtgcgacggtgcttccgagtacctcgtcattgtagtcgtgggctctttctcctggcgggtctacgtgctcatgtaagatatccgatatatgccggacagaacagccatcgattatgtcgacgacgaggtaataaggtcgacacgtggaatgcgcgccgacgacaggcgacacagctaatatacacaggcgcgtcgagtagatttagacaggcgcagaggacgtaacgccgcgacagaacgacgtgtgcatagagataaaaatgtaaggtatatacaagatcctcatgagtctcgctaatgtcagcgaagactccgaaaccagtggggtagagtcgtcgatgcgatagtcgaagcgtagtgaggtgctttgtgtcgtgaagtgtatgtagatggagtcgctgttaagtcgggtaggcgcaatactcgtaggatgtcgcctgagtacgtagttcgcgcatgcgagcttacattagagggtaggtcgtgtgcgcctcgtcatagtggccagaagtcgcggcgttcgcggcgtgcgggctcgtgtntgtaacattaggtgttgggtatgtgcggcgggaggcggcggctagtgattagaggtcgagagttgggatagagcgaggtagagatagagtaat

SEQ ID NO: 14750 - DNA, 268 bp, Homo sapiens
  misc_feature (1)...(268): n = A,T,C or G
attaaaaattcacatagcttttttgatattttgtagagccgcggctagtagtaaatttttattgatggcctctaagccgatatagctaaaagggaccggcgcacagagggggccgaggaaccaattaggccccatagtggttgtattggggggcttatcgcgcgtgtgattatgtagntgggcaagagggaggagtaatttagatattactaattgatagaaagttgtactgtattaataaatataaaaatanaaaaaaaaaaaaaaa

SEQ ID NO: 14751 - DNA, 824 bp, Homo sapiens
  misc_feature (1)...(824): n = A,T,C or G
tttccaccgaaaatattgttttcccagggttgcaataaataaacactttgtcctctttgggttgggattttttactgaaaaagagagagatctccataggtttacccaactgtttttaaaattttgcctctaaatgatcctcttgccttggcctcctaaagtgtggggatacaaggcgtgacccaccacccctggctaatgtgctgatttaaaagaaaaccagtaaatactgtgtagtgactgacacctgtaattgatataaaactattcccttttttatgatntaaagtatatagactatccatacatagtttatatagcgtatataaggtatttagaagtacccatatgtggtatgtgtgtgtgtatgtatacacatacatacatagtatatagaaagtatgtagacttattttaccaaacaaaataaggtggaatggaatgtcagtgtcatggcttactccactcatctccctaaaagccatcaagtctgtaatattgtgggtggcttcaggcatggatgcccttgtgagctgacttgctaatgcctatacagtgtacctggatgagtagcatggtatctttgagtcagtgcaaaatgccatgacattgtactgggtctggacaaagcaaagcgccttgggaaataccacctttcgggttacctaagtggttcccctttacaagtttagaggcagagttctgtttaagttctagtccctccactcgatctaggtagcagactgtaatgatggagggaagctggcacatagcagggatttattgaatgtatttgagtgaatgaaataaaactagatccgcca

SEQ ID NO: 14752 - DNA, 287 bp, Homo sapiens
ccctttcgctttcatttactccgcccctgtcctccgctattaacctgatgtaccgctgtcccgctccacctctatccaaaacaacaacgtacctgccccctcagaccccccccctcgatatacgtccctcggtcgcgcactcccatcgccttctcatacgatccactaattgtccgcacgcgcggccgcttacataaacttactaacttactatatcatggccgccaaggccgaacaatctatactcataatacccagagccagtgacgggggctaatgcgcccccc

SEQ ID NO: 14753 - DNA, 1135 bp, Homo sapiens
  misc_feature (1)...(1135): n = A,T,C or G
agtggagggtgggcggggcgtcccctcgcattgcgcccttcttgcctcgcgtgggaacaccggggaggggtcgtgcgtcgtcgcggcctgnggcggctgtgccggtctgtgcgcgagggtcaccgccgccggtggtgaggcgtctccgatcccgctgaataattgggctcacttcctgngtctcttggggcacggggccgttcctggaggtcagcgggctcagtgacattggancgcacccctgcttgttgaccccgtcactgggtctctcacctcgcgccgtgctggcgcgccgagaactaggttgggatggctggaggcgctcttggaggcctgcgttgatctggtaagagccataccccaacgtgggggcgagggagcaggtagtgggagtgngagtgggacgcgggtgcggtgggcgcacggggagcgggcgcggggaggaccgcgcggcgtgtgggtacggagtgggagcgagccgcgtggagggcggggtgcgggtggagcacgcgtggaggtcggtcagtcggcagctgcgcggcgggtcggggtcgcgcggtgcacgatcgccgcgtgggggtgctctanggtgcactgggagggttcgtgagtggtgggtcctatggggtggcggggcggtgctccaccgcggacgagtggatagagtgaggcctcgtatgtgcgattggcacctcttcaatgcacaccntccgcctaacgcgtcgnnccgtacatnccncccctcctgccattcgtcacacgccgagtgccttccggtgtntctcctctgttntggactgcattgcccttgtnantcgctctaatgtgtctcgtcgnnncccctggtcatctctcgatctcatgtgtactcactgngtntgctcgactcntctcgactgcatcgccactcnnnccttctgcctctcactctctagcnccctcctcattnnnnaccgtctttnnctccactcgnnnctcacgtgccctncttcttttactattatttannaaatatatcatacaaatctattcaccaattctnttctcgcncncaaannntntctccttctcttcttctcttttatttttctcttctctcccttnnncctcctcttatcttnnnttttatcttttt

SEQ ID NO: 14754 - DNA, 616 bp, Homo sapiens
actcaccataacccacctacgcacaccctctctttcgtacttaatctcgcaataacaccctaataccacatgcgagcggcgggaagacatcgcacaaactccatgacaacgtaaccgggcgtcgtacccatccacgtcaagtcctcgtcgcataagaggccggaccccttctccgttcacatatcacccagggaagttctaaacgaactcttctccgtgtaatcgccaatgacttcttttttaccacaccgtactaaaagccggcatacaggtcgtcttatatcccacgttccagaaggcgtacccaccggcccataccctgcaataactcgttaggtccatggtggcaggatccagatactcaagcaataacacagccacccggaaggaacgagcgcaaaagtggtgctagaacctcatcgggcctctatacagtctatgagatgatcgcagggaaggtagagagaaggaccaggtcctccttacaccttctgcacatgattggaagcctcctgaggccctccacgagaagcagatgccgggcacaaggtttattgtacagtccccagaccctgtgagcaaaataaacctctttttaaaaataaatccggatgcg

SEQ ID NO: 14755 - DNA, 545 bp, Homo sapiens
taccaggtttcagacaattacccccccaaatgaagatctcagaagcagctctctctgaccttagcttcccctcttgtctttgacccttccatcttccaagaggctagccacagaaattagaatcccatggaaaccagaacccctttccccaaagccagcaataaaatctaaaaatattactctaaccctccccaccacctttctgtgtaaaaactggccataaagaaactacctgacctacgttattgactgtaggccatgagacctctattccagagagggtcctgacccagacccagaaggagggaatgcatgcttagagagaccaagaagaatttaactggacaggccttgctgcgtttccccactcagtctattagcgtcaaatcatgcccattttgtccagtcatatttctacatggccgcccatactttcttgaagctaagcatacaaacagactgtttctcctgtatctctggatcttcatctgaaggattccataccatgtaaaactatgatcaaataaatgttgatccggccggag

SEQ ID NO: 14756 - DNA, 1153 bp, Homo sapiens
  misc_feature (1)...(1153): n = A,T,C or G
aggaagaaaccgacgggaaacggacgggaggcgggcggggggagggaggggcccttagggggagacagagccgcgggggccctgcggggggaaaaaaccgacgcggagagaggggggggggaaggagggaacgggcgagtcttttaacaagaggggggggaaagggcgcaagtcaagaacaaaagccaaacgggggagcacggggcggcacgaaacacgcagagcacggggacgaccaacgaggcgccaaacggagaagagcacggagacaagaaggaggcaaccggccgacaccacggcaaagaccaggccgggaaaaagggaacgcccacacgcacactattctttttcgaaagggggaggacaagagggaaccaaacaagaaaaacagcgaggcaaacgggaggcgagaacagcagaaagcccgaagggacaacagcaccaacgagggggacacaaaaggccagcgaccgggggagacaagaaaagcagggggagcgtgcaccaccacaccggcgggggagaccggggaaggacaacgacgcgggggggggggaggaaaaggagagaagagaaagggggccaaacacggaaaggggagaacaccacacaacaagggggaacggcggggcacacaaacaatcgaacaacaagacaacagaacgatgacggagagagggcggacacgcggacacagaaaacacaagacagacctgagaagagaatgaaagcgacatcgcacacagaactacaagtgggggagagacaccaacgagacggacaaataagcacnaggaaaaaaaaaagaggaggaaaaagaacagaagaaagaaaaaatgagagggcgaggggagcggccgaacaacacacagcgcggagcanaggcgcacactcgcggcgaaccgggagatgggaaacaacgcaaaaacaacagaaaagaggggggcaacaaggggggcaaacgaaaacaccaccaggagaggaggacgaaaggagggaaacacaaggtgaagaagaaacaccagacgggagacaatgggcaggggccgaagacgccgagcaaaaccgggcagatagagaacaacaacgacagagggggatgcggcgacacaacgggggcggaaagggaaggaggcacaagacgcaagggggg

SEQ ID NO: 14757 - DNA, 665 bp, Homo sapiens
  misc_feature (1)...(665): n = A,T,C or G
tcacatgacagtgattttggatggcctcagggacttgaacaacacctaggtatcagtgtgtgctgcagctgaatcaaggctccagtcaacctgcggtctgcctaccctcaaagatagaaaaaggaagaacaattggcatttgaagaagtgtctgaaaatcttcatattccagtttgaccctcattcgtcatcccctaataacccaaagattcactttctttttttttaaattgaagtctccctctgttgcncaggctggagtgcagtggcaccagttcggctcactgcaactttcatctcccgggttcaagcgattctcctgcctcagcaccccaagtagctgggattacaggtgcccaccaccacacctggctaatttttgtatttttagtagagatgggtttcaccacgttggccaggctggtctcgaactcctgatctcaagtgatccgcccaccttggcctcccaaagtgctgggattacaggcccaaagactcactttcatatgactcttacctaaacctaaagatggttcttccagctatggaagcctggggtatgcgaatatcactgttactgggcaaacacagaccatgcttatgtatggaatttatattcaaaggaaaacccctcccaccagccaaataaaagacgatgctggcgg

SEQ ID NO: 14758 - DNA, 1632 bp, Homo sapiens
  misc_feature (1)...(1632): n = A,T,C or G
tggttgacgatcgaggcggcatgcaatgcgattgggtgccgtgtcaagcgaggcacttaatngatatatctgtgtgtgacaaagacgtcatcatagatactcgctaaagatagatagaacggaaaagagagatgcaagaatgctgtataggtgcagatggcgtgcgagtgcagccacacggagtgggtgagtgaatagcttnagacgccggcccagaaagaanagcagaccgtgatagacttgtatgagatgctgaatagtatgtagcatatgggtcgtctgtggaagatagtagagatcctgttacctcaagtgtattcgcgccgcagtcgagggttgttttactagaatgagacgccgatacgcncagatgatagttagttatagcatgttgctatcanatcgcatgcgctgcagtgctggcgagttgagtgcggcgctgcgtctggantaagggtatctgtgcagacacatagctccgattatgctaagntgagagtcggcacggatatttaatattggtgtgtggcgtgtcatgaatatatgtggatcgactatatgtgagatgaatcactgactgatagcggacaggcgtcacagagtgtgtagtaacagacctgctcgacgttagctctgtcagangagttattgtacacgataactcggtgatgcgcacagttcgcgctcggtagatattaggtgtgagngtaatggagaagacngtctgatatggaacgcgcgtcgaataatctggtagcagggtggcgcgactaatgcggacatatatacggagagctcactgcgtaggaacaatacgtagggggttaggatgcggagaagcggattagacacacagatagatgacgaacgtagtcgcntagatatatgtacgcatagtagaggngtgantgtgaacgaccgcgcaccactggtctncgacntgggtgttgcatccgacgcgtcagcngatatagtctatattagcagtcgtattgcatagtaatgcgctgactatatttgtgggtcacggacacctggtgtcgatatacgcgttctagtctagatagtcactatagcatatnttgcatgccgcactgaaatgtctaacgcatcgagatnggtagatgagtgtgtctcatcgcagcgtccgtccgngcgttacantcatatatangatnctaacgtctgncgcacgcgcgtatngtccgagcaggtcgaatcgtacaatagatccaggcggcgcacgcaggatgatgatgtgtgtatacgtctgacgcgngtcgacacncgacgtattcatctgggcgaagtactcgctgagttgtcgggntgttgaagtataggtgagagaagatnggggaatagacatatgacatacgagtgntggaagagcaggagcagcgacatgtgcgaactaggcgtgcatgaggttgtctgtgcgacgtctgattatggcgcgctatgcacgatgtaagtttaagtgcggttctcgtcagtgaancgtggcgactacgtatgcgnctgcgtgcacacatctaaattatgatcgcgtgcgccagagctntctgtgtcatcacgggtggagncganngataatancatagacacatgtagacatacctgcgtgtgtat

SEQ ID NO: 14759 - DNA, 749 bp, Homo sapiens
  misc_feature (1)...(749): n = A,T,C or G
ataggtcatcaagaatattgatagagctacactactcaaggaccgacaaacaacacggagagaagtagagtgaagatagagtaataagagtgctatgagcatctaaggtactgatnttatctaatatggaagcttaatgcgatgtgtaataanattatacaagtgtgtctctttttgtagcttatcgaagtagattgatgcacaatggattggaactggacaggagggagcaggaaacaatctggtggggaattattggcaatcaggtagcgataggacagcgtatatttgtaatggttgggactcagatggatgtatgctatttcgcggatggagtcgccttgtatgtatattgttgatgatgtggttgtacagagggcatgcagggagctcacacctgaataaaattttcgctgtcatcctcataaatgctcgatgttcccaaagccaataaagaaagagagcaatatcagtctctctatcggcattgtgatggccctcacaccctacgtgccaatcctccgatgcttaatcgcgataagccatacatagagctgcagcgggttggtgtaaagaggtaggaaatgtgaagagagtctccgcacggatccgtgtttatactaaaatgttcaccctccgaagagaagagggactcggagtagttgtgtcctagcaaagagtgctttcggttcgcgacgccaagaagccgggcggcgggatgggcgtggaggaagttatgttttgccctg

SEQ ID NO: 14760 - DNA, 1163 bp, Homo sapiens
  misc_feature (1)...(1163): n = A,T,C or G
catagtcanacactgctntcatngcngtacgttgcaatnaggtcgtagctatagtcatacganagatgcggtagnagctaatcggagcgtgaccctacgtngaacngtgctgactgcgacggagtagaacggagtaatcagcagcntgacgatgccaacgtacgcacatctacaacatcgcncgctgcaactatgagtgcagcgacancacgctgctagtcatctcgcactctactaaaatcgagctagnacttcgctctgntgatgtgtgtgtgcgcgacagctgcacaangcagnggcgaatgtgatacacggcacacgagctctagtnggactgtaccgacgcaggtcggcagcgttcgtcaacacacaatagatgctgcgctgtgtgagttgattgngacaacntcttgtgtcatgngcgatcgcgtatgtcgcgcgatactatctcgagatattcggaccgagagtcgtacggattgcatnatcaatggcgtgatnctctctagncgtgagtnagncggcattgcctatnactgttcgaactcacgacgcctgcgactgacagcgaacnctctnataaagggacaattanacagcgagctcgatataatacacgtgtgcacaatgtacataatatgtaccgtaccaacgtggacggtagctcacagcgcacgtaggcagcatcataacacatagtgcagataaatacttgtcgacatanacanaccanagctagcctacaacgtcgctatatactgtgtataatgatnttacgtgtcgtgatcggtacgcagtctctgtcataacgcgttacgaatattgattcgacgcgataatcatgatacatgtatcaactcgcgacatgcgagatactngacagtactacgtgcantgattctactgacatcagttgatcatcgcatattctcatcgtgcgaccactctactgtatatgaatagataacatctgtacatcagatcacgagtatagatcgagcgggcggcgtgagagtctacattgtattaaaatataagcacctctcttgcgtactctatcntatgacatgtgcgctnatcgcacagaatagnttcatgtcttctagccagagagagccggagcagatagtgacagcatagatcntctagtactcgatctctca

SEQ ID NO: 14761 - DNA, 402 bp, Homo sapiens
agcagaaggtcaagaaatttgtgtgattgaagccatgaaaatgcagaatagtatgacagctgggaaaactggcacggtgaaatctgtgcactgtcaagctggagacacagttggagaaggggatctgctcgtggagctggaatgaaggatttataacctttcagtcatcacccaatttaattagccatttgcatgatgctttcgcacacaattgattcaagcattatacaggaacacccctgtgcagctacgtttacgtcgtcatttattccacagagtcaagaccaattttctggcaaaaaatcaccaatggaaattttcattgatataaatacttggacatatgatttgtccttctgctgtgagattccctagtggcaaaattaaatcaataaagagcga

SEQ ID NO: 14762 - DNA, 1545 bp, Homo sapiens
  misc_feature (1)...(1545): n = A,T,C or G
cgctcatgctacgcgctcgcgtgtgtcgttagcgttctctctcgctagcagcctacctatcgtcntctgctcgtctcagtcgtgtatcngtgcggcataggcgctccctctacgcgtcggtcgctactcgtagctcgtccgtagctgcgcttgcttacgtgcnttgtcgatgtccaggatctngtcgtcctcctcgctcagttcagcgnctctcgntctctcggatgncgcgtgtccgttctgtgcgcgtcgttnggctgcgtcgcgcgacgncactctgncgacgtagctgtgtgtgtatcgtgctctctctgcgctctcgtcgtgatcgtgcgcgtgtgcgttctcctcattctctgctcgntctcgcactcgtgtcgtcgctcgtgcgctgctgcgtcgcgcgcnctgcgctcgcttgctgacgcgtcgtcatgtgctgcgcgtcagccgcgtgtgntgagtcgtctgttgtcgtgcgcttctctctatgacacactgacgangacgatgtgtctcgtctgtcgcngcggcgtgctacgtctagcgtnctacgtcgcgctcgtcgcgtgtctgtnctctctctcgctcnctctcacacgtcgtcgctcgtgtcgatcgccgcttctactccgtcgcttcatctcgtcgtgtctcgtcatcgttgtgctgtgcttcgcgccgcctgtctgncccgctgtcctcgtcgtgtcgncgcnctcgacgtcggtgtcgctgtgcggtcgctcgctcgcgtgcgctggttgcgcgttcttgtcgnctgcgcgctcgtcctagtagctctgtgcgcttgtgtcntgcagggcagaggtctcgctgtgcggcgtcgtgcttgtcgctctgcgcgccgngtcgacgtctgcgctcgtccgcgctcgtcgcnctctcgcgtgtgacgccgtggcctctcgttcgtgccgcgctgtgagtgtggntgcggcctcctctctctccctgctcgttcggcttcgtgctggtgcgctgcgtgggtctgccgccggtcttgcttcgcgctccgtctgttgtgcgttctgtgctcgtccttccgcgtcttctgccgcttctgcgctcttttgctgttgtcgcgccgtcgggcggggcggcgttcggacttctggtcctctctgctgctagtctgctccctctctctcgcgctccgcctgcgcgctccgctcctctctccgtctcggtggccttcttgcggcgtgtctcctcgttggcgtcgtcccctcccgctaaaaaagaaatgtcgtcctgccgggttctgcctcctgtctgtttcgtgtgcgccgtgcgggcggtgtcgctctcttcggccgtgctcccgcgtttgctctccggcctggctctgtcgttgttgctggcgtgctgcgcgcgtggccgcgggcgctcgcgtgggtgcgtgtgttgcggtcgggtttttcccccccgttgcaagggtgccgtggcttccttccctcccccgcccncnngtctcnccncnngagnccncgcgggggtcactaaacgaccctccccggcgcg

SEQ ID NO: 14763 - DNA, 540 bp, Homo sapiens
ttaaaataatatgaaatattgataaaataataatttcttgtataaaaataataataatattaaattatgtatactatatataaaaataaaaaaaataaaataaataagaaaaaaacaaaataaaaataaatagaataaaagtgataaataaagaaaaatataaaataatataaactactaaaatgtttgtaaagtaatataaataaaagttataataaaaaaaaaaacaaaattattaagcgaataatgttatataaacattatttttttataaacataattacacacatataataattaataccgattactaaaaacataaaactaatataagagtttattagaagtatcataaatttaaccatatactaaaagaaaggaagaattttgcgttagcaattataaattgaatagcaatcatatgcaaatattaaattaataaataacagtcaacctcaaaggaggcacggtaaaactaattaaaccctaataataagtagtattacgcgcgctaatattccaggtataaaaaaaaaaaaa

SEQ ID NO: 14764 - DNA, 1272 bp, Homo sapiens
  misc_feature (1)...(1272): n = A,T,C or G
ctgggcgngtgactgctgcgccgtcggactgcggtactcngnactggcttcaactctcatatgcgtacgtgtatgctcactgtgtatcagttgtaggtatgatgactgatataactnatgtgtcttagcttatgggtgatgtcgttgttantgtgttacaggtcgtatagncgctgcagtcataatctcttcaggtgaatcgcgtatcatgtactcttagagtgcatgggagaggtancgcgnggagtatcgcgagatgacagaggactagaaggcgtggacgtgatggngagtgtgnagtactantatattagtcagtcattgatctatgtaatgtatgactctagncgtgatcacntcttagcttatacatgtncttcatcttatctctaatagtagcgctnttctctgagtcatatgacgtgaaggtnganatatagtgcactatgcgtctngangtgagcgcgctcgtngaatcgttcatgagacnatacgtattagtggaaagcatggagggtgataatgatactattcatcggaggangctgcacatgactgttggaatgtgtctgtggagacgtcgataactctgcggagagcgttgacggcaactatgcgtganatgtggtattgttgattggtngcgataggttgtgagttggaggttgattgagtgggggcagggataggcgggtgcggctgtaggctacaacaaactattctcatcnttaccatcatcttgacatattcagttggatgggagagtaataggggctcagccttggtcccggtgtgttgnggccctcgcccgtgattgtcgcatgttgtctctttacttctatatgggtcgatgcagagtaagtagtgttattgtatgtcgtactctattatatctttncgtctgctaggagctgtggtgtattgttacttgagcatatattggggtgataatagtgggtgtatattctgtaatcaatgtagggagatgtaatttaggtgctgagaatcgagatcgttattatccaagttaggagntagcagcatgataataaacttatctggaccaaagtggacgcggcggcggtatatcactggactgcatctgatagtgtgtgcaaattggcgttcctggtcctctcccctcagtagatacgaactggtatcgnnataatgctcgatatgtgccatgagagtgcgctatacactagttaaaattgtctnaacgtctagtatctctgtgcctaaggagttgaatcttatcttttgtgccaa

SEQ ID NO: 14765 - DNA, 765 bp, Homo sapiens
gttaaattcaaacacttaggctcaagggacccttcccgacctcaggccttccttagtagtttaccaaagtcttcaaaagatctgaaggttgggtctcgggccaggtcccctgtcccagtgtgagtgatggaagggagcccattacggaagaagcccgcttcaagagccaacaagaagccactccgaatacagcgcataggacgcccatgtaaagacaggaaaactccagagtcatccatattaaggtgatctcaccaaggaaggaggcaaaagagagaacagaaggcagggcctgaggaacacctgtatttctaggacaagaagagaggatgttgggaaaagctgagtgttaggagaagctgaggcagggtttgcatgtctgacacaatgtaaaagagtcttggaacatgtccggggtccagggtctaaaaccccttgtggcctttggaacaccaagctctgtgctaaagggtggaaggctaccctgacgcaccataatctaagcccagggcataaaatccctcgtgacttggatagaatccagggctcatggctctggaatgtgtctagacttgctggctccttgctctcccaggatcaattgtatcttgagttaaaagaacctactctcactatctcaagtagcagaaaatgttccttataaatgctaaaccatcacagctatagatcatgtgcctgcccttttgacctccacattctcaccacctgtttctttgtggattactaataaacatcgatcggccg

SEQ ID NO: 14766 - DNA, 319 bp, Homo sapiens
  misc_feature (1)...(319): n = A,T,C or G
attgtgcgcggtaatataaaagtcagcccaacctaagtttagggtgttggttaaaagcacctagggtttgccaaattccctttgataggcccctatgaccctcatagcttaatcgatccccgcaacccttcagggggggccggtacccccgattcgccccgataattagtggtatttatgcgcgctccactgccggcgttctgtggttatacctagattatgtggaagaccgtaatcacacctccttcgcagaactaataagagttatatnccctcaaatagagntaagannaaaaaanaaaanntnannngnnnnnnt

SEQ ID NO: 14767 - DNA, 712 bp, Homo sapiens
  misc_feature (1)...(712): n = A,T,C or G
aagctacagcatctgccaagagccgtatgtagcttgagatgactacctgaagatgtatcatggtatcagctggttagttaagaagtcgttttccagcttcgtatgtacagcctttcctttccacttgtggtctgcttgtaaaagaatcaagttttaaaaactattatacttaactctttatatttaacaattaaaatgatagcctcatgtaactgtcaagttgggttcaaatcctggtgtcatcatatatcagttgtatgatttcacaatatttttcatcttgtgtaaacaatagataacaatggcattttcctgacagttattctgtaatcagacatataactgtatctaaagccctgaaaatatttttggcntgttatattattgaagtataaattataatattagatttgccaccaccaccatcaatatgatgatgatgatgatgccgttgtcattgnctgacttgcacatttaacctacntncttttttcctaactggccngttatttttacntacaaacatatcattactnnnantnncatcangggcttatnanaanaacactnttggaaggngnngctttttttntnaanttaangaacttnctggtatnctngnncntttgaaagnanaactcnttnccttncctaagggcggnaaaantggntcnntnatttnaaaaaannnantggntnnanntcngannaa

SEQ ID NO: 14768 - DNA, 946 bp, Homo sapiens
  misc_feature (1)...(946): n = A,T,C or G
ctcacctggctttttatcttaaacccttctcttctcgcgcctctaagaacaattatcacaaccgtacttctggtacaatccttctcgcaatcttaacgacaccacatcattttttcgacctttattcttccaatacactcttggtaccctatatttcgccggcgttgtgggtacactttggggtcaacttttctttttcgccttctcctttggaaaaacaatcatctaattagtccacaaatatgttccccctccaatgtgattggaagtggtaaattatctattgtaaaaaggaaagttggcccacatcgctacaatatttttattattttgttctataagggaaattcccaatttnatttatctcttatttacatatttttaaagtaaatattaagtgtaagaatatttttataaagtctcagtttttttgtataaaattattttagctatctaaaaatatggaaaaaagtgacagccccagagcttaccaagagaanatttataatgtttcaattttatgtatttgatattcatattaaatttgcacataagactttttaaattgcattaaaagtacataaatattatttgaccattaaaatagcaagaaaagggtaagaaaaaaactggtgatggagaagctattaattaagagaccattagcaattccattttatattntgtaataaaatttgntgtatagaagtgattgccccccaaattattggaatatttgaatgcaactttaaaactatgaaaaatgaggctttcattgctgtaaaataaattaggaagcaatattttgctagcaaaggctttttagtaacacagttcataantatttatgtgtattattcccccacgtcctcgnttgttttgtgagctgccttatgatgttgtatttggcattactttaaatttaaaataaaggtagatgcggcgg

SEQ ID NO: 14769 - DNA, 360 bp, Homo sapiens
attctctgaatattaccttatatagtaaaagagtctgtgcaactgtgttaggatctggaaactgggaggttatcttgcataatccctgtgaggctgatgtaatcacaagatcttcataggaggcaggcagagagaaacttgacacagaagaggaggacatgatgtggccagagaagcaaagactagaatggggcagccatagccaaggaaggtgggcagcgagcagactctggaagggccagaaacggattcggccctgagacctctggaaggaagcagccctgctgtcaccttgactttagcccagtgaaatggattggggacttctggcctccagaactgtgggagaataaatataga

SEQ ID NO: 14770 - DNA, 309 bp, Homo sapiens
accactctggcctgccacaacccatcctgtgcctataaaaactcccgagaccccagcaaggcagagacaggggcaggtggacatcgagaggagcacatcggtggaggaacacacaggcactggacaaccacaggaacgcaccggcaggcgccagcaggccaccaaccagcagaaggagaacaatgcagagtttggctggggcagtccgaggaaagcccaggccaccgagtggcccagctcccgaggaaagccctcccactctacccacttctgactttcgctgagctacttccactcaataaaactcga

SEQ ID NO: 14771 - DNA, 359 bp, Homo sapiens
ttcaaaattggaaccacttgtcaccaaataatgtttaaaactatttgagattattggcctagagtagctgtcaaatcctaggacgtggcaaggtcaaggggaaatacaccccaggagagagaacaagttccaaaagctgagaaaagaggttgaggaggttgtgcatacttctccagtctcagcagaaccctttgaatagtgagagaaaagataagcacccgtatcttggaaaccagtcaatgaaactcaaggggcccacttgaaaataaatggctacagtcatagattgcatgcaaggagagtccgtgaatgtgtttatttacaataatgctttctaaaacatgaagaataaataccga

SEQ ID NO: 14772 - DNA, 929 bp, Homo sapiens
tcttttgagaatcgtattttgttaatatagaggttaaacgtttagctgcaaactgactctcttatttaccaccgttacagatgaagaaattggaggccagataagttaattgactccccaaagtaaatataaatactcatcaatgaaactgaggttcaaaatcttgctggactgagtctgaagcccacgttcctttgctttatgcgttatattacctacggtggatttttttaaatggaccttgtaattttcgtgtctcaatgtttactatcaaaaacattccaaaatcaactttttcaccagatggaataacaaaggcaatcgaaagaccatgaaatagattatcatgttgtaagaaaaaaccttgcgttataacaaaaacctttaacctacatgtttatactctactggaaatccaagatctcctgtttacaccctgtaaaacagtattcttctctaattcttacatatgaccttcaccttatactcgatatgaggcacagatccagtccatgacactacaaaaaggcttaattaattatcttatttctactttccttactcccttcattactactctctctacgcatagccggtaatcttctcacaccttacgcctcttatccttatgttcgcatcgagttgatgtgatatatccttgagactactgcattcactcgagctccgctaatccgcctagaaccctatataatgcctctcatgccttcatattttcacagcagcatccatccgtctgtgctaaacctgatcgatatgtaatgctccagtccttatctggacaacaccaatatcaacctacaattttctccccacttgctcctctgaacacttacacctacgcattctccatcttatctctacttcttccgtaacatatacactcagctatagaccgaatccttagttat

SEQ ID NO: 14773 - DNA, 414 bp, Homo sapiens
tcatcaaatgaagatgaggtcatgctggatgatggtgggccctcaatccaatatgagtagtgttcattaaagaagaaaaaaattggacctaaagatacagaaaaacaggaagaagaccacatgatgatgggggcagaaattggagtgtgcagctccaaatcaaggaacaccaaggattgctgctgccaccggaagccaggggagaagcatggaatgggttctgcctgagaccctccagaaggacccaatcctatcatcatcttgatttcagacttctggcctcctgaactacaaaagaataaatttctgttgttttaaaccacctggtttaaggtacattttttatggcagcctgaggaactaacacaatttgtgagtgctggtatgtgctaaagagaaaaaaataaagcaaga

SEQ ID NO: 14774 - DNA, 393 bp, Homo sapiens
  misc_feature (1)...(393): n = A,T,C or G
acagggtctccctctgtttcccaggctgcagtgcattggcatgatcatggatcactgaagcatctaactcctgaagtgaaaacatcctcccacctcagcctcctgcatagctggaaccacatctggcttacttatgactttaaatgtgtgtattagaagaaaaaaatatctaaactaaattatctaagtgtccatcgtaagaagctagaaaatgaagagcaaattaaacattaataagtagaagtggggaaaaagtaaagatcagaactgagactaatgaaataaaaaatggaaaaccattaaaaaagatttggaccanatagaaggggagaggagagaaaaaggagnataagaatggaaagaagggnagagaaccccctaaaaaaaaaaaaa

SEQ ID NO: 14775 - DNA, 1756 bp, Homo sapiens
  misc_feature (1)...(1756): n = A,T,C or G
acggctcgtgcgtgactcgtgcactatcgatacgatacggtctgccttctcttctcaactacatcgttcctntntngtcggcgtagtcgtataccggtccgccgcacgncgcctggatcatctactatctctcgcgtgcactgtcgtgtcngaacgatcagcgnatgngcgcacgtccgtatcatatgtagtatgcgacgacgcgttcgctagangctgctcagctgatagtccacgcgtgtgcgctcatcgcgcgcgcagctgcgcgcccagtcgagaacgcacgtacatctacacctgtgtatcgtctgtgangacatttcgtggcagtngatcatnagctcgcttagcgtagatatgcgatctgagcangatacgacgtcgngacgngcagtcatgtggagcgctcgcgagctcacgttctgcctgcggcgtcgatatatcntnttcgcncacctgcttctctttgtactgtcactcgtatgatgtcgatacacgtacgtgtatcntctgcgatctcaactancgcgacatcgtgatacagtcacgtatcttaagcgcgantncgtcntgatgtncgattgatagtgtgctgccatgccgcgtgactgtatctntcctactcgactgcgcgccctgatagcatcgcggtatcgtacttcgtgagattgaaccgtgcagaccactcaccttctagtctcgcgagcgcctagtctctctacgtattgctatccgcaccaggcctccaccaccgctgtctacatagcgcggcgcgtgatgtctcgagtatgtcgccatcgctgctctcgcgccacattctgctcgctgcgccgcacggcgccagtctctctgatgncattggccctcgactgtcgcataatagtacttgtcctcgtacgtatctactacattatatccttctctatcggcgactctctctgatcagagtgtgatggagtcacggcgcgctcgttatagcctacttacacgtcgagatgagtcatctctcgagtaacatgcctgcagtatcggtcggataacatctatcgtcgtgttgcctctctacgtgataagacgatgtcatcgtgtgtctagccggccgtcagtatagcctcactcgcgctcaggtgcnccagcctntgtcctgcttatgctccacatcagacgttcgctcgtcgcgacctcgcgtactcccgttacacagtgngaacgcatctgtgtaactatcattcngtacanctgcgatgttgtaaaaatgacacgcaccctcgctgcgtcgtgtgctgtcagcgacnatacacacgagtcgatanatggatgcaacatcgtttactcgctccgctgccgctctcacgcgacacttagatanatctctcgctgcgccacgctctcgcacacatatcaatacgcagtgtgtgatgtgcgctgacgatgcggagtcgtctgtcataacacgcggtagcgcgtatcgacgcgctcgtcattgtcaaggtggcgtgttttatgtgtgcatgtcagatatggagactcatcgtcgacgccacgctagacaacatgagtggatagaactgagaagctgctgcaggcacacaacgtacacagcagagacagaaggctgtgantcttgggtgatatanaatccacataccncaacacactctatntctgncntagcgggttcgagacacaccgccagcgctctgctttcttctctgtttntcntcgttgnntcgtagattnggacaccatgctacgg

SEQ ID NO: 14776 - DNA, 1781 bp, Homo sapiens
  misc_feature (1)...(1781): n = A,T,C or G
cgncagtngntgagcaggtatcgatgatagacnanctatcagagcgtgcggtgaagagacgctgtgancgtagggantgcgctagacgcgcaatactgacgagcactcacgtcgcgaatcgctcgtcgacagcgacgactcacgcctatcgtgcgtcgatgaggatgagaccagactcgcagagtgatagggaatanaacgcgcgngatttctaaaaacacgctcgcgacgtgagagcngtatattgcgcgggcagatganggaggcgctgcatatgatgtgtacgagggggcatatactagtacgtgcgagcgatcgtgtgacgtgtgtatcgacgctctcgcgagtagcttcggtagagctngcgcgttcgcttagtagagtagagacgagtctgtgtacgatacaacgctatgtcctcctntatctctactctgagagcgtatataatgtgagcgctatatatcgtcgtgttgtcataatgtgatcgatggttcgtgattagttnaagagttcagntgcgtatatatgcgtgggatgcgttgcggtggcggacgagaaggacgagactagcttgatatcgtcgtaacatgagcggtgctagtgaggatcgacgcacgccagactcgatctagcgcgcataggtatacacatntgttttagatacgcgcgggcgcgggctgcgcgtgccatggtgctgtgcttgtttgcgtcaggcgtcgngantttagttacagatacantctgcgtgcacgcaatagttcaatagtaggaatgacaagtgttgtgacagtgtacgtaatgtacgtctcgagagcaccaacagacgcgcgagactgcatgcgaganggaggcgtcanacatgcgtagtacatgtatcgcagtacgacatcacntgcgcgtnatgacagcgtatcgtggcacgacgtagacgtatgcatatagtatatagtgtcatgattagtgtggcgcgtacntcacgtcaggcnatagtcgatcttatagtgtanagtcgagntgtgtactgccacgtcantcgtgacgcagacgtgatcgatggacacagacatgtatggagtagacgaaggtcagcgtaagtgccacatagatcagctgtgataatgatagcgcgacggaggcgtcacgcgagcgaanggattnagangncgatatttctatattcanacttactaataatgatctactgagtggtgagatgtgctgcggagtcatngatcaatggatcgatcgcgagcgcgatcgcgcacacgtgctacagacaaacatcatgtctgaaacgcgtacagtnagatatgagtatctcgatgattaggcacgcgacacgcgtcgactctcgccagagtgctggagtctgcgatgataacacccgctgtctcactagccgcagctacacacagtggctacgatgtacgatctggagctcgtagctagcagtctcgcacgcgcgtcagtggctgngtgtgcggcgagcgagtagtcggtnggcgtatctgtggtgtagccacaaggctgcgcgtacgtgtngtnccgtcgacggatagtgctcaggtcgacgacgtcaccactagtatctggtagatagntcnggtgctatnatatcatcacagagtatatagcngtcgtgtgtggcgcggagacacaacatcgagtctgtgcgtctgcgncattcatatacgtgccaaacaaatactantacaanattnanaattatatnatagtcctgcagatatagantctggattgngatacagtgttagtag

SEQ ID NO: 14777 - DNA, 818 bp, Homo sapiens
  misc_feature (1)...(818): n = A,T,C or G
tctctaatttccaccgctacagtgaaatgaattccttagtcaaaaacaatgttgtatgggatatcatgatggtgaataacaaattatttaagttcactcatggtagtaccagcagaaaaattgcaaatgtaaaaggctgctcaacatgaatatgcagacgaagacctttatgatgatccactttcacttaatgaatagtaaacatattttctcctccttatgattttcttaatagaattttcttttctctttctttaagaatacagtatataattaacaaattatgcattaattgtttatttgatcagcaaagcttgcagttaagaataggctattagtagttaagtttggggatagcccagagttatatatggattttcaactgcacaggagctggtcccctaacccttgcactgttcaaggatcaacagtatttacaatactatacattttattcatattttagagtgtagtacttctactcatgaaaaataattaactataaaacagcgtcgggaaggtctttcaggagttcttccgaaagagagccttgttatcatagaagatgacaggtggctatatggtattggccttgaagaccctggaaacctttcactgggacaagatttggaaagggagaccgggtttttgatatcctgaccttacagggctagctagtgggtggttggatttaatttttaccaaaagggtaaacttaaaaatatattgattncgtggagtcggccctttcctttagtggggtaattcataacctcgttaatgactcgtgggctcggcgttaggttggggaaacggat

SEQ ID NO: 14778 - DNA, 820 bp, Homo sapiens
tttcaggtatgtcttcatcagcagtgtgaaaatggatgaatacacaggattatagaagtcaagtagacccaagacatataacctctacaacatggaaaaccaagatgcctgaatctcaagtcctgctctacacatacactggatgttattcagtcataaaaacaagtaaatactgtcatatactacaacatagataaatcttgaggacattaccacaaatgaaataaggcaatcacagaagtgcaaatactgagtgattttatttatatacagtatctaaattattcaaacttatggaagcagaaagtagaatggtggttgccaaggacttggcaaagggagaaatagggagttgctattcaatatgtataaaacttcagtcatacagaatgaaatctcctagtgatctgctatacaccattgtgcttatggttaagatactgcactgtttctttaaatatttattaagagtgtagataccatgttatgtgtgttttaccaccatagaagaaggcttcatgttaataattgctattttggatgtattgttttaaatatttattttcaactgttttctgcagtttccaaattttctattataaaaatctgttctttacataatcagaaaatgggttttttttcttttattattatactttaagttttaggggacatgtgcacattgggcaagttagttacatatgtatacatggggtctggctgggtgcgctgcccccactaacctcgtcatctagcattaggtatatctcccaaggctatccttcccccttccgactggtaaggaacagagagataaagg

SEQ ID NO: 14779 - DNA, 796 bp, Homo sapiens
cgacactgcgactggctcttatcgccaccctgttgatggaatatcgggagaatgagttcacagccgaagctgctgaagcggatcttgataacggatgagcacatgccttgccagaatgaactaacccattggagagggacgagaactgacctagttagcaagaagactataatctgagactctacaaaacatgatcgcctaactggtgacgagtatgtgtctaagatcaaaactgattagtgatgggagtcaaatagacaatgaaatacattatgctacactgacggtatacatgcatgcgaaatctagcagacgagagcaccatatgagcttatggatataacaccattctcatgactgctcctacagcgtacaccatgggtagacacttttgtgttaggagactgactgatcttctccgacatgacatgtggagacggtggcttcaatgcgacacttacctttagactgtgctgacaacaagatattgctgagatgctacgtgagcatatctgtgtactgaggctgcccatattaaatctcctactacatctgagtatgaggggtcacgcactaccttaggtcctgacctcttgaagaccgtatcggcaaatattaatatgcgacttccactaatcttgaagaatctctggctcgggcttaagattctaaacggagggggttcagaaactacgacaatctgtgctgttattaaaggagaatgctgggttgagacattctgggctgctggacaattatgcagcgctaatacactcctgtgaaaaagggggaaatt

SEQ ID NO: 14780 - DNA, 900 bp, Homo sapiens
  misc_feature (1)...(900): n = A,T,C or G
tagttgggtcttaggggaatcacattccccgatacgaaagtaatctgcatacgactcatgatagtttttttaaggtgtttaattttcacagggaagctggatgataattgtccataaagcatatgcactgggatatatatctttgtgcctcctcatcatgttatgtcaaattgtatttcctaaggtgctcaataggttggcatatataaccaaggaaaatcaatgccaagtaccaatacatgtaaatttaataccagggatctctatttacacttgaataattgggttcacttgaaaaatttaaccactatgcttttagtgtgtctcaaaaataaacatgtgctcttgaagatagattgcttccaaactttttnattatggcttttcattgcgtcttggctcttaggaatatgaacctgaagtgttcctcttatgggtccaatgggtgattaaacgtggggcaaatctccctttggggaaactagatccttatcttataaagagaaaagaaaaaagttttcaatttgtggaataatacctcttatactggtaagctttcccttaaaagggattcacccgaaaatataaaagaacgcggcctggggaaattatcctcataatccggtntgtgggtttttatattaataataggaggtgaggctatgaaaaagaacgaaggcccccacagctacgcgtggcccttatncatctgtatttttaatgtccttcattttcacaagaaattatataaccctttcgtacgcagatatgataagggtgttctttaagcagggcggggatagggtgaatntatgatagaagttcttctaaaacgngagaaagtngattacaatctataattntagttatgtggttattcatgtcaataagagcaaaggg

SEQ ID NO: 14781 - DNA, 782 bp, Homo sapiens
  misc_feature (1)...(782): n = A,T,C or G
atttagttgcttgatttttaattacaacattgacttgtaaaggatgttcccaactaaaaaataaattgaagtacatgattataaaaataaatattacaattttttctagttttactactttgaacatgtcttttctttcactgagaatgtgttaataggcgaaaatgaagttatataatagataacttgcaggatagcaaaagataaagcatatatggtctctgttgttttgcttttcatgatcacggtatccatggtcaatcatggtcagaatatcagtgagtagagtacaatataggtattaatatcttaagagagagaaagaatacccacataacttttattatatctgtggaagtgtactattttattactcagtatagctgctactcattattaatgcattactaaactttatatacctatgctattggaaaaaattataatattttattctggtataaatggggctatattacaatacgaagtttccgacaatcactgagggctatgaatcataattactgtcggttnnggggcaatacggctccccgacttaggattaacgtgctataatcttagagtggcttgctcctttataaatagttatgaggcgaagattttctataaaagaacataaaatcattgccgtgttctggtttctcacaagttcactatgaatgagaaattaatggcaacttctgttcctcattacatccgtgtcttagtgtcggtttcttacttattatgtttcttttccttttgtatgttattgcatttat

SEQ ID NO: 14782 - DNA, 873 bp, Homo sapiens
  misc_feature (1)...(873): n = A,T,C or G
aagttttaagaattgttccacttcaaattaatttaggacatgattatgagataaaggttttaatttttatagttatgtgaccgtgaaaatgccgtttctttcccgaaacgggggttaaaattgaaaagaggttattttatagcgcatttcagtatagccaaagattatgcaaatagggttatgtggtttagcttttcatccttcgggatccatggtcatcggggttagaaaatagtatattggtgtcattaaaggtgttaatattttagagcaggaaagtaattttccaaaactttttttatactgtggtaagggttcaaattttattcctaggcgagtgttgttaatctttttgtaatgcaataattaaacttgtataatacatgttctataggtaaaaagatataatatatatacgggatatatgggataaatggtttagcagttccagacatccactgaaggttttgagacatattcgctgtggataatgggggaatactgtataccttacttgagataagctgcatatgaattatagagctgtttgtataaatgattataaattttatgtgctgaaagttgtaacaaataaaataaaattaaaataatgtccatttttattattattagaaatgctgctaattggttggtaaaaattagttgttgcctctgttacttataccaattagcagaatttggaatctgatattttgcaataattttattatactttaataataataaaagtaataggcaatcataattgttaatatttatttagtgtttttaagagtaatagcaataaacgtggttangcgtgccaggctctcttctttctctctttattcgtttgtattaaggatataggac

SEQ ID NO: 14783 - DNA, 1313 bp, Homo sapiens
  misc_feature (1)...(1313): n = A,T,C or G
aatgtctacgtcgtcgntcatcacctatagtctgagantcactagatctagccatgagttantcgtaaatctatgtttacatgcgcagaatagataatgataaggattctgatcagtactctgatgctatcatatatcaagggtaggtcacngttggatncgtgatcggtcgtatcgtcgcgagagcgactcgtatcgcgtcgacgtatagatgatattcgatgancgaganantgacaggagtatcagcgtaacattgtgcggaaatatacaatnaatagacagcgcgaatagctccacggtgcgtgagagtagacaccggatggatcgcgcgtctgattcgtgagtggtcagttctcgtgtatggcgctagtagataatacgtacattcacttggtacgtgcggtatctcgaaattatgagataatattaacgctgaataatacgcgccgcgcgcgtgaacgcggattctctgtacatagatgcgccgatgcgaaccgctcatggcctctcagatgtgctagctcttagtgatcgtagacgtgtangattatcgtacgtcgtagtagcaacagcctgattctcggtcgaccgagcggacaaattaaatctaggcgtgtcggtcagcgcgtctgccgccatgcgatcccatgcaccagcagcacatgcgtaacatcgtatatttgacgcagagcgccatgttagagatgattaatatgtaatgatgggatgagtgattatatagggattagaattgagtgcatgcaggtgcaagtgcatttatgggggaattaataggcatcaaacagtgtggtagacttcgtgtagaggagtctgtgtacgaacggtggtcgccgctcctacgtgcagcgcggtatctaatcgcagatgatgccaagacgtgttcgagttagcgaatgtataagtagagatgtgcagtgccaggttcgttgatggtatcaattatcgcgtcgcgcggatagtttataatatgtaagattcctaatgtataacgttataaatgtctgctgtttaaggagtgacgatgcagaaaattggttgttctgttattagtatgtaataactgtctacttatgggatgtcgattacagtgcgtctaatctctggtggcatttgtgattgaaccattgctatatgatcggacgatatccgcgtgatgataccttagaatagtatgcggattgttctatttgtccatttgattcaatatttgttgtacatgttttcgctcgcaaccgtgttgttcgtctctcttgtgccgcataatcgcgtcgtaaatatatatatagaga

SEQ ID NO: 14784 - DNA, 1523 bp, Homo sapiens
  misc_feature (1)...(1523): n = A,T,C or G
ggcngatgtgatcgcattgtgtanaaatcgtacgtcaggntcgantcctcaacatctctgcgctgcgcgcgatctcattcgacgattgctccgcttcgacgctcgcactccggtctattctactcagacggcgcagagtatcgcgtgtggctgcgctncgggtgctacgcccgcgacacgtcagcgcgatcgagaggacggtggatgctcctgtaggcagtagcgtgtcgcggtgatctgcgcgcttgagccggactcacgcgtctnatcggcacgcatctggcgtcgtcgatgagacgactactgagtcgtcagcgtgtctcgtacgctacgctgcgtgtcgtcaattagtgctgcctccgcacgcgcgtgccgctcgcggtgtactcggcgtacgatattagcggagtgaacacgcgtgagggcgctctcgcgatacacngtgcgtnaagctgacgttttgcagtgtgcntacgcggtgagcgtgtgccactcaacacgtcgttgtgcgctgcgcgcagtacgaagaactcgcagaggtcgcgatngatagcgatcatcgtcgcggcgatagatgtcgtaggtgctgtgcactacttttatccctggtagcgagccgtcgcgctctcttgataattggtgttttgttgttcccgagtgctatctacactacccgcactcgtgtcactncgttgtgcagtatgctcgtggtgatgtggtctntgctcgtcctcggtccctcgtggcgtgctactccacgcgacgcacacgtgtagtgtacgtcacgaatctgcgtcggcgtgtggtcggtcatgggctgttcgtcgatctatcatcnttctgttgcaggctgcgagctgtgagcgagagcgccgcagtcaccgtcatgcgngttcgagcatctcgcgtggncgtgatgggactagaagtagtagatctacagtccggacggtccggtccgtggcgtatcacggtcgatcgtcgtcttactgaggccggctgcacgctcgcgctcgtgcgtcactgatgcacgtgcaaccgtgtatggatcgcgcctggtgcggggcttacgccgcgcacgtccagtcgcccgtttccaactcgcctcatgcgcatgtcacttgccgccgaccgtaacgcgcgatgagtgacgagctgtcgcacagtcttctctctgcgctccatgactgcacgacgngccggctggtcgntggcgtagtcgcgcctcgcagntatgctaccacgatctcgntccagtgacgatgcgtgtgtggcgnggaacgagcgaagcgatactgatagctaggacgtctcagcgcatagacgcgtcagatcgcgacgtcgagtganttatcggtgtcctaaccanctgtcgcgaaaaatcgagacngncaccctacgggtgtgttcgtcggcgacccaaaacacgtatatggtctacanatgctacncnctcttacacaactacacatantggatnattagtgctgtatagtcatgtantntgagagtctacgttgtag

SEQ ID NO: 14785 - DNA, 605 bp, Homo sapiens
  misc_feature (1)...(605): n = A,T,C or G
aagccaaacccacaccaaaacatgaaccgggggatggaatttattgctcctgtatcagctcccaccaaatctggtgccccgtggcattttctttctcaaggtcccacggatgcccagagagcagtcagaatcaggccaggcaccaggatgggcttgtcctcagatccagttgtcggcaccttgtcttccagttacctagatctgctaactctctcttacaagcctgggaggacagtgacaagttcatacctaaacgtaagctccgaagtgtcttagcacctccaagtttaaggaaacccacgggatgctctgnaacttccatgaaaatgaagattggagggattgttgcattcttgcatgcctggatgtttcatattctctgaatgtccagcatgaaactgatctgatcccatgcttttttgccaacttgattaatgtaaagataaaagaagtgccccttacaaagatgctctgaaagcaccttctcccttggattaatgataactaatggtattaagagaacataaggcacttttacanaataagagctcacctaaggggatcctgtatgggaattctccgtgcaaaggccttntcggagctgg

SEQ ID NO: 14786 - DNA, 547 bp, Homo sapiens
atatttagaaattattacagtaactttttctggacagacaagaacctaagtctgaacatctaaaaggctcacaaagaatcaagcaaatttattgaaggagaccaatacttattagacctatcttcgtgaactgaagatcgagaaaaaaattccaagaggcatttggacagaaaagcatgttgactccacaggaacaaaaatcaaactgcattcaaaattctcctctgcaatgtctaatagcaggagaaataaaatagtaccaacagagcttcaagggaaaaagactgcattctacgaaacctatatttaggaagttgttcaagtgaaagggtaatggaagaaatgttcttagatgtgcaactcactgttataaccttctaaacaaagccctcgaagacctgatttaactgacagtgaatgaatctaaatacagagctgcgggatgtgagagtcacacctcggaccactgaaccaagtttaaagaaaaattaagtccagataatcggtgtacctataattattaaacaaaataaaagtctaatgccgc

SEQ ID NO: 14787 - DNA, 1235 bp, Homo sapiens
  misc_feature (1)...(1235): n = A,T,C or G
atcattgtcgacngcatctccgacaatgtatcggtgatagagacgtgatgtcgatttataaatntanctctcgcttgtctanatacaactctctgcatanactcagtagattcatctaattgcaggctagtacgcaaanatcgtngattcgantcgcggcagactnctctacgntcgatcttgagtctgtgtactagcagatacgtgtggcgatctgtctatatacgctcgtcgccggattcgatgcagacaagtcggatctcantccgcgctantcaacacatacttccgatggcgcgatctatgacgcagcgtgcgtacgacttcactctccactcgtgctgcacggcgcgtagatacggattaagtcacgtcgancaaataggctcactcagatcacgtgtgccttgacgacattagtnatatcaacgacgccaacgacgcgcgttgcgtcgcgatgcgctagatagttatacgcgcggcgagcgtagctgagattctggactgataataagagcttgagcacgcgatatgtgagtaacantgcacggacgagcttttcatccgatgttttcaggctgttctgatgatgagtctgactcgacagtcgtggagcagtgtgatcaatctngtataagtanataancgcgtcagtacgtttatttgatagatntctcactattgcgtgcgttgtgtaacaccttgctctaactacgtaatcgaatggcagtaggtcatatcggcggtcaaaatcattttcgttctagatcagccggctatacaaccgccgatattaaccgactccgacttggatccatccgggcaggcgcctagatctcgctttagggcgcatttaaatgataatacgtggcttgtggtaattcaggctgtntcatcacggagtgttagttggtctttctttatagcctagtgctaaatagcgcaagggtccgtatcctgcgcaatttcatttgatacgcgagttcgttgtataatagggtcgcccccggctgcctgttacgggtcttgatcgtagacaatcacttgatggcggtagacaatagtacctcgtgcggtcaatatctcctcccagagacgccttgggccaggagataacattgattgaatctctggtggatatgcttctgtttttccttgttaatatatccttgtggttaccacgtagcgttccatgtctttacttatcaacttgccgcctccatattatatgtgag

SEQ ID NO: 14788 - DNA, 1384 bp, Homo sapiens
  misc_feature (1)...(1384): n = A,T,C or G
gtatgttattgcgattcattgntaatcgtgttatcacgtgaagtcgctgacttctcaggcggcgcgaagatgatgagcgtatatctcantntgcgtttgccttcgcgactaatctgatcggntgtgtgctagctggcgcacggcggcgctcggataatcacgccgcatctcataatcgacgtgngtggcgttagtcagtatgcgtggccgatcggagagagcagacatgctcgaatcacggacatcctatctctcgcgcgcaatcgcgagagatgagcgantcnatattgtactatcgcgatggcggtcgtcgtgcaactgagtgacgtacgtgctgcgtatgttagagangtggtcgcgctgtaccttcgacgcgtgcgtcattgtacgcgcgatctcatagtgtagtccgcgtgtcatttctctctagttgtacatcgtgtgnttcgagtaatgtnantgcgagagcggggcagactgaagacgtcgcagcgtgtgctcgcttgttctaataatacataatcgcgtactcgacgctgctcagcctcgcgacgtcatgtaccgtagcagtttgatgagctgtggattctgacctcccctgtcgtcactcgtatagttattctgatattattgcgcgtgtaatttgantacgctcaacagtagtcgcgcagtgatagcgctctctcgtctnccgggtcctacacatctcacctctcatgatcgggtgcggcagcactgttgctctgtgattgtcttctgtcgtcgatgcgtgtacgattgtagtgagtcgatgcgccctgcctccacgtatgtcgactgtgggtgagtcatctctacgcacgtatgtcgttgcanctactgtgactagtctacggtacgcctagtangacgtcgatngacataaggcatatcttgatgatgtgctgcggcgcacggcgtcgtcacgccgagttgtgccacgaagtgaagtgctagcatgacactcgaattattatatcattagtatcatatctacaacatgcattatgacccgtgtgcggaaggcgccgaggccccgttcgttaagctcgccgttgacatatacaattcttgctaggcgtgagcgttgctcctgagactcacacgtacgcctgtgcgctaatgagggagcaagtgctacaactctaggtgtctccgttctgggtggacgaagtcgagacgcagcgtaagagttacaggttcgtgacgataanatccgtctgctcgctcgtctcctactcatatatgaaagagcactgttagccagtctgntacgcggntctcgagctctactttgtggttctgtattctcagtttatcactatctatgtcataagccagactgattggcggagtcctctgctgc

SEQ ID NO: 14789 - DNA, 826 bp, Homo sapiens
actgtggactcgatgctagacaaatagctactacgcgtgacgtgtcttgccctaggcccactgctgcttagagccctggagaccaccactgcatggctactgatttatggcccataaatcgctcacgaccatacggcgcagtgctgattgaagactgcctgtatatgagacgacatgccttgtatatgaggagggcggtgatcgtccatagtaagttgactttgaccaattgatagctgtcgcatgatattgatcctcttacggaatcaactatattgtgctgaagagcttaacattgaccattatagcggcgttaggccttggaaacacttggaaacggtggagaagctccatgagcaactgcctcacgacctgatcgataacataaatgatgtggagtcttctcttgttacccacaggaacaacgaaccatgttttgatccaatggggaggtccaacaagaagtgggttctatactatgagcagaggtgatccgctctggggggaggcatataaggatcttcgctgctatcacgaggtcataacagagccgatttatttggtcactgctcggtaccctggtgccggactgaccactattgcttgctgactcgcaacaaacccttgaattgacaaaagtattctctcataatgaattcactgctgtgggaactgaatgcattgtggccggctttggattaccaaaatgggtatctataatttttcgtggcgatgggctgatctgcccctggcgccctcagggatcaattctggacgttaccaacctttgccttatatcgaagtatacacctggcctatcgcaggg

SEQ ID NO: 14790 - DNA, 593 bp, Homo sapiens
  misc_feature (1)...(593): n = A,T,C or G
aaggcttttggaaagaactgaacttcaatatggattctgagtgtctccactttatgctgccttaaaggctatgagatatgatgctggctgcgagtatggatcaatagagcttacagcccggaggacaggaactaaatactgggaaacaagtgaacattgacttctctaagaatgtatttactcatattctatgcatcttctgctgtgctttcaaggagacgaacataactgtaaagaccagggatgtcgataagtacatcaactggacagtactatgctaactgtgctctgagatatgatctgagaagtgtctaatttttagacacancatccttattgaagggcctccttcaatgaatgtcacagcatgtagtgagggctgtcaacatcatgcttacctgaccaacctacttataaaatcacaggaaagcagcgcgtagatgaaacgtggctttcaaaacgatgaattctagagtcaaagagtgttcgaatgttgcttctagatgactaatataactgaggcagtggataccgtttgaatatctcccctgtacttgggaactcaaggagaaatggttatgaccagtagttat

SEQ ID NO: 14791 - DNA, 1832 bp, Homo sapiens
  misc_feature (1)...(1832): n = A,T,C or G
attggcgtgtggtgatatcatatatagcagtccncaactcatctcgtgtgctcntacgcgcgacgctagttcgtgtgcgtcgtctggtaccctgcgagcgagctcctactcacnacacatacntcaacgcgttgnccgcgcgcttatgatcgtggcgtacaccgcgctagagacgacacaacgcgtgcgattagtatatacacagcacgcggtctctacacagagataatcgctgatcgatgtcgaatgtaaatttatcaacatgagctcgtacatacgtgtcggcgggacgtggcggagactggaagaagacgcgagatacggagcngacgagcagacgtcacatacggttgatgtatataggagacaganacgacgagcgagcggctgctgcacaggtaatanctacaacacntaatacgcgagtacgtacggcgtccgtcgtgagcccgctatagtgtaataatatcgtgcagtggccgagaacgcgctgagcacagctgncacacatcatacgacgagtagagctancgtgcgcgctcntctcacaacactacgatcgtgatcgctgtgatcgagtcancgcgatcgcgtatagtcgcgtgcngcgagganttcgatagagcanatatactatgaaatcacgtgcgactgactgtgtgtatactatatntnagcgactatgcagagtacagacangggagtagagtatgatatcgcagtgcgtagtcatcatagtgtcantcatgtgcgatcgtagcggcgtacacatntgtacgcgtgtgatganganatnactacacggaatatgacnaagtntaganatagtacgactgggcgacagatactaacgtacagtgcatgagtgtncatgngtgagtngcgtcgatntanctcacaacttgcgngcgagcggtatgatcaacgtgacgtactgtcatcgacacgcagtcgancactgaatacacatgcnaccgnantgcgctcggtantacaactaggtagtacgcagagtgtacggatcgtacgagcttagatctaaatgctagctcnagantgagcgcgaccngggtatactgtatcaacgatgctgtacgntctngncgcatcacgcacattctcacgagcaggcgcggcttcatctgatggtgtgangacctcctgatacgcatncgctgagctctccaggatgacactgtgtgaactagtnactgtcagcaagagcnctggtccataatacttgcctctcgtatgcgacgtcagtgcgatggcgcaggaggtattatgtcgcgtgcagaccgtcatgcgntcagtactntntcatntcgtctncgtgcangcacgaacacagngggatcaccgtgagtatcgcagtatcagacgggtggatcgaatatgtactatgacatgcgtantgctctncttctccgtacatgcttcnccgcctgtagtcacgagtgangcaatatgagacgcgacgacttgtccgagcacgcgcggcctcgcgcagcagctatctcgacagtatccatatgtactgcgtatatatgagacggagtagacgacnatctacattagatgtaaatacgatgtctgctgtgatngactcgattgacatacggctgctcgatgtacatcagcatactctactntgctgcatcgatctataagacatctcgtcngttangagttctgcgtcgantcngagtntatttgcgcagtagatcgtntantgagnctatctntgcntctagattatgctctgtgtncgcacgtgctcncnatatcctgtgtgtngctatcgttgacatcacgtagaggacacggactaa

SEQ ID NO: 14792 - DNA, 795 bp, Homo sapiens
  misc_feature (1)...(795): n = A,T,C or G
ggggatgcgttgtaacagatttgtttttcatcgagcggtgcgatgggctacttctatatgatccataacagggggtgaatttatgttgtcggttacgagtatagtccgggtatagcttactgccccggtgggcttgttactaaaattcgtccgtcaagggagccgtgtcttatcttggcaatggatgactcctctattagagcctcttccgctgtccggtcacgctcatggccagaaaggtctattccccagtttgttttctagggcagcgaggggtcagcgactatctatcttggtctttacgcatatgatgtgtgaagtgttttacttctatacgcgaacatcctcattgggtgtgcctccttcaatcgatgttacagcatgtaatgaggacagttcacagccaaatttctctgtacaactcttgttattaaatcacagaaaagcagtgcgttgataagactggctttttatagcgatgcattctatgagtaaaaagaatgtttgaatcttgataatcttgatgactagactatccctgagttaattggacatctctttgcattattttgcctcatacctgggtactcgcaggagaaaatggctagtgtcaagtctagttagttattaatctcataatatcttagatagcaaactatgtaaagatactgttctgtatagctatatgtatatagtatgagagcgtattaatgtataaagaatganctggttgccgaccaacctttttgtttttttttataaattaatttctactagtaataaatttaactattt

SEQ ID NO: 14793 - DNA, 1182 bp, Homo sapiens
  misc_feature (1)...(1182): n = A,T,C or G
atagctctcggtctacccatctccgtccacgtcttcacgcactaaccgacccgccaccacggtccatcacctcgcccgtcgcggagtgtgcatcgcgacactagcgtggaagcgaagtacgtcactgctcacagtggtcccgtaatcactccctgtctacgtgtctcgagcctgagagacttcgtcttcgccgacccatagngttggtaacgcgaacaacgttaatgacgtgtgctagtcaccagnaacatccctcccatgtgtcaaatacagtagtctgggtcaagggcagtcctctcctagaattcgtttcgcatgtctcatgtactacgaccgtgtccactaaaggtctgagccttcggcactgcttagatgttgtaagtagtgggttgagacgagggggtcgcgacgcgcccgagcggtgatatatggcgaacgtccgcgctgtgtcgggaagaagtagtgaatgagcagcggacgaccatcgagccccggcacgggcacttcatgggaatctgggttgtgaataggaggggtagtgttcacgtagcgtcaggccggggtactggatgtcggaatagagagttgtgtttctaccgacgtggggtgtatgtataattnacagtgaggagggcatacgcatgcatgggggcgccgagagcccgcacatgactcaaccagccacacccattctcatatctcaacagcagaccccacccgtctgtcccacgcgtcacatatatattacatctttttacgaaaataaaataaaaacacatccacaacacccccgcattccactttcttatcatgacccttcctttacataatctcgccttcgtccttatctttattaatatcttgtttattattntagtatttcactttctcctcnattaaatangggccaccgcgtcattgttagttctcccactctcgcgtctctgtgtntggcctcctgcacactccctccncctcccctccccgctccncctnngccnccncnctcgcccccctcatgacccccantnntannnctccccnccacgancctannnngccggggggcccccacgcnccccnnnnncccccnnnaaaanaaaannnnnnncnnnnnnnntnnnantnngaaatananaatgtgaangtttattntaattattataatatatgattattaga

SEQ ID NO: 14794 - DNA, 812 bp, Homo sapiens
tatatttccaccgctacacaccaggctgctacaaacaccgtgtctttatctacccgaaactttgttctcagcttccttctcccctgacattctcagtacctctctattcatgaaatcctacccatttattaaggaccagctaaagaagaacatccttgatgaaacctttcttgggtctcttctcctcaacagaatctaacttccttgagatgagagaccatgttttaagtttttccctcttctgagcccacatgacttggacaagaaccatggcaatttttctgaagaaaataaaaggaagcagtgcatttaattgtataggaattcattacatgtatacatatgggtgagcacactcacatgcagatgcacacagacatgaatatgatttcatattcgagttatgctatgcttagaccaagctggtatttcaagagagtcaatttccagagaaaacttaaaaccttagaatcgctgcattgaccttgttctcatgtatttaatgtgtgtaaaagggtagaggaaaaacggatctgatcaaagcccaacatagcccactgcgggctgccaaaaatagcctctggccttgcatttcgagaacacagacctaagctatcatccctcctctcttgatggttgggggagattgtacgtggctataagctcaggacactgttctctgtttaaatgcacataatacctttttctaaagggtattggatcgcattatgttaaatgacttgaaatctttagggatctcactacatccccattcttcccgctcctcttttgattgttatctcgctactcca

SEQ ID NO: 14795 - DNA, 817 bp, Homo sapiens
  misc_feature (1)...(817): n = A,T,C or G
cttgcactcatgtgtaaagcaggacagtgagtgagtccaaaaagatctcatggtgagaagggaagccaaaaatgaaacccaaggaagcctgtttaccaccctacagtgggagggaacccaatcctttgggttccaatcctcttgggaccttctggggaaccaatcctcttgttttctgtgaaagcaagaacttattcacccngtatggaaggcattaatctattcaagagggatctgcttcatgacccaaacacctcccatgaggccctacctcccaacactaccacattggtccacatgggaagcttattcaaaacaagcagagaaaaatgactataagacacatgcacacgtatgtttattgcggcactattcacaatataaagacttggaaccaacccaaatgtccaacaatgatagactggattaagaaaatgtggcacatatacaccatggaatactatgcagccataaaaaatgatgagttcatgtcctttgtagggacatggacgaagatggaaaccatcattctcagcaaactatcccaaggacaaaaaaccaaacaccgcatattctcactcataggtgggaactgaacaatgagaacatatggacacaggaagcagaacatcagacaccggggcctgttgtgaggtggggggagggaggagggatagcatttggagatatacctaatgttaaatgatgagttactgggtacagcacaccaacacggcacatgtatacatatgtaactaacctgcacgttgtgcacatgtaccctaaaacttaaagtataataaaaaacgatcggcca

SEQ ID NO: 14796 - DNA, 927 bp, Homo sapiens
  misc_feature (1)...(927): n = A,T,C or G
gcataccgcgaatggcctaagcctcattaatagagtactcataattttaatacgacgaaatagtcattaaagttatttgtatgataagaatagcgtagaggagccttattctatttgtttatcagagaatactttcactgatggatatcacacctatggcacctaaaacgtaagaatgtgagatatactattgtgtggaactataatgtgtgataatagtctgaatcgcacgcattatataataccacatgattaataagagagtatacganaccggatcttcgaattactacgtatgtatagtgtgtctaaccatacgcctcggtgttcaccactaatgtactaggaatcctacctatgagtaggtagaatagcagtcagcgtaattagaagaataaatacataacgacttatgacggaaagacatagtatctacagaactgtaatgacattcctctttataaactatatataatgtacctgactaatactcgtaatgtagacgagtctatgattagtgtttgagctttatgaaacgtattgttccatctatgtatctgccaagaactcacctgaccaaccgaactgtgacagctaacagtcagtgctatctgatgagtcgtatatagtatatctatctatacgattattcgagtgcctattacgaactcgaggtggtgatatgtgctacttatagcgaagaggatgtatataaggttatagagacatcaggcgaatccagtagtattactagtggagtagaacgaacccagtacaactgattagtctcaatcaatcattggattatcgaatgagatagcaaggtaatcatatcatagaagaaagaaaagangaataatgaatccactaccgaagtctagtactatgtgctgtcattatggaataagtacnagacgagcctcaggg

SEQ ID NO: 14797 - DNA, 222 bp, Homo sapiens
aacttggaagaaggtagtttgggagctactggccaccatcttgtgattacaagggtagagcttaccggataatgacaccaacatgtggaggaaagtaaggccaaatcaagaaacagagagaaccctatcgtcaataacaacatctgctcttctaaatccagccacacaacagaccgtatacacccctagacttttctgttatatgaactaaataaaccccga

SEQ ID NO: 14798 - DNA, 623 bp, Homo sapiens
tcctctacatacataacagtggtgtctcagaatccagacaatatgctgcctttgtttagtaacatatgttccaagtatcaactgagaacagcctggtctgccaaaaagctcaaggtttcatttgacaaacttataaatgtgtaacatacatcctccaaatatctattctatctttgtcctacaagtgactaagacaaggtcccatagaacatctatggcaaagctacagaagcagcacactaatattaagttgttcttcctccaaaccactcttaactacataccaagccaaccaaaagaggtgacattcttccttaagtaggccacataagtactgactatcctaaaagcctccactgactcatgacttctccaaatatatattcttaatataaggtgcttaagtattaggcaagatttttatttttgagccgcttggtcccgaaccggttaggacatttaaaataattctttacacatgaccaacactcttcaaaagacatacgtgtggccaacaagcacatgaaaaaaaggttatatctgatcattacagagatgccaatcaaaccctgagaatacctctcacaccaggcagagtggctattattaaaagccaaaaatcc

SEQ ID NO: 14799 - DNA, 795 bp, Homo sapiens
  misc_feature (1)...(795): n = A,T,C or G
atcctgactccaagtggtaagattcttgctggtttcttcctctgagaaagaggaccctgccatgacttccctatggcctctcttggacaccatatcttgaggttcatcatgaagatttcatatgtgcataattgcgaggatagacctacctacttggcatcggggggggctctaggaggacatacattgtacattattaccctgagaggagctgttgatattatcaatatagattttatccaaacacctataagatacatattctaaatgagactggagactagagttgagagacttgctctataggattaatttgctgtatgaagtgttgtctgtgaacaccgatgaccacgatacctactgcgtatgaacttttgatgcactacgattgtatgtgtttggatacatattttacttggagatctgagacaggggctaagaaccaaggatccctagcactcagaatgacacagacctgacatgatacgggtgcacggaactgacctcagattaaaccatgcttaaaattggaacctttaggagcttctctnacggtgctcacccactagcggtacaacaaatcttatggcaatattaatggctcaaatggaacattaacagtcaggactctttgtggaccctcctttttggcaaaaaaggggaactaaaggtaggctatttatcttcctacccaaaccctcagcaggaaagccttgggaaccatgccttttaaaagaaaagtaactaaatctctggttgaaagaggaaattgaaactatatagaaggcccaactt

SEQ ID NO: 14800 - DNA, 826 bp, Homo sapiens
caatgaagaaatccagcgggtctcctcatggaaacaggcctgcaggcaattgtggtacaatgagatcactgtggaagtctgaggaaggaggcagtgggagtccgcaggaagaaattccaaagtccacctgggagagttgaagacagcgtcatacgggtgttgaagcgtcatctcaaacctgaatatggatgaggaggagtttttctggggcagaagggtgtaggagtagtaggataagccattcaagtaaagagcacaaaagtgaaaaaccatggaggcatatcgaaagcactgtgtcttcagggaatttgaagattttgcaaaggtagaaacaaggtatgaagaaaagaatactactaactagcaactatactactgttgctcctactgtggctattgctgttaccaccaccactgcaatttttaaaaagaaactagtttttagagcagttttaggttcacaaaaaaatttaggcggcatacagatttccatatagtcccacccctacacatgcataacctccttcattacccgcatgcccaccagtgtgctacaactgttacaactcattaacttacattgacacattataatcactcatagcccatagtttacattagggctctctctaggtgttactcattctatgggtttggacaaatgtataatggcatgtattcatcatttctgtaccatacagagaattttcatggccctaaacattttaagtgctctgcctattcatcactcctttccccaggtcctggaacccatgatctttttactcttttattatcaattccgagtgtatatagttggatcacc

SEQ ID NO: 14801 - DNA, 151 bp, Homo sapiens
ttccctactttcaggtcaattcatattttacttaaatctataatggggattaaggaagcaggagtaactacctctacaaaaacccaaaggagctctttttttcaggctctcagaagaggaaagttaatcacgatcttgaaataaaacaaga

SEQ ID NO: 14802 - DNA, 800 bp, Homo sapiens
  misc_feature (1)...(800): n = A,T,C or G
ctgtgcaatcattgcacaccctcaatgaccagatttcccattttattgtcaccaagtcgaaggcactggaggaggacaaagacccttttctacccactgagaaggagactctgaagagttccatgatattgatgaggcacctcttaatggatgctcagaatggattcccggcttaagacaaaagaagttggaaactcactgattccaagaaagtggtgcaagaaggaaggtggtgactgttgtgggcatgacagcctcccctcttgctcagaatggttcacccatcctgctctttctttccccgctgcttcttgactccctgggtcacagctcagctactagaaacaatgtcccatccaccccctccaaagcccagagtccagggtcctcaccctagttcaccaaaaccccagacccgccctcactcgtgatgcttaagtcctgtcatgactcagacaggcattggagagatgataaaattcacagtccgaggacattccggagacttgctgccttacttccaaagggcaatgattgtcattatgctaactgctttcctggtcaaaaacatgtgtntttattattattattattattattattatactttaagttttaggggacatgtgcacaatgtgcaggtttgttacatatgtatacatgtgccctgttggtgtgctgcacccttaactggtcatttaccattgggatatctcctaatgctatccctccccctccccccacccaaaanagncctagagtgaagtgttccccccctgtggcctgggtcccattggcaa

SEQ ID NO: 14803 - DNA, 207 bp, Homo sapiens
ggaggcttggcacaccctccactcccagtaacagctggggcagaaaagggagatgtggtgaatcctgggagccatatgtacatcttgggagatgtgtacattagggactcagaaaagcatttgcatataaaacaaagaaatagcatgtttttagtcctctatttgttgttgttgctcagaggaaaataaatcagaaataaagggcga

SEQ ID NO: 14804 - DNA, 395 bp, Homo sapiens
atggagtttcactcttgttgcccaggctggagtcaatggcacagtctcgactcactgcaccctccgcctcccaggttcaaatgagtctcctgtctcagcctcctgagtagctgggattgcagattggccttcttctctttctctacaggcagcaaagaatatgccatctacagccttgcttagcaacctcaggagaaagggagctcttctttctctagagtccatagtgcaatcccagagaagcgttgattagctgtgctagggctccatgcccatccctgtatccagagggacatgttctacaactttcgggcaaattaaaaacaacacatttttgaagaggacagtatagtatgctgggcaaactaaataaataaaaattaatccccgatgcg

SEQ ID NO: 14805 - DNA, 838 bp, Homo sapiens
tgctaccttaagattaggcctacaaagcttgaagtgtaaaattcttgacatcattagagaaaattaaaatctgaaacaaaaatttatggacactatcctgctctcaaagattctatgtatttcctttatttttaaaaaaacatgcattttaatccacaaatactgatatcaatggataaccacagcatctacatgcatatggttttaaaaatggaaaatgatgtgccataactctgatatttagagaggtaacccttttaataatgcaacttgttatatctcataagaggctttaataaaggtgactctcatatctctgatttgggaggataaccactgacatcctgatacattaaacacatgatgcggaccgtttgcccttttgtgagggttaatacatcgatcctcaacacactgactaacatgcgcccgatccgatcacgatgtatttagacggatacacccagctccacaagcgggtaaaataagtatttcatatgaatcatgccgataatactaataaacaataatgtgagcgacgagtgcaattctacggccaatacctcgtatatctgccgaatttactgcattaatttcaatagatttccaccttcctaacctatcactattatagcctacttttattcctaagcctgttgtatcctcgcatgtcttcttaatgatccccgcccgccaccttgaaagccaacactgttatctttatagatagtgcctgagcagtaatcagagaaccatttctccttcattattacatgaatactatggtacaatcaataagaaggtcaactagttatataataacgagcgcaacctgcag

SEQ ID NO: 14806 - DNA, 1746 bp, Homo sapiens
  misc_feature (1)...(1746): n = A,T,C or G
atctcgctactacactatgatatataatnatacagctcacgagcactgcagaagngtattgttcactatancagctcgagatgcagatcnactataattcatcatagtagagaataggtaacgtagcctgcctcgtgaaataataatacttcnactcacgtcgtnatcgacgacattgangtcatgctaatatatatcaccgaacctgattcgtatgcgcgatatactgatcgattctatatatatgtaagactantcagtatgtacgactacagctaagncattcgtcgtcggtctcattagatacttactcctgtacgaatgtatgcctcacacatcatacgaactgatcgatgctcatacgcttcgtcctcttactctctatcacagctccacagactangatcgnatcagnaagcgacagagcgctgtatacaattctcgtcagcgataatctaatcagtatatccattctgctggtngacanaccctagttactcagatgtagtcatgtgctcatacaccagtcacgtgtacaattctctacgtcccactatcgaataagtcattgagtcgactgtatgtatatgagcgtacgcacatcagaagtctcatatcctcaaactacatcgatactccatgatgcacacatacgantcgatatcacctgagtgcagaatgtagtangntagtacgcaagctactgatttcatctattctctcacgtgatgatatcatatgcaatatatatactctagaattctgaatatgtagcatcattatattcgactataacgagataacatcatcacagtnacaacacacgataatatatatctgacatatacgcagtccaacatcaacataactaactacaacaattattactacactaacgagtaatcacttgatgtatcacatatactatactaatcatatgtgatcaacgtctctactgcctctaatcataatctagccattacaccgtatacacactagagcgcgctgcagtatattcaantagtcgcggcttgcgcgcactcgatatgtgctgtgactattatatgttgtcgtgtngttgctggcggtactagccagntccgncggagataaatcattacagagcagatacaaattatgtatcactcacctatacttatactctcacgcacanaacgaaccatctttgatttaatatataaactatacaagtgatctnaaccgtgctaatgagcaacgatgacgagcattcctcactccgccngatactcccctaagcgagatcgacatatgagctcgtcctatcgcgtatacaagatcatntcacctcgactgaacgctacgttatattctgatacagatcttatctntcgcaggattatttctaatcgtatcgtacatataagtctctcagctacaacgccactgatacagttgatgtgtatatgntatacngcacagtctctattgtggatctcagtatcgccgcctcctcacgatattaactgtcacatcttgatccganctctcatacactatgcaattacactatatagatcanctcatagcgcatgacgtcgcgcagatcattagcgactcgtcacatatgtaccgtcacgncgnatcaatgagtatggaactcttcgcgcgatcgcacgtgctgtagtaagtaatcgtatacatatcagattgcacgatgacatantnactgatgagtacnacgatatattgcaacagcgatcaagg

SEQ ID NO: 14807 - DNA, 787 bp, Homo sapiens
tgagatagatggtgttagggcctgtaatcatgtattagatgcaatacaaacctatttggaccaacaaacccagaagtaacctggccaggcgcagtgggatgcacctgtgattgaaacacagtgggaggatctcttgatgccaagagtgcaagatcagcctgggcatcataagcagtggcccggacaatgcttaggatgaacagatgatgagtgacaatgcgagatgaactgggacaaggatcccgggggttgtgaaatgagttaataggaaggaaagtagactgagggtgtgcgaggaccatactagcttaattggaagcttatttttgaagatgagagggataaagatttaatataagaagtgattaatagcattgactatattgatgatggtaaagcctagtggcagtgtgaaggagttaagagtattgttggcgttgataggtatagcgtgcttgaaaattaatgacaaataaattaatacttttttaatttacgttattgtgccttaatcattttatctttgtagaatttatacattatgagatttgatagtgtagtaagaggttgagttgatttcatttatatataatatgatagtaattgaaaaaatgagtaaatagattatttggaaatgttagtctattttggacataataacgtctttgcgttattggattatataataaagaataagaagtgcacaatcttaacatgaagatctatactacgattacttacatcaaattatgacgtattataaacggggtatatatccaatatttta

SEQ ID NO: 14808 - DNA, 390 bp, Homo sapiens
  misc_feature (1)...(390): n = A,T,C or G
caattntnatatcttactctnggaacntncntgcctnngcngccaacaagaaaactatggaacncanaaacattgtncttgactgncctgatggcggancnatccctnaccnntacaagncntgntcacggacctgctcnngtctanacntatgcnanctatatgnntaccttcatagtgcaggtnaangctgncntnnccttcccagtnnnaacangcntggtntttattttatnggtgaggaaaaatnatcntttaaaaantgagaataaactactcnntgtgagantnactcatcancaatgagttctcattgagaggaattttgttctnttgnngacnggatntnaanaanntncacaantnggacaagcaaaaataanccgtgga

SEQ ID NO: 14809 - DNA, 371 bp, Homo sapiens
  misc_feature (1)...(371): n = A,T,C or G
ccgctcgcctcataatatacccatgatgcgcttaactcctgcttttgtgtagctctggtgcttccgctcctttctttagtgtgtcttcttatgctatcgtctttcgtccttcctcctctgccccctaccatgcttaccgcgcatagttgtaggtcttggtctgtctccgtcctgccgcgcctgcgcgtcttgcctctttgctgtccctccctgttgtgtatggtcgttgttntataaatttttacactcccatcctttcgtcttctctctctctcttcacgtccttctctcttatttcactcctttctcctctcctctctcctctcancccncccttccncncctgtaaaacngctggccagtgaacgcgc

SEQ ID NO: 14810 - DNA, 805 bp, Homo sapiens
  misc_feature (1)...(805): n = A,T,C or G
cgccctctcacactcatttcgctcacaccgttgcgtntgcgcgctactccctggtccgaggcgngcgcactctgagcggacaaccgcagttccactcacctctctgctagtgccctatcagaatgtgtgacgatttacgcgtctactccccatcccattgtactcactacctagtgccatcaccatgtgcctgtcagaagtcgtgtggacactttctcatncttgcatcggcaatacgggaatgggtcttactctgtgcttgcttcacttcaatgagtgcggtcttattttcacacgcctctattatcttgtccgtgtagtccaatatatgtgcgcacggttcgggtacccgcgtccgcgtgtgtattcgataccatctgccttcgcgctcacctcactccgcgcctacgtccattggggtgacctctaaccttacgccttagagtgccagtgtctttccgcgccatatggttgctcctccgtggcaggcgattcttccattcaccataccccacctctacaccgttgcgctcacacctccctcggcgtccactccgttcgcgttgtctgctcctttgtcccatcatcctccccgtcctccgccgcatcgcagtcatcccgtctaccggccctgtcctaacacttaccatccaccccacactcccatcatcccatctcgccccatcccactatctcccatcctgccgcacatccctgtctcgtcattcagtgctctcactccnnnnncnnnnttgttagagttatggccaatgtctgtggagtaccccccctccctataggagtg

SEQ ID NO: 14811 - DNA, 1191 bp, Homo sapiens
  misc_feature (1)...(1191): n = A,T,C or G
cgcgccccgcnccnnnnnncgccanaaaacnatnaacaaattnnnnnnnntgggggggggggggggggggggaggaggggccctggggggagggacagggggggggggggcctcngggggggggggggaaccggggngngnnnnnacaacaaaccccggaagaggagagaaaagatctctcgnnccngcgnncccgcacaccgnngcggncncgacnncnnnncagccgaaggggnagnaggcggcgccccggcccnaaanagagaaccagaacgggcccagggcgccccncnccccccanaccccgaccacaccccaacnggngcgaccnaaaaaaaaccccccgcgcacgcccgcccccaacaacccnncgcccgcgnnnagggccggacgggcgccgnnnnangccaaccccccacccccacgcgcgcgccgccggccccgccccgcaaaaaaacganngcnacgccaanaccacacanaacnacgcagccgcgcnnnnnnnggaaanagggncncnggcaagggggaaggagnaccgcccccccccgccaanacgcacccanagaccccccagacagcgagcggcacccccgcgccccggccccagcggcccccncccccccccgccaccgcccacccccgccaccgcgggccacccacaccaacgccaccgcnccccacacgcccccacanaagaagacaccccccgaccgccgccacaacgcacnccaaacccccgagcgagcacgaggccngacgcccgcccagcacccacgaccgcgccccgcgcccanccaccacaanacaagcccnnncacccgccggcgcggangaaccgccgcgccgggccacgccgcccaccgcaacgagcacggagaaccccggagaccccaaccaccgacacgcagccgaagcaggagaagcgacacaacagcgagaacgccccgccgcgcgagagcacagcangacccacgcgncgcgccgccacgggaggcgcaacaggcgagccgggcgcgcgaaccgcgaggccgcccgcgcaaacacgaacaagaagaccgaaagcgatcggccagcggaccggatgacaccaccccactcgacgcccacggaagcggctcgcagcgcgcgagccgcccgccccgccccgaccaaccgcgcgacgcacccgcacagcgcgccgcgcgaccg

SEQ ID NO: 14812 - DNA, 1597 bp, Homo sapiens
  misc_feature (1)...(1597): n = A,T,C or G
cgtcacatcatctcaaggagacaacncgagctgcgatagtggaacnactcaacataacaccgtgaacgtcagagcctaggacagagctgattactcatacttattcatatcacacggcgtagagcggcatatctgatatgtgttgcgggtgatcatgacgcttgtacaacacgtaagacgagcgnacggtcgagtaggtgngtgacataatagcngtcgggcgcgtgccggaggcagaggagcgnagtgaagctgcgatcgttagatcacgtataagttatcngncacgtatacgtagantcacacatcagtatgcactgctcggactcgtctcgcatactggtacacaggcgattagtgtagcgtttacatgtantacacacctatatagcacaacatntctatacacgactcttgttagtgctgagagcatcatatcgggtcgaacactgcggatatgtgcgcgctancgacacagagacgtgatagaagaatctagttacgtgtcgattgcactatagcgagagctcgataggctataaatgatcatctggtaagtgcgacatgcatcatcgatatctctatgcgagtctgcgcggcgcactgtgagaatacacgngaggtacctaatacatatcgcgtctgctgcattatgatttgtagtagccgaacactacagttctcntgtgcctatcagtcgtgaccgatgtgtgatctntacacacgcgagtcgtcgctgaatgctatactatacttgcgtcgcnagcgtgtntacatctntnagcacgagctaagacgcgcgactctatctgttgcagcatgatggtggactgatatatacagtatatacatcatcagtgtntgcgcgtggctcggcanagtnacgatcanttgtcatgctacgtatgtatgatacatacgtctgctaganatngtntantacattactctactagtactgttgcgtgtgtgatatatatctaatgtgcttatctcagatacactacaactaatcagtggtctctcgatacnactcatccgacgcgaagacgagtagaactcgtacatagntactcgcgcgcgacagactatgtcttcacgtctatctctcgcattgacgacaacgctattatctcggcgcgctggtgtgggtggtatgactgacgctgcgtatctgaggaatacgatacatatacatagacgctgtgacggtccgcgcatgatctatgtcggtgtacgaattatantacctntgcattatacgctggatggaggtgggtaactgatgtgacgantacggatgatgtcgtggtcgtattgtggtatgtcttgcgcgatagtggcgtgctctaggcgacgttcgtgattantcgtacttagctgcgccacctatcacagtatatatgangtggataacnggtaattattaggcgttgtaagctntagtcgatgtgcgcggcccccgcgtacntgcgtgtagtagtactctgtgtcagtgttacatccggctatgctctcgaacacatgtgcaatgatcatcgaaaaatcactcgcactacnatgtttgccngaggaagctacaatattttgtctctac

SEQ ID NO: 14813 - DNA, 219 bp, Homo sapiens
acactcgcactcctgactaatcgttaaaagtgggaattgtcgtttccagtcacgcatataacgtggttgggacttgcggtctctgtcgactgttccctctcccatctatctttaatagagggcaaggacggctaaatcatcactaaagctgaacgggaccggcctcccttacgttgacggaataatagttcatctgcccaagagcctatcccagtaaga

SEQ ID NO: 14814 - DNA, 1462 bp, Homo sapiens
  misc_feature (1)...(1462): n = A,T,C or G
cgctgctctcatactacagtatgcagctanctatctgcatcgtngaactcgtggtcgatactcttcactagcgtctatgtgggctgtgtgcatctacgtggcacagcgntntagtcacccctncgtatattcacgcgacgtctgcgaggacatcgcgtatcgtcacnactgctatgtcgcccaccatcgcanggtcgcatanctctaatctacgtcnatangactcgtacctacatgcgtggagactctctgcntgcgtgnggcgcgcctattctgtgtgcaggtcgantcgcaactntcgtcgctctctcttccagtactgcgcgantngacagaatcgtgccacacatactcacacatatgcgcgtctatacgatactccgcgtgcnggcatgagataatcatctcgtgcgcatgtactatattaccgagacgcgctgtgatgcgtcacactcagtactaatgctcgtcagantcgggcggatatcagcgtccatcgggcgatgtgtgaccagatagattcgacactnacagtgtggtggatactatatctggcgactgcgcggcagccattgtctaatgcgtggcgacctacgaccacacactccactcatccagtactcacggcacgggcagccccgctgntgcacgcactgtctagtgtgtgctcggacttatccgatctgtagtatacacgtccgtcggcatactgcnttgtcgngggcgtactgacactgctctcctgacatctcaactacgttggcgcgtcgactcgaccgcgccgtgtgccatcggttcacgccctgcgactgcggacgatcaacagattcacactcggagcgcgccctacgaatcccatctacatacgcagtcncgcgaccacggtctgtatcatgattcctactgagtgctgcgggatctaaacacttaccgtcactagtgtccgatcacgtgtgcttctctatactacatctatgagctctaccactcttgacgtaccaccgatcgtaccgtcgtgctctgatgctcttacatggcgtctctctctttcacgaggcgcgcttatcgtcggtgttagcggggagcatatacggattatacatattcatatctccactcgcgctatacacataatacagacgaatctgcgttggttattagttaatcttgcgagttccggctatctcgctgacgatcaacacgtcgtatgatgtggtacattatgatcgcggcggctgcgttctccggacgtgtgagcgtgtgatatgcgcggtcaatacattcactatctgagctgatcgagaatactcgtactgccgaatagtgctggcgcctcttctcgcgttgatcgggaaagacttgcaatgctaccatcactccgaccaccgtcctctactagtctccctcccttcacgtctntacgctcgatatttccccaggatcagcatntttatctgtcgca

SEQ ID NO: 14815 - DNA, 544 bp, Homo sapiens
aaacccggggactcatttgcctaatccgccctcttaagaagcccaaacagggggatcactcccactctatgaataaaaacccaccctgggaaaaatggcgaatatccctgtatctaaaaaaattgccggggcgtgggggtttgctcccttgaagggccaatttactaagggtggcttagttgggggaattatttccccccttggggggtgggagttgggggtgccctttatttgggcccccgaattccagtcttgaaaaaaaaaggggagcctctccttaaaaaaaaacaaagctgagattacgtattcccgagcggtgggactgacgttcatatatcttctttttaattatttgaagcccgcataaatgaatagaacactgtgcggggctcattgctgtttgtgggatgaaaaaatagatatttccctacagcgctcacgtcccttcgatcgctgggctgcggagagaggtgttttcttcaagaacggtgattactgattttctcacagtatgagattatctgtctggtgggttgcgtggtgg

SEQ ID NO: 14816 - DNA, 369 bp, Homo sapiens
  misc_feature (1)...(369): n = A,T,C or G
cccccactctcctacctctttcctctgcccccgttcctcccccgcccggcgcgcaacccgtctcctccctcgcctcccctactccccattccctccccactcgggcatcccttccgcctccggcgttgaccgcctcccctccccccccccctccatcggtcagtgcccagntttgttaatcccgtcaatgaaagcgcggcacggctccgcataggggtattgcgcccggcccccccttcaggttgatggtatagataagcttatatgnccatagagcctattcccagttaattggtaacgaagcaggtgtctttgccccaccagtcttgaagttaagtcgcagtgactctgtttatacccccctgttcc

SEQ ID NO: 14817 - DNA, 1744 bp, Homo sapiens
  misc_feature (1)...(1744): n = A,T,C or G
ctncatatatgtacctnctttctgtaactacatactctcatagattcaagtcgtatancagtgctgntagctcactcgtctatacgctagtantcnattagttcactctcgatcgtacgtcgcacactctgtgtataattatatgtagactgtacagngcagacccaccatcatgcacatactgacattgcagactcactancnctctcgagctccgtaatactgtgntctacgatatctatgtaaccatnttctcacatctcagtcttcttcctgcatcatcctctcgtgccttcgcatcttcgtacaattagttctcatgatcncagagtcagagcgcgtcatacgcggngcgtgcaacgtctcagctcacctctatgtcatatctacctagtttctacntcagctgtatctatcgtagcactcatcagatgtcagtgcggactcgagcacgattgtagagtgtaccgtatacacctagagactgcgtctgtagtcctnggcgttattaccctactccgtctgatctctacgtgctcctctcgtcgtcatgcacaatggnatgtatctcttcgtatggtagtcgcctcttctatcctcataccggcctcgtcgtgagnttataggtatgacatactgtgtatcatcttntagccataggtgtgttgtctccgcgaatctcactcnatgcgtatacactcactacgacgcgtagtcgntatctgcgtcccctccattctcaagagagttactctcatacgctctctcgtgctgtctcaatctcactagttgtccctgcgattacatatgatttacgtatgcgccagaatcagtcggtgtggtacactctatctcatatagatgctngagagtccttctgtatcgtcgcacgagtcagtgcgacggtgcgtttgataaatacgcgggctagagtaacantggtgtaggcgttataggtatcgctcagtgattctcatcacgagtagactctcaccgttagtctctacctgncgtcatcgtatagatgtatgtgtatatcacaagaggcagcaacgtgctngncgatgggtgatctgttgttatactatcactattaccttantctcggtgtcaatagttttatacaacagctcagtctcatctactcgtaatctgngtatctacatgtatcgatcaagtggacacctacatcgccatggcgnctgtcatacacgtcgcccactctgccttcacatctctacgagtcagtggcttcagcgcaatcctctcagaacacgcggtcgttctacgtatcttatgtctagacaccttaagagctaactgcactnttctgngcgtagagtatattgntgtgagctattagagtcctactcaactacacggatgnaatgcaggcgtctatcgtgcgagcgcgtacgtgatggagcgagcgtgcgtggatccactccgtagcgctcgtggtgcagacantgcgtccagacgagtatggcacgctacagtgtctcgggttgcgctgcgcacaacaatacgttattctatatactgaaagtcgacactctgattccacactaanagctacagacgcagagactgtagatcagtngcacncatccacggaagatatagagcgatataagatgacacagtagttcatatataatcgcggtgcgacaanacatgagactcataacacgctggcatggcagaagcatcgtaggcaccactacttttatcgatattccgt

SEQ ID NO: 14818 - DNA, 1559 bp, Homo sapiens
  misc_feature (1)...(1559): n = A,T,C or G
cacactccattgctgatctacgtgcgctgtatatagttatctacgctaatgtctcgntgtgtctgctcaactcacantttcacanatccattgtcntntctatacgcgagtctcatccttctgtcatactggacatcatgtcagtgacctctancatgcgtacacactttacgatacnctacgctagactctattgtatntcantcgcgtctcgacgngactcgcatgangacgcacgtcaatgctacacacagtgcagagcacacatangtatacatcgatctccatccatgctcgactagctaacatcacgatcataatctcgactgcatagtcactgatatgatcgcgatgtccggcacgatcaccagacgagcaccgaggcatcctatatcgtctacgcgacgctgtaggctattataacgacgagagtatgtgatgctacacgtccacacacttcgacactgtccacgctgctaattcgtacaangtctagtgacaactattcttatctagctatagagatctacttcctcagtcgattcaaacctgtatcaactccagtagtctcctcatcatacgtanatttgaagaatactatatgctccattcgtcacattcgtatctttctgttttactctcgctcacctagttaccacctctcttcacacgttcgctgccgtggtcttccgttatctatgattctgattcgttgatcgagcgtgctcatctattaccacgcgctcatgttgcttctctacactaagatncagtccacctgatctaatcgatagtcagactccactccactacgcgctccaatatacacaattatgctatgaagtatactctagtagccgagaatgcgcactgcaatacacgagagacgagactgcgtgccactgtagtagtcgcacagctctntgtacactgcanatcgcgatggtgcagatcaacgtgctgtcgccctatcgcgttcgaactatgtaccgtgggccttaccttggtntcgcaccgctccgaggcctcgtatataattctactcataactatatccatacagtatcgatccagactattacatcatccactcagcgtgctacacgttcatacgatcaccctcatgtcctctaatgctagtcgaccgtccctctgtcaacgcgctaaacactgatctggtcatgcgtgtgcactgtcacgtcgtattctggcgctcatctacnagcggagctcccacatattgtatatatggcgagtcataagtcagcgtcgtataagtgtgatcttctcngngaacttatctctatcctcaccngacagctatgcgtcgangtgcgtgacctcacacnctgtgctgcgcngagtgaacaagtgtatgtagatatctctacagacggccgacgtacgtgtactgtaatctatatgcactttattgatctaagcacaccgatgttggagatctgttgctgatgaccttgctaaagtctgtgtccatgtaaattcagatcttaatgaaacttaaatgagagcttgatgcgcccagaggtctttctttctct

SEQ ID NO: 14819 - DNA, 780 bp, Homo sapiens
agcagggggttcacacctctgcatccccagcactccttagaggcccaggcttggcggatcacctaaggttatggagttggagaccatccggggggagggagggaaaaactgggagtttaaaaataaaaacattagccacgtttgatggcacacacctggaattttcatttacttggcgggttttgcccatgagaaaatttttcgccccttgggagacctatggttttaagcaagccgaaaatgtattcatgtttcttttaacaacgcctgggtgacaaagggagtacgctttggtacaaaaatatatcttttttctttaaaagaggaggggaccggtttttccttgaggaaggaggtggattcttgggtcctccgttttgttgatttgatggtgattgagttttttgtttctcatagagaagttataaagctatactataagtctggtataccggatatacactaataagaggtgattacaggtataagataggttggtgggtatgttctatgattaagagaatggagaagtaaattaacgttccatgagtcgtgggatattgtcgtcttttagcctaatatggggtgatgttgaggaggttgagtggcgagcaacggcggtgcatggttgcatttacaatattggataacacactttgcaattatcatacaagtgcgcgtgccgctgttggcgctggcagaagacatagtgggcatagctagtgaatatagttgtgagaaacgcacgtgcacggaggaatcgtgtggcggtgtggtgtt

SEQ ID NO: 14820 - DNA, 967 bp, Homo sapiens
  misc_feature (1)...(967): n = A,T,C or G
tcttaccaaccctacacgttcacgactacacctacacaacataactgtctgtatacaacacacacgctagatcgtggcanacaacaccctgcgcacgcgtcctacnttgtacaacaaaccaaagttgtacctgatacttctgcgcaaccatatacctcttcttacaatctcaccccgcctgtcatccccgctaaaatcaacaagtgtgcagctccccaccaaactaacatacttgtttcagcgtactgcggaacacacggtgtgccacacgtccgtcgtccagcctactcacacccgctgccgtccttttccccaaaaacggtgcgcgccaaaatctattcgcctaataactcggctcggaacaaaacacctactttactttctttctcttctaaacaaaacgcgaggcaaacggggctgaaaaatacggaaaagggtgattggacaaatacccaccataaatatagtgggcgccggctggaccccaacacaaaaaaaaatgcaatggtgggaaaaaatgggggaaaagagggctgaagaaacttgacaattgggctgagtgtggagttgaaaatcaaaaaaatacaacggcgtgatattatataatcagatagtaatatgggtgggcgtaaataatggtggttaaaattaactgtctcaccctcgccatcaaacgttgttggaatcacaaaaaacactctctttttctacaccgggaaaccatgcggtaacaaaaaaaaacggtgtgaccgtccgggtgaacacggacacatacatgtaaaaatatgtgcctcctgtgttgccaccttatcaacaaacgtcatggacacgtgtgaagtggaaaaaaaaataaaatgtgtgaaaaaaatgggatttattttttaatgtgtaattaactttgaaggaaaaagggaacaagggacggagggcggaaaaatgaccgggaaaggaaggaaaaaaaaaaaaa

SEQ ID NO: 14821 - DNA, 1486 bp, Homo sapiens
  misc_feature (1)...(1486): n = A,T,C or G
cccgaaaaaaagacaagcaccggaatgggtagacatactacnacatctctgctgctccctanaccctataccccaagnttcgnaatactcgcccccacgacacacatctaacttaanagcaagagaggagtcagtgtgagcgacggcgaacgctgtctnannnatgagagaganataaccacgagaccacccaccgccgcgcagcanccacgaacaagngcnnttcggcacccgcacggatatgctacgcgcgcgagcggntaaagaacgcagcagagtagcagagcgcagttaggtctcacagagacacgtctgcacacgtgtctgttgcaaacgatcatcaagcgacgcatcgctcccacacacagaggaccaaaagatgcacgagtcaacaacaggcgagatgtcatagtccacantatctnacatacatcaatattacgtataattagaactaccctcacatcactatatctttcactcgacacgtgtattctgcgacgttaccgtatgcacgcctcacccatctccgtcgtgcaccaccaccgccagcaaccggctgcgtgaacgctgctgggttcatgtgcgcagcatagagtatgtgcggcgagtgaggagcgtaggacagatctgtcgaagagggagtagagtgcagagtggggagtaaggtatgactaacgtaagacgaaatcgcgagcgcagagtggacgaccaggagcggggagagactgatgagacaggacagacgggcggagagagcgcgccccaccgccgcanccgcgtccccacgacgcttcgaggacagccgcacgtcacctccagcgatagacgtgcaatctagatcccacacgcccacacgccacgaagactcagacgcccggcgacccaaagcccaggtcagagcaattccgtaagctcgaccagcccggaagagcctatcggtcgtagcgcggccgaggagagaggccgcaagcacatgtatacgatggcaccgagcgcacggcgagcccgaaatcgcaggcatgtaggcagcgttggtccgagtgagagatcgacgcctgttaggtgcgcgaggatacgcgcacagataggcgtgagctagaacccnaatcgcagaccggcagcatcgtccgtcggtgaatgcgtgccgcgcgccacagcaccgagcgttagcatacacgcaagantctcgcgacgcgcgtctcggagtctcagcgagccgcagcaccaccagcgcatgagacgatcggtctagagacgtcganccactngcaacatagntaatagttantacgtacaacgtcagtcacaaagaaccgccaccgcgacgagacgacagggcctcactgcgccntcgcgtacaagttacacgtcgcatcgagagctgacagacngctgcaactgaagtgcgagataggaagacntatagggtcgagcgtgagagtctatccagcacagacacggactgatacagnctaagcgatat

SEQ ID NO: 14822 - DNA, 145 bp, Homo sapiens
  misc_feature (1)...(145): n = A,T,C or G
ttaacccgcccctccttcgtccctcccctatttcgtgctccacccacccccctcggcttattcggtcccgcccccccctccccctgccgaggcccaatcagctagtncccccactttgctgtaatcccccgcccagtgaacgcgc

SEQ ID NO: 14823 - DNA, 1135 bp, Homo sapiens
  misc_feature (1)...(1135): n = A,T,C or G
cccacactctccgcctcaactcatcacacgggccttccggttatccacgtcacctaatggttgatatcttctccctagttcacgtctattgtgtcgatcaccctacaccacactcaaccatcacgcttgcgcanagaaacctcttcctcttgattccacctctccctattgctctcgctctctcgctcttggtccccctgttcaatccagtctcacgaactttctctcataccactccctccctctgtcctctggcgcccctgtcgcattgttctctattttcctatacttcgttattgaccagacgcccacggccggtcgttcgtgcccatgatgctttctttctttttctctcgatctctcctcgtctgctgcctcttctctttgcctccgatngtctttcatacctttncctccttctgatcacgccaacttgcgtctgcccgtccccgtctcagttgtgtctttaagctcgtgcctggagtttcacatctctctgctccaccttggcatcgattcgaacgacatcacgcgctcctcatcctcgccatacacgtattctatccactctggcgtcgtgtccctctagtgctagcattctacgcatcgtcgagccgcgttgtctcttactaatccgttgggaccggtcgtgctcntctgctcttgttattactcctccgccacgctcagtcccctgctctatctcttgcgaccaaacagcgttccgcggcggcgcactctcgttctcaatagtaccctgtcaccgctcttatccgctctatatgagctatgatcccactcctcatcgtccacactccttgtgcgtcttacctctcatgctcccaccacctctcgcagctcgactactgggtccctactgaagaaaacgtgtgttccctcacagcatcccaccccattaagccattgttgccatcgcggccccccatgcaactgccagcctacattggccagtgctgaggcaggagtctcgtttgcacgtggcatacacaggcaacagtcacccgggatcgcaccgctgcacttcatccatgcctgcgtgacagagctacatcggtttcccttaatcaatgcataaataaacacagatgcgcccgaaagtcttcttttctttttc

SEQ ID NO: 14824 - DNA, 1154 bp, Homo sapiens
  misc_feature (1)...(1154): n = A,T,C or G
cccaaagcagggggggaggggaaacaacccccccccgcccccacggcccccgccacacgccccctcgcccggcccgccccccccctttctagcccgccctccgcccgcaccgccacccacaagccaccccaccacccacaaccgggccgcggcggcaccaaacacaccaccaacacccacgagcacagccgcaccaaggtcaccgagcccgacaggccccgaccggggccaggagcgtgcggcccggagagcaatagttgtcccccctaccacgccaccaccaccccgccccccgccgcgcccaccgcccccggcggcgggcgagcgacggcaccgccgcacggcgcgcgacgcgcggacgcgcagtacagattctctacgatcgccagtgcgcaggtgtcacaggcacgagcgcggatagaatgcctattgagagaaggaactaggtggatggatgacgcagagcgcggacccgaccaccccaccgcgcccaccccgcgccgcgcgggccccgctccatcgaccgttacaacaggcacacgacaacaagcgtccgcgcgcgtagactcccgccctcccactcgaccacgactcgcccgcaccacgcgtaccagcgctggccgctggccagccggacaccgctaacgcgtgacgcacagcgcgccgatgacaacagcaccagctccacgcctgtcagcgccgcgcgtcgcccacggaggcggctgaccgcagctcacgacgcggagcgctacagcagacgactcacgcgaccacgtcaccncagcgcagcacaccgccggcacagcagcgccggctccgccgcacatgcgcgcacagcgaccgcgagtgcgcgtgtcgcgacggacgcgcgagcgcaccacgtacggcacaaccgaccgtatacggcgacccgcccgcgccgcgaccgcgacaccggtaagcgcgcacccgcaggaaccacgtaagacgacgaagccgagaaagagcaggcgaagcgacagactacacacacgacanagcttacacaccgcccagccgtcgtcccgcgagcgancacgacaggaggtagagcagaacgatgcaaccgcacgcccacagaagaacaaggcgacgccgagagagataggagcggtgaagcagaggagcgcagacag

SEQ ID NO: 14825 - DNA, 1291 bp, Homo sapiens
  misc_feature (1)...(1291): n = A,T,C or G
agcgagaataattctgatttgacaaacactactggaaaagacttaagggtacacagggccctcactaacattgacgacaagaaagcgataagtctcatataggccattatagtccagccaaaattattaaatttatagaggaagggggaggccatctaccatcaataatatagtaatattaataggcgatatatattgtcgtttgttgtctgcctctacacatagtagacttacatagggtaagccaactcttccggctggtgttaaggttcaccggtactgtgtggtatctatagttgacaacattaggcaaaacgtacncaacatattcatgatctcgatggggggggtgggataagagacacgaggtggcagggtatgcagcgatgataatatgggcactgtctatcggccgtgccggcatcgccatccgctctactatttnagagatcaataattggcgctgtcagtccaatcattcgatactggttgaacgtgtaacgctgatatgtataggntcgtgagtatttggtaagtcactgtatatacataanagtcgatactgacgaaaattaggtaggaagagcagatcatcagacacgtagctaagaatgtgtgacgcgtcatagacagcaggtaaataanagatcggacagtctcactaganattacgttataantcggcgtgttgtatgngtcattagcgtattgcagccgaaagactcctacagcagcatcacactgatacgatctgcacctgctgccncgtagtgagtccgtattatcatgtagttgtagattaggccgacgaagcgcacctgcggcgtgcgtcaagcgagttagattcatatgatcgacagcngtgcgcagtcacactcgctacacatgtgagtgtactcgccgctatatatacaatggggtcaggtaggcgtatatctcaaacgcgtattatgaagatagaatacactgaacatagaataaancagaanagcataacaatcgaatacacacgaggagtaataactacatacatacacaatatggcagagagatatacttgaaaagataagaatcagtcacacaccgcgctctcgatatctacgataaataattcgcagaaggacggcgaacaatgcgngcgatctatgcctctgatactctgtactacacgtactactacagcngtcgcatgaacggcgcgtntcngtgtggtgtncngagagtaactgtcgtaaatagtcacgatgctgtgaagcaggagtgatagtgttcgggagcacagcgcgaggag

SEQ ID NO: 14826 - DNA, 1237 bp, Homo sapiens
  misc_feature (1)...(1237): n = A,T,C or G
aagagaggacggcggggaggggaaaaaaaaagaaggggggggagaggggcctcatagcgggagaaccanggccgggggggagccttaagnggcnngggaaaccgagagggacgagacgcgagagggagagcgcaccccacaacacattttgaacggaggggaggggcaagaccccgcacagagagaancaagcagcacagggcccgggcggcagacgcggccgcgcaaccggcaagagcgagacgaagcgcgagagggagcagcacgcagcgagagaagcacgaccgcccagacggagaagacgaacaggagaagcagggagacacgacagagacggagacgcggagagacgagaaacgcacgacacaagccgaagaaggggacaacaacanaactcttctcaccgcgacgggggggaagaacgccgcagcgaccggacggagagaacgagccagacgagagaagagaaagcgcgacgagcacgggaacgagaggagagagagaggagacggagtcagaagggatagaangaggagagcgagacgagaacaacgcgaagagaggggaggagcaggggaggatgagagcgaaacgacgcagcaggagacccggcacgcaacagacgcagaagacgaggacgaacgcatagagaggagaganacacgaagaggcgagcgacagcgggcagccaancacagcgacgcacaggcgacagcaatgcaggcgacaagacaagagacgaaaagacgaccggcgacgcgcgcgcgccacaccagaccaccacaaaacgggacacgagaccacggccccaagaaagaagaaacaaagaagaccaagaaaaaagaaagaggagacgcgacacaagacgccggcaccacgacagaacccaaaccgagcaacacacaacaacacagagaagaaaagagagnggaggaggacaagcaagagacacgccggggacggcgaagaccgagggggaggggggacgcagagcgaggagaccccgcgcccacccggccgacgccggacccacacgaaagacgagacaaggagaagctgaatacgtaagcagcaacgacaacagacagagaaacagaaagcacgcagaggagggagccgaacgaggagtgcacgagagnaccaagagaaagggagctagcaagaaccaacgagcgcgcgcaaggggaagggaggcagcgggaggaacggggccagcggcgaggcacagaacgacaag

SEQ ID NO: 14827 - DNA, 1351 bp, Homo sapiens
  misc_feature (1)...(1351): n = A,T,C or G
ttcgccgagctcaagaacataatncaacaaacatcccacgggcactacccgcgncntgagcncanaagaagcgggagacaaagaaaaagacgctactccttaaagagaggggagggggggcgggcnacgggggtttgggagaagagnagaagacaacacagacaacgagaagagaccacncccaacgacctcgcgaatccgcggtttctggtcgaggtgtgggaatgtgaagtagcggagctgtacagcgccggtccgccccgggcccaacgacgctaccccaacccatccacaacaagcanaggcgaggaggcgggacagatactactcaatagaggagtctagtccccttcataagagcatagacttacttgtagaggagggcaccacagcgaatcagaacggtgtagcagaccgaagcatagcgaccccatcatacacccacacacaagacaccccacccgtccggcagcagatgcgctagtgtcgcgagagagatgagtagggagnggaagagagagcggagcgaggtgtggaagagtgtcgggcacgggccgtgagtaaagagcgtcgcgaaacacataatagcttagatagtgcgccgatcggacgcgcagaggtgagggcggagagggacacggagcagtgaggacggagaaggagaaggtggaaagtgaaaagtcagagtctggccgcccacgcatacatcccagtcgaccagcagacccacggcaacacgaagggcagacaatgcccggacctgtncgcgacacggatcagggacggaccaaccagcggagacatgagccacggccgcngacgtccgcgacaccacaacacaagatagaacggcggcagcaacgtgcagacaccggcgcgccacacataggccgcgagaagcagacgacggaggaaagaagctgtcagagcgatgagtcacggacgagtcggacactaccaaaggcagtagcagtcggcaccagacgagcagacagnnacacaacagtaacgtagtacgcagagaaacacgaagacgaggccgacgacaaatgcggcagagcgcgcgactctctcgcactacgcatcaacgcccgcgccagagcgagngacacaatcgcatgagccacacgctcctcctcacagtcacgaaccacacagaaagaccgaccctgatggatgcgaggggcggctaggagccgcgaagcagcacagcgtggcacagagantcaacgcacgcgcatggacagccctagaacgagtcgcacgaggcgccacaacgaatacaagaaagagactcatcaagagagcatantacaggagcgtggactgggatgagtgaacaaagagattg

SEQ ID NO: 14828 - DNA, 1658 bp, Homo sapiens
  misc_feature (1)...(1658): n = A,T,C or G
tcanctctcgtcgaccactatactcaaagttcttatgatcatcacacgcatacccagcacatgttcattcgtctgtgcaactctactagtcgctcctctgcccatatcgagcctcattgtgtgaccaccatctcccttcccacctctatattcctctcgcaacttctatcgcacccactctccgtcagctgacctctatctctgttatcctttcagcatctcacgtgtcgcacgtacggctctatatgacacttctccagtatagtatgcctcactatctcgtctcgagtcgtatgcatgcgtcgcagtgcgcgattcgtcttcgcagctcgtcctacgtcatcgagtgtctctgagctcacctgttctcttcntctcaccacttgatgccctactcctcacgcgtgctctctcagtccacatacatctgtgtctcgtcatgancgacagagttcatgcacaccgtctcctctccacaatcgatgagtatacctatgtcgcgtacgctgtctccaccactatccactgttgcgtaccatatgacatccgatcgctattgctgtgatctctaccnctatatgcatatcgcactctcatctatctgattgccgaacacagctcaagtctcttgcatacgtcgtgtatatcctcngtatcactcagtccgacatggtctcccactgagagccctcaccgtctcacactatgttctagacgctgacgcttccgcnaattctacagtngccttccatgacgtacgtgcctgtgtagctcctntcgccagtgccattacgtggcgctctcatagtatcacaccctcgatattacgtcntgtgcggataacnanangtagtgcgaggcgtctctgaggatgttgtttagacatcgcgcacgcgcgcgatcacatccagctcgccggctacctctgtgactcaccacgcacaatagttcacgtcatgctgtagataacgcgatcgagactctgtagngagatgtctgtcatgtgtagtatactaacatgctaatcatccgcgcctacatacatncatagttatactacatcaactgtgctctcgatncgtcactccatactcttgatccagtagcctggcgtgtatnccgattatggctacgctgcgtgaaccatcagtatctacacatggatgcatcagaccacgactataatganggatcttgcacacataattcgcgtantcctagcatacatactcacacaaatcgacggtgctatcacacggcgaccgttcagcagcgcttctactcgcgggacacaacacggtcggctcgagacacgtgtacctgacgagtcgcatgttggatataatatggtgaatctgatgagacaactgtgttatncggccgtccgttagtgggcacctgagtcgtccttacgtcggtngttagacttacgacgagaacatcatgcgcttgntacgcacccgcagtctcatccagaaaacagctccattattacacgtggatacgaacatacagacagtacgtagtagtatacacctcgcgatcaaagcatagcgatcatcanatatctcgcaagntaacttnctgtctaancatgcgggatcgcggctatcattctgcctcctcttgaagcgncttctgctctttctgtatatctg

SEQ ID NO: 14829 - DNA, 406 bp, Homo sapiens
ccccggtgcatcgtccaactcgcggcaacagtcacaaaccctataccgagcttcggcgcgcggtgcgaataattcatatatccagcccaacgcacggtgcggccccctgcgctcgtggaggacacaccagcgtccgctctcggcaccgcgcggcgggcaccagttggtcatcgacatatacgcactgtcgtctccccctccccccaactgtctcgtgcggttcgtgtgccgttttcacttcccttgcctcgttccagcatcaatgggtgtaacccgctcagcccccggcttatccttcgcctgtaccgcagcgtccgacaccctacccatcctgactagcgccccactcgatccagccgctactcccaccattggcgggccaacagcgcgcggtgtaacgggcgac

SEQ ID NO: 14830 - DNA, 883 bp, Homo sapiens
  misc_feature (1)...(883): n = A,T,C or G
caccactagtcgaatgnanattacaaacgnnnnnnnnngtcttccaccgatacaaccgccttataatttatttataatgccttccggattcaaaacacgtggcgtatccagtaatttttttgggcaagtagggcgaccacacctaaatggaaaccgccgccanttctttttttacaacaccctcgaactttatctgaaagggcaatttttattaacgcccctttcccggtttgccctttaagaaaatatttacacgttctgagcaaaaaattaaaacccggggcgccgggggctgtaattttcttactttttcgaaatcgacccaaaaaaaaaggtgtggttataaaagcctttacccaaaatagtttttttggaaagacacaccctataaaaaactacttttttttccttactttaacattcaaaaaacacatttttttaaaaactcttgtttccacaccctttatcatccctcaacttctataagataaaatatccaaaactttggccctcaaaagtaaacttttacctaaaagcacccataggcttccccggggcgaaagagatgggttgtctataacccccccctagaaatctaatcatgtatgttctaataataattatccgcccttctgttaacagggttgaatcatgtccacctattctccccccgtgtctaagtaatatgattattgcccgcatattaaaattataaaagtcgcaaagtctcttcagttgaatgaatcacgcctccttttccaatcgtgctctcttgctgtgatattttcacgtcgccgcccggcaatagtaaatcaggtgataagacatgggcgatgacttggtctttatttagctattgatgttgacttgttagtatgttgtt

SEQ ID NO: 14831 - DNA, 579 bp, Homo sapiens
gtgggaaataggtggggagtatagtgtatgtgcataaatggtacggtatttaaggagtactgttatagagtatgtaatggggtaatggtattgcatatgtgtatttgtagtactggtgatataatgtaccgggatagatatgtatatgtgtgaatagtgagtacactgtattgggttatgcttatggattattaagtaaagtttggtctgtaatacttggtttcatggaggtcacttatgagatcgtgactataattctaggggtataattgtttatgggattagtgggtaggttttatattatgtgggggttataggatatagtagtttatattgtaatgtggtttatgaattattcgatgtgctttatcggttgcatccgtacacattaatggtgataatctgatgcactatatacggtacgtgtgttttctccttttttggataaccgtatttctcgctggtaggaggtgttacggtctctgaatcgaatgatctagccagtgagtcatgaagaggatcgtaattaaacccttcaataaaggaagtgccgcatgatcgttacaaattatacctgga

SEQ ID NO: 14832 - DNA, 718 bp, Homo sapiens
ttattgagcttctctattttttcttctattagtgcgtttatatctttctgttgtggtttacgtggtggggtgtgtggcttcgattcgttgtggaggtcttgtggatgatgtggtttgagggttgcgttgggcttttggggcttactctatgttcggttattattagttcattctgtgggctcgtgttttgtggcgtgagatttatggggagagagttgatggcatgcgtgtagagtagtgcgcgtccttatgtaggatgtagttggatcgtgtgggttgttgttctgtttttggatttatttgtagtttttcatattgcttgggtaggttcctttttatattctgtagcggtgtttttttgtatgttgtgctcgtggtaaggtagataataactgtgggctgtgtcttgtggtgtttggttatggttttggatggtgaaatttggggtgtagggtggggagttggtgggttctttttaatcttgtgtggtacatcgttgcattacttaggggtttaatatatgtcgttttatggttagtgtgtatattttctcgtactttgtttctgtcttctaattataagtctgtgttgtcctttgaggctttgtcttgtggggtagtgaggggtatgtgttcgtagttgtgttagggggggttaggtcagggttttgcaggtgagtgtggttgtagattggcgtccagtgagcgtgggttatatt

SEQ ID NO: 14833 - DNA, 1069 bp, Homo sapiens
  misc_feature (1)...(1069): n = A,T,C or G
gctatgcacagtttataatttgcttggggcggggcggggggctgttttgacaacaacaagtatataaaacttaaagcatggagtttactcttgtataatataaccacccgctaacagggaaaaccacgttgcgataagtgggggaaggtttttcagaagaggggtaaaaaatccccgttcttccactgcggtgggtgagggagtgcgcttctctttggttgtatagagggggggggtgtttagtgccgggcgctgtgccctcactattctgcgtgatgccacacccctggtacttatttacgagcgaagatagccacttttcaattatcagctgtgtttattttttggtgttgcggaccgtgtggagagcgagagattggtttaggcgcgcggctgtggttgtgtgttggaggatgtgttgttgttttctactgtaacattcgtcacttgacagagcgtagtctataaacgcacgtgtcgaacggatgaatacggtgttcgtatgggtggctctgcggaaggacattgctgttggcgcgcggatagatgagagaaacaatggttgatgttcttaccctgttcgatgtggtgagaaagaaagtgtctgagataggggatagacaattacggagttgttacgcattgttgaggcggtgacggacatatgatcagtatcctactggtagccgcgcgttacgtccggtagtagagcgtctgtatatgcgtgggagtcatccgggttggtgggagtactgaggtgtgggtgggtcaaggtgatctgaggcggtatatggtggtgtgggtngggtacaccgcagcatataaggtggatatataggtgaggttatgactatggcggtggaacacaatataatatagtgtggtatacagtccactataatggcgggggtggtcaaaatggagggcggtggaatataggacgtgggtggggagagataactaacagggtgaggcgggggggagaatacggacaggtgaatagacaggcactatcaacacacacactgctcctacaatggtgtggaacgggcgggcggggtgtgggcat

SEQ ID NO: 14834 - DNA, 944 bp, Homo sapiens
tcacagtattaattgctagggcgggggggggcgtctgacacaacagaatagaaacttaaactggaagtaattctttttattagaccaccgctacagggtaaggcagttggatgcgggcggggacctccggatagcgcggttgttaacgtttttcgtcctgaggcgcgcgcgcgagatcataagctttttgggagggggggtttctcacttaaaattcctcttacattagaatggaacaacggttaacgttcgggtgtgtaggtgcgagtgttcgcagtacggttcgttatttagggtattgcactgttcggcgtgattctcttaggggagcacactctatttcttagagagaggtatggtaatagtaattaatgtgttgatgagtgtgcgctagtgaatgaggtagttaaacgatgatgctttgcgctaactacgggagagacaccaacacagagtttgtcagcgcatatagagaaggcgtgcgctgcggtgagcgctgcggaaggacggggtgcgcgcatcaagatgcattacattgtagcgtgtggtatgtagtggcgcgattggaaacggcaatagtgcgagggccgagcgtgttgggtcagcgtagggagaaggagaccgagatggtctgggggggcgcggagagtgtgggggaggtgaattaagttgatgttggtagtgttagagagtccagcgatatgatcactatggttaactaggtgcggagtgtgtgcgtgctgcaggacatgtaggaacgtaggtaaacagggttggttgaggtgtgagtatctacgtcggaggcggagtaatcgtgaaagggagcgctccgagttatcccgctcgtgtcgcggggcacgagaggccttgctgcaggcgggatcccacagagacagacccggcgcgaatagagtggtagtgggtgggttggagagtgtggcagg

SEQ ID NO: 14835 - DNA, 176 bp, Homo sapiens
aatgtaaaccggatgtggtttcccaacgaaaacttcagtgtcaggaacggtacaaggtcaaatccaatccagttccgtttattccatgggatccgatagcatctcagcggccagaaggaataaggcggaaaaattgggttattttcttacggtttaagaagccggtaaaccacttg

SEQ ID NO: 14836 - DNA, 490 bp, Homo sapiens
cactcccaagggtgaacactctggagagaaagatttgctctcagtgctgatttatgaactgcagcgtcagaaaccagcattaatttggagttaatttttccccaaagcttttcgtttacttacagtcatctcttatccctgaaaaaacaaaacacgtatattattgtgctttatactttcctaaagaagaaaaaaattctaagaaaattatatttagtaacttattgtcttaagaaaataactgcaaaatatctgtctagtgcgataaattatacgtgtaagtttattttttttcagaagcagaaaacatcatttctctagtaagttcacaaagataattaagatacccagatgaaattctacaaatggctttaaaagttgatggggaactgaatgtttagtattaatgtatcataattgaaataaaataaagataatagagaaataaaattatggcctcgttggcctcagcggtggagctctgcggccg

SEQ ID NO: 14837 - DNA, 469 bp, Homo sapiens
taaaaattttgcagttatttatcttgtggatattacagaagtgcctgacttcaacaaaatgtatgagttatacgatccatgtactgtcatgtttttcttcaggaacaagcacatcatgattgacttggggactggcaacaacaacaagattaactgggccatggaggacaagcaggagatggtggacatcatcgagacggtgtaccgcggggcccgcaaaggccgcggcctggtggtgtcccccaaggactactccaccaagtaccgctactgaggcgcactcagtctgcgcggataaatgtcgtggagccctttttgtatggaaacgttttaagctatttaaagcctttggaaaatacaggaagctccagggctggagcacctctgagatggaattgataacatggtcttaactcaccgaaataaacacgtggcctcgttggcctcagcggtggagctctgctgcccg

SEQ ID NO: 14838 - DNA, 2047 bp, Homo sapiens
  misc_feature (1)...(2047): n = A,T,C or G
ggcgtgngtaccgacttcgatactagcatctcactcgcgcggggcgcgacgacacngtgtacgcggccgttgcgcgtgtgtatctgctgtgtggcgtggcggtctcatacgacgcaccgcgaccctataaagattacctatcctcctttcgtaccancncanactgntancnttcttactatctatctctattctcttacgtcgttcataatcgcatataatatcttatatcttacagcgtacggtacggcgcgatgaggcgagctatatggagaggagtgaacgctgtatacggaggtataggcggttgttgtgtgtaggtctgttcagtcgcgtcatctgtttagcgatgacgagtacgtntggcgagtgcgcggagatatgtgtccgtgacgcgacgatgcggattgcggcagcgcgtcgcgtgcgtgtgtgtgtacgtggaggtcgggtcgcggtgtcgagctgtgtgatgctgtacgcgctcgcgaggtncgacgctcatgcgcttgaganggagtgaggctctgatgctgatgatctgngaggttctagtcaggtgagangtcatgtgtgtcgctgtgtctgcnggantgatngaatgcgatgntagtcatatagtcgtgtgatcggagtgttgcagacgagtgctgaccgtagttgngtcgagtgagcgtgcntcagtgtgtcatgatgagacgcagagtgcacactgagtgnggtcatcggtgttgatacntacggcgctgcgagctagtgcgtaacgcgtcgnantnctatgtatcgatggcgaacatcctcgtagctcacgcatcattatatcgagngcttcanagacngactaanactntacagccagcatcagactcacgnacatantgtaatagtatgcgacactacgataacngacgngtaggcatcgtactatcacatgacatcagtcactgacatcgatgctcagctgcagctctcgtctctgctgagcggtcatgtctgancgcgtctcgtnganactgntcgtcatctcatngtatgcngcagttcgtacgtacatatcgtcaggtcgntcggtntgtcatgagagattctagtttcngtcgtttgctagacanctanntncagtcgtcgtgctgctgcgatcgntatnccctgctagtnctgagntgngtangtagatncatcgtctattntntantcatncgacgatacgtttantactatcgtaatatacatctcctcactactcatacncttnctatacactttctacnatctcnntcngtctgccacngcngcgcgctgtcatgtgcgagacagtcgtgacngctgantgatggagtngatcgactacatacgnntgctagacgtcaggcagtgtgcatnggtgtagntggggctgcgctcangnggtagtgtgtgtactgtgcagtgtgactacgggcagnacgangngnggatgananctcttgctgtagagtgngtgcagcgtggcagcgctcacatctcacgatgatngtgtcgagtatgagcgcgcatatcgtcagactctacactgagancagtaggagagntacagacgagtgcacgagntagatanaggaatatacagagtgancgaacgtagctgtgcagtcagtgatagttcgatgcagtgtcgatgactagatgataatagcactatactngcgatgtgtantgtatcactgctcgagacaacgtcgtaggtcgcgtgtagtatcatcacacatgtcagcnagagaatgatctgagagtngcgacatgcgacagntgagctgcagctatgtacgagnactctgctngctagccaacatctgcacacgtagcgacccagccacgtgtacgctgatgtgatcgtncgctaggttgtcatagtgnatctgtgtggtcatgacagagacgnaagaggatagcagattgatggaccagcgacatagcacgcctagaagtagatagagaagagtagcgtatagccagagatgtgatagtgcaggatggggtactagagcgcggagctgcgcggatagac

SEQ ID NO: 14839 - DNA, 972 bp, Homo sapiens
  misc_feature (1)...(972): n = A,T,C or G
ccccgactccacggnctaactcgctcatacgccgggctctcactaccataaatagcaactcaagctcccacgctcacgccatacgagagactcgtgaccacaatactgacttgcacacactgccaatcgactgtccactcgacacccaactatcgacgtattgtcataacgaccccggcgagagtacttgaacggtttcaacatcactatctttggaggtcgatacccagacaagtcgctcgtactaacacagtggtagtaagaattctcctgtcaactccacaccaacagagacgcctcgcatggaatatctactttactttggcatccttgattcgatcccgcacccccacgtataattcagtttcgcgcggtacccttgctccatcccacctcccccctcccctcaaatcgtgcctctcccgtccactccgctcacttcactccacccgcgcaccctcactaattacctcgcccccctccctcagccatcgcctcagaacagagcgaacctaccgacagctcccccctaccatctcccggagcccctgttcccaccacataccgccttatattgactaccgctntctcccacgcagactcacgccaccacccacataaccctgcgccatatgtaagaagatgacaaacggactttcctccctccacctccaccagtacaacatccccgagaactctacaccacctactgccccattgcctccttactcagtgtgttccagccattggcatcagcatattgggcatccttcatgataaactccttgtcaacacnttccgcacccacacctctgttcantgctgttggcatattgctcaagatagcatttcatgtttactcttcattaatcccaggatatcctagtcacatggctgaattaataaagtaatggcctcgttggcctcaagcggtggagtcctgctggccggaacgatctttctgtacgaccc

SEQ ID NO: 14840 - DNA, 1132 bp, Homo sapiens
  misc_feature (1)...(1132): n = A,T,C or G
cgcacctcatctccatggcattcacacagcgctccactccgacnaggcatcaatgccccgtcgacgcagtgcggcgtgacactgctccagccgcacacgagcgacccaccctcagatatcacctccctcctccctgtcgtcgtcacgccgccttaccgcacatcgcacggcgccaagccgctccgtcgcctacacacggggcagtgtgcggcctacactctcgcccgcgacacggcgcactccacaagctcgcctacatacctactgtctcacacgtctcgcccgcgagcacactggggaacagcacaaggagcgggcgcaactcagatgggagggtacnggtggggcgcaattcggacagcgaccgcgtcgttcatatgagaggcagcggangcaccaccgctaatgagacacggtagtcgtcatagttgggatcacaagcccggagccgaacggccggacaccactaacagcactaccgcgctcctcaccccgacagcggacagccacgacggacaaggccgcccaccaccaccgaccatctcctctggaagcgtatggtcgctatccctcccacctagtcggcctcccgcacgcacaccacacgggcccccccactgtcctacaaggtcttccagacgtctaagccaacgatcgtgcgcgggcgagccacacgaaagtcctcatagcgcccagtcacatcccccctccccctatagggccactcaggagcgtgcacgaagtcctgagccatcgcgtagttgagtgagctgccccacgtagcagcaaatggcgccacaccatcccagccgcgagtaaaaacaggagtgaaaataaagcggatctgggtgcccacctcctacccccccaagtgaatcgaagttcccagatgatgntgacgctgaccccgctggtccatggacccccattttgagagaggtctcacctatgaacctggcgatggatgagaagatattctttccccccataccacccctcaccaccaactgantgcaaaaacttgagagaccgagtgagaattgcccagctcagccccgttagctcttagaaccatgagagataaaaataaaaggatggcctcgttggcctcagcggtggagctctgcggccg

SEQ ID NO: 14841 - DNA, 1765 bp, Homo sapiens
  misc_feature (1)...(1765): n = A,T,C or G
gtgcgccacagacaacagccganncgcactcgtcttttacttaattaggtgagatataatgctatatattcatttcatcttgtaatgtanatatacctgtganaaattactgtttnctttacgacngcgcacncaagaaacgacgcagcgccgagtgatttaangagaagcagaagtaagngacagggtggctggggnagngcactgagtcgnatctancaacctcacgcagccgtacacacctagagacgatcagacaagnatacntaatcacctcaagcgcgtantagtatatcactaagtgagacagatccaatgctatgagtaagtcgctgctgcgcagncagctcgncntcgagnctctgatgacgcgagctagggtacgggcccaagaacgcangacgntgtagatgngtagnagcagntcgatgctcagatcnctcatactgcatanagtcaatacaatatatactttatacattacagactagtacgctgtgtcatactgaagcatagatantcaaactaagcaccntctatatactcatcanctcatactcactaacacgctccacgatagtgctcagactacacagcgacaatgctgcgagggtnatatgntagtactgccgacgcgcgccgcgcgactgcgctagcacagctggcgtacganngnctgcgcgcntgttgactgcaggngtcgtactactcngacgtaatangtctnagacgatgaagcanatgtanntgtgcanantgtatgtgttgcgccgngnagnagaggtaagagagaacacaggaggngcgagtcagatggaggngtatnacagcgcgacgcgcgcagcgagacgcctgagcgagcgtacggtaagactcatacgtagcgatgcatgcgatcanatccgagagtcgaactgacgcgactagagtcgacgatgacagagcttgangcgngtctgatcgntccgtggnacgcgtacggtggtgatgtcagatatcgctgtgtcccagtcgatgngntcagcatatctgtgcnatgnacatagcanacagtgngcagntatgtaccntactgtcgcgncactcgtcgtgtcgtcacacgcgatgtcctantcntcattctatctnctacacagactgacacttcgtgtctcaaacctcagcgactcagcatctgatgctgcacgntgcgcatatnaacgctacacacagtactgttgactncgttactagtagactcantngagtattagatactcgtcncgtacaggtcacatagcncatgatnanagagactatgantcagacagtaagtctncagatagaccgctcagatgactacactganctcgcgcactcgtctgcacgacgtcgcgtntgctagtgcgctgtcgacacagcatgctacgcatcgtcctcgcgaacgcgccaggtcgtcaatcgactaaacagcngtantagcngtgtgtcacgcgtncgtacgcagtcggtgtgtatgcagatatacacgacatcgtantcgtgcgntcgtcactgtacanatcgagcgntatctattacgatcgtgnangagcctncngactattagaccgncagttatcggatgtgcacgncgcngcgactncatacgtctatgtcgagtcctgtcgtgtanctgtatcgcagcgcgcntgcatcgtactcagccacgtacttgtattcactgcgtatcatatatatcacntcagcactcgatntagtactgatntacgtgcatacgaacnat

SEQ ID NO: 14842 - DNA, 456 bp, Homo sapiens
  misc_feature (1)...(456): n = A,T,C or G
tctccccttcatcaaacaacccggcgcgccatcgctaggtggtcgtactccccccccccaagaagaagttacctacaccccgcatatactcatccgtcgacgggatgtccccctcctcactcgaggcctcactctccatactctagccccaacccaacaccttcaagtaacttccccacccgcccacatcacgagaccgcgcccaggattaacaaggggtttcccttgcatctgatcgtgcattttcctcttccctgtcgtggcgcgcaccccctgaacaatacgactccgtccccctaaacagcctctttccctccgagcccccctgtccaacagtatctataactacggacaccgaaattatttgaaaagagtgagtataggatattaatgagaggaggagaggagnnngagnnnnnnnnnnnnnngnnnnngnnnnnnnnnnnnnnnnnnntt

SEQ ID NO: 14843 - DNA, 828 bp, Homo sapiens
  misc_feature (1)...(828): n = A,T,C or G
acatgcctttgttcgtaattgtcaaaacttggaagcaaccatgatgccgatatccttcagcaagtgaacaaataaattaactgtggtacgtcctgacaatggaatattattcagcactaaaaagaaatgtgccatcaagccatgaaaagccatggaggaaacttaaatgcatattactaagtgatagaagccaatctgaagaggttacatactctgtattccaggtatatgacatctggaaatgacaaaactatggacaccataaaaagatcagtggttaccaggggttggggattgggggatggatacctggagcacagaggatttttaaggcagtgaaactagtctatatgacactataaaaatggatatgtgtcattatacatttgtcaaagctcataggatgtacaacagcaatagcaaactctaatgtaaactgtggactttgagtgattatgatgtgtcaacataggttcatcggctgttaacaaatggacccctctgatggagctataaatatgcgacaacttgaattctgcttaatggacttcctttctttcttatttcctttctttctttctttctttntttcttttttttttttttgggttgtttcttgcatcttatgttatctctatggtaagtttagctaaatgaaaaattcccaggattgtaaactgattggatagaaattatttgatttttctttatttattttatgtaaccttttaagacccagtcaaggaacatttccatatgatgtgcgtgtatccattaaattatatcatggctggctatgcaagtttagcctatgctataaaatgcctg

SEQ ID NO: 14844 - DNA, 233 bp, Homo sapiens
atgaggcaccatatgcatcgctaatggaactctctccagggagagtaaaatgtgggtcgcagagtcccctgtaagccaccctatcgcgcactcaagttgaatggcgtctgctacacttctatatgatgcggtaccctacacaaacaggcccaattgtttggtgtaaagtcatcgagcaactgatgatacgcatcaaatgctttctcagacgcaatgggattaatcacaggggg

SEQ ID NO: 14845 - DNA, 320 bp, Homo sapiens
  misc_feature (1)...(320): n = A,T,C or G
acctcggcactcctcatctcccctacaacgctccctcacgtagccatccaagcctcgtcaaccagcgcgcacacatgccctcaatctcatcctattgttcaccacgtgcgcgctctactcgtctcgacagaacactcagatagcaaccacacgaccgcgacaccaccacccctccccccacacactaaaccccacacagcgaatgcggggtcggtcaaagaacaccaaccccggctcaacagcgattgtcgcttggacatactcgtctacagtaaaaaggagacgacaaccccaacttagcacnaccacacctgttttgg

SEQ ID NO: 14846 - DNA, 322 bp, Homo sapiens
  misc_feature (1)...(322): n = A,T,C or G
catgaaaaccaccactatgttctttttgttcctttagctcatgacctctccctccaccgaccgcatagcaccctctcgggcattcttctgagtaggaaccaagcggttttccggattgccctctacccgctatcacaaatttttttgcggacacctattctcggagacaggcccaccctcttttcatagtactctccccgcccggaacgcaaccccagacccancncgggnnnntggttgggataagacaatagcaatgaataaatcctcaaaagttcttacgaagccatggatatacaacgggggaaacccgggatttttt

SEQ ID NO: 14847 - DNA, 495 bp, Homo sapiens
  misc_feature (1)...(495): n = A,T,C or G
ctttgactgctcgctctacatcagcgcacaacgactaatcccagtcccgaggttctatctatatcgtgttcgagtcagctgccctgttctctaccgaaccaccattataatctccgtacgctaatagccctcgtagccaacaaccggcaatgagcttaccggcttatcgctcacccacgacactgcaaccccagtggaacaggcgtcggggcactgtgatagttacaatgcgattgcgttagtgaaagcgcggattgttccgccctgttaaagaagcggaattattaatgtcttcaagaggaggggcctaatgggattaacaacgtaacgggccatataaagggtctctaccttcataaggcgcctatcccaaaaagtatgccaggggacacccccagatcccgcgccataccgcacaccctccttgaagcgaaacgagccagacgcgcggtccccgccgcgcacaacgcccacagcccgagacacncccnccnt

SEQ ID NO: 14848 - DNA, 838 bp, Homo sapiens
cagatggaagctttcctcctttggggtcagcgggtggaaaaaagactgtgtgaaaccatggatggcctgcaaccactttgaagaggaagatgatcatgtctcttcacaattctcaggcttggcatggccttattgaagtttattctgaggaaccaaatcaatgagatgccaaagaatgaacatttcacttccaacctgcctgcctctaaggatgttaattcactctagccctgatggggtccctgggaagaactcagacatggaatcaaaatccgtttttgttcccgtgaatgggtgaggctctgcttggcctccaggtgtccagtcctagagacaatgggacataagttaccagccgctgtcgctgtcatgaggcctcctgattagtatctcagccttgacacctacccactgtaggaccttggggagaatacttaacctctgaggctgatttactcatctagaaaatgaggttactgatagcatgcaccttttattattgctaggaggattagaaaaaacagtgctctgtaaagggtttaaacacaatgcgaggcacatatgaggagcttggttcatggtttttacctatggcctaatggatttttacttccaactccctgcgggatgcttagagtagtggaatattaatattgaacaaaaaaataaattatgtgattctactaaatatattatagacatgactaagatgttcgttaatttgtgattactttgagttgttatcgtcattctgtagtgatcagagtcatttagtagtgttacctaatgtagttagtgctgtggtcgcactgcactttgacatataaatattagtatc

SEQ ID NO: 14849 - DNA, 852 bp, Homo sapiens
  misc_feature (1)...(852): n = A,T,C or G
gttttgtgtactagaggcgggggtcttttagtgaaaacanggggatacaaacaagggggcgtatccagtgattttgcggggattataagtccaccctaactaaagggaagacgccgcctgcgcttttgtcacaagcaccatagatctgaaactgcacagggttttttaataaaccacctttacagcacttgtcccagctgccaccgagagaagaagagaagtgcatgaaccttcctccttaagcgagttaagganacatgaggcccaggcactccccgagaaaacagggccgccgaaaggaggagtagctatttaaagacccaatatagtcccatccggtcatagagccctgcgagaccctaagaacttggtccctagtactcacagactttgaaagaataaacatgggcgcataggacgacggctgacggaaggtgtgtgcatgtgcacttgacagaaagggaagaacgggggtagataatattgcaaggaccactgcaagaccccccgaaaaaggaaaagaggggaacgagctctcactagggaaaatattgcccaaagacccttgcaaaaaagaagaaagagggagcctcctttgtgaataaggatgagccaagggaattctaaaaaggcacggagcaagcaaaaagggcctttcaatcgaaaaggattagatttctccacaggagtgagaaatgaaggaaagattgaaaagtactggagcgatctaaaccaggcaaattggggttttcctacaaaggtccggtggagaaatccaagatcttccgcataacgcaatgaaatgagctgtttaaaaaggtcttaaaacaccgaataaaagagggacaagca

SEQ ID NO: 14850 - DNA, 935 bp, Homo sapiens
  misc_feature (1)...(935): n = A,T,C or G
cgcactcaaaggactccaacttaatccaggtcacgccaaagccattcccaaggattgacaccctggataaaccacatggttccaacaggacggcccagttccaattctcccatagcccagaggttttcgactgagtagaggttctcgcttttaaagtcaggcccatcgcccaggcaaatgattttcaaagatgantctgaagttcaaaagtctccgaaaagggcattagagccacgttttaaaggcttctcagcaccaataaacacggaaaagtccaatgaggtaaattatcttatanaattagctagtaaaacacataaacctgatataatccatgaaataaatgtcaatctctcctgaaatactattcctgatataatttgtaatctgtttggagaaatggaccaattttgatctctcaagcatttctgagataaattaggcanagcctttgcataattaaggccatcatgataatcatttggaaaagtcataggaaaaattaaagcaaatgagagcttgttcccaagcttgcaattatgtagggtgtttgtattgtacttgtaataaatacaaccaccactcttacttatctgtaaagtgtacatgagctgaaattacttctccagtcgtctatctaccctcaatttattcaaataaaatcagtaagtactaggtacaagttcttagtgctacaaagggctcaagagacaaatgggacatattctgtcattaagaagtttaaaatcttattggggaaaatgttaacaaggggagaacctggggaaatgtatacagaactcattatatttgcaacttcatgtaaatctgaaattatttcaagaaaaattgtcccaacaaacttatttgtgaactaaaatatatccatgtgtaattacaaagcaataaggcataaataaagacggatcggccga

SEQ ID NO: 14851 - DNA, 1187 bp, Homo sapiens
  misc_feature (1)...(1187): n = A,T,C or G
ctagtgtcgccgatgttatctcccccgtcagattatcaagcgtgcgccatnggcnggcngcttccacgggctgtacaaccgccccggataatatgtttactctcgcacgcatcgccatgacgcgggattataatacaccacggtcgagtctccctcgcgaggccacactttattttcgcgctcattacgagagcgcgcatccccaaaatctaaaattggatagacgggcacgccccgcggcgtttgttgtcacccacaaccctgtcgcccctacgctgttatttcactctttatacccaaccaccaccgcacacttgccctgccccccccccagtgtgctcgaaaaaatctacttaagaccgcgagagggcgcctctcaccatctcggcccccagtgggttgtaaatctttccaccctggaactcccccctttcccgggccccccccactgaaagaggatgcaaactgccacgctcagatgtgaggggggctcaaccacccaaaagttgcgtcttaagtttatataagaccgcttcacccccgttttttgtttatataatcgctgcggaagaacaaatgacattggaggggagtgttctcccgcggtatagtgtccgcccatcaacacaacaaaggggggagtgtgatggtcacctttgtaggcacatttctcctagccccacaccccttattgagtctccgcgtactaacgtgggcgtaccgggtggtgcactccgtcccccatatgtgtgtagatgaggtggggatggtggccctttacagctacccccgcacatgttattggaaggcgggtggagtctcgcccccgccgctagtgtactggtactacacgtctcaccggaagacgtagatacatggtagacatgcacaatggtgtgccgacagtcagtaatgttcgattgcaacggtacgtcgagggagcagggaacgagtggagcgtgcacccgctcgtcatgggcagacatgcagcagccgttaatcggagagacctccggcgccctatttaccatgcgccccgctcgccgcatgntgtgacgcttttaggagtcttcctcacgccagacgacttgatttgtccgcgcccactacttcacatatgatgtattgtaacacataatagagagcgcgcgcctggcagcactcgctttttgttctaacccctctag

SEQ ID NO: 14852 - DNA, 1228 bp, Homo sapiens
  misc_feature (1)...(1228): n = A,T,C or G
gcccgatatcgaccatattaatctaacaacgcaaacgggtttttgtaacacaccctcaaatttcttgtgaagccttggagaatcttaggacgccgcccatccagccataccccaggggggaggggggtcatccaattataatggattctccccaacctgtgttttaacaccatcatttcttatgttttagtccagcaaatcttcctaaaatagacatcgctcacccataagtctctcacaatatgaacttacaaaatcaccctttatcataaacctaaccaacggcgggggaggttctcttcttgccacaagtcatttcctcataccaaaagacacactaatcgatcttagacccactcttcaagcacaaagatcgagagaaacaaatttcctatggcgcgaataacaatatcgcccggctgctattaagcccatacgcgtccccccgcttcggcggacttgatgatatgtgatattatcgcagtcgcggtccgcgtaataaaacgccacgatggtcacctatcaccgattaatatctcaccacgctgtttatctgaagtcggtatcacagatatcatacctatcactaatctctcataacccttatatcatcatagaccagcggtgtatcggtactataggaatcgcgcacacctcggacgaacaccgctaactacttataccgaacacactctcatctggccgagtttatcttctatacattagtatctacatccatctgtcaccatagcgcacctactcacacgtcttaacatacgtaaccaacccagagcgccctctctgctcttcgcagtatatatctacgtcntcgagtcacgtgtcgatgtatatgcatacacctgtaataccacagcccactcgatacccgaactcaataccttcaccatgtgngaggataagnagaagagatatgacacatctgatgtcgcatgtagcacttacgataaccgtctattaatctctcactcancaatcgacagatcgtaacgaaactaccgatatatcagtactatgctggtctcttcgtgtcatgagtgctaatacaacgtattgngctgttcnaccatactcatattgcctactagttgtaaagcacaactcaagcatctatttgtattacaagaatgcgtaatctgcagtacgacgaatcgaccggcgtcacancgcgactacgcagaccgccggnacccaacaaaccacccaacat

SEQ ID NO: 14853 - DNA, 774 bp, Homo sapiens
cgcaggcgcctccagtgattgttctgggcattataagcctaccgcaactaaatggatgccgcacgctgagcttttagtcacaccagacaaaaactcaagctgcaatgcctctcttatttatccaccgtttcaggactactccaacaagggagagtgctatggctgttacctatgaaacaccgcgttatgggaaataatggaaacttctttggctgtctcaaagactgaagactagcggttgcttttacaaacctccttccttcttaaatgaagaggcttcctagcgaatgttgatactgttcacatccactattttgttattgctactctccagaattcaaggacctgccttaccaggatgggactttatttcctcactaccttcattctctgaaaatgccatttttcatgaaaatatatctccttctctatgatgggggtcctgcactcctgcgagctgctcttagtaaaatattgagcgaataccttatccaaattgcttctgcgacatccttttttaaaataaaacgatgttctgaaatgttacccttttacttatttctttggtcaagaaggggggtacccttttttttcaataccctttttttttgaggtaccaccctacgaatccccattttgttcttttcccggttcccggggttaataaaaaacggccttgagcaataattctttctctgttggaataaaagccgaggcgggcctttcctttaactgagggatggctttttagcaaaaaattactggattccccgg

SEQ ID NO: 14854 - DNA, 809 bp, Homo sapiens
cgctgcttacaagtcttcaaaggaagtattctgaggtcaccctatactgactggctcatacagtgaagacaacagaaatgcctcgctgagagctatgcttgatctggagtctgctcaatttccccacccaacctggactgggactacatcaaacttaaaaagctttccacagcacataagacagtcaacatactgaattgactacctatacaaagcgaaaagatattttgccaactatgtatctgacaagaacgataatttccaaaatatatagtagactgttacaacttaacgaggaatgagagaatgattacattgacggaacgagaacttgaatatggaagaaaccatagagagatagaaatttaaatatgaatgagccaaggacttgaacaggcatttcttcagaggacacatacaagtaacctatatgtgcatgaagaggtgtttcacgctactaatcattagggagacacaaaccaaatccacagtgaggtatcatcttatacttgatttagatggctcttaataaaaacattgcaatcaagtatccgtgaggatgcggagaaattgaaactcttctacattattggaacatacaatggggcgatagctactgaacacagaaaaaaaagtgcctcacaagataaactgctatatgatctagcagttctcacttttgccatatatccaaacaattgaactcagatttgcaagaagggttcatactctttgcctatcatttacatagctacaatttcaataagtaaatggcctttgccttaattgaagaagaaatgtgtatttca

SEQ ID NO: 14855 - DNA, 890 bp, Homo sapiens
cccccacaccccgccaccacctacctcccccacacccccacttctcttcacccctacccgcccctctactcaatcccccctccccccaccacactccagccccccccccctccgccccctacctccacggctcccccctccccccgctccgcctagccattacccctcctaaacctcaaatgttctccgagcccttggaaatcacggtggtataccagtatttttgcccataacgctctccagttaaatgttaccacgcagtgcttgacccaccatctgcacttaggtcagtgctctttatcaccccccgcccaggctaacccaatggtgaggaatgtctatcctctaaaccaagcgtctggaaataatggaacttctaaggcgtatcagagactgaagccagcggttgatttacagaacttgtcctcttcactcaggggtctcccaggcgactgctgcttcttacaccatacactatcttgctttggctactcaccagaattgaagtcactgccttgacaggctggagctagatttcctcactacctgcatactctgcaaatgacatttttcatgaaatagattcccttctcagtgatttgggtcctggactcctgggagctgctattcatagaagattgagcaaaagcctttttcccacgcattagcacacattttctttcaaaatagaaggatgcttagaaatgttacaataattaaaatttaattgtgtaatgaaaggtggtaactatctttttaattaaacagatttgattaggtaccaccataggaaattaattgttactagttcctgagatacaaaaaagaaaaaaaaacggaataaaagaaagaatatttctcttgtgaaataaattgtgatgcggccggaa

SEQ ID NO: 14856 - DNA, 154 bp, Homo sapiens
taaaaaattatttcagcggagaggagaaagagaggggggcctgtgggtgaaaaggccgagaattaggggagaaaccatggggatataaaaagggggtgtatccagtgatttttcggggcatataagccaaccccagctaaagggatgccgccgc

SEQ ID NO: 14857 - DNA, 982 bp, Homo sapiens
  misc_feature (1)...(982): n = A,T,C or G
ctattctgcactactctcttattggatcaccgctaatctggccagagaagccgtggcgactagaactagcacctcagcagaggcttctacactctgtccatgatncaggaactgatgcgtgacagacccacgctataccgagtccagggatataaggcaaacaaccaaaatcagacagcaacggacctagcccaaacaaatacaccaaataaatgtataaccgctacaagacacggcaccttatagagatgtttttcacacagtttggcggcgcaaaaacaacagtgaactgtaaaccaactaagacataagaaaaaatagaatagcacgcgaaaagacgagcctttctgaacaaaccaaaaagatgccgcaaccgaacagaccggctagaaaccaacaaaattccgacacaagctataaatgcgctcaaaattaaagagtaataacatctagaacttgactaattatattttaatatagcagagcaatgtctataattacgactcagctctagataattataaatagatcgacaaatacagaatactcagatatttacaacataccactcagcaaaagaaagcacaaagtagaaacgcagactcaaataccccagggaagaatacattttanttgtactcaatgtatctatctacaatatacatatataacaaatatagaaaatgtgtatccattctaatctaagaatcctgaatcaataaggaaaatatggatcagataccagcctgacagtacaaacaacacatacaacacactaaataggagacgaatgaggaaaggaatgtcaatacaagatgccgaggatactgtgtaaatgagagataagattgtataaatgaagcaccaaacataacaccacacagcactaatgagacgaaacacaatgaaggaagaaaaagagtatgactactgatnnccacagtacacaagcaaataagtaaaacagaacgtcgacaacaat

SEQ ID NO: 14858 - DNA, 440 bp, Homo sapiens
cttcccatatccgcaacccctctccaacccgttgatttctacgcctcccttcctccccatcccctgggctcttacccggcccaatcacccttcgtcgtactgtgccgcctcgggagcgccacccctcgaccgcgaccccccctcccctcgcggcctcctcaacacatgagccacatcgtccactcccacaatttcttctgcacccttccgcatactccggggccaacccccgtattttgatgccatgacgccttcaccactagctctcgtccggtcacgatttcgcctagcagtttcacccttagacccgtgcttctttaaatcctgccctggtatgggcaatagaccccttggttaaatgcctcaaatggtttttgtatcgcctttggcaaaatccccggttgtaatcccagtgattttttggccaaagacgcctttct

SEQ ID NO: 14859 - DNA, 942 bp, Homo sapiens
  misc_feature (1)...(942): n = A,T,C or G
tttggtgaatgattggattgatcaatatcgtttaatataccctggcttcatttaatacagngcgatatttagttaatcgggcaggcaaagcggcgctgatgtgtgaagaaggttcggataaaaggtggtcgtcatttacaatacgatattatagatgcagatatattcacagttaacggacggtagaatcgccgctttgccctttcgtcgaaaccttcaaaatgggaggtctcaccctatggggacagatcatcgatggtacatcgagacattttttcaccagatagacatatatcagcaatattccagccacactcaaggtttcagcgcaaacagtggtcgatgcttactgatatcacgcgctctcatcccagattatatccaacctggtagcacgtgtcacaagagaaggctatcgccgaaatgaatagtgaagccagtagcaaaattgctctgtagcgtcttgtcatatattctagcaagctcatgaggtgcccaccaggtcacatacatcttccagctcctagctatagctagattataatgtacattataattatgttattgtcgtgatacagccttacactatcttttctatgccagacatggtgtcactagcgcacaaagggtatatactatgtgttganactcatatatctaggggttcccactaggcgacttcctatgcgcaatagcatcactgtcaagaaagatgtgtgagtcccatgagaagagacaagtagccaacaattgtcactaggaattagtgtttaatcacattgcctgtatgtaatgctatatcaatgantcncgcgccacacctatgaggaagtatgaagaatttgagaggtgtggacagatatagtcttctagtatgtggttcataactcgctcgttagagctacatacatgttataaataataaaataaggatctggccag

SEQ ID NO: 14860 - DNA, 969 bp, Homo sapiens
  misc_feature (1)...(969): n = A,T,C or G
cccacgccccacccatttgtagacgcggttgttcacggattcacgttagcggagcgtcgtccctttcgtttacgggaacggtcggcgcggcgcctggttccgttcggagttacagtcggaggcgtcaccacgtacagaagattatttttgtccgcgcgcagacacgggcgcgcattatacgttacagagggttccacgacgtatcgcttctacacccgcacccatccatgggttgccgcgtgtcagcaatacgagattcattcgagaccgttgcatgcggcanttaacgcancaccgaggggttccacccgaacgcgaccatcgcatcgcgcacacttgtgttaacgtgcatcgccacaatttgaccgtgggcgagccccatggagtggttccacgtgaccgtcaccgggtggggggaaaacccatgccaaccacattcccacaaggcagaggtacaccngagaccccccagggtcacgcgccgtntgggaacgtgagccaacacaccaccaggttatttaagcgtggggcgtgagcccaaaaccccagggtcccgtccngtcggggccanggggaggaaaaaaccanggcaaaccccaccacgcccantcattattcgcggggcattcacacggggggagacacgccatcgccacgccacttccantgcantcgttaccagcggtccccacccacagacacggtcgcgttcacacgtcgcacacacacccgtgttagcgccgtatcacgtaacagtagagttccaggtcgccgagaantccgagtgcgttcccatcatttaaaccccccaccgtagcgacgtcgacgtagcngggngagaacttacaggacgagaanacgaggttgatccntagaaantaatggaaggtcaggcgcgagtccccgagaaaccaatagtattataacagcctggcgaccagtatcgcagcgggcgcgggcttcccagct

SEQ ID NO: 14861 - DNA, 796 bp, Homo sapiens
  misc_feature (1)...(796): n = A,T,C or G
agaggggtgggtgagaggtatgttgcaggataggacaaggcgagggggttaaactgaggggggcggggggatgtgggggagtggtgggggaggcaatgattggacgcgcttgagggggattggggagggactgtgaatggtggggaggggtggcagtggggggaggggggtggttggtggagagagcagggaggggggatggtggagggagatgaggggggagagtataatgagggaggagaaggagtgtggaagagaaaaccgtagtgaaagatggccacgaanaaagtatgatgcgtggagattaggaaagcagggatagtggagatacattagtccacaggagcgggacgggattggaatatcggttttcagcaaggggggggtgcatggacaggaatcccttttccccaaagccagccataaaacctaaaaatatttttctaactttccctctaccttggtgtgtaaaaactggtcataaaaatttatctgacctaccttgtttgactgtaggtcataagacccccccactcaagagaggttcagatctacactcagaggaaaaagtgcatgttcagagaggccaagaacaatctggacagacaggccttgctgggtttccccactcagcatattagcattagatcatacacatttcgttcaattatatttctacatggatgtctgtattttgttgaacctaagcataaaaatggacaattttccctgtatgtttgggtcttcattctgaagacttctatgtgtatacattaaataaaaatggatcggccag

SEQ ID NO: 14862 - DNA, 1246 bp, Homo sapiens
  misc_feature (1)...(1246): n = A,T,C or G
tattatgttaattatctcagtggctggagtaaaagggnagagaggagaagagganaggaggnnnnnnnnnnccctttatttgggcctaacgaagtcacgcgagtgacacactcgncgggcggnccgcatagcattcttgggcggggaatatnatacacaaggtgcgggtntcatcatccacagggggtatttatttntcggcgcngcttactgagagctcatacgcactagatgtaatatgcgactacccgcacggccatggtgactttatttatccctaccatgatgtaatggaactctaagcctggtgggagaaattaattgtattgtaggcccaactgcgttctggagatgggataaatgaccaacagaagttgatgtagaatgaagctttctctcgttgcttgtagtcgtggctaatctcctttacacctctggagaggagaacgagataagcgttgctacacataaatcactatatgtgtcttgttggtcgagagagtggagagccaccactagatagtgctagcgcgcattatttataatagaatacttatctccgtatagactcgcttcgacatcacatcacactgtgtcacagctaccaaacgtcgtccgagtagatagttattatatgacgtattntntagaaggggcgccgccgcgtcgcacagagaaatgatatacgcacgcgtggaagaatatacctgtttctttttgtgaagcagatgtgngtgggtgtgagacactaagatgggagtggccccacattcacatggaacgaacatcacacctgagacaagggaatttgggagtattgtacctttgatgcgtgtagcgcgggttcgctgagaaacaacagaggtatataatatggaggtgttttaagagtcaacttacagaagtagcgaagcccgttgagtcagtgaggcgcaggcgcacaatcctcaatatcataacacggggggtggggatcgtctaangagtaccaggtgncagcgatatgtatatgtaggaaccgcgttcgttttccgatgttgtgtacttgggagggataggaggtgtgagtaagagagataattctaatatgtcctcccatctacccctcaccctgcatgggaacaaggatancnacgatatcncacgttgggcgtttagagcatagaagaccgatataattatttcggattcaccccctatttaggataaggaagtatacttgagttcacactgacatacgcggcag

SEQ ID NO: 14863 - DNA, 251 bp, Homo sapiens
ttaatcacccgctcatcgatgaaaatacaagagtgaatgataagtttccttctgagctggcatccttaccatggaagaatcaaagctgtaaaactacaaatcgttcttcaaatggagccccagatgcagaccatgactaatatctaccgcagacccttggaccagcctggtatcctatgcttttgtgtgaatgactttctatgttcgcgtttctttgtaatatgttctgattgtcttttactattttctta

SEQ ID NO: 14864 - DNA, 789 bp, Homo sapiens
tttgctactaccgccttcgggatatataacacggggcgtatccagtgatttttctgggcttataagccaacccctagctaaatggatgccgccgcctgagcttttgtcacaacagatttgcacttaagcctgatagactgtctaatttagccacctgctcaagtgggagagtgggcagaagcaaacatttatctgttctagaaagaggcgtctctcactggggagcactggttttcatctgagatagggaacatggtggcggtcccatatggatgcaaaaaacaccacctggtttgtgcgcttccctagttgtgagattagacccttgaaaagactctttatagatgaccttatacagagcggagcccacaggcaacaaagttggggacaatcctgtccgcacaaacaaagatggatctgtttttaaactggaaaattcaccaaaaattcgttgtggacctaaacttgagaatcctgtggatagaatactaaagattggttcttgcccaaggaaactcataattccacaatgctttttcatcgagaaacatctaattaattgaaatgacccttggctttcctatgcgaaaaaagtaaagtggagaacccggggggaaaaaaaatttcaatttccaagcccgggggtgaaaagaatatatacttcttcccctgataaaaacattgatgttttgtcaattgaaacgcaagggactttaaattaacttcatggattccaataaaccgcttttttgagtttgtggggtccttggggggagaacaaaccatagg

SEQ ID NO: 14865 - DNA, 997 bp, Homo sapiens
gtccactctcgctttcttctcgggcgtccaaataacctagtcgttacccgccgtcttcgcatcgggcattctccgttagttgtaccgcgtccggcgcttcccacctgagcgctcccggcgttgatattagtaccctacctctctcttcctctgttccgctcctttctttttacgcacccaggcctttatttcgcggagcatgttctttaaaagggtcaacatatcgttcctacggcacatattattcttccccacggattgtttcgataaatagttttttccactctatgtagatatctcccgcaagttagttccataggaccccgaagtgagaagggctgttctcagggtctcctccaaaggcaatgggaaggggagtgttgtttactgggtccagagttttcctcttaaaggattgagcaccagtcctttagccatttggcaatgggtgccaaaacaatgtgaatgtatttaatttctttaacctgcccccaaaaaaataataaatgggtaattctcatgtatttttatattttactaaaaggtaaaattcctttctaaaatgaacagcctatagctatttgcactggctgggtgaatatcacaaatgtaatgttgcataaaagaaagcagacatgccagtttgggcaacatagtgaaaccctgtctctaccaaaaatacaaaacaattagccgggcatggtggtgcaaggctgcggtcccagtgactcaaaaggctgaagtggaaggatatcttaagcctggtaggcagaggttgcagtgagatcatgccactgcacaccaacctggggaaaagaaagaaagaaaaaagaagagagaaagaaagaaggaaagaaagagagaaagaaagaagacagaaaaggaaagaaagaaagaaaacagaaaaggaaatacagaaaccagatgtacaagtatacatactatataattttgtttatataaaatgctacaatcaaataaaccctgatcggccgga

SEQ ID NO: 14866 - DNA, 827 bp, Homo sapiens
  misc_feature (1)...(827): n = A,T,C or G
ccttgtcgcaactgaaataaagtgtcagaagtgcctacgaaacttacggaggattcaagggagaatgatttttttgtgtatttttcagcttctacaaattgccttttgaggcttgtggtcctgtccaccttcaaagccagacacaggcactcaaatccttcttatatttcctcactctgacccaactctgcaccctctcccatccacattattttaattttctttcaaagagnctttgaccatggtcattatgctaagttcacccagataattcaggataatcttcctcttttagtatcagctgattagcaggtgttagaaatatcaaaattgttagaaataagtaattggtgccacgaagaaaagtcagtacggagacgaaagacctctcagcaaggccatctttactttctacagaaagggtgctcattcgcagatggaatcatggcgagaacacacctgaacaaaggaaaagcagacatatttatcccttacgcatttgggtcgtccttactgctgtgtcctgcatccattggctggagcgggacctcacagtctgaaactgatacccgatttgctaatagcctaaaactttcctacataggtaagtgcaagaaagaacaaaggagaggaagttgcttacgaaaggtttaagggaagcataacatttcgaaataaggaaggggcacaggatgtgagctgggatgtgcctgtgagcatgtccgacaattacataggatagggcttaaaaagaagtattagcacaaagcagggggcttgaagaaagtagtcttaaaaaaactattattttaacattatgattaata

SEQ ID NO: 14867 - DNA, 979 bp, Homo sapiens
  misc_feature (1)...(979): n = A,T,C or G
agactagtgcctacatacctcatgctcctaaaaaatatatgatattatctgcaattaacacgcataaaccacatctcacacaaccaccacgcacaccacatcagcactacccggtcagtttatagtgcactctatagcataactagagaattttaaaccatccacatcacccgtggcaatacattctttgtaagtcatcatattgatgtctcctggcactatactcccgtctcgcctgcataattgcatcttcaatatgattcgacgttatacccttccttctcgatccatagcgcctcaattagtactttttgccgtaccttatgactacggctgcgagatctgtctatattgcatccacaaaacgatccttccgcgagaaaaccctacgatgtcgaaccaagcatcatgcgatattctgtcaacttcaccattagcagcgcacaacaaaaagccgcgtgcctcgatacaccgttacataccgctactaactctgcatctaaattgcaaaaaaaacatatcacgatgcaaaacacgcgaatatacgcatatttcggcgagcacttgcatattagcgcaaaaaccacgtgcatttaagcaagcaatattatccatgggaagcagtacgatagagtgacacgtggaccagatgtcaaagtagtaatggaaaccagcgaaggcatttcttcgagacatataaaataaattatggtttgtgaccttaagcagccaaccaatcccctgtcctttatgaatagtcaaggaattgtcaccattgggaattaatgttcttacagttctgctgctcaagaaataattgcttttaaattgctccagggaaatgtctttcttttgtgaatgcctcactaagatctcatcaactctgcttttatttttttctttttacatttaaatataagaattcgcccggcattttcaaaacaaagcagagtccgcccngaaganccgtcccccacac

SEQ ID NO: 14868 - DNA, 710 bp, Homo sapiens
  misc_feature (1)...(710): n = A,T,C or G
agcaggnatggatgttgaccactagggaggggaaggacacggggtcgaggagaacgagagggcggacggaacattgggtcgcggtcggcattatagcggcgttggtagagcgagggggggatatgtgggggcggggggcggttccgtcgtccgactgtgttggaggtggggttggaggcggggcaagcggtgggggcggggcggcggcgggggcgggcggttggggatgggcgcgtggtgcggggtgggcccgggcgcgcgcctgcgaagcctctgggatggagggggagggcgggtgcttggggtgggcaggtgttatatggagcgtggggcattaggcgccaagggatgccttggtagcctaagggggcaaggttgggttcttgcaagctaagagaagagctgttgggccaggttcggtggctcacgcctgtaatcccagcgctttggtaggccgaggcagtcggatctcgaggtcaagagatggagaccatcctggccaacatggtgaaatcccgtctctacgaaaaacacaaaaattagctgggcatggtggcgagcacccgtagtcccagctgctcgggaggctgaggcagaagaattgcttgaacccgggaggcggagtttgaagtgagccgagatcgagccactgcactccagcctgaagacagagcgagactccactccgtttcaaaaaaaaaaaaaaaaaa

SEQ ID NO: 14869 - DNA, 213 bp, Homo sapiens
ctgaccgcgacaaagcctgggatgtggctgacgccgcctttgggatatataacagggggcgcatccagtgattgttctgggcttataagccaaccccaactaaagggatgccgccgtctgggcttttatcacaacacagcttcatcttgaggcaggagcgactgtctgagctcaaccacacgacacacctgtcggactctgggctgtgtgacc

SEQ ID NO: 14870 - DNA, 142 bp, Homo sapiens
ttgcacgctcaagtgcctataatgtgaccttacaccgccttcgggatctataccagggggcgtatccagtgattgttctgggcttataggcctaccccagctaaatggatgccgccgcctgggcttttgtcacagcgccttg

SEQ ID NO: 14871 - DNA, 801 bp, Homo sapiens
  misc_feature (1)...(801): n = A,T,C or G
ttcctgacacaaccgcctataatgtgactgactccgcttgcgggatatataaaagggggcgtatccagtgattgttctgggcattataagccaaccatagctaaatggatgccgccgcctgggcttttatcacaatagtcatgaccttgagccagcatagggatattttagttcttcataaaaataagtctagtgcgtgggaaccctaagcctggttttgaaggccaccacatggttcaatgtgagggcatggggagcatcagaccccaaaggctgagctgcttgctcaagccaggtgcatgatcacctatctggatgttgggaacgaataaacccttcttttctaacaccggaaactgcaaatactggggagagattggatgcgctaatgatgcagtgactaagcctggtgactggactttgattcatgaagaagggagatttgcttgataacgtatactacagaggcctctgaagtatgttagatatagcaattgacccttctntctggaacaaagtccatgaaaattgctctttgactgccgaagaagcgctgcattgcttgctagtatgggagactttctgggttagaaaatgaggggtaaatgcttgcacagctccaatacgtgattatgcacctgactgaacattagcacccaccacgtggtattgatgttctccgtgcccacacaatggaagatttgaggggcttgaatacaagctcaggcctcccacgtataagcttttgtgtaggagaaataaaaaacccctgggctcaggtaaaacttgaaataaaagccc

SEQ ID NO: 14872 - DNA, 767 bp, Homo sapiens
  misc_feature (1)...(767): n = A,T,C or G
atggagcttacggacctcccatttcagtagattttattagggcgaagaggtcgggcttaacatatctgggctcggaaccgcttaatactgattcggacagagaccgcacctcgctatctggcgtggacatagatcaatcttcatgacaataaatctcgtgtagggaacttgcacccttaagagtccaggctgccttttcctctcagagcgacccagacttaggtaagctacacctctggtgtctgcataagaggacatattcaagcatattncataacacacgagctgtgtcctatttctataaacagtgggtatcggacttgtttctagtcgccgaggtgctttcttgagaagaatagttgacgggtgaagtgcctgtctttcgccccagggagccagagtcagcacatttaaattggatagatcctctataatgccttcgtggcttgcgagaaccccgttaacctgggtgggaaggactcgtggcttaatggaattatgggaaatccttctatgccagggacacttgctagatggagcgaggttatgttgctcaatgaagtctaaggcccgttgagccctaaggctcttatcaattcctttaaaggggaatgtggcgccaaaaaagagaacagcgttccaccctttaggtgaggctccctaccgggggggttactaaagttgtttccgaaggctatcttgaagaaagattacctcaacaaaaagttcggaatcggaggatgcacaaaagncggtgccggcggtag

SEQ ID NO: 14873 - DNA, 869 bp, Homo sapiens
caagactgactccagcgtcaggtacataactagaggatatgagggctaaccatcgggccgcacagctgcgttgacaccacgagacccaccctctccagctgcagattgatcatgcccaaaaccacctgccgaaagggactgagcacagacgtgtccatgcgccttatcagcacttcatccaacctagttgcctgccctttttgttgctaggactatcctgacttcatgactgatgggccctttgcaccgagctgcaagatgttcgatggcactgcttatgagaacactgtgaagggagctgtctatctacatctgccatatgaagctgcagggatatatctgaatgtgtccactgatagtgaatcatcttatctgacgactgctctgtggctttaaaagattgcaagcccatagcgaaggacaaagcacattgatgagatagctacgtatgagcctatccttgtttcagtcaagcttaattatactagatagtgcatcgactaaatttgaaagatggctcgccgttttggaggctacctaatgggagaggattacaggggctttcgtactttcactgacgaaagtttagtttataaagtattgtggattgaccaaattagcacacagcagccgaacgataatagtttaggtggcggggtaacaaaatgaatccttgcttcacttacaataataccccgcatgccggcccggtttgcttgtaagcaggggtctaattcattgaacacggccgtaactagccttcattcacactaagtccgtgcgataatccgagggaaacgaacattgtctaccttcaaaggccggcaaattagcgctgtatacccagaaaaaggcgcggtatggctggg

SEQ ID NO: 14874 - DNA, 812 bp, Homo sapiens
gctacctggtacaaccgccctataatgtagctgactccgcctttgggatctataaaacggggcgtatccagtgatttttctgggcttataagcctacccctaactaaatggatgccgccgcctgggcttttatccaacaaatgttaatctaagactgatgggagtctatgcccaaaccaccgttacgcgtgtgtgaccagaggttccacaaacgtgggttagattgctaaagggtctgggctctgatataatgcgccggtcgttgcggataaaatcgacagactctagaaggactgtgccttctctacatagagactaaacctttcctggaccattcttatctgtggcactaacaccctgcttttaaatagcttcttaccttagcccctgtgtcccgttgggaaagttctatctccaagaggggcgctgttaaagaaatttggtaccatctatcagagctgtacagtctgactatgcccaacccgtgagattgaccctgagaattttaccaggggatgaagctttactgcatttttcctgggctaaatgcgctgaaggtttcgggatttaaaaaaaattcttgggggctctactctttttaaccaatgtttgtactgctctcagtcccacactttcccggcctttgggaaactgttcaatttgggattagctattgaactcgtttggggcccacaagaccccgattaccattgcccacttgggaaaggtaccccagggtcctgaaatttggtaagcttgaagcactttcataggtggggtagaaatgtgtttggggacaatatgtttttaaa

SEQ ID NO: 14875 - DNA, 915 bp, Homo sapiens
  misc_feature (1)...(915): n = A,T,C or G
ccacaattacatatagaagttagtgaaaagggagaaggagcttgttggcaacactctctnaattcacacggctaacgngatgaccagaggaccagaatggggtgagttgctcaggggactggttttattataaaggccggacttgatacatatagcagagcctaagaggacagagacatcctaaaaacgttagtcccctaccagatgtagtatatccaccctctcagcactgattaagcctccaatgtgtccaaaagtgcctttttttttgcttatggtaacaatatctacataaactcaacaataacccgccgcccgccgttcctccgtttctacatcgtctttgttctttataccattacaataagtcaattcaagcaatacatcagaccctactcccgcctctacaaggtgtaatagatcagaatagtatagatatcaataaataaataaagacaaataatcaaagaagtaagagtataagtacaatgcagatatcgatagactccgtgaagaataccacaacatcacaataagctagtaattaacggaagattctaatagtttacattaatatacaaaaactcaataaacccaatatctttagtggccaacgaatagaagtggagcaagccagtttcacccgcacaagttaaagaaggtcacgaacaatatctcaatatcgacatacaccccccttacatgaagtattatgtagttcctcaccaaactccagagatacaagcgcgcattacactatcttcttcctccaacctcgcccagtctccatccaggacgcatgtcccntatcatacaaacgatacgtggacgtacaagagnccaatacggtacgaaacactcatcncccatagttgctcagctcgtggtcatgatctcagaacgtcacccctaaag

SEQ ID NO: 14876 - DNA, 914 bp, Homo sapiens
ccaaccgtcccccaaccccctctaaggtgtcctacccctcccccctccagcttcttccaagtcaacacccttccccttgctctccaacccccccttgggtcgggatttctccctatccgacccctgaaaaacccccccttacaacaacttttatttgcccccaaatgggctacccaaaaccattcccgtaaaagccatctcagtttttaaccataccccttaggtatggtccttaaaaccttttttgggtaacccattttccccccaatgctaggtcaaagtagccaaattaggatcttgggttccctcccccagtcgcattgttcctcctggtcatttattgcccccgccagtttatagcctaccccccaattaacaattttatagtggccgggtagcttggtgcggaaggaagtttacccattgctgccataagttgggccccatctataacttgatcccggccaccgcagcaaatttagcacaggtaaaatacattaaagctctaccccttctgaaaattcccagggcttattttaatgggttaggcatagtctgcctgtatagctcagatggagccttcatatttacttttacagcgcacctctttaagagagcacattcccaatggaaaacagcggcaagggttagaagacttttaaaaggaggctgttagccaccccactaaaatttgccccaggtaattttttttctctctctcattaggtctcaatcttctttagtattatgacttatccaaaacagactagcattgaatcagagctctcagtttttcaaaaattatgacatgtttgtttaagctcccccccaaactccctaaatgtactctgggcttgcacctcaataattcttttagtaacattttcaaaataaaaaccgagtcgcgccggaag

SEQ ID NO: 14877 - DNA, 232 bp, Homo sapiens
  misc_feature (1)...(232): n = A,T,C or G
gcctacctggaaccaacgcnctaaagagtacctgactccgccttcgggatctataacagggggcgtatccagtgatttttctgggcattataagcctaccctagctaaagggatgccggccgcctgcgctatttatcacaccctacctatacgacaggcgttgtgactcattcaggggacccccgctagaaaacgcctgactccccttgtgcgcattcacttcctaacagag

SEQ ID NO: 14878 - DNA, 1175 bp, Homo sapiens
  misc_feature (1)...(1175): n = A,T,C or G
aaactaacaggaacctatagcacggaagggggacgaaggaagaagagggacgctaaacgggcaacgnaagcggagaaancttaccaccgcaacacccggcactgacagccccgacggggaaggataactagcaatactggagagggcgggaccaagaacggcaccgagcggcatgcgacagaaacgggggggggacccagagcaagaccagacgaaggagaaancagaaagaggcaccagaccgaagaggagatcaggggcagagagcggggggcagatacgacaactaacaagaggagtagagagagaacttcaaatgaaggccgaaacgccgagtcagctgggacaggggacctggagccagatgagccgcagagagacagtccaaacgcaagactgtagagcgcagggntaggaccgaagcgagagggaggggaccccacagcccagcacaagtacagcgcatcgagcaacaagcacaggatacgagaggagagtcaaaccacagatgagagacacagacgngagccacgagggagcgggggatagagaaggtgtagaggaacggtaggagcgacagatgagaggctccggaaggcaacagacaaggacgacacgcacaccaaagacaaggacaaaagaatcaaagacgaagaagcagagaggacaagcgcgcgacgccaaacacggagcgacaggagagaagacaagcactcgagcgacgaagaccagagctccacgacagtagcgatgtagtgataagagacacgtagaaaacgtggacgaagctcaaccgaagaaggaagagaggnccaacgagaaaaaaagagcgagggcggaacnacagacggcgaggaccacaagtgagtggaggaaagaggnccgacgcagagatcgcgcaacacgggcccgaggacacaaacccacgcacagaccacagagcaggcgaccgaccacacaaccagtgcagagatgacagaagtaagcggcgggcgtccgggcggagcacagcgaggggcaggtagatagacatgatagacgacgccgcagacgaggaaggcgaacgcgagtagaggaaggaacgagagaggcggccacacggagtggaccgagaggtggcctggagagagcgacaaagagccgacgcaaagaaaacgacacaaggcaccaaagag

SEQ ID NO: 14879 - DNA, 1377 bp, Homo sapiens
  misc_feature (1)...(1377): n = A,T,C or G
gcggtgggtaaggcgaacaactttaggaggagaaggaggnnnnnnnntttcgtattggtaactncacaagccgnacgncctcaagaagnnanacancanaacgcgcangaanccaaggcggaacgacacacaggaacaggcgtttcgacgngcagagggcaagacatctagcgcgcccaaaccacgggcgaaccgcgccgaaaaacaggagggacacgcggcgagaagacaacgccagcggagaacgagagagcgcaaccagnaccanaaacacccacagagagaacacaacgcaagagagagcagccggcgcggcanncgcggancacggaggcggngcgcgggcagcgagagagaggaaggcgcaacaacacaggatcttctcctgctatcaacgaagacacacgagggagaagnaacgaacaggggagacacggggagaacaaaggggaggaaaagagaacnagcgagagacgncggggggngacacanacaacaacaccaccacgaaaggagaggagagggagggagacggagagagcacaagcacnngggggcgcgaacaggagagcaccaacacacacacccgggcagggggcgacacgacaccnaccacagcacaacgacacggcggngcgacaacgagacaacacnacagnacacagcagagcgncggaggagngngangggcgacnnggaggcanacanangcaagacgancngagagcacaacagcggcgccaacacaggngngnagagngcaggagagacgangaaaccngcgcggagngcggacaccacacacgagcggcgcgcgcggcaacacgcgcanacgacacaacnacncnacacagngangngcgcngngccgcncnggngcaagacagcacangacgggacagaggagcgcgggcgagcagagggcgaacccaacangagcgggaaacnagagggcgagagaggggggagngngaaggaggcgaaaaacaaccacacacacgagagcacggggcgcacacgggagaacnacaacacacaggacaacacgcgggcggccgcccaaacgcgggaggnggaacgccgacaacacaaacacggcggggngggggcgcgagcaggnacaggcgcacaacaacaacacacacaacagagcaaggcggcgccgacggcgggcgcggcggagggaaacaacaacggcacacagcggaagaacngcggggggcgcggcacacaacccgggaacacacgacgaggaaagaggaggcgggggggaacaaaacaacaaagaaccgggnggggagagcgaaaggcgaaaggaaaggacacacaacaacaggcaaaacaaacacgcggcgcggcggggggcgggcaacaacg

SEQ ID NO: 14880 - DNA, 989 bp, Homo sapiens
  misc_feature (1)...(989): n = A,T,C or G
ctgcccacccttccttacgcccggctctttttctccccccaccgccggggtccttgcccgggcccgccacccagccccagagcagccagtcccttgaaccatccaccaacgcactgtgtgtttcatgctgctcccacaccctcttctgagtgtctcccgctcttgacttatcaagtaggaacctccagactcccaagaatcagagaaattctgagtgtccattcccttggcataggggaatttacccccatttcccaatttttggtggggaacccacccaattagcacccctaagggtgccctcagtttcttgtgccagggcctcagaggcccagatgcttccaggtgttgacttagcgtgccccggagtaagctctcacctggaaggtccagttggtacagtgagaggtaatcccaccccagctgccaaattacacctacatgagagtgaagagaatgcacacccaggaatctgccacacctgccaaacccgtgcagaaaccggccaaggttgtcacagctggttatacacctgttgctaatcatcagtgtaatattgcatatgagaagaaaaagaaagaagagggaaagagggtgcaggatgataaagaccacgttttatccttgctatttgccgccttcgagacacaccagtgttcaacataaaggatgtggttggcatcccaatgccacctgtgtgtcctcaaggaaatcttgaatgagacgggtgtttgaaatgtcagtggtccccacaaaagcacccccagttgaaggcagagactgacattatccggcagcagccaagagtgagcaagaggccccttggtcatgcagcaggagatagcaggagcatagtcatctgctcacactaaacttatgtgaggatgggntatttttggtaaggcctcggccttacagggntaggtatctttttttaagtattcacttttacattatgaaccagggaaataaaagcagatccgccgaac

SEQ ID NO: 14881 - DNA, 933 bp, Homo sapiens
  misc_feature (1)...(933): n = A,T,C or G
tgtatcctactaccgccttgcgggatccataacacggggcgtatccagtgatttttctgggcatataagccaaccccaactaaatggatgccgcacgctgtgcttttatcactgcattagggactctataagctgtggagattctgatgaataaaaccacggaacactagagcatgcaccatcctatcatttgtgaaatctacatgaacaacaacagatatttaggatggggacaagctatatccaacaaatgctccagattaccctctgacattgagatatggctatctatacatcaatgncacatagttgcacaggtgctaaacatcgagtctgggtatacggcacccacctatattgtatgggtgaggagattgatttattggctcgagcgacacttcatcaacatacgctngacaccacgacagtgactgtatttgaccataccttgccgatatacacatggtaacaagtttgttttatggttttgaatatcccaagtgctttttctaacatagggggcgatgggacgagccacaatatggagtttgggcgaaagctttcacacaaacacaatattgtagctgaaccctacgcctcttgttggaaaaacaatagatttttaaacccccaacaaactggtgccattgacatggaaaaggggtcaatagcgaccatacagatcaggttgtgaaaacgtgccaaccacaaaaactctcatataagaaagggtgggccttcaccagtccagtgttatccacccttgatctaaagaaccaatgtaaaaatccctactcaatgctcaggggattcggacaccagggggaatatccgtccacccctatatttattctgaaaattttccacaaaatagttgggtgtgccgttgccgtagtcttttcttaagattcccaaaacattatgtcccgaccg

SEQ ID NO: 14882 - DNA, 816 bp, Homo sapiens
cgccttggggatctgtacaacggggcgtatccagtgatttttctgggcttatgagcctaccctaactaaatggatgccgccgcctgtgcttttatcacagacaatctttatcttgatctgaagtgactcttttggttaaccaccgtgcttaattctctcaccgatgggggatgtgtccataccaaaccatcatccccggactgaattgctgatcagaaaaattaacggacccttgttttttgaccaatttaccccccctggatgctgggatgttaacaatccctgggacaagatcctggaattggaatacctcttgtagactatttcaccagggtaaacagtggttgagctcatcgggcgcctgaattggctgttacaagaaaccacgccttatttttatttccttaccgcgaaacaacttgagcttttcttggtattttctttcagggtcacacagtgaatctgggaatatggtaaaatttttttttgccttcctcattgattagcggccttttgcacctgtggggacctaatataattttaaaccgttttccccaattcactatgtttccattggtaggaaataccataaaatgtcctaaagttgtgtcgcctgttagaaaaaaaaaaccatagggggggggctttgttttagctactcccgggcgccagtggttgcaacacacgggttatctgtgaaaaccccgccttaaggagcctctcctttcccagtttctttttcttaggaattttgaaatccaaaatccgccggtgggaaatttggtaaaaacaacttggtacgtttttttttctccc

SEQ ID NO: 14883 - DNA, 1002 bp, Homo sapiens
  misc_feature (1)...(1002): n = A,T,C or G
accgtctctcgttcctcttctccgtcttcgcctgccngctggccctgtccgcctctgcttctcgccgcctngccgccttcccgccgccccatttcgcgccactctgtcggcactcattcaccgcctcgtccntactgcgtcgcgccctcnctgtttcttttaagtacatacgcacccgnttacacacctctaatagtttttttagacgccccgggtatatattacgcgtgggtataccctgtgatttttttgccctacagagccttatccccagatgaatttgctaaagcaggcaagggtgtttgactccaccagttctgaaattaaagcccgaggtgcttctctttatttaccaccgcctcccagtttaagtttgtcatttggatgggcaccccagttcacaaccccgaagtccccaaagataaataatctgtattttcaggaaaagacatcaggttgaaggtggcccctccaaagataatgtccccctggaagctgtaaaggtgaaaaaaaggtcttgccaggtgaaattcattttcttcttctcttgtttggttctgttttttaagacagagtctcactctgtcacccaggctggagtgcagtggcgcaatctcagctcactgcaacctccacttcccaggttcaagcgattcccctgcctcagcctcctgagtagccgggaggcatgcgccaccatgcccggctaattttttgtatttttggtagagacaggttttcgtcatgttagccaggctggtctcgaactcctgacctgaagtgatctgcttgcctcggcctcccaaagtgctgggattacaggcatgagccaccgtgcccggccctgctggtgtaattcagttaaaagtcttgagatgacatcatcctggattgaggtgggccctaaatccaatgacaagtgtcctcacaggagaagaggagaaaacgcccacagaggagagggcaacgtgaagacagagcagaacctggagagatcggccg

SEQ ID NO: 14884 - DNA, 2014 bp, Homo sapiens
  misc_feature (1)...(2014): n = A,T,C or G
tatctcttatagtatctatatantctgtctcagtctcacgatngatactacgcnataccttaagctactctatgcacagagtacgncacnacatgacattattagtcacactccactgtgtnactctgtgactgacctactacagatgtcgccngttgntatgtatgcactcttctcanctnantcagcatctctcnccgagacgcacatcattagttatcngactcgnctcgctcatatagagcantatatgatatatatcntatntataccgccnagcgcatctcaatataatgtactcatgatcngactgagtgtctaccgagatatgaagagccgtacagcatgatgggctagacatgactatcgacgcgntgataacgtgcacaccactacacacctcctcactcatnacctcacgntgtagtcgtcgcgatgnatgaacactgagctcaacgagatacgtntgccagagtacatcacatgatccgtgtatcggtagttggagagctgtatatctgagtcactcactctatacacgttactagtgagcactgagtgntctacagtcagtcagcgacgtagtgtaaangatctactntacgctatagcgacatctcgacgtccacagactgangatganngcagantanacagctactctaantagaatactacgacaatacgnagcngagntgcancctacagtcaantcgtgtgntatatangacgtagcgtagactagntctnancatntggtcagtgaacgagtctatnatcctacataggactagtccgcgcgcgcatcaacagtgagcactgacgcacttagtatatcatacaatatgtgatcgagtcntcgcgcactataatggcatcgcacagcgagcgcatcgaccgtcatgttatatgntgaggatgctagcgctntacccgtccgtcacnctctcgncagcgcacgtcactcagcatatgagcgatatcnatcntacatctctagtactnantcgtatatacgtcacgtctacgtcatcagcatatgacagaatcatgtattatantctatcgtacctcgcgcagcgactcgcgcgcactcacgctcgactgcatcacgagcanacgacgccagcacgtcaagcacagttgtagtttgtgacgtgtgantcntcgcttagatacttactcatgatctgagcgtgtatcatcgtatcgtatgatgtcgcaattccatccatcatagtcatctgatcgcgagatcncgctgcgccgcattaaccgctagctaatcgcagctcctatactctgactcatagtatttattatctttaactatcaccattagactgcatctctcatcacgatctcatcctcgccataccactgatgtcgtgagacacacgctcacctcataacgctaaccatacgttcgccgactacntntctaccactgatcattacggcgactcactagagtagtatcagatcataagcantcncgtccgtacatnatgtncatcccncgatacagatatacaacgagtgangatcacantacacatacgacaatatctcgacactcntacatctcacaaccatgcaatacgcgctagaactagatatacgtagcgacacccgtngcgcgacgcgcacagcgagcatgttatatactacgcgatagatctcacantatatcgatatcgtaatcatgagtgcgtaatactacgattcatcgattctncacgcgttgcgttatgactatggacanacagcacgacgcgctctcagttcacngtatccactgcacactctcnctctcagctacgtgctatgtctgancgcacactcgntgnctgtatgtactctcactatgagagcttacatatacctacacacatgcgttnaatanacatatagacgtgtgtgcttgactccacatctcatgcatcacantcgtgtcatatgtgatcatgcttacgatcacntcgcacataatcacgntcacgacatacacacc

SEQ ID NO: 14885 - DNA, 927 bp, Homo sapiens
actacttatatctcacttatttacacacccaaaggagagtttcttggagaactaacgccttaaaattgagtttattatgcctttgcggatatatcaccaccgggccttatccagtgatttttttaggcttataagcctaccccagttaaagggatcccgccgcctccgcttttatcacaacattatgtaactaaatctcccattgtccatctgaattaccacaccgttttaaacaaaaattttttatccctatcataaactcaatgatgttacctccactttttttaaaggctccctccttaaacaaccatatctttttgttcaacacggattgtgtgagggttcttttggatggtccaccaaaaaagatcgcttcctgaaatccaccccatatcttttgtcctggaaaaattcagacaactcttcccaccttatgttcgtccaaatatgcccttttttggaaattcaaaacccaccattggatcaccgctttagtcccccacctcctttttactcgtattaaaagatggtggtttacccctgttccgagtcccggtcttttaaggattttaaaccccacctttttttaacgaaactaaagctggtcgagatagtttttgattccatcaagacaaaaatattttggtcgaatcacacaaacactctttcttgtgtctcttcttaaaattaacctccttatgatttttagaatttacaaaccctcctattacccgatgacccttcacttttctgtcagataaataatattagtttctattgcgcccaatccttattttatatgtttttgtcctaattataatttatttctcgattcacaaattattaaaaactctgcctgccctcttctccttaggattcttttttccctgcttcttacgccccctaccagtttctgttatgatatgg

SEQ ID NO: 14886 - DNA, 934 bp, Homo sapiens
ccactgaatattagtcccagccgtcgtctccccctcccgtgtaaacgctcgtcccgtcctccacccccttcctcccgaagcttcttatattccccttgtcatcatcttctttccctcaccacgcacaccctacgatatactctcatccttgttctttagaacatcacccggctaaaccctcaaattttttcatcccctgggatactcacggtgtattcccttatttttggcaaacagcctttccagttaattggtaacgcagccagtgttttgaaccccagtttggaaattagctgccagtccctttcttaattcacgcccctacaggtttgcatgtattgaccctttttgtacccaagggataattcccccttcatcatgaagtctccatcaaaaagtgaaaagctgctttcccgaatttgttaacgaataatgttctgaggagacttgcaccttgagaacaaaagggactcttctttggtcctaatcttaaatcccatccccttggctgcaactgctgagtgctggtaatgagtgttgagaggcaatccgaggatggtgattaggtattaagcctgggcaggtattaaccgagaggtgtgtggacctttcgctcagcaccacaagagcagatctctgccagcaagcttatctggccatcagccagggacagagctgcactgtggcaaagtgaaatgtgattttaatgattctgagcacatggtttctgcctccagcatgctagatttgtagactggcattttttttcccttgggtagattccagatgttgtataacttgtgcctttctaagttacagcatggtagatggggacttgtctttgttatgagcatgtacaatgtgggtcgcagttaagcactgtcaaatagcctcctaaaagatgagtttgtgtggaataaagcacgatcggccg

SEQ ID NO: 14887 - DNA, 887 bp, Homo sapiens
tttgtttttcccccccacaggccctcttaccccccgttttttctagaagcccggctaccccaaatcttttagccgggaaaaccggggaaccggttttttgcatggcctatcagtatatgccccgcaggttttgaacagttcgattaagccaaggcttttattcccccccccaaaagggtccccatttaccaggggttttaatttacctcaaaaggcttcgctcccgaaaaaggatccgttgtagccccccctcagcagttttctttttaaaataaaggagactttttccccctgaaaaggtattgtcttatctcaaacccaccccttccaaaatggaagcctcagaattcctgctatttacagaacttagtttcagttcatgccatcaggtttcaggagaagcacatgagcaggccaacttcccttgaagctggtattcaagtctcttggaattcttggtttaggaaacatcagcaccagctgtccagctgctcaagtgaaaaacgtggaagtcattccttctcccttagcccctgatccaatcactgtgtaccttcttaaatatcttttgaatctgaccattttcctccacctccactagtactaattttgagtttatctatttttagttattacacacattagtgcaacacgctaccacatttctgtgctatatcttcctctgctgtaatccattccccatgttagtcaaagtaattttttcaaaatgtgattatcagtatgtcacttctttacatacaattcttcaatgttttcccattgcagtgagtatacattctacccattatctgtgtattagtccgttctcacactgctataaataactgtctgagactaggtcattaataaagcgagatgctggccgg

SEQ ID NO: 14888 - DNA, 932 bp, Homo sapiens
aagccatcgtcccactcagccatcgcacccgctaacactttcgcccgccaaccccgctcctcctctgcccaacctctgctcccgcccacccctcacccctcccgccgccacccccccgcccgcgccctcccgcggcgcccctccaccgcgccagccccgggggcccacgggggttcgtcgcaaccgtccccacccgtggagccgaacacggtcctcccgcaccccgctaccccttactctcgggccccccgccctccttctacacacaaaacccgcgcaccacacacattcacacgaccaccctccccccgccggccttacccccctccccccccccctcccttccttcccactctgttctacccaccccctctcaacggcctccctccctgtgccgcctagccctgccatcccttcctaggcccaatttcaccacaaaccacctacaaggccattcgccacactaactcacagcaactgcgccttccttgtaaaaaggccctcctcagccccgaaccggctcacgaagctagactcctgcgtccacagggccttcctacaggggacattcttttaagccaacaatgcgccaccgccggcaagtaaggggattgcacttcacccccaccaaaaggggcctttctcctaagcaaaaaatgagtcctttcctgccaaacctaagtgattgcaaccttcaccccctcatatagggagtttaagcccaccccgcagcctgatgtttttacccaatcaggcctcccaacccccaagcagatagaaaataagctaatcctatgggacagaaaaaggaaaaggggaggagtcataagaggatataagcataagacacccaagccagaaacggaaacccttacgggtctccttccaccacgtggaaggtttactttcgcttttactgtacgttcacttta

SEQ ID NO: 14889 - DNA, 994 bp, Homo sapiens
  misc_feature (1)...(994): n = A,T,C or G
attggtggtcgggtatcgacgagccatatgttcttcacggagagaacacttctggtggtaacctacacaacacggcggtagcctaatattgtcttgcaaacgtagccgcccagcacgccactccccggtctacactgacactatcgcgtcaacgcgtatagggcagtgatggccccaactagcgcttctctccccggggatcgtgttgagacccggaaaattccccattctcccgccctttgctttttctccgaggttccgacaaattcgaatcggaagagcaatggtattccataacatggtgcatatctcgttcccccacagcgcacaataatgtaagtgccctctccccctttgccggtccccccgaaattactgaggaagaattattgattttcccataaccccttaaaccccgacactcttaaagaaacccctaggaacccctttttggcctcggcccttgggaaataatttgtgtctaagtcctcaaaagcaatgtttaccccaccaaacaatggactagtggcgccctatttaacaagaaaggcatttatacaggataaaaacttattgccagagtaccagccaatcaacaaaatgaaagaacgtattctcaaactatgcatccaacaaatgtctcccacccagaaagtataagaaacttaagtaagcagaaaccaagtagccccattaaaaatgggcaaaatacatgaacagacccctcaaaaaaagacatacaagtggccaagaaacgtgttccacatcccctaatcttcagagaaatgcaaataacaaccataatgagataccatttcacaccagtcagaatgactattattaaaaagtcaagggaggctgaaggaggagaatcgcttgaacctggaaggtggaggttgcagtaagctagatctccanactcgcatggcagcctgggtgacagagtgagactctgtcccaaaaataaaaaaagtcaataaacaaagatgggccg

SEQ ID NO: 14890 - DNA, 192 bp, Homo sapiens
  misc_feature (1)...(192): n = A,T,C or G
cccnatgtgttatgcatgccctggtaccccaatttttcaccctgggaatcccggggatccgtgtttttcccaaagccctcacagtaatttcccgggcgggttttacccacacttcacttaacccaggccttttaatcaccccgcccggggctgacccccgtgggtaaaattaacacgggagggttccatttg

SEQ ID NO: 14891 - DNA, 940 bp, Homo sapiens
acctcccgcgtggccggtgtattcgcgaatccagggtaacttcgggtatgctatgcgctccgcggttactccttccgtcgtcctcacccacctgctcctcattcattgctctcataccaccgcgtgcggtctaaccataatgcatttaatatatttatcttctacctttaataaccttcttactaatctttcgtggctcgggacaaatagtggcacgggatataacatatccccatgcagggtcggatgtcactaaaaaagttgcccataggtctctcaatcctttgacggattaaatgtcccccttcgactcttgttctacactccaaacaatcccagcaaaaataaaataatgctctctcagttcacaatgttacactcaacataccaaagaaagcggtcggaagcatttcaacatgctttttccccaaaaaaatgttgcacgaccaacaattagtctcgtgaaagggtgctccaccattgttaatcattagggagacgcaatgcacaaacagaaagatggatggaaacttttcacccactaaaaggcatgccccaaaaaagccagataacaggtataatgatgtagaaaaactggaaccttatgttattggtgggaatgtaaagtggtacagaggctttggaaaataatctggcagttcctcaaatgatataacatagaagacagcaattctacacctagatatgtacccaagaaaaatgaaaacatttctaaacaaagatgcgtacgtggatattgatagctacattattccttatggcccaaagtggcaacaatctaaatgcccatcaactgatgaatgaataaagaaaatgtgttatatctatacaatggaatataaagaaatgaagtactgttccatgctactacacagatgatccctgaaaacattatgtaaaataaaacccgatgcggccg

SEQ ID NO: 14892 - DNA, 917 bp, Homo sapiens
acccctcccatctcgtctccctctcccccctccacacatcacgtactcccaccccacgcgccccccccccgcggcccgcccgccccccctcccaccccctctggttgttatggacagagccccccacacgcccaatgtcttcgccccttgggaaacaaaagtgaaatccatattcttcggtaaaggcccacccactgaatctaccacaccagttctttcacccacagtttgaattagctcaaacacttctaactacccccccctcaaggtcttaaatatttcttggtcgagcgcccattttcgctttgcatcatccgggaaggaaagctgccatctgcatatggttttttgtcccacaccaaacttcaaaggcctcgcaatccaaaggggagcccaacaggtccctttagtccaaaacaggggcaataacatacgcagatcctttattaggaaagtagttcatggggattggggaagtttttagacaacacaaatgcccatttgaatttgaatgaaaataaaccaacctgaatgaaacttttaatactgagagacattgcacttactttaattaggaagtttaagtatttttttccttactactcagttatagaaacataaagaatgctccaatgtttacatatttcagtgtggtggataaaaatctgaccctactacaatgagactcccaattttggcttccttaatttggaaccttacccattggagaccttgtttcctggtctccccagatcctatccccttcatggttctgcgccagagaaacgggtactgggtagaaagctgcagtccatactggctatactgctagtgagccatatgaccactttgcctcttaattttctaacccataaaatgggaagactaaaataaataaacctaagatgctgcctgaa

SEQ ID NO: 14893 - DNA, 576 bp, Homo sapiens
  misc_feature (1)...(576): n = A,T,C or G
catcggggcgaccctggggctcacgccacagctaaatacgacacgagcaatacatccacaacgctggataccacccccgcaccccgctcgcatccctcgccccggccaacttgcgctgggtgcctgtggcggcgcgatcccaacccgcaactcctagtgcacctgattgacccggcaaccacttcctcatattataaagtgacgcacctctctctgtaggcctaccacaccattccaacaccgccctgtcaccggcaggtacccaccgaacaaggcgatctgcgcccaaccgcaaggaccaacaacacgcgggcgcgcctccccacgcgtgttctccccacaccctgcgaccagggctcaagactactcttggctctctccccctgactgcaccgcccccactcatacactccgccacacaacactcgtcctcacccacacactcatacaacggcgaagccgaaccgacgccttcaatccaacaaaacacctgcgcggcggaagcttccactaccccgcccgctgcaccagtcccaccaaacccaacccantcatccccccncccccatggttctg

SEQ ID NO: 14894 - DNA, 937 bp, Homo sapiens
tttccccgcgcgcaagacacaacaactttgcagtaaaaacggaggttgagaacactctcaagttcgcaactcttagggcccctaactccgcccccccgcttagccaaggggccccattaagatcaagcaagtgtgaaattcacaaatctaccgcccccgagtccagcttatttccgattccccgcacttaggcagaacggccctaaaacccccaattatttttttccccttcccacaaaactaaaaaaccccccatggaaatggtttggaccctccttacccctacccacccattggacccagaaaagagcattttcagaggatcttaccacccaaaattaaaacttccagccaaaaatcagctccttatcgtataagaagcaagaagccatgccaaatctccagaggaaagccaattcccagatccccattccagatgcgagagagaatggaaatttcgaagactttacaccagtgctcccaactatgcttgatgaagtaaagttcgaaataaattgagagacaaaagttcctagcagaaacataaaacctgtagcaaataatcatatggaaattttagaactgaaaaacacagcattcataaaccaaaaaaactaactgcctgggctcaaaaagagaatggagatgacagagaaagtcagtgcccttgaagaaaagtaaattgagcttatttattctaaaacacatacccccatgagaccatcacaaaagatctaatattcatgttatttgagtacaaaagagtagaaattgtttcagaataaatactgggaaaaatggctgaaaatttctcaaatttggtgggggacattgccagaatccaggaagtcagcacccctcccaacaggatcagagcaaagaaaaccttgcccagacatgcatcataatcaaactgctaataaacaaagatccgccg

SEQ ID NO: 14895 - DNA, 628 bp, Homo sapiens
aaggactatcattctcgtctgcacgctggaaagcgatgtaactgttgggctattctcaactgttacttactgaatgacagtgcttcaggagactatactttcagagtacctgatagagaaccgctgaccatgcgtccttagagaacagactctcaacgactgcctaccgctgccaatatgagaaggttagtcaaagatgctcagtacatggatcccattcttatgtacgagaacagggagctagcttgataaagtactcaaaggcgggactacagccctgacttaaaggtgaaactcgcaagtcacaagctgtgagacgagtgtcaggatggagtcagatacctcaatggggtggagggtactagctgtatttctataggcctccgcctcccgtgcttagcattaacaatatggtaaagtttgatagaaaggtggggacctccttattgagacattatcgtataccatagcggttaaggcccggaagattcccgtcggtctcctttaagtgacggactatgcaggattactgggttcctgactaccttgctttccttcggtaagcttgggcctacttaatacccacactagaagggtgtatactggtatacacgcatcagtggatacg

SEQ ID NO: 14896 - DNA, 1560 bp, Homo sapiens
  misc_feature (1)...(1560): n = A,T,C or G
ctgtctactnggagtatgactagtctacgtctcagctcggaatacgtgcanagtgttcactatagtgtgtataggtttgttagtgcgtatcatcactttacatgttttgtcaggtgtatagtgancgtagaagactatatcgtgctagtagcgtctgtgctgtggtgctaatcgatgatgtagnnacatacgacgcggtaactgtcagtactagncgaagtcgcagtcgcggtgtgacgtatcattcgtgatcagnaagacgtgcganctcgatgtagtcatcgtagttgtggtgtactagcatatagacgacaatcgtgatcagtcgtgtcacacctgtgccgccgtcgtcgagcgncgtcgcagacacgagatgatggtgcgnagcgacgtgcgatgttgtagctactgcgtacgtgnggaggggataacatgtagggcgtaacgtgacgtacgantgtgtcgctgtagcgcggtgtngtactcgattgagtggtgtgagtgtgatatgtgatgtagagtangtgtgacgtattcaggtgcagagagagtcagactcgcagcgagtcgacggattagtagtgagtgtatggtcgcgtagcggcatatgctgtagnggtatcatgcacgctngcggtgcttatgcgcaggtattgcgatnagtgatggtcgagtatgtgtatgtgagttggcgatctgtaccacacgcgagagcgtatgtcgcaccgatgaagtgtgggatactctgcgagagagtgtgagctgtngnancacatggtcagatacatcgtcacttgccgtggtaccgtgacgtatgtagagnttgagtattcgcagagtttttgtcgataggtgatatttagtttagtgaagttggtgtgtaggtagttggatagctccagtcttggttctacccacacctgtgcataganttattagagagatacttgtcttacgtatcactccnanagtcnttcagcgactgagagtacagcgagagactctctcaattctacgtctgaattcatagactacgacgacaccatgcgtcgtatcacatgtgcgactctngatngcagacgagatatagcgtagcngtacgcgtccacgatagcatcatatactacgccagccgcttgctcagtgtacgagatagtgacnttgctgtacnanctttgattatgccactgtgcgtacatagctttacgcagagaagagagccngtatagagagtacgtgttctatgncatcgtcttgncnanaatcgtntncnagaagggagtattgtgnaatcgtgagatcgcgacgctctagttgcttctnttangaggtctagngtaatacaagtcaacgtgggacctatggcnatantnattcncgaattgtcgattcaatatttctcgcgagggaagacttctgcattatacgcatgacttatgttacgataagtcgtttctttagatttnatacagatctagtgacaccactataggatngcngttgccaagcgatcttctccaatatgtctctctctgcacaannntnttcttttctctcatc

SEQ ID NO: 14897 - DNA, 839 bp, Homo sapiens
tccagttccttcccacgatccggaggacgagtattggccaacgcccgcaccttcaggacactgttccacccaaacccgggaaagcaccgttagctgtgcagggtatcagccaggttggttactgtcctaaggggccgggagttcgcccctaaaaggcttttccatggaaagggaattatagatccaaagatttagggtcgatataaggggagaagagggaaataggggaccacttggttttgggcagtgccctttccaatcatttttagacccattttgcaacattaacccagtcattttacaggaaagagtttgttctacccactccttccgctttaacctcccagatgtcttggtcattctagaattagccaaacttactttgtttggagggacttagttaccagtttaggttagttttcccagaacaaacccccttcctggttggggactagactgcctttgcaggactaacaaattctaacaagattagaaatcatggtttaggagtcatgcagctagaggctgcaagattctaaacctccctaaattactcctggggataacatcattattgtaaaacccaagatcgtgtttgagatattttgcagaccctatattcaatggattagctggcaccacccagactgatataaactggcctatcttgtcttgtggcccccacccaggaactgactcagcacaagaggacagcttcaactacctatgatttcatctccaacccaatcaatcagaactcctgactcactggtcccctacccacaaaatcatcctttaaaactccaattcacaaattctcggacagactgatttaagta

SEQ ID NO: 14898 - DNA, 913 bp, Homo sapiens
cactccaaccaactctacacttctccatcctcgcctcctctttctctcgtcgtgctccccccaatcccccggtcgtggttgtatggacattcgcctggtaaaccccaaagtttttctacccatggaaacagcggggattccatgatttttgccaaggcgctcccaaactgtttaaggcaaaatgattccccccataacgaccgatgtattgtaacagtcagcatcagtccggagcagcaagaccagggtcagtaaagactcctatgggcgccggaataatccaggtttatactaccaaaatgttgtcacagtaaggaataatttggagtcagagacgatgagtagtgtaaacatgttgatcttccccttgggcaaaaaaccttgaacctttgtgcggatcaccaggatgacagtgtttcactctgttgcccaggcgggagtgaagtggtgcaatcatagcacactaaagcctcaaactcctgggctcaagtagtcctcccacctcagcctcttgagtagctggggttataggcaaatgccaccatgccaagttaatttttaaaaaagattttttttggtaagataggatctcactatgttgcacgcactgatcttgaactccggggatcaagaaatcctcctacctaggcctcccagaagaaaacatcattattttaagctatattacagatatctgggtgtttaaatgagaaatgtataaacaggatgttcacatatgggaatttgatgggttttaatacatttcacacatatttaaggagattttaatcccaacatggttatagtaggtgacaataaaccactttacaaaacagcctctctagtgtactcttgaattacatcaataaaaccatggcctcgttggcctcagcggtggagctctgcggccgga

SEQ ID NO: 14899 - DNA, 769 bp, Homo sapiens
attgattactcggtaattgtgttatattagtatgggtagacgtctttggctattctgtgttaaggatagaacagacgaaagcccaaaattttttgagccatggaataaccagtggaaaacagttattttgcctataaggctcctcacactgttaaggacactatgattcccccaatataaagccatggtaatgtcacaggtcaagaaaacgtccgggagtcagactaaacagcgttgagaatgcgtccaataagggaatatttccaccttagtagtgaataagggagagtgagggaagccttttatgggaaaacaggcttgtgcagaacaaagcattgaagtgagagaaggccaccgatactctcaccaatttactctttcaacaaaataagagaaaggttgaaggccccaagcaatttcatggagaatgtttaagtattctgagtagtgcggtggtaagtaatagaactctggcaagatgagttagttactccacaaagggtatagttgcaatgctatacaagaaaatgatggagtcatattatgtatcatttataagtaggcatagcagttataatagcatcatacggcttaatgttatttcacacaggcatagaggtctgatgatgaaagagtatgctcaataattgtgtacctatagcttaataatgataaaggggttaataaggaatatttgaggtatagtgctttgcataaaggtcataataagccatacaacatgggtaaaggttatattagctagagaatc

SEQ ID NO: 14900 - DNA, 750 bp, Homo sapiens
ctcaacctccttgtaagcgaattaaatatataaatgaacacattcgatatgataaaagagtgggatagaaggatagttagtaaaatgaagactaagatagctaatcgcacacaggactctaaccgtaacgaccgttgagcctataatcacgaacgttatgatgattgtaaagaacaaaatatactattcatatgactttatcaactacatgtcacctcaaatcatggtactataaatcatgtacgtggaggaaccaaccgaccaacggcggctactggatacaaacaaaggaaagagcaattatgcagtgtgctgttttgattccataattacttcatatagagggggtacggagcgataggatgacatttctcttttcttgtcactccaacaactaaaaatagggacttaatcccacaaggtctttctcttgacgaatggaatagttttttggagttcatgctgtgtgatagaaatagcagttatggcttgtgtcgttattttcacccacgaaggaaaaagatggtcggcgtagcaaggaaaatatggacaaatattggtgtgccctttataagtaggcataacagttatagtcaaaacatagtgttttttcttactccacacaggcatagagtgtttgttattaataactatgttcaaagattgtgtaccttaggctttttaatttgtaaaggggttaataagaaatatttgatgtatagtgccttgactagagatcataatcagcca

SEQ ID NO: 14901 - DNA, 920 bp, Homo sapiens
  misc_feature (1)...(920): n = A,T,C or G
acccccccccgcgcccccgccctctacacactcccccccccctcccttcccttnaccacccacatttttgttaagactgagccccccaacccccaagttcttacacccatggaaatcccgggtaaccaggattttggccaaagcctcctcaccatgtctagtcccctatgattctcccattaatcgaccgagttatgtcacagctcaagcatgaagcccggaacagccaagcccatggtcgagtaatccgactccctataggccgacaggctgctggttggtggacacccagaacctcctttttacctcttgctgcaccnagattcataggagacccattcttgttggcccagctcaatggaaaagaggctgcctcattttccctgctgaagaaggagaaagagctggctttcctttcttactattaatgtgtgttcctccctttccaagttaaaataagtcaccaaatgcaggtcaatttctataacatcatagttcattacccaatggattagtcttttgtaagcgatgttagaagcattatgtccattaattacactatcctatgtctagggaaaaaatatttttttgttccacgtaactcactgataagtgaactttcaaaatacaaacctcttgagcaagataggaattcattgcactggaaagacattatttctattctgttaccccccttagaatgattaaataacagaaactagaaatcatgtgcttttaacaccaattaacaatgcatcttgtcagttaatagggttgaaaaaagaaaaaaaatgcatcctggttttacttgagtacaaaaaaaaggcatccttcccccctacagcttaaatcaagaataaagcaaaaaagaataaactactggcctcgttggcctcagcggtggagctctgccgccggaa

SEQ ID NO: 14902 - DNA, 810 bp, Homo sapiens
cagaaagtatataactgaaggcaaaatgatacttatttggtggtatctgggagaacacagacgatctaatgaagaagagttcgagagcttcggcaacccacatatgaccatctccacctgcagaacttcataaaaagatatatagaaaatatgaataaaagataaacaacacatcaaaccttttgagagtatttagcgattggacagctacatgattgataaaattattgcaatggtaatgacaggaaagaaagaacattaatcaatatataattcctttaagctcaaatcttttatatagctttctccccaggatttttattgaatacaatcaaagccagtttcaaaaactgcagcaaacatattgtgtgctgtgcttcaccaataacattacacagccccttttgctggtgtcatctgatatctaagcatgatgtgttgcagtttgtctactccatctcatttctaccatcatttctcttcagtgtctaccacgtggtaggcactattctaggtacagaattctgagcacatatagttaggatttgagtggtttttgagtttagagttagtgagtggaatttggtaataaataattgtaaatgtagggacaaagtgcagctgaaaggaattttttctcttaacatttctctttctttggaatgcttaactctcatcacatgccatgccccacgtgccaaccctgctgtgtaaagctttgttggaagttgaacattgtcatctgtgccactgctctggaagcagggattagaggagtacaggtcccgcgtataatggttttactaagat

SEQ ID NO: 14903 - DNA, 937 bp, Homo sapiens
  misc_feature (1)...(937): n = A,T,C or G
atagcgcctgcaaatccggtctcctccgccaaccacgccactgcctttcgacggctctgccgcgcccggtcccactcccttttgccgcccccatccgtggcctcgactacccaataggtgccagcgcatccgccacccctccttctgtgggctaccccttctgcaagagtgcccgaatagattcctctttccccgtacgttcgtcccacgcgtcgtgttgagaccgctcactctgggacgtgccaacaacctcccttaacgtccttgagacgcgtcgccccaccgtgcacgccccgccgtggagtctcgaccctgctcactggttgtccgctacaactggacccctatcgcggtctcgagtgtggactctgccacctgcccaccctcagtgggggcgcatccgcctccttcccttcatttttccactcctcctacggttgtgcacacggggccctcaatcgccgggtggcttcactgggactccccatcgccctcagtgacatggaggtcgccatatccgcccgtgcccctctcggccaccagactctcccatcactctcaggtcccagcattgacagggctttcccagaggcatccagcgcctcttcttcaccctggtatatatccttagccagcacaagcgcatacaataccaatttccatctcattaattcccaggatgttgttttcctcccccccaaaaaggtatgataatataaagaagattgaatgagaggttttcatttgtccaacatgaaatctgataactcaggaatgatgttgtaaataatgtagacatttttcaaactggcagttggtgaaaagaaagttaataggtttcccccccctaataaggaatgaaatgaaagactgaataaattcatggcgtcgcgcgcctcagcggtgcagtaggtgcgccngaggnnctttatttctt

SEQ ID NO: 14904 - DNA, 920 bp, Homo sapiens
  misc_feature (1)...(920): n = A,T,C or G
ttagcttatctgcttttttccacgtcttcttatggtattttttactttctttcctgctgctacttctcttcctttcttatattgatactccctctctgtcacgcccactttattagtacttgttgtttaagctctgttctcttcttcttctttctgtctctcgctcttctccgttttcggtttactggtttatttggtcctgcgctttgctcacttggtaacatacagacctgggccatcttgtctgtgctacctttggttctttttttatattcttgtctgttacctctgccacactttgaagtgctagcttccttctaatgccaatgtataatattcaccttgttgttgttcgctctacccccttattcagccttagttattttctgggcgttgtagttctacaatgagtgcttcccttggaaagtgttttgggtctaatgaaatgaatgggggtgttttttcttataataactatgcgttgttctggaagccttctaaaggtcttgcactaggctgttgtacagttaaatattgttagtatataagtaagatacggataaaagtatagtatagtaaacagataatatggtaagatagtgttttattattattattaagaattatgtattgtangtaaaccgatatgtgttatanttatatgtgantggaagaggaataggtttgtttatatgagtatnagtataagcacccccccgatgtgagtaatgctgtaatggtacaacatgatggttatatcactaggtgggaggaatttttcatatggattataacattatgggacnagtgcgatatatgaagttaaatgttgannaaaatgttgttatttagtgagcccttcacttagattttatttaaaggtagggtaataataaagggatggcgtggttggcttcaat

SEQ ID NO: 14905 - DNA, 921 bp, Homo sapiens
  misc_feature (1)...(921): n = A,T,C or G
aatgattgggagtagttgtgtgttttttattttggattgtatgtaatatttaatggtgattattatatttgggttttgtaatggagtgaagttaaaaaaggattatgtttagttggggtagtgttggagttgaatgattttatgatagtgtggagtatgtatattatgtgagagggataatggatgattgtgataagaagggtgttatagtatagtgtactagattggagggttatgagggttggtgtgtgagattggatgtttgagatagggtgtaagagtatatgacgatgaatgaagttagatgttagatatttctttagatattgataaggggttttgtaggtagtgtattgagagagaagaatctagatgagggtttttaaaagtaatgatgagaaagtttaagagagttaagtagtaagaggttttgtgggtttagtattagatataatgtgttgatatttaaataggagaggtatgtggttgaaaaaggtataggattaagcaatgaaggagggggacggtgtgttttgggtattaggttttaggattagggtaggggatgtttagtttgtgtatatgtttagcatttttatgagagagtccagtgttagttaagtgtgttgttatagttggtaattgtttatattaaatttgtgttattnaaatgactccagccctttatatattatnaatgaagtttgatataagaaaaatgatattagggcaaaggagaaataagtcgaatttacgattatggatttgaaaatgataaagagatatganagataagttatgtgttgtgaatattttttatgagcagaccctggagaaaatgaaaatagattgagaggaataaaaggatggtggggttgggtaaaaggtggagtgtgttggnngaaaannncnnctacacta

SEQ ID NO: 14906 - DNA, 1816 bp, Homo sapiens
  misc_feature (1)...(1816): n = A,T,C or G
gatttatacctnagtcntcgcnntcgatganaggatngagncnncgatactngctcagnactcacgcngcagctcngcctcgtacgtnagtgtccgaagtcccnncgctcnantagtangtnatcgtccgacgnccnncaagtcngacgnacacggntnagntacgagccagctgcagngacantcgctacatcactgcatagcanctcanctacgtgctagcacgcgagcatggggnactgatantcctgncantcncgancgaccgtcgcntgtcngcattatgatgatcagcaattatagtagaatgccgacgngcangcagtcccnaccngacagganagncagaatacgtgatcgtnctatanctaatcgatgtcaagtgcgtggctgatgcgatgcgtcggtgatangcttagacagctantcanatggcngaagntagacgtagcagagacaacacagtgtatgtgtgcctntgatgatgttagtgaacagtgccattantagtatgaattttacgtgcgcgagcacaggcacgtaaactaatntagatcntagtggttgntactgatgtctatagtaatcacgctgtgacagtacaancaagcctgtcgcgagcnacgcgaacancnctacacaantgtactgatncntatagttccgtacgacactntgagntgcgcagtacatcgccaatanttcatctgtgctcaccacacctgcgtgatcgtattcggactaaacgtcggtngacacncgtcgtgccaccgtagtagccaggtgttagcccccattcatacctaactcgcctctcggtatgttctntcgagatccagagaatcgcaggcactaagacaacaactcgantgctgggacgctcgtggtgtgtgctgacatcgacacatgtagtatgtgacgtactcgacgtccacncntgttgcatcacactgctgtgtgtagctctggtatgttctttactaggaatattgcgagaatcacccttctatgtttttcgatgtcttgatatacatggtcgttggcacgacaacctccacacggaacgaccaagttattgattgtggattgtgcttatcanttctggtgcaccactcangggcgactcgcctctgtcatagtgtagacgcgaagtagggactcgatctgatgtactgcgcgtacttatagcaatataacaccctctcacgatatgcaacctcgaacggattctcaattataatactcatgtccgttaaacctgcagancgcacngcgctcccgcgtcgacacgcacgttgcagcgtacagttgagtgtggtngactatcactatattatattcgcgtccccatctgcgatccagtatttgtgtcctctgccttgtatctaggagtcgttcagatgtatagtgataagtatgcgcatctgcccaccaattgatagtcgcctgtgttgcataacatangtacacatacattcgcgctatattgtatggtacttctagggcgcgacgcctcatgcggcctcagcatatccaccttgtactatttaataacgaagataaggaatctcaccgctagatacgtgataagtgaactaaattctatagacatctaacaccactcacctgagtctatactgaacaaatatacagtcantgatcagctggacgtctgagtgtcagaagctcagcgcgtgtaagagantatacacactatctgaacaacatatacacgagtgaacgacgcgtgattataatcagtcagtcatgatgaggagcgcgctgtcaaagctgtagacgtgcgcatgttgagtcg

SEQ ID NO: 14907 - DNA, 1272 bp, Homo sapiens
  misc_feature (1)...(1272): n = A,T,C or G
gcgcattctagggtccaggaataacaaatcccttgggagacctcttcgtctggcggccacactctcctggcggtgtattgaatactgtttttatcacactcatacccgcgccggggtcgtccccctgccacacccnggcccacgtggtaactgtgcgtcgacccgcccttgtgcgtcatggcaccacacacatcaaactatagtatgtcttgtcatttcgcacaatcttgtggggtgtgctgcatcgaantgagcgtcacatggggtatcctgacacagtggtgctacgctcaccccatctcgcacttttcaccagggtggcattgggagtgggtatgggggtctaatcacaacccgtcctcggtgggctataaccacccgccactgtgtacccgccacatgtaccttcactggatagggtgtgngtacaccactacaccggtgcatagcacaaaccggtggccnanacacacttatatcgttacgtcacgtcggcatcaatgactatgctgctgaacaactacatatgtggtaccccgtcactgtgtcgacactctggaatagtccttctcaccacgtcgtggaattgcgtctctcataacaggtgcaactctcntgtgactacctgttcaccgcatataatgtctgactcctgactactcgtcgtctactcacacaaacatctgcatactcacctcggagcgagcgggcggtggctcacnataacagtggggtatacagtaatttacggatttatatgttcataattgtactccntgtgttaaaccactggcacatgtcactatcattataatctaatgtcattgacagcgttggttttcttgacaatacgaccatggcaacactggcggggaactcataaatctgttgttactactatacacccccatcaggcaccggagctggttgtgcgattcccgtatcttaatagtggtgtgcgtactcattattagtttngtcggtggtgtgtagttatattgtaaagtggcgtttatgtatactggtttgcggtcttccatctttgccgtccagcatnaaatgcgcgcggtggatacatcccggcaatctgagccttgcgagtctccccatcgcctagataaacatcttgtggtttggacaaacccggttatgttagtggtaacatcacctccatttccaataatgggggggcttgtgaacacgggacaccacaacgggtgcgggggggcggcgcccccccccttcgccgaactgtgtgcaaaccgtgcgggg

SEQ ID NO: 14908 - DNA, 137 bp, Homo sapiens
cgcccccccggtgggttgtagtttagccaaggcttccattatgtaccagtcagttcgaccacgtttaatataggcaggacttcttataccacggtcatgcctgctcccgtgggtagaaattgaacggagggttacct

SEQ ID NO: 14909 - DNA, 286 bp, Homo sapiens
catctgcctggtaaacaaccatgtgccggaataactggaagaaccaacatttgtatcatatctgacagctttatttattttccaaatgtttatttggaaacttctaggtctttggagagaagtgagatccacaggaatcatttgtacctgctttctgtggtatcaagacgagcagctcatctgggggctagaggacccactttcaagatgtttgacatggccgagatcacgccagcgcactccagcctgggcgacacagcaagactccgtctcaaaaaaaaaaaaa

SEQ ID NO: 14910 - DNA, 348 bp, Homo sapiens
  misc_feature (1)...(348): n = A,T,C or G
ccatggttttcgagagtttctcctgcactcacccggatgacacacgcccctccccctctccttctccacttcctttttatgccccacatctaaaccgcctaataaccggacaccaaatatacactgtatagaaactctgctccgtaatccattgatataaactatggtgtgtgtaccatcctaactgtccactctggtaaatcataaaaaacacagggtggttataatctctgatcgtcgttcccttattcgcacggctcccagtcagccaaaccgctcgagcaaaggcaagcaaaataatgcaacaactaantcatncnntgttaaaccgccggccagtgaacgcgg

SEQ ID NO: 14911 - DNA, 671 bp, Homo sapiens
gactattgctattacgttcgctcttctcatatgcacttcaattaaatgatggagatggtagattacgacaaataacaacgatagtcttattttaatgcacgctgccaccatatcatccctgacctcaccagcaatctcggattaagacccgtgcttgttcacgctaataactggtcgtttcggtcttctgtccgcgagtaaacgctaaaacacaacaacaaagggtcggatagaatataatgccacataaaattggatggttgcatatatcgtcgccaaacccacgtctgtgtaatataaccagtcgccggaccactgttctcccactcctcctatcgtaaccggcttatcagctcattaacaacccaatgactcggatggggggggctggtaccgaagatatttgtgtgtctactattctcgggatatgctattacccggaacgccacaggacggtgggttgtagtgaaccccgcatccaacgtgtcgctcgcactcataccaataacacaacacgtgcacatgttctctcctcccctacaaaaacacacacaagacatgaccacccctgggcttggtacggaatgtctgtacatccacaagccccttctctaactactaatcctcgccggtctaggtccccggatcttcctcatccctatttaattatt

SEQ ID NO: 14912 - DNA, 295 bp, Homo sapiens
atcgtgcctatctttcccgtctacattacgtctctcgtctttgacccatcagagctccaacacacatcttcgtccgtcttttgatttactcttcctcctctactcatattttccttcacgtagaccacacacatctgtgctcctctattctcgagatctgttcatcgcgtccgtctgttcctcgcttcatcctcccaaatacaccttccagctggagctagacgccaaacactattcgcgatcacctcccgttcccactcctctctatctctccgcgcaggtgcggcgagaatca

SEQ ID NO: 14913 - DNA, 1434 bp, Homo sapiens
  misc_feature (1)...(1434): n = A,T,C or G
tgtacgacgtcaaagagaatgatgcggagagcggagggagaagagccctaggtggggggaacggggagcgaggggggccttgagaaggggcagcaacccagaggcgtaggggaggcagagagngaggagcgagagcgtgagaacgttttaggcgaggggagcgtcgagaggcctggtgggatgggcgcgtgataaacgcagttatgaagggacgggggagaggaagagtgacagacagagtgcagagagtgtgcggcggagacgggagcaggatacgagagtgagcatgtgtgtggagctatgtgtagagtgtgcggcgagccgtagtgtagcgagctgctcagctgcccacggacggacagcgcacggcagggagtgagggagagtgtttttgtttcgtgagcggcgggaggggagtgaagagattaagtagagacagcgtgagatctgagggagtctcttcgcgcctgtacgagattggccgcgagaggatacagagagaaanaggtgctcggaacacgatagncaagaggatctctccacagacgaacgacagnagcgaagcacgagagccgggaagtcagagcgagaagaaacctgagactgaacaacaccgantgacaagcaaacgttacgcagtagacgagtagagaagtatggcgcctgcagaacacgagtgcgaagagagaggtatcttggatcgcatcgatagcgacggaatacattcgcaccagtagacgacataacgtagagtacggtagtggcacacacgcgatcgaaagtcaaaagtactgatcgctgcaaagcgtatacacctgcacgacgttcgtgcgaagcgatcactctcgcagtcggcctaccgtatggagtgagcgacatggctctctcgtatagagatgatagantggtacgcgctcgacaccacaatcggacagatatgtnacgtatgatgtcggacgcancgagagagngaacgtcggntactggaagaagcactcataggtgagtactcacgagaagtagtgcgatagagagtagacaccatatagacagaangatgtaatattatataacgtatatcagtacgctgatgcaatacatataatgtatgaataagcgtgtagtagtgcgcgaatagccgtgaagagtcgcttagactcgtcgcagatgtacaataggacagagacagtgtcgcgcgtgacgactctagtgaccatccgagagacgacagaagaggangccgggcgagcggcagaacgaaggtatatcacgaagtagcttgtcggacgagtcatggtatgagcgtatagagagatgatatgtcagatcacgtgataccctctcgtgctgactgcgcaacaacagagctctcgatgtntctactcgactgaagtagagagcagatgaataantggtggcgatgacttgtatggg

SEQ ID NO: 14914 - DNA, 937 bp, Homo sapiens
  misc_feature (1)...(937): n = A,T,C or G
aatattacaacccatctacagtttccgtcgtgaacaatgggtacatacatttttggcacaaccccccactctctacacccccatacctccccttacccaccatttcaggtccgtctcgtatcaccctgggcaaccagcatgcaaaatcactactcccaaggggccacacggtctatatctttccaggtccctcatctcatcaactagggtcacgaatttnaggctcaccttcccaaacgtgcgacaccaatgacatcatatacccagcagattttgattttggtaaaacagccttttcccatgttgtccagggtgtccttcaactcctaaggtcaagtaatcgccgtgcctcggcctccccaaagtgctaggatccacgaatgagtatcagagcccacccatccaactcttgaatcttaataaagaagtacccaattttacaagtgcatcactctggaaagcaggtaaataggaatcagggctacatcacttccctgtgtcacactaatgacattccacccttttatttcctcttacaggtagaacagttagagttattcatctgtatattaaaatttctaaataattactggcttaggagaaggaaatgtcatttttaattacagaaatccattgtcattattagaaaaaaattctatttttattttatgcataattttgtatatataaagactccccgcaacagaaaatgatagaaaatgcacacataaaatatgtgatattctgagtctattaatttaggactaaaacaaataagtaaaacctttgctgttcatcaacattctttgcttttatataaagagtggtctcttcttagtctcagcccccatgaaataaaatgtaacaaaatccctttatctgcctgataagagtgaattttacaaaagcacgtgtcccccggagcnncttttttttt

SEQ ID NO: 14915 - DNA, 937 bp, Homo sapiens
  misc_feature (1)...(937): n = A,T,C or G
cactcgcccacccagcacaccacacctccccaactcacgtgaccacaacctctgccatacctaccaacaccccggtcatttcagtccttcgccgccgcagctcccgtattttcccccactcggaatcactcggggattccgatgtttctccccaaagcccctctcatcctctccaccccaccactctttcccccactttccagacgatctttcttccccgagtccacgactcggtcccgcagcatccaagcaccaggccccgtaacccacttactatagcccgcaaagctagctccatttcaaaacaacatcacaacccccacgtgcgctctgcggtatcaggccagtgttcttttcccaccccacacatgtggctcctcttggttttgcagtccactcttcttcccaactcatatcttcttttcccgctgtaatctcacccattttcatggtctttcatcccaccctcgtgtacccgatgatgatatcaagatttacacccctgacctgtctcttgatctctatgccacactgccagatgcttcgcgagcatctggagcagatgaggtcacattgacctctcacacgtagagtttccaaacaccacaaactcaggatcctcccaccagcaccccgctaaccccataagcctcctggatcctgagttccctaccttatgaatgacagcactatctatccaggaacatcccccccttttcccttatcccaacagcatgtaaataatttgactaatttctagggctccagaagttctagccaccatagccactgctccacctaaacccacattacccgccacctggaatatcacaacagagttgtcttcctagcacctgngactagatagtgtattccagcaacttcaaaatacttcattgttcctctttgcctaccaaataaatacagagtgtggccg

SEQ ID NO: 14916 - DNA, 955 bp, Homo sapiens
  misc_feature (1)...(955): n = A,T,C or G
cccgctggcacgggcgaggaaacacatggcacctaacataggcgcaatagcgagcgcaccggcagcaaaacactacccaccgacaatgtgagcaagcgcctgcccagtaaaacgagatgcggggacaccatctcacgaccgtacatcctcactgcagccccaccccccaacacacaccgctcagccacccaacaatcaggccatgcactgagcactagccgcgctcagccgaccccaacagggagtccagatagccacagaaccaccaggggaccaacaagctcagggctccaacgcaccccgatcaccaacaagcccattccaggttcgctgcagggaacatcctttccaggaaaactccgcctttcggtctctccactcacattccagcttcccgaaaaaaacagcctcagtggctcagcctgagctatcccccctgcttaacatgcaaaggggataacggagtggatctggcaaagccccacataaaccacgtaggctgagaccaagcagggatgactccctcagacaaaatccaggtattcctcgtgaacaacaaacaagattgacgaatatcccccaagtctctgacagtatattggatgaactccgattgcatcttctaacaaagtgatgaaattcttacatattaattttgcatcctgaggtcccaaatttcattttctacataaaatagccagcagctttgtaccctattttaaaataacgtgcttcctctcccattctatttcccatgcccactcagtccaaagaaatagaaaactgaataataaattaaatacaaagagtgagttaatagtaagggaggctggagaagttgattttggatgagtacacccttcacatcattaaattgtaagcctaaggtataaaatgattaactatgttaatcctaatagaaaaccaagattcccccgaaggnnttttttttttt

SEQ ID NO: 14917 - DNA, 959 bp, Homo sapiens
acaacagaacacatccaatatcaacacagcggaaataccaggtatcacacactctgccaacgcccccccacactgttaccttccacagtctcccaatttccgaccgtatctaattccacagttacgcaccattcccggaacaaccaagccaaggtcgcaaataatacctcaataaagcgctaggctttaaaactgtccctctttctacggttcgcgcctcctttcgatcttcaacacaaaacccgtaaggtgcaattccccattgcttccatataacccgcttatctgcctcctttttcacaattaaagacccctgggattatgtgggctccctagagaattcaaaatcgaatcattgcgccctccaatattcacaggtcaaaccctcacccgcaaggtcggaaaatggaccctttgagcaagcccctaaagttacactaggtaataggggttgtgcctcatctcataagattagtccatataaggagagatatcgaagatctcactttgcctgtctctttgccacatggcatgcacctaggaaaggccatgtgaggactcagcgaggaggtggctatctttaaacccagaagagagctcaccaaatactgaatctgtggacactgccatcatggactttgaaattccagcactgtgagaaaatgaacacctgttgattaagccactcagtccacctaacctgtggtaattttagaaatctaagaagactaatataagaaaaattattccacctctaacaccaaaaaaaatctgaatgagatatggagtttagttaataatttatcaatcttggcccattaattgtgacaaatgtaccatatcaatggaaaatattaataaaagcaggatttaggtgttagtcatagcaattatccccgcacctcaagatttctctctaaatttgaaactattccaaaattaaaagttcattttattaa

SEQ ID NO: 14918 - DNA, 1000 bp, Homo sapiens
  misc_feature (1)...(1000): n = A,T,C or G
cccctgttccccattaccgcgagttattcccggcccgactatctgggaacaacaccagcgctgattacacccccaaatcgcgccacgcgaaacagctacccctcctttgctggattacgcgaatatctcttgcaccaccactcgactgttccacaagcaccggtttctcaccacatgaggtcaaacaatacggtcccaaggcacccctgtcatgggccactccacccccatattttcgtccaagggacaccccctcggtgggtgttgcgcttgcatctctccaccctcactcttctcaaggaagccttgcaatgttaaaccataattaagcctctcttattcgctaaaacccattctctttggagtttctggaaaaaaacaaagaatatgaatgtcaaactcagtctagggacccaacttttgctctctattttaagaaggagactttcaaaaataatgtcactaataccaattctaaatgtcccaaaatgcatttattgagatgatcaagtacccaaagttggatttagatctttacttgttttctcttctatcatagtgtaatgttgtcaagattttaaatctcatgtctttcatacaaacttacaacctaatatctgctttaccgattttaagggtagattggaataatgcatatagagcacctaaacaggatgtcgatatacatcagtatatattcctaacacgtaatttccctaaaaaatgtgtcacaaaacatgatgttttaaaaaaagaaagaaaacttgggacatcaccccctcttaaatattttttaatatgttaaaatcaaaaatataattatataaaaagtaatacctaccaattgataattctgaaaaaacaatatttgtaaagcttctaggaagcaacaaagtttaattacaattaaacaatggtatnacccacccggcattcagtatgactctcaagcagtacaaaagataaaaatgaaacataaaaaataaaaaaagatccgccg

SEQ ID NO: 14919 - DNA, 914 bp, Homo sapiens
ccccctcccttcccctccccaccccgcgtccctaggctccccccccgcacctaaatttttaacccccgaaaccacgggtatcccgtattttgccaaggccctcggcatttttgcccatctaattccacctaaccacccagtatatccccagctagcagagtccgggacggccaagcccggccattaatcgcctcccaaggccccagaggagttcgttctgctcccagttggaggcaaggcgtgattcggccaatgcccctccctctccggttccagcgatttcctcaggctccgagtagtgggatcccagtgtgcccccccagcccagctaatttttttcctatttagtagagaagaggttcccccgtttggccaggctggtctcgaattcctgccctcaactatcagcccaccttggcctcccaaagtgctgggattacaagcgtgagccaccgcgctaggcctataatgtggtttttcttttttaatggcataccccataataaaatataaggcatctctcaaacacactttgatagagccattagtgacataaaaatgctaatgatcactaatattcagtgaaataagataaaaatcaaaaatgtatatttaatacgttctcacataaaataaaagtatacagatgcaattggaaagaaacacaattcaaccaacagttattcccctcatctctgggtgatgtgattctcaaatgtaaattattttcttgtacattctgttttccagtttttctaacttgaagatactttgaaattagaaaacttgtcacctttaagttaaaaatggtttttcatttaaaagaaaaaagccctcaccataaagatctttttattaacaagtttgtctcctggacaggagaggattaaaggaaaataaaacgagatcggccg

SEQ ID NO: 14920 - DNA, 923 bp, Homo sapiens
ggaacatgctccccaacaaaaagaggatatattagattgtgtaaaacacaatcggaataaaaataccagtcaattcagaatatttgatggacatgtccttcaaggtagggggggcataagcctttaaacattccccagaatttttacctgccaaccttaatcagggggagatagtgaaatatctcagaatgctcaaaggttcccaaattaccttccccagaactttcctggaaagattaagcaaaaccaaaaaaaagccatgtgttttcaaagcatgaacaagcaaacattaaaaggggtccaaagaaacaggatctaaaggcccactcaaggaaaaagcaaagataatttctaagaagatcggtgacacgtgtacaccagcttcagaaaatgagtccgtattcagcttagaaggctccaggagtgacatcttcaagaaaatgaagttgacaaatcagaatgaatgcactgaaagttgattttgaaaacaagcacagatttcggggttgaattatagccaagtagcatatacaaaaaaatgaagcaaataaatgaagtctgagaaaatgaaaatacaggaatagagaatagcaactacaatttactagtggatctgctaacaaatactaatctaatcaaaattactaatataattagggtgaaagaactgaggtattggaagagtatatgatatgcatacgtggtgaaggaaaatgtaaagagataaatcctcatcctccataatggttaaaaccaaaaaaataagaattagcaacataagcacaccatttactgacatgataccaaaacagtcagctaaaaatgttcgatgtagtagcctcctgggaggaagaaacagaaatagagttggggagcacctctagtctttcatctcatatgtacattaatagttttaataaaaa

SEQ ID NO: 14921 - DNA, 288 bp, Homo sapiens
  misc_feature (1)...(288): n = A,T,C or G
acttggttaagggtacggtgggattaatgaagtgaagaatacagccgtctctcctttctatcctcaaattatgcaatattctattattcactgacacactgtctgcgtaaatttagatatactagacacggacatcgtacttgagtctacattcggaatttcgaagactactaacatataaattgtctattttatacacgnccatgaagcgcgtatcgatcatataggggattgggttcgggccccctcgaggtgccggttcaatagctcaatggcataaggcctatc

SEQ ID NO: 14922 - DNA, 1028 bp, Homo sapiens
ctatgcgagtgatgggtatacgcttcttaaggaaaatggtccgggcccctcccagttccggtatctatagattaagtcccattaggcgacattccaagttatatggtctagcgcgagtcagtggctttgtcgcacaccatctctggaattataattcgagaggctctttttatagtccccccgcccacaggtttacgccgttgtgaatagttcaaacttctttaataaaatcaaggaatttggggtggcacaaaaagtcaaagcttggaatccaggcactgtttgaggccaaggcaaaaagatcatttccggttaggaagttacacccaggcctagccaccaaggtgaacccctgtttctaatataaaatcaaaaaaatagccaggcggtggtagggcgcacctgtaatcccagctacttgggagaattaggcccgagaattcggttaaatccaggagatggaggatgccagtaacgtgaaatcacgccccctgtattccagtttggggtgacaaagccagaccctgtcttaaaaagaaaaagaacaaaagtaaaggagaaagcacaagaaaaaaagggaaagaatcaaggattttgatccttatcataagagcaatgggggaactgatttttttttttaatgcagtgagatgacaccatcagatttgtgtttccatatggtatctctggctgcagcatttacaggaatacaagagtggatatgaggctcacgcctgtaatcccatcactttgggaggctgaggcggggagatcaggaggtcaggagatcgagtccatcctggctaacacagtgaaaccccatctctaattaaaatacaaaaaattagctgggtgtggtggcgggcgcctgtagtcccagctactcaggaggctgaggcaggagaatggcgtgaacccaggaggcggagcttgcagtgagctgagattgcccactgcactccagcctgggtgacagagtgagactccctctaaaaaaataaataaataaaaaaggatgtccccctgac

SEQ ID NO: 14923 - DNA, 1891 bp, Homo sapiens
  misc_feature (1)...(1891): n = A,T,C or G
aaatacatcatcagctcgtcgtntcacntctatcacatatcactactcgcttctgagcctcagtgncatgatcactctctatctntcacangtcagtaacagccatacatcattcagcanagatcgtngctcctaagtcgactagagctgcttctgcatngatctgacagatncgcactacagagcgagttcantgcgtgacgatcgtctatagttggtncattgcatatcacgacnaggagatgncancatcacgatgtcagacantcatgcgncatgtctgacagagcagtnatngtgtaatgttgagtnanattnatntgtatctcagaatctctgccatgtntcactctacagantatcagcgtagcactancgcagtgctgtgtgtaggcggtatggnagcgctgctcgcttatatctgntcgtgttgacggagatgcagatgtatcatcctgtacgctgctagtagcagagtagacatanagctaatgancntngntcgctcgnatgagagagcgnctgagtagncaacgatgtnatgccgtncgtatctcacttcggatagtatantatancatcgagcactatgtgtcatganactgtggcagcgcngtccagtgtagatgactgattgatgtcgtcacgcagtactgcagcgttgcaccactataanatatgagtgagagatgcatgcncgcgagcactgtgcagtatgtgtgacgtcgcgtgtgatcaacagntcaagagtctagaccacaanctacactatgctcgcagctagagtggattcatacgcactccgtatcantggtgnagcgctctcgtcgtgcacgtctgtgttatgatcgtgatcgtcacatagcagtatcgcgatagtatgtgcgtagtacttatatgtagctgtgcgagagatgctgagtcggcatgcggcgcacgtgttatatctancaggtngtcgctatatgatatgagttncgtagtatctgtgacttgtgntagtcatgtacctgtactgtnacgtctcttgtctntcatcatgatacttcgcgtccgcgcgcgcgacgcnctgatcctaggtatcacgcgatcgacactatatgtgatctgtgcnacgaaacagaacgattcgcgacagctgcgcgactgtgcgtcngtaagngtgatgtaagtaganacgcaantatgacagcatgnacgctgagagagcgnactcgctgtgagagtatgagtatatngnagcagtgacagagcgacgacctcatgcaccactatacataacatatatcgntgtgtgacgtntgatgtgntatgtaatcgagnacgtgcattatanacgcantcatnatcgagcacagtgtgatgttgctacgtatgagcagattgctgatgacgttccgctaatcttatcactgaggtgtgcacgacgttctctccactcacantcagactctactataaccacgacagctctcgttagtgtatatgccggaacaccacgagctacatgcgggcgaatcgtgtcataactgtgtgacatgcgcatggttatgttgactcgctagtctgactcgtagaatagaggctcagctcgtcaagatggntattatgtgcgtgtgctactaactaggagtgngtggcgtccgtctggtgatgcatcggcagacggtcgcggcgtgaattagtaccgtcggttgtttatatgtctggcttacgctgtttattgtgtctgactttgtactgtaggttgcgactatggcagtattctctagtaggtggatangagagtcacgcgttgactacgtcgagagtgtcacgatgtcagtgtgatattcatgagcgtngcgatggtggagcggcngtcactacgcgcatacgatgtcgcgctccg

SEQ ID NO: 14924 - DNA, 998 bp, Homo sapiens
  misc_feature (1)...(998): n = A,T,C or G
cctcgctcacgactcccacccccccgcccccttgtcctcctcccctcctcctacccccacctcaccaccaccacaccctcctcatccgccgagcccgcgtacataactccccaaagcccgatagcgccggcgcccctcccaaggtaccgcctccaatagctaccagcccaaaaacgcctactcacctaaattgccacacggcagccagggctttccccccaccagtctcgcacttcaagtccacgtcactcttttaaataacacaccgctccagtccccagcatcgccccattctccttagaagtccacgttccttaatattggaaagtggtattacaccctcggctctgggcccggggcccagtggctcacgccctgtaatcccagcactctggaagcccgagatcaggcgtttgagaccagcctgctggacatggcgaacccctggctctactaaaaatccaaaaattacccgggcgcggtgccctgtaatcccaccccctcaggaggctggggcaagagaattgcttgacccagggaggcagagattgcagtgagccgagatcgcaccactgcactccagcctgggngacagagaaagactccgtctcaaaaaaagaaaagaaaaagaaccctggatttgggtactaggtgtgcttgtcactactgaagtgctgttgtttctaagtcctctctgctgacagagtaagaatccactaacccatatatgcacatatatgtgtaaatatttctgtatctgtaactataccccccccacaagagttatttttgctattcccaaatctggttcattactacgtgcatcattctgcttctcgttgcttatttgtaaacttccactccaacagtgagaaacctgattcatcacatccaccctccatttatttcattgccccattcccttatattatacatgtaaagcagtatcagtattgttaacctgcagccctaaggaaataaacactgatcggccggag

SEQ ID NO: 14925 - DNA, 602 bp, Homo sapiens
cttgggattattagtgaaatgaaaggggtaagaacaaaagcaattcttgaaaagtaactcctgactcaacctcaggacttatgcttgaatgcgtgagtggaagaaaaaactggtaccacagatagaagccttgagaagcttactttggtcagaaattttgcctttgtctgcaggcttctaccagttcgattccatctgtgggtcttaggtttcagttacctgaagtcaaatgtggtccaatacacagactggaataagagacattggagactccaaaagaatattttctggtagactgatatatttctcctaaaaaatttggaaaaattttgtgatgaagaagctacctgggcctgaagatatcttttctgaaattgccacaaccattctaaccttcagcaaccaccaccctgatcagtcagcagccatcaatatcgaggcaagactcttacagcaaaaagtctatgactctctgaaggcttagctggtttttagcatttttagcaataaaataaaggtatgtacattgttttttagatgtattgcaattggaattattttatatgcactagaaaaccagaaataaaaaaagatcgcgcgag

SEQ ID NO: 14926 - DNA, 407 bp, Homo sapiens
  misc_feature (1)...(407): n = A,T,C or G
gngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnannnnnnnnnnnnnnnnnnnnnnnnnnannnnnnnnnnnnnnnnnnnnnngnngnnnnnnngnnnnnnnnnannnnnnnnnnnngnnngggngngaggaagggagagaagg

SEQ ID NO: 14927 - DNA, 447 bp, Homo sapiens
  misc_feature (1)...(447): n = A,T,C or G
tcggtgagtattcggggcgctacattaaaactaacatccataacgagacgtcaaataggagaaggagcaagtaagttacattagcgtccgtaaccacacgaacaaagataggactgacgacgggtagctccctcggccctaccgcacatacgggaactctctacatctagtcccggttttagtcgcgccccatcgctcagcgatgatgtagggggagccacctcgataactaaagcacacgtagagcgtggttggaacatgttcacgtgtcttaacgccgagtcaagccactcgctcgcgatattacgaaccctaacgctacacatgatggcgaaccgaacaaacaacaccaacaccctaacacaccaccaaccacacccacnnccaccaccccccacccacacaccaccaccccccccaacaacaaccccccccccacacacgctc

SEQ ID NO: 14928 - DNA, 1004 bp, Homo sapiens
cggctagtcatccacagcttccgtgcctcttcgccacatcctggccaactctggtgacctcctccgttgtgttgagcggccgtccgggccgcactcgatcacgcacactaactctactctcacgcttcgagtcccacaacaagatacacgccgcgcatataacatacactcgtaactccatctccgtgacacgatatgctccgttacgtagtttacacacggcggcacgagtaagcggaacgcctattggcgagcgtgagcagggaggcccccccttggaggagaccaaggtccgaagaacgttaaacgagccgcgaggcccccttccgcagctctatctatgaatgccagctcggggtgtggagcaacaggaggacttgcgccctaagttgggagggactttcttaattaacccaccgggtcaacgggggctttcccccttgaggctaagcgagaaggggtttgagggggacgttgcccctgccccccaggaaagcgggagcttgcccttatagggtgaaggacccaagacggggggtccctgcggtggttttgacaccccttacacattcggggactgcttgattcctgccacatgggcacagcccttttttgggggtcggtgcaaaggctcagccattttaagaaatgcaaatgccattcaacgtgggcaattataaatttcctggtaaccacaagaaaaaaacagtaaaaagaaggctgggcgcagtggctcacgcctctaatcccagcactttgggaggctgaggcgggcggacctcctgaggtcgggagcctgagaccagcctggtctctgctaaaaatacaaaattagctgggcgtggtggtgcacgcctgtaatcccagctgattgggaggctaaggccggagaatcacttgcacccaggaggtggaggttgcggtgagctgagatcacaccattgcactccagcttgggcaacaatgagcgaaactccgtctcaaaaaataaaaaacagataaaa

SEQ ID NO: 14929 - DNA, 394 bp, Homo sapiens
  misc_feature (1)...(394): n = A,T,C or G
cgaacactctacgatccattctacctcaactgtgaaactaacaacaacccacagatccttctattctctgggtactccgtcgcgatcgttcctccaccacatgcatacccctacactcatacacactatgtagctatacatctccagcgcgaatacacagacgccccttcacacaatgctccacagcacacccgcctcgcaaccagcacaacgtgggaccaaaatatgtcgggtcacagtgcggctcacggatctacgcgtgtaaaatcaaaaaactccgcgacgctacctcagctacgcggagatgagacaataattggtcgagagatcaaatgcctcgataacctacaatttcattacaccacctaaccaatcaacccaactnananannna

SEQ ID NO: 14930 - DNA, 295 bp, Homo sapiens
  misc_feature (1)...(295): n = A,T,C or G
aaacatccatcaaatcatatactcttcactacattacaccannacaccccccatctccataacttacataattcaccctcacctaacttcctatctactttcaatctcctactccttttttttttacttactattccctacacatacttatnctcctcctatcctcccttcatcccttcnctctttctcactcactcatatctatttaccctatcactataaacaaaaccanacacccccaaaactcacaccaaccanatacaaaaaaccacactacaccacccanccaacccac

SEQ ID NO: 14931 - DNA, 365 bp, Homo sapiens
  misc_feature (1)...(365): n = A,T,C or G
aaaataatccgacgctgcacgatcttagataagtcgacatcctctcccctcctgcgtctcccccttacgttccgcctatctatccggcggactcgttatttgtaacagtatcgcttgtgttatatcgcgtatgtattcactataaccggtgtgccgcacaaatctgatagcttgactaacgatcgatgctaaagtatcctggccagcacatacgcacagcgtgcgcaataccaaacgggcggtgatctatgctgcggagaaaatggcctcacggaggccactcacaccaacaggggcgaagatagatacggtctcttcccaaaaggtcatccgggaagattagctccctaaaactaatatntttt

SEQ ID NO: 14932 - DNA, 359 bp, Homo sapiens
  misc_feature (1)...(359): n = A,T,C or G
attccttctttttacatacctctctaagttaataccgcaactcacatcgtggcggggaacactcgtggcggacgcacgagcaacaggcaaacatgcccctactcaccaacaccccaaatcacaaactccatcttcatatatacctacatatcaactcatacctcactcctagcnctactctcaatcccacttatacttactactctccctctaatcaaatacttacaattctacattccacttaaacaatctcaccacctcctaacccctccctcactttatttacctataatacaccaccatatacaattttnacaaccacaacccaacacccccaccacacccaccccaccccaccc

SEQ ID NO: 14933 - DNA, 555 bp, Homo sapiens
  misc_feature (1)...(555): n = A,T,C or G
cgaaccgataataaatggcatctgaggtccagcacttgagtataccaaccatgcacccgcgactccaacatgcggcacttgagtgaggtataggctgtatggtatcatactacacttccataacctcatccatatacttccctctctacaanatattctcaattaaatatacataaattgtcctattatacccaatacattaataaatcctctttttcaattatanataaccaacacctctcccacatnctattaactctacaccattctccctaccaccaccccccagtcacccaancacacaccaaaaaacacccccccccaccccaccaaccaaccaccacaacacacaacctcccaccccaccccaccacccccacaaactaccacacaccaaacnccaccacacccaacacacaacaccacacacccacacccccanccaccaaacacaaaacaaaacnccccccaacacnacgcccccacaaacacatacaaaacaccacaaaaaanacaanacccaacaaaaaaaannnaanaaannaanaannnnna

SEQ ID NO: 14934 - DNA, 450 bp, Homo sapiens
  misc_feature (1)...(450): n = A,T,C or G
aattataaaaacactaattaacaaggaataaatatatgagcctctgataaaaacactcactactctcgttcacgtgactattaacagaatcaacagaacactacacacggcacaccaagatagcaacacggaccattacctgggcaatctgaagaccactacacaccagtacagagcaaatacttgactgggacgaagaagagaccaagaaaacattacctcgcaacccaaaaagaataataatctaacgaataggaacaaagcttacacatttatcagcgcaaactaacaacaaaacgactctatttaagcagaccacctcattttttttcatttcacaatttcatatcaaatttacaccaacacacaacgctaaacaacccaccatacacccattttattcttcgcccccccatctanaaaaccgatataaaaaatnaaatannnnna

SEQ ID NO: 14935 - DNA, 335 bp, Homo sapiens
aatatactcttcttcatctactcataatattaatttccattacaactattccaccacacctcctcaccatcctcactcatacacacaccttataattccattaatattacctactaacaaccccatctaccactccctattttctctctcatcactacactactaactcaactatctaatctctctacctcacaacaaaatcaccctatctctaccctatcacaaaatctaactcccccccacctacataatcacactccaacatcacccaatcatacaatttcctatcccccatcataaaaaccatacaacaaacaaaaaccaaacaccccccc

SEQ ID NO: 14936 - DNA, 588 bp, Homo sapiens
atatagactctagtaccgtacctagcgcgtagccatagagtggcgcgctgtcgtctatcatatacgatctcgagcacatcgcgtaattccttcattactcttgtagtgtgcctctcacctcatacttaataacactcatcagcatactgacacactccctccatcatttctgccgttctcgcactcaacgtataattactatccacacatacattccggctcgaccgtgcccgcaatcaaagtcaagagctagccactattactggttaatgtaataagcgtataaaattctaatgcttgacagctcttctcgcgtcgattgtactgccatctctacgcttcctcgtacctcacttcaaacctgtcctcaaccgccacaccacaccacttttgcgtaatttgccacgttgaagcgtaagatctaccacgtgggtgctgtcccaaccgtgagaaatgcatccataattacctcagagaaattgattctaatcgattactctctacaaatattttaccttttttcatcaaactactatattcctattctctcgaattctttgtcttttaaattacggtcagtgaacgggc

SEQ ID NO: 14937 - DNA, 221 bp, Homo sapiens
aaaaacatgcgtgagaaagatacagtaagatggtaagagaaaatatagggggcacagaaaaaacacaaatacatactaaagtccctacagtagtacatagcagggggagtagcacggaattgggggaattacaattaagctaacgcgagacgcagagctactctgcggaaaaaatctgataaagtaaatcgcgttttaaaacacccggccagtgaacgggc

SEQ ID NO: 14938 - DNA, 1906 bp, Homo sapiens
  misc_feature (1)...(1906): n = A,T,C or G
atagtctgatcgagantgtctagtcagtgtcatcantacnagtaatcngcacgangatgaagaggatcaggtngatntgngtgataacagctncccttcnacgtgatgatgngcacagagactatagcgcagagngnatgcaggagtacaangttctcncgagacnancgangtagcgctggaccacggntgaacagctnntagngacacatgagatcgagtnatacgacgtatcagtcantgatctgactatcagcgtgtatctattnacacttttctcatcgcacgaccacctgtatgtagngagtctcacacgctgcgagnatgcagcgtatcctagctgagctgcgatgtcgtagtgatgtacgngtatagcagcacgtntagcatatacgcangctcgtatctcatanacnttactnnctctagactacgtcatgctatatgtgacatgcagtgtattgtcgcagcgagcgacacagccaagcagagcttgacgacatcgagagatnctgatgtgtctagtctatgtgancgctgagagtatgatcattcatgtgcgacgngantcacgcaagctagntatagacnacgatngaagttagnctagntgtngacgaagacagctcaccttcaagaccgtatgtgtatcagatggctggcgacgcgagcgctgtactgcacgntatctaacngactcgtagctagcgagtccaacacgtanatgacatctctctccntggnagacgtctagctagcntcatcatacagcacttggtnacgtagtcgctcatccataggtagctgtacctgtatcatttacacgatagtatagtagatnagtnacgganttcgntgnagcaactngangttgtgattgtgctcactctagttatgctcacgttctatcaactacagtgtctgtcgcagcgacgcactcgtcangctatattcaccctgatagcntcactcanatcatctcacgtcgctangctgtgtacagctctgcgatgcagccgaggacggacttcctctactagacgagtacgcnntacatacctatcanctatnattcacgcctatctcgtactgtgcgcaccttatacactcgcacaaatganatacacatactacagatgtnctccatctgctctatgcatgtagacgctcgtctctagatggactatcngtacttgacgntcgtgcagtgtgtgagtagattatatgtgtagcgatatgtatacattagcatccatacacactctatctgatacctcagcactactctgatatacagatcagcgactagctccgctctgcactccactcattatnttgcagacaactagagtaatactgataacatgatcacgaagagtttntntgatatcagatcatagccttagngatgtcccaccactctnctnagatatattntagattgagcgcacaacagaagatcgagtatctgagcnctcactctctctagcgccgctgcanatatcagtcgcacatctaagaatatancacagtctctcgctatgttggtattctcgagtatcttctaacatagtgtctagatgtgatacatagtgattgacacaccactatgtngtatatagtgccttgctancatgatcgcgtgtatatcattgcctacactacatctacagtanagatcatntctgttcttgtttcgtcaacgtgtgtacccatacattcatanatctctgactcataatgtaagtcacagtaaagacaagacgaacagttactatagtggtngntatatcagagagccaatcagcngtcactgacactctacgtgaacatgtactaagtagcatcactactactactgtgtagtaagactcgacatagatattgtgtatgatatcgatagcgc

SEQ ID NO: 14939 - DNA, 891 bp, Homo sapiens
gttcattcatcgcctaccgcatactcaacgagtctaccgggtcctaaattccggctgtgcgccggcctgatagtatctctcatcgagtgcctgtagcactcaaatacttggcccaatcctatactcctcgaccgtacaactttacacccggtgcgcttgctcaccccgccacttatgtctttacaccccgccttgcttcttctcatcccccgttcacaccggcaaaaccggtcagaaaagtcgagcgctggtgtcagacttgtccattggcacacggggcccgcttcaggtgcacactaccataagctcaaatgccatgaaggcacactccactccagcggtcacccagtaaggcttttgctccacagtctctgatttaaggtgcagtgctgttattaattagcctccgccacagggtatgcggaaggtcatacgcccgctctaagggcgcggagccgggacccatgcctgcattctttcaaggaggaccacccctaggttctgggaagtgatggggtttggagataagcatactctgggactcaaaacacttggaaaccatagagtcaccataccttttcccctaacatttccaaggcacgccacaattgtagaaccccctcagcccttgaaagagagaactgaggcaactggagccccagacaggacacctccagccccaggagcccctctgtcgattccagtgtgctatgaaaatattacggttgattcttgaacaacacaggggctaggggtgccaataccccatgcagttaaaatccacacagaatttttgactcccccagatcttacctactaacagcccactgttgaccagaagccttcccaacaacacagataattaacacatctgttgatcatatatgtaga

SEQ ID NO: 14940 - DNA, 1305 bp, Homo sapiens
  misc_feature (1)...(1305): n = A,T,C or G
ttgtcaacactgcagcgtgatcacagcgacacacgacaaccgcagaggtganatntcacacggacnctttcaaatggacgcgaagcgcgaacacgaaggtcagacgagtgtattgacagcatgactacatcagnatgacgtgagtcataagacttcacctantacagtaacgaacgaaggatacatgaggttattttcgagcgtatgtgagatagctggtatacgtattagtcttcgcactacaganattactctcgctaaggctgcgccgcgctcatcagccgctacatcctctaccgacagagcacacatcttatcaccgctcacgccgagcgacttagccagaaacatgagacggtagagtagtaaagattaacgcattcgcggaacgatctccggtaggctcttgtatcggtcttgatcatgtaaactacatgtactcctgagatctataatttcactcatcctcatgttagttcatgactgactaatatcgacaggagctagcgcgcactattatctcgagtatttattatcgatattcgttttgaattcagcgactattgacgcgcgacgttatgttatagagatttatcacacgagcgccgcacataatctacgaagctttatgtacaccgtacaccgatgcgttccgatacgctttatcaccacgtcgcggacctccctatgcagatagtagcggttgatgtcgttcggacgagcgttttcaggagacgatcacgagagcagtatcgctatctcagttcatcnaattcgaccgcgctctgcagtgccgatgatgtctgattatctattgattacaccatgtaacgccggcccacgtatatgtgtaattctatcataatcgtagtattatgagtgtacagtatcggttactaccacgatgaggttcactctcgtcacttgtaatattgtatattatactaaatgtagatcactgtaagtgtattagagtagcaactgcaaccgaggaggcgatccgcttcaagcgaatacggacgacacaaccggtattgtgtatgtagcgagagcgattgtgagaaaacgtcaacgagcctcttcacatgcgttgaagcgagtatgacttgcgtttgggtctctggagtatgattactaatctgtccccgcgcttcgatataactgaaccacacagtgtctactctggtctgatagtctcgcgagtgtcccacacacctcaatatcccgcccgaaaacctacgatagcagtaggagaatgatatatcgctgggacaacagtctaccctatattgtttagtgtgatac

SEQ ID NO: 14941 - DNA, 426 bp, Homo sapiens
gcctctacttcagtcaccttctctatgcagacggtgaccaggcaatctcaccaactccgcggcggttgttagccgcgcctctaacaattgatccgctgttgcttcccagcttccgtcgcgcttattcgcattgtccggtattacattgctctcccccttgcttatagccgtattcttctcacatcttctcctaacactcacggtatacttctctcaatgctcctcatagtgtgctgatgcacggcttatatctgcttttgtcagggggctttgggtcctgggccccccttgcaggtccttggatttataaggtcatatgctcataggaggcctattacagtttaattgttagctcagttagtgcttttgatccaacagtttagaactttagctgccagtgctttccttattaatccaccgttacaa

SEQ ID NO: 14942 - DNA, 552 bp, Homo sapiens
catacctccccgcactcgcgactccacaacgcactccgcatatcattcccggcgcgccgccgcgtgtctggcgccaattctcgccgatcctcgtcgactgctcctctcgcggtcaccccatctctggctttcccccgactgtcaccctcaactctccatccaccacctccccccctatccattttacacccaccgtaccactcctacaacccgcgcccttgtcgcaaacacgctcatgtactacctacacctccgccagagggcccctgcccctcgccgctgtgcgcgccgtgccgtctatatacaatctcacctctctgccgcgctccctgacagctccactctggtgtgcatctgccctcgcaccgccaatacttccctctcgtcctcatacgccgcgcaaacacccactcgcacccaacaccaccgtcctgccgctcatcccgacgttgcgccattcccacacgcgtccgcctctcattgcctcagtcagaccgcgtaaacccggggctgacaccacacaagctccaagtcaacactcaccccctattt

SEQ ID NO: 14943 - DNA, 441 bp, Homo sapiens
  misc_feature (1)...(441): n = A,T,C or G
ggcatgttaatgcggaatctgggctttattcttgcgggcatcgctccatgtaacactgcgtcggcgctcgccgcccgagtatncaacatacacaggctgttatgcacgcgtggcatatcatgaacactctagggtcttctttgttttgtcgtgttgccctatgtcacaatcaccacgcctctaactcccttgcttgcggagtggctaattggcgtgtngttacgcttgtcctcttaaatctcaacgtcactccggtgctcccgtgagctaccatatttcccctacctgtcgccggtatgattccatgcgcctattcagcgggtccgcgcctgttatatagaacgacttggggcgcgcacagagtgcttttgctaacacttgcgtactcccgctctacatgagtcggttcgctctccttggcctcactcgctctttttctgt

SEQ ID NO: 14944 - DNA, 425 bp, Homo sapiens
  misc_feature (1)...(425): n = A,T,C or G
cactactctatctgtggctctgtgatacacggtacacgccataccgaggatacataacctcatcgacggtgcggtatcgaatgtagtctatcaacatgtagtggtgaggaggaggcgctgttctgcaatacggtgagcctctcttcgttatgcgctatgtttgttcctgtccatcttcctttatgatctccgtgtattctccgttgcttatgtctgcctgtatgtgattattcgcaatattatgattcacacgtaataacgtcctaaacagagtggtctcctcttatgttactcattatatctgtcctcttcattcatggacacgagagntgcgggctggcgatgctaaatcctatcttagctcacggagaggcgttcggtaaatctgcattacctcgtgtgaaaagtacgggcagtgaacgtgc

SEQ ID NO: 14945 - DNA, 1763 bp, Homo sapiens
  misc_feature (1)...(1763): n = A,T,C or G
ctgttgcaggcctcacacatcatacttaccggtgtacaccgtcactgtacaacccgatggagttactcggggcaccaccgctcggactggtcgaacagtacatcggtataacctgtaatcgagggaccatttgcagggcacttttacatactcttaaattggccttagtcaccagagtggatggcctttattgaggtatcatacagaatcgtcgagatccgtaagtgcatgagatgggacacctaacctcttgttcataagttgcacacccgatctctcagagcactcggagcatagtgtagtcgccagtggacgtgatgactcgaatgacatcacgcagtagtaggtgatgcatataagatatgttgtatagctggtgtgcatgacaggctctatntnatgtgctagatcaggctcgctgcatnatgtgcagagactctgacctctgccaccgagacactatgattgtcacgtgtacacaggccgatttaatngcatatnactgcgcatgatgatgaacgatgtcgtcacacatcaggacgacgagtactgacgcccgcgactgcgcgcgtgaacatcctactctatgtgatgtgnagntgttgtgcgattcgtctgcagcagcgtggtcgcgacgctntctcnactcntctatacgtangacacgcatgctgtctgctngtctatactcacaccacgagcgcgtgtagtctgcatgcgtattngtcgacgagcattaactcgtaatncgctgacgtcgtgagcatctacgncacgncttacttgtagcagtgcatgcatcatgattagcaatctcgcaagacgctgcagtanctnacngtgttcgatcgtgtcatcgagngctacnagcgcagacgtgcgtgctgtatgtgtatngtgtatgatcgtatagtaagtcacgcgctagctctcctgcancncacacnanacccacatcgacataaacagagtgntagtgactgtaggngnatagnacagtatttcagacgaactgccngctgcacgagntcgnancntgagcgagatgcngatagtgtcgtcgagacggcagcatccgatgctgttcatatgagtgtatagcatgcatcctgtaccgctntgacntcgactancgtncttcntacagtccggacgntntgtcgatacacaccaatncacatctgatnagtaacntcgctgatgtaggngtcatcccctgnagatgngnactctacagctgttacagtgatgccatatagcgactagacgtgcgtcgttacgcgcagtagtgcatgatggtcatgatactagactgactgcatatcgcgcgaagcatatgaccagcntancgaacacgagcagcgnctacatcacgntaattgctggcgctatgagntcgatgctcacgcacgtctgactacgtcgtcgcagtacatgacacnantcgganagcagatgatacggagtgcactctgacgcgntgctaccgcgtgtatcgtcaaacgtagtccggcgtcacatgcttcantnctgatagcagatcnagttcatgtactctgctctgagcgatgcgtcgtctgacntctgcgacaatcgttgacacgnctgtagtatcggggtagactacngcaccgactagntgagagtcgatgatgacatagtcntagcagntncgtnatnagtacggtagtancgacacgcacgntcgacgntctantatctnatgctacgtacgtgcgacgcgctggattgacatccgcacg

SEQ ID NO: 14946 - DNA, 691 bp, Homo sapiens
  misc_feature (1)...(691): n = A,T,C or G
gggggggggccggttagagtatttattagcaataaagcacggcggccgtgggggcgtagccgtagaaggggtggagcgaattttgtctgggttcatgcctggggagtgactggcacccgggagaggcacaagatttgtgccatgttgttgagccaatgggacatgggcggtgggagagaatattttaggggatatttgtgctaataatgggggaacggggggagggcctaggtgatagaaaatttattcggacggttatactgaggtggggtcagtgcagaggtggtggggctgcgggcgcgtcggtcttatcataatggcgtcgaggggtttggggttgtgttacaagggagatcaccgagacaggactggagaggcctggatgacgcggtggaaggaggggggagggggtggctcgggggggaggtgtaatgggagggggtgaggaatggatgcgtgaggatgcggagtgcgacacagacactgggggtagaagtgagataaagcaaacgagacgagggtgaggaggtgggagagtgaaaagaggtggtggactaaatggtgtagtgagatatgcctgctgtgacagattggatgtagtggtaggggtganacgcgcgcgggtgtcgacgggacaccgaccatcggtgggaggggctgggacaatcggagtcactggggactgtcccag

SEQ ID NO: 14947 - DNA, 498 bp, Homo sapiens
ggcgcgtcccgactcgctattgtcactacccgtcttgatacgcgtgcacagcgcgccacactatatgcggccacatcaccatattcaatatgtactcagactctgcgctggggtggggcgtcccgctgagcactctggtaaataaatttgcgggcgagggcggtacggttaagttactgctccactcgcatttctacgtaaatggacagacgtaaagcgggcgaagacaatgggaggaaggtgagtataatacacgcggtacaataacgcggccagcagcgactcctgtgtgaattaatcttccggtgtgtgtcgcttccgtcattgtatgacatagagagcaccaccgtcgcagtacgagctggcgtttacgctctatagcatcaagcgtaccgaggatacacgggcccgagtggagtatcattctaaagtcgctttattcactaccacaccggcgacaaggtgaagaccacacattcccccatctacaattattac

SEQ ID NO: 14948 - DNA, 484 bp, Homo sapiens
agtccaagaacttgaccatggaccgcccttggctcttctgcaggttgacctcatgtgcatttgatccctcggtcttcaagccttttaactcaaaaattggcataaaacattgcaaagtcaaaaatataattgcaagagattttctgttttgcgtggaaatgaaatctaattccaggaaacagctagatgccaaatccagggaaaggttagatcaatatgaagataaatccattcaagtactagccacttgctggtaaccctaaacagaggagtagaaaacaaactttaatacctgggtttcccaagaaagcaaagacccactgcttatttccatttatttttctcacctacacctggtgccttaattgagggagagatactcgaaagagcaaatgggagccaaaggaggagcccctttactggggagaccagaggctcacagaaaagaacattggatctgttttgaaaatagagattttctacg

SEQ ID NO: 14949 - DNA, 987 bp, Homo sapiens
ccgatcctctctcttatccctccggagcatgagaccttcgatccccgccgcgctctctgttaattcctctataactggatctccgtcatatctccttcctgccttcacactattatgcaacacatccgcatccaagagcaggttcccaaaatacacagacacaccgaggaactcaacctgtatcccctcaccaccacgaccactactggtacaacatacccgaaaacacagggagaaccagaggtggaatcccctactcgctacacaacataaaagttctcagaacgagcacacatcgtacaatctctttgaagattagaaggtaatttttctcactaaaacagaagagagaggtgatttctcgtcaaaggtaaatagtttatccgcatgcactaaaagggccaaattagtggaatgccccaaaatgtttcaacatgccaaagcaaatcacattcagagtcggaagaaacaaagcatttcagggctgtgcaagggcaaacgtgtgaaagaacatagtgcgtcacacaaagtcaaatagtatcatgtgggtcgagcccaagtccaacaagaaatatagagggaaataagtctgcaaaggggaggggtcaggccaaggaagactgtgaatacctggataaggaatctgcctcttattctgcagctggggacaggagtccactaaaagtgtatgagcacatttgaaatgtgctttggggaaaacagacttttcctcaagtttcctcacctgcaccaacatcacccttctctgagcaacttaccactaacaggaagactgctcatgggacccttaacactgctaactggatttgcctcctttgtgctgtgaacagctcgaaggcaaggatgaggtctaaataaactctgtatcctgggcacccaacacagagtcagccccatgggaatgcttgttgactgaatgcaggctggtgtgcccaaataaatcatggaataaaccatgatccgccg

SEQ ID NO: 14950 - DNA, 929 bp, Homo sapiens
accgactggtgtcgctgtgtggacaccaaactgcccgcacccgcgtcgcaatccggagttctgccttccctcatctgggccaggaggggatcactcttaggggatggtccgcgccccccccgtcgcggatgatactcaagcccaaaggccttcccgttaatggaaagcagtagggtttggcccaacattcgaacttaagctcatggctctcttaataacccccgcgccagctttttaagggaaagaataattgggggcttttagaaatggccacattcccgccccgcctgacagaagcaagagaaggattttttcttgatattcactgtgagaccctgccacgcttcctggaggtaaaattttaaaagtgtgggagccctaaccatcatcacaggcttcccttggagtatgtgactcccacacttgtgcacactgagcatccagcaattcatttcggtttcggttctccagccccagcgttggttgatgtgaaggtttctgctcacgggtttcttctccaacttctctgtctataaagctaacttctgggaggctgaggcaggtggatcacgaggtcaggagatcgagaccatcctggctaacacggtgaaaccccgtctctactaaaaatacaaaaaattagctggatgtggtggcaggcgcctgtagtcccagctactcaggaggctgaggcaggagaatggcgtgaacccaggaggcagaggttgcagtgagccgagatcgtgccactgcactccagcctgggcgacagagcgagactccatctcaaaacaaaaaaaaacaaaaacaaaacaaaacaaaacaaaaagctaacttcttctggtcagctcattggaatacttattctattttagggaatgaagtgtttctagattctggaattgcaataaagcccgatgctggcctga

SEQ ID NO: 14951 - DNA, 474 bp, Homo sapiens
tccaaagcattgtaaaagggccagtttgtatttttcatttgacaaaggctatctccaaccttcagaagcttttcgttgtaatagtctgctggcagcctgggggcgtatttagtccagatattaaacaaagaagtggcacaacgccggcggaattcgtgcttctcttcctccgtggtggctaaagccttctttttcctcataaagcctaacaactcctggatctccttctcacaagaggccaggagcgggtttttcgcgtccagcggcccataaaacacggctaggggcaatgagtcctcggggcaggtccactgaagcagcgagctccgggagctccccttcgactctgggggcgacctcgaagtcgcggtggaggtcggcggcagttctggcagagaccccgaggtggtagagtcgtctgacggagagctcgagggggagccctgcgccgccatattgacgcgccccggcccc

SEQ ID NO: 14952 - DNA, 519 bp, Homo sapiens
  misc_feature (1)...(519): n = A,T,C or G
attgagaacgggccatgatgacaatggcggttttgtggaatagaaaggggggaaaggtggggaaaagattgagaaatcagatggttgccatgtctgtgtagaaagaggtagacatgggagacttttcattttgttctgtactaagaaaaattcttctgccttgggatcctgttgatctgtgaccttacccccaaccctgtgctctctgaaacatgtgctgtgtccactcagggttgaatggattaagagtggtgcaagatgtgctttgtcaaacagatgcttgaaggcagcatgctggttaagagtcatcaccactccctaatctcaagtacccagggacacaaacactgcggaaggccgcagggtcctctgcctaggaaaaccagagacctttgttcacttgtttatctgctgaccctccctccactattgtcctgtgaccctgacaaatccccctctgcgagaaacacccaagaatgatcattnnncaaaaaaaanggagaaggaaaaaaaaaaaaa

SEQ ID NO: 14953 - DNA, 690 bp, Homo sapiens
  misc_feature (1)...(690): n = A,T,C or G
cttcctatggtctatctgtcgcgggcctacagacgttccacgccgcaacctccgttgcgcgagcgtactctcttatctatcagcttggcccccctcttcagtaccgtctgcacgcctctctctcccgtcccctcgtcctcctgcgncacccgcccggggtcgcgcgcacggcctacacatacacgcactttctcacaactacccgccccatcacacactctctttcctttcaaccgggggacaaggtggcgataccctaactcctcgaggccccactcgatcgagacaaaggtatatcacggcccctttttctttcttattcctcaaaaaaaatttttccccgcggagctcgcatatttggccactaccccaccccctgggcttcgtaacattattcgcgccccccccggcgtaagcattagaacgggcgcaaatagtgcgtttgtcctcacacccttaaatccccctcccttctaagaattcctcccccccctcttttttggtgcccgccgcgcccccccccgggagggccccgcgggtttttttttagaaaaaaaaaaccacccgtttaacggttttatggggccccccccccccgcggttctgtggcgccccccaaaacccccctttgggggagcccccccaaaatgttcttttcctaaaaaaaaaggaaagggaaaaaaaaaaaaa

SEQ ID NO: 14954 - DNA, 605 bp, Homo sapiens
  misc_feature (1)...(605): n = A,T,C or G
atgtgccagaggagttatttgaacattcactgagtccctgttccacctgcaagaataaagaagtttgggaaacaaaacccaaaatgaccaacgcaaccagaatccacaacatccctgtccaattttgcaaggaanacctcttaagggacagaagttgatgaacaagatctcaccattatacaatgatgaagctagcccgcggatgagaaaacggctaccaggaagtcacgattattgttgtacattatttgtgtttagtgccagagaaacgattttctttctgcaatatctttgcctcaataaaattaagaacgcagtgtaagatccaaattccccccaaaggggtcagcctaaaaaaatttattatactctactgccacggggatttatagtttctcctttaatagttatagtctgatataccataagttttgttggtcactaggtggattcatttatctctcttttgaaaaacacattgaatgttttaagcaaattctggcctttcaattgactgaattttgcattgaggagtgaattgctgaatgactttggaatatgtctccaaaacaagtagacattaaaataaaaccagtatcggccag

SEQ ID NO: 14955 - DNA, 610 bp, Homo sapiens
atggagtctcactcggttgcccaggctggagtgcaatggcgcaatctcagctcactgcaacctccacctcccggattcaagcgattctcctgcctcagcctcccgagtagctgggaccacaggcacgtgccaccacacccaggaagaacacattctctctgcggcaattctaaggacggactaactcaacaactcaacaccgggttgcgtgtatactgtatcacctaagccatcagaacacagaaggtagctgtgctaaaatgtataagcacgttaattcaaatcaatgacagaagcctctactgaagcttagcaatcacctatttgaacaacataaacattcaatttctcctctggaaggtaattttaatagcaagcataatattcaagtgattttccacgtctgatggaagaatacaatggagaaagaaagaagagaaagagaaaagaaggaagagctagcaggcagaggggtggagtgtgtccagaagtttgtactaacctggatcgctagccaagtccagccgctttaactgagccctggcaatcaaaacaccactgaggatgaaggaggcaaaagaaaaaatcaaataaatatctatgcggcaag

SEQ ID NO: 14956 - DNA, 387 bp, Homo sapiens
atttatcgatgaacaagtgtgttttgtacgcgaatccagttcttttacagtgcctgttgctatatagaatctacatgtgacatagtggctcatactcgtgccaacacgaatgcgcgacaagtttagacgcggttagaccgcccactacctctcgttcgttccatgtgcatcacgacagatgtgtgcttgctgctcttgttacttaacttggcatcgttgccttcagacttgtgtgttgtatatgatcggtattggagatgatcccccggatcccgcgcgactcggctacgtgtgtacgacttccgatacggactacatggtcgcgaggagtgggacgcgcggcagtctcgagggtgttgtccgtctgacaacttctcctctttcgtg

SEQ ID NO: 14957 - DNA, 865 bp, Homo sapiens
gtgtagtgtgcaatttccagtcaaaggcacttccaggcctgggttggtcaatttaaagaagaaacaggggtccttaatttacctgggaaaggaaatattgggccatggaaacattccagcacagtccaagcggcttccaaaaggtcttttccctgcttttctccaggccggagaccagtgggttccccgcaaatagcagacactcaaagctgttgtgttaatgtaacacatcgtcctaacagccgtattatttctgccaacactttcggcctatcacaaatgccatcaaagaagcaattttcttcctcctttaccgttagaagggtggtcaggcccagcctcgacatgggaaatgtgttccacgccgactgacttcaagtcacagcacgggcgtgcatccaaccgtggaactaattactcggcagcctgagggcgatttccagcacagaagtgcatggaaaccacctacagaagcacctggactgctccaagctcaccctgggccagctcagcagcacgacaggagctactccctcattcatttgttcagacttctggatgcacagctgagaccaggaggaagctgacgaaggcagccgggctaggggcaccaggcttctctcctcacctcgcatggcatcaagacagcaaaagggaatcaatgtggagcccccagcaagcaggcgtggcctcaggcagggcagcgtgggctggggagggggctgagcccggctcctcatagacttgtctccacccccaacctgcccttgcccagggacacagaactcccaccagtcagactttgatctcccccagccagacaagaagggggcagctattccataaataaatgtcgatgcgcccg

SEQ ID NO: 14958 - DNA, 881 bp, Homo sapiens
cgaagggttttgacacacagtttgaattaagctccaggactttcttattacccccgctcaggatgtgaaggttcaaaacgaaggccttgccactgaagggtgaacttacccatcgcgggctctttatagatacatccataagtccccataagcgggactccaggaagagggagggtaatggcaaagcaatgtgacaagtaactgactgaactggcccctggcttagtgactggatgtgtcatatcctaatatcaacatggagcaggagaccccaaacacccaggtggaagaacgtcagaaaaagaccagaagacaggagggatgaaaacaatggagtttcactcttgttgcccaggctggagtgcaatggcgggatcttggctcaccgcaacctctgcctcccaggttcaagcgattctcctgcctcagccgcctgagtagctgggattacaggcatgcgccaccactcccgactaattttgtatctttagtagagatggggtttctccacgttggtcaggttggtctcaaattcccaacctcaggtgatccaccagcctgggactcctaaaatgctgggattacaggcgtgagccaccgtgcccagctattgataactctttcgaccaactggcaatcagaatttttaaatctacctatgatctggaaggctctccccaccactccgagttgccccacccttcctcccttccagatcgaaccagcgtatatcctacatgtattgactgaggtattatgtctccctaaaatgtataaaaacacactgtacccatacaccttgggcacatgtcgtcaggacctcctgagggtgtgtcttgggagtgtccttaaccttagcaaaataaaccccgatgcggcag

SEQ ID NO: 14959 - DNA, 730 bp, Homo sapiens
gtccaaaggacagctggctgggttcccttcctttcataattataagcctcaatccctgctgatcataaacccgcacctagggatgagtgccaggaaatgccaatgccttcttcccttcttgggttgcctctttcagagatttgggggggcagtggcatcctcatgcaagctggtctactggtggctgcccctgtgacctgcttctgaaaggccaggcaggaaaagtctcccactgtgttgcatttaaagaaaagaaaaagatgaattaagtaaaaagctctgcaaacaactgagtaatacagcagaagtgctgggatgtcatttctggatgatgttgtgcaagactgtgacttctatctgggacacactccttttcaaatcctcacttgcccactctggtgaagccactgccacatcgccagctgccctacagagaggccacgtggcaagatgctgagggcagcttctggctgatagctgtaaggaacagagggtctcagcccaacagcttgcaaagaactgaattctggcaacaaccttgtgagtgagtgtggaagtggctcctattgagccttgagatggctacaatctactgtcactgtgattcagtaaatgcaagtcctaaaccatgcccagcttcctgaatttcaggatatgtgagatgaaagtgttgttgcttaggagtatttgttccacagccaataaataactaataaactaagatcggcca

SEQ ID NO: 14960 - DNA, 875 bp, Homo sapiens
  misc_feature (1)...(875): n = A,T,C or G
ccccataaacccccaccccctcgtgcctccctcttccaactctcncccatttccccccctccatatcctcccgcgccctttccaactcagcccaacacccgcaccttctccgaccccaccccccccctcccccccacatctcaccctcccccctccccccccccatgtccaacccccccccctctccccttccctccccgagtttcacccccccctccccaaaccccacaaacaccatcctccccctatcccctataccaaactccctaggcctctaaataattcactctttacacgtcatccccaaaaccaactccgacggacatccaatccccatcacccaattgcggtacacctcaaagcacacacattacgtaggccccaatactactcctcatgcctttacttgggtcccacatacagtttgtatttatcaccaacccatgaatattcttttatatttttatggatggtaaatacactatgtttattttagctcaatgtaataagatttatttgtgcactgaaaaatatctagcaaacaaatanttatttactagaccattcttttctcctaaagcagattatctagtaagttccaatgaaatgtttagctgtcatttgtctcattntattttttntntgtcacctcctcttttcttatttttaagttttaaaatgtcactatgtttcccttcttttctcttttcttactttttttctctctcatgacagcattatgcaattatgctattgataatcataaagttgaggaacaagagaagttggtccacatccanacaagtgagaatattttgagtatttgtacaataaacaggtggcttcgtggcctcagcggtggagctctgcggccg

SEQ ID NO: 14961 - DNA, 764 bp, Homo sapiens
  misc_feature (1)...(764): n = A,T,C or G
gcgcgtcgatgaccgtgttcaaacaaatgtggggtcacagcatgtgcatatccatcattttatagcccgcgttgagcttgcttcttattcgtgtttatattccccgtcttgtgaggtgtgctccttatattggcgctgtgtcgccacctgctcctccgtaataaagtcgatttggcgtgaggcccatttttatcgaatttcgctcatcccgaattctctgaatgctacctactaggctaaactcgccggatagcttaatctcttcaatatttctctttccgacccatatagagtgaccagctgcgcgaacgctctccagcangaaaaccttgttagcttggtgggtaaccccaatatcggactggcggcggctatctccgactcccctattctatctcttcgaaatcccatgacaaggtttaagatcccgagggtctttcatcttctactggtaagccttttcgagttcaggttgtgttaagtaatagattatcttggttggtgtggtttttcacccttggaagcaattagctggatttgccatccctggctatttatggaaaaattttttgcacccntttataattagggatacagtttagtttcataacatcccggtttttattactccccaccaggaatagagtgtttgctattaataactaggctcaaaaattgtgaacctttagctttttaatttgtaaaggggttaataaggaatatttgacgccccctcccttgaatagagatgataatcagccatc

SEQ ID NO: 14962 - DNA, 979 bp, Homo sapiens
  misc_feature (1)...(979): n = A,T,C or G
cacggttcaacccgccgcattcccatcacttcgccctcccacgtcctcgccacgtctacaaccgccaattaaccaccccctagggcttacctcactccgtccatcaccggcgcgacccgctgatacgcgtctataagccccgcgccgacaacgccagtaaaccaccggattccgccgtcacgcgatggatcgcaaatctccctcccttctgatccgctcgcatggccgccgatcacctccctatgcatatggcctctaaccaggcttaaacgtgggtagtggcacctattacccggccgtttgatccaaacccacccgcgcctaatcgcgcagtcgctcgcgccacctctatctccagacgggcccacacccgcaaaccggcgctgacctcgctccaacatgggcggggcaacatcaggccgtatgcgctgtgaggcccaaacccacacctcttttgaccccgcacatcagccccccgcgcatcttacttaggactgggtacgctggggagaagggccaacatcgacgctgccttcttgtaattccgcccccccgctaatctgtacaggtacatagcgtcttgaacttttgtcatccacattagaagcttccagtctttcaatctctcatcacattatccttaagtagctgagtttttatggtacaacccctattccgacattttcattgtcaattaagtgttcattgttcacatatggaattataatttaattaccccctgcaacagtgcaaaaataaattattagctgtactttttttttaatcccttaggaaactcaaagcaatctacagattcaatgcaatctctatcaaaataccaatgacattctttacagaaatagaaaaaacaatcctaaaacccatatcgaatcacaaaantatcctgagcaaaaagaataaaaaagtggcctcgttggcctcagcggtggagtcgggcgccccgaaataactcatcgtc

SEQ ID NO: 14963 - DNA, 110 bp, Homo sapiens
  misc_feature (1)...(110): n = A,T,C or G
cgcgagcgccagcttaanagaggggatagaacgcgcccgcgcccgcccgcccccaaggggcgcccccccccccccccgcggcctcgcgaagaaaaacaaaaaaaaaaaaa

SEQ ID NO: 14964 - DNA, 436 bp, Homo sapiens
ctccatcatttcccgtcctctcttatccatatcgctttccacattctcttcaattctatcgccactataatacatcctctccccctctcactcgcaatctatatactaccccacacaatacaaccttctatagcgccatcactcctcaccttttattatacctcacccccgccctctcacccaccactataccctctccccgactcacgcattcctgttaccgtactaatccgacgcatatctcgatcccccatatagtcttccccatcgccagcgccaacttccccggtgggctatccactaatcttcttgtccattaaggccttcccgaacaccctatttacgaccgccatcggatttccacccactatggcatctgattctaattctccccagtccacgcataacgtccggcagccataaagacccaggcttg

SEQ ID NO: 14965 - DNA, 1063 bp, Homo sapiens
  misc_feature (1)...(1063): n = A,T,C or G
cggcgtgatatcccgcagccctgcttccctcgtcccataataacacaacacgaacaacaacgatttttaccgccgcatacattaatttacccatacattcttcatncaaccgtnccacaaacacnatcatatcttcctcgtcgacatcgataccatcaattaacgcgcccccctctattattatctcgcgtggtgcggggcccactcacccacacattcccccttatccatcatcaatctccctcatccacccccgctttatccgcaccgcattccatatccaccccacataactctttttatcccgtatttcacgatttcccgaattactcttatttcccccgccgtccttaccttcattatacccatcagacctccactcccctcccttttctggtgtggggggattcgatccaatgaccatataatacacgtaaaaattattatacgattccaaattacatatgaacattctctacgcaatgatacacgatacttagaatactaacactacaacaaacaatacaaacaaataatcaaagtaaaaaacgcgtaagaaacgaaatagacagataatgaaactaaataaaaaacacaaaaaagaaaaacattcaatatagtaacaaccattacataccaatatctacatactaagaaagtgaaaggaaagagcgacaacaaagacgtacaaaataagaagaaatgacaatggacatacaataataaagaacgagaagaagacatgtataataagaatatacatccgacccaaacgcacaacaaaaacaaaaaaaaaagattatctgatactccataagtatgtaacacgaattaccagcgatagatcaaggtcacattattaaccgctgttattccattataaaacatataaaaacacaacaaaataaaataacaacattataataatagtccgaaaacaaattatcaaataaacacaattaagactatccaaacattatatccgtatcacaagaataaccacccaatattcgattaaataatcacaaccaatggctacttaaaagcacaataaaatcacata

SEQ ID NO: 14966 - DNA, 410 bp, Homo sapiens
  misc_feature (1)...(410): n = A,T,C or G
cacttccatcacccacacaataatgacgatgcataaggtgtctattctcaaatcagtagaaccagaagatgtatgatgaggtatgcacacattcacgttcctctgccatctttcctcagccncccttacccttcacgtcctatattgtttctataggctacttcgtatttgtacgctggatctgcaacagcaagtaaattagataatagtcctttttgtagttatagccaccacggccaaacttttcaactatacagcctaccctccacccacccttttaattgagttcattataaccttacttattctaatgttctagcgggtcttgcgggtatattatttctcgtttgtctctgtcagtccagtatacgcgctgtagtattctttactttagggtgcaaattggtcat

SEQ ID NO: 14967 - DNA, 305 bp, Homo sapiens
caacccacaacgcacaccgcccctgtccctgctctttattgacccacccacccaccctacacgccccgcctgacctatcacccccccccaccccacctacacctgtcctcgtctctccaaatccaccataaccgtgggacgcgctccaccttcaacccccccacctcgcctccgatcccccaaccagccacacaacgccccacccccacgtctacgcgcgagaacaccgcggcccgcctccaacacaaaacttccccccccctcctttaaacgcacgggccagtgaacgcgcgtaaaacgacctc

SEQ ID NO: 14968 - DNA, 229 bp, Homo sapiens
atcaacaaaaaaggaaagatcaaaagaaagagagagagaaagaaaaggaaggatggaaggaaggaaggaaggaaggaaagaaggaaggaaggaagcaaactgcggagaaactcacaatccagacaagacgtccgctcaattttggattgtatcattccagaattttccacaacatacttaattagcctctaatttttttaataaaacatctctaacattgtgctatttt

SEQ ID NO: 14969 - DNA, 768 bp, Homo sapiens
actttatattcagacactattcctgaagacgtccttcctggaaaattgatcatgcagatctctgctacagacgcagacatccgctctaacgctgaaattacttacacgttattgggttcaggtgcagaaaaattcaaactaaatccagacacaggtgaactgaaaacgtcaaccccccttgatcgtgaggagcatgctgtttatcatcttctcgtcagggccacagatggaggaggaagattctgccaagccaagattgtgctcacgctagaagacgtgaacgataatgcccccgaattctctgccgatccttatgccatcaccgtgtgtgaaaacacagatccccgaacgctgttgacaagagtgcaggccacaaatgccgacgcaggtatctcccgggaatgctcttgccttgacgctgctcactgagatcctaggaccctttgtctacaacacacccaagagtcgacctgtggcagtaactcgatctattgatggcccatagcacttccgggaggaaaggaatccataaacaaattattgagtgtttaatgaaatattaaagtttaaaagttttcgcccaagaacctaatgctggtgaggccacaaaatgctggtgactgattataatctggtcttacccccctatgcattaattcagtgttgtgtatatagttcataatatatgacggggccgctcctctttatgatggcaatttatgaacctgcttatgggacccgacgattgagcttatagtttccgcaaag

SEQ ID NO: 14970 - DNA, 750 bp, Homo sapiens
  misc_feature (1)...(750): n = A,T,C or G
tcccaactaaagggctgccgccgcctgggtttttatcacaacacagtttaactatagctggggtgccacttttaagtaaccaccgtttcagtgggctgtatccccgtggagaaaataacttccattcgggagggattttttttgggccggtgctaatacgataccgcagacccacctctccgggtctagataattcacatataccacccgcccggtgggggccaccgccaaacaggaccctcaaatttgtccgcctccattcaggctattaattggcggcgggaggcgggaaaatccccatttttggggtggagcccctcactatctattggaaagaccccgggggggaaaaacaaaaagattggccgaaaaaccttatactgtggggggggtttttaaaaagaatatggttttagggaaaacaaaccaccctttttgcttaagcacaggccccaccattgaatgtgcaaaaaaaacccattcttttgggtccgggtacaaaaggcccctccccaggttttaacccagggaaaattccctcctccccaatctttaaagaagcgcaaagaggaaaattcacctttaccctcttccagaaggggggtagggctcattccaggctataaaagcggggcgggcactgcttttaaggggaaaaaaataaggtgacagaaaaaaaataggggggtgggtttccaggtagttggggttcttctacaataaaaantccaaaaaacagggaacaggggg

SEQ ID NO: 14971 - DNA, 440 bp, Homo sapiens
ctgtcgtccgcaccaacatctgctgatcgagcatggggcataataatactctattaccaccactgtgttccaacagtgaacaacactgttgagataacatcaatgtctcagcatgtagatcaggcaagcctccctcgcggtttgtataggcgaacaacatctcctctctctatcgggctaacgacgggtcaatcgccgctcgtcgttctaagcctgttcaatattagggcgttaacacctggctgcggcccacaacagtttacgtgactccgtgctagcgagctcccttgcgacgacttgcgaggagtaattagctatctataaactcacagcctggcgactgaaaacataagagtcgctgaccgggtggcgtgacagcaagcgggggatttgtactatttaacaccattcctaccctcccccgagacaaaccacccctg

SEQ ID NO: 14972 - DNA, 917 bp, Homo sapiens
  misc_feature (1)...(917): n = A,T,C or G
ggtggagatgaaaggtggannntcaaacagaaaaagcannnctgncaggaaaacaaaggcctaaaaattaagccgtgggagtgcgttcgggatctatgagcgtggcctatccagggatttatcgaggcctatgagcctatcccaattaaatggcgaccgcacgctcagctgttatcacaacagttttgaacttaacctggaaagactttctaaattaattcttggggtcactctgacgccaaacccacgggggggcatgagctcgtttggatgaaatgattttaccaatctgggggagaagaacaaacaagtccggatgctccgccttaaaatctgttacacgcaccacgaacggcacctttttcacttccgagacccaccagggctcttgcccctataagaaaaaaagtgcccactgttcgaacaggaggaaggacaactcttgtgccgccccctgttagaacctgtaaactcccccggaggtgtgctgggctttattcttgaaaattttgaaaccaagcaaccccccgtcttccgggagagaacaaattttaaaaaatctgtgggacccccgaaccccgggataaaaaacaacttaccgaaattgggggtgtttccccctggaaaagggaattcatagttttaaacgtgaagccaacaaaagggttggataggggaaaataaccaccactgtgaaaaaacttttttaggggaaaggggaaataaaaaaaatatatttgttttaacatacactagaaacaaaaaatgtggatcaaattttgaaaaaataaaaagggagggcaaaaaagtggggattgggaccaggggcccacagataaaaggggcgaccctgtgttttcctgggaatatttggaaacccccgaatcaccctcccgtgggaaagcacctggcgtgtt

SEQ ID NO: 14973 - DNA, 883 bp, Homo sapiens
  misc_feature (1)...(883): n = A,T,C or G
ccaatccgtcgccccacctcctgccgtgccacgtctattgcggatcactcgtcttcgctattcctccccttttcctacttaactcttgcttacatccatctaatgtctccactccctacgacactctttatcacgaccacgacgtcaatactcacacacccaactgtgcttgctcccggggcggtcgtgccgagctcgctgacacaacgtgttcccagtgccctcaaaacctgcacatggctcgagagngcttcctagagtcgttgtgccccactctccacccctgaccggtcgcactgatacgcagcgcctcatactttagtttccccgtgtacgtcgcagtcttatggtacgcggagctggcgtgaacacaacctactttgtaatgggtgtcgaagattaaaagcccaaatgagatgtgtgccattcctagcgcgaagaccccccctcatcttttctatatgttttttatcccggaatcccctctccctcacaggttattgttcaaatgggcccccccgcgaacatatcggcggccgctctcgcatatgagtgctgggccgagtgaaagaagctttcatttgttttacagtggctcccaatcacccacattatcgcctgcactccctcctgtcagatcagtggccccatttgattctcataggagcatgaaccctgttgtgaactgcacatgcaagaggtctaggttgtgtgttccttatgagaatctaatgtctgatgatctgtcactgtctctcatcaaccccagattggactgtctagttgcaggaaaacaagctcagggctcccattgattctacattagagtgagtcatataattattttattatatattacaatgtaatagaaataaactgcaca

SEQ ID NO: 14974 - DNA, 865 bp, Homo sapiens
agggtacgccccccccctccccggttctcccccctcgtgtgtcccatggcccgcctctttctgccaggttgcccggtctttgtatccctcccgaccccgaataattatcctggacattacaaggggttaaaacaacgttccgcctgttggtttcttctacctccaaaacaggttgtcaaccggtcggagagcctcccccttccaagcaatattttggggatcaaagtcctcctaatatcttccgtcatctttaaaaaacaaaaacaagggatccctcctgggccatccaattaaagtgatacctctaatttgtactgctaagacataaaaataccttattttgtcgccttgtgttctctttttcttgcccatagacatggaccttgagaatggagagttcattgcattatgtctttacattctgggttcaatccaatgtcagatctgttaataaatgttgaataattgagcttgttatttgccaagttgaacattggagaactgttcataaaaatcgtgtgtggtatgaatgtgaatgagtataataataacttaatgtaagtcgaagtcatataattggaaaggttgtgattaccaaggtagtaggaaaatataatgaatgaatgacaaactgcatagggtttacccagtaagaaattttgcatttccagatcattactcatgtgatgaatagcaaggataaacataaaactgcaattatgcaattatgcttgaaataaaatcatgtgtgtatatttacatagtatcaactaaagcaaatgttgctattcaaaatattgtgaaaattttgagacaaagtgaatttagaaaacactagaagtaaataaatccatgatgcggccag

SEQ ID NO: 14975 - DNA, 898 bp, Homo sapiens
  misc_feature (1)...(898): n = A,T,C or G
tggagaagaagcgacggagaagaaaaaaaaaaaaaaacnnttttnttggtaacaaaacgcgtaaaattacctctgcgatgtcccctgattctgtgagatgcgggaatatccagttatccagccgggcatataagcctatcacaactaaagggcaaacgccgccagggcttctatcacacaaattctaacttaaactgcagggacactcttaatataacacccggttcaggccttccctggtttatgaacagaaggggtttacccttgggaatttaaaaggggcttcaaggggttttgtcgggtttacggaaaaaacaagggcctcccctcaaggggccacaaaaaaaaaaaaggggagtttgcctgccaaatatggagagggggggcttttcctctcacatccaaaaggggccatttccccccccccgaggaaaaaagggccctccttctaagagagagagaaagcggtgtaaaccgccctcctcccctatggcccacatctcacatttgagcacttctgtcccctctgcggcttttttagaggaggggttttaacccctcccttcttttatttggagcccttttaagacagggctacatttttttggcggggaaaacagactttttaactctcccggttccagttataaaaaaaaaaggtgggggggtaggcctcctacaaaacccgttagaatgcccagcccgcacaagggggtggaccccaaccgtgggtattttgcctcacgaagaaagacggtgtcaatgcacactcttggggagcggccatttatctcccttcgtcttttgaagaaaaaaaatataaaaatttgcaaacttccccacgggtctaatacctaaaataaccattagaagggtgacaccccttcatccttttgtt

SEQ ID NO: 14976 - DNA, 906 bp, Homo sapiens
  misc_feature (1)...(906): n = A,T,C or G
gtgggaaaaacaactgaannnnnnccaannnanaannnnnnttttatgggaactaaaggggtaaaaattttccgtgggcgtggttccgtgtactttggaggcatgcccataaacggatttaacgggccttgtgggcctatccaaataaaagggcacgcggccttttttgctttttttcaaaacttttaaactcaccctggataaatggtccctcactgccccggtatatttacgagctccagcccaagaaaattaaactaacttggcaggggccttttttgggggggagccccaaattggccaaaacccctcccccggggtcctttattttgcaaaaccccccccctcccgcggggacgagcgcccaaggggtcgccttaaatttttgtccccccccccccctttttaatagtggacgcaaaataacacctgggggtgtggccgcccccaccccgggggtttttttaacaccgaatatttaaatctccggggtgggggccatacaacccccccggaaaatttttcccctccaaaatacggggggggtggggtgtctgataaaaaaaagggagctctttaaaaaaaatccttccgggcatttttggtttctacaacccatagggggcccccgcaaaaaaaataattttaccctcctgagaaaaataaaaaatagggggggcagaaaaaaaaaagacaattcccctggccccaaaattaaaatattaaacgagcgcccccgccccctatatattgggggggtaaaatagcatataaaaagaaatttgcgcggtccctcggccggggggcgcgtggacacccaaaagggtggggggcgtgccccaaaaacgagagaaattaannnnntgccccggtttgccctaaccgggaatgctcaaggccttaccc

SEQ ID NO: 14977 - DNA, 1001 bp, Homo sapiens
  misc_feature (1)...(1001): n = A,T,C or G
acagggaaggaactagacaccaacacacagttctggcacaacccgaaattcccgcgggggcgtggagaacccaggcgcccatcaagggtttttttggcctaaacctcccagaaaagggacccgccgctccggtttacccaaaacctcaaacaaacccggaggacttttttctcccccatgaaaaaaaaaaccaagttttaaaaatacccgggggtttcccccttttttccaaaaagcaaaatggaaccctgtgtataaaggcgggggctgccccccctccccaaaattaaaggggaggaaaacctcccccatcaatgttcccaagggcgccctttcatctaaaagggactgcaagaaaaaaacaccccccgagtttttttggaaaaaccttcaagcaatcttattttccgcgccagaagaaaaaaacaggaaagaacctcccccgcctaatttcggcaaaaaattaatataaaaaacacaggccggccgggtctcattttttcgtggggggggatccctcaaatggccccgcacaatatcaacccgggtcccccccccgcccttgtttgttcccgggggaagaggaaaaagaaaaaaatacagagggcgggtcctgtagaattcccacaagcgaaagggcgcaataagccacagaanngaggctgcgcggtagtctccctgagtccacggggccactcttaccactgagacccatatcaccctcacgcgctcnncncacacataatacactatttgaaccgattattacgtctccatcatgcgagcgcgcgcggcggagtacgcactctcctcatttaacacagcccagagaagaatttggatatctaccgacgattacgattgacttncncggccgaagctctcacacgacgagcggtagaactcacactacgaactcattatcatcgctaacgaagaccgggagcttcaaacaatcatcgtaaccgcacatcgctccttcgtcataggtttgtgtgtgt

SEQ ID NO: 14978 - DNA, 805 bp, Homo sapiens
tcactacactaaatggcatccgccgtctgggcttttgtcgcaacatgattcctcttttgctagattgactttctataatatatcgcccgctacacgtgtttttactcgtttttgcaaaggggagagatcctctctttttgcaggtactcgtccaaaggcacccctaaaaccattctctacgtggttttgtggatcaaatgggaaggcgcttatgggaatccaatctttgtatacttttcactgagcgcccttcagccttaattattactttccagaggcccctatgcaccactgggcgctttaatagatggacctgccaataaaatgcttcctgcacccacgaagaaggtgtttttgtgttcactacctggagaaaattccttccctgggaaacagacccaatgacggttggcccccagcacacaccttttcttgttgtatttaacggtgctggctcgctcttggagttgcccccccaaacccatttggaaccccctccgataactttcttaaagtgcaggtttccttaaaatccgctcaaagtgcaaaagcctataaataaagaacccgtgttctttcttttttttttttcccccgccacggcctcatgttagggtgaaaccctttggaacaaaaaaaggaggttgccttttttgcccctgccttttttggcgaattttggaggcctgggccaagatttccttgcttagggagtttaaccctcttggcaaattcttggactgcggttcctttatttacaagaaaaattttttttttgtgttttcccagagccccccttttggaa

SEQ ID NO: 14979 - DNA, 678 bp, Homo sapiens
gttcatcactcattttggaaaggggagagttcctcgctatattcgttagtggtctaatggagtccctaagaagattttatacttctctttggaatcaaaaaagaggacattattgaaagccataatttgtatacttttcactgcaccccatcagtcctcattcttccttcccagagcaccttatgcagagtagtgcccttttcttgatgttccttcaagaaagtgcttcctgttttcaggaagaatgtgttcttctcttcagcaatggatgagcttcttccggggaagttgacccatttcctgatggcccccagcagagtctttgcttggatgttatttgcttcttggattgattttgtattgcccctccagagaaattggaaaaccatccaaaaaacttttagaaatgtagtatttctagaaatactacaaaaatagaagtactagaaaaaaaaaacaccggtatttattcatcattatcattgccatcatcctgtctctcattgggatgttcaaaaccttctgtaaacaataatcagaggctgagcttggtggctcatgcctataatctcaggactttgggaggccaaggcaaaaggtcactttggctcaggagtttaagaccagcgttggaaacatactgggaccttgtctctagaataattaaaaaaaaaaaaa

SEQ ID NO: 14980 - DNA, 915 bp, Homo sapiens
cagcccgcgccaataatcgccgttctctcgcaaccacctctacaaggctatactccgtcctcctacaacttacccgcagcggcgtcaacaaactggccgcatgcgatctcccgcatgcgctctaaatacaaacggcactcacattgtaaggttacaacgccccctgtggtcccgattcatattaaatagcggaggcggggagcaactacctctacgctgcgcggatcaacagaatgcaggtgagtggatcatctctccacgctccactcccggcttagaagggcctgagaatacgccccctttttcccatccctccataatacacatacaaaatgatcacgcaacattccgggtttcagaaaagcaaaagcgtgctatttttttccatatttatgaactctgacacatgaagcaaccttaagtttacctggattttaaggaagtaaaccatgttgagaacattaaggctgtctctttaactcctatgctgggcagcaccttccaatacaaagatgaagagtgggaccaacttgcaaaccctccttcatgctgtggcttatgcctgggtgatcttggctagtgctcaccacagaccctcggagtgggtgttattaacattatatatgccttctcactttttcaacccacagtggctcctagttaacccttgattatctttgtttcatgctaagctcctccatttgtttgcttagtcgctcttattcccatacgccattcccatttcatctccacaacccctgtgcaaggtatttaaggtgtatttgaatgtgttcttgcaaaatatattattctgtgcacatgtatttccatttatataaatgtattttaacacattttttcacatttaaatctctgaagtcaggattcatcttacaataaatggcgatgcggcaa

SEQ ID NO: 14981 - DNA, 745 bp, Homo sapiens
ccacaactaaagggctgccgccgcctgtgcttttaaacaccagtggcgaacttaaacaggggatccctttttgaaaccaccggtatagccccattgcctacccccttttctgcttttcagataccctggccacttctctttgctggaatatgaacaagttttggctctttgggataccaaaacacccaaaacaggctttaagaaaaacaagtggggcttatgaggaacggggcggccactataaatcatatctacgcaacggaaaaaccccgggggtaataaaggtgtttaaggagcgcacaattttgggaaaaacaagccgctttaggactgtgacacctttgtgcgctcttattgcattgggaaaaaatgtaacattaataaggcccttaaaaaaaaagtcccaaatcaacgcgttggcggcgcatttaaaaacttgggtataccttcagaaaaggagttccccatcctcttgaacacagcagaacaaaaaagccctttccaaggggaggaggaatcctttggggcaagcgcttgccacacgataaacattccacattccgggggacttttttcacttttcctctaccgcgggggaaacgtttcttaagggggggcgttttcttaatgaacggaaggatttttcgtattttttaaggccaaacaagaaaaactttcctttgaaaaaggggcaagggcaagggcttccggcttttctcaaatagggcgcaaaaaatggtgggcg

SEQ ID NO: 14982 - DNA, 1557 bp, Homo sapiens
  misc_feature (1)...(1557): n = A,T,C or G
ttattctcttcccggcgcgccgcaatgttgcgataagtcggacttgctccgcgctctgtggttgaatagcatactactcgacgaatattcacatgtatccaagacccgctaattccatcgcataagttggagtgtcgttacgcgaatcatcgtactcaccatcgcgccgatctgtttgttgttctgagaattataatagcacagacaacaccagcctccactctagagctccctagattagctacctgttggtcgtaactacgccacacctgacatggtagattttggtcaggacgtacacacgaccggatccctcgaacatggcgttagcgacacgtctcttcctcacngcgcncgcgcggactcatagtagtgagtcctcacgagatgtgacgaagaccacgcgctgctcgcttactaacaacgcacgggagaatgcgctatagaactattctaacagtcacacaccntatattgtttgtctatacgtatacgctactcatgaatcgtagttatattgctcaatagtctgcngtctacttcacagtgatgtatgcgcagtatgacagaaacgagaatcagtgactggtgcatgataacngatagctatgcccatactaatnagtatgatcagtcgtagatgaagtgacgcgncgcgatagtatangtagtagtgcatcatcgntaatagtgtctatgtactactatgcagtcgttattgttactattatgaaagatgagtcgcgcatcatgtagtacctgtatagtatcactactcgattgcgagcngaagtatagtaatacatgcagatactatcgagcgctactatatantgcccacgatgtaatagtgatgncgagccgcgtgctcgtagatcgctgcgcacgttgtacgtaccatagtcgagattcgtacagtacgtgtctgctctcaatacttacatcatatcgtagtatcatcgcgttatgtatacagcggtggaatacgtcgaagcacgcatgtgagctgacacgtgcacgtcntgcgcgcgcgtgcgcgcacgacatagtgagtagtgnacgagcntagacgtcacgatggagttcagagatatgcacancagagtgaatatgattntatgatgtngtgtgacgatactgcgctcgtcgtatgcatgtacgcggtaagtatgtcacggagtgatanatggagatgtacttgcagccacgagtgtgttcgttatgagtacatgattatgtggtgcttaaacgtcgatgactctctatagttagacagttctatgatcatgtgtgtcgcgatgantgagcatancgccgtatgagcacgagagagtgtaattcatgatacacgaatctcagcatcangcgatgtcgagacgtggtgagtagtagtctacagcgcgtgatngacattgagaactgcagatcagagtctctttagacacagtatgntatccgcccacggnntntaggagcacgtagacatagtagcgacagcacgtaggtcaagcatcgcgacgtcgattatacgcagccgcgcacgatacgatatgtcac

SEQ ID NO: 14983 - DNA, 860 bp, Homo sapiens
acctccccatacgtccccaccctctatcaaataaccgcgatccgtgggcgacacacgcctcttggggccaacagccgactccgggaacgtagtcggtcaaacgcaacgacccttaatcacaacccctcgcatgtcctcacgctccaatgtatatggccgaggggcatacctggcatttatgccataaaggccttcccaatttatcgttggaccacccgggttactgcgccgcagtcttgaactcacacgtcagggatctcttatataaccccccccacaggtcatcagacctgcaaaaaagaggctgggtgttttcctccctcgaggtttccccaatttttttggcagaaggctgtagttgaagttaccctcaaagtggtttgattgggacttcaagtgagagatgctagacttgtcagccccctctccatcaagagaaggaagaaccctcccgaggagccagcctgggtggtgctgggatttggccaagacactccatctgctggaaaggcaacggaaagcttcgaaccactttcttttggcttgtggactcaccggctaattgacaaatgtgcgtcctgtgcatgaactgcgaagattttccatgatatcagcagagcccagtgatatctggggttcaccaagagctgtggggccctttgtgtctagaaacttctggccattgtcagcagagaggcccctggtcgctgttcagggtcctgctcactggcaacccatgacatactgagagtcatcattgtccaatgctgagcacatagtgagtcctcaagaaatagttcttgaatgaatgagtgagtgagtgagtgaaagaacaagagaataaatgaagatgctgtccg

SEQ ID NO: 14984 - DNA, 971 bp, Homo sapiens
  misc_feature (1)...(971): n = A,T,C or G
ggtgtgagtggtggannnncccccccccacacangttttgggcacgaacccgaaaatgccctgctagcttaggaaacaaacccggggcctatccagtgtttttgcgggggctatagagccccctcaactaaagggcggccgccgcccgggtttttaagacaggcagggtttaacttgctgccaaggggggcgttttatttacacccctcccgacacgggttcttttatattcaatcaaccacaggtgagaaagccccctccttttaaagggtacttttttctatgggcggtgtgggtggggggagtcgaacccttaaaacacatttgtttttcgtgcctcctcacaaaagttgggaataaacgggcacctcccccgcggcgggggaggcgggaaaagaaatttatataaaaccctctctgagaaggatagggttaaccccctaagctctttttccccctgggctaaagggccgccggggtaggggggggaccaccgcacacccaccctttttttttgtggatataggccccaacacccccccgccgcttttttttctggagagaagggagaacagggttatatttttctaaaaagggcctttgttttccctccgagggggttatttttttcgcccgaaaaaaaatacccctcctgtggagaaaagaggagctcttgaaaaaagaaacacccccggggggattttccccagggaacaaaaagacagggggggggaggggggcctaatccccaaaaaagagggtgttatcttgttgtttctttttctggcgccaaccccaactgggagaaaagaactggggcgccccctcaccctgcgagggcgggttgatcaatattatttctccccccccgcccccgggtgcgaataacacacgcttcccgcctaaagtttttataattaccccccgctttccataaaaatacaaaaatggggtttacggggattagaaaa

SEQ ID NO: 14985 - DNA, 931 bp, Homo sapiens
  misc_feature (1)...(931): n = A,T,C or G
ataattgtttattgagtnnnnnnncttnnnnnnnnccgcngngtgctccggcaaaaatcgccttaaatttgctcttaactgccttcgggattataaaccggggcttatccagtgatttttcggggcttataggctaaccctacctaaagggcacccgccgtctctgtgtttttataacaaaagggttaacctttcttcgtgcgatttatcatgaggcaccgtactgagccccccttatgcttgctgtattcccctcggggcaggaagggggctcttttttcgcggggggtactctgaaagagattccttcctaaggggagccggcggaatgtcctttccaagaataacacgaacctttgcatcttgggtcttggaggccttcctcccttgaaccaatggctgaatgtgtgtttctcgggggaaaaaaatgacccccccttttggtatccccatttttccccttttatggagcaaggggtcatgggcttttttcccccaaaagctcctgtgccctcgggcttataattggggagaaggggggttatccgagggcgcgccactttttgtttcccccaactcaacattcctgctcccttgaccaggggggaaccccccccaaccaccgcacctttcaagttttttttttattaattgtaaggagatttatgccggtcccctttttaaaaaaaacttctttcatcaaccctctggaagaaaaaaggcctttttttgcccccgggggggcaaaaaactcttaatgggggtgcgtttgtaggcggcgtttattaaagaacgggggggggtgggccattttgttaaaacacacgccgcggcggccttttgtgggggggttagttttgtcaaaaattctttttcccgcctgttttagggccaggtattatttacagcggtggctttttccaattactga

SEQ ID NO: 14986 - DNA, 478 bp, Homo sapiens
  misc_feature (1)...(478): n = A,T,C or G
gggtagataacagaangggnnnacacacnnnnnnnnnacaagggttctcgggacacaaaaagcncgtaaaaatttgagctttgctacatgcctatggcgagatatataacacgccgggtcatactccagtggatttgttctgggcgcatatgagagctcaactccctcacgtaaaaacgggcgcaccgcgcccgccatcgggacgtcttttaaccacagacgacttataatgaacattaacactggcgaatgcccttcttatttagttatacaccacgtgttcagtggggccctgctttccccagtgcgtggcacaataacttcctgagcactggaggagggccatactctttcttttgccccggaggtgctcgtgtgtaattaccaccagaggcacaccagctctacgcgcgttccgagagaaaaacactaaaaaaaaacgccccccccggatggggcgcaccacataaaatggccc

SEQ ID NO: 14987 - DNA, 933 bp, Homo sapiens
  misc_feature (1)...(933): n = A,T,C or G
gcggagactaaaaacgacgcaaacaccannnnnnnnnccggtttttgggaaaacaaaaccnnnaaaatttggggtgggtgttgttctcttggtatctttgcgctatctcaaattacccgtaaacccggccgggtgtggtttcctcatatttaggaagccccaaaataaccggatatagaccgacggttttttttttctatgacttttaagagggcccaaaataaactcctttaccaacgcagacttatgcccccccttttgtgtaaaatgggctaaaaaaaaaacccctttttttaaatcagattagacccccccctatttatgcaagtgaaaaaaaaaaaagggctttatttcagatttactcaccatcctcctttaagggtgattaaaaaaaaataaccttttaaaaaattttcccccccttaaacctggggggctttgaagaataaaaatattatattaaaataagccccacatttttaaccattttctcagaaaaatataaaaaataaaatgtataacacctcccctttcttcaacttggggaaaaggctatttataaaaaatttacaacaccccctcttctcaataaaaggttggaaatatgtctttaaacaaatttttacaaaccccccaacaaaagtgagaagagcacgggagtttaacaccttattctaccacaaaccggaacacttctttaaagcggcgccttgttttttgtgtattattattaaatagtctccgggctttaccggtgatctgcaacaaaaaattatccctataaccaaacaaaataaagtaataatacaataagacttttttttatcccccctgagatgggggaatgttctccacatattattttttaacaaactcggtgtggtgtattgtttataaaaaaaagttctccttttttgggtgttgaatcttaaa

SEQ ID NO: 14988 - DNA, 938 bp, Homo sapiens
  misc_feature (1)...(938): n = A,T,C or G
ctatagatcacggcggccnnnnnnnnnnnnnnnccaccgttttatgcgcacaaaaaaaccctcaaaattttgctttgtatgcttcgcggatcctgagcccgggccaaccccggaattctccagggccctagggcacccacaactaaagggccccccccaatgcggggtttatcacaaggccttattatttagggtggccgggttcttttttaaacccccgttataaaaaagccccctccagggaggttaatttttgggaggggggggggccctataatcgtgggggggcggggggggggggaaacccggaaacaacccatgtgggggaaatgggccgcagaggggggcccccccttgccaaatgggaaaatattgtgggcccacccccacccgagaaaatgccaaaggggggtggctccccctttttccccgggggcccaagttttactctcgcggggctttgtttacggggggggccaagggggggggggccccccaaaatcaagacagcggggccaccttcccgagagtccccttggcgggggagaaaaccctcccccccccggggaggcccccagcccacacccccgtcgagagaaagaccacctccccccccctactgtggttgtccaacggggggccccactccaagacaaaaaaatgcgtggtggtgagtttgccgccaagataaataattgcttctagaattcgaaaggcacttgtaacaccctcctatgggttgagtttactttttctctatcccaagagtgtatgtgatttatctacaaagaaagggagacaccctcttctaaggtatcccccgtggaggaatccccccatgttatggtaagccccccgggggggccgacacagaaaactcgtgtggttaggggacgcccgcaaagaagaaagcaacaacagtcgtgggggtgtacggg

SEQ ID NO: 14989 - DNA, 1308 bp, Homo sapiens
  misc_feature (1)...(1308): n = A,T,C or G
tgggttgtgtataatagaatcacacgncannnnnnacccaaaannnnnnannnnaaaaaagaggnnttttnnttgtgcgactaaactnannacngcggtnnaaaaaattttacaggggggntacgtgcgtcgtcgtatgtcgctcactagtaatctatctagacagcgcatgggtctactatccacatgctagtatgttatatcctgcgcgcatcccgagaggctcttatcctcctacatgtaaaaagtgggaatagcaccgcgccgctcatcctggcgtgtattaagtatagcacaacgagatcctctctgagagctatgttaggcctgtcgcnntagaatntacattctatcacatataaacaccacaccgctgttttnacgagtagtacacaagaggcgtcgtatgagaggtcgtctatggtttcatctcactacgagagngaccatctctactcttaacgctactgtgctttctattaagaaggcacgggaaactntgtgcgacaggactctctccggatggcgcgcctcttctcgtgtaaacagatgtggcgcgactcctccttctctattatgcgggaatagcctctgataccactttgtgctagttccgcggggagggcgccttttttaaaacactcttactctccactagggaggtgggagtacatcatgtgggacttccacacataaaaatattctcgtggggccaaaagggggtttttgtgtgctcctctcctttgggaggcgcgctctcttaatttagggggacaaaaagggaggaactgggcgcccttccccctgccacacaaactgttggcctccgtttagagcgcaaaaattaaaacttttttntagccccaaaatggcaattcttctcaaaaaagggtgtgaaaggggggcggcgcgcacaaagaaagagatcaattacggggggggaaaaatcctcccgggtgttgtttttcccttcccggcgcaagaggctccccaccacaatgttggtcgtgcggtgggcgaaaggggaatcatcccccggcccacctttttttattttttattttttcttgaggcggccctcgtttttttttacaaaaaattggtttttctcttaggaacgggggctgaaataaaccctcaacacactaaaatattccgcttttttggggtcggcccccgtttcttgtttctccgcttcctttgaaattgtgtggcgggaagggcggaattaagagaacttcccccctccccctccctcctgtgggttccgtctcatgaggtaacagaaagattgaaaagaggccggcg

SEQ ID NO: 14990 - DNA, 769 bp, Homo sapiens
atcaaggctgaagtagcatctccactcgggacatgcatttcccatggcagagagaacacagcaatggcaggaccacgcgatggtccttctgttcacagtggccacaccttccattggtaaagcaagatccatggcctggccagagggtagtgtagaagcctcaacctcctgcagtgtgagacactgcaaattccaagcaaaatcccagtgggcaaaggtcttctgatctccttcctggaggcagccaataatcggggacagaggacagcctggcacatctcactcaacaactgtgtgctccttagggcaagattgagactgcgtttcctcatcatcgaatcctacaggatgtgtgaatgggtggcaggcaaaggaaagaaaatcatggaggatgaattccaagttttgtatccactgaggacaggggcccagcccaggtcgtcaggggtgaggaagggaacacacggggacagctacactaatttgtggtctcctggcagccgccatatagacctgaagaaaactggggttctggaaggaaaggggcagagagaaacagtgaagagatgaagtagccaccactgcaccagcacgttctgagctttttgctcagagcatcccatagcacttgttatcccttgtctggctaatgtgtgcaagctccctttcctcccttgactttgggctttccttctatttttgtctgataaattatccaaaactttctgcgttgttgactgacccattccttttaggaatgtattggact

SEQ ID NO: 14991 - DNA, 920 bp, Homo sapiens
  misc_feature (1)...(920): n = A,T,C or G
ataaaaacgaaanagccaacaaannncnngttctggcaacaagccgaaattactgcgggctttcgagtttggggggctacagggttgtcgggccagggcttccaatagggggcgcgacggctttcaaaggtgggaactctagtttcttgacaaaccgcgtaacctgcaccatatgtaaactgggccgatattgggcaaaaatttttacacgccgggagcgggccccgctgggagtgggttttggtgagaggtttttggagggggcgtggggaaaatacacctcccacgcgcctgctgaggagggtcaggctaggtgtgattgtcctggcgtcccctaaaaatccggggaaaaactccccgaggtgggcccccttttgtgttcgcaaagacaaaatggtcgaaggtaagaaaaatatagacgaggctgggtggctttgaaagaggggcgttccccacaagggaagtgaagttagcctgtgggggcctcaacatggccccccccccgcccccggagttgggggcagagcgagaagggggaggagcaatttttggacatccccaatctcatgatccacccccgcttggggaagcacaatgctattatgtacacggtggaggcgccaaggaaacatcccccgccaagtctccttttataagcaataggggaacacgtcgggctagcttcctatatggataatgagtaaataaattactccctctccgaaccgaaaacgggcggttcgtgtgtatgtgtagatcgacaaacattcgcgtctcctattatggcggcgggtgagtaggagaacaattctttgtttggtgccatagccgccgagttttaaattgagttgagcgttcccgcgaggcgcatcaaaaggagaagagcaatttaaacacaatgctgagaggggggtttgtgt

SEQ ID NO: 14992 - DNA, 1142 bp, Homo sapiens
  misc_feature (1)...(1142): n = A,T,C or G
ccttccccactatccttaataaaaccgacgcaagaagaggggtcgctgggcatacagaccccccntagaattttttttgataaatactttgtgtgtaaataatacaaacgggatctttccagcaattttttgggggttagaaatctaccctcgagaatgtggtccgccccaaccgtttttatacaatgaggccaggacagtttgcttctttgacagtagaaattaaaacccccttatcttgtaaaaaacctaacgcccccggtacctacaaagttctcagaaaatgcccctttttattactaaggggttcccaaaaaagatctctctacctcaaaaacctctcctagttttccttctagggtgaagttctatccccccagagactctgtggggcttacctctcttaccttccatagacaaccttaaatccctctggccctcttattaaataaaaaaagaggttatcagtcccgtttatcactcttttagcgttgggaggagtgtccctctcatgccctccacaaatatcacccgcgtttccccccatcacaagcgtctttcgttctcccacggaggcgtttttatatacaacagtccttaagtgagcgtcattcaccccacttttgctccacaaattaacttctttaaacacccaccgctnncacccgcttgttgtgtttttttttgttatccgtatatctcatcacactgatactacacactaacacctctnacctcacagctacgtggtctataagaagcgagggttcatctccatactctcctccccccacgcaccgcatgacgaacaanttcaagcagagataaactatcgtcacatccacctttcaactttaacgtatcattcttatagaaataccccccccattcaacaaatttattcctctattactctttcaacaatacacacatataatctgtaaccctctcccacgaatactcccgctaaccataattttaattatctaacacaatatagaatgaactcagtcccattcactcgctcagatacacatatgtactattcgtctacagaagacagctcgctactaatatatgatctcatnctcccagattctactcccgcccaacgctctcttntttacagatcttacgtttct

SEQ ID NO: 14993 - DNA, 1137 bp, Homo sapiens
  misc_feature (1)...(1137): n = A,T,C or G
gatcataacctcactacacgcacccgaccggggtcttgtcactacgccgacattgancgacgaacgatgggaaaacaaaccacgagccatccagtgatttatctaggcctctaaagcctacccgaataaatggcagcacgcccagccattttacacaacaattccttatgttagacatgaattaacattctttagtgtcatcacccgagtgcggtgatcccttcctaccaccatggcagtctgatatacagcaaacatgaaaggacgtcacattttttccacgcgtgttttgcaaaaccctacgtcgaatatatgcgacaactttacgctaccgtccataggatctttgtgaagcatattattcctcctacaccgtcgctaaaagagaagcgccccccgcagatcatggattctccgcagcgtttctctccaccgactcgtacctattatatcaacagacgccgccggcgaaacccttattgaagtagctaaaccacgcgcatgacgtaatgtgcacgccagtaaacaatgagtggatatgtgtgttttacgcactaacccatttagctcgcccagaacgctgctttcttcgcacgcatcaacccaataatattaatttttaggtcaagccattctccccagccgcggaaacacgtccgatcagtgaagtactccaatccggtagaaacggaggagagacacacccctcacccgatcctatcatatgtagtttccttatcccgacataatgtctcattccagtcgtctgccgttatagccactgtcgggatcaacngttgcagagtatgtaaatagtgtgagctttcactctcttattcatttttcttantcctatcacacatacaccacccaccacacaacagagttccgcgntggaatggatatcaatcatgtatgtggaggagtgtggtgtgtctctccacgccgatgtctacactcgtatgtcgtatgtggtacatatcaatatataataataggaccgaggacgaagaatcacgtcaatagcagtnatacatccagntccctattcacaccgacacacacaatgtgtccgatgttatcgcgagccttcagtgtcacctcacatcatactcgtatgcatacctttgtgagatt

SEQ ID NO: 14994 - DNA, 598 bp, Homo sapiens
actgactacaggaagcagcaattcagtccgacaaataagaatctattcttgagcatcaaatatgggaatactgtgcttggtggaagttcaaggaatgaatatatcaaaagtcacgtcctgcaggaagtcacaaccaacacggagaataaactgttaaactgaaaatgatccttgtatgaatcaaagatgatggtacacttgattttcattgtcttttttatggaactccttctcaaatgttcagatttacttaatcttgacaatttatctctttgctggctgaggtaaaaagagcaacaggcagtataggtcgtcaggagaccctgaaaagggatgagtgtgtgtgtttgtatgtgtgtgtttgtctgtgtgtgtctgtgtgtgcgtgattataaatagtacacactgtagaagcctccacattcagtccacactgccctcttctcaaccttaacgccaactgctcacaagtccatgcgctgcaaattctccatgaatctccaggttctcattagaaagtgcactttcaaactgctttatctttactcataacagtttcctcttctggaatgtctccctcctccaaaagcccaatatc

SEQ ID NO: 14995 - DNA, 1322 bp, Homo sapiens
  misc_feature (1)...(1322): n = A,T,C or G
aggaggagcagaaacaacagttacacacaacggcnanncgcccggctccttggggaaaccanaccgncgaaaaattggagtcggtggtaatggtatcctggagaatttgaggagaatgcctatagagccggtgtttaaccaggcgcgggtgagggcgccatcggagaataaagggcgacgcgtgcctggatcggtgtgtaaaaagccgagcgatctgtttggacattcacatgcgctctggcctcatatcatagactaacccctcaatcttctacctcactcttctaaacaagttccctcttaccagactacaacatttattacaaggaagaaattcatatctttatattttaacgggtgtggttgttgaccacgacaattgtgtggtggtccactcccttgaatgaacccaacttacttttagaaggaggcgcgtcaattctctccgcccacccacaccgcactgaccttcatggtgtacaacaaccacgtctgtggacgctctctccagggtagccggtaatcactttctctgacgacagttcggaagattgcaccctcacgctcctntttagtatctccactatatctctctatccgtattcccttagaatacagagtatgtaactatgtcatacaacaatgtaatctactgtcgaccctcgcncaagtccgatgagagacgtcgctatgactacacatacaacacgcgatccgagtaacacacatctcctctcctgtcgcccgcgtcatgcgacgtantantcgtgttatttncgtgtcaccgccacgctgcagagaggaattccagcctctatagcggaccgtccgcgcgctatcagagtcatatgtacgacaacgcactcttgttctccacgacgagtatacataacggccacggtatgatttgctgcgagagatacacacaggagagtggagattcatgtgtagcaccatcatcacacagagtcgagtgcttcgcgccaccacgcactcatccacaccacacactcattctgagcagctcgtgatgtgtgcagctgcatctacctctcgactcccacttcaatagtaanacctctctgnttgtttgtaatggtcgncgctttatcgtgcgcagctcaatttctatgcgttgtatcgcgcacgcattactcgtgacgcacacgtcgaccgactctactccctcaagatagacgtgagtagatagagctgcagagctatccgatagcatgtattatagattgagcacgtcgtcgtcctgcgtccgccgttcgctcgcggcgcgtgtacccatcgtcatcattcgtgtaatgtgttgt

SEQ ID NO: 14996 - DNA, 666 bp, Homo sapiens
tggctttgaggatgcccctcggggctactcatttccccgactactactgaagtaaaggctgttttctcccagatttatcggccatttggatgtcattattgtgagaagtgattccgctgctgcccacctcgcatttattcttggctggacccgcttgccgcatctgcgaggacgaagcaccatagaccaggtgtttgcacaacggaatctcttctctcccagctctggaggctggaagtccgagatcaagatgaagtcttactctgccgcccaggctggagtgcaatggcatgaccttggctcactgcaaccttcgcttcccgggttcaagcgattctcttgcctcagcctcccaagtagctgccaagtagcacctgccatcatgcccggctaatttttgtatttttagtagagatggggtttcaccatgttggccacgttggtcttgaactcctgacctcaggtgatcccgctcaccttggcctcccaaagtgcctgggattacaggcatgagccaccacacccggccaaaaaaccctattttcaaataagtgcagattctgaggctctgggtagagatggatttggcagggacacaattcaaacacactacaataagtgatgtcatcaaggtagagaaacagaaaaataaaaagagatcggcag

SEQ ID NO: 14997 - DNA, 843 bp, Homo sapiens
gagtacatgtggcggcaaaaaaagaccgttgtagaatggaaagtgggaggtagaacaaaaggggatcttcgcgatatcccaattcgaaggaaggaacccggctttaaaggggtggttcacctttgaattattttaccagcagtggttgttcaagttcggtcaacatgttttcattaaactgcctgccccgttcttgagataatgttccgagttccctctcatgtgttgttaccaatgacgcatcccttatgattagatgggtgttattgtcggcagcctggcgctgatttgtcagctccatgggaacaaagactctgtggggcttgatatcagccgtatccccagtgcatagaacagtgcctggcacctcctaggcagtcaatgaatagttgtggaatgaatgcagatgagtgaatccgtgaaattgcttctcttttttgcctaccctgattcctcccttaaaaagtcgtattcttacagagcaatgttatcactatagtcacctaacactctgctgtcggaaaaggccagcggcagctggaaaagctaaaattaaaatttaaaaattcattagcatggatgagtgtgcaatgatggggaatgcttagaccctggttgagggagggagcctaaaacctaaagggcttctctgaaaagaagctctgcctccccacaagcttgccagcagtagatggtgtccacgttttagaattctggcgatctgatgggtgagacattgtattttaaggcagttaaaaaaactgtattgaggtataattcatatataataatcacgatgcggcaaggcgcccgcgggatgtggggttgatcatcctacaaaac

SEQ ID NO: 14998 - DNA, 965 bp, Homo sapiens
  misc_feature (1)...(965): n = A,T,C or G
tagttatgagcgggacgntcaaacaacaaaaacaacgcttcttgcggaaacnaacgcccaaaaatttaccttaggatgccttcgggaatctcgacgtggctctatccaggtgattttaaccgggcataggggtgcttcacagttaaaggggaacgcccgacacggcttttatcacacagaaggggtgacttgagtttgatttaggccttttattaaaccacaaggtacacggacctgctttttttgttcatttcggttaaatcggttaaaataaggccttttttttttaggggggcgcaccatatgatcactaaataggagccctatacacatgttttattgggttcggtcgagggtcaccccttataattttaaccatgttgcgaagaaaacaatcgttctaaatgcatcgggcgggggtgcttaacccacgcttgactgttataaaaacccaacacacccttgaaggggaagggggttgtttctggggggaccccgaaatatacgcggaattatagttcttgcgtgctaccggcgggcacaaaatccttaaataattagaatacatatggcttttggccaaacccttccatttatatctctctataacttggcacccccctaggtcgggataatacacagcaacagaataaatatatctcccacggtgtcccctcattaggcggcatcataggatatgagggggagagtttatttttgtgttagcaacatcttggggaagttttaataagaatgtgtcgcccgcgtgcgcgaagtactattgtatcctcctaaattatgtcggagtaaggataccccccccatgactcgcgtgttattaaaaattccgccttaagatcatcacacccatactcactattatttctaggagttctaccttaaacatagacgattacgcactaataacaatctatggccccttactcgaacgaggggtagtttag

SEQ ID NO: 14999 - DNA, 1259 bp, Homo sapiens
  misc_feature (1)...(1259): n = A,T,C or G
tagatgtatcttagaagacgccaatcaccacgcgcaagcaccagcgctccattgggaaaacaaaagcccgaaaatgttcagcggataggacagcgctgcgaaaatacatagagcaggatggtcgataccgcggggtattggtcgacgggtgatttatacaggtcatctccctacattacaatggcgcctagcgagcgagataccgggcnttattcttacaacaaatatgacggcacagatcttgagtcgacgcggggtcgcgattcctacaaatataacgccaacggtgtgccgagggcgcgatacacttattgtgtgtagtcttaaacacctgccctccactcgctaggaagataaatacttgattgatatttttgaggggactttagacgcagctcgtacgcaggtgtagaagagagaatggaaagttggtacaatggctggtgcttttatagatacacgtgcgacgtcttgtatgtccttcgatgggaggcaagcactccgacctccaccaggttgcgggggggatagcacggattatgtcgcggataagcgtgggtgggtacgaccaatcatattgcttcatgntatatgctgcgtcgtccacacggggctgattgtcgcgggccgtatgctcacttcgcattgttaaagagcaaaatagcgcctcctctaggcgcactaaaaaatacctcttccgtgtgaccncttcgttctccgactgtatacatattcgctagtgatgtatgtccttccgaccgcaaccacaccatattattgtgtaagagtcggtggacgcgcgggtgtatgtaatatagagtgggccagtcaataggctccattctgctttaattttgcagagcaaggagctcgcgggcgccgnccacctcccgactctaccttcgcgaaggcatagaataggagtgtgctctcagtcctactattcacgtgaggatgagtatatattatgtctcgctgatcattagacatcccattatgtctgccggtgttctgttgttattcttcgtctctctcgcttaatacaatatcaagagtgagagtgatactcgcccttgatgcccgcgtagagcgaaggatatggaagcgctcagcggcgagtttgtgtattatattcagcatgattgcgcgcgttccacacgcgctagtgagctctatcctccagtgttgtcgagttgaatgacatagctagcatgagctgtggtcagcgcacacccgcgtatgatctaggcatatttatt

SEQ ID NO: 15000 - DNA, 935 bp, Homo sapiens
cgcaccacaagccacctaaaaaacaggcgccccccgcgcttatgggcaagaacccgcgaatttggcggggggattttcccgtgtctttggggattctccaaaaatcccttttaacacgcgcggggggtttcccctcgcctttgggggccatcccaaaaggcgggaagacgcgggggtggtttttttttcttgttttgagtggttctccacaaccggagcttccccccccctccctttttactttctctaggagagcagcaatcaaaacattttttttgagcggttcccccaccctaataaatctgaaagagtactacaccacgcatatttcatatttagtagagtccatcaaactatagccaccaaaaagttaaagtttctttgattcagtcatacagacgccggtgtcgtctccccagtgccgcacagcgtggccacagtgccacatacatttacgcgctattcccccacaccagtgtacagtccacacagatggaacaccgccacaccggcctgaccatacacaccacaatcacgtagctcagataataacgcgtccacgaggacggtataagttaaaggatcccagaaccggtaaccattgcacagtcctcccctatagggtatagttcgaggatggacgtaacaccctcagcaacccagagaagtccacatacgattatgttagttgatattagcctcctcagttggcacgcagactactgcacccccacaacagccaggtcgacctatctgcatctcactatacacatcctttctatccttacctccgtgagccagcctcttcttctggatcccgcacttcatcccgcgtcccagtcacgcactacagcgtatacggcgaaagtactaacagcgcgaagtaagagttattatacgtgatctgcatcctgcagagtcacagtgttagacgc

SEQ ID NO: 15001 - DNA, 856 bp, Homo sapiens
ggcggtcaaaagtgaaaaccaggcgagggggtatgggaacagacccgaaaatactcaataaacttacggataaaaacctcgcaatcccgaattaaacgccttaagccacccacctaatgggccccccaagagcgtaacagaagagagtaatgtgattcaccagcacttcaaataagacaagcacgagagacctgattctgtactttaccacaacaccagggaaagtgaaattttttaaggggggtaggaaaaacagtcaacgaaacgaaattgaggacccaaggaactcttcacccgcatagccctcccacaaaaatatctgagctctatcactttcctcgataccccgtctaaaatccttgagccattgccatcgctccacattcgccaagcttacgcctccctacaattcctcttttgcgccgcacaccgtatgggctctcctctcaaattcttcctctgacacctccacgaccccccctctttctccctggatctatttgtcccaccctccccccgcctatattagtactttgtagttttacttataagcgccataagagtagagacattgtaatacgttcgagtgtgggcctctaccgcctccacaaagcggcacatttgtaatgacaagaagttcactattatgatttgcccgagagtgtggaccgcccgagggacaagcgcgcgattggtttaccacatcgatacaataaatattgcggacggtaggtcgttatttattttgataatgatatctcaacgtccctattccaaaaaagaataaattgtcacactagagacattaaattggtgtttacatcattacacaacattcgcattgaggtagtatttt

SEQ ID NO: 15002 - DNA, 771 bp, Homo sapiens
atttttacaaccatgttggtagagcaacacaataaggaggatgagaaggaggaaggagagaaggaggaggaggaagaagagatgaaaagtcacacctaagtcgtctatgagcgagcgcacttccagatgactccagcctcggccactgactgcaagcccatcagaaaccctgagatccacctagcggagcccagtctatccctacactacatatgaatacgcaaatgcaacaccagagagaaaggcctttacagagacttgccctagatgacctgcatgctgccgagagatgcctgtggccagatgtgaggcaccgtcactgccttttttttgtaaaatgcccgatttctacagctatgaagccaaaggtacagtgggccttttgagcacctctaaaaggtcatgttttctgtccgctcctgaatgtccttaaagtcttggtaccaagcatcacattatcctttcgttgtatcctgtgctgagtttgagcttcaggagtgcagaaatgagatgatgagtcattcccccccaacccccgtcccccgaagtttctatgcaggtggtagtgatgatggggacgacggtgatgataaaacatcttaacccttccaaatggactacaaggatcaatggcattttttcacatcttgggtttttggaagttcatcttctattatcttcccctacttccatgaagaccctcttgagcctcctcagacccaccaaggccttttcattttcagaattttataagaaccatcaccttgtccg

SEQ ID NO: 15003 - DNA, 850 bp, Homo sapiens
tatccccccccccgggcccccaagttaaaggggggaggaagagaggagccgttaaaataacatctaaccttccaaggatcaaaggacaacgcatttttcccatttggttcgaagttcatttcaatatctccccctcactccataatacctcctgggcttctcagacacgccaggcactctccattctcaggattttatagggactataccttggcctggcacctctttcattcctttgcctctttcaagacttagctcaaaggttgatgcctcagtgaggccttctccacccacactatggaagtacaactgttcctccccaactctatcctccttgatttctccatagcctttgccatcttcatgcacaaaaccagcacacattttacttattttcctctctttttccccccggaatataagctccttcagagtagggatttttgtctgtgtgtccactgctgtatcaccactacctacacatacagggtactcaataaatatttactgagtgaattcagatggcaatgaataattgctgctacaaataataagatagtgggaagaacaaggatgtgcctgttggaaggctggagtggggtttgcttccaggaggggctccttgtatgtacgtaagagagaggctgaccctgaggtcactgggggagctgtcctttgggcaccttagcttgtgtgcaaggctcatcctccgtacacccttcgcttcaccaaaattgagcctgtttctgacaacaatgtatcagaaccaggcttcccagcagtctacctactgtcacatacttggtaatacatttctttttattaatgaaataaacacatatcggccagg

SEQ ID NO: 15004 - DNA, 974 bp, Homo sapiens
  misc_feature (1)...(974): n = A,T,C or G
aacaacaaaatgggcacgctaaaaacacacacaacaaaaccgggttcctgggccaacgaacgcccgaaaagtcagccggggaaaacctaagggaaacgcagagggggcacatccagccatttagacgggcggtacggggtcaaccacagaataaggggcaccggcacacaggggcgttaaaccacaggaggcaatcaatactggcactcggtttggagagagtaaataaaaacaacagccagatgagggagagcctgaacccgggtcagtgcgcaaacactctgctaaagaggggggcactctttttttcgggggggtgggagctaaagttacccgagatagaatacccagttacggtgtcacgagtagaaacgacgacggcccccccccatgataggcacgcaacgcaaaaattaccgaaattatatttcggggcctattattccttttatggactgggggcgattgacttacctcaagggcgcacctctgagcccccgagtgcggtgacagaagtgcggagataaaaagataggaaaatcccgccacataaaatagccacgtgaccagaaataaggggggagaagataatataggtgttatgtggtggaatatatggaaatagaaatgtctaggtagacgagcactgtacactagttcataggagatagggggcctctacttaaatatactgccggcaaccacgcaagcaaaactcaaggggggggggggggtgcctaagcgcctggggagcaccctgccatatacgcnaccaaatcgcatggttgcggggggtatataggggggaaagaaaagtggaacccacaccaactaatgatcggctgatctatggtgagcgccggcgtgattcaacactgtcgtatcgctcgcaatgccaattcttttaataagattaaccgcggaggggcgaaccccggggtttggacgcccacgggcgcacacaagaaggtgtc

SEQ ID NO: 15005 - DNA, 891 bp, Homo sapiens
gcagcaaagtatgtcgcgacccaaataaaggccggtggaactaaacaggattcatagttgcgcggtacgccgtgtttaaaacagatcctttagggcgaaggtaaggtaagagctaaaaacacaccttggaaagctggctttaatcataatcaaacaatttatggacaggtcccggcccttggcgaagaggcttctgagcgttgtgatagttcattctctgataacatgggaccaccttgtctagtataacccgtccgtgccctcagcgtttacttaaccgtaagctagagctccattttctttaaatgcattgtatagagattgtaaaatgggggaaatgtgaaagtcacataaatttcagtacccccataatgattagcacaaagcgaaaaataaaaatggaaatcgcttagggcaaaacggcatcccacgctattcctttaaaaggtatctactaagataagaaaggtacatacctccctcacaatgtgtccttaaggacattccttacagacaaaggacagacagaactcaaagtcatccctctgctcactgagataaatgcatatctgattgcttcctttggaaaggctaatcagaaacttgaaagaatgcaagcgtttgtctcttatctacctatgacatggaagccccctccctactttgagttgtcctgcttttctggaccgaaccaatgtacaccttacatatattgattgatgtctcatgtctccctaaaatgcacaaaaccaagctgtgccccaaccaccttgggcacatgttgtcaggacctcctgaggctgtgtcacaggtgcatccttaaccctggcaaaataaattcgatgcggcagactaactttctatgtgtgattctgtcaatgctagacacaa

SEQ ID NO: 15006 - DNA, 851 bp, Homo sapiens
ccgctccggattatctggaatgcttctataaagagccactttgctcatctgcaagttggatagccagggatccaagagcaactctccttccagggcctgagtgccaaaaaggaaacaccacaggcttcccagtgatttgaagacttgcaaaggcccagtgtggtgacattgtgcctgcttcctcctacctgcacagggaaggctttctgcatggcactggcgtctgaaaataaacttttgaggagagaagctgctgaattgtttgaagatttctctgagttcaagcaggggaaaacaaaagaaagcaaaacaaaaagatcgtgattccctaacattctcgctgaacattgcaaacctctgggctcagaaacctatatcaatcctagtacaattttatggggttaaaagatgcctagttattttggaaaatcacgtgagatcatgttataattttaaccaaaggctagagccccaagttgtttgatcaaccccttggatggttctgggaattggtaagaactgcttggaattgcatctgccccttttataccctattgattgttacaaccccaacaactggaacaatgccccaattcaaatgagtgttttgcttaagaaaacgctacgcctcactttcgcaaggggaaaataaaacacgttgtggttaaatcgacagggaggatccagcctgaaaaatatcaatgtgaagatttttcattttaatgcagtaaccctgggaccaaccgtattggaccatacagaaacgggcttggaaattttgttctcattgaattggacaaccattgtccttattccctttataccaaatacgaattgttgactttacaacg

SEQ ID NO: 15007 - DNA, 773 bp, Homo sapiens
caaaccgtggggcggccagggttacgggacggcgggaaaagacccctccagagcggcgggctccgccgcgtcgcgtgcaggggcccgtgcccggccgccggccgcgccgcccgagaagcggggggcggaacgggaggcgccgtcggcggggggagcggatagagcaccggggggggccggggggagacacgcacctcacgggcccgggccgtcggcggcgcaacaggcggcggggcggcctcgcccctcacggagggcccagacgccgggcgcggcgtccgcaccgcgggcggagaagccgcacacccaaggggaggcggcaggcacaacccggcggggggcgcgcccggcgggcgccgcccacgcggggagcgggcacgcgcaccgccgcgccgcgttggggcgcgagggccggcccgagcccgcgggcgccagaaagccaaacggcggagagcgctaaaggcgatccgccagggccgcgggagggggggtgttttttcgcgcgccccgcagggctgcccccccccgcgggggagagccgggggcgggcgccgcggccctcccgcaggagggactggagaccacccggcgcgaacaacgtggacagaggagggggcagggacccaagcgaaagagaatgtttaagcccccccccaagaagggggaacaaggcatacacggacagacagagggggttttcttaacgaaagaaaatggtaggttgggaagctccccccgcgtcctctcactccgccgcgccgactcatcgcgcg

SEQ ID NO: 15008 - DNA, 1747 bp, Homo sapiens
  misc_feature (1)...(1747): n = A,T,C or G
tnctaccgctctactcgcacgctccgactccaacgcaattcagtgacgtgcagcggctggcgatcggcggtcgatatattatgttacatacgctatacgtcacagatgtacgtcgtgagcgctcacatcgcgcacccgtattccgagcggaatcgtcacgtatcgtcacagacancnagcgacgatctccggcgacgcgccagcgatacgcgtatncatgtgnactcagtacgagtatcggcagtgggtagcgcgtgagcggtcttgcagngccgnggcgcacgcgacgcactgtcacgtanctcancacggtcgcaangctgcgcgcgcgtcagcagcgcctgtgtctctccgntcgacgcgttgcgctcacntacgacgtcgatcgcgacatcctccagtccggacctaccgcgcgctctcgtgtatctacagtcgcgtcatgctgcacgctgacatgtgcnccatctctctcgagatcagcgtgcgtatcgtcgtccgacctctgcggtctacacgtccttacggaacntcaatcngccgntgacatanacacacgagccgcacggctgtgtgaacatgctgcnacgcgcgaggtagtccagcgagcgcggccctacatgcatcgatcctacatactcantacatacgcgagacgtcacngacgntgagtccatcgtcacgcancagctactactcgnccgtgacacgtcgtncaataganacgatacgtcaacatcgacgcggcgtcgagctacgcgccattcgattcaactacaggtcgcgcagtcacgcgtgacgtccaatcacagcgacgacacatcacactctctannanactagctggtacgatacatcgtgatgctattgcatcagtngcgctgncnttcgcaccacatagattgcacgcagacgtgcactgcgagcctcaacatacgtatcacacttcgcactcagtcacgctcctgacttgacgtggcgtcatcctttgctcgtatccgcatcaagctacactcactangnatgaccatgcgacgcggctctcataccggcgtgccgagcatcttaatcggatgtcgacgctctagncgagagtaagtcgtntanttgtagcacgtcacgtcactatgntgcctcgcgtatgcatgcgtcattgacgcntcatcagcacctgncgtcgtngngngtagcgcgtatatatgaatcatcacttgagtgcgagttanctccggctaacacgantacccgtaacactcacacgacacactaaangacgcggtcgcctgtcaacgcactatctacgtcancncgccagncactangcgcgctatcacatcacctgncgngcatgcgctacngcagngcagntncgagctgtctaccgatatctgtactctgtgatctagtcncgcgccgctgcctaagaagcgcgtctgntgcttcatcgtcgcgcgtcacgaaactattctacaatnactnatcagatatgcagatgaggtatctccgtcacgtgcggctgcacagcacacgcgcgctagagntngctggcggctcggtcatattanatcagcantaatagatcgtnacatcggcatctgaccaaggccacctacagctgtgncgcgacacgactatcatcggaggtatctacaggtctcagacacagtagcatctcgatatatagtaactcctgtccgccggccgtcgcagagacgtcatacacctcaccatctatcacatagccgcg

SEQ ID NO: 15009 - DNA, 860 bp, Homo sapiens
  misc_feature (1)...(860): n = A,T,C or G
agaggacaaaaacgagtagacacggggggggtggcttgtcgtaacgacccttnatttccaggctcacggctgccggaacaaatnaccacaaactgggcggtttaggataacagagattcattctctcacagttctggaggccagaagtctgaaatcaagatattacttataaatggaatcctgtagtccaaaaatgaacagtaacaatttttgggaggatatggagcaactggaatccttatacactgctggtgactttttttgtttggctccatccngacatgccatgggctatgatatatagcatatgtgacacctgactttcttcctaccatatcagggaagtttgcttcccccttgaagttggaagattgagtattctttattctggctgatctctgggcctaatgaaacagggagaaggaaggagagagctcatctagggcgacgttcgatcattcgttagattactgggcatctgattcttattttcggatctggtgaatatcccataccggggttcactacctatactgtgcgacctggacttaccaggaagaagggggcccctattgtcactcatctacccaatggggaggaaaccccgggggagtatggtgccggtaaaaaaggataaaccaccgcgtaacccggtgcatagggatggtggagcccactgcggcgccaaaacgtggcaccgaataacaaaggcgaggggaaggggaacacggggccggcagactcggtccccacaaaagaggggggagaggaaccccggctgaacaacaagggcccatcgacaggggggaggaaagggtgaagcttgtatactgtgcatcacttgtgacatggaaaataaa

SEQ ID NO: 15010 - DNA, 892 bp, Homo sapiens
  misc_feature (1)...(892): n = A,T,C or G
ctcccgccctccctctccggagtcctgataccgcgctcggccgcgccttgccagacgtaccctctcttcctctctcccgcgccctccgcgctcgccactcccctccactagccgccgtctactaagatcccatcaattggaacgggcgagcgcgctctcacactgcaacaccccacccctcccgcagaccccgaggcggcgcaaccgcccgctgctcctccggtcggcgccaccaccgtcccacacccggtacccgctcgcgctccgcactcctccacccagcagctcccccgtttgtgtggccacgctctgtatcctacataatagagcggctacggccggagccgcccccccacccctcgcacactcccggccgcccggatcgccccccccgcgcctccagcctggccccatacccccgcccccttcgccccgaaaacaaacacgactcccttttgtggcccccccccccccttttcccctttcccccacacctaaggttataagcgcccaaaacccattggggcccacgccccccatgacgggttctcccacacgggccccccccccccgctagttttgtgtattcacaggggggccccccccccccccctctaaaaaataatttttgcaacccctaaggcaaatttcttccctttgtaagcttgcgtttcctccaaccacaaaaccaggtttttaatagaaattgtatgtaaggaacctagcccaaggcttgatatagagtaagtttaaagcctccccccccttccctaaattaatgtcataggcccccccaaaaaacaaaaaaaaaaaggttaaaaaaaataaaaaacggcgcctggtgcgtttagcttttttttntttgttttttccatccttttgtttccgtcgc

SEQ ID NO: 15011 - DNA, 1106 bp, Homo sapiens
  misc_feature (1)...(1106): n = A,T,C or G
cattccccaatttcccagtataatcgttacccaaaccangccttcctggggacaacgcctgaaaagttacttagacgatgccttctgggatatatacaccacgggggcgtctatccacggcgatgtttattctgggcgcatcaagagagccgtatacactacattataagtggcatagacggcaccgccacggtgcagtttctgtacagcacactatgttctgnagatacttctacagtcttgcaacgagatatgttttctttaaataacacacacactctgtacgaccgtagtacgaacattgtccaaagattcgcgatttagagttccataaagtgggcaacaagggcagaaagacaccagcgtttttttttagcgcgcgcagtgggcgccagaggggggcgaatgccctcgcaagatagagttctataaacatcactcctctgtgcatgaaaacacaacgggggaaggattggggtgttataaaagcacttggaggggcccgagtcgaaaacagcacttgggggggccaccaggggtgggaatccctcccgggacccaagttttgatacgactaccttgtttttacgcccggagggaagaaacaagcctttttacctctccgtggggaagaacaaaagggttattaaaaacaagggcgcggccacagggtgagtacccaaggctggcattgatctatattctgtgatatacccagtcgataaatttaatttgtaaaatttccaggttggctctgcgcccctgcgaagagtgttcttgaataatactcccaagagtggtgccttattggccagggcgcgtgaaaataaaccgtggtctctcccgcgtgggagcgagtagagacggaagaagtctcatccactctcaggatgagggtggccgtgggcgcagcgtatatatttatgatgtcctcggtcggaggtacgcaacaaaggatgaggatacaaaactaacttccggcgcgtgcccgtttgtaatggagtagaatgcgataggacctaccctatattctcccatctcatccacgttctatgaatgtcgcgatgtgatccgtgacacactcatcgatgtttgccccgccgccc

SEQ ID NO: 15012 - DNA, 1682 bp, Homo sapiens
  misc_feature (1)...(1682): n = A,T,C or G
ccgcacggccggtcacgagcgcagcggccgtcacgcgcnccgagcgtcttnangtattttgagggttttattctttnctatatgatcancacgcagtgaaacacagttctctatctcgtgtccgtcaacacttccacgaggacacctatggaggcattctctcacctaaatccccattgtatatcactccacaccggaggggtgtggggggctcccacagaaatcaccaatactacgacctgttctgttgtacgctgagagcatacatagtagcaggcactatcgtcattttgtcgctaaggtgtgcccgctgacacgatgatatatcattatataatgtnctgatggcaacacatgcccgcgccgcgcgcgtctctgacatcacagcacacgtagacgatagacgagttccgtcgacacacatctactctatagctgacgattactcacgcatgcggcggcggggtggtatgatgcnatcctatcagctcatcagacgtagtctctgctaccaggataggtagtagtcccgactctacacatccgacgtatccgcgatgcgcatcagtgttgctacgtcgaccactgagtatctctacgcgaatatacgtccgtaattcttaatatattctactaatanaccgntgaatcacacatcaacgtatctcncanggacatagnacacatactacacataccacaatcgnactcnataccagcacgctgtctggtcatncatctcactacnaccgcgatgtactatgttcccgtgtagactgtattcgctagcgtctctgcgtcgcagctctctaagatatcgtctgagcgcgcagtatgtgatacacagacgncatatcattngtagtgantagacaatgatgtacattntantacagtcacatctctacgngncgagcgtgcgacatcgcgaggtatggctcatcgtactttcgngcgatggagcgatcactgatcaccatcgacgactatatagatatcagtcactcacactntctatatctntctgagtgactaccactcagcgagcacctcagccgattgctatatatatacatcanatgagaacgtatgcactcattcactcatcagtttncatgcatacgtgctcgaatagatcagtcatcgctgtacgcngaacgactagacagatactgacgntatnacacgacacgacncgtcantcgacgatgcacgatagcgacgcatgctctgagtcagtccgacgacgacactgagtcgatgcagcnacgagantgtgagatacatntgatcgtgagtgcgatgcgagcacagactgcgagaacagctgataagttaganagtatacaccgctacaatcacatgaangcatcanactgncnacgtcgtggagtatntcatganatacagnttagntcgactactgntacatgatgtgacaattngacgcacgtacgatgnatatatatctcatccggtccagcacgagacgtacgtcanangtcggctctacataangcacgtacgtgtnancactcagacataaanagagtctagaatcagcnacatatacctgcagtctctacgatctgaggcngngantcgcgccgagatgtagaagtgcgtgagatacncgtcgagcgacagcgagacactgcgtnantgagcgcacactaanngag

SEQ ID NO: 15013 - DNA, 464 bp, Homo sapiens
cctgactatgtttcagatagatgacctggctaaccgagactgtcggcataggatcggatccgcatgagattggttctgctccatataatccgactgacattcctgccatttattgctcttgtgaaacccttgtagacatcataccaagtaataattagcgcgacgtgctcacgattgctccaagcattcagcagatattctgatctgttggtccgtatcaagtcagatactgattccatcaatcaaagcaagtatcatggtccctggtggtctgtaaataatccagactctatttgcgaactgcatccgctgtgtgctcatactagaccatgaacatctctctatgggatatagctctgatgattcaaactgttactgtcctacttcacggaatatgcttctatgtgaccgtagaaacctgtaacatgtgataattagatatgagaatgaagaatccatctcga

SEQ ID NO: 15014 - DNA, 462 bp, Homo sapiens
aggaagatgtgctgcttcagctcaggcctgggggacatgacttttccaggaagcccagacatcatttccctggaatgcagcgtgccacttcaacttagcgatactagagagattgaaaaggaagaacagattgctgctgaaaaggcagaacaaagagaagttttggagagaatgcattacttatgttggcagatttactgcaactcaatctgagctcacagattcatctgaaagagtctgcatctattcagtattgatgaagaatgaagtgctcagacttttgctgaagacagatctatagctgtcaactgaccctggagtacagaactagggtgaatagaaaagaagtctcagtttgagatattataacaattatagcaatagtaatactgacaatatttatgaaataaacttagaatttagagttaattctcctccatgagaataataaatgaaactcga

SEQ ID NO: 15015 - DNA, 1045 bp, Homo sapiens
  misc_feature (1)...(1045): n = A,T,C or G
atttagggaggggtgttgggtaatggtggtattggggggaggggagggggtgaagagaagaaggtaagagtgggatgtgtggaaattgtgatgtattggagggtagtggagagggataggtgatggtaggggggggggagttgtaattgaatatcagttatgtggggggggtggagaaaggagggataaaagggagtggtgttgaggagggaagtgagtggggtgtggaaagaaagggggtgagtgaaggggttggtggggtgagagcatgggaagggggggtaggggggtggagggtggggagggtagagtagtagggtggggttaagggtgggaaataggataatgtttattatttgggttattgaggggtggtgggagagtgtggaaggaggaggaggtgtggagatgatgtaagagtgagttggtgggggtaaggagtggagtgtgatgaaaatgatgaggtgggggtggaggtgggaagaagtagggggaggggtaagaatagaggggaggatgatgaggatatggggggactaggaaaaggttaaggggtggagaatagttgagggttgtgaggggggatttagagagagggtgggtagagtttgagatnaagtatttttaaagagaattagttaattggtgttttttcaagggttgggtgagggaaatagggggggaattgtaggagagattttttttatgtgtggggaaagggtgagatgggagggttgaaactgtttagtgaaaagggaaggtttataaaaatgtttttaaaaaaagagggcgaggtttgatttaaaaaaaaaagggtttaaggtttaaaaattttggttttgagattggaaagggaggagggttgttaagatttgatttggagatttttgaagaataattttggtttttaaggggaggcttcccaatggggtggtggggtagtttttaagatataggggttgtggaagtgtttaattttataattaaaggaattgtatgggttaatttttttgggttgttgtatttttggggtgtggggggtggg

SEQ ID NO: 15016 - DNA, 823 bp, Homo sapiens
  misc_feature (1)...(823): n = A,T,C or G
agtgggagatggtatttgcggggagtaggagcccgatgtgttcgggggttttggaataggaggtttatttggtagagctgtaactttgggatttggagaaagtgttgacgattttagaggtagggccatgagggaagtttattaaggagtgtgaaagggttacttctgtgtatataaagttaccgtggtgggaagaggtggagtccaaaggaagaattagttggaagttttaagatcttaatgacttgcctgggtggggtttttgacttggagggggggttggggcccctttcattttggggaattttttcccatctgaaatgggaagaatttacccaagggctggtcccctcatggtattttgaaaggagccaattggatttggttgtaagggttataagtggaagggacttgttttggatgagactttggatttggactttttagttaatgttgaaatgagttaagacttggggggatgttgggaagtcaggattgtgtttgaaatgtgaagacatgacattttggagaggccagtggcagaattatatggtttggctgtgtgtcccccacctaaattttatcttttaattaaaatcccccatgtatnaagccccccccaatgatgacaggtgattggattatgggggccgttttcccccatgctgttctcattatagtgagtgagtcttatgagatctgatggttttaaaagtgggagtttttcntttggttgnanttnantttttttgnntgttttaatgtaggaccgcccntcccccnatttnanatgattgtaagtttcgtgaggcctcccaagcca

SEQ ID NO: 15017 - DNA, 847 bp, Homo sapiens
  misc_feature (1)...(847): n = A,T,C or G
cttactaggnggttgtgtcatgtggttaatctgtataggaaagngtgagaccatatagcaagaagacatggaggaaacacaatcaggngnngtacggaggcacatggnggggaggctgacgtnnagaagaagagcgnataggatcatatgcgantgaaagtatgattggtttgatgatgtagnggtttttatttatctattaattcatataatcgatgtngctgacattcgatgagggctcagtctgagacagctggtgcggtctgagttgggtctatgacggcagagacttcttacttctccgcnnnntactcttgcacatcatggacgtgnncaaagcttccgctggacngattatatctattataaagtattacgtgtgaaatctgattacaatctacatagctncaaccattacggaacataactagatganctgatacagtgatagttgcattagttttgatgaatatttgatctgggtgatcaagctgaatgcgtcgagcaactaggancgacgaaacacgcccaacaaacgcgggccctctcgtagggcttactgactttttgtgatcattggtcctctgtgacagtattaacataatacgggcggtatgtgacattgtgggatacgttgacattgtattggtttgactttaaattaataacaacagcaggggaacaaactgggactagatcatcatttgngcctttnnncccataactattaacgcaacataatataaccaaaaacatttacataggaaaattttagtatataaaggatagtcgtattcactctgattttaatattanttcacttgaaatataaagaaaaaaaaaaaaa

SEQ ID NO: 15018 - DNA, 791 bp, Homo sapiens
aatacttctgttgggttgaatgactctctgcccccaggtgcagatgctgagagcactttctagtcaagtcctgcatgttcatttctgtctcaagtcagcttctctgagaatccaatttataaaaatatatttgtgaatgtataagtaaagtgacttggattttgtctacgtacaaggacttctatgcctgcataaaacagtctgactggttggaagaggcccttttcccagcctttgtgaaagagatcttcatgtaaacagagtccctcttattggctgaagtgaagagtcattctgaggaggatctgaaaatgtagaggtgagacgctaatggcagagtggcctcagctttcaccaggttttgaaaacatctgtgagggaggcaccaaattcactgtcctgcagctttgacttcccaatcctcgttgcctcgtgctgccagcctgtatgctggtagaagtgtgttcctgggaacatcctggcatcttgtgttaggactacactggtgcatgggacagatcacgctcaagaaggtcgatgtaatttgaaaaacagatgggctctgctttgggaaaactccaagcataaagtctaacttgaataaaaggcatctcaagatgaaagttcctatttgggattatgaaaaaatgtcaagaacaagtccttggggttctagaccaagtcagaccaccgacctagctggaaaaatgccgaagcctgttatatggaaataaactggatccttcatgttatggctgtgggaaagaaagaacgggtctatttttagtatg

SEQ ID NO: 15019 - DNA, 177 bp, Homo sapiens
ccttctcgaggatattggagatattctgccctgcctgccacctctcacctcctctttcctggagcaggaggagtgacttacctgtttgctgggaaggggagaaattaacacccactgctccacgtgggaaagaaggatgtattaaattaaaggtctccattctcaaaaaaaaaaaaa

SEQ ID NO: 15020 - DNA, 852 bp, Homo sapiens
  misc_feature (1)...(852): n = A,T,C or G
aattttccggtgagggttttccagagcgccagcgaattctcggccgggaaacacgacatattcgcccctcaaaaggccccaatacttgggtgggccatagggtgcgagttcctcnaggggctttcggtggcgaagaaaggccaacggataccctttattaagaacgcctagaatgtccagccctttttatattctctgacccaccctttctttgggccagatattgaggcccaattccccttttggggttttggccctaaaggcccagggtccactgtggttcttatgttatgccccagtagatgcttttaaagggcggtaaaaataaacaggcgtggccgggaaagctaaagccattagaactttgaggcatcttccttgtaataaatacataatacatatgtgttagatagtttatttgaccttataaaaatgcaaggataattattattatttaatacttgtaaatatatttctttccattcagctatgcatatctctcattattttgtttaggaccttaactatgaagatagtaacaaatcaaaaaaccaaagcacctatatttctaggcgctatactaagcctccatacacattatttcactcaattccctcaaaaactctgtcatcttcctcattttacagatgaggaaagtaaagctgagagaagttaagaaacctcctcccaccaagatcacatactaagaaagtggtatggccaggatttgaagtccacctctaacatctgtgctcttagccacaacaccatactgccaaattcttcttcatacattcttcacacaaaaatgtgttccacgccattacncaataagcagagtatccgaccagc

SEQ ID NO: 15021 - DNA, 802 bp, Homo sapiens
ataaggcctttggaatgagcattcttctctgctgttctactacctgtgagagcatactctacctcgtatgtggcaccaacttatggtgttatctgctgcgacctactgtaactgccataaaccatagggctattggaggagacctcagctttggtatctaattcccctgcgactggtaggctacttatttgccgctctttcattgggccctttgctggcctttactctgctgactgaagtattttccctactctttcctatcaagacgtgcctctgtcatgcatattgggctccaaacttctcgcctttgaacaatgcagcggacaaagggctgtctgtcatcggctcgaaattgaaatcacttgatcccatcattattctcaacgcctgattgaccagtgggttggttgaatagaaccaacacacatgccttccctaaatgactcccttggcaccctaatctagacactgattgccactattgcctctaattgctccctttggggctaacgccgggggccagacgcttctgcgatgggaactctcggaggctagaccttttatgtggggggggatgacaataaaaagccctattcttacacttatccaattagcttttgtctgcggaagacccagaatcctttcatttttttaattctaacacaacaggacttaatccctcttgcattgtttttaccggaccaaaagtaaaataacattttaccctggttgaattgacaatttatggcttacgctctgagaacgtaaaagaaaacacaaacccttttgaatggaagcacat

SEQ ID NO: 15022 - DNA, 947 bp, Homo sapiens
  misc_feature (1)...(947): n = A,T,C or G
attnaagagggcgcgcgcgtctcccngcggtggaccgcggcgaaccgcgtcgggagaaatatgatcggtggatcgctcgccgacgaacggcctatttggcggcggctccgccggcacgctagcgggcaaatggttgcgttgcggtcgcgtcgctcatacacccgtgttcgtacatacgggcgagcagcgatgttcctcctcctctgttccgtcgctggacgtctttgtgcttccgcctgtctatcgcggttctcagagcaggcgagcgtttttgccgtcggcgggggccaagaagatcgcgataacagaggcgtcggcacaccaaaacggagggttctatttttttcgtcgcggggtcttcccagaaagagcgtctgacaattggtcacatattcagcgcctctgcggctttaagaggccctattcgatcgcgcgctgctgtgagaaacgccctccacacaattgtttttgggggagcggctgccggggtataaacaccgcgcgcgcggatacatccaacactctctttttttgtggacaagaggcgctttttcaaggtgataagtgggtcaaccaagcgaaagggtttttttgtccacacgggttttggccaatttagccgccagtgggttttttttattataactaacggttataaagaggaggttttttagtttttgttattttaagatggaaaaaagggaggggggggttttttgggtttttttttttggggaaacagcgcttttggggttttaaacccccccccctcgggtataaaggttccttaagggaggtgggggattacaagatccctctctggggagaagggggggaaataagggaaaaggcgcctcctcccaaaacgccaaaaggggctccccccttgagtttggttttcccagccccggggaagtggaggaattaattttccccccccctccccc

SEQ ID NO: 15023 - DNA, 805 bp, Homo sapiens
  misc_feature (1)...(805): n = A,T,C or G
tgtgtgggggtttcttcccgggtggtctcggttcctttgttctttgttgcggtgtctggggggggccttttccgtgtttcccggtcccggtttttgtgccctggggttttgtggttggccttttcggggggggccggggtggggtttgggggcggggtccgcctggggggcttttttttttccggtcttttctggggcctgttttttccggcttgacggggtggtgtttgggtccctttcgccccccgtctcgatggccccccggtgttttttgcggggcgcttggggtttctccccgggggggtttccggtggtttttttggccctgggggcctttcccggtttttttgtttccccgggggggggttttttccccccggttttgggctttggctgccgggccttttttttttctccccccctcccgggggggtttcggtttttccctccgggtgggggtcgggggggggtttttgggtccctggggcccccccctcctggtttttggcctttcccctgcctcggccaccccgggggttggggtttccggtgcccctggggggccggggcccttgggccgggccctcccccnttgcccnnntggggtttccccttgtttttggttttccccgcccccggggctgtgggggtttttttttttttttttttttccctttcccgntaaatcttttttttttttttnngtntntggggtttgttntnccctncgagnatngggtcggttngcggccaaggttttttttttttttttttcttttttgtctcccctggttcttgtgtgggc

SEQ ID NO: 15024 - DNA, 937 bp, Homo sapiens
  misc_feature (1)...(937): n = A,T,C or G
atttggaggggtggtgggtattgtggggaatgtggtggtgaggtggtgtggtgttagtgtgtgaagattgtggatggaatattatagtggaaaggagtgtagggtgaggagggtngggtggaatggggagggtagaagtatatgtggtagttaaggtataggagtgatatggggtgatagtgagttgtaaggcatgtgtgtgagatgtgttgtatgttgtgtattgttgtgtagagagggggggggatatgtgtgtaggaggttgtatggttgatggtgagtgtagtattggtgtttgagtgagtgtgtggtattagtaagggggggtgggttatggagtttggtgtgttgtgtttgtgttatgtatggattgaatgatgatgaaggtggagatggaggaatgttggtggtggggggaggaatgatgtatgtagaaaaaataagatgttaggggggcagggatgggaaaaatttagaggttggtatgttgttggtattatggggttttgatgggaattattaaagatgaggtattggaggattggtgagtgttatagaagatatttgtggatttaattgaaggattgttgtttgaggaatgagggaggaattttggtgagaagagaggtatatattattagtgtggggattgtgttaatagattgtgtnggaatggttgagggtgatggtgtgtggatgagaggtttttttttgtggggataaggtattggggggggggtgccccccctcgttgtggaaaaagagttgtttgtgagagagttgggggggtttgtgtttattatagggattaggtgttataggggaggtggttttataaagtgtgtgtttgtttgtgtggtagaagaagtgttggggggtttaggtgggttggggggaggaggaaggatttatttttaaaatagcacaaaacacaagg

SEQ ID NO: 15025 - DNA, 1020 bp, Homo sapiens
  misc_feature (1)...(1020): n = A,T,C or G
ggccgggggtgtctgggtgcgcgggcgtgctctggctggggtcgtttctttttgccggggcctcgctcgctctcgttcgtctgccctcgccccgctttgttccgttccttccttcgttccgtcccccgggtgcgtcttgcgcttgtgctttccgcgttgtgcgttccgggtctcggccgggttcgttttgccgcgcggcctgtctttgctgcggtcgccgtgtgtcttttcttcgggnttgctgcttcgtttgggcgcttatctctggcggcgcccgtccgcggagggttcctggtttgtggctggcggctggcctttcgttgcgtccgtgctggccctggcggtcgacgtctgtctggngcgttctcgtgtgtgcggcgtgctctggtgtgcgtggctgtgcgtcgcctcgggttccgccgcgtctggtgncgcgtctcgtgtcgtgctgtgttgatgtgtgcgggctcgtcgcggcgtgttgcttctccttctcgggtggtccttgcgcggcccgtgtctgtctggtggttgttgtgcgttggtggtgtttgtgcctttctctgtggggtcggggtaactcgtgtgtctgtgcgctgtgcgcgtcgcgccctcccgcttacggcctgtgtcggctgtggaccctcgtgcttgtnccggtgtctccggtttcggccttcgcggtcgcttacttctccttggttgtggtgttngtgtgttcccctctctcttctcatggagggaattgttgtggctccggtctgtgcngccgttcgttgtttttgtgtttgctttcccccctgtgttgtggggtggtgttttgttgtcgcccggtcgtttcttgtttttggtccctcggccctcgcggtgcgttggtgtttcgggtcactgtccaccgttggccggcggttgtgattactgcgttttccgcttttgttcacgaaacaaaataaataaagctaaatatataacaggaataatagaatgtaagaanagttaattacccctaattcaccggag

SEQ ID NO: 15026 - DNA, 876 bp, Homo sapiens
gtatgcgtgcaacgactctcttaattttccaccgctacacattgaggaaacttgaatatttttgtatcctgaatgtagaaatggatgaagaagaaatggatgaagaagaccgaagataatgatgaagggataatttggaataggattcacagcaagagagacagaagggaaagacattgaagaaacagactagttaacacatgaaaaaaatagagcagaggaaaacacgtccatgtttttccacgtctaatgagaacaggtctgatgtgaaaggaattggaggagaaggggaagtttggtgatgcacagtttgcatcccagaaggctcttgacaaccaaagtgtccactgcagatttcgtccagtctagatagaccatgcccagagaatttgaaagaaaagcagaatagatttccaaacctttaccctaatccaagggaggagaagaccggacatccaaatattagggttgggtatagaacattgggggcgcaaaaacctgaacaacgggtgaaatgaaggacaaatattatggggtcctaggagagggggcgggtggggactttgcttacaggaccctggaattctctcactccggcctggaaacgttgtatgggaaccacgaaatgcttttggaaaaaaaaatgaaactggggtgtccaacggtttgaaaattgtggaaaggctgtgatcttaaaactatttgggaggagggatggaagggattgcttgagagaagtctggaagtatccgcgcgggaggtgaaagaaggcgtgcgaacgcggatgaaattgcgtcgcgggaaggacatgtgtgggataacccgcgcggtgccgaggatgggtgtgtttcctaagcgcgcgagcgaggagtcgcg

SEQ ID NO: 15027 - DNA, 1369 bp, Homo sapiens
  misc_feature (1)...(1369): n = A,T,C or G
tactcggaaagacccgcttcttctcccaacacanaccgcggggttcttgggcaaacaacaccgcggacaaagtttgccgggtttttaaacccataggacacacaggagcactcggcgtccaggagtccacgtgtatcttccgtccgcgggcttattgatgtcctctgcctcctcgcagagaagggtgcaccaaccgcggaccgcggaaaacacaggacagcgcggatgtgtttccttgcgtttatatttggagggtcgacgctttatagggagcggcacccccccgcgggcgcgcgctcatatattttctccgtgtgtccagagcatgagacctcctcctctctaacgaggaggtgctcaacacacgctcttcttctattgaggggcggtatcaaaatcacttccggtgcggcagcgacctatgacgagggagtagacacactcaccgcgctcccgctgagagttgtgaaataccagcgctttgtgtcgccagacgtggcacagcaaagatacgatcagcctcaaccgcacttcaccgacgcgtggtggttatgtactattacaatatggtgactgtgtaccccgctcacacaccactatttttctggtatatggattgtcaggcggtacgcacctacttgtatgcgatgttcgtattcgactatgtgttggtgacaaacagcgaggtattagaccatcttatccttgtgtataataaaccgacacgccgatgacataatctataaaataaatactctgtcacgcgcctctatcatgcaacctcgcgaggagctacaatctaaaactacccctgcacagacaaacttgattgttgtactggagtattatcttccgtcgtgcagagttgtgtgcgttagccgcgatcataagcgctgatgacctcccgcagcaatagaatatcaccgctcgcagggcgaaacgacccacacgccttcaacacaccctcccacgcaagtatctgggaacgcgaaggccagaggtcgacatccacgtggtactctcgccgtccgtcacccgtccgccgagatttcgaagctccaagcgtcgacaccgcacttgcagaccgattgtttcctctaacgaagccgcgtggcgaccatttatacatctataaaacagatgcgnccttctcactcanatatcttcactgtagtccgatggttgngcgtgagctcgccacaacacagatctatagaagagactgcncggatgctcggtcgacgatcgcgacataagacgaaggccaccagtgctgtctaagatacctctgatcatctcgcctctctnctaccattcttctcatccgacaccacgtncctcgcgttctatatatcttatctattttaac

SEQ ID NO: 15028 - DNA, 900 bp, Homo sapiens
attatcatattcaccttatacccattaacccttccgaggggttccaggtatacaccgccttaaaagttactttataatgccctcgggattatcaacgggggcatatccagggatttttttgggcatcataggcctatcctcgttaaagggatacggcccgcatggtttatgtcacaaaagatttaaacttagatgcgcgaaaatttctcttttttgcgccgtttaagataccgggctcccctatgtgaatacctactcgatgcgggaggccctaccatatcttccctagggttctgataacaacaagcagacctaaccttaacctgttgcgaatttttccgaatagcttccctccccttgggagggtgcgattgcacttaattggttcgcggcttcttaaccccttcatttcacgttcaaacaattagtcccaggagtgttaaggcccataaaacacctccttttacatgggtggccgtcgttctatccccgggggggggggggtttgcgcaaaaaaccccaccccccaggttgagggagagcttcttgagagtagataccagggggggccccggggagcgcttctcacccataaaaggtcttataaacgaggttgcctcttcccttaaagcaaccacacatatgcaattgatcgtgccctatttaattatactgtggtaaacaaagggtgagacgccctgttttaattggagagtggattaaaaatgcctataatacgtggattgtcgatcgagcaattgttaacacggggcagctaaacatttcttacggaatgtgtatttgttccctgtgtaccaccgggaaatccttttattccccgtcgcccaaatgttacactaccgtattgttgattcattttgctctatattacaccactat

SEQ ID NO: 15029 - DNA, 173 bp, Homo sapiens
taagaacacttgggataatccgcggttggtggtccaacaatttttgtgcctaagaggccctccccaattttatgggtaggcaggcagagctttgacaacatcagtttttgaatttaaattccagttacttttttggattaacaaccgcgtccaggggcatgaatacaccggta

SEQ ID NO: 15030 - DNA, 1301 bp, Homo sapiens
  misc_feature (1)...(1301): n = A,T,C or G
gtgatctccaattttcccacgtgaggatgataagacgccaagtccatatccttccggcgccgagcaccgcggtgaagaatttaccgtgcggctatctctcgtggattacatcagttacgtgcgcgcgtcccacgatatatatcatgttccgccgcagacgaccgcgtcgttacgggccttaataccccccgtgtttttcctcccacaacgtcgtgcaatccgttaatgcccgcacagttttcccgcgctgattaagactcgtcgttatgatcgcgtcccttcagctatacaccgcaccgaataatgtgatcgagcgcaacgtatacagatcggttggtctataacataatcgtctagaggcggtggatgtaagagaagtactacacgaatagcacgtatcatcgagctaactaatgacagataattcatcatattagcgtgcagaaatcaggtgggacgaatgcctataatattatttttatttccacgcgagacgtgcgcccccgcgtgattgtgtgatttacacgccgctttaccgcacgtcattaaattcatctcctcattattatccntgcgtgtggaaaatccgacgcgacccaccattattttgattgataattattgtgtatgtttgcttgcgtataccactattcacatatacgtcccatatcgcatatatttgagattcatcacactaaagtagataggttgaccacaatgagcagtgattatgaccaagtgtatgttagtataagatacattatgtagaacatatagccgactatcaagtctctgcatctcctccgtggtgantggtngagtgagcacacggtataagacgccgcagcgcaccagcgacantagtcgcagtgtcgcgtgcagatggtcgcgatagtgctcgactgtcgacatcgaatgtcatcaacagctcacgcactagatgagatgttatacgacaatccgagtactgacaaagacgccatcgtgataagactatantgccgcactatggangcagatccaataacgtgatcatgagatcgcgatagttcaggactgngtntctanatcgcagacatgcgaggtatactcactacgattatagctactatcgctaacctaacgccggcgaggtatgtccgactcatatgcgatcagctcgcgccgcngaaggatccacacgtgattattcacgcagccacatcacgncacgacgcgtgtatacgcaccatgtacgatatatgtataacgcgacagctagtactatcagtgcgcgatctatacagaatacacacccagat

SEQ ID NO: 15031 - DNA, 2625 bp, Homo sapiens
  misc_feature (1)...(2625): n = A,T,C or G
gggcggtgagagacatacgaancnnccnnnggggggnacannnagancgaacnnacacagaccannncanaacacgagnagggccgtttcantgtgcgntgnagcaaactagatgcagcgcgcgcggaccacacacaccgtcncgtanacgngngtgagngtcatatatcgnnggntgatnacgagcacacacaccactacgagagnanacggctggtgacactcgaacgcgcgaggcacctgagatttgtgacagatcactacgaggtggtcggntnctctgcgagacgctactcatctgctgtcagtgnancactctatgcagcagtgncgcgncagtccacgtacagcagcnggcgcagactncagagnctgatccntatncatcagtcagtaaangaagagatagagtagttagaaagnattgcgattgtggagcggagntgtatntgagngntgngtcgaaggagtcaggaatgtcttngataagcatactatgcatcttcganagncatgntgtntantgcactggcagtcnatntanantctggtncgtgactcatctggtactaatcggcgagtgatacagcgcnacacanacngacgngtgtgcagncatgagtacaggacgatgactgncgtgcctcgtgactcttcctcnatatatatagtgagacgcgggagagtgagtgtgtccgcancgactatactgtgctgancgtgcgtctggacgctgtccgncacactgagntcgctagttgtgtgcgactagtgnagtgtgatcggagnanactcatacattgcgtgccagtatcatacatgaanagtgccgtcgncacagtcacactcactactngcgtctgtgntctactacatcacggcatgagtancagcgagancgnggtcgctactctaccntantngagcgactgtacgncaacgatnatagngtcgcagcatgagacgcggctgcgtgtgcattgacntccantcgntntgcgcatgngcgcagactgcgacacatacnctnaccttaatcagttgcggatgacatatgcgnatgatacgagagatgacccgtcatantnctagtaagcacgctgtactcattcttcgtcgcngagtatcantgagcgacgtaagctacgacattcagagcagctctggngtcatccganagnctactnagntctaacgaacgacncgngtaggtagnagttagnntcnatcncantanganacgcgcngtggatcgacgnacgttgtngcgatgcgtcaccngacgncgcactacacctttgagatcntcctactactcatntactngatantactggancgcagcntcntcntncggctgtcntcgtcagcntcgcagnctcgcancacgcacncnctcnnctcatncagangatcgtcagatgacgtnacgtatngcntgttgtantgagtcntanntatnctactaatctacntactgctacgcncgacngcagtatacnatatgaagaagatggatgagngtagtaggagncgcaactaactatggtgnnttangngcaganctgntanagcgatntnntntgntggactggancatnntacgcgangatcatngtacgcngctagggcnngtngagtgtcganagacngacgtaagctgcggacgacgtgncgcngcnctgagactgttgnnctatcagctgctnacgacgatgtactnagcaagcnngcagtcgcnnacnncaacntgacgtcagggggngnngtgcggncgnatgnggncgtngtangngnnggtagncgnancacgactacggcgntgatgatcanttagcntgntgcatcgatggctcgacgacgtagntcagtcatcantcgatgangcangtgncantgatcgnntcagctacntaccnacnacnncgnncagtcgantcggtncngtcgnganagctgccgncgnntctnctngtggnacgnctncgagtcngtangtagtnacntgnntttccgtcnncagcngtcngcatacgttacagttgcngctgtcagttagtatggtgtagtagtnattnngtgangctncgtnntcggtcgtnccagctcggcngcntgcgtacgtaatcnatnactgacgtnnctatgaacctnagtaggnagaattcnagggattganttgnatggantgnctggncgttacgcnngcnannacngnngcaangntnnagnntgcttgagtatgagntnanntgatctanntcagtttgncntgcnaggatgnttnnattnnatctgnnnaagntgactagncgacaagnagncttaagcaccngncatcngccnagcgtttngactgganntgcagcnngaagacnaaagnaacntcangtagcctangacncgagcgancntgcctggtggntgcngcngtacggtctnnattcgtacgntngtatgcnagcngacnctagcnngcntaggnntaggnagctagncgaccntggtcagtnactgcggaanggnnnacgacngatccnacgtatgctagcatcgacccgtngtcagntttacggtangtattgantcagtcgtgnatgcnntgacgttgatgntgnatgcntg

SEQ ID NO: 15032 - DNA, 767 bp, Homo sapiens
agtcctgcactatttaggagcccaacagggaaaacagaaactacactgggcatcagcagaggtaacaactccaggatgcatcaccatctctaggaatggaggacaaggggaagaagtgggaagacagaatctagaactgcagagctggctctcagacatcccaggggacatcactcagcagttgctgggtcccttgagggggtgtgatgaagtgtcaatgctggagcaatggcaacagaatccagcaagccagcaggaagtagcaaatctcttctcctgcctttgagtctctccttggtgtccttattggcagagccaaacatggaagcagccaggaaaagattaaggtgttttgcagagtgccagccttagcatctcaaagcagagcatagaaagggcaaggagaggagggggcttggagctgagagatagtcaccgaataactggcatccctcttcatagtagtgttgcgtattcactgggagtacgtgatgcttggatgattctcttcttatgtgttgctatcagccactgatgatgattacctttatccattaattcacatgggactacaaaatcagcaaatatgtcatgatttccatgtggacaagatggagagagacacggaatggatggaaaaatatttgggtggagtagtttctagataacacacccagagttgatgaatggctcttgtccctccaaaaggaggctcttggaggttggtgtatatgtccttaccctgttctgggtagcatcttatcaag

SEQ ID NO: 15033 - DNA, 861 bp, Homo sapiens
agtcagttatttcactcgtggtctaaagacatcttaaaattacaatccccgtggaaatacacacggctgccccagctaaagtggagcgttagaattcgcgtattccagcctcatccaggggttcaagggcggaggggtcgaatcctcaaagatgcaggggagctatactgggcacacacggaagtttgttccccaattcactagctggaagacttctattttaaagatgtggttatggctggaattctgcctcacattacagccacttctccccatgaggttcccaagaagagcaagtggaaagtcaagccactgctttattatttgctgtgttggtgtctgacctttcagtgaagggctctctgataacctaggctgggccctatggatttagcttgagatttaagggattgggagcaggcttttgcttcttctaagcccttatccaagcagtttcctgaaaccagaaacaaaatgtgtccaagctctaagacatagctagagactaagcccttccatgcagcttacagcctcttgtttatgcagcacagatgccatgagaggagacccctaaaggctcttgtctgagtgggattggcaggaagagaagaccccaggctgacttacgcatcagatgacatgcattgaaaaggaagagataagagcgagtctcatgtgaggatgattttaaaatgcatcgtgactctgctcacagtacatgtggcccactgtcctcttgggacctgcaacctgattatcagctcgtcttctctgggtgtgtgtgaaggggttaaggttagttatttattgtattacatattaccccaaacttagtggcttaaaataaacacggatcggcca

SEQ ID NO: 15034 - DNA, 898 bp, Homo sapiens
gggaaaaaaagaagcacgcaacgggtttgggaatcccccaattacttaaagcgggaaaaaaaaacggcataccgggtttctggtttgaagcacctaaaaagggccgccgccggcttcagacaagggtgaatacgaaagacgatgcggtaaacccctttcaggaaaatttcaactaacagatctctcccccagggaatcccggttccttttttaaggggtgccaaaatggggagtggaacaaggggaataacatcatttccgcaccccaccccctatgggtgcacgacttccccgggcagacccgggtttcccgtggccaccacgcaagctaccaactgtgatgaaggagagccccgcaggggggaaggatatttccgcagagaagaacacctgctggctcttcatcttctccacggccataagacaaaaacacaacgccgcggccgtctcccatttctattaggggggggggtccttcgataggccctacaaaacactcgttggcctggccctgcgaatatctcctccggcgccgtgtatctaatttaaagggcgggagaaggagaggcgcaacaaacatacacaacaccaagaggcgcggcttggtccctggatcctgggcgctgcccaaggaacgaggaacaacccggtgggtggtggtccacggatccgtggggatgcccacagaccggggggccacccgggggggggggatccgaatccatgggaatcccccaagtcgcgcgtcccccacgcgggtgggttaccaacaaaagggcaactcccaactccgcgaaacccgcccgcggtgctcacacaaattagggtcgcatgacacacgttacacaccgcttcaagcaaccccatgcgccctatgcacatatccgttgtggcggtg

SEQ ID NO: 15035 - DNA, 845 bp, Homo sapiens
  misc_feature (1)...(845): n = A,T,C or G
ccccagctaaagggcaacaccgccgcctcggcgttttgacagcaaaaatccagagatgattctcggtgtggctctcttaattaaacgccgttcaggggcctgaccaccacgggtgtacataacaacaaaaccggagggcctctttttttgggccgtgtggctggaggagaccgaaacacccacgcccaccgggcttcctttaatcaccaatacccccccccctcggaagggcccagccccaaaaggggcccttcaaatatatccggacggattcattatcctaattagtccccgggaccctgaggacctagccggtttacgcaaagcccactgaaagcgggattttctccctataataccctctctcccgggaaaggggagcttaaaaagggttgggtcggaaaaccaaccccttcacactcggggggggaagccaccagcaccctggtgcgtctcaacaaaccgatcccccaccacccacaccgcaagcactctcgcggtggaaacaactaaacaggcgcgggtcctctcgaccttcgcgcgacaaaatacttgtgtgtattattggacactcgccacacacctgtttggaagtcggagggggcttgtgcctccgcgacttccagtatagccccacccaatatcttgcgttgggtcgctgatgagtggttgggcgcgagtgcgtccttccagcgcaataccaattactgtgtgtancggntttccactctctcctgcgccgcaccgcaagggggaggcgggtgagtcgtcaacccaccaagtacctccgtaacccaagaagacacaagacacacccacccctccgggtccctgcgatcaataat

SEQ ID NO: 15036 - DNA, 571 bp, Homo sapiens
accgtattaatcgcttttttttaagcaagaggagcaagcctgacagccaaaaacctacagaaaccgtaatccttgcctaaagagcccttctgcatgggaaaggctgcctcagcctggataatgttatgaacgcctaactcttaccaacgcttacgccataaccaactgccccatggcctgatgagaaccgaggcagagggcgaagatgagatcggcgattaaatatgaaaggagcaataatgacctgtagtgtaattgtagtaatagtacaagcaagagggaaccatatgagagggtgagcagtagagagggaggcactgagacgccatacaataggtgcagaggcgagatatggcgtggggaatgggtctattagtcctaaccctgacctcaggaagagagtgaaatggaagcaaccgcttatgacagagtgaggggaagtgtagggggcgttgggcctgttcaacataaatacgaggaagagcacaatgacctaataggaatagagcgtctactataacgcccaaaagtatgagtcaacacaatagagaagaaaacgacaacaaaaacg

SEQ ID NO: 15037 - DNA, 876 bp, Homo sapiens
aaacaaaaacatacagggggtggaaagaggggatatatataaaaaagaattggagaaggaacaaacggtagggaaggatagagaggattcacggttaaaatgccgaatataaaaaatgagggggcacgatggcagtggggggtcttttcagcgtaaaataaagaaagaaatccggagaaaagcgcaggggggctgagtgtatgtagtgcgtagggaatgccatgaatggggggaatgaagtaactgggtggcatgcgacaaggggaggatgcgaaaacgggcgaaaattatgtgttggccaacgcagaaaggggaaaagataaaactggctagcagaggggtactgtgatagcaagtaagatcatattaatcaaggagtgtccaaagatcgaatcacagggtggaacggagaagatgatcaatagagggtattaggaatccggttgaatcaatagtgaaacgcatatatgcagcaagatataagaggtaaagggttcttattagccaataatttcatatatcttctgttcgtgaattctcatctcttagatcaagtttattctagatgataggggaactcaatacagtaagaacaccaaagaatgagtgtctatttctgttaataattccctcctgctcactattactgaaccatttcaagaatggaaggtacaaagagcaatgaaatctgctctctaatgcagacaccctcccctccctgatcccacccccacccattcaatttccctttggaggaaagaaatgacataaatttaataaatatccaatcttgggagctgtcagaaaagaactcacaggtcacgacccaaactcaagagcctcctgggtactaacaataaaccccgatgctggcag

SEQ ID NO: 15038 - DNA, 1945 bp, Homo sapiens
  misc_feature (1)...(1945): n = A,T,C or G
cggtgtgtgcacactacaattntgcgtaatatcaacaccagggcaagagaccggggcacctactttgggtcanacttacaacaccgggngcaattttcgtcacttggaccatatacntgttcacacaaacaccacatacacaacttgttattcccnttgtggagacactacattgttctaacatctgantgtgcacaanacatagaccccacaatcgcacttgcacaacaatggagtggcacaacnccaacaccngtgggggcaccacatccagcncataatattgtcactgttntcacatgngtctgtgagacattcgcacacngtcacaccgtgtttgcatcttaatatgtgtcattcnctcttatactggccntngagtcactgttagtgacnatcncctctcaatctcttgattntgcaatcacgtgctcatanctgtgggnatactctactctnctgtatactgctnatgtgtgangnaggtgatagtgtgtgtgtgctcatatantcatcacatgtgtanctatctctatcngacgaggtgagtttagggtgtngcaaacactgtggtcatcatatcatctgtcttgagacctctcntctggtgtgtgtgtcatcnacacntatctcactatctcgattngtgttcagtgttcgtctctcctacaanctctacttgtagttagtctgcttctctactgtgatatnttggacacaactcacactctctnctcaacatgcgtgactaacacatcctctatgtngtcacctatatacatcacacgtaccgaatggngtggtgatgcgtgtgatgaatatcactaacatatcntcgtcctttngcgtgtatacgtcgtnctcatctatttatactgttgtagttnatattancattattctatncangtcacacgtacttctcatcttgctgtgcgtttcttacgtttttanaccgtatacactgacatcatgtgtgtgcgtgcaactgtgtgcgtcacacatcantatgntntatgtgtgttaactnatacatacatctgtgtatacactctcgctctgcatcatctncatcatacaggntcgtctattcacttctcatccgtanacntctgtctacctactcgctcatctctcatacaagcatatacattctncctcaacacctctactactctcgantgctgtgtgtgtgtttcgtctntngntacgatctctgcagtagagattcanagacacgtancagtatacttgtgtgttngtctcttcttgtgtcctcnctgcatgctgnctgcgtatttnttcgcgtgctcatattcactctcncacnactctngtgtgtgtaatncactcatctctcactatcgctttcctctcgtcgttcnacatacactgtgttcatatcgatcacaaatcatataaancttgacacgtgtcgntgtcaactacttntgtctgtgcnaatcantcgctacactatacaccttcgngtttnttgtactcctatgactcgtattcagttanttgnttccanctgatcgaactgctgttnncgcgctatacttatcttcgtgtctctgtctgaaatacgctcgntcgtcctctctctctnctaatctctcatgatcatcgatatncataactatcntntgntgcacgtcgtcnctagttactgcttctgatgtgaacncattcatatgcntatntgtgggtcatcgtcgtcctcnctcgctgtcgcgtgtgttgttgatgatgttgcctgtccatcttcatcgncatgtcgatatatctcatatctaaaccatacatcgctcgccagcncaacangcactatctatcactncttcagtcgactcgtatcttcgtttattgactcatgtgtctgactctgantgtctacgctcacatatacgcgcaattataacgattcattgtngtctgtctt

SEQ ID NO: 15039 - DNA, 1236 bp, Homo sapiens
  misc_feature (1)...(1236): n = A,T,C or G
gcggggaatacctcatgtaaactcagcagcagacaatcagggtgcgtctcgggggaaaccttaagattgtgaattttcatttgacatatactagacgcgaaaaataacatagtggtctaatgcccgctgcgggtactgtggccgtttagacgaccaccaccagacaatgtggggccacgcgggtgtgcgtaagtaataagccacgtgaacaggatggtaacaaacctacacatctgagtgcgatgttctctcatcagattcgtgatcgggccgaggattactaacgcaaattggcctcgttgtaatctcgtctagtggtcggcgcagtggcggacaagcctatatgtttataggcgcgggtgacacaaacagggcatccggccaaccgacggagctggtagattaataaccaaaactacaataccgattcaaacgggtgccgtcaaaatgagtgggagcacccccaaaacatccatcactgaaatgtcgcgaatcttaaacaatgggctggtgatacacataatcggtacaagtatacgccataagaaaccgggcaatgccgcgccggaacactatcgtctcagccctataagagagatacaaacttgtggaaatatcgaccgcgggcaggtccatactatgtgttttggttgatattatcctgtacagcgtatgtgagtgataattgacccgcaatgaccacacacacctacattcgtggtgtggcggttcagactcgggatgtgcagagttaatacatacgcaagcaactgtcgactgcgcggtacacggtatattgcatatcagaggtgggcatccgatagtctctcattcgggacacaaacggttggatggacaatatacacgtgtagtgggtcaagtcgtttctatacttactctattagatgtgtgtggctgtgtgactcataatatcggacccagctgcctcgggtgaacaagacattgtggagcgaaacacagggtgtggaacacaaatagcacaagactcaccataactctgggtgggtgtgagaatancgtgatataactgattaataatatctatcccgaacaccagatgcgacgtgtggagcgctgcggcataacatccggtaacgatacaaacaataattgtgcatggaataataaggtggacagccacattactaattggtacgtangaactattcacacgatagcaccacaaggacagatgactcagtctggtgggtggta

SEQ ID NO: 15040 - DNA, 719 bp, Homo sapiens
  misc_feature (1)...(719): n = A,T,C or G
aagaaagcccccatgccccaaaataaagatttgtcatatttttttcagggtaaatacatgctattttattcttaaggagactcttgaattgtaggcataaatacttaagatattttctatcaaaatgcccactgacaagcatctatattcctccccagataggatggaacggcaatgtgctccctggcccctcccaacccagtcctctaggcgttttgtttcacagcattaatattcttaccactattttttaaatcaacaggttatgacatcataatttttacttatttctttgcccaactttgtatcatctgctcttgtatttctcatggatttcttcatgtctatttctgcaagacatctttaaaacagagtttaggagccgggagccatggctcacgccagtaatcccagcactttggaaggcagaggtggatggatcacttgaagccaggagttcaagaccagcctggtcaacatagtgaaaccctgtctctactaagaatacaaaaattacccaggcgtggtggtacatgtgcctgtaatcccagctacttgggaggctgaggcaggagaattgcttgaacccgggaggcagaggttgcagtgagctgagatcacgccactgcactccagcctgggtncaaaagcaaaactctgtctcaaaaaaaattgaaaacataaaaataaataaataaataaaagctgtatcggccagg

SEQ ID NO: 15041 - DNA, 938 bp, Homo sapiens
  misc_feature (1)...(938): n = A,T,C or G
ttggtgaggtagacccgggannggcaccccgcannncaagagcttccccggcaaacaaacgccttaaaatgtgatttacaacgcctgcgggattcaacaaccgggcacatccagtgattgttctgggcttataagccaaccccaactaaagggaaaccgccgcctctgcttttatcacaccagattcaaacttaagcgtgggtgaatcctttaataaaccaccggttccggaagaactgcccacaacaccataaaacgcttatgttccctaccaggacgttttttttcagaacaacacgaatatgctagcctataacccgggactccaacagttgaattgaggcctcccgacaccgaggaacaacttcactgcgtgacttaaaatatcgctctagcccagggaacaaagcatgctttggtggcctatccctctttaataagaggcccttttggaccgcagaacacacgtgaaatttcctattgcattaagtccaagccccactttcttctttccgaaaacggaaactattcctccaaagggtaatgatgttgatggacaaaattttaactttggggaaaaatcctcggaaccaaatccaaatcgctgccctgcctatggcatatgaaatttatttttttttctagaacccaaaagcgcccctgtttcacaaaggcgtaagcaaccatgacatgcgtcggaccccggggcttccgaaaatatttaaacaccacaacgcaaattttcctccgttgtctggaggaccaattgctaatttttgaataccgcggattaatgcatgcctcttccgttttttaataaaaccacccccggaagggaacccacccgctcctggggttgtgcacctactccaaaccgggcgagaaaaaagcaacacccccactccagcacgaggaacaaaaccaaccagcccttcctt

SEQ ID NO: 15042 - DNA, 292 bp, Homo sapiens
ctcgaatgctagagcagtacagactgaggaaaaccgatggcaatacagggggtggaaatacagtaatatctgtacgtaaagaggcccctcccagtgtactcgattagtgagtcgtacatttggacatacaggttatagtgatcagcttgcggtgtttcatatattttatccacatgctcgcatggcataaagtcatctacagatataatacaataaataatgagagggcttgcctatcgggcactcagatttaacaaagaattccgcaagtaccccgtgtacaagtgtatca

SEQ ID NO: 15043 - DNA, 979 bp, Homo sapiens
acactgagtgggtcggtaaaaagacacaaaaagggactcctggcaacaaaccctgaaattccttcaaaaagcctggggaaacaaaaccggggggtctccagtgattgatctagggatagaagcctatcccaactaaagggcaaccgccggcaggggttataacagacgagcgttgagctgtacgctcaggggcttttttaaattaaacacgcggtcacataatttaaaaaacacgcatagggcaaaattacagagaaggcgataggctttttttttgtcgggtgggaacgacacccgatccgttgaaaatccgcgcgacagggggaaccattgggtgtgtgagaattaatgcgtactggggggcctctgcggctataaaaatcacacaacacccctatttaagtgaaaaatatcacctcaaacagccatatctctaactcccgcccttatattactacccgacacaacaccacaaaaatttaaagcaagcacacctcttttctgtgactttgtataaggtgtcaactttggccgtcagaaaaccacgcccccgcgtcatacgagtacaaaacagtgtaaagagtgtataccccttacgtaaaaaaagtgcgccggttggagttcagatccgcgcgagctttccgtccgcacaggagaagggaccactacaacgcgcacgacataccgcactcacctctcttcttcctttcgcgtgtgacttcggtatgacataatagtgacgggcactggtaaggcaaccataggagcgacaggggggttgaaaaccaatcgagcagcggagagatagacgagcgataccgaggctatcggagatcatatttacatgtaaacaaataattgtgtggatcacacgcgaacttcttcttttggtcgactagggcatatctcactagagagcaccgacttgacatgtacctactacgtcaccgaccaccacggtcattaaacataatataag

SEQ ID NO: 15044 - DNA, 170 bp, Homo sapiens
actagtgggaggcgcggggagaacgaaggaggagagggcttccacgggaaaaacgccccaaattttgattgataaagccatcgggatacaaaacaggggcgcatccattgattgatctgggcttatgagccaaccactcctaaagggaaaccgccgcaaaggcttttaga

SEQ ID NO: 15045 - DNA, 1310 bp, Homo sapiens
  misc_feature (1)...(1310): n = A,T,C or G
atatcacttgacagaatattatacgttagtcatctcgcaagcgatacgtgtgattatatgtattcacagcgtaacaatcacatgannggaactcagcacacataccggatacggcacgagngaccagagttatttaattttattatattcttgtaagtcttgctcacgcgtctcctcacggncctgacacctcactgtgcacctncaggggcgtngatgtcgctcgtttggctactgattnncactcatggcacgacttcctcgnaccaaacggcaccctcacacctccatcggngtatacttcactccttctatcggnataccttcactatttgacatangcaactattcatcatcgatgtgcgnaatcatggtgatctacggttgcgatgatctcacatttatgaaacattagtacgataatcaacatcttcacaaggtgagngatcgagaaatcagttgactatatnagctgcatcatatagtctattgtggagttacccatgagagagcatacgatagaaatangcaggaggaaacatggccggagcggactgaccgttgaaggctcatatatttggtcgtgtngtgtgtgatagagcgtatatcgtgtacgaccatggacgtcgagnacagcgacggcacgcacgtctttggttnnnaattctacactgcacccacaccacgacgnaggaccactatgtaacactattcaacagataatcgctattctnnntacaaaacacacctaaaaacaacaaanngaatcatacaaactataaactatatataaataatanaatgcgcccgcctatgcctgttagctatgcgctagaggagaattgtccctcgacctatgnacatacacaaacaacnnnncaaatcaagnanaacactcacaaactacaaaaataccgtagaaaaagcgttaagtattgaacattgctcctttccctcctctacaacacctcgcatcctccatactngnncatncatcctactacaccgacacttacatacactctcgtatcttcatgatacatctattctactatactttnnnctcccatttcttttctcacctcttttctcttacattttnncnctcttcctanacttcttacnnnnnnactcctttcctcccttctcnaccttatctttctnnctcttaataactnanccattcattccatctacttactactcccccccaactncccttcactttcttncctccctccatnncactccaccttcttcacattactttnnnnnttcatctctcaaactctcatnnncancaccctaca

SEQ ID NO: 15046 - DNA, 1000 bp, Homo sapiens
  misc_feature (1)...(1000): n = A,T,C or G
atctatgtatggcctacgtgtgtctcacccgccacgagagcccgcctgcccgggcaacaacggcccttaaattgatctgataccgctacgggaatccaaaacacggggcacttccagtgattgttcggggctcatgagccaacccctcttaaagggataccgcacgcagagctattgaacacaccagtgatgtacctcttttccacagggggtttctaaataccggccggggatccacacccttcttccgaccccgtatgtgacaaaatccatgcagaaccttctaccagttttttggcaaagggagaggaatcacaacgcattttagttttgctcgtaacacgccatctatctcacattccttctagccccttctttataactcaaattgccctattcttgtgtgtggcaatggtgggtgtgtgtaatatatcaattcccgcatcgtttggtacttataataaacttcatcctctctagacttttcggatatcatacactttcgcggtgggtttgcctcttgtttcccaccgaccttactccaccaacaacaggtagacctacatcttcttggtgcaacctccgaccctctgctcctctgttttagtcttgtgtctccaactttatttccaacgtcatcaaggtcccctctccccctcgtggtttactttactagtattgtcactgcacacaanatatacctatagattaccaggaaagaagggttcttgttggacattcacacccccgccgacgttgttactgtttttctcccctccccgtcaggtacacgagtctgaatagtctggctcttggcgcgagtacctgactactatcctacgatatgcccgacgacctattattttgtttcgcccattttggatgctggcggcgctagccctctcctcggcagatatatatctagttccattctctcgctccacttcgtgcgcacatctctgttatcccccacccgtgcgacaccacgcagtgaccatcc

SEQ ID NO: 15047 - DNA, 955 bp, Homo sapiens
ttttaacgttcgtggtttagcacccgacaccgtttcccgcaaaaccgcctagatttacttgaaatgcttcgccaccatacccgggagctatccagtgatttttctgggctcataagccaaccccacctaaatggaaaccgccgcctgagattttatcgcaacgcattctattttaaactctgttgacggtcttccttaacaactgtttatagatggacattaaataagtgggtcatagttcgaatgcgtagtgaccatctctttttgttggaaaccaagggtcccggggcctagggccttttttattttaaaatcccccaggctaaacacatcaaacctctggagaatttttatacgtaaagccttgggcgcaaaaaaatatccctatacaaaggccccccaccccagaattattcccttgttgagtttgctatgacccaaccattcgaggaaaagggcccggaccagcccctaaatatatactcccggtgttccaccgtattttttgccctccaaggataagcttctcaattcgcgcggtagtttataacccccacatacttttctgtagaaacttctttttccctagtctaaacacccttcttgtacctaagggtcttaataatttcataaaaagacatttccttcaaaaagcgttggtcggtcggatattctcactttacacctttaagaactactctttggggtgctaaataaaataccccccgcccggcccagagctctttgtgagaggggtggggcgctctcttttatgtagttttgttttttcgaaattcgcagccgccttaaatttgatctaccggcacgtgttcatagaagagttcttcactcccccccttttgatattaaaactctacaaagagataaaactgctctttcgtgcggcgtcaaccgcaaacaacacccccacctccttttttctcattctattttc

SEQ ID NO: 15048 - DNA, 1764 bp, Homo sapiens
  misc_feature (1)...(1764): n = A,T,C or G
agagatcacgagcgaccgccgcgcgccgacgccgagccgagagcgacagccgaacgcgagaacacgaaagagaggacaacgcgcgccgccctcgaatagcacgggaacgaaccnagcncgcgcgcgagaaanaagacccctacaaancgnggagcgcgaagccacacacangagnacgcaccgccgcggaaanacgcgacacacacagcacagaagacaaggcagcagacagacgagccgtgacgcacgccgcgcacgagcgagcnacagcancagacacancggcaacgcagcgagagcagcgaagcaggcagagcagaaganacagangcgaacacgagcgcancaagcgcaancgacgcacaanacgagacggagcgncggaacgcggacagngcacgancgcgcgacgaccgagcgcgnacgacgcacgacgangnagagagaanagaccacagacgcgcgagcacgccacggccgacgagcgnggncagcaccgcagcacgagcgcagaanaccagacacgcgagacgagangagacgacgccagcaaccngacgnaggcgcacaggcgaagaacaggccggagcganaagcggcagaacgcagcgcaccgccgancacgcncgcaggacgcaccannacgcagacgcgcnacaggacgcgagacgcccgaccgagagagacangcgcagccggacaacacacacgcgaaggacgacggcgaagcaagngcaagacgcacgacgacggaacagggagacgagagcganngacagcngcgcacgcacggacaagcgngaggcgagaggcgcacgaggacagcgccgcgagagagaacgacgagcgctggcgcgagcgtacggacccgacgcgccagagcgaggacaacgccagacgacacgccgcgcgcggatgtcgactacgatgcnagcgagcgncgagcgagagcgaggcgcganagcagagagaaggcggcgcagcgccacagtcgagcagagcgcgtgctacaatcgcgagcgcaagacgcgcgagagacgtagnacgcacgagcgagatgcgccacgcagcgcagcgtatcagctcgcagcaagagcacgcgcgaacagcacctagagnanagacagcagacgagcgctagagcagacagacaggagnagagcgcggaccacgcgacgcggacaacgagcgcgaacaggagacgagaggngacgcgagcaaagcaggaccgcacacgaacgacccacgacgcagagcacgagaagacgagcngagagcgacacgcagccgcncngcagcgagagccgcacgcgaacagcagaagagacaggactctcgcncgcacgacgggacgcgcgccggcgggagcgagaacgncacgcgactagcgagcacatacgcggcagcggtagagacagcgaacaggacacacacgaccgcgcgccagaancacgcgcgcgcactacgcacgacagcaccacagtcgagaggaccgagacgaagcggacaggaagcgcaagacagagagacacagcacactagcggcgagcagaggnaggaggaccagcaccgcacgcggcgcagaggagcagccggcggaccaggacgcaacacacgggacgccgaagacagcacgcaaacaaaacgacgacaggacagcagaggcagacaaacgggaaccgcacccagaagagcaaaacaagaagcgaacgcagcgagagagagacgcagaggcaggctcgagcgcccggcaggccgaaggag

SEQ ID NO: 15049 - DNA, 886 bp, Homo sapiens
ttggaggcttgtaccaagttctctctttcatttcctccgcgtataaaagaatgtttggctaattcctccagttgaaggcccaggggcaaattctggatcactcaacactatctccacggtgttacaatgttttttgcctctagctttgggtggggcataccaagaataccctctctaaagtctaaaaggttaagcgtggcgattacaagaaacccatatgtatggttcaacccccagcagactgatacacaattttagttttccaagtggaaaaaccattggaagacaagtgccagatagctctaacatatgtccatgattgacccccggttttaatctccccacatcagggctccacattttggacttaattttcaaaccattcaattttttttaagtaaattctctgtccctagattaatcccattcatacactaagatcttgaaaaagaaaaaaagaggagacatgaaaaggtctgtgtgtgcgatagaccccagatgcttcaagaaattatccctgaacttcaaaaaatatactcaaagacactaatatcttttgattgctggttcagttattcacttcttttctatgttaataacaaaatcaacaacaaaagaaacaggaaaaaaggccttgatagaggaagaattctgagcacataggcatttgaataaaaatcttcctaagtgatgaattttactgctgtgtgtttctaaaatgaagcagtaccgacgcatttgtgccattcatttccatacaatttgtaaagttattacctatttggaatattacccacttttttcatgtacaacataaaaatttatgatggataccctttaaatgtgtatctaaaagtaatgcattacaataaagtctgatcggcca

SEQ ID NO: 15050 - DNA, 760 bp, Homo sapiens
tcacaattaaatggataacgccggcttagcttttaacacagaagggatggaacttaagctggcggagatgctcttaatatatcccccgcttcaagggaataaatgaagctctgtgtcctttgcacctggtcaacacgaaaaccccccagacgggggttgggcggaaagatctgcccacgataaacaacacatcgcttattgtcccgcatagttgggaactgggaacaggcggcagagggcactagttacggggcaactaacagccgaagggagatctttcagctccggagcctagggggagattacaaaattatttctgtaattcgggggctctggggcttaacatccgtcccaaaaggggtgtttccggcccacattacgtgtgtttaggtatggaaattgttacactagggatattcccttacccaggtatgctatccacgctcctgtgcttcctccgccccgacacgatccaaaattaagagcattttagtggggccagagagattgagtaaggaaagtgtgtgaattcgcgcttggcggtggtcgaaccctcaacaacacctttcggagaggtagttccccctcttcgtttctttttaagggaaaaggcacacttgacaccctacagaaaatttagggggggcttcttatctttaaaagtatgtgagaggggaaaaacaatttatacgaggggccataagggttagccaagcgcgatgactacccgtcacacacaatcatttgaggatctcctacc

SEQ ID NO: 15051 - DNA, 1056 bp, Homo sapiens
  misc_feature (1)...(1056): n = A,T,C or G
cgacggcggcaacaagacgcggagccgaagnaaaaaaaaagtaattcttgttcatcagaggccgatttactgaaaccgcaaacgcagacacagcgaccgaccaccacagtcaatttaagcgggggtgagtctatcaattaaccaccggatacagaacattcatccatcgatgcgacgccttaggaagcgaggtgcctaaagatgatgcctggcccaagctaaggaagacaaccaaatgggagaaagcggcctggttccctctgggtagaggaagaaagcatgatcctttatgagggacatgtgcgctcggaagctctgacgggggagcagtttaacttgactaagaggcgaggggtcaggaatccactgaatctaccaacaacgctgtaaacaacaatgtggttcgcaaaagaacatttatagagggccttatacaccccataaaggcgcggatgggcccttaatgacgcataaccgtatgaaggctggcgagatccccgggggctttgtttaaacaaccagaggggagataataaggcccgaggggggtaaaccccgcttttattacaaatatagagcacccaggggaaaaaccgctgaaggcggaatttcggggagggcaatgaagaaagacaggccaggccgtgttaaatggagaacctgggctccaccctttttttacagcggaaatggctgggcagcataccggagaacgctttcccattcgtttttagagaaaaatcacgagaaaagagtaggcgggacagaatcggcgacatggtgagcgaaaaacaccgggggggacggccgagacagagagcgtgtgtctgccggccacaaacggggaggtgagcgacaacatctgggnagttcaactacacaccgactccggtggagggcgtctccagttgataggtcgagcaacgcgcgaaagatggcaaccgtttcttccccacttcataatagggggatatatatctaaccacacgagtaaagctgacgtggggctccgcgggcacggagcgccgcagcaaccgatacagagaaaggtgcgag

SEQ ID NO: 15052 - DNA, 881 bp, Homo sapiens
gtgtcccgcacgtcttgcactacccacccagacagtcctccataatcccccgcatgaaacggttccaccctagacctccctattacccgcatcctcgcgccttactctccccactcacttccccctatttcactctagcaagattccgcggtacgcaaataccccttgcggtttttgctccctggaggatgaccccttcccccccagtttgtgagcttgcctcccccggcctggcagagagattttcaagtgccacttttcaagctacggaaacggcgtatatagattgcaaagcctgtcctaaaaagctcagaaatggcgctaccaagtggtggtaaagacctcccaacataattttttgacggccctggcaatgagagaagaagccaatcccagtggaacaattgagtgttggagtgcattggcaccatctcggctcactgcgacctatgcctcttgggttcaaggaattttcctgcttcagcctcccgagtagctgggattacaggcatgcaccaccacacccgggtaattttgtatttttagtagagacggggtttaaccatgttggccaggctggtttcaaactcttgacctcagatgatccagccgcctcagcctcccaaagggttgggattacaggtgtgagccaccatgcccagccggggcattatgttttaatgggcatggagtttcagtttatgatggtgaaaaagttctggagatgggtggtgttgatagttgcaatgtgaattcacttaatgccactgaattttactcttaaaaatggttcaaatggtagactgtatgttatatgtattttaccacaataaaaaataaatacagatgcggccgacaccgcggtggagtgttgcgtccag

SEQ ID NO: 15053 - DNA, 981 bp, Homo sapiens
cagtcccaaatttgtacatcgtatcataagccaaacgcagggctccacggaaaaaccgccttaaaagtacttgacaacgccttggggattataaaccggggcccatccagggatttttttgggctagaggccatccacctaagggatcgccccattgcttttgacacacacagtcgcccaactctaaagagggggggggctctttctaaataacccaccaccaaacattttgcccgacattcccgggcgcttttattatatactctcccataacaagagagtggcgtcttccacttatggcgcgcgtagtggttgaatatcagatatccacgcaatgacacccacggttcttcctgggcgtctctaaatcttatgtgagcccataaaacagagtcccgccgcgagaaggccacttcaccctctaagttggggtgctttcaatataagagagcgccccgcgaacaaacttctcttattcttgcttgtgcggtgccacgcccccaatccttatttctttatatccactcccccttttttgggcccccttctggtagcgctttcgagaaaaaaaaataaaaaacatcccccccctctgcaaagcgctcgaaaataattaaaaaacacccatattaccctttgacctctccataataagaaagtggggggcgcgcttcctaaaaaataaataaatttgggtatcgttgcaccccccctaaattacgcaagaaggtctcaacatttattttatagtcccaccctttattttttatctttgcgataatttaagtgttgtataggaagattctcttcactttcctccgtctccgttagagggaggagtctcgcatctcatcccccgaattacacccacacgtcctcacaaggaaattgtttatttttcgggttccgtttttccacccacacaaaaaaattttaatagcgtttatttgccgcccacaaacatcgatttcactccccact

SEQ ID NO: 15054 - DNA, 1248 bp, Homo sapiens
  misc_feature (1)...(1248): n = A,T,C or G
cggcgcgccgcagggcgacaaggtcctgttaaaacaagagagaggaggtangtcntgtgtgtgctcactcgcacgtctcgcatttttcttcttcgaagacncagactacaccgcgagatgcacgtagactgactcngactgcacacacgtacgttcagaatctatgaagacgagaggagagtgaggatcttcatctcacatctacatcacaacgcgtgcatagcccgggcacgggcgcttcgcgatgtcatattgtggtgatacagcacgttgcgattaattctattcttgttncacagaagtcgaagagaggttgtgatcatccaaggggtggatgtaacacgcagcgggaccgtcgcaggactctccaagttcaactattagtggttcactaaacgtactatttagcgtgttcgtgtcttgtgcacaagggcggcgggatggaacatgcccaagtgtaaagtcgctgttgataacacatggagaaggctgtgcaagctatagcgctggggggccacacaccgatacaggagtatgaggatagtgggaacacagtagaaatgactgccgtgctttggcttgagatgtgcaagtactgaggtggcgggagcccacccggatatgtttgtggagaacataaggtacgtaaaagacttagtgcggagaaaagcgacaagatttctgtaaatgaatcaacccctcatactatcagcgagggcgcgccaccctgactaattaaagacgtacctcgattgtttagtgacgacgatattaacttggtctctctctaatcggtctcatatatagtaatcagttaaaatacgacacgcgagtacgggattgggcggacagccgacatccattagggactttaagtttttgtgtttggcgtgcgaacgcatctccatttatatatgtccggacagcccccgtgcctgaagtcctatccgggaagagtagaagggagaatgtgaatgagtcgcagattgcgagggccgcagtcagcccatagatggtatatctggattacagctgttatgtgtgtggccacatcgcgagtgcgttgacaaataccgtattaanatgtattgtgtgcgtggggggacagtgagtggatagaagttgcggagtggttgttgcgtaattttggattacgaggtgatagaagaaaggtgttaaacacatgagatgtgtgggggcagttcaatggagggccagtacggtcgcaagtagtctagagtaggcnag

SEQ ID NO: 15055 - DNA, 1065 bp, Homo sapiens
  misc_feature (1)...(1065): n = A,T,C or G
aggaccccaaaagaccacacgcaaaaaaaaaaaccaggncgcggaggccctccgcagagggactaacgcgcanaaaacctccccgggcgcaaaaccccagggaacacagagacacgggggcgaaacccgagggaatatacgcaggggagaagaagcgccagcacccacaagaaggggcgaagcacgccacgggaaggcccaacacaaccccaagcccccaaacccgagaagagggacccgaacaccaccccaaaaaaaaacccaccacagaaaagggagcaaaaaaacgacgcccccacgcgggggggcaccgggcacgcagaggaaaaccaccacgtaaaaagggaggagagacacgaaaacgacgaacgcccgcagaagcaaacaaagaaaccaaatggaaagacgcagagcgagacagacgcaaggaccacaaaacaggggaggaggggacagacaaaaaaaaccggggagccaccgggaggacaaagcaccccgaggagccgcgcacgaaggccggcaaggagaaacaccgcacaaaagagagagcgaacacaagcgaaacaaaaccccggggggcgcggaaaaagccccgacccgagccacaggaaaaaagacagaaaaacagaggacacacggtaggaacacggcggaaaagcaaacagaggaaagaagaggagggagggcgcggagcacggccccacccacgcccaaggagaggcgaaacgggagcgaagccaagaaaaagaggaacgcgagggccagcaccgccgggggacagaaagcgaaggagccgccggggaaggagcaaacccaggaccgggcgagagaacaacacaagagcacaacgagagacgaggaggcgaacacacgcgcaaggagcacagcagaacgcaacacataacaagcacacgcacaacacaagacgacaccaaccgaaggccaacagacgaaacgaaagcaaggagccacacagagacacaatagagcgcgaaccaagcacaagacgagagccaccaccaagaggacgcgggaaggagcacggcgcagggcccgccccgcgcg

SEQ ID NO: 15056 - DNA, 976 bp, Homo sapiens
  misc_feature (1)...(976): n = A,T,C or G
cgggcggcgcccgctcagcgaagtgactagcgagtaacagaagaggaagtccttggtccacacacgccgatttcagctgaaaccgctcacgcagagccggctactgaccaccatatcaatttacgctggggatacctgacacattctacatgggtgcgagacgggcactctttccatcgacactccttctaccaagatgaggacacattgagacggccccatttatgaaccaggaagcagacactttacagacactgaatctgccagaacttgacatcctgggattacccggggctgtacaactatgagaagtgcatttgctcgttgtttatccgcttgaggatcgtaccctgtctgggattccccaatgtcccaagatatcgaacgtatgtatcggtgcgcctcacccgtactaggggggaggggcgtccgggtgcgttaccgctgtggataatcagctgccgagaccatcccgtggtagcgtggatgatgctttgtaattttaaggagagtagccgacaatacttctatattagtttcggcgtctccgcgtcgggaggaagggtggtattgaggctgccaaccgatgggcgggtgataactacggcgtctctcattagatgtgagcgtcgcacgtgctggatgtagatatttatgttctgtaaaaggacgcgagataggttagcgtcctgtgtcgtttattaggacatctcgtgttgatgcgtggtaggctggtagcaacgaacgagagaagagagggtaaagcaattgtgcgacgcgggcgacacgtgagatccgacagtagggggaggttagggagagggtattgtgttatgtgtggttagggcgaatcgtggctgcggcggcggtggccgggagagtggagcgngcgagagtggaggagaatgtgatatgggcgagggaggggcatgttaccgatgtgaccaggtaggggggggatacggagggaggcgat

SEQ ID NO: 15057 - DNA, 1729 bp, Homo sapiens
  misc_feature (1)...(1729): n = A,T,C or G
catatgcgccgctgactttatccgagcagcgcagtggagctagagcangacgcacagnagcgngangaganngccttagtggagagagatgacgacagcgagagatanagaaagccgtananancngnaggagtgnatgcagcgngagttggagatagctggtcggcgatgtcgagtggcagagatatctgcgaacgcgccggattttagactcagaatgatctcgcgcgcgcgccgggtgcgngcgctctctagncacgatgatgactcagtacgatgatcatagacgacgcaccagcagtagtagtctatgncagacgcgacgctcagcgccgctcgcgtctccgnaatcactcagagtgagnatagtcgcgcgcgcgacgagtataagttgtcacacgcgtatatgtcagtataacgccgccagantgnttgtagacgtncatgaccgctgtgacgtatattgctacaggcactcgagngcgcaggtagtgtactnatgagncacgtgagacgcggatgcagcagagacacacgtccgacgcgaagtcanaggtnatactgacgatatgcgacgtgagggncgtcacgataccgattgtgtgctgcacagcgctcgcgatagacggtgctgccgtgtntgtacgcatgagaggtacngcacgaacntgcagtagtcagtagagacanacatngatctgagttggcagcncngatgatacgagtcgtcgcgaggggtcgtgcggaccgctacggtcgacgctngtatgaangtagtcgatggtggtatgttagatccctgtcagccancacagccagtacgcgacacacgactcgctgtgatgtggactcaggtatgtcacacgcacatgtatgtggaggtgcacacgctgtatgtgctggtcgcatctgcgccacngcgagtgagncgagcggacagatgttgatgctatcagacgacnactctgacacgatgtagattatagagtagcaccagtgatgtcgnacgtcgtcncnagttcgacttgtaaatcatgagcaccgcagagtctcgcgcagntangcagacngtagtcgtctnagcccgacagcagagtgagcgtagtagtgtgagtgagganantaatagctgacgtacgactgtggaccncgcatgatggatagacgtancncgtagttgtgatcgacttattgtgacgcaccagtgcgcagcacatgcaccgcaccacgtcgtagtgtgtgtagtcgagaagcgtcatatgagcaagcactcagactatgcagantctaccacaatgtgtgagtacagacgctgaaggacatatctcatagagccgaggcgcgcgagaaatgaccaggcgttagatgcagaataatatgagagacgagctctgcagcagcttcgagcagacggtgatgaagagagccgcggcgtagcggcancaggnctgcgtgtcgctggngtgatcgagacatacctatagcgtatctgtacgcactacgacacgacacgatagtcagcatatatcagatctcacgcgtgatgacactattgcgtgatccactatgactagcaagagcncgcgatacnaggtatgtcgcgtatgtgtattgcaccgcgcacgcatacncgatactacgaatatacagagtcagtgcggcgagtgagcagtactccgcatccctacacgtgcgcgtgcgatgttatgttcanagcacccgaaatncg

SEQ ID NO: 15058 - DNA, 1770 bp, Homo sapiens
  misc_feature (1)...(1770): n = A,T,C or G
ggtgccgtgtttacggtctcgcgttttttcttctctgagattttcagaacgagagggtttttctctgtcggtcacatacagctactgtctcgcaatttttcaagcntagaatatctcgacgtacagccgcgacgatngcacggtnagacatgtacntctgtacgaccagctctactgtnacgttcctattatcgtgtgacacgacagagctggcgagtggagattcgtacatatcacatcttacatcacaacgcggggataagctagtgctcgtggccttggacgctgcactctctcttgtgcgtcggcacaggtattatatcgtgcacgcggatgatccgtgnatgaagagtggntatagagcgcattgtctgtgtgtcacgcgctaagttagtgttagcgagaggagcagtcggcgccgccgagaagtactcttcatccgcttctatcacgagggacgttcattatcgaatgtagtgagtataagtacagagatgacgacacttcgagatgcaccgtgtcagcgcgaggagggagtgcgccacgcgtagaccctgagctgagggatgatcgtcgagtcattctacttnaggcatagatangtcantnatatactacgcncgcgcgtgcttccgcgtgctgtnacatattgactcagtnagtaaangatgangtatgtcgtgcgggagtccgagagagagcagtgctgtgtatcgacagacacgtagtacacatcgtatgggcgtagtgcgtcgtagatangnatggctatatcngctnatggatcgantgcacgtattatgagagagagtcagtaccgggtgtagtactatcgcnagtgatagantccgcgtcgcgctatatatacngtctggattataccggtacgcagcttgcgcgcgtaaggactagacatagagatgcgtcatagtatgcgcgctcgcgtggatacgcgtgnagtctgtacgagcnactcatatacacgcagtcgctcnagcgatcnagtcggngacgagcgatgatgtntatcgcgcgtcgcgcgtgcgncgaatcgtgctacgacnctgngtagatcattgcatantccgctctacacactacatgcatctctcgttctacgtctcactcatgcatgctcttatttatntagtttaagtgctcgagagacacacgagagtactagatnccatgngtgtagagtcacttgacagagncagtcacgtactagtaattcngagctcagtcgaccggtgcgctgcgtctcacgacntgtgtatcgancagagacacgagatgtattgcgtcgctctncaacatgtactactgacacgctggtattacatattagacgctctggcatacctgnatggtacatactctctgtttgtagatcgtatctcacgtgatagcgatgctctgaggctcgcatacctatgtaccatgcatctatcncgcttcatctacgtgttaggagcgctgcaggtggcgctgtgcgcgtgagactatctcgtttcgtctagtgcgccaagcagcagtcaagctaactacaccacagtgcagagctactaagtttgtngcgagttgtgtgnaatccatacattcaccatggaatgatatatactcnatcgataggatgagaagcgcctcggatagctatggtggaatgagtagagcgatctggagaggcgaagcgccgaggcgggcgaggagattattattatgagaatgtctctgtacgagcgagaacgagggaggaacgcgggacgcggc

SEQ ID NO: 15059 - DNA, 554 bp, Homo sapiens
  misc_feature (1)...(554): n = A,T,C or G
attgacttcagtaggcagcaattcaatccaacaaataaggatctatgactgagcatcaactatggtgaaactgtgcttggtggaagttcaagaatgaatatatgaaaagtcacggcctgcaagaagatccaaccaacaacggagataaactgataaactgaaaatgatccttgaatgaatcaaagatgctggaccactagatttttattgtctggtttagggaactccgttctaaatgttcaaatcctacttaatcttgacaatttatctctttgctggctgaggaaaaagagcaacaggcagtataggtcggtaggagaccctgaaaagggatgagtgtgtngtgattgaatgtgatgtgttttactgcgtgttgctgtgtttgccttattaataatagtaccacttttaaaacctcctcattcagtccacccggccttttcttaaccttagcccgatcggtgcctagttctactactcagttcctcattcatttcatttcccgcttaaaaatacactgtttactgtttatgagatctctcccgtgctattct

SEQ ID NO: 15060 - DNA, 849 bp, Homo sapiens
ccggcccaccatcatatcacgtcaaattttctaacgcaattggcgcgcgtcttcatggcactcgcagttcttccggttccttgggacatacgcggtagcaatcccgtcctacttccaccaagaccctgtaaccgtacgagcggtcgaccagcgaggggtaaaccactctctctccacactacccctcgacctttcttaagtccgcctccctaataagccatagaagcactctgcggcaattctttcgcgccactctcctcaagttcacgtccgctttccgaactatttctgggccaaagggaggcgaaattgaagcttcccgtcctcacccccacggcttgtcctccggcaaaggcttccaggtataagtggtgagcatttggaactttttgggaggtgtcgaggaaatcctccctcccccctgcgcaaaataatatgaagcacagctgacccattcatgtaccccggcaaccatccatccaattaacactgctaaggaccagtgctagaagatccagagtctaggggcttatgtgggcccagtccctgaggagcctgaaatttatcagggaggccaaaaagacaaacacctatggcaacaggtggaatgtggtgaggagaaaagtattctccgattggaggagcactcacggtacagaaagaaggatgaggggactccacaggctggggagcttgtccccaacatggccgaggtattcctggctcttcacagacccatggacaaatgccccaccatcagaggacattgggtaggctgcccatacaccctcagcagacactgggcatggtacttgtccactgcgttagacctttcttgcatgcaatata

SEQ ID NO: 15061 - DNA, 983 bp, Homo sapiens
  misc_feature (1)...(983): n = A,T,C or G
agaccccccgagtatccccaagcataagcaaaagcacccgggacgaaggtgacggggcagacaaccgccgaaaaagttgaccgacacaaccngcgggaatttacccggggaccaccagccattatttgggttaagggcttcccccataaaggcaccgccaccccggcttttacccacggcccccccaccgtggaagaccatttaggatacccgcccaaagggccaaatcccccggagccgaaaagacaccactccggaggagggccccacacccccgatgacgcgagggcgtgtatgaatttgcccaaacatcccccccacaccggcgcccagatggaaccggcactaaaaacagcgggggggaagggggcccgcacacagcgggtggattagaatccaaccacgcggccaccgccggtgttaatagttcaccccggggtgtccagtgtgtgttattgaacggaacccccctccttttttccccccccccgcgcgacacgacatcttttctggcatgtgagtcaccggtcggcgacaaagcaccgaaaaattacaataaaataataccccgtcgtcgaaaggaggccacgcaacccactccacaaaaacaggagtgaccttggccccagaaccgggcgcaccacaccatctgtatcgtgatatgaaaacaaacaacgcagggccccgtgggtaggggcgctggggagacgaagctctaaccaccgcgccggatgcgaggttaaccaccccggggaggcgacagcgtcgtcatatacgggccccgtcgcgcgagatgtcgagcgggagtagctggtctaggagtgtgtggggctgcaggagacgccagcatagggtccacgcacgtccactcaggtcaccggagggcgcccgccaccgctccgtggtttgcaccccccgcgccaccgcttactcgcacccgattcatacacttccagacccctacaatgttgcagcacgcctcg

SEQ ID NO: 15062 - DNA, 955 bp, Homo sapiens
gcgccaacaccgccgggatacagttggaatgacaaagtttttttgtcctcgccgccgattttcactgaaccgctacacgcaatcactgctactcgaccaccactagtcgatcttcagctgtggtgacttctccattatccccggataccgatcgaatatggttctatatagagagaatacactattggctctccgcataatatctgagtgggtgtcatgaccattgcgcacactgctcctggaggaaaccttccaggcatactccttaatgtaacccttgggtgtttggagacgcttctaataaaccctttgttataacgcaaacagagcaaatggtacccgtgaaatagaaatatccttcgccacaaactgatcctacagcatttagataactttgaggggaaacacactcttcgttccctatctgattgaaagctactagcttggttctgtcaaacggaattcactccttcctcatcagatcacctctagtgcaacacgagaacggtttggaaaaaacctgtgcctccccccttgtgggaggaaattaataaatggtgggctgataacgccggggtctttattgcgctggctacataattatctaacccacctccgcgcaactttcttagtaggacatgaactcggccaaagcaagagcgtaagtccccctactcggtgttgggaataaccgcccatttcttctgcccgaggtctaaacggatctgagggagatggtctaaaatggtgccaaatgtttgaaactttgtgtgccaacaaatcacaacaacgcggcgggcgtatgtacaatattgtgtgaaggagcaattataataaatattttctctaagattattgtataggacagcttgtgttggcattcgtggcataccatatggagttacaagacgcaagccctgctattgtttgtgtcggcactgaagaaaaatcgctg

SEQ ID NO: 15063 - DNA, 1222 bp, Homo sapiens
  misc_feature (1)...(1222): n = A,T,C or G
gagaccgaaaacgaaaacacaacacgcgccgccacaccaaaaagggacgaaacctaagcggggaaaccgcacaaaaagaaactaacacacgacaaaaccgcgacaagacaccccacgacccagcgcggggacgagatatatccgaagaaaggggggggagcaccaaaccccgacacaaaggacagagagagaaaacaaaaagaagacccccccgcccgccgccgcgcaaagagaaaaaaacagcgaaaacagaagcagggccagacagaaggacagacagacgagaaacaggaaggcagcgcgcagccaagacacaaatagagaccacgccacagcagagtagaacaaacggaacagaaaggaagagctagaaaaacagagagggagaaaacaacaccgcgagaaagcagcggggcgagggcgcgagaaccgcagaaaacccgacgagagcggcgcacaagaagcaccgagagaaaggagcaccaaaacagaaaccaggaaacaggcacgcgacggcgcgggcacgaaatgggggccccccgccgaagaactacaagagaccgcacacgagacccaagcaagagaaggagaaagaccggcgaagacaggaaaccggaaggcacaccgcgagaagaagaagtaaggcgcagatcacaggaaggcgacaagagaacacagcacacaaaggaagaaagccgacagcgacggaaaagcccatgacaaggcacgaagagaagagatatgagcaccgaactacaacagacaacgagcaattaaagacacaacgcaggcgaagccgaggaacataagacaccagtatacgcgagccgaacaggcgangtacgagaacgaacaacggcgacgacgcagatcaaacaaacgaacacacaccagggcaagcgaaacgcacggaacagaagagcgcgnagaagagcagtgacgacagacagaacgccgacaagaaggccacggtaaacgaacgcaacacaccgcgcacgcgcacaataagacgcacacnagcaacgccccgccgcgacaagagcacgaccagagaacaccgagcgcggagacgacagagacgacagggcagcagccatgaacagcactcgcgcgcagccaagcgcgccgcgcagcaacacaaaacagaatgagagagagacagccgcaggagagagggnaacagagagagagaggacaagaagaagtagaacgagcacgagcg

SEQ ID NO: 15064 - DNA, 223 bp, Homo sapiens
ggcggagtcgatacaggtcgcaatccctgccgtaacatggtcgagttttcttcgcacacccaccatgtacgctcgctcgcacgctaacactgcgatctagattcaggtgtgcttgccacactggtgattccctgtcacatgcgatatgacgagccctatccaacagtgggaaccctccaagcttcagaaacctccgcgcccagatgggctgactataggccaa

SEQ ID NO: 15065 - DNA, 1744 bp, Homo sapiens
  misc_feature (1)...(1744): n = A,T,C or G
ctagttacctacgcgaagtantcntctcagcaacgcgtagtatgacgagagaatgagcatcaccngagatcaccagaacggtttcagttagacgcatagaaacaacacacggcgacaagtacagacgccttgcactataatcacagtagaagacactactacngagagagatatatgatcaagcncacangttagagagattctactactcagncgcgagcatcntgtatatatnagtgggcgtgtattgaagcgcgacgcgacgtgagtggcgagcaatcagctgtagaanatgtagtaccacgtgcgatcgggtatatagtcancacagctgcgntcttagttgagtatgcccacaacacngagcgctactctcgcgcagacccggtgctaaanctcagtacagatgtcgcggngtgctctgcgatatatatatnacatcgncatagcactactatagatatcactcnacagagaagtgaatctncggcanatcaccnttcacgacactnatcntccggncgcagacagatcagtgtatggatgtgctgtgtgtagcgtagggagaagcatacactacacatacagcanagatgacacgagatgtgcgantnatgatcagtgtacnagtangtagattcctantactgaatctntacgagcgctcacctatcgataccatacccgcgcatagtaatagtgagtgagcaacatacacaaagtatactatcgcgngntgtgtactacancanacctgagatagcaganacngcgagtcgacgtagtatacgcagagctgtcgaagctatcagagtcagcagtggaagagagtgtgtaggtgtatatatcgtatgcacaccccacagagctgaggcgaacgacnactacagaggatgtactgtgtgtgatgaagttcgcaacacacacaggctgcatacncacatagatgtgtgcgtcaccatatcgacacagtcttaattatacgtggtgctggatgtagttatcgccacacacacacgcatagtaggtgtataaatgcgaagtcgtgttgtagctgactaatgtgaatanccaacacatgncacatctaacacaccgacgagcgacaacaacaatgacttatcatgcgtcagagctaacgtgagtggggtgtgatntgtcatgtgcgcgaacatagagagctcgctatggatcacgtatacnatagcgttatgtattgatatattatacaccantatacacacgcactaccaacgcctcgttatcggaatgttgcctgtactagntaaanagaacactaccgaatacanatggagcacctgttgtagtaatatgaacacgagacgatgtaaatataatgcagaattagtaacccaccagcaagatatnatatgacatcataatacagtctgacngntgagtagaacaacgaagatacgatgcaagtagtggnatgacggcaacagcgctcaccactagaagccgacantatcgtaggcacgactgtaatcacgcttagtgtacgccacagtcagcatcacaacagacaaacgatatgatacatcacatgtcgcatatacatattcantgtatctatgtattcgtgcacgcgacccacttactaccctattgtttattcacctcacgcacacgcttccagcacgtgtnctaaacgtgtccgcataatantcgtgncacgcacatcgtactcgcgcacagtatttatccacatcnccacgcgccg

SEQ ID NO: 15066 - DNA, 1007 bp, Homo sapiens
  misc_feature (1)...(1007): n = A,T,C or G
cgcgccagtcgcacagactcacagtttgtcgacgacagcgtggngaacaggcaaatgaggtatttctgtttggtccatcagcacgtccgtatttacagcttgaatatccgcctacacgcgagtagcaggtagacttatcctgacacgacactacgtagtccaaacgtagacagctggcgtggtggactcttctctactttaatccacgcggctagcaggtcatcatacattcaataaggtcataacttgcatggctaccttatgtatccatacgaattttctgggggattacccgctatcctttaaatgggaaagctattgaaacatgaagcatgcgcattcctccattcattgccctcgggaaagggagaacatgattttgactcaagatcctaatacaataaactgggcggattcacttgatgtccctgtattaactcaaggcgatgctgatcttcatgacatggaaaaatggtgatctataaacattgattcacgggggaaaaggtctaatcacttgggtatcttcccgtgaaggaagggacccaagtcattcttcattcttgcacaagaaacgctctcgtacgtaaatacgttttttgtcgttgttatagtatataaattggtcgttttaaaatgagatgtttattcgcctcttttatctttgctttgcacactatgtctttcctactgtactatgctctcaccattatatttgtaggacggctctattattgatagaaattcctgtccgtctgtgcattttggctcggcagtaaggagttgcgttaaatatcttatgaatcaaaaaatctattgcagtcccagcctcttacggtttgtgtacggttgcacttaagcagttggcattggtttatgaagccaaagttccgcatcctattgtgtttggatcgctgatttctcggactcttgtagaatagattggagacatactggtagagtggaggctatgacgtattgagtcatagtgcgtgtcccgatccgct

SEQ ID NO: 15067 - DNA, 1042 bp, Homo sapiens
  misc_feature (1)...(1042): n = A,T,C or G
cagttcccagattatcgcaatcatatccagtagcgcaagcgcagtcctacgcggaaaatccgcgggcaaacgttcgcgggggctgcctcccgggatttagcacatcggtcgcagccccgaaattaatccgggtagagaggcctcccacgcccaaatacataaagcacgacccgatggttggcgccacagactcccactccgatttgatcgcgtatattgccaatggtaaccccagtaggtccaccaccgaggaaccgtaaagcgctgtggaggcccaattaaaccccataacaaatagcctggggggcggacgagcactgctccaaatcgtcgccgactacccattgcgcaccccgcccgtaggaagaatgggaaggggggggctaaccgggcgccccagacaagacgtggtagttagtttccacgccaacggccgccaccggttttgttggtagtcatccatttgtctccgtagaagaagcgctcacgtacatcaacggaattatgtcgccacacagaggagtagnaacaatcacgaggggacgtaggggtcactggccacggccgcccacaccactcatttggcagaaanattaatgttaggatagtatgatcaaaaatacacatatggcttggaatatacgttcggttcggccacgagtcgccgaaaccccgaaaagtagtggtcatacggggagcaatccgtagactgtatgagtgtattaacgggcgcggtattacgtgtaggcgcgtaggacagcgagctgctaggcttagaagacgagtggaacatgcgacgccgaacgagacaggaggacgaatggcttgaatgaggtcgcatgatcgctgaaatatgagtgtatagacaccacgcgctcagagtcgctatatgcgaggatgcacttctcactagtgtccattgattgtgcgtcccgcacgagacgcgcttgttacgcacacgctcacacccaccgattattgacatttccgtattgttggtgtctacctgatcatcacgacgtgtatgtttcacaccctactg

SEQ ID NO: 15068 - DNA, 1268 bp, Homo sapiens
  misc_feature (1)...(1268): n = A,T,C or G
cgccgtcccacgccctcggatgcgagtaaaaaagaaggttttttttgacccgagaggcccatttctactgaaacaaccccacgcaggacagggcttcttgacgcaccaatgactccacttctataacccaggagggtgggcgggtcattcaattaaacaacaccggcatacagggcgcctaatctctagcatcgatacaaccctactgaggaatcgcgcagagggatgaccctactgcgcactcngtgaatccgtcgcggtactttacaacaagccagcccagacacactctaagcacactaacgcaacacagataaacgacaccatggatcactccggagaccaactctcggtaagatcactagaanttctgtaatgcgngtggggagagcgcgggcacgcgaagattcacacctccgtgcgagcctctctactagctaaatgtcggggagaacccacatctgatacacataagacacacgccgtacatccgcggtagggcagcgctcataatatctgtaacctacgtggcgactcgatttcccaagaaaaacactgctcgcgcgcgcctattgacgcacacttcccctgttacggatggacgcaaaacacagcagcggcgctgcgcatcgcgactcaaatcgagtccactggcggcccccccataacatacgccaagagagtcacagcgcgctacccagagcatactgtatagagtaccacgccgctaccgccctagcgcgcgggcgacggacgcgtaagacaacgctcatcgagcgtnggcgggcttcctcacgctaggccatacgacctgggagcaaaacgtatggaatgggagggggcgcacccaccggggttctattagtctaacacatcattacacaaacgggcgccaatgtcacagtggtgaaatgcggggctggttacaatacgatatagcacataacaganacgaatgtgggaggagacgaaggggacaacagagataaggggaggtacgtgcgcggaaacatactagtgggtgnagaccagaggcnggacacntgtatgagtgagtctcctgatacagactgtatatctcggtgtaggggtnagaaccacanctatagtggaggtgtgaacagtcgctcagtggacatcggctaccatcgagggaacacgcgaaggatagggggcacaaaatatgggacaaacacaaggggaaaacaccgcggaagaaccgcggcgggggagaaatgcgctgggggcgggagggaacacagacaagg

SEQ ID NO: 15069 - DNA, 772 bp, Homo sapiens
tccccagtgaggattgtcaggcctctgagcccaagctaagccatcatatcccctgtgacctgcacgtatacatccagatggcctgaagcaactgaagatccacagaataagtgaatatcgccagttcctgccttaactgatgacattccaccattgtaatttgttcctgccccaccctaactgatcaattgactttgtgacaatacaccctccctacccttgcgataatgtaatttgtgatattccctcacccttgtgaaggtactttgtactatacaccctccccacccttgagaaggtactttgtaatattctcccctgcccttaggaatgtactttgtaagatccaccccctgcccacaaaaaattgctcctaactccaccgcctatctcaaacctgtaagaactaatgataatcccaccaccctttgctgactctcttttcggactcagcccaccttcacccaggtgataaaaaagctttattgctcacacaaggcctgtttggtggtctcttcacatggatgtgcatgacaaggatgtgtgtttggaggcaggttttcccctttcgcccttggtaactcacagtttctctcctgtctatggaatttgcagaggcttgctgcttattttaaataatctgtgaattatttcagttttctttggtacattcctgcagtggttcttggagaaaatccggtgtatgagtctccacacacttttctatctggccaagtgggagctggacattgtcccgtctggtatcctgcct

SEQ ID NO: 15070 - DNA, 871 bp, Homo sapiens
aattttcggcccttcccccgggtcatggagaaatcgcagagaagccccccccctgttttttgcccaaagggacccaccaatgtccgtaggaatccgccatcgcctcctaatccccgtgtttttattacgcgtttattttcaccccggcacccaccgatatacaggcccccaaaggtgtcccagagcctttcaagaatatttggaaacctcatctgagtatataagtagagatttgagctcctaaaaatgaaagtttttaaaaataaattgcgctttaggatgggaaatctgtcctcatatcattaccaaaaatatgctttggatccccctttgcacgtcctccaacaccctatatcagtcaacaggccaacacaaaacagatggcacactccaaataaggcacctggaggagggtgcatctacaacggacctagttacagaggtgttaagtacaggggaatcgcgagaggtagtgttgcaatctaagactcagtaaagagaagagagaagagattagttaacagagaatttagaacagtgacctggacaaaggtcagcttaccttgcaaggagagagttaggcaaataatgccctgacctcattctgcaactccccgctaaacttctggggcttcccattggttggacataggggatgttagaacacatgagaacctctcaaaatccatacaggccaggctctcagagaagacaggagagtgaaaaactggcagaaagtggacctaaaggagaaagtgaaagatgctcagaacaatattcttattcagaggttatacaaagattgttttaattaaatatacaatatatgctggaaaaattagaattatgaacaataaacaaagatcggcag

SEQ ID NO: 15071 - DNA, 1057 bp, Homo sapiens
cgaccaccaaacgcccggcaaaagcgaaaacaagggggcctgggggggacacgcgggagaagttagggggcaggacaaggggagaaacacccggggcgcaccggggaactcgcagggcaaaggggcccaccccaccaaaggggacgacgccgcccagcggcgcgggaacagcgcccaccgccaacagcacaaggcggcgagaagagcgcctccaaagaaaccccagaacagcggacagctaacacgggggagaagagccacaagggcgccccggaggagcgggaaaccccacgaaagcctgagaaaccccgagaacgaagccggggggacgggccacaagaagcaagacccccagaccaaagtgaaggacaaagcgagcaccaccggagggccagagaccggcggcgagacccaacgagccagacagggcgcggaaaaacaacaccgaggccccgggcctcgacgatggaaaggaaaaaaacgagcgagcgagaccaaagaccgggaaaaagggcaagcacagggacagaaaccccccccgagacagaagaaagcccagcgcgcggcgacacagaagtccagagacaaaagcaccccaggaccccgaacgtcgcacaaaggaacagcgacggaagagagggacccgacggcgacacaaaaagaagaaagagcgcggggccagggggcccctaacaaaggacgcaacgcacgcgaggggggagagaggagagacccccgccaaacgaggggccggagagaacaccaccccgaggacaggggaggaggagaggccggcaggggggaggcggaaaacgagcgcggcaggcgagcgcccgccgcgaaaggaaccaagagggcaacagaagaggagcgcaacacagaacacgacaagggacggcggcgcagccccgcgagagagggcgcacaccacccgatgaggcaacgggagcgacgccgccccgacggccgcagagtacaccacacacacccacaagcggaacggacggagccgaaagaaacgcacacaaacccgcgagtagggaacccgcccgcgaag

SEQ ID NO: 15072 - DNA, 1185 bp, Homo sapiens
  misc_feature (1)...(1185): n = A,T,C or G
gtggcagcgattatacatacagtagttatcttagtacaaatgtgnggngcgcccgacgcgantgttttttctctgttgtncagctgcgncacgtctcttattttacagcttgaatatctcgcgtacaccgcgacatacacggagtttgatctggtacaccacaacaggtacgttcgatactatacagacgtgacagattgacatcttaattacatctacaccaacgcgggatagcagggcacagtcatcatcatcgtgtgcaattcatcgagactgttttgtgtttgcgcaatctcgcctcaccaagagcaatcatgttgngctagtgcaatgctccatccagcaaaaggcactaaggttattatgttcacgctcatcaggtctccctaatctaataaatatagttatagtaaactatgtgaatactcttcggtgtgggaagctaacacacagcagggtgatattaccttacgagtgacatccgaatcgccctctctacaaaataaataaatggtgctcgcatgaggaaagaacatcgcttcgcatgtgagtacccatcgaaagattgaaaatgtgggcgggagacctgcgctaactcctctgcatccgaccgatgatgggttttgacactactgtttgtattattatcctgtcagtaattgaggcgtattctctcatatctcaccctcaatataggtaacggggaatgttaacaatattgtgttaaacttactctggttgttaatgccaggtattttntgttacagctagaaatagtactaattttctttgttggccttcttattctcataatatcttggggtcatactctcttttggttggtgaattgatttttgtattggggcggcaattcctctggtttccttgttatatattggaaagaaccataatccatcggcgggtaagttagttcctgaatacatgtcttagttggaatgacataatgttttatagttgtattcagactccatttggtaagagcgctatctacctcgtaagcattttaagtatttggagatctcagtgttagttgtcgtaccgtgtaacagctattattatgattctctcatgactatgacaaatagttaatagttaataaatacgcgtgacccgtgaccagtcgagatatatagaaacgcgcgacggccgctgcacgcactcgcc

SEQ ID NO: 15073 - DNA, 812 bp, Homo sapiens
  misc_feature (1)...(812): n = A,T,C or G
atgctgcagaggctctcttaaacttgattctgttttttcctggggaaaaggccaaaaagccatctaggcctcaaccccagcatctctgaacctctgacccagccctggacttccaaatttcagacttctttcaggtgagacaagcaaaccacatgttttttaagcctctgctattcaggttttccattgtttgcagcctaacggagccctggctgctcctgtctggagatggggcatgtggacgaggccttggagaggccancatctctcacctcctttctagcccacagctccaggcacgcagactcttcctgtgactatatagaagtcatctatcttcctaaagccataaccagacagaccttctgtcaaaaggcaggagagttgggaacgggctctttgaggccacagatggacactgtcattgacccctccaggatcctgtttcctgacatacacccttgattcaggtcatctggttattgtgagctgggtcataaatcttaaggagctccctttctttgcaaacaactatacgcccagaattctccttatttataaaacaatatgtattgctggttctatggaagggtttcaatcctcaaggggctaaaattcttgggcccttttgccttttaaccctagcacacatgctgaagagaactagagttgccaagaatttttttttttacatgggcttcaacaaacccagggtagtggggatggcctatttccacaaggcttaattaaggtgctcctcactaaagggaatactatgttgtgggaaaaaaaacttatggcctgaaaaggta

SEQ ID NO: 15074 - DNA, 855 bp, Homo sapiens
ctttccctcaccaccccgaacacgctccggtttttctaggggtggcttaaattcaacagcccctttctttccacacactattctcccaaacaactcccttttataaaacacaaattataccggtttcatggaaggttttcccccctccggggcgcaaaattttgggccccttccgccttttaccccaaacccccccggcccaagaaaactaaaggttccccaagaattcatttttaaccaatgggcccccacaaaccccggtaatgagggaggcctttttccaccaagcttcatttaaggttttccctccattaaaggaataaatatgatgatgtgaagcagaccatacatgctgcagaaaagtcagaaaattccctcctggtgcctcatcatcattggggtgaggggaacaaaaggtggaaaaatcgattccaccttcttattcttggagaagaaaacaactctctagacaagaacatggaccagcaaacagggagagactgatttcagccaattattgcagttgccacatttctcaggagtgttgatgtccaggtcggggctgacccatgaatggtcagcaacacactcaggccaacaaagaaggagcaggcctggctgtgaatgaagcatgctcgactttagctcgtcatatgagcaggtcacagagagcagatgcctgtgggtgcttagtgaacactgcagggcatggcactggtactgaaagggactacagaagcagctttccataagacatgcccaccagtgtgccatgtcagtttaccatcgccgtggcaacacctgagagttaccacccctttctatggcagtaacccaataaacccggatcggcag

SEQ ID NO: 15075 - DNA, 1245 bp, Homo sapiens
  misc_feature (1)...(1245): n = A,T,C or G
cagtttcccacaagttatcccccagtgcgtgtatcggatagaaggagagccgagtgcttctgcgggcagtacatagcgcctaaananatgttcctcgtgacgaccagcacatgcgcggaatattataacccagcgtagagttcatcccgagttgatgttgtttctgaggctttaagagagccctattcccacagctaacgtgtgcgttacggcactgtccgctgcgtttatgtacacacaacatccctccagaccgttctaacaatggggtggggccctctttctgtatcacacaacacagcatgtctcgcacgaaatgttgtgctacgcgtatgtgttagagcagagacacgctcagtgggccggtgacggaagacgtgatatggccgcacacgagagtttttgggaggtagacgtacgtggaagataaacatctgtgtggggaacaaacagaattattatacgttttaaagcggatagattacgcgcccccctcttcctttagagatggcaggtcattccgatgtgagtgcttcaggtgagtgttcggaggtctggtttgttttgccccgcacagaacatataacgccccgtgtgttatcgagtgatcttcccagtgcgctgcagtcatgctagtggatggcacaatggttcggtggcatgtcttgacataccactgtggactctctcgatttcattcacttcttaacgtgctaaataaactatcacactactccacatccccgttcacccgtatcggggtatacggagagggactgttggaactaaacaaaacgggcgcgagaggatatggctgggtatggaaccatgcagaacacccacccgatcatgtgtatactcccatgcgcagcacacacaccgatcgggaggcatgtgacttgtnattgtcgtgttaaggagatattaantgatgttcgcccgcctcgagaatgagtgaaatcgaggcacgtagcgccacacgcacaacagtntcatatcgtagcctacagacgnacgagtgatcgagtagaatagcatatagacgagagaatatgtttcgcaggggacgtatgaactngattaatgcgntgacgcaccattcgatattacgtgaccggtgtattatagatacacacatgataacgcttgtatatacctcactccatcgcaggaggtgtggttggtggccgcgaattggatgtccagactcatatcatccggcgtatttttctctgccacacctcg

SEQ ID NO: 15076 - DNA, 1221 bp, Homo sapiens
  misc_feature (1)...(1221): n = A,T,C or G
cgcgccgagtcgtccatgttctgtgagttgttcgtgctcnattntttgnccnacagagcagaanctgttatttcctgagtaacccacacacacactgtaacatatgtcnacttctngtctcattgtctcntcttangtggtctattcttggagtgcggatcgcacgtcactcgttcgccacgatgtttctcactagctaccgggtggagagtggggtgggtgtttgatacacgttttgatagagatagcgtttgcgcactgactcataggttggaccgccgcagcctttgtgttgtgtaatcgatatatacgtcgcgctgtgagttgggttcaactacaatattgatcnatacgcgcctacagccttatttctgctcatttttatacatatgttgatggagagactcaaattttcatcatgattgaaatcgcaatacacggggggcgggatctaccaattactagtgcgcagatccagatttcacgaatgtcgatttnatcacaaatatgtagtgtggagtcttcggtagttcgccgggtcgccatgttatttattttttgtgcggtgcgctaatgtggctggctccgcggagttatccatcgcaccggttcggcggtagagttcgtgtagttaatcctgtgctctatattctgttcttctagatatcgtcccatttccacgtctacatgatactctctcgatctgtacacagaggtgagagagntattattatattttaaagatgttattcgatttttgtgctgtcagattatgtttacataacatccgactatctctctncagtgatgcatctcactcttttgtgatagacgtgatcacaccgtctgttctgtttcatgttttactagcttgtctcatgttcacataactacatatagtgatgctgccttctatcagttaggtgaagacttgctcggctgctcgcggagacctgatacctgaaacaatctgcggttagatgagcttagtacaatgaggctagtcgatgtgggagccgacagttcttgtatagtagaagagttttgttaacatactcatgcgatattgatgtgattcgcgcaccgcagtcaattggcgcttagagtctctctatttattgtgatgcttctattataatatagtcaattgagttgatgagtgcggtgtcccagcctctgctgtatatgcgattcgtaggtgggtccgcgcggcgatcgcct

SEQ ID NO: 15077 - DNA, 956 bp, Homo sapiens
ccatcccgtcatcgcctctgacaccagtaaccaaaccgtatctcgccggagacaccgccttaaattttcctaaccacgccttcggaattcttaacgctggcccttccagtgattttattgggcacatgggccaacctcaactaaagggtaacgcccgcaccgcttttaccccacgagactcgaaataacatttagaagccactttcgtccttcccatcgctcgatggaacaggaaattcgaaccacgggtgtccttcatactaagaaacacaggagggattttgcggctagatttagcaaagtcaccatataagacaattcgagggtaacactgggcgaaaatataacatgagctataaaaaccctcttccgaagtccaagaaaaaaatatggtctcagaaaaaaacacccgggggtaaaaagagaccccccagcgcgcccttagaatgctgtgccctccttggggggctttattcaacccccctttaattctgaaatccataagatctcttttactcaagcctttctttctacgcccaagttatcccagatttatgggtggtaaggttggccattcaccatttccgagtatctatgtttgattacccatatataacaagcaacagacgttgtaataccggcccccagcacccaacgtggagcgcgtcactctagtatccactctccctttttagtttcagaacccagtgtgattatagatcactacctggccctgtacgttaatagttgagaatgagcactagctttcacaacagatacgcactgctgttacccccttgtggatccaatacatatgacgccagagagcacaagacctaacagagtggtgcgattggttgactccaaatcgataccactttatacgaccgcaccctgctgttttttttcttcgtattttttcgcacacattctactcaatttataacaccccacta

SEQ ID NO: 15078 - DNA, 1138 bp, Homo sapiens
  misc_feature (1)...(1138): n = A,T,C or G
cgaccgtccatgatccgggatgtggcgtcattgctaaaaacaaaaggttttttttctcgaagcaaaagcgagcaataaatttatatctgtatgtatactcccgaagcactattacggagagcggtacgtaataccgagtgagtatatagccaaggcggttgtgtggccttttcctaacatagaaactgggtcgtggcaccaccagctcctattcataaccccacacgttgtttatgacattcaaactggaggagtgtatgctcatagtaagagactgccgcagccatccaccgctgttgttcggccatttcgacagcttgagacgtcatatccgcgacagacatgaccaccagacagtcagcgttccctcatgtggtggcgggagntcttctgggcnatagatgatatgatatacgacttttacggactgcaggcttatagagcagtgacatatgctggacacaaagtgttcgggtctgtatctcgcctcgtatttttatttggtggactcctacttcacgtgatccggcctacggttctgacaataacattaccacccctccgcataatgacatagagacccatcacccgcaggtggaaccggatagtaaatgagccctgcgcagcacccacaattcataccgccaagagttgggaccttcataggcgttaattcatatggcgagcggagccgacggggtgagggggtatgatggtggaggggcgcgctcgtcagcggggtttcagcgctatgataaagatcggaagtgcggcgcgcgcacgatctatcgattgtttctgctaatattgcggtgtgagatagcatgcgcaccaaattaagaggtagattacgctggctgatttactctatgttaaagaagactcgtgctttcacaataggttctagaggacatccgctatcgatctatcgcgatacgacctgtcctgaactcaatgaccgtgatggaggagggaattgaagttacctcatgctagttggtggtgtgacttactcgcagaaagctgtcattcatccatctctgtcggcactgtaggagcggaccacgtgggttacacgataggaggcaggacgagtggggttgctggggtgaggagggggatgggagaggacgcaggg

SEQ ID NO: 15079 - DNA, 1426 bp, Homo sapiens
  misc_feature (1)...(1426): n = A,T,C or G
attataattatttgattagatacagatatcctaccgaacagaaacaacaatgcgcagtacactgagctaggaaggaggactccttactgtaatagattgacacgacgctacatagaaaaaatatagtaaacattagggacacgatattggcagtcccacgacgtagtttggccacagggagggcagtcgcatcatatatatacgatctagcagtaaagcagttaacgttaagtgttatgtagtgtcccgcgaggcgatccgcnttantctgcattctgattatgctccnctgtccatntagtccaagcgtgtgtagctagggtgagagcgttgacggtactattcgccagatatggcggagcatgagagtaactgatgtgtagtacagacgcgattgtgagtagaagaaccgactattagaattgataatncatacgctatcgtcatcgacgagtactatactatagcatacgcgtgatgatgagagcgatgatcgacgagcagatgatattcagcgcgatgtgttgcagtgtaagtgcgttatcgctngatagataccaaggtgagagagcacgcgccggatacaagctttgcgatgagtcgtaatccatgaagacgcgcgctnatgagtgtatattgcgccggccgcgagttattcacgagtgttatatgatacaaggtcactgtaattaattaaggtgagatataggccggctgctgctgattaagcgaggcactaagcggccatcgtatgattaatctacaacaggagnattcgagtgataaagtcaaatacgtgtactacggagcgatatacgtctgtagtataacaagagtttaatatttgcgctacatattatctgtagaaggtgtgcgntgtnccagtcgcacgcgaacagcaatccataaatcaccatgatantcatatatattcgcgagcagtgtggttaccagctaatattgatgcgctaggcgntggttcgcgtacatatgatatgacgagattgcgttgctcctcanccagatcgtccacccatcataatgatggtaagtcgcggatatcatccagagagtcntgttatatatgttatacacggctagagtgtcgattatcacaatttatcgcgccctcattcagagcagaagacgtaggctgatacctgcgtaaccacatctgacgactcaatagagcacgtccatagtatatacgcgcgagaagatagtgctatgacagcgcatattagcgagtataatcgaatttacactcattagnatatgtggatgtacggcatagtatgacnacacgtcgtgacggcgaatgtagcgtcatagagacgcgaaagcgtatagagaatgtgaatactgctcatcttggggcatantctctgaatgcatctgtacatacatgtgtatataatatgtgcag

SEQ ID NO: 15080 - DNA, 1754 bp, Homo sapiens
  misc_feature (1)...(1754): n = A,T,C or G
gcattcgtcccacaagtatttccacgcacagtgactacttatctcgaatanacaccacgaaggtcgcggggtggcttacctgccgcgcgataacctcgacgaccgcatataagaggttttacgccgaggactgatgagacgcgttggcgcggatatatattattgacctacgcgggcggcagtatcactcgcgcagctccgcgattnatgttctctcgagggtgagtcagaccgagtcgctacacacgcatacactatcacaatgtgcgcgagtcctattgtcggctgcgcgcacgagacggtcttcttgtatatctcaactacatgcgatagcgctgcgcacacanatactaccgatcgattagaaggctagcaacgctcgtatatgtcganacgatnataagtcagacacatcgncangcacagtnatggtagtgctcgcgcagagctgtcntggntacgcgtagcgcacacactacangnagtagatcnanagcctcgacatgangcacagagtggagagttgagagtgtgatcgacaactccctcgtactgtcgtgctgtcgcacagccgtgtgtgtagtgtgaacgacaccatgatttgatcnatgcgcgcagtcagtgagacanaccactacgacantattnatacnacntngacgancagtangtacnancacgatgctatgtcgagtgtatcaactcatagacgggatttgcatggcggtgtgcgagacgtacatctcgatatagtggagcgccgcgtcactctgcgaccatacttgaagatgatggtatcagcattggtgtatgcaccgtcnacaagctactctgactctcgcccacgacacacgttgttcgctgtctgttantattgctacncgagagatagggcgacgtgtgacgcgtntaggagatagaagcacgtcagtctnattngcactactcnacgatgcagagtatggctggnagcactcacnancacgcagnantcatagtgatatganagttgncaaggcgcacggagagtgtgtacagaatgtatngttcaccgacaantgtcacacattatccaccacgcgagtcacgacatagacgatgatacgacacatttatgtagagntagagcgggttngtgcgcaacnctcatcgtacacacgagacgactgancgcagnttgtactactcactacaccacatatagggagtccgttagaggtacgcatcttgtgtcgtgntcacacaccccaccgacgctcntgattagtgagtggtagactgacgcacagataaaccacgaaccntgacgcatgtgagtagtgtatgagatatgacgagtgctcgtgagatgatgcatagacgcaccgaggtgttactgaatacacatgtggcggtggcgaatatgangggatgtggaggtgtacgatgcgaaacgtctcgtgtgttgtcgagtatcgctcgccgtctgcgtagcgcgatgcgtacgacacgcaaagagatcgcagtccgcgatctgatatagtntcacacgcagcgacacgcaccgcgcaatcgagtagaccacgccgcgcgngtgtacacatagtctgtgtctgaccgtagattngattgtgcgcgtcnctcggtatacttcacgtgnttatattttgtccacacacacggccgtgaggcattattgaggcgcgctcgcgacattnagtgttcgcctacgcagttatgcgcggacgttatagtgatgcatccacagcgaatcg

SEQ ID NO: 15081 - DNA, 1066 bp, Homo sapiens
cgccggcacccatcccttttataaagatatcaaacgccaaaagagtgttttttaaccaacacgggaacaattatcatgtgtcgagacccctttgggatctctggggatacccaaagataccggggttcccacccgccggggtggggttcttcgcaacacttatgtggatattcagcaaactcccacgttaatccccacacctcttgtgtactctttcgtgaacacgtggggtctgctataaagagaccgtagccgctccgcgcgcctccagcatacccatcatatgaatagtcgggaagcctacctatagaccgcgcaaacgtgcgtcctctattggggcggtttaataacacatacacctgctgagtatcgcattacatgagcccgatcttcactcgtctacctcagctgatcatcaaacccgtaaatcggtatagaatgttcaactgtagttgagacttcgatttatatatctttaggtcgctgtcaaccatcgcacccttacgcaacaggacatcgaggtatcataaatagatcggatttggctggtgtgataatgtacaccaccactcgctgcgtgaaatatctatcgagttgtaccaacgagacaacgttggtaaatataaaccgcaaaataaaaaaggcggggtaaggaatataatcataacggggagtggtacaaactgaggaaactcacgggcaaccatggtggggtggacgaacccgagggaatatagtgtgacgtacaaatcagtgggaagggaaggggaaaaggtgaacaaacggggggtgtacacactggaagacaggacggtgatggataaaacgaataggttgtgcgcggggaataaaagggacgaaacggtgggacaggagggggaacaacaactacaaataataagggagtgtgataagaaaatgctggggcaagtgggaagggaagtgcaaataaatgcgacgaaaaattgatggcggaaatgtatggtgacaataaatgtgggataaacatgggtcgtaatggtgcacggctggaatggggtgggagggcgaaacgaacaacaacacg

SEQ ID NO: 15082 - DNA, 1187 bp, Homo sapiens
  misc_feature (1)...(1187): n = A,T,C or G
caaacaccccaaaaaccccgcggaaggacgaagaggcgcaggggggccttaatggggggaccaacccgcaaaaaaggtcgcggggcgaggaacaaggcgagagaatagcacgccggaggcgagcagcccagcggcacgtgatgggggacggagacacgagcgccccaccccaaacaaaaaggaggggaccggccaagcaccccgccataatagacaccacacaagcgccgcccacccccaacccgaagaacgccccacgcccaaacgccccaaccgaggggccccacaggtaacgccgacgaaagacagagccgcggacaccaacaagagaggcgcgatgagagacacccgagagagagacaccgcggcgggcgacgggaggggcgaacagcggcggataaacggaggcggcgacgaccaagaagcacatagcaggaaggacagagcacaccaccacacccgcggcaagngagcccgtgagagaagagggcggcaaacgaggaagagcacaaaacaagaaggaagcgggggcaagcaacgcttgcacacagcagcacaccgcgcgccacgcgcgggcgaggcggccgtacgcacccccgcggcacgacacaaacagggccgcacaagagcagcgaatagaatcaccggcgtgcgagagaagctgcagcagcgggcaccagcggaaggaataacagacgaggcggggggcgcaggggtacgaccacaaaacacagacccaccccacgaccaacagcaagaccgcgagcaagagggagggaaacggaggcggaggtcaacacagagagaggcggagccagcagaggggcaggagaccaggacgagcacgcccacaagcgcagcagaggcaagacagcgcagaggccgaacggacgcacggggacgagagaagaggacgcaccacgacaaccaagcgaccgagaaagacccaacggcgaaagaaacgaaccggggagcgaacacagcgaagaagacacgccaccgaagcgagaaagaggacggcgacagacagcacggcccaagcccacgcccacacacccgaaaacgaacgaacccaacccagcaaacacgcaacagaagagcccccaaaaaccagtaagacgcgccgcagccccgggagggggcacgaagagaggccgcgcgacagccgcgagggggccgcccacagg

SEQ ID NO: 15083 - DNA, 1629 bp, Homo sapiens
  misc_feature (1)...(1629): n = A,T,C or G
ggtccgactcgccagtgcgaacagcgcagtaaggaaggtcangagacagagaggngggtgaattggtttaacacaccgacgcagaacaaattacnctcatgacgcgatcccgctatggngactcctcaggtgcgaggcgtccaaaagataacagtgtttttacatgatcgcgcgcggtgtggtgggggttgctctacggaatctagaacagtgccgagaccgcacccaatacnatagctggtaggtacgacaccaactcgttgttgtctcgtgattttactcagcacagactgttatataaccgcacgactgaatacatagtaagagacgccgacgtcactagcatgtcgccgctgctccgctccgtctctgtcgtttgatgttctattcttgttcgtctagtcggatcgtatagcgcagcgcaggcatcaccgagtgtgcgcgccgcgcggcggggtggtccgcgacacctaagtatatgtaatagacgtctacttccggagcacgcaacaggcgtgcacaggtaacgtcattcgcgcacatccgggcctcgatttagcaatcattacacatgctcgccgtatctgtcacgctcgcgagccgtggcatagaggtaagagtgcggtgagagtctggtctgtataaactcagtatttctgtgcgtgttgcggagtgatgatgcgtttagtactatactactgctgcttatcagctatacgccactctaagtgtagcgcgcatcgactcgagtcgcctgcatgatagtgccacagcgcccagtgtatcagatcgcgacgcgacatcatagtgantaatactacgagtcataacgctgtgtgtgctgctnctatattctgttctcgatacgcgagagagcacaagtattgctgtatatggaaccgctcgcgagcgagcgagagatnancgacatagagcgtcgacgcttgtcttctncggcgagtcctgctgtctatcatattaactgcattctcgtatgcggtctccgcactcagactcgtgacgtcgagntgcgagcacgtacgatacncacagcttcagacgtcctgccgcncggtccncagacggtgnagagagtgtgcgcgccttacatgtgngnagcgtacgacgacancgagtgacgntatcatatatgcaatcccntactcngcgagatgctagngngcgccgncnagttgcacagctcntcagcantcgcatcgcgcgtactctacagctgtgtgtctgctacttggcgttgnacagtcatactgatgcgactgcgcgcanancccgcgtngctgactgagcgngnactgctgcgcgatacttatatctgcatgtagagcgagtctgtagcacactccgtctgcggagcgtattatnagntacactattgtggtgagtgtggacacgagtcgcacacacgcgacagcacgtctggtactatcgcgcggatcaatcntgtatctgacgatagangcggcaccgntagatagtgcgccactagacaacgttatgtgtgtcgtaccgtattgcgggttcataccgcacggcgtgagtgcagcagacgnacactgcgcgagtagtcgcgcgaggagcgctatagcgagataactagcaccnancgtg

SEQ ID NO: 15084 - DNA, 767 bp, Homo sapiens
ccccacttaaatggataacgcacgctgcgcttttgtcacaacactctccaactttagccgcattgcccccctgctttcaattggataccttctatgccgaaagacctttttggcccaaattctttgttgtagacctttaaacatcggcaggctgggtgcacaggagatttatgggtttaaaagaccttgtgttggccagcatcccatggtcggaaaaatgggtggttactcaatagtcccaaagtggaaactaattcaagtaaattccttctgatacgttatagaatgatccccgttcttaggcccccttgttgcaattcatgtttcaaggattttcgggcacacgtgttaaaaaaggatctttgtcggttaaaagaaaggatcctgcgcatgagaaatattatcggggaaagctgctatttttttggttcccccataaatggcttcgtaccaagaaacgaacaaaggtttgttggactccccggggaaaaaaaaaccacctgatagtttttgaaaaaatatattcacacagggcattgggaaggaccccccccaatgaataattgtggttttgtggggggagaacaccacaaaaaacccgaacaattccgtggggaggtcctgcccaagttgtcgccgaattcggtccatagaacacacatggcgtgggtccttgaagagacggccacaaccccttgtttgcctttatccaacacttttatctgagacgaaaatgccacacttccacaacttgttccctccccctc

SEQ ID NO: 15085 - DNA, 1365 bp, Homo sapiens
  misc_feature (1)...(1365): n = A,T,C or G
cgacggacatcgctgagcattggccgcccacntgnnntntagcaanagggttatttttccgaccaccccgactgacacacttttactcctgaatttttccccccctgggcccttcgggcgcattctaacacaaaatttcgatgtttgttcttacaacggcggcggtaggtgtccagaagaatatcaagacagaaattaccgacaacacaccggccgatctattcccccacctcctttttgtttattactatataacacactatagactgcaatganacacacatctagaataagagaatacagcccctccccacgcctctcctcttctgcnatcccccgtaataatgaatangatttcacacnacatctcactattttacattcagttagatctccactacgccacgtgcgggggcggcggacgtatttatctcacagtgtatcatntcaataccaattaactatataaagaatgcacacacatatacaacatatcattattctgactgtcgtagtcacaaccacaaatagagacatcattctctacgcacaatctaattatattcctacaacatcacactacttacgagtcgagcgtgtcgccgagcattagaatactgactagactcacatatcgtgcgacacatctcacacacacacattatcaagtaattccatacaaataccacgttatactgatcacntgtaagcatatagatcgcagcatcttaacctctcgcagcacaatacgataacaaactattaatataccacgacgcaaagagcgcgaatatatatagcagtcatcttcgacgctgcgcagtcgacctagagcctgtagcggcgtataattagtaaatttaaggccaaacgatagtttacctctctcaactataccaacataccaacgacatctagttcctactaaccacctcagacacacagcgagatttaatagtattttataactgtcttacactcgcacaccgccaactaacaaacactagtcaatattacattagttatttatctcacagtatatcgaacaaatgtaaataaccagtgcaatgagatagaagttgttgattcgtttataaaaataattgaccataacacgcaacatacacagtctatgaactccttacaacagcaatcttcatatgtacacgagactcagcactaatccatctgcacaatatcacatcactccccgtcaacctccatccactaatacacacaatttatattcttacattcgcagcgcgatatctagtgctatcgatagatgtcattgttccacgcactgttggtcggatgtataagcttcatactgtgcagctagtatacgcgccatcgcacactcgc

SEQ ID NO: 15086 - DNA, 1141 bp, Homo sapiens
  misc_feature (1)...(1141): n = A,T,C or G
cgtttgccccagagatatccacccatagaacaacaggaaaaccagaaagcgggagctcnctgggcagaacaccgcctgtaaaaggtgacgcngacgaaaacctatcggagaatcaaacccggtagccgcatcccgcgattttgttggggcataggaggcgcttccaagaagtaatatggagtgacgacacgccaggagtttatgtcgcacacaaccctccaccaataaaactagagaagacctttatcgaaaataaaactcccctctcaaagtgagccgctctgcttaaccgagacctgaggcgaaaaggggcatctttggagggtaaataaaatgacctcttcgaatatatgggacgatttggctcacctcccacagagcatcatcaacccctcgaacaaacgctacccaagagaggtggtaagagataaagtgtgccaacgaaacagacaaatttggtggtctgcctagccacccgggccccacgacttggtagtcgtgttgctacctcgctgaggcccgacatggtgataagtatatcgatataaacatactcttcacgggaaacgtcctcatattattaggcggccacagcgacttgggggtgaggttttataacagatgcgccttattcatggatgcccctctagctatagagatagtcaagcatttgatgtatcatacgtagacgacgcgtaacccagtgtgtgtatcaacgtatttgtgacaggtgaggcacttgtgtatcccgccaaacaagcgcgttgtgtctctaaccagagacgcgcgccgccgccggtggtgacctatttgcgatggcagcagtagagcagtgagagacgagtgccgcaaaccagtaggagggagtatgggtgacatagcgaggcggaccgacccgagtgcgtacgtggcatgcgggaggacagcgcgtccgtccatacagacacatataacattaagttaaaaatgagcaccccgccgcacccagtagttgcttccgccacctatcacatagttggcactattgacaacactccccacgagtggcccaggtgttcccacnaccgcgcatccatgtatttcgatcgtacgatgtgtattgcctacgcagattctcccaatgtattcactcccactcacg

SEQ ID NO: 15087 - DNA, 655 bp, Homo sapiens
  misc_feature (1)...(655): n = A,T,C or G
cagatgggaaagaaaatgcgagcaaaagttaacctaagctagaatcaaatctcggggcgccggtcttgttccattgtatccctgtccttgtaaatttgctaantgaacatcacatcaactctcactgtgtctatttattatctgacacttcgcgcccctgcacctgcagcctggtttatgcgtggacacctcgcgcatccgcacgaaaaacaaccccccctttatctggtggaaaagcaccgggcgtataggatcgcacacaggggaaacggtgaaagggaggaaacaacacggcacgcgtgatgataacgaagcccggaatggtaacatggggaatacatgggggtacaaaacgcggccaaggaagaaagcgagcatgactatatatatattaagatgtaaataggggtggattaactcttcatatcctcctttattttcgtttcatggtacaacacggatgggtggcggccacgcccggactgagagggttccaattgaaataaaaaatggatgaaacacaggaatggggcggggaaaacaagtcgaaaaaggtgtcgggaggaaaataaaaactgaaatggggggggaaaaattgggtgaaaatggacaaacaaaaaatcatggcggcgcataacgtggaaaaaaaaaaaaa

SEQ ID NO: 15088 - DNA, 759 bp, Homo sapiens
tgctaaaatgtgctttttctgcttgtaaagtgcctctcaaatattggcccttgggctgtctgcagcagaacagccacacaaagaaacataaaaaagaattcataggtaattctgatgatcaaactgatttgttctagaatctgcaaagacaatattctgtcttctagagccttgtctaactaaacatatttctaaaaaatattcagctgaattttttatttatgtgcaagagtcattggaatttatttcagccagaatcatgttctcgatgcaggaagcagattatcatcagtccatacagtcatctacttcccaaaatgcattttagggtaggttgttccccaagaatcgcgtattttaaaaaatgttctttttaacatctaaattaaaaaaaataaagtcttaaagtcttacagaaaaccagaatatgataaacaaatagaagacatgttttattagtaaaaatgtgtaattcctcagctatgtcctaaatgtttggaaaagtagaaagatccaatctattgccaacaatactgaggagggtgaatttgctacaattaattggtaagttcaaatgtgtaataattattaattatgagggttggcgatttgggcaacatgctgcattaacaaatttgaacctaggtttcaacaaccttgtacggagttgttctgagaaacacaaatttgaaaccaaagtcactacatatttcaagaaactccacccaccacccgatcttcaactggctgagaccatta

SEQ ID NO: 15089 - DNA, 839 bp, Homo sapiens
tcctgtagcgtcttccactccccccactaatattaacccaatagctttcgggcgtagtgtccccaaaagtgagcatactagaagatttatttgacagccaagtaaaagcattgatctttacgtctttatcgtacccactaaaatatgttagaatgagacccatattattaatagaaaatttcttccccacgagtcgcctacagcttggaaagaagacaagtcactttcttacgcctgcatacccgatgaggtgggttctccgccaaccattagcaggctccgcaggggaagatttctctactatcagggtcgcgcgcttggcacactagttgcattaacaaaattgaacctagggttcaccacccctttatcgagttgttgtgtgatcccccaatttgaacccagagtccttcaaaatattcgagaagtcccccccccccacggttattaaatgggtgagaccattaaatggccaggacccctccggaatgcaggcatttaaagatttcatatattacacgcagggcagggatggttaaaaaaattaaattgggttccaaaaaaaaaagaagtcacaagaggcatttaagtggactaggtttgaaaaaagtcaaatagaacttacagaatataacttaaattaaaagcatgctgataggatttaaccgtgattaatcaaagctaaagagaggagatgagtcaaaagatgaagccaaatgcaacaggaagggagaaaagaaaagatggacaatacaaaagacaaatcaaaaacatggattatagaatgcaaacatctaatataagcctggtcagagttccaggaagatagagaaaataaa

SEQ ID NO: 15090 - DNA, 1710 bp, Homo sapiens
  misc_feature (1)...(1710): n = A,T,C or G
aaggctcgcgcgagtatatcgcccacagatataatcacaagagagacgacagaagcgaggagcttttgatcngggaaagacataaccgcncggaatagaatgttcacgatagacagcaagaccaatgcggggaattatatacacaccgcgggaggtttcataccaaaggagatgtttattttagggcgaatgagcgcgagctctcagtgcgctacaacataattatggcgacgtatacntgcactagacacgcgagcgtctnttgtgatcatcaccacgatcgctctacgtgaacgcgtggtagacggatacgtatagcgcgcacgatgcttgttnttcagactaaactccatcgcacacgaccantccggagatagtattctcancgctgtgcacgtgtnatgctcgcggagcatgnttacatgagaggcgcatgtgagtgtctcgtacagtacgaagcagatagacacgctccaacacggtgtggcgagcgtggagtgtctancactatcagatgtgtgtattaggcgatctcgcnacaatagacgaccgcacgagtggagagcgacgcggcacttctctaacacacctgcgcttcagtacaacatctctgtgagtgtatgctactgctgngcgataatagacagaatcgcgagaccgtatcttgtgcattgttgccgcggtgtagttggagataagatggatggtgagccgcacaagcacacgtgactgacaatanagcgacggaatntagtatgcngatagtgtttctacaacaacagtagcntctacgncgaacgagaactgtgtggtagcatgnagatagctgatcgatgtgacagatatcacgtcgtggncgcgttgagatggtgatacacacngaacgcgtcacntcgtaggacgagtactagcacgcactacantagtnagttgtggtcgtcgacnctcgtggntcatctgatccgacgnatatgcagcgtgcatcacacaccagtactcngaccnatcgtaatggatatagagggagtncnacgtcaccaacgttgactggcgtggcgcagngagcatggagananatatgtctatggagcagacgtggtgtgatatcgtagtgntanacaagtgatgtgcagtaagtgatacacgagatgatcccgcgcacacatcgcacaatcgatcgtagctatgttagngtgtcatcgaggtgagtaggcgagcggagantatgaaacacactcattacacacgcatgatgactgatgtggtatcatcgtgattcaccactaagagacagattgtctagacagtctcgngatactgtattgtatatagcgtgcggacgtgatgtngtgtaacagtgtgagcagcgagatgatcgacatactagtcaccatgatgcatcgacccaaganagacagcactagcgtagntgacgtgagagagtgagcgccgtggtggcattaatgacagagcgcacagcgcngnagcggtacgtgagtaaggaatcagcctcacacactanatcgcactaggtatatgaanacgntgattattangtncgtgcncagcgtaagcactctacccatatatatatacaacaacgctctcacgcacatcacgctngtatatcgcatgatgtccctagataagtatatgtcnctgcacctactactctcataactcttctgtgatcatcagcgcacacctctg

SEQ ID NO: 15091 - DNA, 1150 bp, Homo sapiens
  misc_feature (1)...(1150): n = A,T,C or G
acaccccctccatacgaattgtggaatgtatatatcgtcacaaaagntagctacaatatacgtcttaaaagtaatcttcggtctgctttcccgggaacctgaagcattggccccatacacccattaacataggggggggggggctttcacaactaaaagggagcggccaacagcgcttttatcaccacctcctgttagctcttacttgccgcgacggtgctcaaaaaaacaccgcgctccaccggcgccatccagcgcgtaggtggaaaaaacatgtatcacaggcatcgtacaaagccaatcaatacaactcgggggggcgggggttttaagcacatattatcctatatacaaattcggcgccacacgtggagtcacaacttgacatttcggtattaaggggagttgtcaagattaatgggagacgattggagggggacgtttcgttacacaacccggcgccacacaatatgtgtcataaccggggataaggataggtgtgtataaatatcattgtttgattgtatgtgacaaaatggtaggcacatcgggcggtcaatcactccgcctatgtacgcccaccatacgctcggactataataataaatacactnatcaaacacgtgtggagcggggattctttcgctcacgtggngcaggggtacataagggagggacacacatggcgacctatacaggcaactgagaggggaaatcccatggggacagataaagaagaggatgagctaccacatcaggaggcgagagcacatagggaacggacgggtaagtaattggtgtagaagtaaattcaagtaattcactgtgtaggtaaacaagggaacaacaggaaaacaggagggagacgggtgataacaatatattgtaggagatctgagggcggcactgtggatgcacaacacacacanctaagagaattcactagtagacgggcggntatgacaaaatggtgtgtggaaagaaggacaacagggtaacgagcaaagaaacggcgaacaatgatatgaaatggcgtgaacaaatatgtgacaaaacacaaatggggataaaaacatgggagatgagaacgggtgcaatgcgcacgatcatgaggaacgcgcgaaaggagaagcgaacaaacaaataggag

SEQ ID NO: 15092 - DNA, 1496 bp, Homo sapiens
  misc_feature (1)...(1496): n = A,T,C or G
cgaatgctcgcgagttagtccgacgactatcatactcattagtcccgcaagcacgaagggacgttcctgcggggaggaacacgcgcgagncgaaaaattttcacgccggaccgaaagaccccagggtgagataaacgaccacagaacgagtgccataatgcccaggcccaatttaattctctgtgaccccgccacgcctcccgcatcctacgcttataaacgagctatgagtaccgcgcgctgagtgtgttattctggtagcaacacaagattctctctgaatctcaataaaatcggccccatgtgtttaatgctcgcaattttattgcatacccccggttttcgtgtgccatcaatgtacgtgtgtcaaactgctgttcaccccgcatanaggtggttcccacggtgttccttacgaaangtaaccacacatcgatgtgatgtcatatagagcgtagtaacatgaatgggaagaagaactgatgataagagtggtatatagcagagcgtactatcttctgcaattagggcctaaaacaggagtctagacttgtgcgaatttcacgaggagacgcgcacacgaaacatgtgtatgggtgtgtatatgactaatctcccgccacgactaagcagccgataagaggtattcctcttgtaatgttcgaactctgtaaagattgctcgacgtgcgtagataaagtagcgcgcaggttatctcatccgcggatttttctccatcngaccccgagtcgtaacgagtccgtcgtcataggatgtgtgtcacgactttgtccagccgacggttgcccgactccacgacagcgacacatanagatatcatcgagtttcgngagtgagctgaggttctaagcgttatcaatactacatacaccantttagcatcgagaatacgatataaggctgtcacacagcgcgctcacgatactatagacagccatcgcgcgctgtcgcatggtagtactgacataaggtgtgagacatcaccctactcgacacagtagatacgcctcactngtgataccatagtgcgagaatangtcgaagctcgtagctagcagagagtcgcgagtagacgtcacgagtgacatcacgangcatgtaatagcatgcatcgngtgtatcgcgcgtgcgactctcgacgcggcagangtcgagagcgncgtagctgaggcacgcctctatgtcaggtggcagntgtgagattccgacgatgtatatacatattgtagtaaaccgcgagatgcactacgcnagcngatgagcagaataatacacgcaancagctgcgtgtaccaagagtggtgtggcgcantctatggcgcgcatgcgacagacgtgatcantctgcgtatgtataatgtagtgcgcgtgcacgacccgcgactcntggtgtacnagcgcgacgcgacgagtgtgattgccgcgtagcgatactgaacgcgatgcttgtgtagtcatccgccncgaccatctcg

SEQ ID NO: 15093 - DNA, 1012 bp, Homo sapiens
  misc_feature (1)...(1012): n = A,T,C or G
cctaccttataccgcacgaagnnnnnnnnnannnnnnnnnnngntagnnggttattttttctatttttcctaatatacacgtttatctctcttctctcctccttttttttttagaattttctcaaaaacaacaaaatcaccccaccggggtgggttttttcataaaaatatctcatcctactcacccccacccaccccccctccccctttttttctctctttatccgcacactcatttaataacacttattaacccaccctcccctcttcttctttcattcaaattcttcttcactcatttattccatctatcccgtgtggttttctataaatttttacaatacctaccaaactcaattctccataacacctccataccttttatttttaatttaatatattcccttttattatactcttattttctatcctcttttcactccctttatttttctacctctctccctcctctctactttttaactaccaaccattttcatacttcatctcttaccaaatcccacctaatatctcttccattaaaccacaaatatattttatattataataaatctcacaatcttcccaaaccactaccattatattctctcattatctcacactacactttatcctcccactatatatttcacataccccccctcttcctctaaaaatacattttttcactctttcctatacttatctttaattccgttctccttcattcatctattcctttcctctatccaccaccatattcatttatatgatacccttactcatacaaacttattccactttttgccataattaattatactatttataacaacattaattccatatccctaaagtcccctactatattcccactctcctcctatatacaatctcactctaccatcatcctcatatccctactccatttttcccaccctttttatataacatcagcccaccacactcaaactactccaaccacctcctccctcaatctcatacttacttt

SEQ ID NO: 15094 - DNA, 1107 bp, Homo sapiens
  misc_feature (1)...(1107): n = A,T,C or G
aaaaataattttaactgtaccagaagagcccagtgctcacaaaccaatatcgaggtctatacagaatacaagaggggatgctggattaattttatcccaccactccttggagtgtcccatttggtgccaggattggtctaccgagagacaatacaaaaactatttattagagcgttgagataggggggcggcagccgccgggagtgcctctatccgccgctggtctattttctttcgccttttgagtgaggggagggagggggggaggaagatactactcggtggggtaatgcgaaagtacaacgaaccgaaccatcacacgaagaagtgcgagcgcgttcttcacatcttcttagagaaataaaagagcgcaactattgagctatgtggtgtgagatcagggcgggcgcgtcacagatcttatacaccgccgcgaatagagagaagagtcaagaggtgaatactgtaatatagtgatgcatactcggcggcgtggagatagagcgaacgcaacggcgggagaggatatttgtgtacctatagatcgcctaagacagaaagtgtgtgggatagcgcaanaatgtagattcaggtgtacgcgatatagtgatacgtatatagtagagagagaggcggtgacgcgcccggcgattctgaccacgtgatcgcgcgcgttatatttggtcgccgttatgtccgacgcgtatataacttgcggagtctgtgngcgcgtcgcgtagataagacagatacgatgaacggccgctatggcngtacgtctatgtngtgtcgatgcaaatgcgatccgaaatatatatgatgtaatgacgaggatnccgatcgagtaangggtaaatatacgcgctgaaggctgacgttctgtgattatgtaatagggcaggctcgcgaagttggcgagcgggtgagtacagcgaaatgcatcttgcgacgctgagtgccgtatgtcgcggatgcaagagcgtgatacgagancctcaagtcgacctagaatataatgtgtattgttgagtagcgtaggagatgattcggacacggagcatcgcacgctataaatgccggatctcgacagagaatacagtacaccag

SEQ ID NO: 15095 - DNA, 948 bp, Homo sapiens
cttcgcatgtaatcaaaaatgtgaggggatattaaataatagataatcgttcattatttcaacctgctcaccccacctcaatgaccaggagtttgtgaggctcttagaggttctctgacccgaagacaggttcgttctttgtgacactaatgaattttcgcatataattgacgggaaccaacatttgcgaactcgtttacgatcaacctactctactaccataattttataatgcggaaaaggccgtgcagacagtatcgatgtaaaaagttcaacagtgactgcatattaaatagttaaatttacacgggcgttctttaagtatcgataaccccattaccttcataaactgtaattatgaacgaaattcttccctgttaaatcggtgtgcttttggaaacggttctcaatttttaatgattttttttagcatctaatggtttaacctcacagttaaagaatcaacaggttgtagatcacatcttaaaaaccatgagtgaccagtaataggaaatcccggtcttagaggaagcctgttaaaataaatgtaatacttcccagagtcttaggaattacccctagaagttaaaatatggggcgaatactaaaaaaaaaagaagaatggagaatgtagatacacttaaaacacaaatggataatataaaagatctacttcaaattgcctaatattttgaaatggctgcaaggaggacagctttcccttagcagttgtccttgcttagaaatctaaataagaatatttattctaaatgactatatcattggatcaaaatatatagcatacgcactatattttaattctaatgctgctttcagtgattatcttgtgatcatctttgttatgatgaaaggagttttgctaataaagcctgtacgcggcaagacacatgaaaaaaagggcctaacacaacacatcacccacaccac

SEQ ID NO: 15096 - DNA, 1737 bp, Homo sapiens
  misc_feature (1)...(1737): n = A,T,C or G
cgatatcccaatttgttcccactcctatttctcttactcccgtagtccggattggcttctcgcggcaaaacacccgcggtggataaggttcactcttgccggatagaccctgcgtggaattatactgcacgccgggtgagcgtcatcccacgctgattattttgctttgtgcgcatcacgagagctcacactcacctcaattataaattntgtgtattcggcgcctcctttgttggtgttgttgatcatcaaacacacctctccaatgcccataagtgcgcgacgacgtgtacgtcctcctttttattaatacaccacaccgttttacccaactcccaatgcgttgtattcttgggcgcgccgcgcgtgttgttgatatcgccccgacacactcctggtagtaggtagattgcggcgacgacttgatcatctagagaggaagatgagacattgttgtgaaccgaacgacccgtcggtcngcgcgtttaatgataanataaccgcacnagtgcgcgcaacgctatatagcatcataactatctatattcagcatcgtgcatagagatctatgtgtatgcgcgatcgtcagctgtntcacagtttgtgatcgtacactatattatattgatgtctagccgcgaacaacagtctagctcacacactccgtgtttttctctacactntnatgtgtctactaccgcgttgtatgacagtgtgactcacaagtatgttgtgcgattctncatcgcttgtctttcccgcgcttcgactgttgtctagtgtgactgtgagcgacgcgggcgagcacttctgtacttagacacngattcgtatagtatacagcccncattcgtgcatgtgtgcatgcgcgtttcacgctcaggacgccacagtcgaatacaaacaccactaatatctatgctgatgtagacgagtagtatagatcaacgcgtagtncgccgatgnctgcttgacgtnagtacgcacacctatgatctaatnacncgcccntnattgctctcgcgncgtngatatagggtatgtatgtctgtgtgactantctctatcatcagcgtgagtgcgatgangacttgacagtcgatacagnacgcgcacagancgtacgagnagaaccacnagtagagaganagtggnaggcgtcttggncgacgntactgatatgtacactntgtactgactagctgctcgtgcgaccactacatgattgtcagtctacgttgacgtcgaacgtatgtcgcactcgcgagcagatgatgcgtgtgtctgtgtctnactcgacgacgtagtatatctatatcactatcggncagagcacagcggagtgtcgttatgctctcgcgcgtacatgtacgttacatntncactcatgtntgtatgtgcgtangttatacactntgagcgcgacctatagtnagtctaatgatgnctgactcagcancggacgganacgcacaatatanatagcgtagagatgnagcncngtgtggctgttcgtttattgtnantcgactatgctgttcagttgtctgncacgcncactctgtctgctcggcatgattagtgtacatcgcgcgactgacacncntacatgcacacngtagctgtctgcagtgacggtcgaccgatgtgattgntgatgtcngtcggcatctcacntgctactancagcacgtgcgtgcgngtctttgtacgtcaatcnntcgcacagcaccgacg

SEQ ID NO: 15097 - DNA, 1044 bp, Homo sapiens
  misc_feature (1)...(1044): n = A,T,C or G
atcgattacatgcgttccncgctnnnnngnnanggttgctcataaaccgtaaaatttcttggtttgcctccggcactttgggattcccaaaaaccctattaccccagggggggggggctacggtagttaaagggattccccaaaaaccgtttttacaccccccctctttttgttatttatcggcattctgactgtcccaaaattcccccgccccccccacccggtctctttttcccaattttggaaatttacaataacacatggttcgcacggggggggggtttttataccaaaaaaaaaaactcaccaaaagataaccgtttcacaccctacacatgccgtgttgnacaagtttttttgtgataccctcccctcacaatgaagaaaataaaaagtgcggcatcttcttctagaatctctgcacaaaaacggacatacatcctgacgatagatgagccgactctttataccattccatttaataacactcacctagacagagcaacaacaaagttgtcgtagaaaagagagtatatcaacatcacatctctacacagtgtggggccccgccataaatacaaagcgcttcgccttacaaacctgtgagtgtctcatggtcntccgatcgctttagtctacttacaccgtgtggttaagggaagcccttccatagatcttttaagagggaatatcaaaacgccgacactacatgtgtggttagcatacctgcgacacgacgaaagttcctcagataacactgacaccgatgtatatctatggagagcacaacccgtacccacacgaggtgtatccccgctagggaccacgggacaagaacagaaataacgcggaggggtattatatgatatttgtggtgtgtaacaagtgattgctatccaccgaatagaggccgatcacantaacatactggtcacctaaaatgaatcatattatacgtgtcgctactctaatgcagatttatagtccgatctgccccgccccatccccttaccacgccgctctcacacaacacgcacgctcaca

SEQ ID NO: 15098 - DNA, 712 bp, Homo sapiens
  misc_feature (1)...(712): n = A,T,C or G
acccgttaccactcaacgtgattggcctgtgttgcaatgccaccttgttgagaagaaaccacctaacagaggatgacacctcacaccgtggaggtttcattaccccgcccacctttcaaattttcaggcaaaccttggcggttgccttttagatgtaatatagcagaaaactaaaattaatcatttcctccactagtgtagttcaaaaagtcgcaaatgggtttttgacttgccaaactttccagtggttgggaaggggcttactaacgaccacaaaccctctccctggttgtttgtaggagaaaaaatcccacaccgggaatccaataaactcctgaaaagagacttaatggtttaatcaaaaggtttttgaaacctccccttggggttttttttgcccctcccggnnccnnagatgcaggggnatagatacaagggnnnnccccccgagggaagataaggtcnaggaggaggggggcagggggatggggggggtaggggggggcggagggggaggggtgggaggatgagtgcgtcggtagcgttgcccttatgggatcttatcttgtcctctgtatacgtagatatgaatataaattcgtactatatttacccgcggcgcggggtgatctggtgggtggggtagggggagggggtgggaggaggagcgagacgtggcgcagtgggccctgtgcagaggaggggggcagag

SEQ ID NO: 15099 - DNA, 793 bp, Homo sapiens
ccccagctaaatggataacgccgtatttgcttttaacacaacacactcaaacatagaagggaccgaatctcttaattaaacaacgccaactttgcctgacccccccacgggagaatacctcctagactgtaggggctaccatttggccccagagttccaaggataccgggagactcactcccacccgggcccccattatcagaaggaatccatctccctctaagggctcgacctttaattttgtcttaaaaaggttacccaccacattaaaggtctcaaccatagccccggaagatattcctaaggagcgccgggattagtggcaccccctcgaaaatttctgcgaaataaggggcggctctaaaagtctttcctccactaatgtctctaattatgaaagggaacccttaaaagccagccccactagcgaaaagtttttcggggggggaatcctaaatgccatatctcctattgcatatcatcccccggcccccacgtgggaaaccttggatggaaggggagtactgttctataagacacgcttatagggctcttcccctcaacaaatacatacaagcacttgttgaaaaaaaccagcggactcctctcgaatgtggtccagtcactaaccatgggaatcgcgctgggcgcccactagaaatccctaacagatatatgaagtattctcctcacattagagccgtcgaaacgactgtttctctcacaccaccacaaaaatgtttccactcccatataataccctgcaaactaaatcaataatttcccccctccc

SEQ ID NO: 15100 - DNA, 1024 bp, Homo sapiens
  misc_feature (1)...(1024): n = A,T,C or G
cgcacaggtactatggaacaacacaaaangngtgcgacaaannnnnaatacacnnngggttttgtcttctagatgtgaccgtggtaaaccaacttcttatttcgggncgttcgttccacggtatccttgaggcattgcccaataaccactattatcaccaccgggggggggggtccccgaaataaaagacattccccaaaattcctgtttatcccacccctcttcgtttttacatgaaactagaggtctcaaaaagcacctgttatcccccccaccttccctttctcccgtatatatgtggatactccaaagggcgcattattccccggggtgggtgcgatatctggcggatcacgcacaacttacaatacccatttatatcccgcagttttcttttttttcccctaagttttcctattctccacatttatcttataatattgagaagctgtcgtttgagttttgttaacaagtagcgggcacaaaagaagcatattaatatttgtcagcaattcgtttgaatacntgtctacgcagtagcgtttcattagatcagcgcgaattataaacgaataggtctctttaatctatccaatgattcagcagtccctccgacgaatattttcttgtaatcggggtgcatagttcttaaaagaataacgcacgttaaatctatctaatcactccccattgttctctattttccaggaatcgaacgttctccctaaaaataagacgcaccgtaaaaggtgtaaaaccacactgtcatctctagggtgagctagtttacaagtaaatgagtctctattaaatatagagaccgtgccaatacacaagttatataataagaagtagaagagatcctctctctagttagttatttcttgtttcaaacttaattaaaataaaggagtgtcagtcaaaattataatgatgtgttattatgtaaaatactatagagaaactctcgtaatacgaatggtaaccgagaagagcgttcggcagacagaactcgaaagcccat

SEQ ID NO: 15101 - DNA, 1225 bp, Homo sapiens
  misc_feature (1)...(1225): n = A,T,C or G
cagatgccgcccggagtagtacacagagtgcgatgatgacgaatcaagcgccagagacgcgaagagtcgcttcangngtggcagaacgcagcccgcnaaagnaggaaacctcttacgcacaggcagcgcagacgcccncgcgagaggcggatcgtcgatcgagcgcagtgcagggagggcagatgtgcccagcggcgcattagtgtatgtcacggtgaggcagacgcgacgcaggccacgccgccgccgcggacgcgtattaaagcgtggcgagcagtatacgcgcgcgcgtcgagcggagcagtagtttcgacggccaccaggcacagagacgcagacgcgtaagagcgcanantagtgtagcgacgcacganacgggacgtgactcnccgcgtcatatagtagagacagaccacgacgcgggtggtacgcgcgagcgacangccgcgtaatcaagagtggagaagcagcagtgtggggtagaatgcggcggaagatgcgaagcaagagcgcgagaggcgtctattgacaaacgaggaggatagttaaaggaccacccgactataaagcacaggtttagcagtgacccacatcgaagaatggacctccccgcggtgagtcggggggggggatcgggtgagggagcgggacatacgcgtggttgagttggaggggacaatacgtggcaggacggttggggcgtagcacccaggtgtggaccgctatgagtacgggtcggccgtgatgtccgtgcggtggggggtgagcgacagggccggctggagaggcccgcgagcgggcgaggaggtgtgcgcccagccggagccccaggtcgcactgtgtggagtgaatgagtccaggtcgggagcagggctggggagggaaacaggtagggtagcacgtaggtgcacgcccagatctaacaaacaccgggataggagccggagtgaagaggcaaagtgacggtgggaggagccagggggacaaggaggatggggggagggagggctgtaggaaggtgggccagcgggcggggaggggggcagaggcgtaaccgggagggtcagagagggagtggggcggcccaagcagggttatgaaaccgcacgccggctggccatctcagagaccccaggaagcgctggtgtgccccgccggccgccaccagagtgcgctagggaataagagtgccaacaaggaccggcgttgtgtgcccgcccgccag

SEQ ID NO: 15102 - DNA, 1039 bp, Homo sapiens
  misc_feature (1)...(1039): n = A,T,C or G
cgggcgaacaatacacaaanntnnnnnnnnnnnnncnctagggggggtcctttttttaccgagaacaaagtcttctgggctggcccccgcggaaaccaggacacccgccaaaatcccctaattatcccacggggcgggggggtgttcctaaatataagagacacaccaaaaaaccgcggtacaaaccacccccgtcttttatttttgagtatttagagaggtgcaaaaaaaaggcgggtgtgaaccggcgccgccctttagttccgggaattcgaagacaacacataaaaatggcgcgaattttcccggggggcggggtttatagagagagtcctaaaacagcacgcaaaatacatctttctaaaataaaaactttcaggatatataccaacttaacgggggggcgtgctaaaaaacacgtcttatctacatagggtcgggtccagtgggggggagaaaaaacgcggccgttcggatacagaaaaagacaaatgcgtggctttgtagtcctgaaaaaacgccgggcgccctcaagaatgaaacacacttgaaaccggcagtgaagaatgatgtaaagagaagtatgtaacagcgaagggaagaataatagcagtggttgaccacgacagtggttggattagaaggaaagaaagatataatgacagaggtcgcctatgagattaaaatagaagaggattctgtcgtgacggagggaggagtgaagtcggcggaggtaattcagnatacacagccagattactgtgagaggaaggataggagagtggagaggggggagacatgtttcagtggggtagagggttacgagtctgtactgttactagacacacgattatatgatctttaagaagagaggtactggaatctagcacgtcaaacaatgagaaggaacaagagtatatgctgctggagtatagtcgatacccatttagaagttcagatgataatcgtactcagatgatgtatttacagcaaaagagcagcaaaggatgtcgaacgatcaatagagactcgatggcac

SEQ ID NO: 15103 - DNA, 810 bp, Homo sapiens
  misc_feature (1)...(810): n = A,T,C or G
cttgtataggccatcagagcgcccgaaacccccaacgttttcgaagcccgcgcaaaacaccggggcaatcgagcatttttgcccaaacgcccttcccagttaattgttacgcagtaggggttttcccccacacttccggaattaaggtccaggccttttttaaatacccccccccccaggggaggactcgtcgccaaagattatctgaaaaggcttgcgcccatataaaaaatcatattttgaggagcttgtggagggggctaacattccaagattgataacttccaatagctagtacgcattatcagccaaagcaaaaattgtctaagtggtgttttatagaaaaattgttatcaggttagtttanaatgttgaatctctttttctaattgtgaatcaacacatgtttacatgcagatatccaaattttaaacttgatcataggagtagctaaagacagattccaacattttattcccagaagccatttttcttccattgcattggcaatctcttcaagtttttgtggggctttttaagcagatgctttaagttgcaatttgagccccccctcgcatttcattctaccattgattggtagattccaggcacccagaatttgntagaacattcccacctttcatcaccttttgctaaatatttgatggacacgaaagcatcccataatagtagagaagtaatcagntaacaaaaggaaacacttatccttcccagcatcattccctttttaactcttccatgggcatgtgcttcttttcaaaattcatgaataaacaacgaatgcgtgca

SEQ ID NO: 15104 - DNA, 865 bp, Homo sapiens
cacgtacaaccccgcgcacacgttcgcacaaacgcgcaggctacgtcccaccctcacgccccccccatacatatcagactaggccccgccactaaacccagcccactatccaccgctaacggacccgctccctccccgccacccggccggcagacggccagccatctaccccgctcctggctcccagccaccagcccaaatcctcaactctcccaaaaaacaaagggggtccccagataaagctagagactaccaaatggggaggaaaaaaacatgtaccttcttgctccacgtgcgcccacggtctctgagagcaagtcctcgtcccatgcccaccgttgagggcaggggcgcgatttgggctcggcccggtccctccttcctgcgttcaaggggaagtccctgccccagcctccccagtagtcgggatgacaggcatgtgcccccatccccagctaacttctgtattttagtagagacgggattttcatacgttggccaggctgatttcgaacttctgacctcaagtgattagcccttctcggcatgtcaaagcgctggaattacaagcttgagcccccccccctggatggagataaactatttcttaaaacatgaaggctgcagttgttatttgaaaatatgtctaaggaatctgaaacacctatcggtgagaattcaagaaaccaaaactgaaagtgacttatcacagacttagtcttctggggtaccccacagccgctcttctatttaaaaaatgcatacaatattttatatcaattaaaaaatacgtaaattgacaaaataacaacgatgcggcaagcccccccccccccttctccccccttccccccctcacccccag

SEQ ID NO: 15105 - DNA, 1507 bp, Homo sapiens
  misc_feature (1)...(1507): n = A,T,C or G
accatacccacgaataacctcgcacttcataatctcttagcagcccacagagccgngtggagggcttccttacgggaagacaacgcgcgggtgannnacttttttnngcgtccgaacnagacatgcagagcngaattaactcgcgcgcacagtcgccaccgtcatagcagtgcgtggatatatcacgcctcggattcacacactacgaagatccagagtgcgtgtgcatattatanacagttgagataactatagcacctgcgcgcggagagagttgntgctcagctacaccactctcacgctacgcccacaagacacgatatgtgtgtccccacaccgactcatataatcttacgcatntctattgtacatcgacgcgantgtatagtgcgcgtcgtcgatcaatagaccgagccncgtcaagacataagaagntgtatgtgtctggataggagatacacacagcacgtccacgcacacgccgtcgtggaattcgacgggcgtggctgaaatgtagtagttatgctggtcaacaagtacacccgccctatatagacaggtaggatccgacttagtgaatctggacatatacgatacagcgtagcctatgttaagtatacaatagatatgccgcgtcagaaggcataggtgatgagtctctctgttatctgacaccaacccnctcacttatgacagaaagtaggatatggttgtgtttactcatacccatcatctatagtcactttcattttagtataagtagacgcagtcaatttcgggcgcgtggtatagtagaggcacacaccagcgccgatctgttgaggaggtgtcgcgagtgttgagtcggctagttatagatacgagcgtaaacacgacaaacccagagttcgagcaaataggcaagagagtaagatacacgacaatgcggagtagtagagcagagggatgcaaantatatacacccgtggagcgatggaatagcagtacatattgccgtgtagagcagccatgtccantactacacccagcacgtgctacgtnaatagatgatagagagtcagcaccacgcacgacacacattatgcacagatacctgctcaagcatcacataatatggtacttatagaccgagagatgagacgaatcgacgggtgtgtgagatgtacagtatagcgtgacgatgagttagagccaacatagggtatgtgtgtagngtgcagagcatgnanacagaagagcgatacagtggnagggacagtactcgtcatgatgtgtgaggtcgcgcgcagcaatacgcaccaccganaaatgttccgtgacganacatatgacactgtatgatgttcagatgatggtatcatcacacgaccgcnctacatcactacgttgtgtttagtccagagaaccgacattctagcacgtcatgatacgaatgcacgcgcccatgaagaatatacccgtgcaacacaacgcgcacgccatagtagtgctgcaactcgcaacctct

SEQ ID NO: 15106 - DNA, 1299 bp, Homo sapiens
  misc_feature (1)...(1299): n = A,T,C or G
cctccggactccatcacaggattggtgtctccgatcgtganagacacagagagtttagtttttggtgtcaccccaaccgccaaactgtctatcttgggggnttacacacccctgcggtcgcgtgagagggaatgcgcgccaacatactatagtggtatttacacatataaggtggtggtgcgcactcgccatgagaatatcaaataagaagacagcctcagttatgagacccgagagtatacactcctcacaccactctgattaggttgtactgtattgtgcacaccagcaggagagaattatacgaaatgacaacacaaaagacgtagccgcgccgacacgcgtgtagatataatactgcacgatagatcatatgggttggtgaggacactaacacttcagctgacgtaaccttcgtcacgcggtgggtggttcgcacatgcgtcatatgtagcaatcgcgttcagcgcgtatactagatttggagagtacaatatagatatccagtaggtcggtgtgtaatgtcgtactgaggttacangcgataatacactgaatataatatatgatttatgcatattcatatcagaatcgtacgtggntccatatcatacacatacgacaacaattgctatactccgacattcacgatagagacgcaagataatagacatggacgacgatatgcagcanccgggtaatgagagggagccaacatagtgagtgctcacgatatgtgtggcctaatagagaacagcgatacagccgggtaaatagactatgttaatctatgttcttctggagacgggtggagttngggagtatactatattattaggtggggtgtgggnatacaacagggatggacttcactaaggccagactcgcaggtgttgtgtgagngtacgggcactcgtgcgggtgttctacanctgtgataactacacacctccaccaacactaggcgaaacgtgagaagggcgataatagtcgggaagaataacggtggtagtgagacaaacacacgacaaacacagagacgaggagaggcgacaaaaacggactatggagtggaaggggtaaacacaaggggtgaacacggagggaangnggggagggaaccagacaaaccgaaaacatagggaggggggatagaaaaaggggggggaaagggaaagggaaagaacaaaacgggaaaacaaaaggagggggaacaaaagggacaacaaagggagaaaaacggagagaaaatgtggagggcaggaatgggggggaaagggaaaaagacaaaacaaaaag

SEQ ID NO: 15107 - DNA, 2237 bp, Homo sapiens
  misc_feature (1)...(2237): n = A,T,C or G
attattacaatagtattggcacangtgatatatcagacgcacaacgcgaataatctcagagtatcaggtagtgctgatgctttctcaatgcagtcagatgagatatcctcagcacattacctcatattgatcagagacagactntagacaattcaatgtactatattttgcgtagacggacagaaaccaactgacgaatnattcatattaattatcccatcatatttcagtacacgccgcatccagaaatatctctcagcttatatctattaccgaagttaacacgcggagattacgtatagtttgagtggctacgccgtggcgagacgcgcatatattatatagattagatcgatgtggcagcaccatatatgcgtctgctctatcttcgtatntgtntgtangagctagccgcagtatttcaatatctgatattgacgcgtacgttagagtagcgaggacgctgacgatactatcgttagtacgtagcatcagtgatgcgcctcgaacgntcaatacacaagagtgagtggagatgactaactcattttcgtcactagctagtagacgcgagcnctgcacgatactgcaactatgagcagataactgatgtgattagtanttacgacagtaagacagnacgntcgcagatacgagantcantgtagcnatggatgtgaatagtacatantgtacangncatgcatgctgtagtcatgatcgtacgttcaatgtatgacatcatttatgatntgtgatcacgagtgagagcagcgatacagatgagcatgacagtcggtcatacgatctgtagttagcgacagtcagtatgtacncgcagccgncangactcgtntgctatcaatgatcatcaccntcgcgcgcccgcatgtctgatagtgacntagcgatgaangtcacagagagtatagatcatccgtacangcaatatagcaggtatatgagatcatatanancgacgcacagtcgctgcaggacgtcngnataggnatcggattctaatagacgtagtaacagnangatcgagcgcgtgcgtactttactgtatactgntaatcatgtctacncgctcangtagtagcagttgctacgtangtgtaantataatatgagtgtgatgntatgtcgntagcgatcacgcngncnatcanatatcctatagcatactgtcanaagcataccagcagatcntntcgtatntagngatacanactagatatatactcgacgcngccgancgacgacngcgagctatcatcagcgncggtcacggcagcgtcancgtgctatatgcgactgatactgaacgcacgcaagtcatangtaagtatgactctgatgnnacgcgctgcacgatacgactaccgtnatcgntcaagctatantagtgaagtagtacggctacatctgaacgnttcnacactcncgcagtntcgcncattcagtntantctnacgcgcagnactancgagtntacgtcgaccgncgtancgacgcatcnacgacgcactnatgctcgtagtactagnacgtncgatcagatcagatgacgacgacgttatcgtccgctagtcaagnngcaacagtgcaatcgacagtanagnaagacnntcatgntncgacacgagncgactgttngttactactannattngtatnacgtcatcngtnnagtntagctcgacacgacgtantacgcgcantcgctgagacacgaagaatggcatantatgnntanttcatcatgntagcatgcgtcgngccgnctactacgtgacngcatcntgattagcatcacangtcgccactgangatatgntagtctccgncgtccgatactacgtctagttntanaggatgcggcacgtcagcatnannatncngactcatnangtcagtcgcgagagtatnatganangaantcgatgcagctacgatgacgtaggtagctgacactaactcgttctcagtcgctatnacgtcaactangcntgacnatntcgagcaaagattcagacgaacgtcngtcatncnaaacgncgcagcgtacaatcagcnnangtcnannacgaanngtagatgacgctagcgccgnntgtagntctggaattatgtgcagncgcagctnatnatttcgtcntaatnaggncgcngnacgnactgncatnatncngancgatggtcangtatgcancnacgtaagatgntcgagcnag

SEQ ID NO: 15108 - DNA, 882 bp, Homo sapiens
cccacaatccgcaccgtaacgcaaacgcgcctcgcaggatactcactcaaaaccggacgcgcccccctcaaccctctttacgccgcgccactcatataagtaacaggatagagtatcacggactctctccggcagcgcggaactacacaggttttacacgcagcgtactataatgagctccgtccagacaagtgtcgagactagaagaacaatggcacattgtggatcaacatcccgtgatcgggaaaaagcaccaaggcaaaatgggtttcctcagaatcacacaaacccccctctagaagaggcagtcgtgcatcgttttagggccattcccccctaaggtatatcaccgcgtcagccacagacaaatctaatctcagtcaaggccacagcatccatttctttctcgcagcgcgctcctcttcatatgagggtggaggtgtgtgtacccatctctctaattctagaaactacccaaaagcggctaaaaaggagttccgggggccagtgggaccccacccagagcctggggacttggctgcctggaaccagaacctggcccctcaaaggagttgcagaatttcgatagaggagtgccccccccccgtactggttgaagaggaggcccaagggaagagaacgttgccctcattggtctggaatcagcaggtacctcatggctggaggtgtattttcagactcctttggcatctggtgaggcctgtggattcattctcagaatcacatttttaaacgcacacaataaaatacatagaattgcaaaggaagttaattatattgaaatacagttatcaaaaatataaataaaccctgatgcggcaaacctacgtttccatacccccccatcttctcccatacaca

SEQ ID NO: 15109 - DNA, 1551 bp, Homo sapiens
  misc_feature (1)...(1551): n = A,T,C or G
tcggtctgccaatattcccctactctgttcggaaacagcgaaacgcgggggcttacgcgcggaaactaccggcgcgaaataagctttccctcgagccatgactctatgcgggtacatccgcaagcacgtggcgtcatctagtcccgcggcattttcttntacgagccatgtcgtagagcgctcagtgacattgatgctaaatggtgagttgcaggtcttgttcgcacgatgcgttcttggtacgacagcacgatgggctgcgcagtccagtaataacatggactgaggaacaccgctgtagttattccaccgtgatcatcacgccagccgcacgcganataatatggccgtccggcgtgtgttgtgtcacagtagatagtcgagcatatctggtgtcctcgcccgacgcgctnacataataaagaggcacacagtatagacaccattgtgatgttgtgtagcatatgatgttgatcgattgatctgatcgtcctctcatcacacgaatcgcataaagcacggagtngccgctctactttgagcgagaaaatagcatctctactctagatggagactcagctatcacttgtccgtgggtaaggcgtactcacatagtacatgcgtgcgcagtgctttgtgttaatctttcacgcagcgcccacgcctaccgccacgcagcacctcttgtgtttacgcgntgtcgtcaccatgtgtcaggtgcacggccttgttgtgtaggatgaggagaagaggactttcncaaagcatgcttgctgttacgctcgacgaaggagatgaaagcatgcatgcgatgatagacgtgtgtatgtgtcgcgcctttgagtatagtcagcgtaatccacaagatacgccaacaatgtcaacactttgatatatataagcgtatgcgttatacaatacgtagtataaagatgtggccaactacattcactcatgtttacagtgtgatactatgggtatgcgctctgtcaccgctgttgcgtgcagaggncacaccctctgtgaggtggatgtgtgcacgcacgacgcaccgacacaacacacncacgcgagtgtgctgtacgcttgtactcacatcaccgctcatacataccttatactgtgttgtgagtcacgcgccgcacgagtatatgtgtctatgatatgactcctgcgtgtgtgatgtgcaggcatcgcacacgatatgagtnagttgtgtgactccatgtagnatgacgcacgatcatacggactggcgctgtgtgtcgagtgagataccaacatgtagagtgttgattgacgacgagcacgttgcacgacatcttatattatgtctgtacgcgcgacncngntacgctgtgatgatgttatctatcgtgttagcgtcgcggcgcacacgagtactgtgtatgccaatgtatcttnactacgcacgtcggcnctaccancctctcatggtgtaacacgcatacgcagcgatgtataaganatggccgcgtcgcagagctctcatcnagtcagagtnactgtgtccactcacacagcgatacg

SEQ ID NO: 15110 - DNA, 1759 bp, Homo sapiens
  misc_feature (1)...(1759): n = A,T,C or G
accgacagagcatccactctctgatatagatcgatcacaaatttcantcagacaagaagtttttttttcttttccaccccacccaaaaatttttataggagatatccccctcgggacaaaaaaacatttctctaataacaccatatttctttccccggggggtggggggcgctacctatcaatcttaaatcagacatcccactaatgtgcaccccgaatcacatatctactcccccatccttagtgaatctctaagagattacgcgccgacaacatctattcaaatacaaaacgaacatgttcattcaccaccaccctacacgccatctagttctgctatatgcgtagacgataattgcactctcgcttattactaatttatgacgcgcgtactatcctaacacaatcgcgcggcggggtgtgttttagtcaatgtcctactataatcctaccaattcaagctcttctctcaccaactcttcacataatcaccaacacactccaccacacactaaccatcatcccatattcgctgtacgtattctcatatcattaacacnacattataatttacgtacagcttatagactatgaagtacactgttagtgacgtcactacgataaattcgcactacatcaactnactatgtctattgcacactgctatcaccatatacatatacctcagatctctatcncagcaaccatcnatgcgcaccacgacttatctgatagtcacgctccacggctncacccactcangatctactagtcacgacgtagacacnanatcagagcgacggtatcatcctgcccttctgtggnagtatagaagacacacatgtcatgagtctatatagaccnaccccatatanctgcatatcgtctgtggtatagtncgaccgtgagaccgcgtatcacgancacctgacctctcgccntacgaacnagtcgatgagagaccttaacacgacacgacgtgtnacncagccacacagcatgcatctatatatcacnntgatattcataatacactactcacgcgcgcgtcgctctagatagacttcgtatatatgtatcctcgactgcntaccaatcacgcgnttaagtancttanatantcanatntaaatataacatctatatatacctatcaacgatnaagcaccgtactcacagacgacagatctcntgatctactacatgcacagcancactgcactaatgagaccgtatcgtcactgagctcactacacacatccgcgatgntctnatatcgtgctcatccacnatngnagagctcgccgatatgagccatcgaggcagatcacgagnctagtagcgatgtatgtcgatatgtaatatctacatgacgtacagttagcatcgcgacntcataccgtcgtcnctgtatccactcgcatattatgcgacgatctacgcctgctatagatacgctagtgacactctctaccgcatcacgatgcgcgatgactcatttcactacagtcgctgcttnctgtactnactgtcaacgatgatgatagacatgcatcganacatcacgtcacagcacaatgatacatgantagatacnattgaacctantacacatgtctntacgcagtctatgcagcatagcgtaagatatatacatatcntaactacattgatctgcaggctatactctcacactcccatcagtgctctcgctgccgacgcgcccccgcacagccaccacgctacccacaacatcccc

SEQ ID NO: 15111 - DNA, 1411 bp, Homo sapiens
  misc_feature (1)...(1411): n = A,T,C or G
taattacgattaactacacctgaatcatttctatcgaccacccgttaccgattaccgaagtgcagatctatagcagactgcagtaatgccacgcgcagagagtatatagtccgcctacagtaagataatatttgtatctagtgatngtctgcgcgcgcaacgccctacccgcgtgctccataattatgagcaccagctaatatcgatatgcggcacgcacacaattactaccgtagtcagatgaagcatatgctcanataaatgtatttattggtgcctcggacgcgcgccgcaaatatagcattctacttactccaccacgtctgctcgagaccgttcatgatatatacgccacgatgttgacgaactacatacgcgagctagtagtgaagaaatatgatgatcggagcgctgaatgagcaatatcagtcgatcaatacaatttagatcaccgcatatctcgctgtgcgtacgacatatacatcaagttagtattctacactaatacacactcgattctccacgtcccagattcttcaaaccagaggattattgctgaatataacacactgaaacaagatactgcgactgtcaattnctgctcttacttacgaccgacgacgccgactgattcggacacagaccacgccccgtcgttagacctctatcaaagagcgatgcgcgattctattatcttaccctaacaccctcttcgccatgttgcctgctcgtccgtcccgccctctatcaatattagattcacattctcatacaacatgcttatgctcatagnctagatacatctaatatacttgatgtacacgttacgcccanatttgatgcacaatatgacggtcactcgtgcgacaactgatatcccgcgcgcgctcaactccgcatcagctcccaactgtactttatattgcgccgaattctgcctacgctgatatttatatcgcgtatgctgacaaaccgatacgagttcacatcttcactattccattagtacgcgacacatatctcgtcttcatatattctgtaaagcangcgctcaagcgatccatatgtattactgttatatattattcgcgcacgcactatagactntctcgctctcgtntcacgcaccgcgccacgcagtccgnactactcatacatacgttggtcgtcgtcacgccgcagatgactctcgtgcgcactatgatccgccaattgcgctattagccgactcgtaatacgccgtagaagcagtatgacatatgtcaatacatagcatgtcgtaatgcaccgcgtnacaggaacgactaaccactcacgcgcatcgtactatcaatcattatagacctatcaatattctcagcgtaactatatattcacgcagacagtcgatgacacatacagtataacgcag

SEQ ID NO: 15112 - DNA, 806 bp, Homo sapiens
  misc_feature (1)...(806): n = A,T,C or G
acgttaaataatatgcgatatggctacggggcatatggcgcggtatacacacaataagatgtgtcggtgacatatattataccgctgttttgccttgagcaattcacttagtgtgctctttgatagagaaaaaggacacggatcagcgcccacactcacttgtctccattcgggcaaaatctataaaagatatgttctgtttctactacgataggatatacataaatcagagacttcggcctcttttctatatcccatgcaggtacaggtacgaaggtcccatggggttcgtggtacatgaattcacagcattatcaattaggtatgagaagatgacacaactcctcgttataatggcagattaaacttgcaattcggtttaagtcctatatctgtgtgtaagagcacaaagagcaaggttaatattctttgagtatttaaaagctatgagatcattcagcaataaagcagctcatatcatcaagtgaaccagatagaggagcatcctccataatagctgaccagtcctctaaatgaacaagattttccaaaataaggaaagactgagaaactgtcacagtcaagaagatcataaggagacgtgactcntagatttaatgtggtgctctcaatggaaccctagaacacaaaaaggacattaggtaaaaaaataaggaagtctaagtaaattatagattttagtttgtaacaatgtattaatattatttcattaaatgtaacgtggcacactaagatgttagtaagaggaaatactggatggagggtacatggaatttttttagaca

SEQ ID NO: 15113 - DNA, 1037 bp, Homo sapiens
ctttagcttttcccagtgatgtgaggagaagaaggagcctctcggggaacccacccgaaatattccggcgcagacactggggatatctcaaccgcgcggtatccggggatatttctgggccaagaggccgatcacaactaaaggtccaccgcctgcgggggttttagcacaccaaacacgaaggcaagcttctatcccccattaaggcaacaccccccccgtgaggagccgatggttaaccccacgagacgtaggtaggggcccctatatgaaggttatcgaaggggaggaaaaaatatatctttggcgccaaaaagggcgatagaaagaaggtctccacgacgctggggaaaaatcagcctgggagaaccatggagagcaaggaaaagtggtttaaatatgaccgcggccccagaaccacgagggtggttttactcacccattttcttaccaaacgagggaaaaacaagggtcacaccgtaaataccaacaccctgtgaatagattcgctaacatactctattagccctaggtagctcgtatacacatacgccacatcacctctagattattatatcatatcaactgggggtatctactggaacaagagtagcgcaattagagtatcaacgggatgacacgaatgacgaagtagacacacaaacggaagaatagtatagtagacacttatagcgatcagcagccagaagtacaggtggtgcgtgtacgtgctggagaaggagaacgggataaagaccatgcttgctgcgatagagaagcgatcttagttgctgagacaagaatgacaagacaagcgatgcttagacggcttcttggttacgatgtgactcataggtgataccgcacgacaccagacccggaatgacagacgagcagtatagcgtagactttatgggttgtatactcgcatcaagactacccatggtttccaccccacacacacacgcgtattgtaagagataacagggagaggtaccactcaatagaacggaggatgatatagctgcaacccctcc

SEQ ID NO: 15114 - DNA, 1439 bp, Homo sapiens
  misc_feature (1)...(1439): n = A,T,C or G
cgccccgcaagtaggcccggcactggcgcggtcctgattacnanaggagatnggggtttttttttgcagaaaacaccgagggaaacacagtgttatctcgtggtggcttgtacgctcagcgggcgagcnattaggagcgcgagagtctcctacgatcgccagcggtaattctcaccanccaaggtggtggtgggaggtgtcgctatctgagatatatactgagagtagcatagtcgtacaataccagccagtgcggtagntgcgacacgccgacttgcgcttggtggtgttatctaatatntnacgtccgacacgaagcaattctgcggataatatgacgagagatcaggcgtccagcagccagccgcagcgcgttcgaaccacatcgagagatgacatgtgtagtcgccagcgtcactaattgtacatagtcagtaaagccccgcgtggggtgggtgggaaccatccacatcgcatacgacaagttcgaagaagagacgcataacgaagatcgacaacggttaggtctgctcgtctttcgtcgtcgagtatcttgacggacagctatgcgttcatacgtgttagtaatgtgccacgagatattactaagtcgtcgcacacgatcgacacccctatggatgtgcaatacggcatagatggtaagcaacaaagacgagctgatatcggcatcgtgtacatatcaacgattcgcgtttncaccacgcggtacctgactccaccaccattgtgcacagcgacatacgaatgtctctagtctcacttgctaaaatcgacttcaataagaactcgggncgtatggtcataattctatcttgtatatgcgtcggcagtggtgatcgacgctatgtaggcggtgcaagcagtcgcaatcttacagacatctcacatcggaccatatccatcacatcacagtatgtagatattaggtatagtgactcatccatcagtccaagcgatgtggcgcatacgttataantacgaccatncgtctctgctcacggaacagcatatccttaagtgtagtatatcatttcagtctctgcacgagagcacgagcgaccactgcacgactatacgcacgatgtatggctgcgcagcgtgtgtaatgtataatagcagagttagaattcgagaggcatgacgagacgcncgatagacacgatcgcgacacgtacactagncatctctgcgtacgtgcgagatgatgctatatgtatgtcggtgctcgttcgggtcanagcgcgacncgtgtcgatgtcatagcgctcttactggattcgtcagtcgggtcantagtatgtatctgacgatatccatatcgcggnagaccgacntccacgtcgnacagcgcgacgagcgtagcgcgcgtatagtcgcagtctgncggagcacgttcatgtacntacacgaacnacacg

SEQ ID NO: 15115 - DNA, 1521 bp, Homo sapiens
  misc_feature (1)...(1521): n = A,T,C or G
cagagacaagacgacagaaggcgcccgggcgaggcgaacgaaggcgcctgtaggagacaagacgaagggcctcggagcggaaaacaaaaaccgaaacagccccgaagcggcccgaacgaaaaaataccggagaacccggaccgcaggcacaaaagcaggaagaaaaagagagaaaacccnacaaagaagaagaggcgccccgcaggcggacgcgcagaaacaagcgcaagacaaggggcgcaccgcaacaggagagangcgggaggcgacgacgcagcggcacgccagnacaaagagagggagcagaggtacagcggaggagacaggcgagcnaggacaaggaggcgacgaggcgagacgaagaagcacagccagaaggtagaacggaggagaacagcggacgagacgangcgagaggagaagagggagcggcacgagagacgccgangaagacaaccacgacagaacaagcacacagcgacaagacgcaggcgagcgacaggacgaccgacgaaggaggaagaggggaggcggtagagtaggaggagcacagcagcgccggcggaggcggcagcgacggagcagcgtcagacaacggcgaggcgcgcgaagaaaacgaggaacgagaggcgccgccgacgtggncgtagaacgaaatcgacacagacgcagngccagaagaaacaagagagagcgacgacagcgcagcgcgacacgcgcnagaagagacgcacaacgcgcgcgcgcgcgaagcacnaagaacgagacgagcacagagcgagacagacgcagagagcaaagaangagcgagcgccgagacaacgacagcgcgacgcaatagacgccgaagcacaacggacgtaaatagagacgcgagaacagatacagagcggagagcagacgncaacaacatcgacgagcgcccgaacgacgaagcgcatgcgcaaccaccagtacgcgagcgaganagagagcgcgcgtatnagtcagcgacgcgagaananacanacgagcccagagagcgngtangcatgcganacggaggagagnaacatacgacgnagacagatgnctcgcgnagcacgtgacgagcggacgcatacgagacgcagcggcgcgacgcgacagnggcgagagcgtganagcgcggcataagagagatagacggcgacgtcgcacgcgacgcggcacacggagntgcgaaccagccgcgaagcagtgagaacgagcgaggcagaacgaagcaggcagatacgcngngccaggngaccgagagaccgccccgcagagcacgaagctgcnagagcacgcacaagcgcgacacagatgaaacgccgacgacgcaatacggagacgagcgaacgacgcggcagnacacaggacgcgcggcacgtatgagagcaantgaggagaccagacggcgtcgagacgagganagagaagagatgtcgcgagagtgcgcgaacgcgnagaananagacgcgaagtcgcacacgctagcgacagcgcagcacacgcccg

SEQ ID NO: 15116 - DNA, 793 bp, Homo sapiens
  misc_feature (1)...(793): n = A,T,C or G
aggtcccgccccccggtgaacagcccaccaatttttccgaaccaagcggaacatccccgctgtcaaccagcgaattcttggccaagagcgcctcacggcacatgccaaacagtcagggttcccccccccagttttgacttaaagcccacgaccttttaattacccccccccaagtgggaccccgcaggaagcccccggcccctgtcctggccctcttggagtcaggaaggggccaccaaagatccctcgtgttaaaaatctggtgacagcttctcccagcccccttggaaaccacccagtgagttctgtgaacccacaggatgagcacttggccgggagtccaacagctttgggttntagtcccaactcggctgctcagtctggtgccctggggctgaacagttaccctgtctgggcttggtcccaagatccttatttcctcatgttgtaaaataagtcacttcctctgccttcgccatctccgagtttgctaggtgaattaaatgaagcgatatatggtaaaccctcctggtgaagagctctggagtataaccatcctctcntcttgaccccccgactttcaaantgctgaccatcatggagggcccagctcagatgcttccccttccaggaagccctctctggtcttccagctgggcacaaccacagcctcctcagagctggcacacctcttttggggcaccctctgccttgcatggggtcaccattcccggntaatttctggtggcatcccccgattccagaatagaatccagcacacattatgtgctta

SEQ ID NO: 15117 - DNA, 1706 bp, Homo sapiens
  misc_feature (1)...(1706): n = A,T,C or G
gagagtaatacaccacctaggatgatnatctctctcgcctattaacnagtaagatgcggaagtacnaanagccacgagagggggncgnggngtggctttctcgctgngagngaagaaaancacgcgcgcgatggataagaaacggtttctccagacgggngaggggctctaaacccctcnacgcgcggagacactatatagtgttgaggcgacagcgacngcatatagcgagagagagtacgagcgcgcgacgagtctaatagatctcagcgcgagnagngtgcncggaagacgagctgncagntgccncgagagtgtcgtattccagtgtgtggacgcagcncgcaaganacatatacacgcgacgctgtgtgatgttgtctcaccaccacgactcngcgccgctccggaggcgaaatccagtacaaacagatatgtgtagtacgcgacacacctacttatagtattaccgtcgaagtagtaccanaagtatccaccacacaagcagctagtgcgccggcgcgacatacagaatgatccacagcgcagctcagcagtgnatgcagtagagctcagtgatgccngtccaacngacanacacggccggacaggcacgcgctatcccactggcagtgcgtctgatagatcgagagnacgagatagacttgcgatttngtatncacagcacacagcgccattcagcgcggccgacgatgtaggcgcgacgatcgactccgtcacaagcagacacaacgcgtgtgcgnctgaagatgaatagtcatgacagtgccatcgcacagtacttcgtntaggaagagcgcagcaggataagtaacgtgtgtatatcgataagtatattgatcacgcaagcgaacgacaaacgggaccacgacagntgttgtgtgcgtcaagagtgtccaccacctcgagagtcgtcacgntataggaatgtcacatatgcgcaggtcagtttaccgctagtgtagtgtaagaccgacgacgcgacgccgtctatatacacattagccaccgcgtgctgtcgtctcgtgtgattgtacacaattcaacgtatgaccaccgttggtccatagtttgacaaaaaggaggacacaaagtatatagcctgtggcctgcgtttaccacgtacatcaataactagtggtctccacgggtccctattccatcgaccgcaccagtgtagattaaggaaacagcgatgtagcgtcaccggaggaggagtaggccttaaaggacgagatccagtaaacagtaccagtagaaatagtgcaaccaaaccatgatactctaggtctattagcgcatgcgactaacagtcgtcagacgacaagacatgtgagtcaagcgatagcgcacgngngcgtaccagtgatgacaagtgaacaggaagacggcacgatagcgctgcgngcgatgntagatancgaatagctactcaagagaccggcaaatgnatgacgactgctgacncgacgagtctagtcgtagagtgacgagcacagtgatcgagtgcatacccacatatgcatgaataacgttgagtatatcgtcttagcacncgtctcgtcacactcgtacagtgtgtgtgctgtgcagttgcacganagagtatcatagatgcaccgcatcgcacacngcatcaacgcgctncgactgtctntagtcttccactcacgcgcgtcactcgc

SEQ ID NO: 15118 - DNA, 1030 bp, Homo sapiens
  misc_feature (1)...(1030): n = A,T,C or G
acgcccgcgaccgcggagaagcgtgcaacaanaacaaaaaggagtttttttcgaaaacccgagcaacatttatccggccacgcccgcggggaccggaggaggggcgccaaccaaggattttaccagggggagggggccagcgcaaccaaaaggaacacgcagacacggcggtgagcccacacacccgcggcccaagccgcgggaagaaagtacccaaaaccaaacgtaaagagcaaacaaacgaccacgaataacagacaagggcaaccccgcgaaacgggcccccgaaaagggggacggaaactccacccgggggcaaaagccccggaaaacccaacccagagcctacggaccatatccgctagccacgcaaaacccaccacacccacacgaagcactccaaagccgcgcaaacgcggcggagacacacgctccaacgaaacaaaccccgaacggaaccggcaaaacccacgaccgcgatccatccgcacacaacgcgcgcccatcagtcggcacaaccccaacgaaaataaccagaccgcaccgacaacaagagaagaccctatccaaaaccaaacaagcgagagccgatagcatcacaaacacgagggagggaacaccgcgcggaaaaaagcgcgcctgacagagaacaacaccagcgacccaccgggcgagaatacaccaccacagagaacaacactaaccaagcacacccagcgacgcacgccaacgcagcgcgaggacaagacacaagaaagcacgggaccgacccgaaagagacagcgaacatacggagacaaggataaacaccaactacgcagagcgcgcaagacgcgcacggaaacacacaagatgacgacataagcaagggggagcacgacaaacgccgtgcgaccgccaacgccgaagcgcaactagggacaagagtagaatgcgcagcaccaacgcacaacagaaacgcatagcatcaggccgaacgcggagaaccgaagcaaagacgaacgcacagggaaaggccccacacacagct

SEQ ID NO: 15119 - DNA, 871 bp, Homo sapiens
catcaccgctacctcacccgtcccaaccgccacccgcgaccccacccacgacccccccacccggcctccctaccgccacatccccccccccctcacacccgctattcgctccctcctaccaacaccccacatctaaacctaacccaccccccagccaaccaaccaacccctcacaccagtcccccaaccaccccctccacccgccgcccccgacccccccctcaacccctccccccccccgaaacccgctcccaccacgtggtcttcgccccttcactccccaccctcccacccctcaaactcccgccccgccagccacgcggcgctcccaaccccccccccagacaccaggtttcccacgcctccaacgccaatggtagtttcaccgctcccattcacaacggccaaaaaccactacaaacaaggcatcactttctcccgcaacgccccactccctctttacaaaacactgttggaaagcgctcccacacaccagcatatgaaggataagcagagacctcgtccaccatcttgcaagagcacagtaggtcttgcaaaggattccaagtttttccactgcaaattcaaggctggcttgtccccccccccctatgatcatcacaagtttccctttgttatacggcatgaagttacattttaaaatgaggacttctctagatcctgtttttcttttacacctgtcttcataactgcttctttgtccgtttttggctactttttttttcctgtctctaccctctcccagaaaaaaagtcccaagcaaaaaatgtttgtctcaggtgattagtttgtgcaaaaataaaatcggagcgccagacccccccccctggccccaacacaatgcggctac

SEQ ID NO: 15120 - DNA, 1204 bp, Homo sapiens
  misc_feature (1)...(1204): n = A,T,C or G
cgattcaccatattcccccaanaatttatgnnntntccnagagcaggtgttaatgggggcaaccaagagcgcctaagatttttgccgcgggctcaccttttccgccatatatatcagcagcagggtattacatacctcacactattttgcaccaggtcggggccgcccaccccaaccatacatataaccaaccgttcattcgcccgcactataataaactagcaataccaccccgcgcgataactaataatagtcccgcagatgtatccgccaacatgtttgttcacacgattttaggcgccctgcgcattccactatatgctgcctttccagagcgcgaataatggacgaccctatagtcgcgggcgggtgggtcgttttctngcgttgtgagaaacgcagcgacgcgatttacgcgagccatatatcatcaccagggaccaagccataatgcgtgccgcgctcagaatgagcgaaatagattatacacatcttattatcaacaccccaccaccgttctcccctccctgtatttattttatttcaaacctgattantacaaatatatttgtagatataatattcttatcacagcgtatatcgtgcccccgcgcccgcaatatttataaaaaagattgtgatcatcgcacttctactaacacttacactagccaccccaaccaacaaataattttgcaatatgacaagagttgtgcgtaggattacacaatataataccgatgtacgcgttggctcttgagtcttcgtagcccaggtgcaaacacgcccgcagcatcgttgtcctaacggtaggaatcacgctaggaacaatatacgctaggcgtggtaacactgagtgatctaggcacgagaggtaccacacagtgtgatgagactatgcgagatgagttggtgcgtcctgcgcgttgatgacagagaacgaggtgacggcgtacaactcggatgcaacatacaaactaacgtatcaatatggagtattactgcagcgcacagctagacgacaataagatgactgtccagcgacgatacacaatggtgttccctagtacatagtagtcccagcctatgctgaccatgttgtatccacccacgcacccacacgctctttgtgtatcgtgctagcnagtgttcgtaatcgcatcgcttcgttatcccgtctattatggttcactcccgctctcct

SEQ ID NO: 15121 - DNA, 1418 bp, Homo sapiens
  misc_feature (1)...(1418): n = A,T,C or G
acacgcaccacgggggcaagaagaaagcagaacaaaaaaagcagaaaagaagttttttttttgagaaaccacaagacaacacgaggtatacacaggaccgaaccccacccgggagaccaaggcagccggggagcgacaccacccaaacaccacatctagaacaacgcggggagccgggggcgcgcaccgggtacagcccgacacacacgagacgagagacgagcgcacgcaagaacaacacagaagagcaaccacgaagagaacagagcgcgcactcgcggtgcccgcggcgccgcaccaccagagacaccacagggtcgaagaggaaagaaaacgcaagagacgggccaagccacgagaccccccacgacggacagggcggacgggcgccagatagcaaagacgccagagaacacacaaagccgacggggggaggacccggagaacgcaccaacagacatagcaaaaacagagaatccagacaccaaccccgcagaacaaaaagacaggcaggcacccccccagaccgcacagaacggagagcacaatgaccagaaaacgacaagaaagaaagggggcaggaaagcagacaacaccacaacgtaacgcgcgcaacacgagaatagagagaaacaagagccaaccggcagacgcgcgccaacacngcaacagcgcgacgcgccgcgaccggcaaaacaagacccaccatagaacaaacgagagcaacccacgacgcaactagcaaagacaacagagacacgcacgagagcacagcggagaacgagcacagcgatgcacagaacgcaccagacggcgacacaaccacacatagagcgagcaagcacacgcgacaagcgagagagcgaaccgggagacggcgcaaccgaccgcgngagcggcatagagagagagaggagcgcgccgcacacacacacataccagcgcacacgctcacacgctacgacgcacggcagaagcccacgcgacgaacggcgacgcagaagagcaagcccaagacaagacatgcggcgagcaacagacacggcagcgcgcacgccgacacaagcgcggcgagcaggagacgtaaagacagaagagcaggcggacgaagcgagagcaggatgggcgacgacagtagcacagacagacacaacgaccagatggacatatcgnacgacgcggaacaacaggaagaatagaggcagcgcagagtgccgagtcagcaganacgangacacgacncgagagnncgccagtgcgcatgggagacgaagagcacgacgacgcgacaacgcagagagacagacgaaactaagcggaagagctagagcagggagaagagagcctcacggatancgagagagagagaacgcacagagcgcggagccactggagcggcagacgccgcncgcgcgcag

SEQ ID NO: 15122 - DNA, 1416 bp, Homo sapiens
  misc_feature (1)...(1416): n = A,T,C or G
gatatgcatgcaactcgacgtcatgcttacatataacccacacgcgtaacagaccccgttgagtacactagacctcctcttaggaagagcaccctatcgggtcacatgcagagaagcatgggattgagggaccccatactagcatagcaacataggaagtatagagactccaatcgctncccagtctatcctaatagagatgactcagnaacgtcttccctgatctngatattctgagctatatgactcctataganaacgagagtcaagaagcacaccaggcattagacgcantgaagagctngacgccgatagcttgctatnatgcagaagagaatagccgagagataggatagncagtcacgcggagtnatctnctggnaanctgacgccacatgatgatcgacggggaggcgnaggcgagagacagctacagctaacatgtgcatcanacngatagatagcgtctgtacgaggangagacaatgagagctcactgagaacancggnagtgacagaagtaaaagagnacaaagatagagaggaagcgtgccgagcggcgcgagaagaactagtcgacgcacgancggcggactaataacagagagaagacgattagaggcgtcgccgtaaataagaaagtccagctgaaatcgcgacgcacgatcagaatacacgctagcaacgtagcgcgcgcatcttgatngagtaagatatcagataatgaagtgagaggaacaagatgnagatgatagaggcagntgntagaatcatcctatacgccgcggagtaaacagatagcgagatgatagatacgncaaggagatagaatgcgaggagcgcganacacgatgacgatgtacgcgactccaagtagcagatagcgcaagttactccgagacgcagtangaagggtgacgacgggcgctgagctgcgacgcgcgtacatggactacagatgccagngatacgcgacagnagaacgtatcgcaatacgtcgcatgaaggaacaccgtgtacgatcagaagtatgcggagtagtangagagatgtcgcgactagaggacagatatagcgtcacgtgtagaccgcaggctgcgagacagaacgagcgnagaagtgattgagacagttgtccgacggcgcgagctgaccagatcagaagtgagagataatgatacgcgagcgatcacagagataatgatgcgagcgagtatcaggactgatgtagatagtacagagaacacangcgctgagagcacgaggaagcaggcgccgcgngtcaggacagcagatgatatagacaagaatcaagcgggtacaancaatgagagaatcggtagcgtacaagtagagtgtgcgtaactagtaagnaagagcagaaagacacatgagtaggacagtacgaagacagag

SEQ ID NO: 15123 - DNA, 1941 bp, Homo sapiens
  misc_feature (1)...(1941): n = A,T,C or G
acggtttgtgtcgcaccgagatagataatcaccgcagcagcgctcgatataatgactacgnaatntgaactgcgcagaganagnatggcgagagagaagtctttagangcngcgaagtgataaaaacacatnaccangcngncagctgaaacaacacgatcatttctcacgtcgacgagactgcacgtgtgatgcatcgtnactcgtcgtcggagactctnctagtcggagagngcccacatcgtgcgcagattagctggtaagangttacggcggccagcgtaatatgatatgaggagatgacgactctgtagcncgnancgacgcctcgctcgtgaccgtcagataagactgtacgcatattatagcgcgtcanagtgatactgatagtatcgacngcacgcagcgagtttgatcgatcgtncttgaccacgcactgcgactacagcgacgacatctccatgacacgagttnatgtagaaaccaccgcgccaaatgatantaccacctctatgtaacgcactnatatacaccgaaccgagtgagtatcacacaccantcagtagctagcggtcatagtccagncgcacgcgactcngcgcgactgtgcagtcgtgcngtgtggtgagttacagcgagacatcacgacancacgactacgntcgcacacaagcacaccgagntgcagagagtgagtanattacggtagcagtataagcacagtatgatagacgctagangatcagcaatgatgagacgagcacatagtgtatangngnagtgagtccgcaaaactatctctatcgaangagcgatgtgtgcactacagcagacacgacgtagacgacgggagtgatgaatgcgaagaaatacncacgtgtataantagcgcacgaagagntgagcgcgtatagtatgcgtgctggntcagatatcgtgtngtnatacgtacccagtgaacgcacnacgcatagactgcagcgcagctcgcagcgcgcgnacggattgtatgantatggtntgtggtactgacaatcntcgcagcgagaggactgtagagtncnagcgagcgtatagcgcagtctgcgcatcactcagtcagtgtngagtgttaaacgaaggncgacagtggtcacgtgactctcgcgtcacacacancgatncgctgtctgtcgagagtaccatacgacggttatgcgaacgaatacgcgcgacggtgagaggatatgtcagccgaccattcctactaaagacacgtccgacanatcatancacgagactagtgtgtcgagtgtagcgtggcacgtcgatcagttntcaggtatttcgcatgctatgtggagccgatcatgtcgagtgaacacatatagatactacgcgtacgaggatgtgtcgctngtcgcggnctcgctacacactatattccgacatactcacacatgacgcgtagaagagttagtacggggacagggaaggtgcgtacagtaccatctatagagacacgaggtgtagcgccattagttgatcggcagtacgctcgatgagagagcatctgcagaatcgagtgantgagacgcatacagatagcaatagtacacgtatcgacgcagagcaggagagcacacagctcaacactctcactcgtacgtgtcgcgcacagcggtggcgacgaccgtagtggcgagtagtgcgtgagtgacacaatacgacgggtcgtgagatatcgcggcgtcacatagataggcacgcagtatgtgacggcgaacacacctgtcgcgcagagtttaacgcatagatattgacctgcgcccccggagagagtacctatagtatatgccgcgcacaccacncacacctagagtgtgtacgcgtgtagcgtgattgagtggcgcatgaagacgacagatcgccgcacatgatgtgagcatacacacgccatcg

SEQ ID NO: 15124 - DNA, 1935 bp, Homo sapiens
  misc_feature (1)...(1935): n = A,T,C or G
gcgcggcgcgagctgtactagcaacaccacatatctttntnnnnnntannaaanntnnnnnnnnnaatcnaacacagnngggtncctanctcttnntccggtagatacacagcgcggatngataacnaactttttcttcctcntcgngagtcgctctgtctctactncacgatagagatcactctgagcaggacatcatcctgctacacntcactcaacacgtctgttctttctcactgtcgcacgccgcggtgtgaggaggtggtgagccaacgaagagataacttcaacagcaatagacaaatgcatcctgcgtagatgcgacgcgcaggcgagtatgatcgctgcccacccgtccgtgttgtgttgtgtatatactctctcgtctgtatcacgagcttngncagagcacattgcgacatcacaagtgtgaagctactgtatacaatccagccactacacctcgccccctgtatctgtagttttntctacagcacaggagagtgatcataacgcgtgacagtcgctcgactactatcaatngtnatctananagccntctctcacctcgtcccgagaggatggtgctgtccgctgatganntcgttgatcgcagacgacngagcagacttcccacgagatcgtagcgatgactcactggtantagtacananctatgccagctgacatagtcgcggtacgtattggagattantatcgtcgcgtagtggatagtatagccagcatatgaactcntgcgcgcgactgacgcataacgattatcgcatgccatcacgctgctagcatanacgactgatcggactactgctctgcgtncattccaatnacacatgtaancagatccgtagtctcgcacgcgnatagcgcgagatagcatgagtatatngtgtaaagtaccatncantcgtcgtgagatacacaccatcgagacgtcgtatagatatgtcgccatgcatgcgcgncgacgancgctcgncaacgagttagtacgacgcgcgntagtgattacacagaaagngccagacgcagncgtaatnttagtagcgctagcgcatatgctaacgatgatatacgcactcantgagtacacagccgactcgagctgtgagctcgtgattagttgtgtatcgtccagtgacgactagctgtcgctcgtcggtcgcgcgtatnanctgtagtcatgtagtcatcactaacgcactcatgcgtcctatatatcgattgtcanggtcctncgtgcgacgctnctcgcgcgntggtgtngcgtnatagagatcgatgattantgagaacaagatatcgacatgaccggatncgcgagcatcgataacaatatatgctatactagtgcgtgcgagccntgtggtatgaccgacttacttcgnagtatatctatnatcatcactgagatgtgacatcaccgtgctcgactatcagcncatcatcgctgtcacgcacngagncatgacngacgtgtcngtcgtgcggcncgtgtgattcaagantaancgagacgactagancncgtanctganacatacgtgtgtatgtcanctatcgtgcgacgagcagnacagctgcgtntacanagatcgacagaaattacttnctacacggtnancgacggcagtactacgatgagcntnagtacancagtcgtgatatatcgagatcgngactagtcacgagccactacgctactacactgccatcaggatcgtnagatgacgacatagatcgagatcgagcgtcgacgatangcgcgcagcgtagntagcnttatcgatatagtcggcnatacactgcgtcatgacaagncgcggagagcagagagtcggcacagagacnatagatcnncgatgnatctgacatcgcacacacanctgctctgcncntactgacgattcnccgcac

SEQ ID NO: 15125 - DNA, 1333 bp, Homo sapiens
  misc_feature (1)...(1333): n = A,T,C or G
caatatccccatatgtgccccgaacaataaccaaagagaccgagggggngggctcattgcgcgaacaaaacgcgggggaaaatttcccgccgcgggcagactttgcggggagatacccggcgcgggtgtgccccgacgcacagcgtttgtgtgcgacaagtcgcgcgaccgaacacaaacgtagcgagaaccgaaggtgaataacccccccggagatgtaccagatggctccaacgagtcgccgatataccataaatacgccgccctggtgtggcgcgcagtgaatttatgccccgcggtagtttcgacgggggagcgagaagcgccggcgcaggacaggggcgagggggcgagggagttagagcgcggaggacgggacgaagtcgcagttgggagagtgcatgcattgtcagcgatcctacgccgcgggatgatacgggggaggaacgatacggcagcggaagagataaggaggagagacgtgagagagattgtgttgtggacgacactgcggtgagagtgtgaatagaaatatgccaccgccccacactcgacccacgcagaagagtggtgcgatgacacccggnatagcggagacgcgtaaagtgagcagtagcacgaggatgtccgatcggagtgagttagccgccacccaggcgggagtgtagcaacacctggttgtgcgtgatacctttgaagtcaacctatcgcactgccgcggacgagcccgtacgagagtgatggagagcgcaccgagtgggatagaagcggaggcacacaacggagacaccagtgtggccgagagtatcggatgtgagggctgtagtcgatatattgcgcacacaccacggcgaagtgaacgtgtgacgatctacacgatgaaccggcggacacacgactcgcgtgacgcgccgatgcgngacgagggcacagcgtgaggctatccntagcancgcagaatgcnggacncgaccacgngagtgtaggtgatgaagtacagagcaccgcgaggacgcgcagagctcgcgcacgcgagacgcgtacggaggcgcgggagagtggcgagagcatgcggaatgcnggcaaggacagcggagacgaaagagcagtatagtacatgcagcgtcactcagcgcgagagatagtaccgtgacgcgaccactgttcgccacgtagattagcacggcgttacggaccgcgcgcccncaacaatctcctactttcgatgccnacgccgcattctacatcgatctgtgtggacacgtcgtgaccactgaagagacgcgcctcacatctgtaacacatccgattaggtcgcacatccacgcgatnc

SEQ ID NO: 15126 - DNA, 1795 bp, Homo sapiens
  misc_feature (1)...(1795): n = A,T,C or G
gcgaccgggcgtgccgggacaataatagtccggttcacacaaaatagacgccagaggaggngctaagttttgtttaccaccacgcgagcaccgcctgtcnctacatgggctgcaagccacacacgagggtggcntaggaagcatttctcgtcttctatctcacatatacacgtatattatcaactacacccggcggagngtgaggttgctacagcagaagtatacacgangagacgagacgagcaatcctacgccacaatgacggagcaagccgtcgagcagcaccagcatgtgtgcatcagtgacacgtctnataagcacnagcagagcggcatgcngaggtcgtgctacattatagcaagaagcacacacgaacaccncaactactcgcgcaggtgncgcatngtatcgcacgcncgctatacacgatagttatcagatcgagcgcacactacacntagcgccgtgtnatcactncatgtgnaagtatccgctagtatagcgtgagatgtgtagtagcgacgtgcagtgntaatacgtangcatccantccgcattagcatgccgctcactgtagcttctantgtgctgggcggtaactcgctatcgtgaccttctcggaagtatacttatcatgtgcagtgcgcgatctnactaccgcatctattacgacgaatagctatagtacctagacgtatccgatctgatctagtatctagcatnatagacnattcagcatacaacctacatcatgctcgaggcgnacgtcgctgatgtagtacagacaatgatgacgcggcgcgntcgcacacgtcatcagtactgcgatgtagacgctatactcgcgcactcgttatacgcgtgtcatagatcagggantgaatgcagncgcgacgagtagcggcngatcagccgagacganctatcgagncgacatgtatagacgaccagaatgactgataacagacatcacacgaacacacgaggnagtcacgaacacgcgatctacggataacacgcacgaggcagacgcacgagacgtgcgcgtcatgacacaactncggcggccngacgtcgcacgctaacacgtcacacgtatgtgctgtcctatcgtgagccgacgctatgtgagtgtgcatatggcagttagtatcagccaatactccgtgttctatcgtaattagtacattgcatgtagatcagcagtctagttgaccatatgcacgcgcgacganacanattntgcatgtatctgtcgcggcctatgtgtaancgatgtcgaggtagatgactgtancgacgcgcgttatcactcagctacgaacaatcacacgattcactgatgacgacgctatgtagntgntatgtcgagatatcgctactcgatgtgagtatgatgcgtgtgcgtcgcgttcgccgtgcagcacgagcncatacantacnatctagacccgtcattccgacatcgcttgagtctacanctacactcactgaacntcgcagtangtncatgccacagctagagcgcagagtcagagtgatcaggcgcaacgaatcgtcgctcgattgganactgtcgatgcnccatcgatacngcatcacntatatagcagctgatacgtnagntatccgttatatgtaatgtacgaganctcatggtnctcatacgtgatttagtcgctgcgatgcagcagtagttgacacnacngacgtngcagctgacagtctgagagacacgagagcgacgacagagacaatgagatgagacacgngtgatatagtcatgagagagagt

SEQ ID NO: 15127 - DNA, 1865 bp, Homo sapiens
  misc_feature (1)...(1865): n = A,T,C or G
ttgtactagatgattcgagctgacgacaaggcggctgggcggccgcgagatgcgattacaatgagtgcagagtctaggatatggcagctagcgcttggctgcttgactgttatgccagctcggtgtcactagagtattagataatgtgtgaccgccggcacatccacgcgcagcacggagtgtagtnattatctncggctgttacgcacgagcacccatatgatatgagtctgagatcatntgagtaatctgcaaagataaccagcgttgatatagtatatatgcgcgcccgcggacgcgcactcgcgcnattatctgtgtatatctactatgagcgccgccgtatacttggtattcacatatgtctgagttgacagctatcatgcagtccggaacttgacattagtatgttatatgaaagacgcgacagacgatactacgacgaagagtcacattgcgancacgacgagtcactcgattacgcggatgatgcgaatgctgaatactgacagcgatcagtagtagagttccagtagtttatcagtctantnagtataccatgtacagttgagttgatagcagcatagcataatgtgcgataagacaactagactagacgatagcctggacgcagncaatgagagantgctgcacgcgaatgtgatngtagacgagngtagttgatcgactacgtccgtatagacgcatgtcgtcactnaganattcnctagattgtggcgtgtcantggtaccgagncgtcacactatgtactgntntacagtacagagcgcatgctcgcgcagatagancngatgctgagcacngagatgtgacgcgtgcactcgtccagcgtctagncagtgtngatcatcnatcgacgaancgtcagctgagcatgacagagaatacgttcgacagtctcgtgcgatgcgcgcagagagtagcgattcagtacatatgtcacgagcgatctctacgtcagttgtagacaagcggtcgtgtagtagattanatgtacgatggcgagagtgtattgagtgcgcgggtgntcgtcgcactctataagatcgatcgntntattgagtatgatgaacgagacgcgagtgaagntagtcggccgcngtattgtacatcgctcgatcagtgacgccgagantgatagaattatgaagagcgcgagctactcgacgcagttcgacaggtanatgagatgangacgcgcgtaggcgactagataccgtgagcgtatgnangatatgagtcgcagctatcggancagatacgcncatgcgtgtcactcgcgctctntatattgnattagatcgacgcgtcgcgacatcatcggagcgntgtagtnantggcgcatatagtcatgtagcatcgcggcgntgatgtgacatcgagatatagtcgtatacttcatgccgcacctnacgcgcgtacgtcgtccatcacgctctatgatctaagtcntcgtcgcatcgtcggtgcgagcngngngcatngtgatgtcacagttgcgcgatntagtcaatacgcacagcgactctaggcncntgtagngangagacgacacgatatnatgcgaccggtacgtatcgtnagataangtccgccactgcgtnganagcangatgacgtancgncagcgagatgtcgtcntgcgactgatgtgacgagtatcactncagatagntgagcagtacgaatcatactgagtaanatgcnncnatntataatnatgatagcggatgntgcagtctgatancgatcgtngcgatgcgngtnatacgtantgatatgtcngcatacgatcancgcagacgacgcaagatcatagaagnactgtagtgcagtgacatg

SEQ ID NO: 15128 - DNA, 422 bp, Homo sapiens
tttgcgttcccccacccccgcgtagttcgcactcccccctcctcctccgcccccacccccatggtccttctctgtccccccgcaataactcttgtcgtacctcaataaggtaatgtataaccaaccattctccccccccccgctcaatgtaaaacgggactttttttttctcactgtgattctttccctatgtttttactctacacatttccacacgtttacttttcttgaatttgcttcccagtaaattagttcactgctggcacttctttgtagtctattgctatggcccgtccacatgtttatctgaaaattatgaagattcctagagtttctttacacttgttatatttaggggcaataaaaaccgcagcggccgagatgtacgccacatcgccaccccccacccccccgcctcccac

SEQ ID NO: 15129 - DNA, 1031 bp, Homo sapiens
cggctccccgtgattcgcccaggctagtgtcacaaagatcacagttccgatgttatatcccgacacagatcccgcaggtagtattcgaccgagtcggttgtcccctagggactctgctatcattcgcgcccgcgcaaatatttcgtattgcgcggcagtccacacgtcgattgaacataagggaggatttttttgcggcagaacaaagccccctgcaaaaatggttccgcgttttccccaaacgcctcccccgggggaaatttccatcaaaaccacggggggggtggtatagccgagggggcatgtttatatctggagggccgcagatggggggcgcttatcccctccccaccttaaaattggggtgacaccccgcccgggggcccggaggggagtttttagaaacaaaaaaaacgctttgtaaacttttgggggagcggcggggccgcccttcctaagataaaacaccccccccccagtatggctgtgtgtcttcttcacatcccccccgcggtcgtttgggggagggacttctctaccccacgaacatgggggggggggggcgggggccggcttctcggcgcccactcatttagtgtgtcaacaataaagtattagacgggggaaggaacaccccacccacgtagtggtgcgtgcgcactgtcggataggaactatcagttctttattgtggccggaaagggggcaaccaccccccacgccgctaatatgcgatgaacatggggggcgaggcgctatatcaccccccgacctgaaggaggacgggacgtccgcggtccgcagtatgtttagtattacaacattagacaagacacgcgccgctagggcagaaagcccacgcggtgtggcgacacacttacgctaattgtcgtgccgcctctgacccagttgttcctacgttatcaccacaccgtgagacgagtttatctccgcgtccggcatacacgatgtggggagcgcaatggtgttgcgcgcactcatctgcggcagatagttaccccactcgcgcg

SEQ ID NO: 15130 - DNA, 1493 bp, Homo sapiens
  misc_feature (1)...(1493): n = A,T,C or G
cgtgccggccttccgagaacgcaaacnannnnnnnannaatannnnnnngaaaaaggggggtttttttgtgagtgacacacgggcgagacacatgtcttttctctggntgctcgaccctgcgcaggggtctcacttggngagcgctgtgcacacacataagacacacttataacttcaccagaccctcggctgggagcggttgngtgcaaacgtggactcacacactaacacatatccgtgcttaagtcacgccggagagtgtctacgatgctgcccacgtcgtgttaatatattactttctagtgatcttctgtgcgcgactacgctattctctaacatatcgcgcacacgnatcatacnagccacgcaccaccnctgtcttcttattctncacgccagctcagacgatgtnattcaccagtgttacaatgcatcantggcacnaattaacctctctctgtcgagntcggtggggtgtgtgagcgtntcacggattcgaacgcttcgcgtcgcatcactcaatcttcacacgtagtcgtcgaaggtacctcacctgctctcattcaactntctgatcttgttctgtctcattctgcgcntcagtatatggacgacgtattctcactcacnattcagtaggtgtttatatgtatnttcgcatgggtatatgtatcgttatagccagattatangcattgaatcacntagcagtttggaccatatcgggagtaggtggtgtataatagcagctcagcgcgatatgtgactcgctgtatggaagtagatcgcactaacagatcatcgtcgatagatccgtagcgtgatgttagcccgctgacgtacgtatctcaattatatataatcttgttctctgtgtcttcttctggctattgagagatagaagtttactatctcgtgtcggcttgntgntatatataacggacgtatggtattcttcgtgacacgtgaagacagtatgtgttacggtcgcgtcatcctcagactcgtcagactcagacttatttcgcttnttcgtcgttgcagctggcgcancgtgccgttttcctctcgctcgctcgcttcttaactttccgatgtagcatcattacgacgatgttgcatctagtatgatattacatacatctacacagtgacntatgatataagtttctgcatgagtgatattatactagctgcaggatggtacacgcgcgtactattctcctnactatataagtgcactgcctattccacttnttcgcgctgccgccgccgagtgcagactgtgtgcgagtactctcactgagtcgaatatgaacctctactcttacgtctcccgcctnagtacntgtatatcgtggnacagttgtatacgtnaggatatgtacaatacgcatatactcaccagtgctgtctgtcgcgtcgtgtgtattcgcgcttgctagtaacacattncgacacgcgagcgantctcggagcgacacacccggct

SEQ ID NO: 15131 - DNA, 1579 bp, Homo sapiens
  misc_feature (1)...(1579): n = A,T,C or G
ctttaaatataatacgtatgaagatgagacgacccggccgttcaccaacgcgcggagnaagtctagcgcgtgggggaaccaagcgtcgaactagaccttttccggcccagagctacagtagatacaccgatgaagatcgaccgtcacaggcaagccgcgccgctcagcccagtgttataagccgaccgattggctacgcccaagtgcgcatagaccaatcagtaaagatgaatgatatgtacagcacatatatatatatatagactcgcgcgcgccgcgcacgcctggtatgatacgactggatagtatgtgcccaaccgacgtgatcactncacgtctcatatcttcgagattacggcgttcacatactatgtaggagaactgaactgtagaacgcggaaatctacttagtacgagagaatgtggacgacaggcgaggagcggcgagtgcacagtacagttagtatgagatggaccatcgntacagacgcgcagtattccagaatcaatacggtaaacgaagtagactgtcatgcggcacgcctcgtaatacatcgacgcgcgcgtcgtacgacgccgaaggagcgactcactaggcaggcgcgcgcagagtagaatatacataggcacgcgtactancgcttcacgactggcctcgtagatcacatacgagcgcgtgcgccaccnanacagagttagaatacgccgccgccgcacgttntaatacgagcgattacgagcgntagttatgtccaccaatcgctaatatacacgaacgataagaacgcgaaccgagactgttaatagatcacagtcacgtacgcgcacatntacggtattagagctacgcacgggtgtggtcagagaaggatagagatgacgagcgctgtcatcagatcgcagcgagtgctataacgtgtgcaggagacgaggngctatagcgagacacgatnantatattanacgcgagatgcgcgtcgtatattaccgcgctcgatatgacgtgcctcatcnacgacccacgatgatagagatagagataggacagagacagcgcatacgctntatattaatatactaatatcacatatacacagnaacgacacattngcagacgnagtgggagtgagatcgtagcgcgntnaaccgatcgcattatattanctnaatcgcgacgcgacgttgcgagccgagataattacgagagtgcgtgtagcacagacggcgtcgtatactacatatagagtatcttatttgcgcagacacattaagagcgagnanagcatgatggtngtacgtgtcactcgcttcagaggtaagatgtcatacgcacgcatataattgtacacgcgatcattgtatagagatcccgaccgntangtatcgcgtatgagagctattagagcgatagagagatgtacgcgacctgcgantacgaagcacgtacgtagcagtagtacgatacgtggcgtanagacatcatgcttgacgaagtaggagtatagcgagcggctcataactctgcggcgtcagatgagtgtgcagacagcagtcactagtaaacaggagcatggcacgt

SEQ ID NO: 15132 - DNA, 786 bp, Homo sapiens
acgtgcgctgtacctcacatcgttccaccactatgcactcaccgccggaatattactatcgggtgtcactttgctcgttatttatcggtaaaagtggcaaggatgagctgtgtgtagcatcctatgatcgcgaagggccaccgatttggccgccaacccccccctgactcccgtagactcacccgtctcatgggctcgaaccttacacacctcttaaacaaccctcccgtgaacgttacggtccaagataggtcctagcagatttatcaccgcccactccggtctatcaatgttagccggaaaaataaagtcggcggttttaaaaagcccaggtggaatatcaaggtcgggcccgggatctaaccaagccaaaataactaatgggtaaagaaattctaaaaaaaagggctgatttgcccttttcccacagtcggcccaagcccccccctcattcccatggaaaccccccggatggtgccaatcaagttttccccccatcataggggcattgttttttgttattatgtgagttattagcatcagacaatggcaccacaggagacacagtggaagcaggagaagtgcctccttgtttcacaaagtctgtgttactgtgcccccagagtctcgcatatagtttagttgcatatattcattttggtaacacgtatgtggaacgacgaatgtgccaagctaaagcccgaagccccctccttatttgttttcagagcccatcaagtgttcatcatattacatcccattgctctctcccttctcccgctccga

SEQ ID NO: 15133 - DNA, 1098 bp, Homo sapiens
caattccataatccccgtatagccacgaccgagcggactacttggtgacaagccgaataagtaggcggagatacttcgggatattacacgggtggtacagccagtcgattttgttggcgatacgagggcccatcccagactaactatgagcaccgcatgtcacggcggttattacacaccgattgaccagcaactatagccttcgtatcgacccctatataacccgacacaagttaccatgattccgcccaattcgattgcgccgcaccgagatcatagactgtggtgagcgccagatagagtatcgatcgttcgttagaccgtgcaagaggaataaacataaagaagagtcgctcaccaccaatagcaccagcataactacgtgccatggtacattttggtagacgcaggacacaagcggttgcgacaacagccctgctctgtttatattatacccaccccgaacgggaacccaaccgtggttggccgtggcgaccccagtattctccggtatcgatataatgacaactttttaccgtggggtgttgttgcgcacccccgcccgctgagctcgacgcctcacgtcgccttctatgctgatcgcatttcgcaaatcaaccgagacgaaagtgattataactcataatatatacaggcgaagagatgacgacaagtatgcacagatgaccggagatcgaaattggtcggttgtcaccctattgctaccacacccatctgtgatgatggagccaacggtccgatctctcctagctccgtgtggctgtacatgcgaggatacatattggctacagagcatagtagactatacacgtgcttgggatagataacgaaggtccggccagccccgtcggatgatatgggcaacggcgacttcctatactcctcattacgtacacacaagttgttggtgtagtcacgcacgcaccgcaccgatatgccatccctccttaacccttgtgtctacttttgcggtgtgccctcaactctcactggttttccaacctcctgctaccagatatactatcggtccgtttatatcacgtacgatcgacccgagaattttgtcacccacgcttg

SEQ ID NO: 15134 - DNA, 1072 bp, Homo sapiens
  misc_feature (1)...(1072): n = A,T,C or G
gcgcggtgatcgagcgcggagtggtgacaagaanagcgcccaaaggggtatttcgtaccacaccggggcacattctcgcggcgttaccttcttgggtactcttggccttttgtaaatcaccgcgttatccccgaggcgggtgggggtgtgtgaagttataagggaagtcgacaagaagcccggtatcccacgacaattgggtgttttacccgccatttcgagtactcctcatacaaccagagccgccgcccgcatccgtttttgtatagcgatttttaagtggatttctgaccaaagagtcgattctccttggcggggggtttctacatatgttccggagactacttcgcgaacccagtggcggcagacgacgttcgtgatcgtggtgatcgcccctagagcgacatctgtaacaatccatagcatagacactttgtcccctcccattatgactctctttcgcgctttgagtgagtggataatcgttgtgcgttttacctccggtgtgttttcgagtacagcccccccagtgctagcgcgcaattagcagcgctatcgtcacgatatatttatcgtcccattgattgttagagtgatcgcaggagtgtatggtcagcctattgttacatctaggacagagcgtttgcgtagttaaagtttgttgagttcacatccgctcgttgctaattaaaggattctacacttcctcccgtccagtggatccattctccttgttctggatgtataggtgcaatatatccanactggggcgaccagtctatctaaaaatcgtatcgtccaccttctcgaagtacggtctgttcgtgttcagagcatgttcatatgcgatccggtcgtgagacgcagatagaagatggtgttctgcgtngctcgttgttactcttatgtcgctgtcccgcagcacctgtcgtacaacccttcttcatcatcctattgtagtacacgttcatatttaatgacacnacctcttattcctatacgaaccgcagttttagtgcgtctttcgcctgtggcgtgcctgtcgagctccccatggcgccgcgttgcggat

SEQ ID NO: 15135 - DNA, 850 bp, Homo sapiens
ttcttttatcccccgctcacaccaccacacgaacttataacttcatatcgcacccctcccacttctcaccaaccgcaaaacctccgcggttttctatgcaaagccatagaagaggtccagcatcgacccacaggtattacgtcctacagtagctcacctacatcgtcctagtttcactcgcaccaacgccagggccgcagaccaggctagattcccgtgaaacaatgtggaatgggttaagttacctacagtgccgcccctgcttcaccagcatatcacaagatgtggggcaatatacaacatccctccatgaaatacctgtttggtctagtggtctagagtttggtgcatcagggagaaatatgcgccattatcccctcacattaaaacacattccacttaggcatctcctgtaatctcattggaaaaaagtgtggacgttatttgtaatttcactcagaatgataggattagtttggtactagtaacaatggagataagtaactaactttttgtgaaacttcttcatggggtgaaacaaaatctattgtggaaactcttttcaatcatctctggaaatttattaagtgacctagtatataacgataatttaccatgatatttgataaaatacttttgtgtgttcagaataatttcttttttctttacctttgaaaataatgcattgatagttaattttctcctaaattatctgtttttatttccataaaaggtatttattgaatgtctccttacttttaatataactaggcattgtgtgatcaaagaaaaataaataagatgcgcccacctgccgccccttcgtgcaacgaatcgcacgttcgcatag

SEQ ID NO: 15136 - DNA, 530 bp, Homo sapiens
attaaaaaaacactggtagacagtcacctaaaagggcgcgtgttgcccaggccgtggacttttttttgtggggcgcgtggccttggtccccccaactaccgagaggacagtgggcttttttttttctggggaaaggtttttgggaatgaaaaatataccctttcgctttttgtgatctagggaaaaagaagaatattttggtacccttccggcgggggaaaaccaaaaaaatatactggtgtgcggggcgcgcggtccctttttgttggaggggtaataagtatgccgcgcgcccctgactcgtggacgttcaaccgacgtgagatgggtggaggagaaataccaaacatttacaggggggaatttcggtgtttcgcaatacgagtgggtaacgggtgggtttggagccgttgcatcatcgcggggttatgatttgtgaggtcgctcgagccgtaggccacgatgaagtggtttgatcggagcaggacgcagagatattggtggcattggtgttctatggttgatggggg

SEQ ID NO: 15137 - DNA, 879 bp, Homo sapiens
agcgagaatcaaagcaatacccatcccacatcatactcgcgtcgccgatcaacatactcgtatattagcaccgtatatacctagtaacataggctaatcagcgcaggcgctcgccgcgcgagtgcaatactccttgtgtgtctaacgtcctacttaccatacacttcacgctcctgccgtcgcttttccacgaatatgtggtaatctatttttcgtaccggcctataaccgctcgccaccaacctttatttacaaactcctcatagccggtgcctcctctctgggtgaataacggtgccaaccaccatttaagggtccccgaaggtcaagcaccggcgaaaagcaccaagactatcacaacccggcaaatcgtaaatctgctctctcgccccccgctacctccattaatttacccccgacccgtcaatatatactcctttatcccaacggagccctggcccaatcagccaatttcagttctatacgtgatcgaagcggatgttgattattttcatcctccatcgtgaagttcccatcgcagcagtccgcttacaaggcacttcaaacactaaggcctgaataggccggacacggtgactcacgccggtcatatctgccctttggcagcctgagacgggaggatcaccggaggtcaggagatcgagaccaccctgaagaacatggtgaaaccccatctctactaaaaatacaagaattagctgggcgtggtggcgagtgcctgtaatcccagctactcaggaggctgagatagaagaatcacttgaatcctgcaggcgaaggttgcagtgagccgagatggcgccactgcactccagcctgggggacagcgtgagactctgtctctaaataaataaataa

SEQ ID NO: 15138 - DNA, 983 bp, Homo sapiens
  misc_feature (1)...(983): n = A,T,C or G
aacctangccacccaccacagtgatgtcaaacatgangaatctctgtcctcccaggttagataactccttngnacgcatcagcgtgggacgtgtcgatgtggcgagtctctactcttcaagtgtaggagcactcctctcccgctacagggacaccccacccttctagatgagacgtgaaactcgcgagtaacagtagatcatgggggggtgtcagtacacacacatgctttaccactgtgccaccaccctccgtacttncccagtactctttacgttgaacattaatcactatggatgaactgtaagccttcgagggctactttggccctcacctatcatacttgggccgggatacaataatcacacgaactatggctaacactcatagtacaggtcaaggggagagcggcagacacagcaggagggcccgagganagggctcaccgagtagccccgtagcctcgggatcgatgaacttctaaacgcttgggtcagggacgttggacgtacgtttggtgaactcatttacctgttcatttggaataaaagnacactcttctcggtaagacattnntcatttgacctctccttctgtatncatattacgttcgnctctatgacacctncctggtaggcgggggcgggaccggtcattggccgcgcacactctcctaatcgagaccgttgtcttccgcncccctctcccgaacgccaccgcgcatggctcgtaatcgggctcgctctcttttctcttccccctcttngtatttactattaaagaaagcatattgnaattcgtntctaccctccaaccttnctctcccttctctcctcnnccttctatncccttctncctcttctnnccctttctctcttnnactcttctnctttccactanaaaattntttctcncttttttnccaanttttcttttctccataaacccacctctccttcttnttcttttcattctttcttattt

SEQ ID NO: 15139 - DNA, 927 bp, Homo sapiens
ctggcgtgcctcacccccactccgccgtcccggctcgggccgcggcgctactccgacgcccggcgcgtacccgcgaccagcacgcgggcgcgcatcgcgctcagcatgactgcgccacgctctctaaacaaatacccacaacgtgcgtccaccctacaccatcgaaaccctatccgccacacccctccattctacttcgctgctggcccatctcgcttctccacctccaccccccccccgctcgccgaacgacattggcgccacgcctgccactcgccgcgcgagcgaaggcggcacatgccacgagccggccgcgccatacgccgcgcggcacatccacgagcaccaaccccgccaactcccatggcgttaccagcccccccgcgcgagttgccagcacgggaaattcccctggccgccacgcccaatctcacacccccgccgccgcagcccgggcccgtgaccacaagttcccccctcgccccacgcaccctcttccctcacctccccacccagctcacgagggggcataaataggaggcttatgccaagtcttcccacaggcgaagcatccccgactgatctgccactctgctagaataatggataagagcaatctgggcactgttccccctgggcagaatgacatggcggccacgccctcttcataatctcctgttgtgatctatcactgggccagaaggaagaaaatggacccccattgtatgtttccagtgaagataagaacatctgttgaatatcttgagtctagaaaataacattgaaaatatagtggttgaggaccaattcctcatcctgaagtttacaatgtaatgaaaaaaaggaaatgtataattttaataaaaatggatgccgcccagtcccccctccatcttaagcagaccgccaaccaccacacccccgtgc

SEQ ID NO: 15140 - DNA, 410 bp, Homo sapiens
atataacgaagaaatttagaaaaactgcacgcggttaatatgggtgaacgggagttgataatagctagtgaagggttttacagaggaaaaagcgcacgggggacacaggcgaggtagaaatgaacgttcgtctaggcgattctcgctaacttaccgatagacccggagacacgcattataaataatgtcgctgcggcgggagaggggaatcggtagatgcaaaaaaaaataaataagataacaagtggtctgcaactagggtgtaacatgacagggcaacaaaaatagacaaaattacagaggcagaaattcagtacccggggaattacgggacagaataaaattaatcacagggagtgaaggagggcataatacacttataaagaaggacaagtatagcgcgagataaa

SEQ ID NO: 15141 - DNA, 601 bp, Homo sapiens
ttactacatacaccccgtcggccaaccggcggctaccacgactctcgaaaggaataaaaagaaacaaaggctccatcttatatagcaaacaatcagcgctacaagttattactctcaccctctaccagccgcgcgctctccactgtccccgaatgactacaaacagagcaaacacccggcactcccagggccacaacaatcgcaccccgttaatcattataaacccggcaatcccactaaccgatgaaaagcggcagtaacgacccaggcaagcgtgtataagttaacacgcactacaccccccacacgccccaggtgtacttggtaaccttcacccaaatattcctgcgtttagcggcgcaccacaataggtgtctcgtaattcaaacacgctagccacctgatcgctacgaaactagcgccataaggcgtcactgacacaacccgcattaccttccccaacgcgagggacccacccacctgtctagctctagctggcaaaagggccggggcgtgagatgactctttctaggccgccacgcggcacaaggcccaccttaaaggtacaggatagagataagctaataagcccatagaggcc

SEQ ID NO: 15142 - DNA, 714 bp, Homo sapiens
  misc_feature (1)...(714): n = A,T,C or G
ctaattacactcccctatggcgtcgccctccacgtccatcattattgtcattccgcctctctccaagcgcaccgcttcctacgcaggctgcgcatttcaagtccttgtcagttactgtacaatgctcactctgcagtccagcggctctgactatcacctgctctccccgtgattgcgagatatgacatctgttgacctccactttgcgtgttcgccacttcgcactcatatatctggacatgcgcgactgccgtacaacacggtatcggcgtgtccgctcctctagaatccaacacgagctgtcccacccctcacacgtctctccatcagtgcgggtcgtcacattccatttactatgttatattgtcncacacaggcggaccaatagcgcctgggtctcgctcgtggcgccataagatatagcatgcacgtatcgccgccacggcgctacacctgagggcctgcgcccctgttagggtcttcagagccgagactctttttccgtgctattcctgggtaactcattattgcttcaactcccaagccccgctcggcgatggccttccgccggtcgttgttactctccgcccccatacactcgcaggtgctttacctatctggcgcccccgtgtggctccatatgagacgcgagacgaccccacggctctacctggattccaagatttatttagccaattaatccaggccacgcgg

SEQ ID NO: 15143 - DNA, 410 bp, Homo sapiens
  misc_feature (1)...(410): n = A,T,C or G
ctccatcccactatgcnctgtcgcgcctcgcaataacaacacaatagctcaccgcaaacaaccgccaatacgcgtcccctcctcagctcctaccaaaccccagcgatacaaggggatgtccttcaccttccaccccgcgccccgccgctacttctcgttactcccaacatcacctcgtctcgcgctaccttcggatatcatggactgatacgcctcgcccccaatgactgaaaagaacacggccaccaacacgaaatactatgacgtcgggctccaacagataccactgaaactcggaaacccacaaacagcaacactacactacacattacgcccccggcattaaacttaccctctaactcacagcatcccccccccgtccgccgaaggcagatcaaggggggtgctac

SEQ ID NO: 15144 - DNA, 905 bp, Homo sapiens
gtcttacaccacctccggcccccaacgcgcgccacacgcgccacgccccatccaccataccccacacacagcgctgctccactcaccggctatcacccctaccgctctcccaacctctccattcttccgccactcctcctcgctgacacagccactcctacaattaaccctccacccctgaactccggcatacgctgcgtcaccaccgtgctcgacgcccctccacccacacccggcatcccttcactcctctcacagcgcgcgctaacccacacacgcaccgcgggacacagaaaaaacccccccgccacctcctccccgactaccgcgacgcagggctccacatccccgcctccacacccttaatttggctcccagccccccctcatgatccgccggcaccacaagcatcacagcgtcaacgggcctactacagttaaaccgccaccccacccagcgcttcccgcgcccagctctccgcttaacggtccagcgcatatctcaattcaccccagtcacaggtgcattttcactcgtggtgagtcggcccccacccacaagccacctgcgggatgaacgcaaggtacgaccatgtacatatctttcaagcaatcgcctataaatgaacaagtctgcatgtgtgtatacaaggagtgagaacttacaattttaaatactcacatgaatatctcaagtcaaattgactcagaaaaatcatgatctttgtaaattctcatttggaaaggatttgacttaaataatagcaatgatgatgtttaacagaaatgcctttacataacaatgttgtggtttactgaaaaaagctttatattgctagtcaataaacctatttgccggcagcttctccctctctctttgccctacaccaccgcgccgcccgcggc

SEQ ID NO: 15145 - DNA, 578 bp, Homo sapiens
  misc_feature (1)...(578): n = A,T,C or G
ctatattcacaatacataccgggtgagcaaggggggaagattngtatatacgagaaatcataacaatggactaaactgagcaggattaggcaccacggacgaacacgactagactcacaagggggaagcatctacacgatacgtcgtcctctctttgatatctttatcatcaaagtgaagatctaactttaagctgtaccaaatcgcgacaggtagggcgaacaaaatgcgcgatagcggctggaataaaacgcaacggtggtagccatccgcacgcagcggatggggtgggtgcaacgaatataagaaatagtgtcaaatatcacaactgcccccgccatgcatgccacaccgcgctcttgcccacgcacaacaacaccaacattagaatcatttcaagaacaagacagctccactatccaaatactagcatcccctctcgtatacccaaacactcgccccaccgcctcaacaacagggactatgaagcgagtacacattcacaataaaaaagtctctcacccaagcgaagtaacgatgaactggaacctaaaaaaagaacgaaccagagaacgcgc

SEQ ID NO: 15146 - DNA, 910 bp, Homo sapiens
aaataagaataacaataatgaacgtaaaggcaaacaaatatagaaggtgaaacgaacataaataacgaaagacaataagtgtaaaaaggccgaaaagaactaagaaaaaaaggaagataataaataatacatgagcgcaaagccataaaagaaaacaagattgcataaaggaagtaagaacaaatggaaaaggatgggagcaaaaggactctgtgctgagaattaaaataaaaaagtcgacaacacgaaagaaatgaagtggctgagcaaaaaaaatagggaagtgtggtagcaataaaacacaaagcaacaaaacaaaacgacatatcgcgatgaaacctaacaacaaacagataaaatcattatatctagaacgacagctcaatgtaagtggaggaacacaaaatcaataaagaaaggatagggcacggggccccccccacaagtcgacggcatagataagataataggccaaaaaaagcaatcacaagataaactgcaaagcaagtcagacaatttaacaccacagtgttgaaattaagttgcaaaagactctcttaaataaaccgcaaattacaggtacaagaatgttccagaaccaagaaggcaaaggatcataggtacttcaaacctataaaagaaatgaccaaaaggagagaacatagcagcacatgcacatggtgaaacataagtattaaacaatcgcttaagaaaataaaacatctccattccaccattccccaccacaatacctgcttctcacaggcaacgacttttatcagtttgggtttttaactcttctggtactttccccaaaataaaacttagtttcagacattattttcgtcctaaataaaggagatgcggcagtctccaacaacacaaaaaaaaaatgagcgagcaatcggca

SEQ ID NO: 15147 - DNA, 880 bp, Homo sapiens
atttataacatatttgcgccctaacgggggaaaatctatatttcacacgatcagatgtacattaaagtgtgctctaaatatgtaaaaagtaatggaaacaacttattgatttaagcttttgtactcgggtaggcatcacatctatatctatgcttgtatagtaattaaacagttgcgaatgactggctaaaaaagcacgtcgcacgataaccgatatatttgggacacaacgaactcaactaatgcgcgggcaagcagaacaagtaaatgggtaaaacttattatggacctaaaagcttctccctgcctttgtatataccttccggcatatggcacccggacgcttgagtcaggcccacgaatccttattattacctgttatcacaaggaatggtcctcagaaggttccccaggagtgtttgaaaagcaggccttacaaaaaacaaccagagtgagcttctcgaaggagggaggcactttgcactagtctgattcaaagataaatgtgctgcttagtctcatgttattacccccactatcaatccagtgaaccaagaagatgaggaaactatagcgcaataaacatgtataaagccactcctagatacatcataataacattgctcaaatgtggccagaagaaaaagacattgtacatacacaggagcaaaaatgaggattgcatcagcttcctttctgctcttgccggcctctaccaggagcagcaatgcacacgagcagacagagaagcaacatctttaaggtactgagggcaggagaagttaatgtagaatactatgccagaaaaaataaattcccaaaagtggaagtgaataggtcagagcgcagttttatttattgacaaactgctaacagtgag

SEQ ID NO: 15148 - DNA, 185 bp, Homo sapiens
cccacttcctccacgactcgcctaacaccgattaacctaccccgatccccccccaaagccagcttcaccaacccccaccattccacacacacgagtagttcctccggtccaccacaccgctccagaactctagtggccgccagcgtcctccttctggtcatgcccgccaggaatattctttttac

SEQ ID NO: 15149 - DNA, 804 bp, Homo sapiens
cgaagcgcatcgatcccacgttcggaaagcaccattacgtccgacgtgcggatgaggaaagaataaacgagtgcatccaatatgaacctaatcgcggagtgcgcaaatcaccaaggagggaagaattccccatgggtataaagtgtaattgtaacaaaaaaaaaaagtttaatgagattatgttctttcaccataaacatactcagccgaaagagctcagggcgctagttttcctccaacacttatcagcctacacgcaagtagaggaacgcgatgcccgcgagcaagaccagaatgcaaagtaattgatcctagaccccttaggcataaaagattcccaacaggaagggacctaaatccctgaatcacagaaagaaagagaaatgacagccaaccaggagaatctatcatggattgtcatagaataaagcctaaaattaaggatgaatattacgtgctgctttgacatctggtatacttggagaaccttgaataacctagttgcaagctttccgtcatcctctgatcctgtggataaggtgccatagccaagcaaccgtccttatcagagaacccagtcacagtttctgagcaatgggtttcagtttaccaccagcccacagaattattcaaacaagccaatgacatcctcttcagggaactagggagcatctttccctactgatactacaaagcctgcctcccataactcctaattattcactccggtcccaaggaaaacctcacatggtcttgtgaagcatgtgttgtcctcctccctcagggctgtgagacacggacata

SEQ ID NO: 15150 - DNA, 700 bp, Homo sapiens
  misc_feature (1)...(700): n = A,T,C or G
gcggctggggcgangaaccaggtgtcttgctgtggctcatgggatgggacaggcatcaagggcggctgggggctatgatgagcaagagaacttacggggggaaggaatgaaggtggcggacgcgaaatgatgaagtggggtgttttcattaattctctgaacaggaggggctaaaaagcggggggcgaagggggagaagggagggaaagaaacggaaggacaagggaattactatgagaagagatggggcatgaacgaaaggggtaaggtgggggggagtgggaacaacggggaaaaggggggcacaaaaacagaagggggggagggggaaagaaagaaaaaaaaggggggcgggggaggaaggaaggaaaggagggggggaaacacagagggggtggagggaggggggggggggggccccccccactcctcttatttatgtctatagcagtatggggggaacaaaaggggggacaaaaaagggggacanaaaaaaaaacgggaaaaaaaacaggggacaacaggaaggaaacacaggggagggggacagacaacaaaacaagaaaaggaaggaaagggaaacaaaaaaacggaagaagaaaaaaaaaaacagggggggggaaaaagaaaaccagggacatnggggggggaagggacaaagacagggcgggggaacatggaagggaggggaggaaagagg

SEQ ID NO: 15151 - DNA, 407 bp, Homo sapiens
atctaacacactccttgtatactccaactgcccacacccccacttcccgccataatcccctcctcattccctgatgaatcactcagacacgaacacacggaactatggtgccccacgacctccaccaatgcacacccaagcgtgtgccaaaacacctaaaaacgtgacgacaaccccgttcgcattaaccgccctccacacgtgcgcatcccctctgggttctagtccacacaacgtcaccctacgtgcacactgacacgttcgcgcaacttcacaactcactttaaagaaaaaacacttcaagtgcccgcgcacccaaaggcacccgcgcaggcggcggggaataacttcgcaacccaaccgcgactcggtcatctatgcgcccaagtaacgagtgtaatagaccc

SEQ ID NO: 15152 - DNA, 1114 bp, Homo sapiens
  misc_feature (1)...(1114): n = A,T,C or G
agaaaccggacgggggaaagacgggacacaaaaagggaaaactttatattaaaacagcccccccacctgtccacggcaacgaaaccccaccgggccatgtcatgcctttcgcatttttaacttaaagggggagggcggggccctagcacaaaccagatattaaccttacaatagacatcncatttacttatcaaaaccaaaatctgactgaggtatgcctagccgcgcgccgcgcgttaccacccattagaaatgacaaaaaacgttcaacactttcataaatttcacccaataccttttatacacggggggggtgactcctacccggtgagccaaccatcaacagacacattcaatcccttaagctttatacgacaacgactatccctactatcttacaaactccgcccggtacatccatcatcattaacactgatacaccattcactcgctcatcggacaacgagtatatcacctcttctccccccctgctcctcacctaacttacaaacgcgcgcaatcatcgggagtccaatatgataataattaagattactcaattcgactctgcattgaaaatccacccactcctctcgtcttgcaacacaaagtcacaaacacctaccgtatccttcgtttatacaagacactgttacgtacacgctataaaacaacaatcggtggattcgtatacgatctttccccccgcgcgtccccactctaacaaggatctcctatgtactatacagtaatatacatgcgcctacattagtactgctatgagttactgactttaccattcaatcnagttctacaccatagatcaccctcttaccaaatacgcatatttgttcgcacaccttacatatatttacccatattacctatttacctctctcactctccacatctaccaatcctcatgtttaggctccagtgttcaagctcatccattacattgatacagagcacattaacacaaacaatacatgtagtattgatacacagacatcaatgcaacttntatgttagtatgtgtagtgaattataatacatgaacagctatccagcgcgctatcactgacagctggtcatagccactaatactaatctc

SEQ ID NO: 15153 - DNA, 327 bp, Homo sapiens
atacccccgtcggtatcaacgtgtactatgctgtaaacgtatttctcgtactttgtgcgtcatcgggaatatcacaatcggtgcacccccaatcccgccataacagaacgaaacaccattcctcccgaaggcgtgattgatgacagcaagccaacgcgagtaacgcgtcgaccgtccagaggtcgcggacgggtgcagccaaggcgcattacgttggaaagtattcgcaatatatggtgcaacatcttcgacgcttgatacatgtggtgatataataatacaaacgggtggacgggctgacgtattgttgcacgtggtttctcgtgt

SEQ ID NO: 15154 - DNA, 1590 bp, Homo sapiens
  misc_feature (1)...(1590): n = A,T,C or G
ccgacgacagcggagcgcnagcacctgtcaggtactaatgcgtggcgcctgccagaacagcgnngaggagagcgcnctcngtgtangagtggataccctagtagtgcactctttcgtcatgttgttctcctgangtcggtntgagtatcctatgtgtcagcttcatnctccgagcgncccccgtgatgtagtatcgactcaatcagctcagtcttcgtacgcccatagtaggaggcggtgagacgcggcgcgacaacgtatcctttatcaagtcacctcctcacatctcaaatatcacattagtagctgaagctgcgtctatgatgacagaagattgcaccagtacgcatcgtgagcagagtgctgcgctatatntattcaccaatatcgcgcgcgtctcagctccgcgtaagaagtgtacagacgagcgtcgtggaagaatgaagacatgcattagtgtactcgcncattgctcgtactactatcataatctactcgcccgcgcttgctcttacgtacgggcggggcgtgtcgggcggaaccaggctcacgatagtcggtggcagacaacgcctcagctagaagagcgcgngttgagacatacgcgcgtcanatatgatatgaagctcgtcagtagatgcacacccgaggttctgccgtgtcgcaccgatctcagtgcgcgcatgtacgcggcgatgagttgtactgtggcgcaccgacgcgatggtgaataggagggcaggataatgcgcnatgcagtatgttgcatattctgccttgcgatatgagttaggcatgattccgtgagagacgagggtgatggcaggtctgtgggaagtgtacgcgaccagagccacactatctacattatgcacatgatagagatgatcacgcatacaagtataattagtcggtcagctgtgcacactacgagaagnaccagcagtaacattgacacatatacaactctgtgacgaacgcgagtatatgtctatgtacatctcacgtgtgcggtgcgcgctgttattccgacatctcgtaagagtggttgttactggatatgtgccgacgcgcgacacagcaagttcagaaaatatatatgagggtggaactgtatcacggtgtacgccctcgtacacatacgagtncgtgctatatcttaatgtacgcgagtacgcaggtggacgngatggtcctagccagcagaatcacgcgcctaggagtgcgcagcagtatcgcagtttctatgtgtgcaactcgcagcggtatacagtagcagcacacgtctggggtcaggtatgattgtncgtgagcgctgtcgacagctcgacacgtagnatacgctatgatacatagtgtcntgntgggtcacctgctcgctgtcacgngcatgtgtgtgtntagcagggcgattgagnagtggacacgcgctgtgattgtgagctgcgacgcncgtgcgaaatagagacgatgctgantagntntgtgtagtgcgtgnagtagantagcagagtgtgaagcgncgtctgccgctgtgctgcgcgtactcgctacagagtgtggagtctgcngagagtgatgtcagatgag

SEQ ID NO: 15155 - DNA, 1421 bp, Homo sapiens
  misc_feature (1)...(1421): n = A,T,C or G
cagtctcggccgagataattcctccagaccgagagagacgatcagcgccaccataaccgcagaggccctcgcaccgcggcaggacaagcggcggcgnatatagaggttgtgctctacgacggcaagacgcnaccgcngagaatacacatacacacagtctggaggccagcatccgcgcgcgcgatntgtgatctctcnagtccaccatccgagagcgcgcacacaccacgacacaaaatacgcgcaagacaacgcacctgcgaacactggcaagtttcagcgctcccatcgccgagaccgcnacgacacgccggattgatgctgccgcgcggcattaagcccgaatgagtggacggtacgcgtcaaggtagacacacaagggatatgtatgacgacagcgcacgggcatggggcgaagttgccaggacaaggaacacgcacgggagtataacatctgtggtcgtgcggcggctgtccgacgtnaacgcccgcgctcacctcgtcctatgtgacgcgagggccaccacncggcacgacgacgaacgggaaggaaggcggagaacaaacatataagaggccacgctcgtggagactatctgaataagttagcccagcgcactcgccgcccacacacagtgagaagccaggtttgcgacccactgttgcgacacatatatgagtcgtcagccacgcgatgataaccagcgcggtgtaagtcgcacgccacctcaccgagcgcggacgaagagcatgcctgtagagcgccgcagaagaantgcgcatgatccccaccccgcagcgacgacacattagtactggtgacgagggtatctacgacgagaggtacagaactctggcgaccggcgtaacacacagacngtagagatgtgcacctcgtgattcgacgtgacacacangtgcagatccgcgccgccacgcgcactntgtagtgcggacacacgggatcgcgcgcagacacgccacaggatgacgccagtagtgtgtacgaagcgagtggtgagtcgcgagtagcagaggtcaaacgccacacggactcgagtagcgaaatcaacgtctgtatgacgaccaggccgacaaagagtcggaggataagacgcacgagagagacgacgacntcaaggcgcgagagtgtcgtcgtgatgcacagagataatagattgacgacgcgcgcataccggcaccgacacaacatatacagtaacagcacgcattaacggaattggtgtgctcagngtgctatcggtcgtacgccgcgcgagcgaagcgactgttgtgatggccgcgcgcacgcctcgaccgacacgatagtatngtatgcgagntaccncntactctcntagcgcgctctcaaantaagactaccgctccantnagtatgtcgcactgacacacatgatgtg

SEQ ID NO: 15156 - DNA, 1410 bp, Homo sapiens
  misc_feature (1)...(1410): n = A,T,C or G
ccatattccaccagacatagtctccgccatagcaattatacgcaataagagcaccacagaccgcaagggagccttacccgcagcggcagaacaacagcccgcgncagaagaatctctcgctctggcnnacagacacctctgcgcgtatgatcgagcactgcgccgggcgaccacatccccagcgacgatgttatttcttggtgcctcacgagggcgccactacccggactaaagacgcgcgtaactgcgccccctgcttttttttatacacaaacaatcctccgcaatttaaaaaaatgacccgcgactagtgtccccagttaatacacgacacggctgtacacaagcgctcgcgtagtattataacaaccacacctgcacaatcgtcactgtgtgacacanctcttagagacagcagagacgagcagatggaaatgtctgctggcgaggcgcagcactccccaatgaaggctccgtaacacaacactgtcgccggacagcgaccataacaaacacaagaaggtcagacgagagtacccagcgatgtgagaatgtctataataaacagaagaccaccacggactataccgtgtgtngtcgtaggtgactaataatgccgcccgcaccgcacagggcgcggcccgacagagagagagattcctattttcaagcccagagagtccggctccgtcggaacgtctcttctatccgcgacgatacatatagccgctagagatgagatattgagcgccggccgcccgcgctctgatngngatgtacatacaccactctcgttgtcgtcgccgggttgncgcatcacactatagcacactcgactcgcgcacntactctgcgtaatgaagnaactgcgtagacccacacctatgatggaagtgtagcccatgtgcacactcgtgaggccacatatagcgatatatttgctgcgatttgttcgctcttgctcccagatgtcggaccactcacactacacaaaagaggtgtagctgaatagatgaacagcctagcggcgacgcatatagcacagcgcagagcaatcgccgctacggctctcnttatttcggttatcacacccacgtgtctagtgttatatatcagtgccttggcagtagaggagacctacgctgcgagaacacgcgaccgtgtgacggacattcacaggcagnagcgtggtgaccttattactctagtatagtaagtgtacccgcggatgagtctcgatatttcatgaaccgcaccctataacagtgaagtacacaacttgatggtgtgcgctcatacagcaaccattagaatcctcacacggacgcgccgtccgagtgactccgtctcgcggtatatagatcacgcacaggtatcgcgccccgtatttttaacatcacccgctccccg

SEQ ID NO: 15157 - DNA, 817 bp, Homo sapiens
  misc_feature (1)...(817): n = A,T,C or G
agatttatgtccaaagagccttttcaagtaatgcgtaacccgccggggtttgtncccaccgtctgagcttagactcaggcctctttctttacccccggtccaggtcaagggagaatgcctttttcctttttcacttgcgcaatgatggtaagtttcctgaggccacccccaaagcagaagttttacacgccccagaccaggagctgattcaccctcttatctttataattacccagtccccaggcttttaggcagaagggccttgtgttgttcaagatgagacttgggattgtgaacttttgagttaatgcagaaatgagttaagactttgagggactgttgggaaaacatgagtgtgttttgagatataagaaaaacatgcgatctgggaggggatggggcagaatgatatggtttggctctgtgttcccacacaaatctctttttgaattataatcttcagtgttgaaagaggggccaggtgggaggtgactgaatcataggggaagacttctcccttgctattctcatgatagagttcttatgagattgattgtttgaaagtgtgtagcacccctcacccttatttgaccatggaaagatgtgcctgcttccctttcaccttctgccatgattgtaagtttcctgaggtatccccagctgtgcagaactatgagtctgcgagtcaattaaatctcttgtctttaagttaaccagtctcaggtatgtctttatagcagtgtgagaacagactaatacagggcctgtacaaatttgtattgccaaaagatttgtaaataaaaaacgatgcgggcca

SEQ ID NO: 15158 - DNA, 858 bp, Homo sapiens
atatttgctcaccccaccgcttgccgaaacctcccctgcgcgcgtaaataccgggcacacggaacggacccacccttcgccgcccacaactatcgaacatacccgtaagacccccaggtttgcgggctccaaattctatcaccaattaacccagccaccccgaaaggcccgactctaacaaggtgctcccgcatccttaacccccccccacccaacctaaatacttgtccccgggaagctaaagaagaagtaaatctttccaaaccccccacaaaaaacctcccatgtgaaatggcagcagacacgagtgatgcagcgcaaagccaagaaacaccaagaactggtcaccaccagaagttaaggagaggcaaagaagtgttctacctagagtctcaaacgtagcgtggctctactgaatcgtttacttcagacttctactctccagaagcatgagacaattaatttccattgttttaagccacccagtttgtgatatttggtatggcagctcaaggaaactgatacagctttttaaaaaatacaacaacccgttgagttttaacttgtatgagatatcagaaataacaccggactaggagttaaaggacctacatttttgtcccaactctcttctaactcactgacactgacattgggcaagtcaccaactttctctgtttttccccttttacaaaatgcagggattggcttgcatgttcactaaggtcccctcgaggatgacacgccccattaatagaactcttcattttacaattctgaaaatgttagcataggaccccaaattcaaatgacaccaataaaaagtaaaatatctccaaataagacgagatcggccag

SEQ ID NO: 15159 - DNA, 1343 bp, Homo sapiens
  misc_feature (1)...(1343): n = A,T,C or G
cggggcgccaaagaagcgggcggaaacgacggaacgagacccaaagcccaaaagagccttcgtgggggcggaacaagcagcggggggngacttttcagagggccagagaagacgagaggaagagaaaaagcgcgcaacgaaaacgcgcgccccgagcagcgggtatgaagcggaggcgccgacgcgcggacgccgggacgagagatagacaggcaccgcgcgacccccgcgcggagggggcgcggccacgacgacgcgaccccgagaaccaacgaacagaccgccgagaaggcccgcgaatcataaaacacacagagaaaggccacaagcgaagaggcgagcaacaaacggggcgagaggcgacaggacaaaagaggggcacgaggcgaaacaaagagcgagagcgagcggggaagcgcacgggcaacaccgacaaagggcgcaagaacagcgacacgcgcacgagcggcacaccgagggagtagaagagcggcaacgaggcacccagatgaggcagcatacgtaacaaggaagaaatgtgctgcgatggcgcaccagacggaaccgacgggaggccccacgaggggggaggaggggcaggagccgacccgcggtgagagacacggtgagggggagggcgagccaccaatgattaacaggagcgcaagggacagagccagagcacacacaaggatcggggagcaggccagaacggggagcggcgacaagagggtagccagcaggcccagaacggccgaagcaagacaaggggcggaggacgagacaaaccgaggacggggagacgagcggacaggaacaagacccggagagcgacgaggcagcaggacagggcgaacggacacccaaagcagacacaaacaccaagagcgtgagagggagagtgaggacaacgaaagccgacggcggcgacgagccgagcggagagtgtctacgaggtgagaggngagagcgagcagccggcgacacggagagagagcagaggagccagccgcagagagagaggcgagagaggcacaagaagcgagccgcggcgtacgaacaacacagnctcacaacgagacacagccgcacggcggcgccaggagagacgggagattgagggagagaggcaggcgacggcagacgaacagggacggcggaagcatcggcacgaaacgaacgtcacctcacacagaccgcgaaaagtgacagccgagggggggcaagtgccgcaaggaaccccgattacgagcgcgccacccgccaccaccgcgagtgagggcgagcagcagaatgntgcgctgacaaggagagacagcagaaaggaacagagaccccgatcg

SEQ ID NO: 15160 - DNA, 1180 bp, Homo sapiens
  misc_feature (1)...(1180): n = A,T,C or G
ttatccatttgatcctttattcacgcaacgcacaaaanataacgaagcgctctttcttgtcaccgtctgatttgcttataccccgcgacttacataattgttacgggatacacccacccactccttagccttgactcctcatccaccctgtcttaccccgcactataccagcgtatgcctccatcgataggagatgttataggtggcgttgcttacccgtgcgctaacgacacaaatcaaagataattatacaggtcatttcgttaatcaaaatagtgcgatctacttttcctaatactcgtccccgcaattcagagagcctatatgttgttgatagttgcttctatacaactgtatacgcgcgccatacatcgcaatctataattaatgtgtttatctgttcgctctcgcatgccacaccgcatcacgtacgtatatattatgtatctattagtctctttncatcccatgaatttaatcaacacatacgaaacgttgcgagatcgaaatgaatatagccaggtgtaagaaatggctgcggtctctnttgttgctctacaccgcgtcatattcacccaccccccgccatctcccgattgcacccaaccgcgagcaaccgacagccgatgttattgtcgacgggtatcgacctaatacaaatcgtcatggtctgctcagctctaggcaattcgatacgntgtggtatagtactctatatagcacagcatagtaaaagctgatgattcctgcgtcgcgctcctctcgtttgangcgatgaggattcattcccccgtgttgcatcccctcagccacaacacacgctgctacggttcactctacgtatatttatgtactctaaacgcctcacgtctcatgtctaacaacacatatatatatcgtacatacatcgagctgtctgacacaactcgtcnatcgataatatagaagcttcagtgagaatacactgatgatagtgcaccatagtgactacagtaccactactctccgcgtattagacgaccacatgtgaacacatatcactctcaccctccncctcgtctatccgcatagcctcctactcatcctgcacgtctcgcttcgatatntagctcaacaaatcactcaataattctgatactgatatcagtgatagcagcacgaataacatagagtatacgag

SEQ ID NO: 15161 - DNA, 756 bp, Homo sapiens
tgagcctaccccaaactaaagggcatgcggccccctcggctcttattataacattttataaacttcatctcggggagagaaaataaattatcacaccgctcccatctgggacatatccacacaaagcttttttaatccttgggggataaaaacaaattcttttggccaatttgctttttggaccaatcttatccagcgttttgcaatacgctgaaaaataccccctcgcgattttactcattattacacctgagagttcatcagacctctcgagggcccatacgcggttccaaaaacgcaacgcgttttctctttctaacgacaaagggttatccataaaaaaaatataaagccatccttaaacaccgccacattttcttttatacaaaacccccctccatcaatctgatagccctgccctcctaaacggtttgcgcccctaggggtcgcagacccaccagttttatatagaaaggcatgtgctatatccacccttgtatatatcggaaaaaactaacttaaagaaggggccaaaaacggtagttctaccacaaaagttaacaacctctggcctgatagcctttggatccgcgcataaaagaaacatcctccccactaacatccaaattagtcccaaaatactagttaggcgccaatttattaatggacacattaacctgaacacacccaccttccccagccttttgttgtgcgccccgtacaacttctagagtggggatccgttcctcctctcct

SEQ ID NO: 15162 - DNA, 1016 bp, Homo sapiens
tattgttgtttttaatggcgcgtaagaattaatagcggacgagagctcttttctaaaaaaacgcggaaaattacaaggactcggcctggtcctagtgactttgagcattttccaaaaattccttttaaccccctgggcccggccctagtaatatgtaaaggggggcttaccctgtgatatttaaggccttaagtgactacgccagtgaattttgattaaaccaccgtttttttttgcggaaggttttgtacctaaataaagagggacgcagttattgaactatctttttcattgtgggacgaggaactaacaagtcaccttttctgttggcctgcctccgggataaaacaaacttttgcccacctatacctataaatctaatttgtgttggccgtagccgctttgaaatgcccccttctaaaaacccctctcttcttttttaaaccgccttatgtgcggccattttgttccacataacaccggtgagaatacaccagttgcgcttattagaaagggtccctttacaccatacataatattgtgaggatttttcctttagtctcactaccttgttctcggtgttgaaactcgacaccacttcctcttgctcctctttcttttcggtctatgaatgtgtgtcttacatacttgtactgctgattgtctcttcaccaatgagatttggatggatgtagatatccgatttcgttggaagactcccatcacagtccacaaatgcgtttttacaatagggtggtcgcatcacgaacgttccctccacaatactaatatatatttaattcatattagatcctcattgtattactctttctctcaaagagatgctctcaatatatgcatatacatgacttatcctttcgtaagatcatatgcaaagtttataagacatgtcaccactttcgtgatgtacttctttgtatatactaatcattggtaaagaaatagcaacaaataaccatacctctggacttttatatattttaatgtattgtacc

SEQ ID NO: 15163 - DNA, 827 bp, Homo sapiens
cccacgtcccttccccggacccggcctatacaccgcccaggaaggcccctatcccagggaggcaaaaatataaaccccaagcccccaccacccaaaagccgctcgctgggggcgccgacccctcccatacgccactcggccaggcaacgcaaccgatcaaaaatacaccgacttcagcacattttttatttggtaacacaccaaaaaaaaccaaggggaagggcctcccgaaccaaacgatcgctctgggataacctgcccagccatatccaaaagattgaaattggacccttcctctccccaactataaaaacaacccaagatggataaaagactaagtgtaaaccctaaaattattaactccctccaagaaaaccttggaaaaccattctggacattggccatggcaaagacttcatgatgagactccaaaagcaattgtaccaaaaacaaaaatcgacaagtgggacctaattaaagagtttctgcacagtaaaagaaactatcaacagagtaaatagaccacctacagaatggaagaaaatatttgcaaactacgtatctgacaaaggtctaatatctagaatctataaggaacttaagcaattcaacaaactaaaaacaaacaatcccattaaaaagtgggcaaaagacatgaacagacacttctcaaacgaagacagacaagcagccaacaaacatatgaaaaaatgctcaacatcattaatcatcagagaaatgcaaatcaaaaccacaatgagataccgtctcacaccagtcagagtggctattactacaatgtcaaaaaataaacaacgatgcggcca

SEQ ID NO: 15164 - DNA, 451 bp, Homo sapiens
  misc_feature (1)...(451): n = A,T,C or G
tactacaccactgctgaatctaatgatgtggtctatagaatacaacaaatacacacaaaaccacacaggggctttttttttttatctgacaccgcctccttaaagtagttttttatacacagacatgcgtggtgcgagttgctatgctaagtagcaccagtagcgacgtcagtcatatggnagtatgttgatcgtctgtgcggccaacaaatggacgaccccgacccgcctcgtcctatacaggtgcgagagtcacggcaccgcccactacgcagctgtactacttattacgacgtagagtagttgtatatggagactatcattatacaattccgcctctgtgtgtacaggngtcatacgcacagactaaaaacttatgacacccgcatcgtgtggtctctagtatgaagaacgccatgcaaagagcacacatgtatgacgcagttataca

SEQ ID NO: 15165 - DNA, 1575 bp, Homo sapiens
  misc_feature (1)...(1575): n = A,T,C or G
cgggagcagcgacgatgagcgtgggcgacatatattgttaagttactagactacgagagttactcataggtaaaataataaacactgctgccgcgctctgatatatgttntacaacgagctttcctctatatatcccttcgtctcgcgatacaactgttgttgcttgttgttagtgtaatgttgttatttatncgctaaggggtgcggtgagggcangctcccgacaaccatcttacaactctcagactctcaacggatcagtatagccatgtgctacatgttttccatattcctcttctcagcatgtgatgttgatgtatatataatcgacgtcagagcacgtcgaagtactcgagacgcccttgctgccgcgncgtggacctaagaagattcattacaacttgtcgtcactcgtctctgttatagctatgtggtagctgtacgctcggcgcgcgcactcattattccagaggagcggggtgtgttcggtcattctcgtcagttattgcctagcatgatacttccgaatgagtggcggtggctccgctgcgcaggnataacgtttttagggtaacttatcgcgctgcacgcgctctcgttctctgccaatcatgcgacacgccgctgccgatcgcgaccatactacatgatatccgactctaccgcgctgagcactggatctgacgcagcgcgtactacacattcatattcgacggcagacaatgccagctgtagtgtgacgcgnccccgcagtgatatcttacgtgcttctaagtctttcctggcgctgacgtagacgggtcgacttcaatttcactcctacgcgagtacagctccaatgcccgatactatatcagnatgcattaacgcattacgtacagntcgtagcctctatttcctatcgtatcgatctctttgtgaattatacacagtatagtgagacgtaattcgatcgtgacagagccgttcgcagcgcgcgacggcagcaagngtgtacgtgtagtgtcgtgtgtcttagtggtattattcggcgcgcacgcattacgacacaactgacaggatgagtattataaagtatcatcgagnaatttacgtgcctctagctacgactgacacatagcactcgccggtatcacctctctagtgtgtgtgagcgctagcacactatatacgatngantatgaactctgtggcgatatacactagccagttgcatgctcagtcgactacatatatactttaactcgtcagctatacagatagattaacatagcagttgtggtcgattaggctcacnttaccagactccataacccgactctgttctactatgtatgcagtagacattgntatacgagatactacgcactcgctgctatggtgnagcatacttacacgttcttatcnactgttatttcgtcctgtgtcatacagngtcgacgtagagagtctctgttgccttatgtatgttntccatcctctgtcatgtcgtgctgatgtgcgtctcgtacgtcntagatgcgctcctatgtcatatgtgaggtgtagtgagtggcacacatgttctctgtacg

SEQ ID NO: 15166 - DNA, 1033 bp, Homo sapiens
  misc_feature (1)...(1033): n = A,T,C or G
ggataagcctcgcanngtngacnttctacttataattatacacacncngcttacgagnggtattcgattggttagatactttcacatttcgagtacttacgtgccagggtactcacgtgggagtgtcagttgtgtgctttcgctacccctacttaggagattgttcgtnncactctaggactagtgtgatntgtaagaagcacgaaaagggacgtagtagggagactgcgcttcaacctcgctccttctcngagagacagtgcagtgctcgtatatttgtatagaagcggcaacttcgcctgtccgcgagtgggaacgaatggtcagcctcgtgagaatgagaaagacatggtgcgtaaaatgtgatactaacgtgtgttgggcattattgacgatgtacgataagagggaaattatgggcggtggagtgcgggaacgacctccgaacttatggggcaagaaggtggaacacatcaataaataacatacaatgtgggctgaaacataagggtggggatcaacggaacaaattgacgagtgggaatagacaccgggtgggaagcaccactgggaccacaaaggaaaacaaataggggaaaaaaacaaacaattatggcaggaaagaacaatggggaaactgaactataganggggacaaaagcgaaacacaacaaaagggtacaggacaatgaacagaccgacaaacacaccgggggatgggacatggaaaaaaacaaaaggaaaaacggaaaagaaaagggagacaaaaaaaacaaaaggaaaaaaaaatggggggcaaaaacaaagggggggaaagggggaaaacggaaacggcggggaaaaggggagggaacaaaggggggggaaggaaacgggggggggaaaggaaaaaaacaacaacagggggggaaaaacaatattaaaaatataaagaggcaaaaggggggaggggaaagaaaaaagacaagggggaaaaaaaaaagggaatcaataacggaaataaaaggaacagggaacactgggaaaaaaaaaa

SEQ ID NO: 15167 - DNA, 850 bp, Homo sapiens
  misc_feature (1)...(850): n = A,T,C or G
gtgtggtggtggaattttttttatagtgaaaaagtcgcggttattcatgaagcgtatatgatattgtgtaatatttttgaatttataagttgtagattgttatgtatgattgaatgataatgaaattggtggagtatgggatggtaggtgtttgtggtatagagtaatttaaaaagggggtatggatttgaagagttgtttatttgaaaaaaagaagtatctatggaaaaaaagtattgggaggttaaatataagggtagaatagattgtggggagtgtttgtatattgtttgggttggagagcttatcgtactgactgtgtgggggggggtgtaagagaatttttttaaggctttttataaaaaggggcccatgaaaggggggggaaaggggtttaaaaataatgtgaaattgtggtacaggggcccccccccttagagttgggcggggattggattagaggttttttttgggccaaaaaaggggtttttataaaagtaaaaaggggtaacggagggtaaggggtttctgccacaaaaagtttttgaagtttaagtgaaggtgaattttttttatttagctccggtgacagttatcaatggtgaccttgtctcacgattgtaaggtagccantgggttcatgatgttagtccttatggggattgttgattggatgttatttagacagcaagagtgatgaatggataggtgccttccggatcaagagatatgttatttaaaagggaattgataatcagtgaagaagttacgtggagagtaaagtactggctagattatcgaatgttctacattttaaagttctgagagaaataaatgatgatggggcgga

SEQ ID NO: 15168 - DNA, 810 bp, Homo sapiens
  misc_feature (1)...(810): n = A,T,C or G
cccccacacccctcccggacatccttcttnggccgtcgcttatcttgtatagcgccgtgnagcagtgttgagggtgctcctttggataccatcccatgcagtaggggtcgcataatcactgacgtgtcactatctaacgaggatgagtgggctctcggggttagggtgagtgagtgggaaggatctggtgggagcgaatgtatgttgttatttggtcgaccctctcggatcgatatttatttatatgttccttgtcttcgggtacctgcgttgacttgccggctgcatctggctggggcgcaaagcacgtactggacataacctacgcgctccagagagagatggacgtgtgggtagtgtagaattctaattggactcagacacaatatgtcaagttaattgtgtagtgtggatggcggtgggtgctcgtttgtgaattactatcctacagttntctctttnaattaatttatgggatttgttcatatatagttttatatcatcccctttgactcacgtcaaatgtcccatagttcattttattgtatctgtggttacatgttggctagactaacgaaattcctccgtcaattcgagtgggttgcttgaggccagggacgggagcaggcaaggaagcagagacagcttttgggggtggtggaagtgttctaaaagcaaatcatgtatgatggtagcacaaatgtattaatttactaaaactcaaactgtccacttaagatgagtaaattttatggtatgtgaattgtacatcaataaagctcaattctgtcccaaattcacntttattaa

SEQ ID NO: 15169 - DNA, 826 bp, Homo sapiens
  misc_feature (1)...(826): n = A,T,C or G
caagaggtggtggctttgctcgacacctgaacaaactctcctcactcagttgaacaaggtgtctaagaccntaatttatgtaccttcgacttaagaaagaggattctatgcaattcaataaaatagtagaggtgtccggtattcaggttatcacccacaaaaccagggcccacaccatttcctgaaggagaaattaaatgaaatcatggtcatagcaatataaaaaaaggatagtcctaccgctagccttgccaaatgaaagcgtaggcacaacaagtagcgtcaataatttgctaatggtctcccccccgttgtacatgttgaaaccaggattcgaggataggttttggcccccccctcaacttaagagctttatcatctatatcggggttttttcccagaacaaggtgtctgaccatgtgtgccgacagaaaacagggttcattcattcatcaaatgtttgttgaagcatctattgtgaatcaggcaatatcctagctcaaggattgtcaacctttttctataaaggacaagagggcaaacattttaggtctcctgcgtcatacggtcagtcactgtgattcaactctgctgttgtagtacaagattgtgaaagcagccatagatgatatgtcaatgaatgagcatggttgtgttccaataaaatgtcacttgcgaaagcaggctgtgggctgggtttgggccaacagttctatccctgctctaggcactggagttacaatagcaaaaaattaaaataaagtaaaataaaaccgcatgcggccgaatccctcaccccattacctaacttttcccccttactatc

SEQ ID NO: 15170 - DNA, 294 bp, Homo sapiens
gggagggaagaagggggacaacgtaataggaagaaaaaatggtaggaggaagatgaagaaaaagcggggaaaaatgaaaatacgagacgagaatgaggtagcggaagagagaagtcatagtggtaacacatatgggatgggaacgaaacgtagagcggaaaaaaaggaggatgaaaaggaaaaaagaggacgcaagaaataggggagggggagataggatggcaatgaataaagaaaaacggaggggtgtacagtaatgtggtgagaggtatataccgcggccagtgaacgcgg

SEQ ID NO: 15171 - DNA, 492 bp, Homo sapiens
  misc_feature (1)...(492): n = A,T,C or G
aacgacggggtttcaccatgttgccccagctagtctccaactcctgacctcaagtgatccacctgccttggcctcccgaagtgctgagattacaaagttcacagtgcaacttctgctcttaaatctcaacacggagttacttgcttcaagttgcaggctacaagacactggggggaggatacctgtcattcatatatgatccgctgggcagctganaaatcgggtggctgctaaggaaagagcgaagccaaagaggctgatgttgtcgctcgaccttggttgggtgggctgggagcatctccaaaccagcaaaagatgtgacccctggctttttggcatagtggctagtccaaaagagagggctgggtttttcttatggaattcattgtttcttcctggcgttgataattggaagggggaaaaaaatgaggggaagaattggggcgggaggggaatttatccccgccggtgggggaggagcgccgcaatcct

SEQ ID NO: 15172 - DNA, 743 bp, Homo sapiens
ggtgggggagaaaagggtatatgtaaaaagaatggctgatttttgtagattgaaattcaagatctcccttcgtggaaaatgcaaaatgggaatcccgttaaaggaaatggggggaaggaatatacatcctggcagtgtacagtgaatgacatggaaagtgagggatgaaagtgtccggcgagttcagattgtaccagggccccctcacaacagtgtcgccccaaccatttaggacaattgttcctcacacttcagggactatctggaggctcatagctgatctaatgcttagactaaaacttggtctacagtgatgtattcagaggactcttttgcagtcgttttcatgagcagaattcctgaaaaggtgctgacattttaatgcatcctattgatactttacatttagagacaacaagctttgcactgcacgcaaaatccttgcaaatcctaatgctatgtggtcttagccacctcgctcaaacatggggtgtaattattaatagaacagatgagggacatgatcatttgaacgcaatcttcatattgaagacagctgagcattaattgatgttcaacacccttcagaggtaggagtgtattacctggcttctcagatggatgacttcaggcagtggaatgataaaatccaaagcctcagggcagagattgtgcctttgattaattctgctaaagggcatcaatggtgcaacagtgatgggaaaataaagccggatgggccg

SEQ ID NO: 15173 - DNA, 1886 bp, Homo sapiens
  misc_feature (1)...(1886): n = A,T,C or G
cgttgtttttatatggtcagngggagntgtgtagagggatgatattaggagttgtgtntntnatgatgtgttgagtatcgagagtgagtgtgtgcagtcgcgtcgcgaggtctgagtgcggcgtngaggtnagtgacaagagtggtctgatatcgtgngaggagtgtgtcgtgtcgtgtgtacacacgtttcgcgngcgcnatcaagagacacatctttcgtatagtaaatagtgaggcatagatcagcatgagtatataagttgagtncgtaattcantatagcatgattctntaataatgattcatagatatatgcttntgtntagaacattctgtttatactgcgtctnatattgatgatcgtcgcagatgancgagaagcatattgtatgcgtattctatagcgcataacactatcgtgtgatgaatgacgccctctacgcttctgtcagtcgtaagtattgagaagaacgatagnatatcactgactcttctntnacaacagacacttatataggtgtactgatagactagaaaatcgataagatantgttctatgtcgcgacgngcgtangacaanatagctatntacactgaatgtatgactggagccgacacaaggaatctcactaggcgtagactgacgagcgtacatcaatncacacacaacatcacgtgaagaatagagtgatgtggancgagacaccgtgncgcgtatcgtangctgtggagtgngattgtcggtaaggtattatgtgtctcgagccgcangcgacgcgaccgtctcacggtacactnancgcgtgtcgatacggtaacgctagcaactagatatatcgtacncttcgctcgtntcanatgagatacgctacanctatcagcgcgcgagacganagcgaagagtgcacgagagacgagcgatcgcaagcagcgagacactaagagaggaggangtcgtttagaggtatctagtggagcgtattcaggatttccgtcggtcatcacgtngtcgccagcacgctagttgtcgggcagcacgcatataactctacgnanagtatactagagacanaattaatgtcgatatctcgagcactgatgtatgctagtacagtgactcgactgtgtggtagttacnatactcatngtcgtatatagntataagaacaaggagagaggatcacgtcgcgtgagggtgtgatgactcagcgactgcngcgctgcagacgacgnggcnacacgtgcggcgtgatgcgcgtgcacacatgacaatgacatactgaactgtcgantatacttcgagagatgtnctgtgtagcgctgtatgaattatatagtgnanctaacagtataagtantttangatagtgttgtatngatatngtacgtcagtactgtagacanacagtagagagagagcacagaggatagacttctgtcgnagtgctactcctactactatactctatgatgacttgatcgtacgcgttacacatatatcacactatgctgagagagacagtgactagggacgngtgangcatactatacgagtgtgatacgagnatgtcatctaggcatgccgtgtgcaggancggagatgagcgcacgacatgtatgatgtggttgtttatgatgtctctntattaacagacgatatgtgagtatctactggacacggagtaggttgagagctgaggttaattagagatangagagtagaatggtgggtgaagtgagantgattgttgagatagattatcgaggatgtgagtnggtcgtgtggtgacacgagcaanagtgagcnggtgactcgacactgacgtgctgagagatgccgtgtcgtagattgctatcgatatgatctgtgagcagacgtggcta

SEQ ID NO: 15174 - DNA, 1891 bp, Homo sapiens
  misc_feature (1)...(1891): n = A,T,C or G
actctatgtgnagtcngcgtcgatgtgtganacgcgtcagttgtgggctagnctcatggtagaganggaacatcttatgtgagaagctgtagtatagatagtggagacngctcgtgtgtcgtgtgtggagacgtgacgtgtangtnggtgtagtgtgagctactcgcattctantgcggngccatatagttggtcgcgtataacgcacntgcgcatgacgtgagactatgcattgatnaaggagactagntgagagaagagacatgagtcagggnaggagagtacagggcagtgcgatcaggaggtagngtganntcatagtancgtatatggtgtngtgcgcgatacagtgatcgagttcattcntnatggtgtgtatgggtgagatgctgacgtatgagagngngactagagtgatgatgntanngtgnattatagtacactcncnncgnatcacatcggancaccncattcactctctggntacgtctactgttgtgnacactaagctntctcgangngngnactcgctattcntactaagacttgangnannngntgtagctgctctangtangcgctaagcttcgtgananagtgantgagnggaagagttgctgagtgtgatgatcacaccgctgacgcggntagcaatgagacagtgangcatacatatgtgctggtcttcattgatatcgcatgagcgcgagtatctantngagngcgattangtggntagatagntgtgtgtcgttgtcgtgcatagtgtnctgatgtgtcangaggnggtctgtgcgatgatcatagtctctagtcattgtgtgtgctttaatacgtgtatntcgtacagtagacacatctgactcaacctacnacgnagtactctattatcatggttcgattgtatantgtacatatgtggagtgtgaggacggtagctgggtngcgtgcgtgcgtcntttatatcgagagtcgagatacatcggacactcaccggtcatcagaagtcgagcacatcacatntagtcatcatacagagagtactagtngagtgtncngcgagtngtnggctntgagctcagattagtacatgctgtcngagatacatgatgatatacgcagtatatgnagatactgttcgagccgtgacatggatgtngcgtgaagangaggantgncgtgtgagtgacatattnagatnaccatatattatagnttctgtgcgagngggngtgcgatacatctgnggctatgcgtgtatgatntcaggagtcgctanctgcgcgtctacantcgcattgctgtgtcgagnntacancaaatgatgagaacatagtcgtcgnanacatcatgcaganatatgtctactatatctgcgatacgagtttaatgtgtgagtgtacgtctctggacgcatggtagcgatgnagntaccagatattgtgtcgctcatggagtgtgcgcactcactagtgtacacactctcgggtcgcgtactctacgcgcctctatgacagctctcactcattgtgactacgactgtgactagatgtgcctcatgtctgtgtgacgtcgcgatggtggcgtcactgtgagatcgtntgggaccacaattagttcacgctgtctggcaaactttatatagtgatatncattggtggnctgccgtatantgactttcgnggtatctgcngntngtgctggagtgagtctgtgagctcgtcgctctaactctacacattactatacaacagctgcgggtgttgtanaattaggtgagtatggtgggagtctgatantgtgcgatgtgtcgtggactgagcgtcggagcgtagatcgcgtagtggaggcggcgttgtggcctgttggatatgttgtagtgatggtgtag

SEQ ID NO: 15175 - DNA, 301 bp, Homo sapiens
ccatcccgagtctagttaccacgaacaacaacgagagactttcatctagccaataatgttagttaaaaagcaaattccgagtgattggtgttcaaaatgggtcataaagcagcggagacaactgacaatatcaacaacgtgtttggcccaggaactgctaacgaatgtacagcgcaccggccattcaagaagttctgcaaaggagacaaaagcccttgaagatcaggagtataatagcacgccatcgcaaagttgacaacgacccccccgtcagccttatcaaggccgcccctcctaccac

SEQ ID NO: 15176 - DNA, 1826 bp, Homo sapiens
  misc_feature (1)...(1826): n = A,T,C or G
cacactcatacgatacgcctccacaacgggatcagcgctcagtcaggangtacactnctgaacngnctcctaactgcacgagtgtactgcacatnttagacgntntatatacgaaccagtcgtattanatatcgacatcntgcagacactgtaacgagactcnctgcntcagtactcntcacatcactcactgcatgcgtcatactcagntgacgactggcgancacgtcgcgcctacngagcgagtcctcacaacgcgtgcgtagtacttagacngtgntgctgctgacgactgacagcancnactggtagtgatgtgattcgcatgtgtgcgntgtggttgtcagcgatcgcgtnagntgatgantgagngaagagtagtgagtgtaggctgagctgtcgagcgaggacgnngngncgctgacgtcgtgcgntcgtgggtctgagccggtgcgacgtgacacatgatatcgancgtacagctgtangtgatactattatatntacganactgcagtcgcgatgcgtgtctgcgnctcgtagtnctcgcgcagactgancgttgcgcgtacaatagtagcgagtatcatatttatacgtgcagagatatcatcacatcaataacantnagtangacgcgcacagacgagcagactganangcagaagctatgcagatngnataagcgttactacatatcttatacatctatagcaatacgtacgtanagctngatatactgtgtagatgtcgtntattagatcgtgctngataactattttgtcganaaatcgtctatatatgaantgatatctgtngtcgctagtacatctnactatcgagcagcaggacatgatatgangcatgantagggctgtatgagatcacgtcgcgacgtattgtagactagtgacaggacagagtagatatanaagatngatagagnatatcacagtatgagtgatgtactacgtgcgcanaatacagtatcgtatagaggctataaagatgnngagttgtagttatatagatgcatatgtacatatgttacgatcgcacgtgcggcacattagcgtcggcctctctccgtacatgncgtgcgacacgtncacagcncagctatacggacgattgacgtgagataagtctatagagagtgcgagttgactggtcacgactcgtcgactaggagtcgatacntcgaagaatcggtctagagtgcgctcacntgtgtaggtgatgagtcagcgctcaacaatgatanttgtgacgcgatacaagggcagtcatgtnanttacagactgacgaggtcattaacatacacgttatctacttaactnacgacgcacgtncaacgaagactagagtatgtantcactatatatangagcgacgcacagtcngagttacacgctngtgnggaagagtaganggagatatatcgagtagcgtatgcgagtatatagacgcatcatgantgaagacgacatgttatactaatgaatgcggacgtganacgagtntcgtgagtntgnagntggtgtaggatgaagcggtacggcacgctggtatgtggtgttctgttcgtgcagatatagagtctagtaggcgtgaggtatatgcttatcgattatctctcgtaatntcgtccgctcacttcactagctacaggtctcttgacatgactcactcatcaccacacaccgtcacatctcgtacaaccgcggcactacacgccaccgatcgacgacctcgttgactatttgctatctatattcnagacatactacaacacactcctaagcacatgcatctactctcacta

SEQ ID NO: 15177 - DNA, 798 bp, Homo sapiens
ctttttgcaaattaaaccacattttttaagcttttgtgacaacttttttcagggcaaaccctttccccaacgggccgggaaacaaaaaaatgcttttctgaggatttgttggaattcttaaggcccagaattttttcccctaccccgaataaagaaacttaatttttttttggcaaaaaatgtgttgattggtaatggctcctattttgaattttgattaataaaaggggtgcttgagcctagttattaagattttaaaattcacagtccaaaacttgcaattacttttgcaccaaccttaatatgtttaattttaacagttttatcatagaataattaatcccataaaagcctacatgtctaaagtacacaattttataagctttgacctatgtatacagccataaaatcatcaccataatcaaataaatgaatatatctatcataccccaaagtttccacactttccttgaaatccttccttcccaccactcttctttatcccctcattatcattgatctgctatcatcatcgatttttttgcattttctggagttttatataaatgaaatcatacagtaagggcttttttcctagcatttttcattcagcttaatcaatatgaagtgtgtccatgttattgcacatccaccttttaaattgctaaatattatttcattgtatggatatgccacaatttgcttatgcatccacttgttgataaacattttgcttctaattttagtgtaataacaataaagctgctatgagcatccttgtacaaaaaaaaaaaaaaa

SEQ ID NO: 15178 - DNA, 1633 bp, Homo sapiens
  misc_feature (1)...(1633): n = A,T,C or G
agttntataacgagacatgcatagagtcgctgcgatagtagatcgatgcactcatctgacnttagcagacagcgtgtagctatcgatcactccgtactatcngatgatatatagttactgtanatgtgtacagacgtagtntgtgtgtancatcatgtagtntntatgtatcgcatgtcgtctgntacgtgtgntttntntnatatagttgtatgtcgcagtgatacgaatgatgcgtgtgcgagagacgnagcgtcgtgagtgtcgtatgtcgtacgtcgactcgcactcatcgcactacctactcgtgcancgcttgtctgtcatttcttcacgctcctggagcgatatactcgatgtgtactgagagacactgcaactagtgatcgtgctcaccatgtcgagtggctcaatataccacgncatagtctcacgcctnctgactccgtctactactcagtcattctgagtncgcgtcactgtgatttacnccggcagcgacgcgactctcgnggctacgatgatcagtcgcaatgatatngtcgtcaggtacgacgtgtctcgtatgtgtaatcatcaatcgtgacgcacggtgagttatcgagcatactcttgatctctctatctatgtctactattgtttactatatagattatagtgagnacatacgatatcgatgtacacatcgactctcctcagagacagcaaacaaatacganaacgtcgttatatntagtacntngtgctgtgatcgtatctntgctgnatatacantcgtacctactgttcgcgccaccacatcatgtctctgcatcagtataatattancatactcatagcnctcaacgcgctagcactagtatgccatgactagcgaatacacgaatanctctgtttatattatatgaattactgatantgtgtatatctcgtatcgtctccttataattgtcattagtaagtaataaactgcgtgaaagacggctagcatatgtagtatcgcttatcgtatacacagtcacacagcgtcactatatacactagtccgtcactgtacacgcagtggttatcatctatagatgatgagcttccgtaatcgagaatagttcagtctctatcgtgatcgcgccgtctcgctaccttttacacgacactgtgactactacataatagtctcgacatgatcgtcacagtgatagaatctagattcatgcgcagtgcatgatctcagcacagacactagccgagttatctcagcgtattgtactcgttgttacaaccgagtacgatgcacgacacctctgtctgcgtcatgcgcgtgtcgcgcgcagaaccgcaggtcatcgtttcagtcatcgtgtgatgttcattatagtaaggatgatagcggatgaagcgtcgcctgccgcgaatagtacgatagacattttgtgcatcaaaantattcatgatcctcctattcctcgtactcctcgcgtctataattccactttcgctaggcaacatatatcaatattataaatattacaaagataaatatattaaaagcgcgccgcgactattccgttctacaacgctatctataatgttcattcctattgttactactatcttttcgtgttactctattta

SEQ ID NO: 15179 - DNA, 939 bp, Homo sapiens
  misc_feature (1)...(939): n = A,T,C or G
tatatatagtattacccaaaacaaacaaacccnactcaggatatacgcctggggaaaattaacgggatcacgccggattgcaaaacaatggcaaatttaaactctagtgcttcatctagtaaatgcacgcgagcaaccagcagactacgcatgtncgtgcaagggccaaccagtgaagataatgatttaaaaccccagaacagaagganaatactattgcgcaaaggaaacgggcctcgacaccatgctcaagtgccgcatgaacacatgaatactaacacgaagtctttttcccnngagncccccaagattgcagtgcgccctcagaattcggcccatcatgtagatttactcccttaaatctgtgttctgcactcctttagtataattaggaatactgtaaataagctactaatacacgagattagaacaatagtgcaaggaggtcatactcatggtcttagtctacaggtgttatggcctnagcaagtnttcaagtacggtgtgtagcaagatatgatcgacacatgtcttcgtgtgtaaagcggtagtcacattgttttgtgtgcaaattccncaagtagtgatgattatacaatgatagatccacgactgggtagcattatataacaatgaaagtaatgcggatggttnaaatgtagcttttataaaggtgattttacgagcatgccctataaaataggcatccgcccaacagatagaaaaaaatncaatatatgataacatcgataatccatactgtactctcaacaaaaatacctccccacgccagtcacagtctagctcgcccgatcggtaaactctaaatgttatgtttatactgcaatgggccctatgcccataaggacaagcagcagatcttatgatccaagtatctaatcttatgtgtacaataatgctatattaggcgcntccggt

SEQ ID NO: 15180 - DNA, 1243 bp, Homo sapiens
  misc_feature (1)...(1243): n = A,T,C or G
ctcgagngagccgtgcctggttctaggatacgctnacgcgtctatccgnctctctccgcagcactctgctcantactagcctgcgtanagcgcgtctgnaccatccatcgcgcacggcnacacagcatcctagcttgatgctatatgtgagcatcgatcgtgcttcnaacgtaagaatatgcactcaattcangcgcgttgnatactcagactagctaccncatgttcacgtgtctcatctgcgtccgcatctgcacgaacgcgttatgcgtccgctgtgttagcgcanatctcgatactatactgcgacagtcgatactaagtgtatataagtcatctgtactcgtctaatcgaccacggctccacgcacgcatcgcatctaagtagcggatattacttatacgtaacacgtccactgcgcacacgggacctcgctcccgtattcttgtcacgtgcggtgtcttgtcacccacctcgcgcccacgccgactcgctacattcatatacatagatgattattaccacggttaccactcnatagcgcgcgcgccnccatcctcgactcagctaangccagttcatccaaatacaactggcaacatgtctcacgaccacccttactctatcacacctagcctacgcattattcattacccaagctccagagtactcggccgtcttgtctatttccctcagcggcgccgtatatgccataattccaccacgttctgtggagcagcatagatatcttccagccgcggcgccacgcccatgtcgctcactcagttatgtcgccactcatacncacgtaagtcgcctcaaggcatgtatatgaactggccagtttgtaccattcatgcgcgcgggaactcgtacccccgtgttgcgtatgtgtagctactcccatttaatacccgcgaatttctcagacttcgtctcaccgcaatttcatagtccctatatgcccggcacgccccctcctcccgtatctttatcttcacatgtaagtatcgcacatcacaatataatggacagacacgtatctccacgactcgcgttgcatgcgcatctattcttcccccatacgtagaatgtatagcttcatccctactatccgttgtgtatacctcgccaaaacggtataatggtgtctccaatgcgtggactcctttgtgattatctttgcgcccccctcccccccttaaaagtaacgcctttttatttgtaaaaaaaaaaaaaaaa

SEQ ID NO: 15181 - DNA, 766 bp, Homo sapiens
tgaataaatgagaaaaacctaaagtataatggtagaatctatgtttgtaaatttcaccaatcaataagaagtagaattaatcaagcaacagaactccttgtgattacatgtttcaaaaataaaaagatgatttgttccaataaatattctaaattactacatatatttgtcaatatattgatgagttaatattaagattagtatagattttaaatttctacattttttctcttaactataaacaaagttcattatcttatgatgaatctttgtatttactttcattcaacactgaaaattctaaaataaaaaaagatgagaaaatcttattgaagcatttggacatccatgttgttattattaacatatatttatatgtgtgtatataaatcatatgtaatatatatcaaattattacacacattggtttactttttcaacactattttaaattaactacatttttactgtttctctttttttattgctttttcctcatttcctacctcttattagaatatttttcattttgtctgaaaacatcctttagtattgcctttaatgaatgcctatttatgagaaattttttcaggtttttttttgtctaaaaataccttgttttcttgaataatattttcatattcttgattagtgattattttatttttgcatttatgtatatcattccattgagtagtattgcttgttttaagataattttttaaaataaaattatctcttgtatggttaaaaaaaaaaaaaaaaa

SEQ ID NO: 15182 - DNA, 799 bp, Homo sapiens
  misc_feature (1)...(799): n = A,T,C or G
ttcgtggggaaacttcgctaccttcttanagggctgaactgcaatggcgcgatctcggttcactgcaacatcatcctccggggttcaagtgattctcctgcctcaggctctagagtaactgggattacaggcgcctgccaccatgcgcagttaatttttgtatttttagtagagacagggtttcgccatgttggagttggctggtctcaaactccagacctcaggtganctcctgccttggcctcccaaagtgctgggattacaggcgtgagccaccacattcagccaagagctcatttaaagtgaaatataaacactggtttagtttactaacttataaaatatatatactaaacatgaattaacatatgtgcacatacacatttcttcccttatgacctatatgtaagctttggatctttggatttcttagaaagctccatgtagccaatagtatgaagaagggagagaaaattctaatctatgtctccaggtgggaaaattgaaccacaggaagaatcctaacattcccattccatgctaaacatttaaagaaggcccaataaacacatttctggtccttgagacttggtcaaacatcgaatttactaagcatcttctatctttttttccaccttgcaggaggctgaaagaatacctggagactcctgaaaaaacccccttccttggctaagacccgaaactcctccggctcgaaagcatttgcgctttgggcagttttcattttccaccacctttctcaaaaggatggtccttacagttatagcggagaacgcct

SEQ ID NO: 15183 - DNA, 895 bp, Homo sapiens
  misc_feature (1)...(895): n = A,T,C or G
agaaccgcaggcanagatcgaggcgcgcagctcgtattcactggaaggacaggaagaagacctcnagcgcatcaacatgtactngtnagaatgtccaaggtagccaagctttgagcaagtcacagccacatcgaaggccagatgagggttttctggataatgggcccagttgaaatcccagccaacagatgccatcaattaccagacacatgagtaaggctgcctccagatgactcctgtacctcatgactgagttgctcccagcctccaagtgttgccaatcaagactctagactttacaaagccatggcaagctgtccccactttgcctttgccaaatttccaacccacagaatctcggaacataatacacggattatcttttactgataagctctgaaatagttcgatacacagcagcagatatttggactatcacacatgatcgtactttcgtaagaacccacagttttgagtaactggtggcatgaaaaaacagttgattgtgggttatggttcaaatatacgtgtattttatggctaacagaatgtatttactttaacacgtcatgatgcgtatttcaaggggtgtcttcatataaaaacccccacataagaatgtatgtcccccccccaaaaacaaaatgcggcctcccttggacccaagtcgcgggaatctcactggccgttttctctttaaacgaggggtccttccttgataccttccctcacctaatctctcggtccttaggtctatcgcctgccacgacaacaggtacactcctacctaaacagcgcgcaataccgcttcgtcgagcgaccagagcgcccagcgccgaatctacccttgtcgtctccgcgtcattcatcgccatctatttgtttataggcgctg

SEQ ID NO: 15184 - DNA, 892 bp, Homo sapiens
caccgcagggcgctggtgaacaccgggaaccggaagcgaaagaagggctagctgcatgcgcgcagccggggggaacagacctgacatgggtcgagctttaggactcactatatgagcgcgtgcttgtcggtggtgcccaagcgactggacttctgcatcagccccgggtgcaggtctacgaccatgccctccatggcggggaccggacacccgcttacccgcctcttcacaaccaagccgccgccgagccgccgggcctggagacctggaggggggccgctgctagctagcttcgcgaccccgatcctttgaggtgaggaaactgaagtcccacgagagacgggggcaatgttaagtagcatagtgcactcactcctctcagcaaggagtctgccactcgcactagaaagacgggtttgaagagctgctttcccagcgggatgccgccctaaagggtttgttcccctgggacttttctctgatgactacattttacctgctgctcgctgggggaacgccaaccgaatgagtttggttctcctgaaaatataaagacggtctacgacactaacatgcgctcacctttccagccacgtgcgcgggggcacaccccgattcggggatgaagggcacgggatctgtggacaaccacgcggtaacccgcccaccctcacctttgcgggaccctccgcctatcaagcccaacgcacaagaaggctagccgacgtataacacgaaagcggggagacgggtcggcacgcgacgacgcccgcgccggggaggagctatccgaaaccacgggcgcgaggccgcgggcccgcgtatactgacctcgctgttagtcattagtgctatgacgatggggtgccaaccggagtaaagacgggacgga

SEQ ID NO: 15185 - DNA, 854 bp, Homo sapiens
  misc_feature (1)...(854): n = A,T,C or G
gcacggagcggaagaggccccccgcactcccagggaaacaaagaaaacaccttattagcanacatncaaanncagttttgaggacataaaaagagaggcaaattgacatcatggaaagaactaactttggagtctgtcatattcactttcaaatctgtgaaaggaaaataccttgggcccccaaaatcactccggaaaactcaagctggaaactgcttagggcaaacttgcctcccattctattcaaagtcactcttctgctcaataagatagatgctttttttattcgcttcctttggaaaggctactcaaaaactcaaaagtatgtaaccctttgtgtttcacctatctgtgacctgaaagctccctccccacttcctgtcttcttgcttttgcttcatgttgtcccacctttccagactgaaccactgtacttcttacatacattgattgatatctcatgtctccctaaaatgtatgaaaccacactgtgcccctgaccacctttggcacaaggtgtcgggacctcctgaggctgagtcatggggcgggtcctcggccttggcaaaaaaaacttcctaaattaacccgcacaaaaaagaatacaccccgtacaataagcatagcaacgcctgcccggtaaccgcacgcgcgcacccaccgttcctatgtagcaaaacggggggagccgaaatggaaagactcccccctcttcgctaccccaggaaaacacccacgccgcctcttccttctctaaggggggcaactttcaagaccttccactataccccacggagacggaaacacgccgttccccgattactcttactccctcacaaacgaccctaacgcca

SEQ ID NO: 15186 - DNA, 860 bp, Homo sapiens
ccccccaccaggcccagcaccaagcagtaagcgcgcggaggttaactgtggcctacctggcagctttctggagagcgcgagtcctgaagaagattccacagctatactcgactcctacaatatgactagaagaggttaacctctggcttctgctgggaaataagtttctattcttgcagtcccatgcatacaagatgagtctgaagtgtgacacataagtactggaaggagatattggatctgaagggatcgtgtaggtgacaatgaacgaactttcaatggcctgatgacaaaatcggatgatggagttctcacggtatgcatagtaatcaggaaacctatgttgggttcatctgcaaatcatgccaacttgaccttcaccgcttttcatacttctaaccatgaccaccattaccattctaagtcatgtcttcattctttctctcatggggctattataactcagcccttgaattgctgcctggattttgcacctactactctactgctcattgaaaggccttcaactgttccacttcttcctgagtgcgaaaactaaaaagctggccagcggtacacaaaggttgcaatgaactgcgcccctaaaccctaccctttgatctcgaccttgactaccgggcctctcctcttctcctacttgcttgatctcccacataaacaccacggacttccttcactttcctttttcccctgcctactactgccccatctaacgcccctttacacattccgacaaccgaatggacatttcgtgttcccgcatccccactttagtacctggcacaccgttaagatttcgagagtctacctacccgagccgggctcccgccggcccaccg

SEQ ID NO: 15187 - DNA, 900 bp, Homo sapiens
  misc_feature (1)...(900): n = A,T,C or G
tgcctcgctgtagtttacccctccccccccgccgcgcggaacctcanatctgcctctgtcgcccatgctggagtgcactggcatgatcttggctcgtgcaaacttcgtctcctgggttcaagcaattctcctgcctcagcctctgagtagctgcgactatgggcgtgccccaccattccctgctactttttgtatttttagtagagacggggttttgccatgttgcccaggctggtctcgaactcctgaactcaagtgatccacccgccttgccctcccaaagtgctgggattataggcataagccattgcacctggactgttctgaatgtttcttctatacatgcaaaatattctcctgacaccactgttataactacctcacatcttttgatagatagaggctggcatctgctggcataatgccgaaggacaaagacccttgagcctccataaaaggcattcagcgatgtttctcacgaacaggacttcaccacctgtgatctatgtgaactcacagtgccattnctcgggtactacccactgcctcgctgtatacgaactggctcgaccttataaagtcttgctgggttcccatctgaccgtgccgcgtagtttttatctttccgccatccaatgcgctattttgccagcgtggcgtccttatccctaggtcaggcttgacatgactatcttggacgccttatcagacgcgatgcaggcgatctcgggccaccgtcgccgggcggagtgtagtgaaacgtacttacgtgctccgcacacacgcagccgcgcccttcgtcttcctcgtccagtacgcctgcctccgcgcgccccccctcgcgcgcaagccgccgaccgcaatctcctcactccttcctcagtatctcctcctaggcaa

SEQ ID NO: 15188 - DNA, 841 bp, Homo sapiens
acccaatatcacataaagcccatactattcaggcggtcgtatgccctaatcaagttgaggcttccacctggttgcactccacccacaccagaccagcggcactccacccacaccagaccagcggcactccacccacaccagacctactgcactccacccagtcttcacactaacagctttcacttccctgctagcccatggaatgactcaaacatctaatcgcatcctccctcaggaatgagggggcacccctgctcctgttatgacaaaacctatctccaacagcctctttgggaacccctgtgcggccctgaacagcatgaagcgcccccctccaattgatgaaggtgactacacaactgacgtggactcacacctgcccaacctctgagcccacatagtcagagccccttatcccattacaggccctaatatttacattttgattttatggggacatagaagattacacaactttccgttccctactaaccaatccatacccccacctcgttcgcttaaaacttacatagccatttcactacgtataacatcgattgatactccctgacccatgttttagtatcgctcaacactcgactgaacccccgcctcgtccccctgacacaatcacacttacgcacctacaaaacattgaatcgaacaattacccggcacagaatctaagtctacaatcccgatttactcgagctagcatcccctaaagtcttgactgacctacgccttcttattctattacctgtttaatccatcccccccacactgcacctccttcacttaattttggcacagaccactccctcttctcctcccattccat

SEQ ID NO: 15189 - DNA, 866 bp, Homo sapiens
acgcacagcaacgcctccatcaacctcaagcgccgaaagagaacttcatgtgtcactgtccttcagcatccaggtgaatgccacgtcctcttcagagccttcctggatgtcacagccgaccattgctggggctcagaaaaagctacctgaacatatggcgctctggcctgcagagtactttgaactggaggagattggaaggcttcagcaatggcctcagcactaagatctctctgaccttctcttgcccttgtgtctcgctcctctttctcccctaagcacagggaggggctgtccctgaactttccttgtcttcttaaagatagatctaaaaaggaactcagtttctctcccagagacaagattcactgtatgataggacaagagactggggggccgggccactcacagacatggccataggctatcgcctggtactcttaccccaaaaagcaccttattcttccctaaacagcctacatgcccgatgccctcgttcttatgaagaactatgataaccttgccaattacgactggggtttgcgacctcaattttagctcccgcgctgccccatccctctaatacacgtccactgctctttccctctgccactcctcccacgggccctggggggaattttgaaaactcagaaacgataacaaaagcggtttctgtgcccttacgaagggggccctgcggttctctagcgctcatcgaccgcctgcctgggacacttacctagataccccgaatcgcccttaatagaagcggcctccggaggagagttgaaacttgctctcatatgactccatcaggcacctaagagaggagcacacatcgcaccccccgctcagtgtcgcagcgc

SEQ ID NO: 15190 - DNA, 857 bp, Homo sapiens
gacgcccggatagcagggccccgagcggctgtgcgacgcgccgcggcggctttagatctgcctctgtcgcccatgctggagtgcactggcatgatcttggctcgtgcaaacttcgtctcctgggttcaagcaattctcctgcctcagcctctgagtagctgcgactatgggcgtgccccaccattccctgttacttttcgtatttttagtagagacgggattttgccatgttgcccaggctggtctcgaactcctgaactcaagtgatccacccgccttgccctcccaaagtgctgggattataggcataagccattgcacctggactgttctgaatgtttcttctatacatgcaaaatattctcctgacaccactgttataactacatcacatcttctgagagatagaggctggtatctgctggtataatgtaaaaggacaaagacccctcatcctccaaaaaaggcaaaaaccacgttttctcacgagcaggagctcagtcctgtgatctatgtaactcgcaatccaatcttgcatactaccactcctcctgcatagaacctgtgatgacctcataattcttgtgttctccacctgagcaccccaagttgttactatttcccatataacactatattagtaaagtcctcctaactcctgctcacacctgcattaatttaacattcctctttttacccatgggtgccgcccaccagcttggctaccccttttggatccctcgccctaataaaaggagcctatgcttcatcagcctggccccggacataagtaacccgcacgacgggtgctctatataataatagatctttacattcgatatacacagcgtcaattg

SEQ ID NO: 15191 - DNA, 808 bp, Homo sapiens
gccgaggtgaaaagacttcccccgaattgagggtttgcgtgtcttcagcaccaccaaagcctcatattgggatctcctcttgaaggtctttagggctctcctggggatatgcctttgctgagcccttcctatggggacggccctacaactatgcccaagtctactgggcagagaccaccccacagcccaggggcagggcacatttgtctccccattgctaatgcctgaggatggaaaaagcaattctctccaaaggtcctgagccaaagggtcttcatgatggagtccctgttggttctgtctctgccatgcccagcccagggtacactcagaggtggtcccagtcttcaacatgctgatctgcaagcaagtgcctactgctgacacaatcaactgttatcacagaagcccgcattgtgggcttcagactgtgagcccaggaaggagagtgctactttatggacagggccacctggcttgcttctgggcaaaggcaacactggagtggggcctcaatctgttgtcagtccacacagaagggctggggctgaaacctctggggcattttaacatttgacatttcaataaaatggcttgggcctccagggccccaggaaaaaggattatttttttgttgtatccccaacattctgaccccgttggcctaaggcggggaaccctgcggcaccttcccttttgggagggcaaaatactgagcctggctaattgaacgtcacgctggtctgttccggtcggggtagcgttattcactactacaaggccgcgatacggttatcacagatcgagg

SEQ ID NO: 15192 - DNA, 880 bp, Homo sapiens
ctaccaaggcttgcaatcacctacttcgagaataaactgggcaatctaggtacactgcaggtacctcggtaaaaaatccaattccgaaaaccactactagaactgtttgaaaaaagttagaagtacacaaaatagcctaattcaatgaacctagacattacacactcgtcttttaagatgttgaaaaacatgaaaaaaaattactcaaattgtatgtacctaaatattaaattatcttaacctattatgattccttatttgaatgaaataataacaacataatggggcgccccactggctgctctgaaaagacatctttgcattgttcctcatacaactccttgctcgacgaaggcggaagctttatcgtcggataacctgcaacttgactttctttttatatccctgggttagatcactggacggccctactctctgagactcaagcgttgacatcccgttcgaattttccaccttcgactttactgaaaactaagtgacgttgcgtcacgaggctatagaaggaataagattcctatcttgtcgacgagacttggggatcttcgagctttaatataaaatgtccccaataacaagtatccagtccctggggcaatcatgatgttaaatagagatttcaggcgaggaaatttagaaggagctcactccggtaactacaaacaaagtacaaaggaaacagtagtgttcaattccacgttgctctaagagaagataataattcacgtaatgcaatatacacagagacggtgttcgcgacatatggttagaggaagggggagtactgcctgctgaggctggaacgtgttagtgcctctgctcactacgacgatagaaggagtatggcgtacaattaaataag

SEQ ID NO: 15193 - DNA, 834 bp, Homo sapiens
acgcatctcaaatgcgacaagttgcttatgtatgagggacttactaacaacatcaattacagatgactgacataacaagagaggcaaattgacatcatggaaagatactaactttggagtctgtcatattcactttcaaatctgtgaaaggaaaatactcttgggcccccaaaaatcactcaggaaaactcaagctggaaactgcttagggcaaacttgcctcccattctattcaaagtcactcttctgctcaataagatagatgcatatctgatttgcttcctttggaaaggctactcagaaactcaaaagtatgtaaccctttgtgtttcacctatttgtgacctgaaagctccctccccacttcctgtcttcttgcttttgcttcatgttgctcccccttttcaagaatgaaccactgtacttcttacatacattgatagatatctcatgtctccctacatgtatgaaaccacactgtgccctgaccaccctttacacatgttggcagaactcctgaagctgagtcttgggccgtgtcctcggcttggaaaaataacttcctaacttgtatacaaggggcactcaagcgcaacagtctccctcagtgacttcatagcactcagccccgaagatacggctaaacgcgttatttatttgtgtatatttatgacattccccacatactactacactgacgaacccctcgcagatcagccaaatgggacccccacaaagtgcggcgggggaagtatggaatagtaacatctgtccgttccgcagaaggagccctcagcaacatcaccacccgctcctacgtctctagggtgtcgc

SEQ ID NO: 15194 - DNA, 848 bp, Homo sapiens
tatgacggcatccgcgaggatagtcgagattcgcaacattatggtgacctaggccatgttggttggtgcccaaaaagaacgtcttgattagaccgtacctgacagagcatctgatgacactgttaggatgacaacagaggccaaggatctaagaagatgcgcacagaagaaggcaggccaaaactgaagctgaccaacggccctggccagaccactaactggaactgaaccatgagaaagcttgccagataagatcacttgcagctgacaggaggaggttaaccagagactgaaggacacttacagcacctcatcgaatatgaaacgaaggaggctctctactatcgtgcaggctactcttggcaattgcgaggtgtaccgcacgatctcgcgctctctttagcgaaccggcccggccgccagatgggatctgatccggttactgcgctcggtgggtgatatccgacctaggcggtgcgcatccgactaggcgctcatgcaatgagacagtaccttgagatggggtcggctttttttatttaatagagcggcctgccggacgccaggagcttgtgggtgttgcgagcgtgggggctggcctgaaggtaaggtctgtggcggtcctggtcgaaaacggattgcccgttctcgtgacgtatccaggcggtcgtcgcggttcccagggggtttattgtcgacgagattcgtggtcaggcggtcgggctggcgggtagagccttgatgtagctcgcgtgcaacagagagggggccacgatatgcaaatgcgctagttggccgggcgccgacgaggccccccgcgccggtccgacccgcgtgccgcggccgcc

SEQ ID NO: 15195 - DNA, 867 bp, Homo sapiens
gtgaaccacatcagatcatcaaatacaaaacatagaaatagtttaagcggacataactctgtggcccaggctggagcgcagttgtttgatcttggctcattgcaacctccacctcccaggttcaagagattctcctgcctcagcctcctgagtagctgggattacaagcatgcaccaccatgcccggctaatttttgtatttttagtagagacggtgtttcaccatattgaccaggctggtctcaaactcctgacctcgggtgatccgcctaccttggcctcccaaatagtttgcattttctggaattctgtgtaaatggaatcctataatgcatgggatttcaccatctggcttatttaattcaacatgtttatttggagaggcatccatgttgtacatgcatccgcaggtcatatccatttactgaatactattccattcggacggatataccagctacgttttatattccttacactcgcctgatcaacccattgggttgtttttattttattgattgataggaacagatgctacttatgaacgtgcgttgcgcatgatcaactctctgaacttgctatataagataagagcataagtcgggcttcgttgggattacgcggatggaagcttgatgggaacgcttcgcctttgatgatggtcgaaatttgaagacactccgccactctgatacttctagggtacagaatttagtgtttgtgttgatacccgtttacccctacccgcaagacgcgctcttactccggttacccacgtatctcgtgatgttgcttggaaaggcattgcgaccccaaggcccacccaacgcgcaccaacccgtaaaagcgcgctgatatcgccgttat

SEQ ID NO: 15196 - DNA, 813 bp, Homo sapiens
cataaatagcaatcttttgacaagatataatcccatattagttcaaatatcgactgacggggtacgcaggagacggagctatttctttagatccagcctatacgtatgcaataggagttggtaactctgatatcttctggtatactcatgaacctgttatttgtattgtacatgctgctgacagttcatgtatcaggagggctgatgaaatatcagactcatttagttcgcgccctctgtggtgggtcatcataaaccgacccagacctcataatatcaccttacacaaatgtttcttataaaatactcaagaacctttccctggaaagattggttgaactggataggtaacccaggacatttatctgaatataagtgtggatgagccacgaaccaagcttattttggacataatagaagttggattagtggatctttgacctgtactggtatatagattatacaacaataaacaaacaaatcagacaaccaacatatgtgggttcgtaaagggcaccttaagagcgcatggaaggcgatgggtaaaaaaaccctcccaagcaccacgtagccaacttccatacattacgacgaggccaagcgtgtaggataagaaagaactctaatatagcactaggaggtggccaacgcaagccacaagatattctgctgagaacgctgcaaccaccacgccaccgaactgtacctattctttaacattataatagtcttgatataggtctgtataactgaccagaagcgctactagaaaattaggaatttctataataatcaaaaaacgacatttttcga

SEQ ID NO: 15197 - DNA, 847 bp, Homo sapiens
ggtgatgtagcccgtgttgcgaatcattcggatggagttgggctctaggaggactgcgcaggctaggtcgagattccatcgatgcgcacagaactcatgtcccggatccagagcctgccacacttatctcgactgcccaatgtgactggcaggcacatgcacctgccctttgcgggagacatttactagggaagattgatggactcacctgttttcaggtaccaccactatgcaagacacgctacaaggtacgcgcaccaccctgccgccggattttagccatgtgctgagacagaaatactaacgcattgacatgttaggatgtatagtattgcgtaaggcggtttgtgcggtgtgtttacacctgcggcatacacttggtgtgatttgcttgagagtcgaagtgttaaatatatgcgtctttggtatggctatttcatcggctaagcttcgcctacttgtttaacctgcatggtattactcctgtagtttttctctgaatgacagcttaaggcatcgctcatttattatatttcaatttgtcgtacaaggagagggtggtgacctggtcgcgactgaggcgaagggtacacctagtgactcgttttgtattgagggggaagcgagcgtggaccgcgcgggatgtgaattatgaagcgggttaccaggttgtagagtgtgttgcattcccacgctcggctttaggagcgggtattgtgctagatagtgggggagattctcgtgttgtgggccggtgcatattgttccttcggatttaagagattacaaaatatggaggaggagggcgggggtgttgtttcatcacatatctacaactgtggtcgtc

SEQ ID NO: 15198 - DNA, 809 bp, Homo sapiens
tataacgaacaaacagatcggaagttccaccaaacccaaatggagagcgtttgactgtgaaccacctgaacccaaagtaagacaaagttcaattttagtaacctgaagttcttcactgaagccaacatggaatgcctccttcttctcccacagcaatgtcacgaggagaatgacagcctccacacaatctgtcccgaaagccttctcatctctccacttcatgagccttactcctgtaagtaccatgttcttacagcttcacaagggagctggctcatctgctgaaggaaatccacacaagcatgacattagcatgtcacttttaacacgataatcctcactagggcttctctgggacaattaccaaaatgttctccgagaataaagtatgaagatcatgacagcggattggagagtgtgatgactgaagcagtaaaatcatgctagagaaagacgaccaaagagaaaagtgcacatcaacagccaacactctcattcacttaaaccaatcatcaaggaagctgtatgacctttctgggttcggcctcaagaaagaccggagaaattaaggttggacgcacccgctttacctaacagatacaaactcgcacaactggtcaatgaaaaaaaaaatcgatcctcttggcctcactcgtggaactctctgacccctttccttcaggggcgctaacctcctgaccccgcccactgactactggaccacatactttccatgctgaccccgcctattttcattcaaagtcggaatcccggcctccaccacactcgtgcttaccgccgaaagaacc

SEQ ID NO: 15199 - DNA, 834 bp, Homo sapiens
  misc_feature (1)...(834): n = A,T,C or G
acgagcgggtgggcagggctgtaggtgaaaatcgtcgaggggctcagattgccgcgaagatcgataaaanacaacatcgtgaggatgatctggctgtgacacatgtcaccccactgatctccagagttgattcggctgatcaggctggttgggcaggtgtcccctttctccctcaccactccgcatgcattcctcccgaaactgcacacttggccaaagaggaagacctttcctgatagaggaggaccattcttcagtcaagggtatatgagcacctgttctgtcctgccagaatctccgaaggagctctcagtaaaatcacaagattttattgtgcatggtagcatgagcctgtaatcccagctactcaggaggccgagctaggaggactgcttgagcccaggagtttgagaccggcctgcgcaacatagcgagaccctgtctcaaataaaaaagaaagaaagacagaaaagactaataatagcaataaatcacctgtgcaacgtgctcacttctctctttggaagtgagcacgtgtccctaataaatgcgatcattggactctcaccggtgagcacaggctaaagcatctttgactttattctataggcaataaacgagggtttggctttacagaactcattatggttgggaaaataattctgccacattaacaaaagaccatccttgagggaacaggaaaaccccccattattctcccaaagcttaataatttacaatttcgcctatccctccaaacttggcgactgaactcttaatttcacagggcgccaaagagtgtcatgccaattctcttatcccgcctttcacaag

SEQ ID NO: 15200 - DNA, 948 bp, Homo sapiens
gggacgatggtattacgtggtgccagcctttcactcctgtacggatttagttgctcctgcggcgtattttttagattcaagaccacagaagttcacagcttctatgaatgtggaagtgggtcctcaccagacactgtgtctgctggcatcttgatcttggacctcccagcctgcagaatgacttgttgaggctggcaggaatcgacatatatgtcatatgtgagaaacagctcgcacaaccgctattatcacagatggacggagaaatgccagctcactaacaagggtggtgctgccgctatcgcatctcatgcattaccactggtgaagaatggagctgatagctaggtccgtaggtggtgttcccctgtccctggctccggaatggagtagagtagtagctctatgtttgtcataattcagtggttccttgaactaattggtctctattgcttggctccgcttttgataaccacccggacaagtttttccggtgcattggaacatcttcgctcggtccccttaccatcacaatctccctaccgggctacatgacgtcccgatggcggtgacggagtaacgacagtcgtgcatgccgatgtctcacctaacctcatatacctttgtccccccccccgtccatggtacccactcggctacgtatgaaacttagaggttgccagttgggcgcacgaggcaacgcaagtggttgtgccccatctggtacccctgcatcgcccgctcccggcgcgcttctgcgccacgtcgctcgttcgctcgtgtattctggtctctcccctccacgagaggcgcgaatccctcgtggagatcagcgaccttgaattggagagttgctgacgctctttagtttgtgtcctctacttgcctggcctatgttcgtgtagtataactcagctgggccagatcgtctctagcaggcgtctcgtg

SEQ ID NO: 15201 - DNA, 877 bp, Homo sapiens
ctagcatgagtaaacgtgattaaagtgcgccccagtcactcttgtttcttcaaattgacatttcgaccaggatggatactgagcagagcaaagatcacctggtgctcatcaagccggacttccagaggcaaagctccttaactgaagaattcagaatctatcattgatgggcatttaggttggttccatgtctttgctattgtgagtagtactgcaatgaacatatgcacgtctttgaggaatcaccaccatggaatactatgtagccataaaaaagaaagataacatgtccttcacagggacatatatggagctggaggccattctccttagcaaactaaactatgtaacaaacctatacttgtaccccagaacttaaaataaaagtttaaaaaagcacaaaaacaaaattggcctccttggcctcatcgggggacttctcggggcgcttcccttagagagggtgaattatgatcctagctccctgactcggtgcgcctccgtcatcggcttgagcgaactgatatgagctctcttaaacactttaaatctagttctcccgataatccggctgcctccccccgcacaacaacctgttaacctactcggccatctcttaggccaggaaccctctcaaacgcccttgtcgctaccttcctttttcttaagcctcccctccctctcacagatattctaagcacgcagcctctcaaattatacaggcgcttaatccgctccccaactataaagatacacgaggcttttccggatgaacagcccccctgacgagcttactagttctatatcttcctgccaccgcgccacgcgcgccgctcttctccttctataaccccgccactcttcaccagtccactcg

SEQ ID NO: 15202 - DNA, 851 bp, Homo sapiens
ctacctcttttctttcttctttcccttcattctacctcgtcttttctggcatactcacttcacaaaactgacctcaaaggactctttcttaatctgagagttgtctacatcaattgtttctgcaatcaattcagaaagtgacaaattctcaaggtctcttgtgggagaagctttatgaaatgccatgactacagagatcctgttaattctgatattccgggtgaagactgacagcgatttgctaattgtgacaggggaaaggatcccaaacttagatctgtgaaactggcagatgactggttacaaaggtcagataaagctaagcactggcttatattgttttctttgtgttcctgaaacacctcagccagggatggactttcacactgacaaaactgctaattaccatttttaaaagcggcgattcttggcactttgttcaactcaaaaaacattcccaactgcattttctttactagcatttatatttattcaactttcatggttttccaacgagcctacttccctgccctaggattatattgaactatcccactctggtcctcctcttgtgattgtcgttcataaatcacaccagagacatatttcgcaaatctataaaagaaataatttctgatgttctgctcttcccctaccgaccatcctcgctctcactaattcatcttccctccacttcctctttaactgctgaaacctatgctcaccaccatgacctttaaccgagggcttacttcattgtcactcttcttattttttctcatcgcgctttcatgccacctgataaaaacacgagtattacatctcatctctatgtacgtcccactctgctt

SEQ ID NO: 15203 - DNA, 456 bp, Homo sapiens
cacaaccatctaaattctcccatagatccaaattaaagaattcgaacgtggcgacatcatgaaaagtaactccaagatcgagcagctgaggagtatcatcaagcactgaagttctttctttctctctactctatcatcagcatcaggataacctaaagcaaagatggatgccattgacaatggagctacacccaacggaagagagaaggaacacagaatccaggcctttgtcttcagtataatatggtccgtctgagccaacagcacatgaagtaaatggctgtgtgaacgggaagcaaggatgagattaaacaatcgctgatatgtatacagatgagtatgtgtgcatgcatacacgtacccacacagtagtataactagcctggctgctacataaggtataaaatagttccggacttcaagaacctgcttcatcaattggaatacacgcaactt

SEQ ID NO: 15204 - DNA, 472 bp, Homo sapiens
ccggtgccacagatatactacatatgagatgtcaccacaactactccacgcgcggctacgtcgcccaagaaagaacagcacccgctccagcgtgataaacttttcactccttgacaagcgtaagaagccggaaaactgcccagccagaagttttgtgtcgcccctttgagatgctgtctaacctccacgagctgcttccgaatcacctgatggagacgctttattcccgcaagagtgaagaggtcaccaagcaattaaaccttgctgctgcttgctctttgggtttgcagtccctttatgagctgtaacactggccgtgggggtctgctgctgcattcttgagagccactgaagccagaaactcgcccacaggaacgaacatctgtgggtattgccaccttatgagcttagaacgctcaccgtgataatctatcgcttgactcgtgagtcgcggggagccgggagcactatg

SEQ ID NO: 15205 - DNA, 469 bp, Homo sapiens
tcgcaccagacataacaccactacaataacacgcgctccagaaccgtacgatctattgctgtatgcatatattcgaagcctctgaagatttcagatgttagacattccacttataacagtacatgtgttggctctttatggattccactgaataggacatgattattcaatgttgctctgaaatagcatctatgtttttgaacgataaagagccaacaccactatctgaggtcccatttgctatctcactgacgactatattcaatcttgagagactcttccgatctgactaatgattgcattctatcaagaggaagcctttccaactggatagcgacctaattccctgaacacgctatctacgctaaccttatgcaggatttacttgctgccgtccatcttcatacgatcaaaaagttatggaacagccctcatataatccactcactattaaatagtactccttaca

SEQ ID NO: 15206 - DNA, 479 bp, Homo sapiens
cgagtgtcgaagttagaatatgtgcaaatgtgaatccagttaaaactcagtcttctattcgagcagccccagccagccccagctgaccagcagtgacctctggactgaagttgttttgaagataacaatggaatatgaattgcaagagagaaactccattgtaaccttttctaaagacaactccgttttcaattgtggtctcaacatgatgctacaagagtggtcatgttgggaaaaagcctcgactatctcaacaactcaaattccttgacataaaccgtctggtggaaggacaacctccagtgatgcttggtttccaaacaaactttccattgttctgaataaagaaacttgaagcatctactagccttttccatctattatctcctaaaatcagtgcccacagctttcccttaggtattcctaggactagatttagaaaccttctcctggtgttggctatccttcctggtgtactg

SEQ ID NO: 15207 - DNA, 472 bp, Homo sapiens
gaaatctaatactatgggtgtcttcctaccgacaggggcagagaacgtcgaggcgagctcctcttacttattaaaaaaatagtgaactgtaaaacagcctcaggcatgtccttcaggaggattccagaataaggcattgttatcataggagatgacagttccatgcatgttattgcccctgaagactttccagtgggacaagatgtggagatgaagacagtgatactgatggtcctgaccctgtgtaggccttgggtctgcatgcttctcaaattgagttgtaacactcactgctgcggtccaagccttcattctttgaagccccgtggaaccacaaactcttcaattgataaaaaccttcgatcggaagagacttctcatctcatttctgggggcctggccgggatttctctgaagtgaatacaatccatgatactgccaggggttctaccaatggaggccccaatgaaca

SEQ ID NO: 15208 - DNA, 695 bp, Homo sapiens
cagctgacctgcttttctttatgaagaaaacaacttggaagactagtagatttttgaacatccataaatatttgctgagaaccctttacacaatgagcaaatggaacatacaaaaagaaagtacacatgatcctcctttgaattatctttttcactcttatcagcttcatcttatcaggagaaattaatatatgccgtatacttctgtggtcatcctcctccaggatggcctccagtgatctccacttcccggcattcgcacagtgtggcattccctcccacgttgcactggggttgatcgataagccactctagggaaagcagctgctgcgtcatgagcacgttcagcagcctgtagagaggcacatgtggcaggaagggaggcctctggacatcagccagcgaggaactggggcctgccaacaaccacgtgagcgagtttggaaatggattctccagccccagtcaagccttgatgggactgcagctgttgccaacagcttgactgctaccttgtgagagacagtgagccagagccacccagctaagctgctacctgttttctgcccctcagaaaccgggagagataataaatgtttgttggttcaagctgctaaatttgggggtaatttgttacacagcaatagatacctaaaacaactttgtactactaggattaaaaattatctaggaaa

SEQ ID NO: 15209 - DNA, 771 bp, Homo sapiens
tcaaggaactcaaaggaccctggatagccaaaacaatcttgagcaagaacaaagttggaggtatcgttcttcctggtttttaaatcatctacagcatggtactggcataaagaccaatagaacagaatagacagtcgagcaataaacccatgaatatatgaacaactgatcttcagcaaaggtactaacaatacgcaatgaggaaagggtaatctcttgaataaatgatgtttgaaaactagatatccacatgcaaaagaatgaaattggacccgcttgttatacaaaaatcaactcaaaatggactgaagacttatatttaagacccgaaacagtaaaattcctacaagaaaacgtaagataacgcttcttgacattggttttggcaatgatttcttagatgtgacaccaaaagcacaggtgacaaaagcaaaataaacaagtgggactatgtccaatgaaaaagcttcttcacagcaaaagaaacaacagaatttgggctgtgcagagatagggttagaagatataacagtgaagagaagtggaaactcaaatccattctgatggggaaattagtactggttttcctgaaaaccatttaccactatacaaaacatattgattacccatatagcaaatacataaagaactctgacaattttataacaaggaaaccaaatacctaattagaaatcaagagctcaaatagaatacttgatatgcccatgtttactgtggcattattagatgaaaaggcaaaggtggaagcat

SEQ ID NO: 15210 - DNA, 782 bp, Homo sapiens
acggtgagatgaagtatcggtgcccaacatcacacctatgagcagtgaagctgtgtcgaagcttaaggaacaggtgccttggactgggaatcgattttctctaagagaaaccagaaacacctttcttccatgttatcaatataacaagcttatcatttaccaccaatgtaatttcgccacatacgatcgtcaaacctaaacaaagacaggctcgtcagagaccaattaatatcacagtgaaatgttttaggctcaggtttctcctattgctcggagcactgccctatcagtaagggaacacactaatcagaatgggcaaggctgtattgaaattacaccaccaagcaatccaagagaaaaaaaagccctgaagctacagtctgactgagggagaagctccacagacctatgaaatacagagagcccagatgatcctataacacaactacgcccaagagcaccagaacccagagaggactgctaactaccggaccaccagctaaggacatacctttacaccaacgaagtaagagaatcgaaacaaagggggcaccaggaaagaagacacaggaatccgcgtgccaaggaggggcaaaaccgggaggaggaggggaacagagaaaacgcggacgcaagaaagggtagagagaggagcaccgagaccgggggcgccgggggggaggaagagacaccagagactggggcactccgcgaggaaggaggggaacgggcgggcagcacgaaccaggaacgggggaagccagaagcatacaggagaaaag

SEQ ID NO: 15211 - DNA, 773 bp, Homo sapiens
gtccaatttacctcttagctccttggagatagtcatgtactttggccataacatatcagcagatacgacgtgggacgctcttctgtatgacgagctggtgactgatttgctccattttcctctccctgctatggcaaatgacaacccttcatggtggaagcttgtcagtctgcatccccgcgtgaggacgaggtggaccagaatccatgaagggtgtgcagcctgaacagtagctgttgatggtttctacgaaagatggagtttcactcttgttacccaggctacagtgcaatgatgctatctcagctcaccataacctccacctcccaggttcaagcaattcccctgcctcagtctcccgagtagctgggattacaggcatgcagcaccatgcccagctaattttatattttcagtagagatggggtttctccatattggtcagactggtcttgaactcccgacctcaggtgatccacctgcctcggcctcccaaagtgctgggattacaggtgtgagccaccggacccggcctacaaggattttttaaggaaaagattacccttcatatagaaaatttcattatgtttttctactttttcagcattaataaaaatttacattgttttctgtgaaaataataatataaatgaaggggtcgtttgtttacgccttcctgtttgatctttatttaaagaactgaaagactctccctattttgtttacgtgggggaccatcgacccccttccttttggaaggtctaatctgaagt

SEQ ID NO: 15212 - DNA, 402 bp, Homo sapiens
taggccctgacgccatcgttgccccagcagctggaagctggctcaagacctgctcaggctgttttcccctgcactcaccttgcgctcccagatcctggccttcctcctgtggcgcggtctcaggtccgaaccctcctgcttcttgcggactccttctggctgccaattgcagacactgttgagcaaatcatcaggggagcagcaagtgtacaggcagtttgaagagcagagccttggaccagaggatctcaagtatgtgtgctgcagacccttctcgctgcctgaagaagtccagggactcctccccagaataatgttttaaatgcataaaataaaacacttgagattataaaggaaacaagccatatcgaaatataattaacaatattttttgaattgaaa

SEQ ID NO: 15213 - DNA, 753 bp, Homo sapiens
cagagtgtgactacttgagctctgcccccggcaccatcatagggagtgttcacacttcacctttgagaatgggaccaagaggtcaaaaggaaagattccacctgccattcaggacctcaaaacttccaaagaccttcaaatcatgaaggaaactgggcatagaccttctctgttgcaaagttgtttatgtcaggcctctgagcccaagctaagccatcatatcccctgtgacctgcatgtacacatccagatggccggttcctgccttaactgatgacatttcaccacaaaagaagtgaaaatggcctgttcctgccttaactgatgacattgtcttgtgaaattccttctcctggctcatcctggctcaaaagctcccacactgagtaccttgtgacccccacacctgcccaccagagaacaacccccctttgactgtaattttcctttatctacccaaatcctataaaacggccccacccttatctcccttcgctgactctcttttcggactcaacctgcctgcacccaggtgattaaaagctttatagctcacaagaagattaaaaatgcgggctgtaagcatttaaagtaactacaatgacagacgtaaggagaaactaggacataaatatgatattctagtcctgtttgaacatccgaaggaaaagtcactggatacacaccctcggtgctactaactgtgccttctaatcacgtaactaaccatgagatggtccaccttttgagagg

SEQ ID NO: 15214 - DNA, 316 bp, Homo sapiens
caggagcgggattggaattatggccgggcacctctgaagttgataagggctgacatctcatggaccaaccctcaaccactgggagacgggagctgctggataaatgattctgtcttctgtcccttgggcagatgatgcagagatattttattctcttttcatgatgtcctggtgatgggatggggagcttgataccacactatagtgtgtgtggcattgatggcattggcttttcctccttccctgttgaccctcactagcaccttactggcatccctggttgacttcctgaaataaactacctgcacacagaaaa

SEQ ID NO: 15215 - DNA, 396 bp, Homo sapiens
tagatggaatctcgctctgtcgcccaggctggagtgcagtggcatgatctcggctcgctgcaacctccgcctcctgggttcaagcaattctactgtctcatcatcctgagtagctgggactacaggctcatgttgccatacccggctaactgctgtattcttagtagagacggggtgtcatcatattggtcaggcttgtctccaactcctgacctcaggtgatccacccacttcagcccccaaagtgctgggattacaggtgtgagccactgtgcctgtcctcaagtcagtgtatttagaatatgcatcacctcaagtatatatcatttctctgtgaatgcattatctttaaactggaagtttgtgaataaatcattctaatgacttttactgaaa

SEQ ID NO: 15216 - DNA, 787 bp, Homo sapiens
  misc_feature (1)...(787): n = A,T,C or G
taggtgttcaggcctattctaagagccttagatgcctttgcaacatcacgtctctaaaagatgggaaccatcactatcgccattttgcagaagagactaaagattaagtgaattgcccaagattacctggctggtagtccctggtctttttctacagcctacaaaatcatttatctcacacttcaagaagaaatgctatgttagcaggcagccatgaatttgggaattctggacaattgtgtagaatacttttgtgaagtagacatctccctgtatggcacagcctggcgagtgatgattcctctgtgtgaagctctcaaagcaccatttcctccaggtgcagggcctggagagggagcccaggcccctgctgccctctgccaggccccctgtgtattatggatgagtcggcttgggctgctgtaacagacagggagtcttaaccagcagaaatctattgtctcatgatgctggaggccacaagtcccagatcaagatgtcacagggttggttccttctggggactgtgagggagaacccatcccaggcttttctccttggcttgcagatggccatcttcaccctgtgtcttcacaatcatctttctttttggggtgcctgtttctgggtcaaaatttcctctttgcaaagaacatgaatcattggattagagcccatcctgagaacctcatgtcagctcatctctgtacagaccttatctccaaggtaaggtactttctgaagtcctgaggtggggactncaacaattcagctcctgtgtggtgct

SEQ ID NO: 15217 - DNA, 286 bp, Homo sapiens
agattcctggaaacaagaggcatagcattccatgcagggaagcagcaggatgtgtctgggctggcctgcactcagataagaccacatgaaacagaaatgagtcaactcccctgagaccatgccaagccagtcatctcccagccaatccacaggctgattgcagatgcagaagtatatccatccaagatcaaccaaacccaccctaggtcagcagaagcagccagcttgcatacacactcctaagttcaataaatgcttgttattttaagcaataaaaaaaaaaaaa

SEQ ID NO: 15218 - DNA, 787 bp, Homo sapiens
  misc_feature (1)...(787): n = A,T,C or G
cctgagattgaaggtcagaaaaattaattcccaggatcctatacagttggagttgcagaagtgaagtctgagcccaggtctctttgataaccatgcctttcaaggtagccagcctccaagatggctccacaagatcccacctcctggaatgaacctttatgaagtctgtattagtccatccttatgctgctatgaagaaatacccaagagagggttatttataaaggaaagagatttaattgactcacagttctgcatggctggggaaacctcaggaaacttacaatcatggcagaagacacctcttcacagggcagcaggagagagaatgagaacctagcatagggggaagacccttataaaatcatcacatcttgtgagaactctcactatcacaagaacagtatggggaacaccacccccacgattcaattatctctacctggtccctaccatgacatgtgggaattatgggaactataactcaagatgagattgggggcagggggacacaacaaaaccacatcaatgtccttttcctggccattgtatcagagttggtctacaggaccaacagaataaagtggaattgatcacttttgactatagagactgtaaatcataaaagacctgttgacttctgtttgtctctcttttaagtcactcactcaaggaagggccagntgcgaggtcatgaggaccacactgcaagaatctaaggtctcttggcgagagccatctgagtgagtcattctggacatcttgcaccctaagtcagctttcggat

SEQ ID NO: 15219 - DNA, 546 bp, Homo sapiens
ctggattacaggatgtccttcttatccaggatggcaagacagatgtctacagttttgggaacgctggcagtttgaccacccacgtgcttcctgccccctcaacaccacgctctgcgacttcagcctcacgcaaagattccttaccaacctcagacgacagttccttggtctctttgatgcccccattcttttttgtctgctttccatcttcatgaaaatacgacactccttcctgtctcctctaactccttttatcatccctttctctggctctttctcctcctcctgttcctaagagtaaagggctgtttcactttctgtactcgtactattacgtactctctccttgggcggtctcgtccctttctcctggtttcaacaatcacctttacatgaatgaagcaatctacattttttcttctgttctctaccagtctgccatgctagaacaccacatttgacactattgggcttctcagactggctataccaaaacctaaaaatcagcttgtcaaaaactaaatatattggtttaactccctaaaa

SEQ ID NO: 15220 - DNA, 478 bp, Homo sapiens
  misc_feature (1)...(478): n = A,T,C or G
ctcnagaattgggttggacttacttttacagtgctgtgttatttcatcgctcataaaacctacaatcatggctgaaggggaagcaaacatgtccttcttcacatggtggcatcaaggagaagtgaaggtctcctgaganctcactcaccatcatgagaacagcatggaggaacatggatgcaaccggaggccattaccctcagcaaactaattctggaacagaagaccaaatactccagatattctcatttgatgagaacttattaacacaaagaaggaaacaacagacactggggtctacttgagggtgaaggttggaaggagggaaaggagcaggaaagacagctattggttattgggcttaatacctaaatgatgaaataatctgtacaacaaactcccatgacatgagtttgcctatgtaacaaaacttcatatgtacccccgagccttaaataaaactaaaagaaacanaaaa

SEQ ID NO: 15221 - DNA, 778 bp, Homo sapiens
tagactttacccaagagaaagcgattggagaattgcctaatcctggtatcatgtttccggctatgacaggaagagatagatcataatagataaaaatggaaaatgttgtgaaaaaatcaaatacttctaagaaagacaaaacgcaagactcagctgtggtgagtgttaaaggaaatgagtgtcgcaactagatgaagctcaagacatatatttaaacatgttctaatggtggaacagtgagaagaacagctaagaataatggcctaagacagtctcagaaacccagggctcagcccctgactctttaccctcagcgattctccccatcaaaccccatgatctgtctgggcagtcttattctcaacacctcccttgatggaagtctaacctcagcttctagatattctaaccagaggtctaagtcaatcctttctgaaatttaatttcaattctttctttaacctgactctcaagagaaaaattcaggtactttctatttccaattcccttctctaaactgaaacataatgtaacttgctcactcttctccccatgaaatagcttacgactttttgacctctaccgatggaataactctcacacacatactcctatgatcaggcctctgataaatattcaattatgttttccacttctttcccaggagttgcctgccacagaaactgcaaatggcataccaaaggttcctaattaaaaatataccctatgattgataaaaaacaaaatcgggctcgttggctaaacgtggagcttgcgg

SEQ ID NO: 15222 - DNA, 519 bp, Homo sapiens
ggcgcctcacttgaggagcatcatctacctccagacctcatgcagataatgagacgtgagattttgggactgatgctgggattggactttgggggtctttggagggagtgggagggttgtaaactactgcagcctgagggaggactgcagtagaacatctctaaaggtcactaccaccaattcttcccattcctgtaatgcatgttactcttcccatcaagaagccgagtctatatctctacccttgattcttagctggccttgagacttgctttgaccaacagactgcagtggaaggaaggttctggaacttttgagcccaaaccttaggaggcactgaaacacccatctttactcaagagggagcccgctgccatatcaagagtccaggctatctgtatggagaaaggtcacacggaactgaactgaagtctcagatacatgattgaggccaaccaaacatgtggaataaagatgatgggttcttgttgaaaaaaaaaatccggcttgttggcctca

SEQ ID NO: 15223 - DNA, 370 bp, Homo sapiens
aggtatgtcctcagtcgtgaaccaacaactgatctcgcccctttctggaaacttctaacttcttctgtccttgcacaagagagaatgctgccatcaatcataaagaatcacttccagaaatatttggaagtctctggaagaccagcagtatatcaagagtgtgctggttggcaactttgtagcaattaagaaatgaatgaggcacattcattttgctcaaaaccaggcaagaagctctgaaggattattgactctgcttcttttatctggaccatccactccatctgcagttcctgtcaatcaacaactaaaggtcttccaaggtttgccccataaatagtaattaataaaaaataataaaacaataaaa

SEQ ID NO: 15224 - DNA, 847 bp, Homo sapiens
  misc_feature (1)...(847): n = A,T,C or G
tacggtcgaggggtccagggccgagtcctgttcctaatactcacaagaggagtcttgctctgtcacccaaactgggtacagtggcacgatctcggctcactacgaactccacctgctgggttcaagagattctgctacctcagcctcccgagtagctgggactacangctcaacactgccaaggaacataatggaagctgccaaggcttanggcttccatcctctgaacccacagcctgggctgtacgttggctcctttcaacaactactggancagctgggacacaggacaccaagtccgtgggttgcacacagcatggggaccctggacccattccacaaaaccactattttatcctgagcctgcaccnctgtgatgggaggggctgccatgaagctctgtgacatggcctggagacattttccccatggtcacgggaataaacattagggcaccgtgcggctgcatcaaatttctggagcgagctggaatgttctcccccagagattgacttggtcaatggtgccccaggcccaggcggcagaagttcccagctgcgaagggatgggtgcctgaaaaagcccattagctgatatcttctactataanaaagtgagtcctggcaggcctgcgcgaaggaggttggcgggacggttgccctcagggcggtgtaatgntgatgcgggctgagtaaatagactggncacggtagagcctagtgaggaggcaatgtaacagacgatagaggtggaaaacacaagggaccccaaaccgggattgcccgcgactagtccctactagaacnncatcaaacccccagtgatnacatagaggtagcggtggcat

SEQ ID NO: 15225 - DNA, 923 bp, Homo sapiens
  misc_feature (1)...(923): n = A,T,C or G
gagaggatgaatgattcaagtggcaaaaatatatgtcatacgggagctccagggcgccgcctgggaggcctcctacctgtcatccacctgcagatccctactcagccttctgggcccacctccaaggtcacagccatgaagccctctcctgctgcccaagagccagcagcatggtcggggctcagggggcatggcatcggagcctactagtaactgcnaggcaactccaggccttttgtccgctgtccatcttggcaacaccccttggagatgctgtccttctagaggaaccaccgcctcgcccagcagctgccacatgttctggagtggcttgctctctcctttgctggtcccgggccccagggtgttattcagcaccccgaggccccaggcatgctgctgctgcagcttcctgcctacctggccttggctgctccttagctctccagtcgatctgctcacaaaggccaaaagcgctctgaatggcactctgactctgggaagctagccagcttgctccaaaacattatttattgctctcgggagccaaaagagcaagggaccgcnctcctaacgcgttggctcttgtgcgcccgcacgcctgcgggcctaaacatggcagcccattctcctcacatcagacgtagagcagagcattcctgggtacatgcaaggattgtgaggacacgaccagcgctggctgtgcgtaagaaganccttgtgtgagagagagggcccggtccgagggagnccccgtacgcaccngcgagcgacacagagancgaacactaatcccaatgcttgtgtggtaacaccnacaagatgaacnntacaccgaagcgcctgtttacaccgtgcggtccttccccaggggcacgaaaaaggcaagaggagggcccaacgaggggcaagaagagaggcag

SEQ ID NO: 15226 - DNA, 1175 bp, Homo sapiens
  misc_feature (1)...(1175): n = A,T,C or G
tttttttntttttnttncccgnntttccgnnntnnttngnngcgtccgcgctcttttatggacgcttcgtntcttctttcnantacttcctttacttattagtgtcgatccaaaattnnanatacacantcaaatacatgaatcgccagtncnattgtctctttccacttccccgcggcnctacgctagcgctacatcgcacgaggacgcatccaccaccatattctactagtacacactcttgtagtgttatatatatatngccntcgccatatcctcatgtagtgcgtatgtatatataacatgtgtcgtatcccgcctncacatacatacagcagtgatcgtttcatttcgacgtcttactctctatttacacttcaccacagcctcactctcctgttggtgtcgattgtgttatctttgttctacctctgcaacactcttcgcatgttgtcgtgtgcacagtgcatacgctccacccgtgacttatccctgactgtgtattatatactctctttcttactaataatatttttcattatttttttcgtcatccaattcgctcgcccctttttctcctcctatttctacgattattttatttttctttttatattcccaccatgttgtttctattgtctataattaccataccgcccttcaatcagggaagatacgattgtctatcttccgacaacgcaaccacagccgtcacaccggcgttgcttttatctatctttacccccctttgtgtctcttatatccaattcacattctctccctcccccatccattcgcataatatctctcttacccgcgatgtccgtcgcttattcttttcttattcattcccttccccgccctgctcctattcgaatccgtcccgcacctcgatctctcccgccccatgtccccgccccctatatttccatctgcccctctactcccttctaccgtttcctccaaatnatttcgcctccgtagcgcgctttcgcttctgattctacccacaatatcccccgccatcaccccccctacctttactctttttctactcatccgtactatttcttatctactcccgctagtggagcgcattaagaaccggatagttttaccctatttcctcattcccctcttatgtatttatctctctatattagattcccgcctgc

SEQ ID NO: 15227 - DNA, 198 bp, Homo sapiens
agtgttaaatggttgggtatggggaggtccttgtggattccagtgctatccacatggacgtctaatctttatgtaatttcttggagaagaaacacctatcagttggagagtgtgtaaccactgcagaggagctcctacgctggaatacaagcataggccaaaacctttcttgctcagtaaaactcgatgtagttaaaa

SEQ ID NO: 15228 - DNA, 412 bp, Homo sapiens
  misc_feature (1)...(412): n = A,T,C or G
taggtatttgcaggatcactgagtacccattccttnggaccccaaagtaagaaagatgtgagatgctggaacctggtgaaggggaaaccgatagtttccatttggatataatgatcctgcgacccagacaaggaagccagattttcttgttccatggtaatttccctgtagaaaagattttcaatgtaaagaaaatttcaaagaaaaggcctttgttatgtttcagattcagtttagtcgacatggcaaaatcaaggggaatattcttggcgaagaggaagctccctccctttcccttccctccatccctgggccagtacattacatggctgcaacccagagaattttagagacagggtttgtccctaatacctgatattaaactctgatttctttgctaaaaaaaaaaaaa

SEQ ID NO: 15229 - DNA, 882 bp, Homo sapiens
  misc_feature (1)...(882): n = A,T,C or G
gagggcaaggtaaggttgttgtaagaaataggacttgcagtgacaactacanatcctattggccatgctgatgttaaacgttaaaggatggctgccaatgagaattgtgcgccgggcaggaacgtgcatcatgcttgggcgtgagaaatgaatctgagaccagggatatgaaatgggtccctcagacaaatactcggtctaaagatgaaacgagggcagaactcaagtcgcagatttgtatcatggataaacactgagtaccaagttagtaccaagaagtaggaaccacactggtgcctcccgctctcctccgcacgtgcacaaaccctcaactgcccctaggagttggtcatctggcttctttggggtaacagccacatcctccataaagggtcaggagccccagcctccagagactccagacagttttctcaaggacgcgaacttaccctccccgacggcatcgtaccaccctttcccgggccctgtcaccttgactgcccgtcccatggctctccttaccgggggcgctacctccagagcaatcgagtagaccccgcctctcagaaaccaatcaaagacctgaactgtttcccgcccccctgtagtcgcgttacttatgccccacaacgaatcaattaggcggcttttcccttttagcccccccccttcctccaaaaggacggagggaggccttttggctaaaccgggccgtttggctaataggcggttgggttaaacgggattgggaaacttgattaaatacccccgaggaacccctcaaaaccccatgtcttgggtcaaaaaaagaaccggaaattcaccctggaacgccactgctaagtaaaggggatcagnccatttccggctggagggtttgct

SEQ ID NO: 15230 - DNA, 767 bp, Homo sapiens
  misc_feature (1)...(767): n = A,T,C or G
cagagatggatctcgaactcctgggctcaagcgatcctttcaccttggcctctcaagtagctgggaccacatttgctcaccagctggcccaagaccaggctgggcaacatgatggagtcttgttctgtcgcccaggctggagtgcagtggcacaatctcagctcattgcaatctctgcctactgggttcaagttattctcccacctcagcctcccaagtagctggaattacaggcacgagccaccacatccagctaatttttttgtatttttagtagacatggggtttcaccgtgttggccaggctggtcttgaactcctaacctcaagtgatccacctgcttcggcctcccaaagtgctgggattgattacaggcatgagccaccgtgcctggccattgntctataatatatctttttttttttttttaattgagacggagtctcgctctgttgcccaggctggagtgcagtggcgcaatcgcggctcactgcaagctccgcctctcgggttcacgccattctcctgcctcagcctctccgagcagctgggactacaggtgcccaccaccacacccggctaattntttgtatttttggtagagacgggatttcaccgtggcctcgatctcctgacctcgggatccacccgcctcggcctcccaaagtgctgggaatacaagcgtgagccaccgcgcccgggtataatacatcttaattgtgggggtacctgggcatattcctttggcaaaccatttgaactgtacc

SEQ ID NO: 15231 - DNA, 770 bp, Homo sapiens
acttcttaatgtgaaccttgtggactggaggttctaaatatcaagcaaatgaaaacagtattgactgggacagaaggttctttggtttggaatatcctccatttcttcaaccaaaatatgctgagcactgggtgtccaatgaagagtgaaagcacacatgatctccaatttttgtgcaactgctcgaagctgggctgacttttcagattacaaagaccaaattccctgttttcggagacatttgattggtgtttggtgaaagctgggggcggagtgtgtgtaaatgccagtggcagtcggccgccctcttcatagtggacgctggagcctttagagtggagggagtaatggatttgcaaaatctcctgctgctcccgaagctttcccaagtcctgcttctaagtccatggctcttgtaatcaaagtaacatgctcatcagcctggataatcattgttacatcaatgtctgcatctggtgtttatcatcttggagagccaagcaacagaaggccttatttcgaccaggcattttaaaatctcttcttggaatgacacttcctgtgtgccctaaaggacctacagcgagtgccaagttaccgtgtttcctgttgtacatacacatggagagcactacgaaaagggaactgaagtccccaggattaaaggctcccggggagcatgatgtcttgcacccgctcaaactgagacggattgggtcatggctcagtcactcactgatcaggtagctttctggaaattagggaaacat

SEQ ID NO: 15232 - DNA, 790 bp, Homo sapiens
  misc_feature (1)...(790): n = A,T,C or G
cctgtagcaacacttcagaccgtaacgactttctcaaattttcacactcctatatcaaagatggtggaattgaagaccagagaggtgaggtatttcctaaggtcaagagttggcaaaaaatccaggagtcccagcctccagtctatggctcattaagctcagctgtgtctcagtgaggaccatagtcatccggcacagagggctcaactgactgctcagctgggctgtcccatcaactcaggcaagaatcacctgccctgatgtcaaaggcatcaacacctgggagggatcacttgaatcacaagaatcacagcctcgagaagttgtttggcattcactggcagattgtaagaaatgtatttctgtgagagataaactgtatttctatggttttctttccttcagtagcttatgtatctggttttaggaatatggggacaaatggtagggtgggggaaggctaacagaatcttcattaagactggggataaaaacaaattggcaataaggagaaaaggatgacattctccttatagatcaaagcagaaatcattgtgacaaaatctccacattaaaaaaaaaaagtccagccactgtggagagcaattgggagacttctcanagaaccaggagttgagctaccatttgacccagcaatctcattactgggtatgtacccgaatgaaaataaattgttctgccaaagatacttgtacccatattttcatcatagtgctagtcacataacaacgacatggaatcaatcaaggggcccatcaactgcagaatg

SEQ ID NO: 15233 - DNA, 797 bp, Homo sapiens
  misc_feature (1)...(797): n = A,T,C or G
cttgggtgtggcaggcaggcctgttatgaccaattcaaagtccctcttgttgctactgaagcatgtttgagacctgcgaggaggaggaggcctctatcagagcaaagaatttggagctgcttccaatctgaaacttccttagcgttgtaaaaagcacccttcattcgaaatcgctcagtgcctggactcagagaaagtgggagagttaccaaggctcggcccccaaggcacagtgagaagaaactgaggcaatgccaagaacaccccgacctcatgagcttcaaagaagctgctgctgcagttcccggttctgaggcacctccaagaccactctcatccaaactctcaaaacactccccttggggggcaacatggagtccatcccggagcactggggaaagggacccagaggctgtcctgccactctgcactaacaacaaggaacagtgtaaggttggggcattgatgtccctttctagggcacctggagctcttttggcttgcgaatggacatctgctgattttgcctgtctgggacctggtcactctctgccacactttggatcttcccttgtggcgggcagtcaaagggaccatcagttaaggttccacactcttatctagccaagaggttggaatgaagcccaagctgggtcagtcagattcgcataggaattttaaccttgaacagganaaggaaagaaattgaagatgacggtgaacactggtacttccctaagagactattacttnctgctacttaaattctctagttccagtggcttctgttacttgat

SEQ ID NO: 15234 - DNA, 788 bp, Homo sapiens
  misc_feature (1)...(788): n = A,T,C or G
aactggtgggaactctaccatgnncgtaagcggccctagagagagggaagccaactgccatgtcttgaggattctcaggtagcctatggagaagtctaaacagcaagaaacaaaagcctgccagcaaccacgtaaccaaaatgtgagatgtcaaagagaagagcccatgataatggcatgacttttggcctgagcaactggagtcagaaagacttgccattttctcaaacattgaagactgttgagagaatgtaaaggaaagaaccagaagtttatcttgtataagttcagtatggtgcacttacttgacaagcaggtggaattcctgagcagactggagttcaggggagatacccaagctgaagatgtgtgtttgggacttaatgtcctgaaactggatgagaaggtatagatggggaagggtaaagaaaattggattgagtcctgngttatgccaacatttataggcctgagaagatgagcgggaatgaggaaaacaagagaagttaagaaggatgcaagagggagtgctgtcccagaagccaagtgaagacagtatttaaagaaagcaggagtgatcgtgatctacactcaaatgctccaggcaagtcaagtacgatgatggctgaagattaataagttggatttaacaccctggaagtcactcatgttcctaacaaagtggtagtcatgcttgaaataccattttggtttctattttttattggcccttaataactctttgaaatcctattttcaagcctgcattaaatcccataatataaaag

SEQ ID NO: 15235 - DNA, 440 bp, Homo sapiens
ggcttctcacaacaataaaaaccaaaaaaaagcagttcagtagctctgcttgtcttcttgcttgtatcctgcagtttggccctgtcaagaagtttctgaatccactcatgcaagaagatatacaaaccacatcaaaaatagtgtataggctgggtgtggtggctcatgcctgtaatcacagcactttgggaagctgaagcaggtggatcacaaggtcaggagttcgagaccagcctgactagcatggtgaaaccccatctctactgaaaatacaaaaattagccgggcatgatgtcatgtgcctataatcccagctactcaggaggctgaggcaggagaatcgctttaacccgggaggtggaggttgcagtgagccgagattgtgccattgcactccaggctgggagacagagtgagactccatctcaaaaaaaaaaaaa

SEQ ID NO: 15236 - DNA, 790 bp, Homo sapiens
ttcactatacggcagaaaaccactatgtcatgggatcgtgcagacagctccccttccttccctcaaataaaagcagtgtccacatttccgctgtgatgggcaccgcttccctcctttccctatgtgagctgaaaactcacccctaggagtcaaatataatcaattacacaaaactattttaccggacgtgggttgtgagctggaggtaaggctcagttccgtttctaaaggagtccacaagatttgcttctcagagaagaaattaaagttaatgatgggccaggtgcggtgtctcatgcttgcaatcccagcactttgggatgccaaggcaggaggattacttgaggtcaggagttcaagaccagcctcaccaacatagagaaaccctgtctctactaaaaatacagaaattagccgggcatggcagtgcatgcctgttatcccagatattctggagggtgagtcaggagaatcacttgaaccaggaaggtggaggttgcagtgagccaacatcgtgccattgcactctagcctgggcaacaagagtgaaactctgtctcataagcaaaaaaaaaaataattagccaacgttggtggtgcatgcctgtaatcccagctactctgggactgatgcaggagcatcccttgaacccaggaagcagaggttacagtgagccaagatcatgccactgcacttcagcctgggcaacaagaaggaaactctgtctcaaaaaataaaattaactaggataaggatattgataaccttttttgaaggcaaaaaatatat

SEQ ID NO: 15237 - DNA, 766 bp, Homo sapiens
aggaccaggcaaaagagatgtacccaaaggctccctaatgagaatatgtgagcattccatgaaacatgagccaaagtgaggcttaaacacccaacagatgcctgttgaaatgaattgaacctatgaactctgagagaagccaaatttaacatctcatgttaaatttctctgtgtcggaattcattttcattacccaagtctttgataaggatggcataaagacttactcaggctgggcgcagtggctcatgcctataatcccagcactctgggaggccgagatgcatggatcacttgaggtcaggagctggagaccagcctggctaacatagtgaaatcctatctctactaaaatacaaaaattatccaggagtggtggctggcccctgtaatcccagctacttgggaggctaaggcaggagaatcactagaacccaggaggcagaggttgcagtgagccgaaatcataccactgcactccagcctgagcaatagagcgagactttgtttcaaaaaaaagaaaagaaaaaagacatattcatataggcgagtactcagtaaatctttatctttctcaagctactggaataaagtaatacaaggaggaataacagccaattgagtattagaaaagttccacaatgaaagggtaaaccaagaaagatgggagacatgagatgctggaaaatagatgttttcctgaagactggcaaagaaaccacccccgggatggcagccttccgcaaactaagagaaagatcgtcca

SEQ ID NO: 15238 - DNA, 277 bp, Homo sapiens
agatgacagagcagctgagtcttgcgatcaccgacaacaaaccacaccgaggcacctactccactcagccatgtagcggctatcatggacacgtactacactactacactacgagaacacagtgtacccctgaacgactgactttacaaatgcggaccgacatagtaaacgaggttctgacagctgctttaacttatagatcactcgcacatgtgttcgacaggagattagtgcgtgcctccaaaaacagaaccatcgggcgtcgttggcctcaccc

SEQ ID NO: 15239 - DNA, 822 bp, Homo sapiens
  misc_feature (1)...(822): n = A,T,C or G
gctcccatcatacctaataaagacgagttaactcacanaaacccactcaataggacaggcctggttactggtgtaaccttccactgctgctatcaggaggaaacaaacatttttccaacaaatgaaaagatttattgcatctgaaaggagacacggtttcagggagctccctgaggtcagggaccatgtctgtcctgctcatcattgtacatcatggcacttgtatgacttgtacatcacagcttggccgagacagcatatggacacagggaacatctgtggaagaaacgaatgaacagacaaggcctcaacttaaatgtcacctacacagaggtgcctgcctgtcttccaatctaaattagatctttgttaacttacctcagactacaccgttcttttctaatctaataatttctagacctgacatattattaaaaagacacattcctaaccatactatcatgacgcttacgtatcaagagctggttatgacatgcttatcactctccccctaatccttaacctgcagcccaccatatccaagttactattattcttcagcgagtatgactgacccactccaccataccttaataatcacctccatatgttacatggcatattaacaaatctcatatggaacactactttaaaccacatcacgccctaaatacaccatcgacgtctaatccccctactagttagcctcttacgtcaaacaaatcatctttgaatatcctctccttgaatccgtcgttctaccccgccgctctgtccactatctccaaaatctttcctctattccatcgaacgtaatacttg

SEQ ID NO: 15240 - DNA, 837 bp, Homo sapiens
  misc_feature (1)...(837): n = A,T,C or G
gcccgcgaataaccgtctaaagacaacgaaacaggacaagcgaaaagncctgagggggcaacactttgacatccttgctggagtgcactggcatgatctcacctcacctcactgcagccgtgacctaccagactcaagtgatcctcctgcctctgcctaccaagtagctgggactacaggcacacaccactgtgcctggtgaatttttgtcttttttcagagatgaggttttgccatgttgcccaggctggtctcagactcctgaagtcaagcaacccacctgcctcagcctcccaaattgctgagattacaggcgtgagccacctcgcctggcctgaatgactacattttaacttaaatttagaatcttaattattacctaatatcttcaaaaaggtcacacaatgatgtaccattgaaatttcagaagatggctcgcacacaccatgcagtggaactgaaggcaggaaagatggccatatctctcatgacagattccggaatttccaaaaattcagaaagttagagtaatggactagttgtcaaaaacttcctgctgactttcaagagaagtcatgtgatttccgcattgtgaaatcccacttaagaaagaagaaatcccaggggaacttgaaatgcacgcaacttaagattcttgtgccggctttgaactcatatttggaaggacctttaaagcgcaggggccaattacttggtatggaaagcattgtgactcctaggaggcttgaaaagcttctgtgcaacataattatctccaaggttctcccaatcctaatacaaaccctgtctatacttaactggtgtcttgaactaatg

SEQ ID NO: 15241 - DNA, 741 bp, Homo sapiens
  misc_feature (1)...(741): n = A,T,C or G
tccgaagagacattaggtgtcattatanacgtacaccccagagtactcttgatgatcttgagagttctatacccactctacgggcacaccactcaattactctggagcgttaccgtggtaaatcactggaaacctccagccttacaagcttgaatatgcgcatagatgagaagatcttcactgactcatgtgagaccgtgagaatccgtgcttatggaagagtacattgccggcttctcctcttaagctcagggccatatgtattcctagccaaatgcttcgcacacattcagagaaatgttaccactgctgactgagactcttagaatgactgagactgagagaatgttgtttatctcattgcatacctgccagagtggtcaccctgatctcagaaccgagactggactttcagcagtgataacctgctgaccaaggcccctgactctacagacgcctatatgcctaaccaaacactagctcaccattggcatctgcgtagacataagacattctatcatgatcgaggaggtttcctccgaaggtgtgccggagtggcccaacatatgcgagtcgctcaatgtgtgtccccactgacacccgaatgcgtgaagttagattcgccctacttggcctcacttgttagttctgggaccggttcctttatagagggtaattggtgatgcttctcggtgactccttgagctcgggcgaatcgctgcggcagcggcatctcttcct

SEQ ID NO: 15242 - DNA, 794 bp, Homo sapiens
taggatctctacaaaagtataggaaacacagatgcttgagaggatgtggagaaataggaacacttttaaactgttgttgggagtgtaaattggtgcaaccactgtggaagacagtctggcgattcctcaaggatatagaaccagaaataccatttgacccagcgatcccattactaggaaaaagagagaagcaaccaatattccaaatgttctttcagtggtgttactatatccacaatgttgggcaaccatcaccaccatttccaaaattttttgtcacccagtgcagaaactgtgtaaccattaagcaataactctccattcctcccttccccagcctctgcataaagtcttcaaggttcatcaatgttgcagcatgtatcagaactttgttccttttatgacggaataatattccattgggcctgtgtaaagacactgcaaagcacaaggtggaagaagcctgggtcctagagtcaccacatacaggaaaaccacctgctatccaggaacatcattattagaccattgcatggatgagagataaacttctgctttgttaagccactgaaattttgagggtttcttggtatagaatctagcattaccttaatgaatatgcttctgaaagacaaggaaagagctatgccgcccttgatgaaatactggatggaaggatttcaggcagggagaacatgcatgtaattggatattcctggagcaaagaataacaagtgtttgcggggacccccaagagccagtgtgggtgaagaaagaaacaaagggattactga

SEQ ID NO: 15243 - DNA, 1234 bp, Homo sapiens
  misc_feature (1)...(1234): n = A,T,C or G
gccctcgaactaagcattaccctcacgtctaaaacaccaaaggccctcgagcgtgccccggcaagaagctctgaggaacagccctacaattgtagaaatgcgcaaacctgtagaggatcatcctggatcacagctaggaagagactgagagcttcgcttcctgctaccttcttcatgaagatcaaaactggacctaatagtccagtcagctggctcactgcatcagacagcatcaatcctagatgctcatnagatcctatcatgtctcttgacaccacgctgttagcagttcctataactgctagaccatatagcgagccgcctgacctatcttaacacgacgttcaagataatattccgcgtaaggcaataactcgatncgcatgccacgtatacacnaccttgcaccttgaatcgagtacctcgcttcttctcttttccctagcctccagacgctaagatgcgtatctatcacccatcctagcactgtttgaacgggcgtgcactgtganactactcacgacgcccacgactcactcgctggaccagccgtcataggtgcctcttcccttaggaggacctcagcctttgtctcaagagcaacagtccgtgtgaccgtactctcaccacactctattggcgacaatgcagtcactcgtcgcgggtcgtggtctgtgaacataactcctgaccagcactatgaaccaacataccgacgcctgacaatatgtgtacactcgagcgtcgtaattgctacatatcgtcacaaatatgaatattttcttacatgcttacgtcgtantttactcacntgcatataccacactancgcaccccgtccacacccgggcctctgtgtagaggagtgtccgttcacagtatagatgtattattatcctgcagcccagacgcccctacgacgaggnacagtgagcaaacggcgctcggtaggtcaacagcttcgtatcacacnacatgcgaccagtcgcgttgtanattatcctgcaactaatacttcttactgaccacacgctacgcgacgatctcctcatncgtgcatcctactcagccatacgtcgtatatcccactactccgcgccgggactccgtctttgctccgccatcttgtcggactcccagcatgatatgtgtttatagctgctcgtacgcgactgcgtgttgtacacctcgtcgtcgctctgctntagctagtacctagtccatagctgctgcg

SEQ ID NO: 15244 - DNA, 749 bp, Homo sapiens
aatgttgtcccgaatgacggtggatacgttgaaagtccaatcaactgtgctaaatcttgaatcagttctctctgttgccttttgcagtaaataaggaaatatggagtaaaagagtaatcttcctgctgagcatgttttgcggttgccagcgctgccccgggtgtgtctggaggaacactccctgttgcctaacaactgctgtaatgtaacggaaatagaagcatgatgccacacatccctcagaaaacgacttggcccttggcactcctgtggatgaagagtatattgaagagaaactggatatttctaaatttgctaagactcgcttttctcacttgccctcagatcacactacttttgagtagcccaaaattttgttgccaactcagcaagttaagcaaacaatattacaaatcatgttgaaactgaagtggtccccatgggccagtgagtacggtgcatgtggaaaaaaattatctgctgagttaggacaaactgctccaattatgaaggcacaaaatggcattatcttggggcccgggtactacccaaggtggacctctcaatcaggctcttaagctaccaggtgcaggtgtggggagaactttctcctggatgcttaggggacagcatctcaagagaggtgatggaagaatcatgaaaccctgcacacactctaggtgcagtggatacaagggttaatacctcttatttataaccgaaaggctttatgctccattttttttgag

SEQ ID NO: 15245 - DNA, 722 bp, Homo sapiens
  misc_feature (1)...(722): n = A,T,C or G
cagctctctctcttgcccgatgagaagaggtccttgcttcccctttgctttccgctgtgactgtaagtttcctgtggcttcctgttaaaccccaaaaatgatgagatttcaccatgttgctcaaggattctggaggctgagagtccaagatcaaagtgccagcagtttcaatgtttgtgaggtctacactttctgcttccaagatggcactttactgctgcatccttccaagaaaaggaatgctgtgtcctcatcatggtggaaaggatggaagagcaagaggggacaaaccttgtgtcccctcacatagcagagcagaagagagcaaactcactccttctagtccttttataagggccctaacgccacccacgagggctctgctcacatgacttaatcacctccccaaaatcccaccttttaacactaactggtgattttgcaggggacatcatcagccaaaccataacaccacataaaagcatgtttaagatttgtttctgatgactgagacagtttgcatctcaatattaaaattgttctacctgatttaacttagagaccttgggtctttagctactaaaagattgaataatcacctatctttcctgaaggagcttatttttgaagcagctaataatgtcaaacttttctcactctctacttgtctcaattnttcccaatgttttacaatattaattataatcataatcccctcccaa

SEQ ID NO: 15246 - DNA, 802 bp, Homo sapiens
tagtatttactgaatgcccaccattgatgaggcactatgctagatgcagaggacacagtagtgaacaagatgtgttttctattctccggggactgacagtacacagatgtagacagactatggaaatgatgttagacaaaaagcaaattcaattgattttcttatttgagttcaaagtgggtcataaagcagtgcagacaactcgcaacatcaacaacgtattggcccggtaactgctaatgaacatacagttcagtggtggttcacggaagttttgcaaaggagacgagagccttgaggatggggagccttgtggctggccatcagaagttgacgatgaccagttaagaacaatcatcaaagctgatcctcttacaaccacacgagaagttgctgaagaactcaaggttggcctgtctatggtcattcgtcatttgaaacaaattggaaaggtgaatgagcttgataagtgggagcttcatgagctgagaaaaaatttaaaaaattcatcatttgaagtgtcatcttctcctattctacacaacaacaatgaaccattcctggatccaattgccaggagtgacgaaaagtgcgatttctccaacgactggaaactggcaatgaaccccttagcggctggactggaaagaatttccaaggcgctttacagaagcccaacttgcaccaaataaaggtcatcgatcctgttctaccggcctgctcgctggatagatcccctacacattttttgattccctgcgaaacacatacatccatagcagtatcccaagaacatgctggg

SEQ ID NO: 15247 - DNA, 585 bp, Homo sapiens
tctgacagtcctttccataatctctctcagtgagaagaactgttattttgtccattttgtggatgaagaaaccagaacccaagagcggaaataattcatccaagatcactcgctaggattcaagctttaatacctggtgtgtctgaatcaagaattcgcatccttacaactgctccatatccccctactccccaaaccttgatgcttacaggtatctactgaacaataaacatcttccctgagcctgaaaatggtggagatgcggtgtggatttctggaaattggagcggagagacacctttggggggataaaagacggcatttgagacacttgcattcctccagctgtccccctttggcatgttttaattttaaagtggcaaatgaggaggatgcttcctcaggggttccccaaaggcctggatattggccgacaagagggccaatcttctcactgacattcttcttcttaatagaataagtcacttcagctgtaaaaatatttatttttaaccccacatgggactgtctacaaactattttcatgttgagtataaaacagtcaaacctgtaaaaaaaaaaaaa

SEQ ID NO: 15248 - DNA, 754 bp, Homo sapiens
  misc_feature (1)...(754): n = A,T,C or G
tagcttttccaagaagtactgtanaaagagacttagcagcccttgttcctctgaggtctgacactaaacagctggagctagagctttgactaatctgaagagggaagagaaagaggaggaactgtgaaacatcattttaaactttcctgagaagttctcctgagactatcaaaatcatcccccagaaactgggtgatgggtatacaggaaccctctgtcccacctttgcaacttttctgtaaatcaaaaattatttcaacatagaagtttattaaaattatttgaaaataattcccccaaattttctaaagtaatgaacggaaccattattaattacttaaggattatagtaatagtaatttaccgaatgatagagttaaatcttgtactctatgctaatactttggagtgcactgggcctgttacataatcagcaatatttatactgttaccttcctccctaactgagcaaaaaattccatttgtcccaaaacatcaaaacatcaaactcacagacactctgtagttgagggttctctaacagtcaattttatacatagcagctacttggtcagcagtctacaaaggcccttgaacctcaacattcattccctggtgattatttaaaagccagacaacagattgtgatgaagctgtggaaatagggaatgcttatccctggtggtggaaatgccaactggttcaccaccgtgggaagcactttaaaaatttctcaaaaacctaaaatgggccg

SEQ ID NO: 15249 - DNA, 785 bp, Homo sapiens
cagtctgggaccatttcgcgagaccaccagagacttatttatgaacagaaactacaagcgattgaactgtccacagacaaggaacgcttgatacccatctatgtgtctgggcaactcattccatggggcgcacctggacatgcaacggcgacccccttggctcctatactcaaagatgccattgaagagaagatcatccttgctgaagtcgcgaacgaaatgaaccgtgctaatgggaggaggacatgtgggattttcctcttaatatacaataatctccttcttgctgaccattagtctggacaaatcgtgtgagaggctccactggcggatgtgaccaaagtgtcactgagctgacatatgatggcttcttccaccgccacctcaaagagggctcacaagcagatagtaaaggagactttctcttcagcagagatcacctgagtgatatggacaccgagctctatcgcacaactctcgaggcaaccaaacagatgctcactgttgagatttccgatgagttcctgggacaggtgagacaggaccaagtgtgtgggaagtgtattcaggctaaccacaaaaaagggagtgtgcgctccagcttacgaaaaagccccccgcttcgtagaggttgctggcccttaactggcgcctcctcttttcttttaatggacttgttacttctgaactaccggacttgggagtcttgtttaatctcgggttcattgggttgcctgggaatcccccaaggcttttccaattctttaggaatattaaatattggc

SEQ ID NO: 15250 - DNA, 781 bp, Homo sapiens
tgatggggtttcactgtgttatccaggatggtctcgatctcctgacctcgagatccgcccaccttggcctcccaaagtgctgggattacaggtgtgagccaccgtgtccggccaaagggtctcgactctatcacccaggatggagtgcagtggcaggatctcagctcaccgcagcctcaacctcccaggctcagaagattctcttacttcagcctcctgtgtagctgggaccacaggcacgcaccaccactcctggctaattttttacataatttgtacagacagtatctccctatgttgcccaggctggtttcaaactcctgggctcaaacgattctcctgcctcagcctcccaaagtgttgaaattttacaggcatgagccactgcaccagcccaagaggctttcttaaacaagtatagtactcattaatccagggcaaaggtgaccaaatgatgtggataatgatttgtttatttgtcaacgttcaccactaagtaaaagctccatgagggcagggaccatgtctgtcctaattattattggaattataaaagctacaggtcgttaacacataataggaactgcaatatctgctgaatgaatgccagaaatatgtacccactataataccatatactgtgctactctagatgtctgtacttaaagtgttcggatttcttaacagattgacatctcactgagctctgtctttgcaaacaataaatttggcctcgttggactcaggggtggagctctggggccgctcccttaaagagggt

SEQ ID NO: 15251 - DNA, 809 bp, Homo sapiens
ctaggcctttggtatcgagatgattctggcctcatacatgagatagggaggattccctctttttctactgtttggactagatacacaaggaatggcaccagctgctttttataccctctgatctaattcacctgagaagtccggctgggactggactttttttgtagaagaattatgagaatgactagcataaaaactaagacatggggatacttgaaagccaccactaacagagccaatgggaatgaggacctcctgctttcatcacttggcatccaacgagctctctttagagacctcatacgattcacggaagaagaacgtagagaatgcataaaaacctagagcactgaggactttatgagactttatggaaactgatgcatgtgaacatgatggagtggagcatatgattaatggcccgatctctccccctgttgaatgcagcaggattcaaaagcagcacctaaccaagccctaataagacaaccacactccacacaggggatggtctgttgtgtacgaaccacataagagctctgcctgcttgaagcagcacattctctagtgtcgccaggacacaggtgcatgtgctcacttaacatataacctttgaaggatcgcataagctataaaacaggggtggagtgactgccctataaacataaatcttttttttttaaaataaagactgcactatacgttgcggggggcctctactatggtaattattctcattacaaacataggttgtcttagccctcatatgaaggtgaggagggtcatgaggacttgcctaagacagttag

SEQ ID NO: 15252 - DNA, 503 bp, Homo sapiens
caggtcctctttgttccaggaaagagacttagtgggcagacaattgaacttcctcagcttcgctccacacacaccccagctttaagaaagcccaggaagaatttttttttttttttttttttgagacggagtcttactctgtcacccaggctggagtgtagtggcgtggtctcggattctcagctcactgcaacctacacctcccatattcaagcgattctcccgcctcagcctctccaggagctgggattacaggtgtgcaccaccacgcccagctaattttcatatttttagtagagacaaggatttcaccacgttggccaagctggtctcaaacgcctgacctcaaatgatccacccacctcggcctcccaaagttctgggattacagacatgagccacctcgcctagcctttggattacagacatgagccacctcgcctagcctttttttctttttaaggaaaaaaagaaaaataaaatctcatcttaatctgcaaaat

SEQ ID NO: 15253 - DNA, 828 bp, Homo sapiens
ctctaccctacgaagccagaagacaaagttgaaaaaaaaaagaaaattcagtttttctggtgggtttctggagaatcaaccgtcaacattctgcaaaacaatcactgactcaaaaaactcaagaagggagtaaagataattaatagaaaatttgctaagggaattgaagaaatgtaaccaagtgactagtgtagcatcaccaacggtatcacatatcccaaaatatggtgtaaaaagaaggacacttcacctctgtggtattcttccccaaaatatcatcagcccagtccattcacaagaaagacaccagacaatcaaattgaggcaccttctacaaaggtgactcttcaaactgcccagctcaaaaaacaaggaaacctgcttgactcttcaaaactgttaaggctatgaaaaacaaaataatggtatctgaggaattgtaactaatcagagaagactaaagagacattaaaggaaggacaatgcggtcccctgaatggatcctgtaacacagaaaacatgttagctggaaaactgctgaaatacatataatgtccttactttagccaatagtaatgtcgccaataattatttctttaattgggataaatctactggccgctatcgtagatgctcactggaaagagaaaatagctgaaagatttcaatggttaattttagcaacttttctgctaatcttactttattccaaaggcaacgacgttatttttaaatacttgctgtaataaaagatggtttcgtccttgacaatatacacccctgccttgtcgtcccactgcgggaacttgcgattacttccctgagagg

SEQ ID NO: 15254 - DNA, 765 bp, Homo sapiens
tttggttaatgcagttaagtaacatgatcttggaagacgagtgttgaaggtgaaagaggcacaagttagaagaaacctgggtccttagatccttgcttggaggaaaaccacctgccaatccagaacatcattttggacttcatgtgggatcattacttgccagccttccagctgatgccagtggcaacagcacgacaggctgaactggattctttatgactatgtattcattagggggaaaaagcacttccaatgcaaatgattgaaatggaaacaagatgtgcactctgctgcctaaatgaaagctctaccaggtaggtcattcaaactcaattaagagtagcaaaacaggatctatcaggacagtggctgtaacccctgtcacagagaatggacagtgagcggtccaaatggattggggggcatgaatggcacctgacttacagcaggagctcagcacttttactctctttgccgcttcactggaacacggagaaaaagacattaggatgaaggataatgtgtgattcacacatacagatgaaagcgacagggacacatgcgatgccacctattggaaggaccactcaacggctgtctgtactttcttccctaaaacatgttccacttggtttagccatctggggcccactttggagctcaaggaccctggcctatgtgtttaatgtgagccccccatatgaaactcgctctgccaccccaggggaagtctctccccgtctctgtgacaaagccccggatcat

SEQ ID NO: 15255 - DNA, 816 bp, Homo sapiens
ctaggatgtgtggcaggttcctgcggcggctgctggcggaggagagccggcgctccacccccgtggggcgcctcttgcttcccgtgctcctgggattccgccttgtgctgctggctgccagtgggcctggagtctatggtgatgagcagagtgaattcgtgtgtcacacccagcagccgggctgcaaggctgcctgcttcgatgccttccaccccctctccccgctgcgtttctgggtcttccaggtcatcttggtggctgtacccagcgccctctatatgggtttcactctgtatcacgtgatctggcactgggaattatcaggaaaggggaaggaggaggagaccctgatccagggacgggagggcaacacagatgtcccaggggctggaagcctcaggctgctctgggcttatgtggctcagctgggggctcggcttgtcctggagggggcagccctggggttgcagtaccacctgtatgggttccagatgcccagctcctttgcatgtcgccgagaaccttgccttgggaggataaccctgcatctgtcccgcccctcttaaaagaccatttcctaaagacccttgttggagtcagccggttctgtctcttgtttacttttttggagcttgtgcttttgggtttggggagatgggggaaggaccgggagagccaaatcttcctctcctaatacttcctaacttcagagagcaccataaggacccagaaaagctcccgttgccttcccattgggggaaaccaaatatacatttaagaagccgttcccggacaagcttatcccagaacaacaag

SEQ ID NO: 15256 - DNA, 1036 bp, Homo sapiens
  misc_feature (1)...(1036): n = A,T,C or G
atgatgtataatgnnaagtttatgaggnngaataagtaaagttattagataatatttgataaatattgataggagatnaaaanaagatgttattgataatttannatataannnntatatatatattantnatattattaatttatgatgttttattgtgttgtggatgtgtgatttggtggtttttgtattgttttgttgggtttgttgtgaatatggttgtnngttggaggttaatgtaaggtcgcctggtgggttgtntcggcatgtgtttgttncaggttttctctctctntgtagttagctcttaaccatatctataatttagtcattaatcacaggacgatnnngttcgagagttgagagaataataatatgtgtaatatcccgaggtttcgtatatttagttatacttataacagcgacagccacatgcagcgtaccttacaatgttcccttcttctgttacttttgtttattccttctctacgccaccccccccatccacccatccaaccnaccccactcccacctctctcctaaccccaacccacatcccccctctccccgtcccaccccccacctaccttcccccctaaaccacacgcggaagacggcccagctctcccccccctcctcttctcacactactcttttncttctccttttccccatctcccgaatctacgccccgcctccccggatgtgtcgcacgaacttcatctccctctgacccatctcataaccttcctcagtgaccaccgccgtgtcgagcgaccccggaagattccatccacacatcgctccaccgtccgttcttccctagacccttaccatttctacttacaaatatgattcctatttatnctcatctatacacaattttattccggacgagctnccctgtggacttagatctctttaatcctcatgttatttccacacgctccacttcgcgtacgtctgtaagttagccaggacgccccaatgnacccgtgacacgctcgcctaacccactacctcaccaatccccact

SEQ ID NO: 15257 - DNA, 827 bp, Homo sapiens
  misc_feature (1)...(827): n = A,T,C or G
atataaatacacccacaacaaaccaaccactcaaaacaaaaagagactcaggagaaacggttgcctcacgtttnaagacacacctggatgttggtctgaatcaccgatagaaaaatcaaatgtctccagggacccggcaggatcccgaaagacgccgctctaagccagagggagcggcgtgtgctgaggctgaagtggaaactacaaccccagctcaagggcattcaaacatgaattgttttttgtaaagccgtgccagccaaacaaaacatgtgattcatctcttattaggctaacacgactgctggcttgtgaccctaggactcaacctcaaccatgttgggcaaggcaaactaagatatgctgtgaatggccacccgaccagccattgtactccccctcccgccccgtctcagttatttgggaacatcttacatcgctgcatggacactcacggccctttcccctgttatttccctactgactctgccacctatacctgctatgagccacaccataaagactaacctctacaagcaaccgaccttccatcctttaaaactgagatctactcatctccaatttacttggtccttggagtccaccaaagatctcgaccttcttttttcttatattacaaattcggcactctcttactttttagggatcccaaactacccttccactgcccccatcgatatgtctttcgccactaccccctctcaccatatatgtaacactacccggcatcaccggattccgtactcccaccgatcttagatattccaatccccatcactacctccccttcccccctaactctttcg

SEQ ID NO: 15258 - DNA, 737 bp, Homo sapiens
tttttcctgaggggtggtgactttttttttttgtcttgcgaaacggggtgtacgggggtgcgcccttttcccatttttcggtgtcccgtttttttgttccctcgggatttctggttgggtgtttctttggggggtcggaatgtggttaaaggccgggtgaaccgctggtcgatttttcttttgggttttttaaaggccggtttttccccgcgggcggggtgggttttggtgcctttggcgccctggttgaaagcccccccaattttttttttcttgcccctggggtttttccccgggggggttttcccgtttttttttgggcctaggggcccccccccgacctgtttttggggccactttcggcttccccccctttttcggggccgtttttttttttccccggttttggttgacgtcccgggggggggccaggcccgggggcgggttttttcccccccttttggggggggggggttgggcatcccttttttttcccccttgggcctccgggctcctggggttttagcctttggggctcgggtggttttccccccccgcttccctggggttcccgcttgtggggggctttttggggggttttccccccccctttttttgtgggccccttttttttttttttttcttttttttttaaaaaaaaaaaaaaaaaaaaaaaaaaaaaaaaaaaaaaaaaaaaaaaaaaaaaaaaaaaaaaaaaaaagaaaaaaaaaaaaaaa

SEQ ID NO: 15259 - DNA, 677 bp, Homo sapiens
gatagaggccatcaagctacagatggtcttacaaatgaaaccccaaatgagctcaactaacaacttctaccgaggacccctggactgacctgctggccctttcactggcctaaagagttcccctctggagaacactacaactgcaaggccccttctttgccctatccagcaggaagtagctagaatggtcatcacccaaattcccaacagccattggggtgtcctgtttagaggggggattgagaggtgaagccagctggacttcctgggttgagtggggacttggagaacttttctgtctagctaaaggattgtaaacacaccaatcagcactctgtaaaaatgcaccaatcagcactctgtgtctagctaaaggtttgtaaatgcaccaatcagcactctgtaaaaatgcaccaatcgtcctctgtgtctagttaaaggtttggaaatgcaccaatcagcactctgtaaaacagaccaatcaacactgtaaaatggaccaatcggcgctctgtaaaatggaccaatcagcaggacgtgggtggggacaaataagggaataaaagctggccatcccagcaagcaacggcaacctgcttgggtccccttccatgctgcaaaagctttgttcttttgctcttcaaaaaaaatcttgctgctgctcaaaaaaaaaaaaa

SEQ ID NO: 15260 - DNA, 277 bp, Homo sapiens
agtgattacatgaatctgaggtacagatggacttcaaacttacgcagaataagctatgaaaattgtgttcatggaatattagaaggatcctttaacacagcagtccccacactttttggcaccaggaactggtttcatggaagaccatttttccactgacctgggggtgggggcgatggtttagggatgattcaagtgtattacatttattgtgtactttatttctattacgttgtgatatataataaaataattatacaactcaaaaaaaaaaaaa

SEQ ID NO: 15261 - DNA, 779 bp, Homo sapiens
  misc_feature (1)...(779): n = A,T,C or G
ttggtgaaacaacgcactgcttatttcttcaagtcaaaatgccttaaaggagcagtatcttgaatgtgacgtggcaaactcaaggggatgctcttcaacataaagcatcagaagcctgagtaacattttctgatcttgactctacgtgacaagtcgaaaagaatttttttcaatttagtttttaccaagtcagattctatttgacaatatggcagcactacacatggaaagtaacttattactttgggcatctagtttaaatagagacaatccataatgtgcatgtgaaaaaaaatggccactgttcttgaagcattgcccttgagcaagcaacaagtttaaatctgtcagtgtggaagaaattgttttttcttaattgcttaattgttaaccctaggagaaaatgacaataaaattctacttcaaaatgtttatgtttttggaattacaggtacatgtagaaaccataagtggaacactgtattaactgaatatcattgagaaacttcaagcaaacatgttactgatataaattaaagaataattgaaaaggaaaagacctccttccttttttccccaaaaggtaaatgtgttttcttataactttaactacttgctngaaaattaaatgcttttaatttctgatacaagggagcagaatacgatgttaatattttcctgatggcttttgatataaaaatgcattgaaaatatctgcaacattaaaatcttttctgtggccttttgtgaatgctataatgtcagctttattgtgcact

SEQ ID NO: 15262 - DNA, 554 bp, Homo sapiens
ccttgctcctgctctcgccatgtgatgtgcctgctccctcttcaccttttgccacgaataaaagctccctgaggcttccccagaagccaagcagatgccagcaccatgcctgtatagcctacggaactacagagtcccgctgcgccacccaggctggagtgtagtggcgcaatctcggctcactgcaagctctgcctccggggttcaagcgattctcctgtcccagattcccaagtggctgggactagaggcgcctgccaccacgcccagctaatctttttatatttttagtagagacagggtttcactatgttggccaggctggtcttgaactcctgacctcatgatccacccgcctcagcctcccaaagtgctgggatacagacgtaagcccccgcgcccagccctaatatctttatataaattttgaatgtctaaaactagtagtgtatttagtgtttttcttgtatcatttaacaataaattaaaatgcaatcaaaatttaaaaaaaaaaaaaaaaaaaaaaaaaaaaacaacaaaaaaaaaaaaaaaaa

SEQ ID NO: 15263 - DNA, 1006 bp, Homo sapiens
  misc_feature (1)...(1006): n = A,T,C or G
acaaacccccggccccaccagcacctttttaacaaaaaaaaataagctttttggagctataccggcctcctggtttcctagcctacagtctcactcacctcgactggatctcactctggtgatggcgatcctaccaacacacaaaggagacacaccagcctctactgcaattgctcaaccagccctaatgtgcttaatgaaagaagactcaggcgggcccaactgctggatatactgattcggatatgggttagtacttggcatctgagaaagggattaaagtactacagaaattggctactaagttacaccacatcagcagacaaaccccaaactcccgcaattccaccccctaacagacagactgccgactttccctccccgtcttcgcccccgtttctcccgttcccgccccttagcaccttataccgtccacaaagaccccgccgccttaatcgtactgtaatcccccccgcgtctcctctccaccccatactcgttcccgtacccaaaccctacacgagtccccccctttccccccttttcgccctcacctgaaataatacctcccgatacctccgttccgcgatttttccccccccccgcccaatccgtaccaacgtccacctccccgcctacaccccctttccccatcccttcccatcccccatcccctatcacccgtcccacagataacgatccgcccgacatactggcaggcaaccgccgcctgccgccttcagcgccctttcttaactcatccccctttgagctcgcgcccccccatattggaagcgtcgctgcactacgtccatcacnacaatatcactctcatactatgttacccccactatttttccccggcagttaccaatttttccacgcaacaccacgatgtgcgttcgtgcacccgcgtgctctcgttagacgtctcccatcagccgtccaccgcgatatgtacaccacctcttgaagcttcaccccaatataaacacacattgtcacg

SEQ ID NO: 15264 - DNA, 349 bp, Homo sapiens
cctagttctgctgctctgtggccttgaggagcttcttcctgtcctctcatctcttcaccttgttctggggtaaatcatctctggaccgccttacctgctgagcagctcactggagaccacaccgtggaggcacaccacacagaacagccaaactccccaggccacaaccaggctacacctcctgaaagacaactggagaaccaaagagcatcagtctttgtggcctccctgtaccatctcctcctaccatcagagcataccagagcctccaaactcttcttgggtagtgtcagaacctgcaacggtcatgttaattcagtaaaaatgtctgtgtctaaaaaaaaaaaaa

SEQ ID NO: 15265 - DNA, 561 bp, Homo sapiens
  misc_feature (1)...(561): n = A,T,C or G
gctaggcngaatctagaaaaaacaatatgttgacacacgtggagaagttttaaggagcagggagtttaataggcaagaaagaagggggaagacaaaaagaagaacctgcccaggaacagagagggaggaggactccaaagctgagagacagaagcccacctgctacggataccagccagatggagtttccctcttgttgcccagactggaatgcagtggctcgatctgggctcactgcaacctcagcctcctgcactcaagcggttcacctgccttagcctcctgagtagctgggaggcatgtgctaccatgcccggttaattttgtattattagtagagacggggtgtctccatgttggtcaggctggtctcgaactcccgacctcaggtgatccacctgcctcggtctcccaaaattctgggattataggcgtgagccactgtgcctggccacacattcttttttaattattttttttcttttctaatactctcataaagcaaaatggtaacgagaatgaaacaaaattaaaattttgatttatataaaaaaaaaaaaa

SEQ ID NO: 15266 - DNA, 561 bp, Homo sapiens
gttgcctgaatgagtgatgacgaataccacagagaaagtatacatgaagtcctttttgtgtaacttttcatggcttgaagttgatgtggaagacatcactttggtatgcagcagaaacaaacttcaaaagtccatagtatcaggctctagacaattttcactaacaatttactctgcatcttcctaaaaaaattgaattatagatggttaataacaatgaaaatctatactacttactactcagtctaccaactatacaatgccacagtacaatcggagtcatcatagaaaagaacctggggacaaaatatcttttccatctctttaaagactgaaacatatgattgacccatggccaatgtcatgtttaagaaacttagaaaaattcaacattagacttatagtgctgtcatcattgtttcgcctgctgctaaaacccatatttttctaaacctcctatagttttggacttgcaggactatctacaatagagatttactttctaacatgttcagaaactgtaataaacctttgctattgtcacctgcaaaaaaaaaaaaa

SEQ ID NO: 15267 - DNA, 755 bp, Homo sapiens
cccacagggctgagctataccaagcctcagattcctatctgtggtctttgtggtttggactgctggggctcagaaagcaataccccaaggatcagtgctttgacatgctgagaagctgcctgagaatcaaggtcatcctttgaaccgtgccttgttacctccaccctcaagcacagggagagactttctctggaatttccttacctgaccaagaaggcttctttccaaaagaaactcggaaatctcattatctatcccacaaaagaagactgaggacagcaatcacacctggacagacttgtgcacaagataatgccttcctcattcaggctccaaagagaatcatttgcaagttaatttctgtccattctttctcccaaataatcatttgctgccccgtcaaaagaactgtctacatcccctatctccctctcccctgtgaaatagggtacataaccttctgtgtcgcattaggctactgggtcatctttctcctgctatttattccccggtgctatgcacgtcaaaattttaatgtcttttctcctgttgacagctgattttcagggaaacttcaaagggtgaaagggaagctttctcatggcccctacaggaccaacctatctctaagccccgttccactgccacgatcctcaacttacaagaactaagaggcaagataatgtctgtacgactcagaaaaaaaattcatgaaacagtgtatgtcaccagagcctcgaacttcgcaagaaaag

SEQ ID NO: 15268 - DNA, 948 bp, Homo sapiens
  misc_feature (1)...(948): n = A,T,C or G
ctgttcattctcgagnaacactttcctatgggngaatgggggggttccttgagtggtggaggggatattnnngttctcttctactgtatggggctgtggggagcctttgtgtgtttgttaggtgngtcgaaattggtcggttgggtctccttgggtctgtgtttggggccttggcgcgttgtcggagctgtggcggggtgggaaatgggggcatgaggcgtgactgtggttgctctagacgttagnnactgtggacggggctactcgcgcgttgagtctcgtaggctttcgggtgcctctcgctaggcttgctagtggtgctgtttancagttttctccgtnnctctttgggtgtcgtagttaatgcgttggttgtggtgatttggagnnaaagctcttgggatgtggagtggggtgcggcggtggcggggggttgaggctgtcgggtgggaggtttgggcgctggggagtggaggccgctgttgtttagggtgtnnnaggtatagtggatgtggggtaggtagtatgttgaagggnaataatttggttcttncttattagatttatttgcttttgtttctcgggttacatgtgttgttgcttttgccttttcttgtgtttcatnnattaatatttattttatttttttttttatctcccaccccccgatcagnncacccaatcattctttccatacctcctccttngcctttcctttattattcttcgtttctntcgcctaaccccttttcttctccctnactttagcaatanntcttttttttcttttcctttttcttnatctcttattaattacctatattaatttccnncccactcccttggccttttcttaatcttctgtctcccctcttcctccctaaattcactnctttatattcaantataaattnnatacttattaactttcctaaanatctttaacct

SEQ ID NO: 15269 - DNA, 683 bp, Homo sapiens
  misc_feature (1)...(683): n = A,T,C or G
acgttaatatacgnnnactattaatttaagagcttgatttgcttctttagtgttgtgatggaaattggacctctattctctccctatggcctctcgggatcttactcttcggtgcgtttgctcgagcacacctaggtgggggtctgncccacgaacaggggagcgccgttgcgggtgggatctattggatggtacaagagtgcaaggcgtgcggataagaaaggtcttattngcttagatggaatctgacagggaacaccagaatccccaaagcacaaggagctgccaagtcttttggccgggatcgancacataggagcgcccccgcaaaaaacaaaactaaaatngaatacccggtaaagaaacgggccccccccccaaagttgggggcaatggtttatgcctgttaccccagcactttgggagggcaagggggggaggtctctttggggcaagagtcccggaccagtttggcccaaatggttaaaccccctcttttctaataatacaaaaattagcccggcatgggggggggggcccggaaaattttttggttttccaaggcacaccaatgttatatttatattaaactggagtttattaaatgggcaaaacccctgcctttaaaaaatgtagaacctttatttttaaaaaattttattgccaaaaactgctttccttcc

SEQ ID NO: 15270 - DNA, 847 bp, Homo sapiens
  misc_feature (1)...(847): n = A,T,C or G
cctgcgcttcgccgcgcggcgtgggcgcggtttcgccgcaccgcgcgggcgtgcgggggcgccggcggtccgtctccgcgtccggggcgcgtgcttctcgccccccggggtgggggggggggccggccgcccgggcgcgccggctcgcgtcccgcggggggcggtcgcgcgggcccgcgggccgcccggggcggcgggcgcgggtgggcgcggggggggtcgcaagcgctgcccccccgccgacgcccgcgcccctcgccgcgcgccgagcccgccttttctcgccccgcgctcctcccccgcccccctgtgcgccccgcccccccctccggcgcgccgcgcgggcgccgcccgcggccccgcgggcgggggcgggcgggcggggggcggggggggggggttggcgggggtccgtgctccccgcgcgggccggggtgccccggcggggcggggcggggggcgcccgcgcggcccgaccgcccgggcgggccggtatggggctgtagagctctccccaccccccccccctctgcgcgtcctcttggcggtccccggggggggcggcccgggggtgcgcgggctccggcgggcccgcgccgccgctagcgagttcccgcccgacccgggccggagggttggtgtccgtgcacggggagggggcgagcaaggcggcggggccgggggcgagaagggagagggaaggagaaaaaacaaaaaaaagaaagagacgcgacaaaagaagggaggaagaatcggcgctcgttggcacacagcggtggagtgttgcggccacgggggcgcggcgggcgcatttttntcccccccctccccccccnctcccttccct

SEQ ID NO: 15271 - DNA, 406 bp, Homo sapiens
ctagggctggactgcgatggcgcattctcggctcacagcaacctccacctcccgggttcaagtgattctcctgcctcagcctcccgagttagctgggattacaggcgtgtgccaccacgcccagctaattttgtatttttagtagagatggggtttttccatgttggtcaggctggtcttgaactcccgacctcaggtgatccgcccaccttggcctctcaaagtgctgggattaccagtgtgagctacctaccgtgcccagctggattgtcttcctttctaaggctgaataatattccattgtatgcatagaccacattttgtttctccagtcatcctttggtagacgcttggattgctttcacctcttgggtgccatgaataaatgctgctgtgaacatgaaaa

SEQ ID NO: 15272 - DNA, 294 bp, Homo sapiens
caggtctcagtgtgctccgaaatgtcccttcacagattctacaaaaagagtgattccaacctgctgaatcaaaagaaaagtttaactctgtaggctgaatggtcacatcatgaagcagtttcacagataccttcattatagtttttatcacgggatactcattatttcattgtaggcctcagtgggctccaaaatgtcttttcacagattctataaaaggagtgttttcaacatggtaaaccaaaagagagattttactctatgagccgaatgaaatatcataaaaaactaaaa

SEQ ID NO: 15273 - DNA, 797 bp, Homo sapiens
tggaaaggcagaatatacgatgatgtggatctagactccatggattctaattcagttgctggatgtctgctggctggagatcacccgttaccctgtcaagggggcctctctgccacaataagttgcttcatcacccttcgacaagagagaaaggctactagcaagacagatgttacaattacagaaacgaagttttgccacattggccaggctggtctcaaactcctggcctcaagcaatccacccacctcagcctcccaaattgctgggattacaagcgtgagtcactgtacttggctctttctaaaagcttttaagtgtcgtctttgggagtaatcattttaaattgctttaaccaattttctttctgactcctttattggaacttcatagaccctaatcatccctccagatatattgacactagttataccatctaattctttgttctgtatttgatattatttaggaacaagtacatcagcttttccttttatcataggtctaaggtggcttccataagctaaaaaattatattagaaaaatgcatcttattttatccagggagtggttctaatttttataatgtcttctattctgaatataggactaacacatttttaaaaccaagccaatatcgctccatttctgtcaataatattgattcctagtaatataatgtttaaccataccatcttcattttctttgggacattgggttatttgtgttccatatataaagatatttttctcaacttaaagaaaaaaaatcggcctttatggccttagccgggaag

SEQ ID NO: 15274 - DNA, 785 bp, Homo sapiens
caggaatccccagctgcagaacagatgaaggcgacacctggcttcttcctgggaatggttgctggcaatgggacactctcactttcagctgcctctgagtttgaatggtgactcataccccctgtctgagcccagcttcactttcaccctcctccacctgccaagccctgcctgtccgagacaccacggagttctcatttccttcctctttccaccagtctgaagaagaaaatggccaagaatgaagtcctcaggacattaagatgacgtagaaaacacaaaaaggagaaagactttgctgttatttaccccacatcattccattaaagtttcttggatctcttcttcatccatgtagcaataaccctgggggtgggaaccagcaatccaagtcctccaaatgatttggcggttcttcaaggattatctgactccataagggtggacatttatggttgtctttctattgactaggctattttataaccctataaagacggaagtctagttacagaaaaactgacaattatgcaaattattcttatccatagatatacaaatgaattttgtctagtagagatacatagagttttagaaaagataaccccactccaatttatagtatatgaatcagttttttgtccatcggcaaattcagcattactggttatatgtgtctctttaaatttactcttaactggatttaaccattttctggctccctcattaattaaggaggctaataataaaatctacaacacaaggtcattttaaaaaaaaaaaaa

SEQ ID NO: 15275 - DNA, 648 bp, Homo sapiens
aggatccactctgtcacccatggtagaatgcaatggcatgaccacagttcattgcagcctcgacctcccaggctcaagtgatcctcccacctctgcctcttaagtacttgggactacaggcacacatcaccactcccagctaatatttttatttttgtagagacagaggtctcactatgttgcccaagctggtctcaaactcatagacccaggtaatcttcctgatatgaacaggagacggggaaatactggaaagttatttactttgtttgatttatttacctgccaaaagccccaccctcaagcctggaaacccgaggccccaaatgggaacaggcattcctgttttcgtgcccaaatgttgcatcttggcccgccacaccccacatcctgtacccatataaaccccgaatccctgggtccatgaggagatgagcagaagagccaaagaactgaagaacggcatggcagagaaggagcatctgaatatctagaggagtccagctggggacagttggagaggagttctgccacaggactgctgaactccaagggaagatcatctttccactccgtgcccgttccagctccccatccatcctgctgagagccacctccaccactccataagacccccattttcaccac

SEQ ID NO: 15276 - DNA, 467 bp, Homo sapiens
tttggaatgatcttaatccatggttgtgactgtctgagcaagtggaagaagccatggtataacacagattaaattatctcagtgatgatggtaatcatttccaaaagaaggtagtggtcctcttccctgaactgtaagaactgtgatttcatgcactccaagttgagaacccctgcaggatcctgagttgactaaatcctaatcagtacggcagtcaaagattccgtagtgcctggccattgtatggaaagatcggtcttctcagggttattaaaatctcccataatatattcactgtgtacttacatgaatacaatgatgtcaactaaaatacaatttatttcaaatttttaattttgtgttgtctattaagtatgcttacatttttatgtcaacatggtttcactttttatgttagaaaatgctaagcaataaatgctacagctgaatgttgaaaaaaaaaaaaa

SEQ ID NO: 15277 - DNA, 1096 bp, Homo sapiens
agatatagtattgagagtcagtctaccgtctcataatgctatagcattatcaaacccactatttacaaaaggaactagcagaactgcaattttgtctactctgaatccactacggctccgagtatggtaaccatgactcatcaagtcctttctctgcatgtcagactaatccaaagcaagagaagtcacactaccaattacacacgaagctggacgccgtgtcgccttcatgtcatgataagcgaccacacccacacaccttgtatccacgcctaatcagcgtttcatacaggtcctgtcgcgagcggtctgcatgtagtaactccataataagcacgcgcaccactattactacgccccgccaatcaagattcaatactggagccaataaggccagtttgtcttcttgtttattctcagacagtaacacgatctctcgaaggcactcttcgtatgcgtgaatagtgcgtctttccatatcggattatcgtcacacctcctcgacacatcaaccatagaacaccctcctataaactttagtcccatcatacgcacactcgcctcccgccttcaaagaactgatcaatgagaacgtttaaagactttgaatagtaaggaaataatgtattataaatcgactgacaaagtgacgccaatcatttacccttctcgagcgcccacgggaccgagctagttaataacgtccccttactactttcgacaactagccccccatacttacattctacttcatatgatttctagtgtactcgctagtgtagacacaggccctcgatgcttcgaccactcttttctatcatgccctccagcacgaagaagatacagacaaccaagtaggattacgccccaaggtataccaatcatatacccgatccgcacggcatccatccacgtcatagtggtacgcactttcgttttccgtaaagatcgaccaatataatacagacgatgtactacataatcattatattaccgtggtgatcagtaacgaccggtagcgtagtacgttcaatatgacgcttccaccatgctcgaccgctcgatatacaaacgtccttcatctgtaatatatcag

SEQ ID NO: 15278 - DNA, 789 bp, Homo sapiens
agggatgcctggaggctggaagactattttactgtggcccaaaatgaagaatttgacaaggactaccagaagaagatggcaggaagcaccctaaccttccgcacagagatctgagagcagtcagggagtctgtcctggactttcttaccagatttttgccatttgagcctcatgatcaaggacacttaaaacaaagacacccttcctccagtctggagctgttacacactacctgtagatgataatacttcatcaaaatgtaaccaaatcctgggtagagtttttaattaagatacatgatccctcatttagacaccaaccacataacgtactcccctgtcctaaggcaaaataaaggcaatttagttccatcactagtttacaatagtgaaataaataaagagataaataagagtagaatttcaatgtaagagaaagtgagcaagagaagaatgaggatgataagtgggcactaaggataatgtgtgggggaactggtttttatttttaaaggtcaggaatgagaggcagaggatagtcctactcttgaagatattagattaggaggtgcagggggtggcatgaaagatggaatgctgtgagctgggtctggctcaggtggcttcaagctgaaatggtcccaaaaccaaagagaaaggccacaggagagcgattaggaacacaagatgaccagaaactcatcctacttctatggccaacacagagctggaaagcagagaaagattttatctttcaaatggactcctgagagagaggaagtcttcagtg

SEQ ID NO: 15279 - DNA, 707 bp, Homo sapiens
atattctgaaaagttaaaagcaatgatagaaaaaaaatgactatatggaatagcaaatctttaacatggataaaatggattgtcttggtgaaaatatgtcaaatagataatctattctggaagaataaaaacaattccagagtttctccctttgaaaggtaggttgtttattactttggagttaatgtagtgaaatactacgaaatataaaaaaaaccccagtagctaacaaaaactgtagctaggctgcatacccagacacacacatttttaacctataaaaaatggattactggccaggagccatagctcacatctgtaattccaacactttgggaagctaaagcagaaggatcgcttgaggccaggagttttgagaccagcccaggcaacatggcaaggcctcatctctacaaaaaatttaaaaattaattagatatggtggtgcatgcctgtaatctcagctacttgggaggctgaggtagttggattgcttaagctcaagggtttgaggctgcagtgagctgggatcatgttactgcactccagcctgggcaccagagtgagaccatgtctctaaaaaaagaaagtattatgggaagttaggaaatggttatggaaatatatatcgaataaaggtacttagtgcaatgaatcaaacaacatttgcaagcaaatgttatagatccctccaataaactgcacat

SEQ ID NO: 15280 - DNA, 373 bp, Homo sapiens
ataggagatggcttctccagctctgctgtcataccagagcctgacatataggaagtgctcagcaaacatttgccctatgaagagatgaatgaacagggcaacttggcagtacttgtaaaggtgacgatgagcacgcacacgcagatccagcaaagccccagagaaatgctaacacacgtgtccattgggagacatatataagggtgttcacagcagcactcttccttttcttcaattatgcaaagctacccacaggttcataatcaggagaccggatgaataagtcataatgtatttatacaatggaataccattacagcagtgaaaatgaataaactccagctacatgtgttaacttggaaaaaaaaaaaaa

SEQ ID NO: 15281 - DNA, 417 bp, Homo sapiens
gtagtagactggaagacctctggttatagaagactaagaatggaatgcagaagatatataaaatgtgattggattttctcttgccccaaattcaaattcgtgcacttccaaatagtcattctccttcacataacaactggcttcattttttaagtttgaagtcttcaaagaggaaacaatgtacaaaatatgtgatagctggcaacatggactaggatcaaattttagtctgtggattttattttccctcattctctatgtactctttatgccccttgttttcatgtcccaatgtaaagccctaagatgtgcatcattcactatatccattctgttttatcacagttctgtcattttcctaggcttaacattctcatcagcattatttgaggactgtgacaaacaaaaaaaaaaaaa

SEQ ID NO: 15282 - DNA, 1634 bp, Homo sapiens
  misc_feature (1)...(1634): n = A,T,C or G
aagaaggcgggaaggacagaccaagggacacggagaaagccgagaacaacccntcgacaaaagaaacaccgcggagatgagacacaagacacaagacgaacgcaagcagagacaggcgcgaacacgagcagaagacagggggagacaaacaggagagcgcgaagagaggcgacagcgatggacaacagacaagagaanaacacagagagacacncaccactcacgacagagcnacgagacagcacgcaagcnccataaccgacaagcgagaccaagccacacggacgcaacgcgcacagcgagngcgacgngcggacagacaacacggacgccaccaggtaagccagcgaaccaaccgaaaacaaacaggcagacgnagaggagcgcagatctgaagacgccaggagaagagaggcgagagcacacagacgcacagaatacgacgcgcgagcgagaacacagaagcggagagacaacgaaacagacgccacaagcagcggggagcaaacacacagcagacgaacgacacgagcngcgacgaaacagcacangggagagaacgacaaacaacactgcttgtgtgttntcataatacaacagcncncgngcgcacgcgagacagaagggacgaagaagaggacgacgaagagacaacaaagagacgagagagcgcgcccccgaccccacacaccacancgcagaangagacaaagcgancagcgaccagcgcgcgaaangcacnacgcaaagagagaaaagaagnaaagagagcgcagcgcgcagcgcgancggcgacgaccangaacaagccgagcgaacancggacgcgaccgcacgcnacagagcgcacgagagagacaggncacgaacgaagcacacacanccacgacgcgacagcncgcgcgagaacacaacacagacacagacagcgcgcgacgacgacagaacacagacagcgacgacacggacaccgccgnngcnacaccgcgccncgcacgacgcgcgagagacgagacacgcgacaacgagcgaggagcaggcaanagcgcgacagnggancgcgcacacgagagcgacgacgcagcaccgacgcagcgcgccagncnagcgaagaacacaaanacgacagacacgcagagcacgancacagaaagaaanagaaaanacgacaancnancnacaagcaagagcngaacagcgcgccaagcngcggagcggnggcgcggangcaganacacgacnagagacgaacgccgacggncacgagaagacaanagcacaccgacgaaacgcacgacagcggcagcggcaccacganacgagagnancgagacacacngacnancagacacancgcgcgagcgnacacancacgcggacagaagacgacgcgccaccgagcacacagccagagacaacggacacaacacacgagacaagaccangcgacacacacacngcaacgacagaaaaacaacacacagcaccccgaaaangcgcacacgcnacagcaaaaaccagaacgcgcgagagcgcgcgcggncnagngcgcgacnanaccgcgcagcaagccaacagcacaacacgagcacgcgcaggagccaccagcacacagagagagagaagacacgaag

SEQ ID NO: 15283 - DNA, 358 bp, Homo sapiens
agtgatttggacatggtatagcctgtgttctcgaaattgaacaattattataacagcaatgcactgcagtgaaatcagagagtgaagataagcaaaacaaagagaacatggccagaatcccacctgtccctccacacccactataaacgggtttatgtgtatcttccaaatgtcttctagacgcataaagatatctgggcataaacacacaatggaatcccctggagaaggaatggtacaaatttgcctgtgacctgctttgatcaacagtgcgtgtatttttccatgtgaataaatgactttcccctgtataatttttcatgactgcaaaaaaaaaaaatcggcctcaatggcctca

SEQ ID NO: 15284 - DNA, 857 bp, Homo sapiens
agtcacagagttattgtccatgtgagcacgcagtgagaagctgctatctgcaagctgagaagagaaacatcactagaaaccatccctgctggcacttgatcttgactttcagctttcagaactttgagaaaataaatgtgtgtcgcttaagccagttcatctttagttattttagtatgtcatcctgagcacgattagacaatttctcacactgcacatataaggtaatattatccatctttatacgaattaacgagggggtcggggagtttttttttttttaaacaccccgcaacaaagagctgagatattaaattaggcacccccccacaattatatttttatatatatatattgctaaaaaatacattaatttctatcttcgtattatattattatctgtccttcttatcatgttttagaccattatatattatgtaaatataaatgtgtaatcttataataagtagttcaatatatcatcctctagatctagttaataaatttatactacattacagtagaatagcagtatctgctcatcttcactgcaaatacaaactctaaataattgcagtgaccattctcttccttcttccttcctcgtttcgtacgtgtaactaatatatgtaagttataataattcaaccatcataatgatgttaatgtgtcctgcttatcctcatattcctacatcatccgattacactagctctaaaattatgataaatataatccattactatcgcgacaaacagatctaactagcttgtagtgattatcatacatacatcataatattactttctactttgctctatgtagtaatcatatactcatcctataatcgtttcttg

SEQ ID NO: 15285 - DNA, 374 bp, Homo sapiens
aggccccactgccgtaagtcagaagccccacatgcatgactctgtttcagggctagtccactgtttcttcttgcaccacacgacaccagcttgatcaccagttttatggtgttcgggccaccatcttaaatgagaagttccaaaccactcattttacaggtgaaaatattgaggcccataaagaaactgatttgccctgctcacaaagaactcttcgctgaggaaaagagctggacccagaactcaagtcttctgaatcacggccattctgttctctcaaaccatgtctcctttatcacagaaattttgttgtgaacattgttatgtttttatttatttatattaatagaaaataaaccatgttaagaacaaaa

SEQ ID NO: 15286 - DNA, 720 bp, Homo sapiens
  misc_feature (1)...(720): n = A,T,C or G
atctactctttcccactctgtgcatttcctctacctagaacagtctccccattacatctccaaagtctaaatcccatccttttcaggccctgtctggatgacaagaagccattctctgtggctcagtggaattatccaggatcttaactttcataactttcactcagcacctgtgggaatttcctcagcccatcttgatcaaagttactaacacatgccttttattttcaagactggatgctctctgagggcaatgtctacaactgctccatctttgtaagcccacctgcaccatttgcacttatgcccatggcaggtgctcatgctttttgctacagtatgcaagaaggatgctaaagtgtgctaaagctcaagtgactgatcatttaaaccaaatggacaagtacctgcactcagacaagttttgctgaagaaagacttcagttaaaaagatatgcaatgagacttgtttccttgtgaagcaaactgagagaggagaattgtaatgctactcccagggcatttaccgactagtgatctgccaacagctactaacggtggtgcattaaaagcttccttcccattgaggtaactgataatatacttccaaattagataaatcataagatagctgatcctgtctttcccctgctgcaaacttaaaatactgtttgcctctggggccttggatcaagagctntcaagatctgcgtatacagt

SEQ ID NO: 15287 - DNA, 848 bp, Homo sapiens
ttattttgtaaattttttaaatttttttttgtatttttatatcagtacgtgtagaccacgtggctttcagcgcctgaatcagccagagagaaggctggatatcagctgtgttctacttcttgactctccatcgggtacctgtgaggaagctgtggtctgcgagggatcctaagaaagaaacatctttccagtttatgagggattcatcacaaacacgttgataccaaatcagtgttcagctgccattgtgcctggctgatgcttgcgattcccaatcagtagactaatgagattccgggtacacagaatccggtggagttatggggacgcgcattctcttcagaacgcctgagaggaagtcacgtctgaagtccggccggatgggaattgtacaaacacacttccgggttattacaggcgtaataatggtagattaaaactgttcacaggatatttgagtacctagtagatactggatactagtcctttgatggaaggtatattattgtgaagattttatcttattctttttacgtttatagaatttttgatttactaatattgatttacttgaatctaggcctgttatgttagtatcccaagttcgttctgtagtggttggggtgtactatctaataagatattattcgaggtttcttgaaatcatttatgtgttacactaggtgttatcttcatagcgttgtaacgcatccgtgatatgttaagtttattattatatttccatcttttgctttagtacaattgcattgttcttgtaatggtcatgagccagcattcataaatgattatctccttgtatgtccattacgatctagatttaacttttt

SEQ ID NO: 15288 - DNA, 775 bp, Homo sapiens
gtagatggggtctactctgtcctccaggctggagtgcagtggcacaatctctgctcactgcaacctctgtctcccaggttcaagcaattctctgcctcagcctcctgagtagctgggattacaggcacccaccaccaagcctggctaatttttgtatttttaatagagatggggtttcaccatcttggtcaggctggtcttgaactcttgagctcgtgatccacccgcctcagcctcccaaagtgctgggattacaggcgtgagccaccgcacccggccacatttctcttctatctatgttgttttgttgttgttgccttgtccgtttccttaccatttgtgaggtcaacacattcactgaaaaatatgggatttcacttccaaaaccttctaagattaaaaaaaatggtgcatagaagatcacaaagacaagaaaataaacagaagcactggctacagaacagagaacaactgaaaggggactcagggagaccagtgagaagatggccattgggcttagtatgaaatgataatggtggtcgcttccatgtgctttgtgttgttgcttggaatgaagagaaaatattctaagattaactagaagaaaaaaaaagacctttttgtgggaaccatcacaacttaagctgctttttgccgatggaaggaacacttctcccctttgctaacatttttaccctttctccagaagagcaaaagggatctgattgtcctggttcacgaccgtgattggggcaccctttgctactttggtgtt

SEQ ID NO: 15289 - DNA, 815 bp, Homo sapiens
  misc_feature (1)...(815): n = A,T,C or G
ttttttcttatttgtttttgtgngtttttaataanntttgaaacttcaggtgccaggtatctatttttgtcatcaccagccaggaaggaacaaggcctcttccaagatgaagacttatactattgacagatattctgtcaagaccaaattttccctaagggccctgtcatagattgttccctgggcaggatgcagcctccttcagagagtgaagaacacaccaaatgatcctctactaaattaatcataagccacatgaggcaggctggaatacagttaccaatctgctttaattctcccacttagatggcctgattccgcctgaactgaaagttggatgaagctcggctttgagtttcatccgcggggcatcttgtggcctaagtccttagccaatgcctgccaaatattagcttgagtttcaataaagagaaaaggtccaaattctccccttgactaatgatttattcatcaaaccaacatgccttcaacctgtaattcttagtgtgtaatctgaacagatcgtcatcttattttaaaagagaaactgcctgttggaaggagaatattatctttcattgaacacaccagcactgtgcgcgctcttctctgtgtaagcaacgacggtcctaataaaatcatgtggaagcgacagaggctctttttacaacaaatcccttgaccctgatgaaattggctgtctccataaccttatctagggaaggatgaatcctcttcacttcagtcctttcttcttcacaaccacctttgtctatccctttcaatgattttctatcctatactataagacatgt

SEQ ID NO: 15290 - DNA, 1027 bp, Homo sapiens
  misc_feature (1)...(1027): n = A,T,C or G
gatacgtacagaatagggctataacaaatataagacaacaaaaanagacaacctgacaaagcactnaggcagcagacttgnaccggcaacaaccncagcagggncagggaaagggccagcaaccagttgcccaggcaccaaaaaaccgcccngaacaggacagaccacaacaacgagccgcgcgcagcacgccacgagcaggacacaggcagagcgaagaaacacaggaacagaacgagacaccggcgccaaagcaaacgcacgcccgacaaaaacaaacgaggaggacccccagcacgcgacaaccaagagaatcgggaccaagaccaaggcnagaggacccaacaaacacaagacacagtgttttttctttcacgttcccctggaaaggaccaatgaacccactgacgtgcaaggagaggccccaaggaacttaaagctcgagaaacacagaccatacccttaagagaaaggggcagaatcgccgagccgtggaaacttgggtagtacgaacaagggaggaatacctgatacaaacaatgcaatccgaatattgactagtctacatgggacgtaccagaaaaacatgcaaggatctatagtaaaaagtaggcatgcagaacgaagccacatagagaggtaaaagtgtcagtaagcaagtcgatgtatagaagagacaaaacggagggatgtgaagagggaaagaaagaaaaaatatagatggggaacaacaaagcgacacgcgtggggtgggtgatagaaaattgaagagagattaaataaagtaaaagaaagatacataatagacccaaagaaaaaactgacatataagctcgagtaaagcacgatgaggcacaatgcgcatagaaaggcgaaacctaagacgcggtaagaaggcaggaagaggaatcaaagagagagaagaaagccaaggagaagaaagagattgaaaaagcgagacgagtgaaaaacgaacagagaacaggcatgcagatgcatgaacagtgaaagagaagacaagaacaag

SEQ ID NO: 15291 - DNA, 824 bp, Homo sapiens
tttatttattaattaataaagaagattttaaaaacattaaaattactactgcactcttaaagtatatgtgaatgtaatggtgtgtcacaactgctattagagaagtccttgggaaaagagtacaacatcgctgatcaaccttaggcagtccccacatacagcatgattatattgtaatactgtttgatacaatcgtatgtttgatcagtttcaagagatgaatatcacctcacttcaaacaatatgatacagtctcattgtatggaattatggctgctgtcaatcagcatatggcataacccttaaagtgccatctttggggaatgtcataaaaatgattgcaacacttgcattaattattaagtttttgcactaaatccaagcaaaacctgtaaaagacaatgtatcttctatatctctgttcatattgtgttatcataaaattcattaaatttaacccatacatgccttacacttagctgattagcttgatcttgttagaatcagtcattgctaataagaatatcgaagtgagctcctttgtattgataaacttaaaaaaaatatcggccttctatgttctaaatgttgaaattttgcatccttttttcttttaatgatggtaatattttatacttatttattttgacttttgataataattttatctattattggtatcgaattattacacttaaaagagttataattatatccctctattcacatttattcctgtaaaaatttttcatcattacgctgtcttaagcttagtattataaatagcatttgatttataattcttaaataatatttaccaaaaa

SEQ ID NO: 15292 - DNA, 904 bp, Homo sapiens
  misc_feature (1)...(904): n = A,T,C or G
tttttttggatatttttcactgctcacctgtattcaggaatantagaaattttatcatttcattaaagttccaattttatcagctggattcttatcgcaattcaggcatgtagccgagcgataacggacatagttggcattgaagagaggcagaagatggatcaagttatgcagagaacatgcgaaattctgcttatcaccaggttagcaaaggagccccggctcacataatcagcaaacagaatggagaggaaaaaataacgatgcattggcaccttccaccccatcatgaggatttttcctacccgcttagagatagaaaataacataacagttatagccttagctcctgcacccggccaggagcggaatgtacacgagatagattgctcttgggataagtaaagctagacagacacgagactcggcgctacagctgcggaacgctgcatgaacgccccggtttcagtgtaggaggcagaagccactacgcaataattatcccatatccaaataatagcagaaagcaactatgcgacatccagaaacccaattagaaaaacaagccgaaactagtgacaccagcagcacactccatacaacccacagaccatacataacaaatatttatataaggncttaaacccaaccgccgcgtttccggctcccccaccataagagattatatagtaataaagaatgtactacagatacaggataaacggcccttccccctagcctactacctcgcgaccggtagagttggaacattcgtagcatagaacttcagtgaagcacagaaggaaagcacgccacaagagacggcaaagaaagaaaggataccaggaaagccgcaacgcgccgctaccacaggaagccgaggacggccaagaggcgaaataag

SEQ ID NO: 15293 - DNA, 741 bp, Homo sapiens
cacgaggtcacctgtcaggaaaggaaaaggtgccttttataatggtcaaaaactacaggtttcacaagaagatattaccaaatcactcttggtgaccgagctgggctattgcagaacatcagaaattgtaagaactattctttccaatatggaaaagctttcttgcattcctattcacgaatacctgaaactgagtaacgtataaagaaaaggaatttatttctttcagttatggaggctgagaagtccaaggtcgaggggctgcattagattggttcaacttacctcaatcaacattcaaactgaagttaggaggaataccttacttgaaaggtggaccattccatttaatgtcacggagaataattgctgcaaattgtacagcattagcagaaaggatagccaaagaaattcaggtagcaccttttcaatgagatgatgaagattaattacagcagccttatagtcaatcacagttgcttttccccagacttgctgactcactgtggataccggtttcagatgtattatatgcttaagttaaattgtctttggccagattaagattttggacttgtgtcatattttactatggctagggtcgcaagaatagacatgaagtttacttcattggttaaaaaaattgcatgtaatagccttatggaaaaatccccaaaagggtaggtgtagaaataagtataacatcgcggaaaaagtaagcattttgaatttctgatgata

SEQ ID NO: 15294 - DNA, 782 bp, Homo sapiens
  misc_feature (1)...(782): n = A,T,C or G
caggaatgcagatgtgaggctggaggcagtagagccatctcgcaatcatgcagcaacaagcaaggcagatctggcatgtggttgactgataacatcgagaagctgctatataaatcctggactgccaatctctgaacttcttgtaggaagccagtgacctcctgcattttggtagcacataaccatgcactttacccagtggggtggataggaaggtgcatgaatgtcccatgaaggctttttggttgcataatcagaaacctacttcttctactttaaataaggaagaaaaatcaagaggagggcatgtgatggaaagaatcctgggggctctcacagaatccaaggacaaagtgtgcatctgaaaatcactggaaacttgagggactccagagacttcaggaaccccctgagcatcttccacctctcagaaaccacagggcttcttgcatatctgctccttcatcttgcacctgcccgccccacctgcagccccatctctctgcttcagctctcagctccagcgctcaccatggacagactcaacgtcccaagtcctcaagagggaaacccatttggttctctctcactgtcatgccagcctggccactggtgagtctactgagggaacccttangtcaagtgtccaattacagtgcactcttcaaaggcttggagctggggaagcagggccacttattcagctgtggaagtgcccagaagcaggaaacaattggcatcttttataacttgagatggggttgttctccagtcattttcaa

SEQ ID NO: 15295 - DNA, 287 bp, Homo sapiens
caggtttcatcctcacttgccctccagtataagtttcgtgaggacagagattttattttcacccttactttctggcatactctagatgctcaaatagtattgttggaagaaatgaattgaacttgaacaaaaggcccaattttccttctatgatcgaggctcttcctgatctggctttggctttgccttggaattctcccccataactcttctcatggttttcgccttagggattcaacatcaatgccttctagagaaaaaagaattttttttcctcgttggcctca

SEQ ID NO: 15296 - DNA, 788 bp, Homo sapiens
taggatcaccatgcaacgtagatatatgaagagttcgagggacgtggctcaattcatccacgaattttctttcgaaggtttttgcaaaaagtgctctcaactacttggactagtggttaaagattaaagaactgttatgactaagtctttcttacagagggatgttttaaaaggaaagaaaccgtcccttcccgttactctaaatgagcggcctcttgttctcggcagtctgtctgcacacaagaccactactgacttcagtgggaattctgcccaagaagtgaggaagacaggataggattaaattagcgctaaatccacaccattgttccaagccattaccacttgtacagttctccaataacctccaaagaatagatatctgaagtttgatggtggttcttaaattgaattaaaagaatgaccactcgagctctgacaggtgacactgcatagctcttcaaaagttgtgtcaaactcacagcctaacggatggagccagttggcccttatcacaattcaaggttgcattgcaatgcagcccccatcagtggctgcaacagccacccagtgatttctcacagcaatgagcctgcaaagggaaactgaataggattaagcactattcgttcccccactgaaacctgttcaagcttgagaattctaaatcctagcccctgcagcatagaaactgactcagtttccctcaactgctaagcccaggggaatctgacagacaccaactgaaatgctattctcaacagcggtataagagaccaaataattat

SEQ ID NO: 15297 - DNA, 779 bp, Homo sapiens
agaagctctggggtgactatattgcaaattggacaaagcaagagtgctaaaaatgcagagacagaccttcaaatgctcccaaattctagcgtccagcagccgtccacagtacttatatggagcaatggtgacatccagtggtcaattaagttacacctggatgaggtttgtgatttttttttttcccccaacctaaaaataattataccagaaaaaatattttttgaacaactcagttttgggttcctctgaacatcaagaaaagcctgaatgttgtgtcttcaaattcaggataacactggcctctgcctctcagcttgtagcattcatgtctgcagacagtcttcgctcaagcatagaaaaaagagctctctactgcctcatctataaaatggagcgggtaataaactacctgccaaattggagtcagcaatgagttgccacgggaagcacagtgtgtgaggatggccataaatgtgtacagcgagaaaatgagagagacggtgttccataagtcaaaccaggaacgaagaacagaaagctgaaagaatgagcccagctgaagactctcaaacagagaactgtattagggtaaggccccgggcttatttgctttttctcccctggcacttagcacaatgtcagcacataacaagggctcggatatttttgactctttaaattgatgaatgaatgaatgaatgaatgaatgaattgaggatttcctaaggcttataccccaaaggaattgccaacttaggatttggttggtttgtcca

SEQ ID NO: 15298 - DNA, 776 bp, Homo sapiens
  misc_feature (1)...(776): n = A,T,C or G
ttcagtgaaattaaattttaacaaatacaaggtgtttgtagcaataaatgaagtatgctgatgatatacctacaaagcataaacaccagtttaagaggtttgacacaccagtttaagaggcttgacatcagctttcagttcaacatccctggagactagtcactccagaaggtgaatttacaaaggagcttattggatgctggatattttcttctgtaactgactgaagttctagtggctgaaagtttgactaagcacctacaaagagacttaatccagaatcaattctagcagctttcaaatgcgtgtacttaaaaaaaagaaagaatttccaacagacatataaaatgccagaattaaagttccttcgccatttcagctgccaccaacccctctccccaaaaccccagtagacatcaacagaatccagaaactacagggtccactggcatggcagggcctgtaggattcttttccaatgtgtacagattggctgatgcctggactatgccagttcactgttttaaagattactcttgattgtcacaattaaaaacaaagaatatttagaaccaaattatatgtgttgcacattanacaaaacgttttataatatgttctaaaagtcagcaaaggttatttagctgtgtatgattcatttcacattccattttttaataattgaattctcccttatgccttctaattttttttgaatgaccacagatatcttctgtaggccaaatagcatattacacatctgtcaaacatacttg

SEQ ID NO: 15299 - DNA, 167 bp, Homo sapiens
  misc_feature (1)...(167): n = A,T,C or G
tcagctctccaacaaggtcatgtctccggntatcctaataactgataccctcataaaactcatggtgcctcagacaattggatctaagcctggagctgacttctcaactttgattcttagtccttagttcccttacaaaaatactaaagcttcttttcaataccaaa

SEQ ID NO: 15300 - DNA, 782 bp, Homo sapiens
cagtttatcactgaactgcattggaatgtacattgattctacaaaatgtattgcatagcttctgcatcatgtcagaactacaacctggagacccatctataaggagatcagcatgcatctaagtttcatgaatatgagcttaaaaatagtaagctaactcacaaagttaaggtcatttcttccttggccaaagaaacctggatataggtcagtctcaacagaatgaatttggagacagcacaactgcgagccacaaccgtttaacacattaagagcagatctcgatgctgaatgaatgtctccttcagaattgcaccgaagatacctaatttaatttgcctctaggcaaacatcacaatgactgacagtataactttaaggtttgttaaacatagtctgggtgtttatttgcatctctctggaagacactccagaaattatgttagttctttaaaatgtaacagttaggatatgcagcaggggaaaaatcatgtgtgggttcagttggaatttttgtgaggacattcaagtactgtttcaatctatccaatccaatacacctcttaagagatagcaaatacattcaaaagttgcatagcctctccacctttcccagatagtggcaaatcatacaaccaaaacaaccaaatacattttctaaatcaatccctaggtcactaagctcaccttagaataactgcaagtatagataaaatggctgaattttcccccatgttttaggtgagaaatgaagcaggtagcttaacatagccataaaattt

SEQ ID NO: 15301 - DNA, 803 bp, Homo sapiens
cctagatttgaaaatgcagtcatcctactaccatcatgaaggacaaatatccaagggtaacagaaggcagaatgaaaggcctgagtccttgatgacattgttgaatcaccaaagcaacaccaggagaccctgcctccaaccatcttaagtaagatctacacaatatcttatcacacttaaactatgagcattgaaggagaatgcctttccacatgcagtgcaagaaacagaaaaagaatagccactggatcctatgtcatatgagctgcatttcagaggcggtcctgtgccataccatggagaaaggaatgctgcacagaggccaagatgaaatctccaccgacagacctcgctggattttcccactcagtctgtgactattagattatacccctttgtccaattgcatttgtacacagttgttcatgcttcagtcatgcctattcaatgaaatttccatagaaggcccaagaggaaagagtttgaagagcttccagaaaacggaacatgtggaggttcctggaagatagcaaggccggagagaacattgaagctttgtgagccttccctcatacctttccctatgcatctcttcatctgcaccctttggaatatcttttgtaataaacccgtttcctggagttcagtaagctgctctaacaagtttatcaaacccaaggagggggttgtgggaataccaatttacaggcggttggttagaagcacaagttaaacaacctggggcttgtgattgacattggaagtgggggcagtcttgtgcgactgggcctgtggaatctgat

SEQ ID NO: 15302 - DNA, 773 bp, Homo sapiens
atagatcaatctactcattcatcttatgaaaaatgataagaatactgtgttatttgtctgccttctcattggatgtatgaaatgtttaaatggccacctttaagtatcatactttgagtgctcacttgcacctccactggataataatagaaattaatatgtattgagcatttgcatatattgtaaagaaaaatagtctgaagggacaaaaaaatatataaatggtgtctgcctctcttcttcccaatccagactaaattgaccaaggaaaatgtgaaaataaggaaaagttgcattggtatttaaagctaaaagaagaatgccagatgacacaaacactgaaaaatattttaatagagctctaaattaaagacatatactcaatgaagcttgccatttgcatttacaaagaaaacagcactgccttttgagaataaaggtcactaccaaccccatggtcatttctcctaacttagaggaaaagaaaaaccatgagaccaataggaaacatgcctctgggaatccatctgtctgccctaaaatgacaaaatgtaaagactgcaatgcaacagagctctgtagagaccagcatctggggtaaacagaagtcttatggcagtaatgagatagaagtggaatgaggctgacgagaaagtggcaatgagaggtgaagccagcttgacttcctgggtccaatggggacttggagaacttttctgtctagctagaagatatgtaatgcaccaatcagcactctgtgtctagctaaaggt

SEQ ID NO: 15303 - DNA, 745 bp, Homo sapiens
  misc_feature (1)...(745): n = A,T,C or G
tagagagaattcagctcactatgtatttctgcatatacaattatgggaaatcatgtttggattgacactgtagacagaaatggcatgcatgattcctgtttggacaggaatagctgttggggaggaagccaaccttgaatgacactgaagagcaacataatgaagcatgaattgacaggcatccttcacgttgcttctggcttcccgtgtaaaaagccatatctgagcgctgctcttatggggccagatccaggggaggagaaaggaagtgaggcccagaaaaaatacattgtcatggaggagtgaagctgaagacaaaacaaaaaggactttccacaactaggcccctggcttacactgcaatggaagaagaggagcagaaatactgccaaagatccttatgatggcattgcattttagactgcttttcaactgattatgacagtatcaacaaaagaaactttcatttgagggacatggatggagctggaggccattatccttagcaaggtnacccaggaacgaaaacgaaatactgcatggtctcactaataaatgggaactaatggataaaatatttgggcccttagaagggaacaacccccacctgagccttttaaaaggtaaacggtgggaaaaaggggaagggtcccaaaaattaccccctgggggtccaggcttaaaactctggaaaaggaggcaagggcttggggttcaccccccttaaaaccaaccactttggggg

SEQ ID NO: 15304 - DNA, 772 bp, Homo sapiens
ctcagatggagtctcgctgttgctggctagagtgcagtggcgtgatctcagcttgctgcaacctccgcctcctgggttcaagtgagtctcctgcctcagcctcccaagtagctgggactacaggcaggcaccaccatgcccggctaatttttgtatttttagtagagacaagatttcaccatgttggccaggatggtctcaatctcttgacctcgcgatctgcctgcctcggcctcccaaagtgctgggatgacaggcgtgagccacggcaccctggccagaactgttaattttaaactatagttactgctcacaaagagacacccggtgggctaataccaatctgcaacatatcagctattgaagaaagcactttgtaactgtaaattcctataaatattaagtattcttactactcttttagttttctacagccactcaaggagaatcttctaaagaatattccagcgcggctccattcagcttacaaattcttccagccagtcttccctagcagtcgttcatatctattgtaacagttctagagcaactccccaagcatcaattggccaaatgcctatttaccaaaaatcaatggattgaatgaataatttgctaagttttctatatctttatagtaaatggtagtatctaataaagtcttccactttcaaaaagatggagtaggcatacttttccctaatcctcccactaatacaaataacaaccatgaacattatatataaaagtaacttaagaaaacagtgaaagg

SEQ ID NO: 15305 - DNA, 815 bp, Homo sapiens
agtgataatgagttggttctcttgcattgtctttcgtaatgtttttgaatatcaattaggaagcctctgtcacccatgctagagtgcagtggcacgatctcggctcactgcaacctctaccttccaggttcaagcaattcttctgcctcagcctcccgagtagccgggattacaggcatgtgccaccatgcccggctaatctttgtatttttagtagagacgggttttcaccatgttggcctggttggcattttcttcaaaacaattaaagaagcccaattgaaaaacacgagcaagctttgcatatattaattattcaaatgttttgtattcggaaggaactaattcaaaatcctctaaatctgaagaactctaagattgtgaattggatgcaaggaagagttaaaatttggtgaaactttctattttttatttgagctaattggtctctgactttcaatagaggaaagatgttccagtggaataaatgaatgacaaatagccccggatgcctctaatatgtttcccacacctacactgggtataaattaatctataaaactctctgggtatcaataatgttatggtctctcttctgttttatatagttacttccgccagtcgaattctatatttttttatatcgaacctgtggttatagaataaagctagcgcgaatgaggaatcagacggtatgaagttaagatgacgactaagctcttatcattacaccacctggaaatcttttccacatcatcgaacgtgctttgccattatatcagtacctccatacgtcctgttgtacgcgctgctct

SEQ ID NO: 15306 - DNA, 758 bp, Homo sapiens
cgcacgggccttgtgctgtcgctgccgaggcaccccttctagaaggactctattctttataacagaagtgggagccttggacaactgaacgcctatctctagctcaagaaatgtcagctcttttttttttttttgagactgtcacccagtcgggagttcagtggcgccatcttggctctctgtaacctccacctcctgggttcaagcgattctcctgcctcagcctcctgagtagctggggctacaggtatgcaccatcactcctggctaattgttgtatttttagtagataatggggtttcaccatgttggccagggtggtctcaaactcctgacctcaggtgatctgcctgcctcggcctcccaaagtgctgggattacagacgtgagccaccatgcccagccaataaatgtcaattctttatcgtaacctggctttccatatttctcactaaaggttatattctctagtttcgaaatcacatttgggcgttagtagatcactccttccctttaagaggcattcttttttaagtggcatctgccaatatgaaaaaaccgtattatgctttttcctcctttatttgtcccttaacagatttattacatctgtaatacgcttggatttggggatacacaatgaataacatcaggtctgttttcaaaggtatcacaaaaatttcctatatcaccctactggccacgttttggatttcttggatcaaaaccactttcggtgcgttttatttccctccccg

SEQ ID NO: 15307 - DNA, 425 bp, Homo sapiens
aggtttgaggctctaccagatgaaatgtgaagactttgtctctaaaaacagagattcttgttgaaactaagcaattgtggggatgtttaaatatcatggccaagcttgatgatataggccaagttggatattaaatggaggaggcaggcactgtagagtctatctgctacccccacgaaattggttgatctcccatcctggcacaatttgaggaccctctctgcgggaggaaaagaatcaggaaacaagtctgacttcctgaccatcatggtcaaggaatagatgtttcatgctgaaaggaaggacataggaagctctcctcaatcctctggacttgcacttgcttttcctgaagtatcgacaatttatactcttagaaataataaagcttgatcttatctctgcgagtcataaaaaaaaaaaaa

SEQ ID NO: 15308 - DNA, 818 bp, Homo sapiens
tataataaaattttataaattgaaagactgcacttacagaacaaagtgaagttactcataaaacccgggagaaagaagagggaatcgactactgttttattagtgtccttacaccaagagacatgagagggctccactgtctgccacttaaggatacaatgtgtgtaaaacaaaaatgctaaccactacactatggaaccatgtaaacgatacaatgctgaagctggccaacatgaaaactgagggagctgaccaccagaggacactggatctgatagtacctcgatctgtggacttactcatgctctaaaaccgtaatattataattctgaagagcaagacacacaattaatgctaaatagaagtccaaactggccaaaagcctatactgcattttagagtaggaggcacccccctattaccaactgaagtaaatttgatatcaatactataaagcaggcgcggccggactcaaagatactaactcatctgaaattaactttcacacaggaatatcgcacatccatactcacatgacgcgatactcaaaataacctacagattgatcgcggcaaaaagcaacaaacgccgggcgctacctcaaacatacaaccaaaaaacctagcacaaaaatcacaacgtaaaccaaatgtcagctaagagggaagtaacctaaaggagatgggcttcgccaatgaccacatctttctagaatttcgttaaccatcaccagaaaatctatctatccctactcagcaatactaatcctctgtctggaattccagttgcccaatcacataagttctatatcaattatt

SEQ ID NO: 15309 - DNA, 817 bp, Homo sapiens
  misc_feature (1)...(817): n = A,T,C or G
tttttataaaaattcnnncntttaaaaaaatgaaattggcatgacccagctgctttctgcagaacaatgcttattgccaagagatcaataaaggatctcattggaaatgaacacgagaggaaacgatgacagtgataattccaaatatgatgctttcttcataaactatccatagagatggcacagctctcgatcaacctttgcctggttggcttgaaatgttttaagtctttgacataaaaattgtgaaaggactcgtcgtttccaaagtgagatgaagattttggtgctgctgtttattaaaattttttcgttgtgtttccacacatgcctttaattccccatatttgaacttcattgcaacttaaagaaaaaggccatttgaaatttgatggtaccattgtctttcgtttgctcgtcagatttataaaagaaatgacattccctagtctaataccgaagccccctgtgaaacatctgtcacaccaatgtgaatggcactatcgaatcaactcctttcagaaatattttttaatactttccacggtcatttaccccataccggctttttgccgactacctttaacttgggactgcaatcgaaaacgcatggaaacatattttatttgttccccatagaaacggatcactatgctaagcttaacagtttattttattttaccaagacctgttatccgttacttaggacataccatgtttagagtcgcggacaagaaaagtcattcatcaccgcgcgtagatgcccttattacaaatacctaatccgtctttagaaatacctcgggcagagttattt

SEQ ID NO: 15310 - DNA, 823 bp, Homo sapiens
  misc_feature (1)...(823): n = A,T,C or G
tttttttttcactatattaanannnnnantttgtataacacttttgaaaaattantaccatggtagaatttaggttaacggttgaactttccagaagaggtggcatgggagctgaagaaatttgcttctatgaaagtccagacagacaccaaataatttggaagacttactgacattcaggtggcaaacaaatggattcttttttgtgtgtgtttacttttttgatttattatattatttaaattaacatacagtcaattggctttactgtgaacaattcttttaattttagcacaggtatagatttctgcaaccatcatgattgtagaaacagaacagatctatgacttcaaaagcctacctcatgtaatacttttaaagtcacacactacccagtctaaaccgatccgagccactgtctgctctcagtcacaaccatcttatttattttataaaatgtcgtataaactgcattagaacatcgttttaacatttatgaaacttgattcctttcattctctatattattatttaagaatattcaagtgttagactgtaataaacattaattaccttttcaatcaaccacttttgtattgagaagacaaatcagtatcaaatctcttacatctttataaaataactactccctcctatttctctccagagatcacacgccagctaatccatttaggaggctatagctatcaactctacacgttacatttcttttttgtacccagacattcatgtcattcccccattacttctgtcattatgaagtttttccatatctcatattactctcatgcccccaataatt

SEQ ID NO: 15311 - DNA, 852 bp, Homo sapiens
  misc_feature (1)...(852): n = A,T,C or G
cgcccactcgcagctctcaattttctcccctatntnnnctctccctctagtacctggtaagatttaggttaacggttgaactttccagaagaggtggcatgggagctgaagatactccgcttctatgaaagaccagacagacaccaaataattggaagacttactgacattcaggtggcaaacagatggattcttttttgtgtgtgtttacttttttgctttattatatttttttaaattaacatacagtcaattggctttactgtgtacaattcttttaattttagcacaggtatagatttctgtaaccatcaggtcgttttaaacagaacagctctatcacttcaaaagcctccccagtgtcatccttttagagtcacacactccccagtctaaaacgcttagagtcactgtctgctctcagtcacaataattttcgttttttgaaaatgccatattaaccggaattgtacagtgtttaacatttttgaaactgatttcttctattcagccctgttgccctttgagattattccagtggttcgcctgtattaaccagtctatttcttttctaaaactaattccatgtcttttatttgaacaaataaaaatcttatatatttatagtgttttcatacctaccctcccctcgctccccagccatctctatccaatcctcaaccatattacctccttcttttctattgtactttccccttccctcatcacgtattagatcctttgatcaccctcccctctttctttcttcctccctctccccgtcctttgttgcctctgtttccttctctcctcttttttatttttttatatatctccattcacttttccact

SEQ ID NO: 15312 - DNA, 784 bp, Homo sapiens
cctggtgagacacaagtgagaggtcagctgtctacatgccaggaagagagccctcaccagaaactaaccctgctggcaccttcatcttgaacttcacagcctgtagaacttcaagaaataaatttatattgttaagccactttgttatgacatcctgagctgactaaaacgcaatactctgaaagccttcacttcgtctctcatgacatctttcaaaagacctcaaccaaagcaaccttttcagtgggaagcctgagggaatgagtgttatcctaaattactcatctggatacagtacccatcccctggctctcagagaaccctgagttattaccattctctctctcataacattatcacttgtcaggatttgaatatgtcccctccaacattcagatgttcagaattaaaggacaatgtaataggataaacaggtgggaactttaacaggagattaggcctcaaggactcctccctcctgaatgggattaaggcccttataaaagaagctttgcaaagcatttggttagcttgtccttctgccaactgccatgtgttgatatagctttgctcccctctggaggttgcatcaccgaagtaccattctgaaagcagagagactgggcccctccgtcaccagccagtaccttgatcttggacttaccagcctccagaactgcgagaaaatacatttcttttcattataaataacccaggctgtggtatttggtatagcagcactaatgaatgaagacatcactttatgtttagtatttggactccc

SEQ ID NO: 15313 - DNA, 803 bp, Homo sapiens
agacagtcactggagcctgcgtatccttttgtctgcaactgaaaccgcctttgcaaaattatgactgatacagtgaaagaggtccaacttaaacgactccatcttgcctctaacctccaagctgtccttgttcatttctgggcgcaggctgaaaaaactttgggaggaacttagtttatagttttaaaaaatgacaataacagccctttcccagaacaaactcccttcttgcctggagactagactactaaagttagccacagtattagaaattacggtttaggagtcaagtagttggaggccacaagattctgaccttccctaaactgctcccaagatcagtgcctgagatgttttgcagactctactcttgatggatcaactggcaccacccatatcgagaaaccggcccatctgatcttgtgactcacacccaggaactgactcagcgcatgaagacagggacgccccgtaatttcacctccgacccaacaatcagcactctccacttactgctactgcactccaacacattctctttaaaaattttgatccccaaaaggtccgggaaaactgattggaataaaaaaagaactcccggcctctccttctaaaaaaaaaatttcggccctctttagccttcatcggtggacgctcttgcgaccgcttccctttaacacggggtaattccatgatctccctccctgactccctgactttaattctctccgttcatcgtagcggtacaactgaccttaacgcggatatctggttctcctaacatcacaggaacacaccccaaa

SEQ ID NO: 15314 - DNA, 807 bp, Homo sapiens
tcgtttagctactttcgccatggctcttagtggtggtatcaggactcatgacctgcaagggatccgcccacctcgtcctcccaaagtgctaagactacaggcgtgagccgctgcacctggccatactactcttccccgccccgccccaccgctccaccccggcaaaggagtcttgctctgtcgaccaggttggagtgcagtggcgcgatctcagctcactgcaatgcaatccctgcctcccgggttcaagcgatcctcctggctcagccttccgagtagctgggattacaggcgcccgccaccacgcccggttactttttttgtatatttagcagagacggggatccaccaccctggccagcctgtgctcaaactcctgacctcgggacccaccaccctgggtttcacaaagtggtgggattataggcatgaaccacagccatagaccatgctactatgatagtactgactcagagcccaactccaatacctagacaaggccagcccacacccttccatcctttccgccacccccctcttctccaacaaacggtccctaagtctccctccctcccccgacacacactcctccccccactcccctcaccccccccctcccacccccccacatactcacaaccacctttattgttcaatacaggaaagcacgatacccgactaaccctactacaccccaaaatctactgcccacccgcgctcacgccgcatgcctaacaccctcctgtttcttctatcattccgaatcagaccaggtacacactacactacaatctgattatgcaccgt

SEQ ID NO: 15315 - DNA, 851 bp, Homo sapiens
ttccacgtccatccaattctccaataaaacgcactcagtggctttctggtggtgtcagacatctttacggaacaatctcatggatacgaggtttttaacatctccagcccaagcaacaatgcgtggcaatgttcaggaaacagtgacaattgataatgaaaaaaataccgccatcattaacatccatgcaggatcatgctcttctaccacaatttttgactataaacatggctacattgcatccagggtgctctcccgaagagcctgctttatcctgaagatggaccatcagaacatccctttttttatcaatctccaatggtacatctatgagaaacaggctctggacaacatgttctccagcaaatacacctgggttaagtacaaccctctggagtctctgatcaaagacgtggattggttcctgcttgggtcacccattgagaaactctggaaacatatccctttgcataacggggaagtggtttgagaacacacattataccaactgtcaaggaccttccgctgccatcagacagggcctcgatgatgaagaatgattgacacccacagcaagcaccggggtggacactccatggcctgaccccttcccgttgtaacgcacaagggccagcccaaggcaaacctctggatggcccctgggaaagtaattagtgggctgccaccattccccaacaaggccagaaaaaaactcgcttcgggccccattacacagcaaaatactccggcgtctgcccgtctaaaaccaaatttgtatatataaaacaaacctgcgctgcaaaaggagactcatcataaacgttcttgctttcttaatttaaatgccacac

SEQ ID NO: 15316 - DNA, 366 bp, Homo sapiens
  misc_feature (1)...(366): n = A,T,C or G
aactagaggcactacagaacgtgctttgcggcgggaccgaacaagtgaaggtttgctactgagagattgatcctcngtggccgtatagaagtcaaaaatgaagaacgtgaaaacgaatatgcctcagtgtggtgaattgtgaaattacgtccacagggctaagaagcaatacgagaaaatgacactacaccatattttttacattgtgatgtccttgttatggagcataacttgatttttaactctaacattgaggaatcgcacagtcatttcaagacttttataatacaagctgctctgtgtgtgaacctgaaaaaaaaaaaatcaccctcgttggcctaacctgtggaggtctgaggacagata

SEQ ID NO: 15317 - DNA, 304 bp, Homo sapiens
  misc_feature (1)...(304): n = A,T,C or G
gggtaaaccgtcggacaagaccagggaagagggaacacggagaacaaggctcagcgggggagagnaggaccaacaacgaagaaagtgacaaaaaagaagccaaagagaaggaagaaaagtgaaattacatatcaagagaaaaaagaagcaaaaggagaaaaagataatacagcaaaaaggaatacattaagacgaccaagaaaagagaacatacttgtttttgcgaactggaacatagaaaaatcgaacagccactccaagaataagagaaaaaaaaccccccttagaaagaaaaaaaaaaaaa

SEQ ID NO: 15318 - DNA, 422 bp, Homo sapiens
taggcttcccctcatcagcctttgcagcagcacttgccctgcggtatgcgtgcggcaagcttgggttcaacggtgacagatacgcggcttgcatgatccgcctggagaccctcttcatactattcacccttctggacgaagacaaggatggcatggttcagctctctgtggccgaggggctgcgctgcttgttggtctgacccggcgtttcggatatcagtttctctgcctgccccactgcttgcttcttgataccccttctctactttttttgggaacatttatgctccagtggcattcactggttgttcatacctttcttgccctgagtctatttcagcaccactgatctatgagctatggaagccgacccggcgggcccagtggagggaaaggagtcaattaaagctgtgagccagaaa

SEQ ID NO: 15319 - DNA, 412 bp, Homo sapiens
cttagggctcagcttcctctggcttagggggttgacactgttggtttatacatcgagggggcaggatggcgtcgcgagcagaaaagaatcgaagactcgctgactctggagatgtgctgtgattgtaccgacatatactgtttgccgacaaagatagctaccagaacaccaaatgcttccaaccagacagactcagaactctatgcttttgaatgcgcaggttaccattcttttgagaggtcaagaattggtggcaactaccggtttaccattttatttttgtaacatgagggcatttatgaacgaagaaacctgctagtcgcacgatcacaatgcgggttgcattgttttgagagaagaatgaaaaataaatgtccatatcaaaaagaaagaattggcctcgttggcctca

SEQ ID NO: 15320 - DNA, 558 bp, Homo sapiens
agagcttctggttcctgggccttcagacttggactagaacttcactaccagctttcctgggtctccattttgcagagagcagatcgcagaacttcctagcctccataatcacaagaacgtgtttgcttccccttccaccatgattgtaagtttcctgaggcctccccagtcctgcagaactgctttgaagaagaccactgcgtcggtatttgtgaaatgttttgagcctctggatttaaataagatggaaaaccaaagctcagggagttttacatgggcaggcagctggtgagggctgagactggagccaggccagtggtcttcaaaggctttagtcaaactttttgacagatataagaaaaccgaactaaggaaaatactttcctgggatcatccctatatgaagtggcagacctggaattgctccctgtttcaaaacatgtaagctcctcaagaacaggaacttttgtctgtttgttcattggtgtatctccaatccttagaactatgcctggctcaaagtaggtgctcaataaaatatctgctgaatgaacaaaa

SEQ ID NO: 15321 - DNA, 301 bp, Homo sapiens
cagaagaaccccagtaagccaccaatgtggagaaccccaggctttagagaaccccacaagccaccatgtggataagcccaggctaacctgctggatgatgagactcacaaagcccaggcatccctgtagcccttgccaaccgtcatgtatgtgagtgagactatccatctgacgggatgttcatgagtgagctcagaggagaagagaaccatcacatagctgagcccagcttaaattgccaaaccacaaaatggtgaactaaataaatgtcttttgttttaagccaccaaaaaaaaaaaaa

SEQ ID NO: 15322 - DNA, 231 bp, Homo sapiens
ttgccttttacggtaaaagcagcatctgtaagaagaaaggagtgattatttggtggccatggcaaaggaaacacaaaccaaaatatcatgtttaattacctatgcatcgttcatcatctgtcacagcgtcaccgatatactcaaacttaaagtctctgagtgaatgagcaaacttccgctgggccactgacagacctagaaagaaaggtattatgatgaaaaaaaaaaaaa

SEQ ID NO: 15323 - DNA, 779 bp, Homo sapiens
  misc_feature (1)...(779): n = A,T,C or G
tgacggagtctcactgtcgtctangctggagtgcagtggcgcgatctcggctcattgcaggctccgctccccgggggttcacgccattctcctgcctcagcctcccaagtagctgggactacaggcgcccaccacctcgcccggctaattttttgtatttttagtagagacggggtttcatcgtgttagccaggatggtctcgatctcctgacctcgtgatccacctgcctcggcctcccaaagtgctgggattacaggcgtgagccactgcacctagccaattgctgcaatcttacaatgaaacttgaacaaatgaagaactgcttcttatgaatgagcaaagaaagtgttttttaagatagagtctactcctggtaaagatgctctgaacattgttgaaagtataacaaaagatttaggatattacataaacttaattgataggctggactcagtggctcatgcctataatcccaggctgaagtagaagcagaataaaaccctgtctctaaaaaaattaaaattcatacctaaataaattttaattgataaagcagaaaacgtactcctggatttctaattttctgtttcttgtttttgtcgtgtcgcccccccccctgtgttctgtgtatttattctacccttttttccgtttggtcctactcgccggtaatcgaacccgttcctttattgcggggggcgtattatactttctccctcttatcttacggctttccgtgtccacttccctggtcctaggttcttcttcttatataag

SEQ ID NO: 15324 - DNA, 475 bp, Homo sapiens
tagggcaatcagaggaaaagaattgctcttcctattggagttgctgaaggaattggtgcaaagtctggttctgatggcagccgtcttgccgccatgaagcgagggactgagagcgaagtggaaagcagagccactagagaagaggaacagcttgctcatggtgggtcttctgttaattacactgaaagagacttgggtaatgccttggggtgatttgagaaaagccctgcagtgctggattgagagaagcagtgtggcgtggtggtttattttgagacgtgactcacagattttcctcttcttcaaactcactgcaggactctgaaaaaattatttaatccccctggcctaaattttctcatctataaaagagagattattaatagattgtcatagtttgtcatgattaaatgtgtgaatgccgtgtttgatacacagaaagtatccaataaatattatcttttattccttcaaa

SEQ ID NO: 15325 - DNA, 899 bp, Homo sapiens
ctatgactcttgacatattgctttctgtgggccttgaaaaacggagtcagttccttcacttgtagtcacatagctggggattaatccagggggctatacggatttgcgagcataaaatactcgaagactcgctgcctctggaggagcgctgtgagtttacctacgaatacttagtgccaacaaagatttctaccattacaccaaaggcttgctaccagacaggactcctaactctctgcttttgaatgcccaatttaccaaatcctctgacaggtcaagaatattggcaactaccggctaacttttttttttttctttaacactaagagtattgtattcagcgaaagaaacctctctccgtccctcgaatcacctctgctgtgttaggtgttgtttataagagaaaaaagatggtgtattttgttcgctatcaaactcattttattaaaaaaaaaaagtggagttttgttcgctctgtagaacgtgtacgatctggtacccgcttaccctatagttgagctatgttattttcgattcttcgggtactatatcgggctggagccctggtcataccacacctcttaaaaaaatatgtacgggtcactgcaataggtctgttctctggcaatgcgttagtatataggcgtagtatccgatatacacaatcatcttctctataaatgtctattccgtcataccaagtgatccctcgagacagaccactctcatcttgttctttattgatcagtcgtccgagccctctaatgttgttactccaaaaacgatgctctactatcatatagttcggtagtccccgtctgagtctataaatgaccttatgttctatttcgttactcaaccactcacactgcacactccacgtactacacattacatat

SEQ ID NO: 15326 - DNA, 771 bp, Homo sapiens
agagactcagaaatcaacacatatagaggacctgccccttcaaggaaggaaggagactggaaccccttaaaaatttcccctactggaagaatgcacctaagagatctggttggagttggagggtgagagaaaatgaattctaatttacctgcagagaacttaaccattgcagtcaatatgaccaagactttgcctacagcagtaacgcatggatttaattccactaatgacccaccttcaatgtcaattacaaggctttttccagccttactggaatgctttggcattgtcctttgtggctacatagcaggaagggccaatgtcataacatcaacccaggccaaaggactaggaaattttgtctccagatttgcacttccagctttattattcaaaaacatggttgtactcaatttttccaatgtggactggtccttcctatatagtatcttaattgccaaagcttctgtatttttcattgtatgtgtattaaccttattggttgccagtcctgatagtcgatttagcaaagctggactattccctatttttgctacacaaagtaatgactttgcattgggataccctataggtaagctaatttttaattttcaagtgtcaaaaaattcatttttatttatttaggcttttggtggaacagaatcttctctcatatcaaaaggttttcatttttttctcaaatatgtgctaagagaaaaatagttttcctaaacccagagtttgggatccttaaactttactaaattaagg

SEQ ID NO: 15327 - DNA, 764 bp, Homo sapiens
tggagcctgcgtatccttttgtctgcaactgaaaccgcctttgcataattatgactgatacagagaaagaggtacaacttacacgactccatcttgcctataacctccgagctgcccttgttcattactgggcgcaggctgaagaaactttgcgaggaacttaattcacagttgtaaaaagatgacaatagcatccctttaccagaacatactcccttcttgcctggagactagactactaaagtcagacacagtattataatttacggctgaggagtcaagaaagttggaggccacaagattctgaccttccctaaactgctcccaagagcagggcctgagagggggtgcagactctactcttgatggatcacctggcaccatccataactcgaaaccggcccatctgatcttgtgactcacaccgcagaactgactcatcgcaggaagacagggacgcaccgtgatataacctgcgacccaaccgatccgcactctccaactacctgattctggcctcccaccacattctctttaatagtttgatccccctatgttacgtgagactgatttgagtaaaataaaagtccgtatcccgctaagaaaataaaatcaccatgctttgcctatgggtggtcctctggggccgttctgcttcaaccagggtaatttcagatcctcgtctccgatctccttgggtagtctttcgctttcgaaagcgtaacatgtaacttacagggggaggagtgtatctcggtataaag

SEQ ID NO: 15328 - DNA, 786 bp, Homo sapiens
  misc_feature (1)...(786): n = A,T,C or G
agctcttcttcccatgctgtttcctgccaccttgtgaagaaggtactggcttttccttcactttctgccatgattcaacttggatggagctaaaggctattattctaagttaactgaggaacagaaaatcaaataccttctaagtggaaggaaaaagaggaagccgcctccctttcttcttttcgaaagagggagaataaactttgaaccttggagaagtggaaaggatactgagttcttattctaactttttaaaatatagtattttctttttttcttttgagatagggtcttgctctgttgcccaggctagagtacagtggggtgattaaggctgactgcaacctctgcctcctgggctcaagcgatcctcccacctcagcctcccaagtagctgggactacaggaacatgccaccacacttggctaatatttttgtagagacagggtttacctttgttgcccaggctggtctcaaactcctgaactcaagcaatccacctgcctcggcctcccaaagtgctaagtttacagatgtgagtcaccatgctcagccttggaatgtaatttaaacctctccgagggccagatggcttcagattttaaaccttgagactntgccaaagttttatgctnttctcttgatatgtaaacatatactttaggagctaggtaaatctttctggagttctctatctataaaattgtaaattactgtcccaagtcttggtctcagcccagaatcctgttttcaggtaaaatttcttcagaaacctcccactctag

SEQ ID NO: 15329 - DNA, 715 bp, Homo sapiens
acaagttttccaagcccatcagttctggagaatatatatttccctttcctcttttcatgtctaccaccatctttgtatttttagtacagatgggtttttgccatgttggccaggttagtctcgaactcctggcctcaagtgatctgcccgccacagcctcctaaagtgctgggattacaggtggcatgagccactgcgcccggcctaaactcatctttacattaacaagcagctgttacctaaagcaactaatgaaatgtgaactctccccgctatcctctgcttcagtggctcccttttacggttcatggttgtcaccaggtgctctgtgcctggggatgtatatgtccagtttacccatctgaaatgcccttaaccccacacctaacactgtttttggactgttaatcccaaatgcaggactggatatcttgctccctaatgtctacatccacatgggagcagttccagaaccagtgttgaagatgtattagtcacggaaacagagatgatcagtgatggcatcctcactgacactcgtaccctcacagagaagacagacacacatatcagctttcttattatctcacatgtcattgtttacttcctttaaatccctcatttccatcttataaactgaagtgtggccattccttcacacgtttcttttctcacaaaaatacgaacaccaggattgtaaaaaaaaaaaaaaaaa

SEQ ID NO: 15330 - DNA, 782 bp, Homo sapiens
  misc_feature (1)...(782): n = A,T,C or G
agttgtacctcctacaagtatccctcaattaaatttcacctccacagctggtctccttctaaagataccaacctctgatatttggtagcaagactgatcctagaaagcaggtgacatagcgggattttggagctgtatcccacactgcctagttggtgatgaggatcacaaaactggcagtagatgtagtacagacagtttctgatacaagatggtgatccaatattttaagctctcactagtagcaaattgaagtaaatatcacaaacaaatgggaaaacatcccatgctaatggatcagaagaattaatattgtcaaaatgaccatattgcccaaagcaatctatagattgctatcaagacaccacagaataagaaaaaaaatctaaaatttatatggaaccaaaaaacagcttaaattaacagagcaatctgaagcaaaaaagagaatctgcaggcatcacagtacctgacttcaaattacacagcaagtttatagcaaacaaaacagcatggtgttggtatgaaaatagacacctgggtcaatggaatagaatatagaactcagaaataaagaatccagagagaaagccacatatgttcagccaactgatccttgacacaattgacaagatcacacactggggaaataacacccttttcaatanatgcagctganaaaattggattgccatatgcagaagaataaaatgtacccctacctctcaaaagaaacanaatcaactcnagatggattaaagagttaaatgtgagacttaaaa

SEQ ID NO: 15331 - DNA, 776 bp, Homo sapiens
cgagggggggtcttggagagaagcccacaccccctgcgaaatttgttctttaaaccctttttctggagggccggaaaaaatatttcactggggtgtttcccaaagggggccccggggaaagttctccctcccccggggaagaaaaacgtttttttttttgagaggggctttgcgttgttttccccccggcgggggggcagagggccaattttgggtcttgtaaacctttgcccccggggtgtaaagggtttttttttttccccccccccaaaaaatgggggaaagggggccctttcccccccccggcggaatttttttccccttcccaaagggggtgtggggtttaatgtggggggcacctttttcctttgggaccttttggcgccccccccatttggggggccaaaaaaaaaaacattttttttaaaggtgggccgcccccatgggtgggggggtctccccttttggggggggagaaaaagttttggggaataaaaaaagggggccggtggtttacccacccctaaaaaaggcaaattcctcccccccagaattgggttattttaaaaggggttgaaaaaggttaaggttttattttttattttcccaattttttaaagggggcccgccccccttttaaggggccataaaatattttcccggaggggggggtgaaaaaaaaaaaatgggaaaaaaaaaaaaaaaaaaaaaaaaaaaaaaaaaaaaaaaaaaaaaaaaaaaaaaaaaaaaaaaaaaaaagaaaaaaaaaaaaaaaa

SEQ ID NO: 15332 - DNA, 971 bp, Homo sapiens
  misc_feature (1)...(971): n = A,T,C or G
ataataaattgagggggtggtgtggtnttgtgcnagtcagttgtattgatgggcgatcgtttatttttaaagagaggtgaaaaganaaatngagagtaagaaagataacgacgatagaagtaagatgggganctggcgtgttgtgcggagtgaggggagatatttaacgggcatctattgggaggcatactctataaattcactgtaagtatgtncacgncgcggcgcgaacggagagacgcacgagacacaaggttgtgtgctccnacacaaacacgagcaaggtataatactaatgtccgcgcgagtgcgtgagcgcgacagagcgcgaggcaacgaagcgagagacaaatacgaagtatcggccagtgcctgctgtgagtccacagattggaagagatgagttactggattccaatcgccatgtaatctcaaattatacatcccaaaaccacanccattttttacaaaaacccaaccaaaccntttttttttgtaccacacaaacaaaacacccgcgagacccccaaaacatcacgggggttcnctctttggtgtgcccccaggaaaaccactaggagatgctcttgcaggccaacaaagggctttncctcccaaagcactttttgagggcgggcgcgccaataattcaaaatcccacccttgtttgggaaaccttggtttcctaaaatggcacaggaaaattggattccaggccaagtccggagaagggggaaaccctggaaaaagcctcgcggttttggtacacaagctttccccaaaaagcctggttgcaaaccgttggttggggctatgccagcccccactttttgtgagaaaacgcttaaaactcccgaaaaggcctggtaaaatcttcttccacacgatctgtcaaaaataggggccaaacccccgcgggtcggtccaaatttccccaaaaagcgcctcccctctttatttgttcccacaga

SEQ ID NO: 15333 - DNA, 803 bp, Homo sapiens
agcttttgcacttgtttcctacatcgctgagcaaattgaagcatcaagtgagagcttccagaaactccattgcatctattagtctactcaatctgagttcttatgatctttatccactggaaggtacaatcttaaggttaaaacctacattcctaaataaactcatctgttattctccacacaaaggaagtcagggactctgaacggagggaccgactggagctgcagcagaggaacataaattgtgaagatttcatggacattcaccagtttccaaataatactcttataatttcttacacctgtcttaatttaatctcttaatcctgttatctttgtaagctgaggatgtacatcacctcaggaccactgtgataattgtgttaactgtacaaattgattgtaaaacatgtgtgtttgaacaatatgaaatcagttcaccttgaaaaagaacagaataacagcgattttcagggaacaaggggagacaaccataaggtctgactgcctgtgaggtcgagcaaaacagagccatatttttcttcgtgcagacagcctataaatggacgtgtaagtagggaagatatacataaattcttttcctagcaaggagtattaataattaataccgaggggaagaatgcattcctggcgggaggtctataaacagttgctctgggagtgccggtcttaagtgggttacataaggaaccaaatacgccctggtctactgcagaacccttaggcttactggggtggagagaaaacctcgccctggtaatgtggcatcagattggctcctg

SEQ ID NO: 15334 - DNA, 737 bp, Homo sapiens
atttattacttctttagaataatcaatattactgttaatatattaaagttcagattaatagtgatttaaaaagtattgagtggagaatagactaaaagtgtaaatccttggtatgtatatttaagaacaataaatctcatcttatgttgtcattgatccataataactatagatcacaaggcagtatacagcttatttacatagtttaataaaagcaatggagcaagataatgcaaaattatttcagataaattatattgaagcatatcaaagacaatgacacttggttttctgaagggattttattttccatattagaatattaataaaatatgattcttttatatgcaaaaatatataacgagaatacataaggtagctgtgggctaggcatacaaaatagaaaaaagtgtgaaaaacagtaaagttgggagaggagcatctattttcttaaagaaataaaacacccaaaacagtataaagttgtccagaatgtatgtcaagaattttagataggcctttcagtaacacaggtgacgaaatttttaaaaatacattgattattatctaggttagacttaaagtgaatctcaaataaaagaatcaggaatacaacttaagtaatcatgaggtccttccatatttagattgggtaagcatgaatgtgtattttctacaaaagaccttgagaagagttcaataaaaaatgttagcattataaaaaaaaaaaaaaaaaa

SEQ ID NO: 15335 - DNA, 220 bp, Homo sapiens
taggttgaaattgaggagcccatcaaaaaggacgttgcaatggcagttagaaacaacagttttgaaattgcagatgaaacagactcgctacaagacaaggggattgttgaaaagccctccacaacaaaggaaatgaactcaaatccctaacctgcggggcgttccagcaaccctgaggccaaaaataaagctctctgatgaaaagccaaaaaaaaaaaaa

SEQ ID NO: 15336 - DNA, 810 bp, Homo sapiens
ctacctagaaaatgtctctgaacctactggagtaagaatgtgattcataaagtagcactccatcaaaaggactattgccttccagcaaaggctgggcacatttcgtgacatctatcagaaaagagttcaggtaatcacaaggaagcacagttttccttctcatcaagccaccaactctatgacaatggctctcatttggggatgaagcaaagcagttactgaaaatcaaaagaatgttgagaagagaaaagttgtcatggaaagagctctgacccctaattcagctgaggctaccagagaagcagagtccctgcctctttttttatcaggcccttagcaactcacttatggtgaatactagtgatgtagtttgcttgtacataaatttcctaccaaaatgtatgaattttataccatttggcattctttgtttcaatgaataaatctcaaactttactcttttattttatttgtctgattacatgtctatgtcaccaaatctgtgaaatcctgtaaggcagaaaaaaatgtcttcacatatctatactttaagataccaatgctcacctggcatatggcagggcacaacacgtatttgatgactaaatgaaaataatattaaaatatcacctagttatacaccaataatctgagaacatattatcatatctgagatctgcgggactttttttgagatggagttttagctctgttgcccagcctggagtgcatggcacaatcttaactcactggaaccttttgccttccaggatcaaagaattctcctttctcaggctgccaagtaggttg

SEQ ID NO: 15337 - DNA, 994 bp, Homo sapiens
  misc_feature (1)...(994): n = A,T,C or G
agtagtgnagacccaaanggaggtagtgaatattggagatataaaagtccgtaacagtacatggacactgagagcaacaggngtggatgaaatcggtgagtgcatcttctatttgacttatgtgatttcttatggcccagactaaaatgaagngcatgacagcacgtcgaagggatcaccaagagtagaaatcggatacgaacatagtgctcgcggcgtagcgtgtgncggctgaacggaaagagcagnaggcaagagccaatacgaaagacgagatcgaagccgccgtangactatacatatgtgacagcgttatttgttatagcgatgtgacgggatgggtgtcggacatgcacccattgaaagggagaaggatcgtgggtgcggcctgcgcacagatgagggcaggnggagactgctgacctataaaaaagacttgaccatactatctgttcactggagctcgcctcgcacggcgcctcgggctcgcagcgcgtgaaggtgtggagggaacagtatcgcagaattaatcgtcatagcagtggacttacagaacacagacgcgcccgacactcatcaaaccaccacttcaacgcgtacgagactaagaagcaggagggggcgtcatttgatcaccannaagggggacacgacaccacacaacctacagaaatcctaactttcttagtagttattaanaacaataaactacataccaaaaacaaaactcaatnatataccaactctatatacctataacgcggcgctaaatgttacctgctccagccaggacaggaatcattatataaggaacgcaacagccctgttcactnnntattcctcttcacactttcctacaattaaacctcttctcttcataactcaacaaanatnntacgccctctnncccctcnnnnacttanctctctncccaatannannnnnnnnnccatccnnnacttcatcnnncctcnccaccncnnnnntcaccctt

SEQ ID NO: 15338 - DNA, 771 bp, Homo sapiens
  misc_feature (1)...(771): n = A,T,C or G
caggatttatttgccaagagtctccagattcctcatccccaggcaccggacctcagtcagcagccacctgcttccatctacctgtccccacttagaagggaccatgatggacatggaagacctgtaaaatagacagggaccatctactccatccacttcatctgcaggaaatgcagaaacagcaggccggaggcatgaaatgtgagctcaatgtgcatgaacttccttgacgttcagccttctgcttgtcccatctgctgtcatccacattctggccacttttcatgactcccagcccaatctccttcttggtggcacgtctctatttctggatgccatcccctggtcttgtccaccatactgctgcccgggccaggtgtgtgtgtcttgcagacatcgtgttgtgatgctgggtgtgccctggtgctcccagcacctgtgaagtgagttttctttatgcccgagaagtgatgacagctgaatgcatgttctcatctgttgaagggaaaaaagcagcttatcaacatcctggctgtcaccatgaaggtgaactcttctgataggtcaagccttagggaaacttctttaatactctacanacaatgccagatccctacactcaaccagaaatgaaaacttanacacagaacanaaaagagtccttttcttgaagagggcaccagcatggcttaaagcttgaaagcaagccgaagaccctccaacctctctccaacaaggccagacacttctcatgcccaaccctgatgtggg

SEQ ID NO: 15339 - DNA, 785 bp, Homo sapiens
  misc_feature (1)...(785): n = A,T,C or G
agctgtggggtcgacctcaccagcgcgccgnnggcggcttaacctgccggaccgcggctcagtacatagttgtagcttttgggtatacgtctcgtctgtggacccgagaagagagtgtcgggtgaatagtaatgaggtgtacatcgtccgagaggacccgccgtcgtggccgacgggaacgcttgatgagtgtagcccgccaagcgcgatgtagtgtggggctaatagtgngcgttctaggcagcgaagggagaatcgagccttccacaatacgnaacgtatactacaagatgccactgtctcactatcaagagctggagggcatagactcccggatacgacaggacgacctacgacgacttggtccacactcagggggcccggagatgantgtgtaaagtgtgtgagaaagaagtaggagggtagtggggagaggagggcagcgggggggaactggaagaaccatcacccctcctccagtcactaaagggggaggaggtagccccatgccttgcgatttcgagctagtcggcaagtccacgtgggcccacacaccaccatactcacccctcatctatactacttatcagggttcatgacaaattttgctttgagacgtcggaacttgtcttggctcttataaaatttgataacgccttataggntccttttaacaagcatcaaaacactactacactnagcgaactccccccctacattgagaggcttgtgggctcgacattataaatatggccttgtaccacacggagaataaggcgcgccgg

SEQ ID NO: 15340 - DNA, 803 bp, Homo sapiens
caggcagagacatgtgggaaggttccacatgtccacctagctagcagaacgagcgggacccaacggatgctctgcacagacatgtgctacatgggccggagctatgacaccgcgtgacaagccaactggactctttgatgttgccagagatcccacaagagagaaacccatggctccagcatggggaccccggtgttatgaaatactcctagtcatgcaggacgctgctgacagacacacccagaccctgtcagaggtgcccgatcagttttttttttacaactttgattggaagccctggcttggctgtgctcgccgtccaccggactagcttgccaaggtgataaagaaaaactggataggacactgagccgctggctacgtctggggaccatacagaagcagtgtggcggagctcaccatctgcactacacacacacctgagagaggcgatggggaaacatatgttcctgtacaccttggatcgggactgacggtgcattttatcgcctgaaggcttggaccacagctcaacagctactgaactggaggggtgagggggataattgcttgtgggtacacactggaagatggtaggtctatgccttctggggtctgagcctgggactcatggaaatggattgaatagaggggctttcacaaggcgaaccattgcaaccagatggacaaggggagcagacggcattcttgaaaacaaagggtgcgagatggaccttaactcaccctaaggcaatacctaggcctacagtttgtaattgcaatcgctgtatattcgaggtggg

SEQ ID NO: 15341 - DNA, 1412 bp, Homo sapiens
  misc_feature (1)...(1412): n = A,T,C or G
ctacctatctagagnnagagtatagtagagagtagctgtcatctgatatnnnacttgacgatgagcaagtctacnactattactgcacttactngtcagtatcgagcgtgaatgattgatatgatcagnagttntatancgattcatggtctcttatactctcttctctgttcttgncagtcaatgtgantaanctatcattatacggtgacagcgatattactatgttatgtggnctctggacagccaccggtgctcttcgtgtgcanggcactagactgtgatggatacaatgataacattgatgacactgtatccgtgagtaatagtattgtatcagtntngatntactagtcttcttcttgtcttattgttgancctctcacgtaacatcaatatntaatattgagaatgaggaggtcattgattatactgacagttatcactaacacatagatactgtatgagtcatgagtgatgacaacatcgaagtgagttgtaagtggctgattgtgagatgtgatatctatatataatgaggcgagagtngnacgttagtttgagtgtntgactaatgaacataatnaatgaagcagtnaacgatgcataataggtgaccgtggaatgtacgccaaggannagtactgacgagatagatgtgctaatgngcggagataaatggcacttaatagtctgtcgtgcgctctgctgtcgcgttggtgtctgtgttgngttgctcttgtgctcgtgggcaggaggcactgtgcgctatagtgtcttgtgttatgtcttgctgcttcttactacctcctnnngcttctatatctaagtnntacttcattagctgggcagcggggaatagtgatcatatttgtcttggtatgatttgtcttcacacttatatcttgcgngttcactatttntgattgatgcatatgccatcttcttaacttttctttacattatataattatacaaaanntttatttannaactaaaatatactttnttcacataaaatatacattctnatatancttctaccacataattaatactttttatttcttcgttttaccctccggacacttatcactatactcgtngaattagtngaacacgattaggnagacgcttccacgagcgacgctatgccatattaatacacttnnncccnccncnctcatccttactcaccttcnctcctttacaatttnnnnactttcctcacatcctnccttnncactcatattnctacnnnnnnnnnnacttctctctncnnncccacctttcnnnnnncctctnnnnntcttcttcnnncctatatnnnccntnnnnnnnnnnnnnncccttcccnnnnnctctttctcctcnnnncactnttnccanctttnnnnnnnnnaccccccccc

SEQ ID NO: 15342 - DNA, 1021 bp, Homo sapiens
  misc_feature (1)...(1021): n = A,T,C or G
tggttattcttggagtggggtggggggcagacggcaaggatatgcgatatctgtatgtgacgtgaacaggtccttccgactgtgaagtggaagaggactagaggactctagccctggatttgctctaccatgacaaacccaaacgacttttggaaagagaagatactcaaagcagactacccaaagatcaaacctatcctgggagcataggccaatataagaagctagctgtcaacccctgttgtagcatggtggggtgctggaagaaccatctagcattctaattacagcaaatacaaaactctattgaggttactttatccatgttatggtacatttttttttcataatgaaagcatggcttgcactgtaacagaatgacggaaagaagcttgggacggtgtcgtgaaattaacgctgtaacggtaatgacactagaaatatttgtccaggaagacttatagtataaatattaggatcgtgtcagtgagtagacggatcatcgtctgcgtggaggttatttatgttcagcggacgaagctcggaactggagggacgtgcgatgttgttttgcacctaattctccaatcaccttgagatgatgactcccagtcttggtgactgtgtgcactccacgtctcacgattcgaatctttagtgagcactcctgccgactagcacatcgggccgaactcatcgacaagtgtgggcgcctagacggacaactcagtgtcatagctgatgagcgcgtgtgatatatgatctcttgtgcgaccaggtctnagatggtattatatgtttcggtttcgatcgcgtcgaccatgctttcttcgtaaatcattaatgttaagcgtcatagccacacagaaacacacgaccgcgcccggtgtgcgccggatgagtgtcggacgacggacgcatatttttacatgtntgccttgttngagttactgaacatatctatgcgcagtgtacgcgagtatcggtgagaaagagctatacttgtacgcggggtggtgtt

SEQ ID NO: 15343 - DNA, 741 bp, Homo sapiens
  misc_feature (1)...(741): n = A,T,C or G
atacagttgtgacccgccacccttggccctaaatgtttctttaatttaacacttataaatcttccaaaaatcccctttcgtccaaattccaataattatgaatgggccttactaaactgaggctttctaaataagctcctcttcaccctgaatgcaagagaccctcatagttaggcaagaatatcatcaccccattcaacctgaaaaagntacagaagatggatcgtcatccctctgcaaccctcaggattaaggattctttcataaaagggagagggaaatgtctgagacatgtgaaccagagcatctccatcttaaataagagctgggtaaaatgaggctgaaagttactgggctgcattcccagacggataaagcaatctaagtcatgaagtcagcacaaaatacgggtcataatgaccttgctgataaaacaggttgcagtaaaggagccagccaaaaccaaaatggtgacaagactgacctctggtcgtcctcactgctacactcccatcagcaccatgacagtttacaaatgccatggcaacgtcaggaggttaccctatatggtctaaaaaggagaggcattaataatccaccccttgtttagtatatcatcaagaaataaccataaaaataggcaaccagcagcccttggggctgctctatggagtagccattcttttattcctttactttcttaataaacttactttcactttgcaaaaaaaaaaaaaaaaa

SEQ ID NO: 15344 - DNA, 797 bp, Homo sapiens
cagacttgtcatgaacaggtccctccgactgtgaagtggaagaggactagaggactctagccctggaggatgctctaccatgacttaataaaacgacttttagaaagaaaagtatactcaaagcaaactacccaaagatcaaacctatctgggagcatgtccaatatagaagctgcttcagcccctgtggtgcgggtgggggctggagaaccatcagcatctaatcaagagatcaaaatctatgaggttatttataatgtattgtccagtagtttctattagtgttggctgcctgtgacaatagtgaagtcctgggaggtgacagccctcacctgaacagatgacactggcatcctccaggtgcccacagttgtgcctggcccggcccccatgcacgcactgccccaggtggctctcgctccccacacactgcacgtcatccagcaggattttcccagagcctgccccgaagtgagcccctgttggggctgccacagcccgtccacactgtagctggcggcacacgacagtggccttggccagattccagaggtcgtcacgcaacacacggtcctccatgtgccctggacaagaacctccacgcggcctgagcacctccctgtgccattcagcagcctcacctccatccaggctactgggaaggcacaaagaggagaagtactgggactggcctctggtacagagatattctctcacctttttgaatctagtctgttatcacataagcttgtgttgacatgtggccaggacagcaagacataatcaccttcagtttc

SEQ ID NO: 15345 - DNA, 785 bp, Homo sapiens
  misc_feature (1)...(785): n = A,T,C or G
agcaataaggagtagggagctattgggcaggnagagctagcgagtctggataatagggcatcccgtatgcgtgattgatgagaagacttgagaaggctggcatgaagagttgagggaagagatcttgtggaaggtgacttgggagtcacaccgtgccagtgggggtagagagggtggatgatacgagcaggacatcgtgcggcggagccagggagcctcgcacctgccattcggacgccactacgtagggggtagtaggatacgcgatatgngaacactaaagcgtgaaacttgagagggatgtggctatgatgacaaaaggagatcttactgatacgtgaaaagtgggagtggccgcgtggtgaccagtaaagcatagatgtggaaagtgccgagaacggagggagggaagacgtccgctctcccgtcgactgacccggnccggggtgccgggggctgtggcgcgggtggaggggtatcttatgttacctaccttgactaaaacgcaaatagtgggatgagtgtaccggactcctacatctaaactcacagggccgaccatgaaacaaaacacacgcacaaaacgatgnctgtggaaacgcaggactggaccaccaacagatagggggatggaaccgaaagtgaattagtagggggtaaacatccgtaactttgnacggtcattaacaacattctccacgagctgcacacctgacaaaaccataataatggtgatctgtaagggttctacaatgttgaataagacttncatcttctaacaatac

SEQ ID NO: 15346 - DNA, 835 bp, Homo sapiens
tcggatctctatcaacattacatagcaaagacaattaaagaaaacacataaaattttgaacctcaactctacggacgtgtgaattctacattcagcaaacttagtttaatctgtgaagactaagtcattctcacatttctgggaattaaggaaatctaaaattaatgcatccatcattcaattctatgagacagaatagaaacgcagaattaagtgtttaccaaatgcggcggggagcaatccagactccaagatctgagctattaatcactgtgtttagctgcttttcatcaaccaaaggatggtttgaaagtactttgtaaactgctattcaagcccattgagctgacaacggaaatccagagtgccttctgcaagacgaaagtatacagccagtaggcattagtgcaccattctttgtttcttcgccttcaaaggcctgaggggccatttgccaccacgacaaaaactggagcgagctaagaccactgagagggttacatgaaggggttggcttgggaaaaaacttggaattattgccttcggtgggcaaaaccggctaagttgggggttattccaccctggtttcttgatcttggggtgccccacacactttgaccatttggatctatagcccaaatttcaagaacctcccgacccacaaactcccaaggtgggctcggtgccgtgcgcttcggaaatggagagaatttggggattcccgccgcacgcccgagagaaggatcccacattcctcccaacccaaaaaatccggaccctcgggggtttaaggggggcccgggtgacccctgcgccgtggtgagggtaggaaaag

SEQ ID NO: 15347 - DNA, 710 bp, Homo sapiens
ctcatgttaaaaatttgccaattaagcatatcgcttcgtattcttatcatagggggggtacgatgcgataaatgtgagagcgtcatagttattggcattttttcgacgtcccgaggatattatttatggttctgattcgggatcattaggcttatttgcgcagtgaaatgggtctgttgttcataccattcgctccgtcctgatttacttagtgccaatcacttttaattcgtagtcctttttccattctgaacttcggcctgccagtctctttggtttctatctacatcatgtggtacttcgggtgatgtgccagaatgtctcgacctctcatttgtccaacatgaagcccgtatccgtctatattccgagaacatggtggcgctgggccggacctcaccgggggatatgatgttggttctctccacacccttattctcaacgccctttatccgcgttcttccgttcacatgtctgcgatggtctggtcctcgtattgttttgtcgcggggcgcggcgccgcccaccctctcaccgtgttatctccccgttgtctctgtatatttgtgatgcttacctcccattcttactgtgtcgcgcgccgggggctcgagtgttgtgtctgccctcggagcacacgcgccgtcgccgtggtgggtatgtgatagatcctcacgcctctgcccaggccaatatttattcacacctcg

SEQ ID NO: 15348 - DNA, 900 bp, Homo sapiens
  misc_feature (1)...(900): n = A,T,C or G
aaaggttatagtggtnctctctgtttctagttcactacctacactgagataatttaagctgactgctgcaaacccgatcaaacccttctctctccgacgcccctcaaaagctaccattataatgaagaaactggaggcccagagtaagttagcgaaagcttgtgtgaaagcattnatgtagtttcacgttcaaancctcgcgctccgcaatcactcgtgtctctttataggtttctacactctggcctctccttttgacagtcccagtcttcgtttagacctgcaggcttgtactccaagactccttactggctagatatatggatgannttctcccttacattcacctcattgtcctagggcccttcatcgcttatatcatcctgctcaggggtagtgcggttgagcggaaagtctgattctatatttttttaattaaacttattccttccactttttntttactcgttgagtatctcctgttgcccgcatcttctatgcatttacacaacgaacccactgtgccttgtatgtcaagagcttgccattccaaaacttaatacgcattcttcctcaccctccttgttcattttccgaacatccatctcgggcaacgttctccccctctgaatatattttatgtggtccntcctttatactgcccgcatttcactcagggtaacccctctataaccttatatccctctcntcattccttttgccctcccacccactatatttaaattagtacggccgtctatatatgagattgaatcttgcataacatccttactctcaccaactaatcctatattatgttatcnctgctgccacttcatctgcttctttattactaatttatccnccataccatcacgtttttctatgtttctattcatg

SEQ ID NO: 15349 - DNA, 925 bp, Homo sapiens
  misc_feature (1)...(925): n = A,T,C or G
agaggggggggtcaaggggtgaaggtctctcctccccctccccctcgggatgcagggggaataaagaccctctcagatgaagaaacactaagagaatttgtcaccagtagaccattcctaaagggggtccctgaaacagaaagaagtgattaaagaaagaatcttggaacatcaagaagaaataacaggaagaacagaaatatgggtgtgctagcactcaatgctaaagatggcacccagttcaaggtcagcaaatggaaggcgtcctcgcccacaactgtggggtgggcacggcttctctatcagagagcgcttttcacctaagtccagatgcaggcctgaagtcttctctggccatccctgcagaaggccactgtgataacctgaattgggaaggaaggagaaggcccggtggcttgcaagatcaccttggtgtttttttttgcctcccgggcagattctcggggcgcattttcccaggggggaaaaagtattagttttgtcttcttggctggaaaacccttggtgggaatgaagattggaagtaggaatttggaggagngcgctcgcatttcttgaagagggtttggggacaattccgtggataacgaagtcgggggccctggagatcgaattttgttggtgcctccccctctaatccttcccctggcgggactttgtcggagaacccgcacgtcgtgtatttgttgtgggcagaccaatggcggacagagcgtgggcccgcaccgccgtctagccctgggggggtcccacaccccgcgggtggcggggggcggcagtccttttccttgggcccggctgcctaccccaaagggagggtgtcccagggaggttgggaatgtgctccgggagtggggggattagccactaaagnctggcgggtttctggtgaatctcctagctt

SEQ ID NO: 15350 - DNA, 797 bp, Homo sapiens
aggtcccttccagcttggatgtcaatgaatgaaactgaactgagacactctaatggaatttcaggatctgcaggagaggggcaaaggaagcaattcagtaatacctttcaaatgaccccacatcttccaagcagtcttagagcttgtggaggcaaatctccttaatgagaacagcacctcaggtgggcagcctgagcccacatggcagtgaaccctgtgtcaatgagggagaatagtggggcttcagcccttccagacagaaagccacatgcacccagcttttgcaatgaatcttgaagatcatgaactgattcgcgttgctgccaagaaagcttttgtcctataaatatgactcaggagtacaggtgaatcagctgtgtgccacatcttcgggaaaataaaatacagtgcttagttagagtttaaagcctgcgactgaagtgaacatgtcacttaaatttattcgctgtgatatccccaccagattgctataaaaatggggaaggatcgtcagtcagtgcagtgagatcaccttcaagaaaagccacacaaaaatgcctcggctcttcttataaaagctgtaagtcctggcctggcacaatggcttgtgcctgtactccaacacttttagaggctgaggcggccaatcacgaggtcaaaaattcagactcttctgccaaactgggaaaccccttgcctactaaaatacaaaaataaccggggggggggggggattcctggggcccagctctttgggaggtgtgcgcggagaaacgttgacccttgaggggaggggc

SEQ ID NO: 15351 - DNA, 811 bp, Homo sapiens
gtagctgcaactccatacccaagatgctggatccacctcacaccctagactaagattctacaaattattatttgacttcctttgaaaaactgattgccagctttataactcgatctgggcacactccccatcggggcctgcatttcctgtggatgatgcattggtttccaaggtgacggtgggaaggaatagacctgttagcttgtggcttctgactcactcactgcaatggacgtcatagaattgtagctgaacaaatggatgctgacaataagtatgtgcctaaggtagcagcggggcaccaatggttaaaacaatcccattgtaccagctctctctccctcccactaagcaagccgacaggccaacagaaataccggaactgaaaaaagatacaacagatttccccagtcatatataagttcacagtgaagtcctatttacatccccgagattttgctcctacgcctggagaatttccttttcctttccggaatgtagaagtcccaggattctgtaacaatcctcatatggaggctgaagaaagtgtgatggaaacaagcccaaaactcaccataagtctgttcacaaaggtgacagcccgcttttgaacttttaaatttgtttcttgtagaggcattcccaggggactaacattcttcagagcccaaatgaaacatactttctgctggaaaaattaatcttcagaaaagttgaatttcttgaaagctggaaaagcctttttttctttctctttcctttttttttcaataacccgacaccaggggggggggtcttcttgcttaaggtc

SEQ ID NO: 15352 - DNA, 770 bp, Homo sapiens
aagcattgaatattgatctctgcggatgcggaggagactgtcttcagactttgtgcgcagcatcaacatgtcctggttctagagcaggctgcttttgaacccacatgtaactctctattgagtctccagcttgtaggacaacgtcattaaattttggacttcccaagcctccacagtctcattagagcagaatttaattttataagtataactcagtatatcagattattgtatattgaaatacaggaaaatttataattaaagttttaaaaagtcttttcactaatcagtatattgaaatgtgcaagagaatttacaaatgatttgccttctatataaagctacagatttttagccaagattgttaaaaacaattttgtcaggcaaattttattaagtgaattaatcacctaagcagacatttctaacagtgcgaaattacttcagggggagcaaaagtcgtgtatatagattaattaatgcagtcaagtattccttgaactggggcacgtaaacaggaccaggtaaaattgctgcattccaaagaaaactcatcttttttatgctgtgaaaatgattatgttgagttaactaccataaaaggcagactcaacctttatagatcccacaaatcctatcgtctcgtctgtatggggggatgcatcatccctcccataccggtcctcaataggcgaatatccacttttcgcctcagactggatatttatggtgtggtcgccactgaaccgcacccttgggttatattctcc

SEQ ID NO: 15353 - DNA, 807 bp, Homo sapiens
  misc_feature (1)...(807): n = A,T,C or G
gtccctagtccacagctaaattgtggtggagctgcgctttgaatgcctcagaaactgttccataactccactactccactgcttctcctgaatgcagaactaatctttgctccttcagatgtgtcagcacaatgtgatagacacaattgaggactccacaggattcagcataacatacaaaagaatctgttactgacatcccagaccccagcatccaagttttagaataaaaacgctcacctgtgctaggaagtccactccacatcctggcagggctctcaccagcttcaagagcaaccaagttggataaacaaaacttccagnatgtgaccaggataatgcacagcgctaccgagacttggctccagccctgattatctgtgtgacaggcacacgttatatcagtgccgctccaagccttcccagttgctggcttattggactggttattgaaaaatcctttacctgttgggtaccattttatggaaacaaccaagccacctctgagcccttcggcaacgaaggtagagcanccncgaattgctatatcctccttgtgtcgcttaacaccaaaacgcactgtccaatgtgcatgtctcanngtgggatttgtggctctacaaccacggcatcctatgcgcttgtgtttttaattgcgtgaatatcgtggactggtgccccccttctcacgccgctccccagcatggtcgcgttgtagaaggccnccgcggagttatgccgcacactcgtggacatatagggtctcnctttagagcncggtggaagggccaagataacccatggctt

SEQ ID NO: 15354 - DNA, 734 bp, Homo sapiens
aattacgtattatctggagattcaactggggaagaatttgcttttgaactcattcagactgttggtagaattcacttagaggtcattcttatttctaagaagtcaactgcgattccttgctatgtggtcttccttggcatgtctgcttatttcattatgtccacaaggagaatctctggatacagggttcttgaaaaacaaagtcttaaggtaatagaaccacagaagtgatatcttgcaaccattgctatagccaagtagttagaaacaagttacaggtcttgccacatgcaaggggagggattattcaaggatgtggatactagaaagtgatcattggaaatcacttagtgtctgtccaccataaattctgacataggggagcaatattctggcttccaagggctctgtgcttacgaataaaaccaggtgttcgtgggccggggttgacctgcctactctttctggccacacgcgaatcatcctctctttggtgcttaagcaacttcacttcaccctcattcttcccatcctaatccaccaactccgttctatctattatcgtctacctcctaccctaccatccactcatatcacctaccttcatgacggttaagtgcgtgtcccgacgagttcttgcgcgcgctaccctcggcctcgctgtatgccccgtcccgtccgactaccgtttgcgcggtgccactatctctttacacttcctagtggtctgaact

SEQ ID NO: 15355 - DNA, 828 bp, Homo sapiens
agattagcacactgaagtccagaaaggggaaaggacctcagtgacatctcaaaagatccaatgagctggaggacttcaggttttctattcactgatgtattttttctccacctgatataaatttctgattaagatcagtatctttgatgaatccaagaatgaaatcaaaattcccttgttttgttaagaagtatgcttaaaataagccatctgaactttttgatacatagaacaggggaacattattttgataaatattcgaaacatctattttgataaatagaactaatcaagccactttttgattaatagaattccaagctataggtttagattttatattacattcaaatagaaaatggcacatttgtgatactcttctctgttgttgaaacagcaataatatgacttacctgtctttatgtcttgactcctttaatgggtggtaggacaatgctgtgaattacctcacccaggcatcagggatgtatcccaaggatcttcattgacaaaacatcacttcccttggcatgtgaatttaaacactatccagtccccataggcttatccctgttacttctattggaaaagggtctgaatggagattacggatatggtgggggacgggaaaaacctaaaagatggcaaggctaaggagccccaccttcccagcgagggatggaaatagtttactcttttagaacataaacacttttctggggacagaggggcaaacttcccagcccaatcccaaactcactctgaagacggcagaaagggggactctcctgggttttagctggcggcaaaagtttcttcacccagggg

SEQ ID NO: 15356 - DNA, 776 bp, Homo sapiens
  misc_feature (1)...(776): n = A,T,C or G
ctttggagaacgcaaatctagaagtaggcagaaagctcgataaaaagcctaactggcatctattgaatgaatgtctccacatgatgatacatatgtaaaaattaatacatctttaagaaattccataaagaaatttgtgaaattttgcatctacatatgcatccatttagagatgacaattcttagtatgaagtatgactctaagaagaagtgagtccatggggaagagctaggagaggagcatggagaagagcatcaaaaagtggaaaatatgagagagaagaaagaagacagacaaaaaaaggcagaagaggagagagaagaagaagaggtacatggaggagaggagaataagcaggggaagaaaagtctgtctctgtctaaactgattttgccccacttgaatagagttgttaataatgtacaaatcatttcatatatagtttttccgaattttgcttttcaggctatcagtagaaatattaggagtttttggtatatactcagcaaacttatggcatatcttttcttctaaagctaacatctgttagcttatagttttctgagatgtataattgttacttcattcttatttgacacagagtctgtttcttgtaatgaatacagttgggacctcttaacacaacacactgtaatactttccaacagagtccttttatgtctttgtattcaaatcattggggatggngtcaaagaacaactcatcttatgttgcactccagccaagaacagtgtgctaggaaaagcccagtgat

SEQ ID NO: 15357 - DNA, 910 bp, Homo sapiens
  misc_feature (1)...(910): n = A,T,C or G
taaaattaaaagtatgataggataaaattcggtgtttctgatcttagacacccagtgtttcacagtgtaaactctgacagaggagaagcacatgaggtgagaccctcatgtgccccagttgacaacctggagagagcttccacgccaccatacagaccctgtcagggacccactgtctccaggcctcctccttgctcatctgtaaagccgaggggtgggccatttaccccggcatgagttttgacattttatgatcccagccttttttgttgtgggtgcagaagnggctataaagatcccaggcttccctgtgtggcttgataattggcttttatccttcatcatatttaattgccaatgggactcccggccctatattgcttaacggagcaagagagctttcccttgctcttgaggttgggtggtggccatccgctgtctgtgtgaatgttgtataattaaccatggggccatagatgtcgatgttttctttcgataaccactaatgcgaccttccacccttgcccgggggctttggtctcatacaaatgtttgtcccgcggggagagatatttatgtccattatttatttctgttggataatctcacactaagaagcggatctgatttagtaagaacaggtgtgatagaaatatttggtgaaagttcgccgcattcttattttaggtactgttgtatccacgttgtattttccttgttggacccggggtggtagcgagttctttcttcttgtgctggttctttttttccgaactcctgcttgtgtttcctatttggtaaaatacatattttgtttcctcttagcccttattgtnncctcttcgattggtaatttggcccaaatgttagatcactcaccgtaaaaactaacctttacatagaggcctat

SEQ ID NO: 15358 - DNA, 809 bp, Homo sapiens
  misc_feature (1)...(809): n = A,T,C or G
ccagttttatggccacaattgctttctccagaagattacancttgagtctaccaagtttcctggccaaagcagcacatccctcctgctgtataaactgagatgtggcagacaggggccacagggaagtgagcagaggctgaagacccctttctcaacaccccacccggccagcagcatcatgctgcttctcctccaaggtcacctggttgagactgaaagaatctggaaaagcaaggttgaaaagccttcttcctcacaggaaataacccgcaaatgaaatcacgagacacagttgttctccttggtgagctgttggaagggcggacgattcctggtccatccattaccatgtaaataattaaacacccagagcccgcagcccagggtgggcagtctgtggcagcaatttgctttaaatattggtgagcctaaactcggtcagtcattagctcctcctagtggctntttgggccttcaatcangaggcagctgaggtgctgctgactntgaggaacaaatccctgattgatgagtagcctgaagtttcttccgaagtgacaagaccgttcgtcacctctcaaccacaggacttgattcctcagggaaagctgccccagctctaagtacaaaatctgatttggtcacaacctacttttacacaaccagggcaaagcatgttatcatctatgcacgtggcctttatgataacaatcaacactgtgtgtgtaattctggcccaaaatagaagccaggcccggtggcgtggttaacgcttgaattccatcactttgaaaggtgagaggggcgg

SEQ ID NO: 15359 - DNA, 739 bp, Homo sapiens
  misc_feature (1)...(739): n = A,T,C or G
tctagggggccaccttcaangtcgacatggnagaagtttaattagattgcctcaagcaagaatgttattctccaagtttcacgatagtggcattaactcccggactgaagagttcacacaggtgagcagctacaagggactgaaacatccacttccgcggcccactccactctccagaagacaagagtccttcagaacagggagaagtttaaaaaaacacatacacacaaaacaaaacaacttctttcacttggaatatccctgagaaacccagggttaatgttcaactctgggtgtgtagtggagaccagcccagcccacaggttcagcggagcagagagcanagaggccagccaaggggcacttccctgctcatgtctcatagtcaagggaaagcacagccttccagccagtgtccaccctccaggggcggtcaaggtgaccaaacggaaacttggtgaaaaggcacagatgcaatcaacatcacacaagctacctctaggtctacacctgcaccatccaagaacagagtcaccatccacctgtgactcctgggaggggggctagtcccaactgagatgtggtggaagaaatacagcccagatctcgaagacttcagacaggacaatattaatatcttaattttcataagaatacctggtggaaggatcctattggtaggatattttaaataaattaaaattaaccaaaaaaaaaaatcgggcttgttggccctagg

SEQ ID NO: 15360 - DNA, 838 bp, Homo sapiens
attatgtatctcattgctcgaaatacacgacccatttaacatccacaaagtgcctcgagagggcacgcaccagaatgactttgggagtatacaaaccgaaacatgagagtgcagtgtggaaatacacatttcgttgctgacatggatggaacatacacattgtgatttattaaccggatgtccaccatgactccaaaaaagagacggcaccactgtgttggggaggctccaagaggacaagaatggaacatagcccaccttacatgctagaacaatgatttttatctatcagtgtctatgacagctgtaaatatcgaactggaccacagggaacggcagtagagaatacactgagccatcaacgacaacacaaacagcacagtggccctttggtccttgttcgaagcttttgttctaattgccatgacattgggacagatctactacctgaagaaattttttgaagtccgcatagttgtttaaaaagcctattccagaagatcccaactcataactatctgtttaccaaacaccttaaatataaaaaatgtcattattcactccatatttatttcttctgaaccgcacattccccaactcacgtctcctttgaaattaataaaatattgggggaaaaaacccctttttaggaaaatcatagtgaaaacttgacagtcgatctgcgataatttcttggcttaaaggctcactcccctctctcaggcccttccagaaatatgtcatctgtctgtcgcatgatggccgcataccccatctaatattagcgtatttcccttttgtttcgcctcatatagcaatcggttaaggaaatactcca

SEQ ID NO: 15361 - DNA, 789 bp, Homo sapiens
tgggttctcagaagcacatgagagcactctctctgttctccaccatgtgaggatccaacaagaaggtggccatctgcaacccacaagaggaccctcacaagaacccaatcacgttggcaccctcatctcggacttccagcttccaaaacgatcctcaggcatcgggtggtggaagaagcagttgctgttctccccatgctagaactgttcacatcccaattttgtgatggactctttttattctccttttgggttaaccaactgatttgaaatccgacttttcaccctcttcaagctactgaaattcaggcctctaaattcagtaccttttctgagtgacatcctccaccagccaaaacaatgttgtagattgaaattctaccttcttcaaatgctcctctgcctcctgctgtccttttcttcttctacctcacttgacaatcatcctcctctgtctcctttccatcatgtttccctctcccttctctccatgtagacacttcatcgtgatcttccttggatcccactctcctctggttaactgacttatcagatctgcacagctgccctgatgagatctctgatgagttccacatttacccttgcagctttctggtgggcgccttgaccagtgtgttccaccagggcctcaatttccacacttttcagttgcatctgcttcccttccatcatctttctcatcaaggcatcacattatcatcattcatacctgtgacttccctcgtgctaattctctggctccattaacttgccagtttccaattcttc

SEQ ID NO: 15362 - DNA, 811 bp, Homo sapiens
  misc_feature (1)...(811): n = A,T,C or G
taggggatgcagcgctggaggaaggcactgggtatggatgttgaagagagaaacccaaagagttccttccatactggaagaagacaggaaactggaaggattttgtaaacggcttgaagttctttatgaatcaagagcaggggctttgtgtgcacaaagcagaaatattcaggagttaatgctccctttgggacaggccccccccaaacaatgatggatgggatttgaagagtaaacaccccgtcttcttgtccctcatatgatacaacactgaggattattctatgcactctttccgaagtccccagcaggattaagcttcaagagctcatggcagacacttgcttactgataacacgccttggattggcagctgcttcttttagtctcactgcccttctcttctactggtgtttcctgggatcacctctcaagtaaactacatacactcaaatcctcatctgagggtctgcttgacctcagtgaatgatgattagaactaagcaaaagatctaggtactctctgatttggggatagacacacccaaattattgtttagtattctggaggatgcaaaaaataagccagctgtgagtctccttagaaaaaatggacatgttnttagggtaccttttttccatacataacaatctgggcctacttagaaatataaagttctctgaaacttttaaaccctgaaggaaactggaaatgtttgaacaaataaaaatatttacatagcttatataattttcaacacccttcacagatctaaagtcactttgttaattaagaaccataaaatgcctt

SEQ ID NO: 15363 - DNA, 813 bp, Homo sapiens
  misc_feature (1)...(813): n = A,T,C or G
ctagagtcctacttcgttaccagtctggagtgcagtagcatgatctcggctcactgcaaccttcacctcctgagttcaagtgattctcctgccttggcgtcccgagtagctgggattacaagtgtgcaccaccaagcctggataattttttattttccttttctttttttttttttttttaagtggagatggggtttcaccatgttggtcaggctggttcggaactcctggcctcaaatgatccacccacctcagctttccaaaatgctgggattacaggcataacctgaagcccttcctaaggagtagagtgattctcatctgctctcaacataagtatgtacctctaatcctgagcccagtccactttctaataccatttgaagtgtcagcaaagatcagtagtcagcctctcagagtggtgtagggaatttccagtgtcccgtagagtgacccatgtttgagacatttcatagttagggaaaggtatcagcactgacttgccattgcccaggaattcttccagttttctgggcttcatagctacaacagacttttagaggaatttgcataattttccctcaaacaagcatatgattgatgattggataagtatagaaaattttttcaagaatagtttttccaatttggaaaaacctatttaaaataaaaaaatattgctcatggtatcattatccaaagaaaaccactcttttcactntagcatactttctaagattctacctatgttttacaaaattggtatattgttattaaaatctgcccccagtttttttgcatatgccttggctt

SEQ ID NO: 15364 - DNA, 767 bp, Homo sapiens
tttcatagtggaaacatctgatttacactagacaatataggaatgaaaatattgtacattacagatacagttaaaagagatgtctgcagactagctgtgaaaaggatacaaagcaaaacagaaaatggaaaagttgcatgggatgaaatccaatggaaactagttgcaagtgaagtcaaataggatacagaaaaacagactggtgatcatctaaaactctgaagacagatgaagatggagtctctctctgtcgcccaagctggagtgcagtggcgcaatcacggcaagctccgccttccaggttcacaccattctcctgcctcagcctcccgagtagctgggaccacaggtgcccaccaccacgcccagctaattttttgtatttttagtagagacggggttttaccgtggtctcgatctcctgacctcgtgatccgcctgcctcggcctcccaaagtgctgggattacaggcgtgagccacctcgcccagccctttctgtgtaatattttacactaatattttaataataaagttatgattcaggtataggccttaatctctgttagcatcttaatagcataatatcatttttaatggtattaccattttaaataattctatttgaaatgcaaaaggaagataaccctgagatataattgcagatttggcttcaaaattattttaatgaatattattggcttaaaggatgtgcaaattaaattatgtttttattatcactggttcatgatacttagacatatagag

SEQ ID NO: 15365 - DNA, 1300 bp, Homo sapiens
  misc_feature (1)...(1300): n = A,T,C or G
gacgcatgcgtgtttttgttcagacgtgttgtctatctcttatcgcatatattttttcatcgtttatgtctctctctgtcttccattgacttcctacctatcgtgctgagttttcnccctgcttttgtcgcaactgcattgtctcattagcaccaacaggtaacgtcctggcctcgactattcaacaacgcatgagtctncgcaantactgcacgcgcataacctactcagtcgtcaagtgtctccaatctactagtctngctcgtcgacctctcaacaatactttgcctcaacgatacatgtacacatcaaatgtgattcgtccgacgcacnaatatctaagcgcgtgtgtcacgacgtgatgtcgcagctaaatgtatacgtnantcagcgactcatggcaaanttacgcgcttcgccaatcacttgctagtacgtgagtacagactacgcacgcaccancgactangtaatcaatgcacgatgcactaatctacacctgcgtaatagctttggtacgtaatacatcatatggtgtttgacgacgtcccagtagttgtctctttgtgattaagcacgacactgcacgagcgatacctatcatcgttagctgttctccatagtcgaccatctcttctggctattgccattgcatataaacagcctgctaagacatggtacgtcccgtcgctctgtagcggcgttcgctctttaagtgatctcgacactgggatcacccatctcgtcaatccttcatgcaatgctatacctcagtcgcgtgcatagtacgccttctcatatatcgtcactattgcgtctactcaccgatcctattattcgatttgtatactgcacgtntcgtccgtgtactgtatgtcacgtccgtgtcgccgttcgcattccctcgtgcattcgtatcctatcgccataatctccganttcgtcgcgcgcatcagttcgcagaatatgcgcgcgatcatcgcgccccgctatgcccattcgtcgtacgcgttagacggtcatcgtattccgtacgcgtttattcggctgccgaatcatgtcataatctcaatcttcatccaacaatgatcgtcaccttcgccacggcatacgcgcattacgtccataaagtgttgccgttcggtccacgattgtcaccgtccttatgcatatatgttgcggtatggcgtatgcatttcaatcacgtgattgttgcgtcgttccggttgcatttttgatcactattttctccgctctttcttgcctttcatgccttctactgcgcgtcacgctacatatg

SEQ ID NO: 15366 - DNA, 802 bp, Homo sapiens
  misc_feature (1)...(802): n = A,T,C or G
agtgaatcagtcggccctccctatccatgggttctgcctctgcaanccaacatggatggaaaaatacagtattcactggatacaaaacccacagatatgacttttgctagaaccaactgtggaacttgagtatgcagggtcctggaaacaattcccggaggatacggagagagactgtattaagatatggattatttaccattcattctcccaaagcgacagtaattagaagcacctgatcatgttgattacaccaataagcagaggaaaataaccaactcctcttcctaacatctatttgttacttcctgtgcgtgggaagtcagaagggaaagagtcttactatggacatcatcaccatttcatcttcattgtgcctagtacagttccttgcatgtagcaccattcaacagttgtttattaaatgtagaacgaatcagtttatggaactaattgacactgacaaacggaaacatgtntcattatctntgaggaaagaaaacaccaacttcccctgactgtaactcacagncgctttctactttccttcttcctgcctcatgcaaggtagatcctcagaaaagtaaagcctgacgtgggtttgtgccctctatttccaggaagaaacaggtgaaaaaggtgaagggaaggagaaaaagaccaagaagaagaatttgggctgaaccaggagtggagatagcttttgggagctggtttttctatcccaatgggctattaccaacccaagcgatagctttcttgaccctttattgagccgaattggtttaaaatcttattttat

SEQ ID NO: 15367 - DNA, 826 bp, Homo sapiens
cctaggccagaccctggttggaattctagcagaactatgaaggcctcaattgtagtatgctctcaatcaagaatcatcatgaactttggtatagctgctaaatgatgttgaatgatgattaagaattatcgcgaactttggtatagctgttgaagcaggacagacagaaatcaccttccaatgtagatgatcaactgacaggctccaagttggcaaaatcactgcatctattatgcagatatatacggtatttaagggtattctcaatgataagggctgtactttccaatacaagattaatttggacatcatgatctattaaagaaaagccatacacagcagaattattataatttctaagttacttacactttcgccttcagacttggaaccttgttcctgtaaagatttctggaggtcctcaatctgctgctgcaattctcttatacgctctttggtcagcctattgtaagatggggcataagcatttacttgtattgaaagtcaaagcagttaaggatctacaaaggaccatcagttagcaattaaagtaaaaattatttttatagcaatgacatatgcgggataattatttgggcctaggtccatatggaagtaggggaggctacttctaaaaagaaaactttttaaaagaaaaactttcttcctgaaagtatatatgcctacatttaaaaatttaaaggaccttaatgccggggggaaaaaatttctcccccgcccttactggtaaaaaaatcaaaaaaccggctaatttttcttacgttgtgtttttatgaatgaaaactaaatttcatctttggttcaa

SEQ ID NO: 15368 - DNA, 820 bp, Homo sapiens
  misc_feature (1)...(820): n = A,T,C or G
agtttgtgttttgtagaaacgtagaacctgagaaaacactggaatgcgtaagctcattctggagtttgttctgaagaagtaaggtgcatatgatggaacaggaagaatgaaaaatgcaacgaagaaaataaaatgcaacttaattattaaaagtgttactgctggggcaactgggtctcttccaacatgctctgataaaactgtgtcttagaatccttcttctgaaggatgagcacccaaggcaattatccatgacttccatgtctttcaggccacaccgatgcaaggggtgagctcccaagactttgcgcatctctgtccctgtggctctgcagaatacagccccttcggctgctttcagaggctggcgttgaatgcctacagattttctaggtgcatggtgcaagctgttggtggatctaccatcatgggatctggagaacagccgtcctctcctcacaacttcacaaggcagtgctccagtggggactctgtgtgggggctccaactccacatttcccctctgaactatcctagcagaggttctgcatgagggctcttcctctgcagcaggcttctgcctggatgcctggacatgcaagcattcccatacattctctgaaatctaggggggggctcccaagcctcaactcttgctttctgtgtacccacaggcttaacaccacatcaagccgtcaatgtgtatactttgcaccctctggtgcagtggcctgagatgtatctggngctcttttagccacagctgcagctggatcagcacctttagagactgtgatctcctggctgtgcacagagtctg

SEQ ID NO: 15369 - DNA, 906 bp, Homo sapiens
actggcctcgttcttacgtcaccgcgagcagagccgggggccttcgtaatttcttagctgaaaaagtaaagcagctgatcggaatggagttccagacgctcaatcttcccaatgaatggtgatggggtgcgaggatttataaaggcaccacctcgaaactattccatgattgttatgttcactgctcttcagcctgaccgggagtgttctgtgtgcaggcaagctaatgaagaatatcaaatacctggcgaactcctggcgctatttatctgctttttggagggggggtcttcttaaccgggggggggactatgataagggggaccagactggctttcaccatctcaacatgaacgtctgctcctaacattgcatgcattgtccctccaaaggggaagaccctgaagagaactggttacttttggacctccacaaatactggatttgccacctgagccaacctagcaataggggattggtgacgcgaacggagaggttcgtgattgacgtgttttaaaaccacccctactacctctcgggacccctggcttttggcccttgataagcgcgggtgtggttcagaggctaatcttatccaaaaaaaaggaaagtcgtggggtggctatcagaatccacgagttggtgaggcccgtagggggtgttggggggataggccgttaatgacaacctcaaggccctagagtgttgaaaccatgtgtcctaggactcgtcgttagtgcccacgagaggcgcacgagggggtggccaggtgggccgctgtctgtagtggagggccgcgtggtgcacggggggcgagtgtaatacgtattacttttgagatataaacgcgcagtatcacccatgcggggagtgattcaaatgatgctgctatctccgagtgggttg

SEQ ID NO: 15370 - DNA, 822 bp, Homo sapiens
  misc_feature (1)...(822): n = A,T,C or G
agaaggagagaggagagtaagcacgggggggagagaacaancaatcaaagtggcggacttggactggatccttcctccttagattgcagacggccaactgtgggactacatcttgtgattgtgggctcgggctgtagcccaggctggactgcaatggtgtgatctcactcgctgcaacctctacctcccaaattcaagcaattctcgtgcctcagccttctgagtagctggaactacaggttctcagatactctctagggtgtttgggttcttaaagggggggggtctttggctgggcaccatggccttggctcaccggccagcctcaagggtctaatcgcagacacacatttaacatgggactcatcacactacaaaagcactggaagccaaaaggtggaaatggaatttgcacttgggtgaaatcaaggggcccccaagaacccattggccttggaggctctcagaagcaagcaggtgcttgcctcttccagcctcggggggctggcaagattccttggcttgccggctacttacctccgtgcttgaagggtaaaaaaatctccccagaagaaagcacctgaaagttagatattggaccaatgttttacttttgttcaggatgaggggtcagctgggccgtgccaatggttcgagagagggcggccgacgtgggagtgagagtcgttaaacaatacggaacccatcgggcgctggggggggtgaaaagcgcttgccaaaagtggaggggcctatgccggggaaatcaacttgaccttgggggcagggtggagcgaatgagtaagtaaggaccgcggggga

SEQ ID NO: 15371 - DNA, 820 bp, Homo sapiens
  misc_feature (1)...(820): n = A,T,C or G
cagtttttcgaaattaactgtgaagatgaaattttctgctataaatatggcagcaaatgaagtaatgatgacactgttgagaaaatggggttatgaaatagccacatgcttgttctgacattctacaaatattccatgaggttgttttccatattggctccctggaaagccttagaaattctcaagaagtcttggctactgattccagatatccgtgtcaagaaaattcaaaagccggggtgaaaaagttgacaatgaaaacaacagaaatgtatcggaaatatgaagagtggtttctaagatctaatatggcagaatattctagaaccaatttatgtgtctccctctatgcattcaggtttcaattaccaaggccaggtttcagtcaccttgtgggtgttttctagatggtaaaggtaccttacctgggggtgtgaaatcttggctgccacctgggttactcaccaccacacactgccacactggctggtttttaaaccttccccaagagatgtggaccggggcttagacatggcatccactgggcctgtnaaaatggggagggcatagctctcacgcctaaggctgacccctcctggaaaaaacaataatttggctttgccaaggtctgtctaggagggccccagacctcattgggggtgatggggcaattgccccttggaccaaattaggagatgggaaatcgggaaaacccagaaaaaacggtccagtgcactttttgaattaactttctgaaatgggcgggggttccatggcctctccgggaagcgctttggctcgtttaaaaagtggaggggcg

SEQ ID NO: 15372 - DNA, 838 bp, Homo sapiens
gggagcgggggtgtgacccaatccgcagagcactaggagaggggcttcagcgcaacacacctttgacttctcaggtggagcgtgttggcgtgatcgcagctaactgcagccttgacctctcaggcgggagcgaggctcttaccaagaccacaggaaaccaaccttcagagctcccagatggtatcaaggtactgaaacttaccaccagaacaccacatgttggacagggagatgccagacccctcacccattatgatggcctgactgaccacctgctgcctaggggcaaactcctctttcttacccctaatgccaatacatggttacagtgggttccctgcgattccaatgcgttaaatttagggcatcaaggggaaggggtgtgagggtgatatcccatctccttggctgcacgaacgcgggaaggccgtgttgcctgaaaagagtcactgactaaatgagtggcgagcctgcggcccaaagcagctagaacctacaccagacactctgggtgttttagaacagctccatattaaagggcaaagaggtggttggcgtgtgaccaggggaaaggaaagtggagtttcgagggagacctcagctaaccagtagacatcttgcacttccttgacgtttaaggaagggtcgctcgatggcccgcgttacacactacgagacatttgtctgtgcttacccaagtgctgcgacggggggggaggggtgcctgtctacactttctccccctccccttctaataactcagcgcgatgctgctataaggccccgataaggggccggttgcctatttcgagtgttcgattttattctatattgatag

SEQ ID NO: 15373 - DNA, 890 bp, Homo sapiens
  misc_feature (1)...(890): n = A,T,C or G
aggtgagtaagacaggagaaaagtaaatatataagacgtcagtggtactgtccccactgctggcaaccccagaagtgccatcagtgaccccgaaccctgttgaaggcctacacctgctgaagaagctcatgcccagtttgaacccactcatgactgagcccaaggacagtcttgtctgtgccaagggtcctggcggctgcgttgaaggactgaagagaagctcactacctagataaaaaagcctcaacaaaacgacaaatacttcctggtgccaacagagaaaagcccacacatgtcttccagcaaaatccacttgctgtttgcatttgtgatacgtcttattgttttggaatggcttttccctgaaatgtttcccctcagtcctgttctctattcctttctactctattttatattcactcccaacctggggcaggatgggggaaaagaatgaaagaagaaactataaacaaaaatgggagtggttacgggaaaattattttcactggcatgttccggctctaagggaaaaaagaaatcaccctttttgcttttctccagtaaaagaagcgataccccgacaatggaaattcgggcctcgttgggccctaacgggtggagcttttggcggcccctttcccttaagtgggggggttatatctcgatcctccgttccttgactcgttgggctccgagtggttcggttggggccgagtgggtttccncttaatttagaggggggtaatacggtgtattccaaaaagctaaggggaatcccgagggaagaacctgggtggcataaaggccagcacaaggccacgaccccgacaatgggcgggttggtggacgtttttcataacgttctcccccctggcaactctacataatag

SEQ ID NO: 15374 - DNA, 773 bp, Homo sapiens
cagatggagtttcgttctcgttgcccaggctggagtgtaatggcatgatcttgactcacagcaatctccgcctcccgtgggcaagcgaatctcctgcctcagcctcctgactacctgggattacagatcggtctccaaccattttcaccctctcttctctaagctgacctgtatgcacaccatcaacaaattattttctgccctggcttccagctgggttcagtcagtgaaaggcactggcagaagactgaattgggatagggtaagatctagcatttattctcctagctccctctctaccagatcatcaaaggttggctgtgtcgctcaactcaagatcatagctcatgtcagactgcccttctggcttatagctctttctctagattctaatagcattccttccctttgccccattaggtagaagcattaatggttcccactgttactaatcccaggcattccatgatgtcttgtggttttccctaaattctggccaaacctttggacatcctatagggtcttattgaactctcctcaattacctacttaagcatgctatctgacgtctgctaggatcctgatggatataccttttgaattgctacctcctttatctgaaaagtgaggacaacaatagatccggcttcactggaatactgcaggggtaaagaaaataaggggggagattatttagcccttgtaagggggaaaaagtcatggggtggggactaggacgggggatattatgcttaaaacgtagggaagactaa

SEQ ID NO: 15375 - DNA, 856 bp, Homo sapiens
  misc_feature (1)...(856): n = A,T,C or G
ttaggaaaggaattgaaagcacgtggagttaggtggaggaagtagattaagtcttctttgagccctcagctcaacagtaagtcctccaaaccaagagcatgcacatgaagagcaaagggagattacggacctggtctacagatgtgtaactgaagaagtacgatntatgaaaaggacaagattcgcagaaactaggatactagaaccaatgtatacatctacctaatattaagcacctaaataacagaagagaatgagatcttacggataacaaggggaagagcggggcctacaaactagaatagggtggcttaggagagacnagctagatttgcgtgaagtccacttgaagatcttgtgagcctgataggtgacataaccagcaagaagggcatgacagcatggtccctcgtgtctcaactgctgaagcaatttggtactcgtgtttattctaagtgaaacacaaagacacacacaaaaggcttaagttttctatgatagacccaggacttcatgctacaagagacaataccaaagtgcgggctcngctggcctaaagccgtaggaggttgtgctgcccgtttccctttagggaggnncaattaatgatccgttgtcactgcctcggtgccctcgggtgggtcaggtggcggaaacggaatcaagtcactcaatggcggcatacaggtttccagagactgagggggcncacgggaggaacatgggtgcaatagggcccgtatacggcgagaagccgtaagcgggccgggtggctgtaatttttcaaagggttcacgccctcgagaaggttgcgaaatccgcgattagccaaaggcggtaacctcccaagatattc

SEQ ID NO: 15376 - DNA, 809 bp, Homo sapiens
agggttacgaaataatctatactggcaatttctgcaagtttgacaagtcatctgtctttaaaattggggcaagacaagggatggggaaaaactctttgtgaagagagacggtgtctcagagtgtctcactgtgtcaccgaggctggagtgcaatggtgtgataatagctcactgcagcatccaactcctgggctcaggtgatcctcctgcttcagcctcctgagtagctgggacggggggctcacaccatcacacccagctaatttaacttttgtagagatagagtctcactatgttacccaggctggtgtcttgaactcctggcctgaagcaattctctgcctcagcctcccaaagtgctgggattaaaggcatgagccattgtgccagtatggattgtttgtttttggaatttttatttaatattctttgactactgttgaccacacttaactgaaactggcaaaactgaaaacacagataaagggcgctattgtattttatgattcctccccatttagttactgtgggggtgctactggagactggaatctcctgtccctcaataacctttccactctattggtttatcatctattgaaaattttcacccgaatgaaatttactggctccattctgaataagaaatttaccacttaataatcaattttggatggtttaagccagatttctatttggaagaaagggttttggtatagccaacttggcctttctcctttaattatctggcatccaatacagactcaggaattcatttgattccggattgttaatctatgggcgtgaat

SEQ ID NO: 15377 - DNA, 906 bp, Homo sapiens
  misc_feature (1)...(906): n = A,T,C or G
gcctgagtgcaggtaatggccggcgggttcancgggngncggnttcttgcattcacactgggagcaacatgaacagtctgagcattcaaagttcaagatttcaagacaatcagttctgtttgcctgatcgggagggggaaggtaattttaacatgaccttgctactcccttggatgaaaggatcatcacgaagttttacaacaaactttatggttatggaagttctatatttacatttggaagatgaccaaggtgccagtagcaaatattttaattaaaaatatgggggggggctggtccaatatgtgtagatggtaaaaaaggagacttatcggacttgacggggcttatgagagtggtgaaaagctggggatctcagatccgggggcacacatggggagaaacggggcggccagtcccaggggagacgctgcaaatctgcaggagacactggggggccggtcgcagtgggtcggtgctccccttcggagctcggccaagggccgctaagggtgggcgttggtgggcaggctcccaaataagctcacgcttgggaggtgggggcagggggaaggggcggcgggcgccggcgggggagcacgtacnccagagagaggaaggggggcggcggccgcgcacactaaaggggcgggggttcacgagggagaaaccgcaaggactgtgtcctccggaactctactgtcncctcaggagaggctctgtggtctaggggcggcccagagggggggtgggggggggggggaggagggcgcgcggcacagggagccgtccaacgcgggagagtagcggcggagctgcaagactaaactgagggaggccgggagacggaggagcgcagaatctgcatggcgcggtacggtaggagttcccccacctttgagggcg

SEQ ID NO: 15378 - DNA, 827 bp, Homo sapiens
  misc_feature (1)...(827): n = A,T,C or G
gggagggaactgagggagggcaaatgtggagggggnnncnncttagggggccgtagaacaggatgagctggataccacccatagcgcacacaagctctttgtgagctgttcaagcaaaaagagggtatgggggcaaacagcccccatctctacaggaggccaccaggatgctgctctcacctctcaccaggaaccagagactacagaaaaagcaatgcaatgtctcattgagtttgcctcccatcagctccccctccctttttttctttctgattccttgggggggggtaatccatcatgagaaagccagaaatcatgaaatgacagtgtgtaaagtgacctttacaatcaggggcactgggttggaagacatggactcggaacacctgtgggtggtaataaacaagaagatggccttattcaaagatcacatttggccaaaggcctattctattgattatggatgggtgaaaaggcaacccttttagaactatgggtacaacattcaaggggggcagtgcttagaatgagggctacctttaacactaagggccaaaacaggcttttgaagggtgggcacgcctagccggggaaaaggaacaagatggtccctcaacacgtgaataaatgggctcccaaggggggtttctcaagaggaaggggaaaaggtgcgccaagaaaaaaggggggggatgaaaaaggggttgtggagaggatcggcgagccatggggatatattgacagaagaccataccctccggggcagggggaacgaggggatccccctttttgctaattatgtggaaaaaaaggctggcgcctaaacc

SEQ ID NO: 15379 - DNA, 1084 bp, Homo sapiens
  misc_feature (1)...(1084): n = A,T,C or G
tacttccanctggnatggnaactttacctgaactccctaagtcacctcgccaaagccaaagaaatgcaagttgcctgcagcttcaccccggcacatccgccccagtggtctcacctacaagcagccctttctgtctaggcaccgggcatgtgtgcccctgcagatggcccgccaacaggggaagcagatggaggctgtctggaagaccgaggtggcctcctccagttacacaatagaaaaaaagacccctgccagccttccccgggaccagctgaggggacacccagatattccccggctgttgacactggacgtgtagtcctcctgccacaaaagcctgaacttcctgaaggcccagtaagcgcctcagcgaaccaaaggaaggaattgccaggaacctacaaatgaatcccgcttagcttggttcaaaaaaagttcaaccggagttcactcccctggaaccccaaattaagcccaggaagggatccaaggacaggcccccagttctttccaactggcatcccctcaagcccattggatttttcccaacctttcttggagggggaccgggaaaaacccccacccgaagaaacttttgggtccaaaaaatggccaagggtttccccaaggccttgggtgggcttttttaaaaaggaaaaagccccctttttggggggggggtttgggcttgggaaattaaccttaccttaagaaaaacttttttgggagggaaaaaaaccccccttgggcttttttccccccttttacctttggcaaagatttccccccccccaaaaaaccttcttttaaacctattttttttaaaaattatttaaaattttaaggaaaggggtttggggggccttttaaatttttttcttaccactcattatataaccctaaccttctcgtgggggggcccttctgctttttgggggccctcttttaaaacccgcgctttgggaaaaaacccttcttctttctcagggaacccccccttttttgcccccttttttcaaaatggagaaaggggggtttttaaaaattttactattgaaaaatcccccttggggtttttataaat

SEQ ID NO: 15380 - DNA, 514 bp, Homo sapiens
aggcattgatcctgagagttctccccagcaaacttccagcatacaaataggtgcctcagaggcgcctcatcctaagacagggtgtggcagacagggaagctgaagcctggagaccatctgagtagacggtgagcaaaagccatgaggtaccagacactacggtctcacagaagtcattccgaggtcaggagccacagattaaaaatgagaaaaaaaaagtagacggggtcaagtcactgtctcaacgtatcctgaacatcagctgaagtaacgagaagttgtttttcctccctgccaactggaaagagcctcaggaccacactcagccaggcaccagagctgggcatctgccttgtgtctgtcttgtccctccacttcccttgacccttggaccagtgacagggacactctgcctacatttgtcagcctctccctttgaggaactggccaacgttctctaaacagccaacttctggctgcagcgttgttccgaataaattgacctagaacaaaa

SEQ ID NO: 15381 - DNA, 792 bp, Homo sapiens
tttacatgaggattacttggatcagaaaccggagcctgatggcaacctcccagggcatgcgtgcggagtgctggacagttcacgattcgtcaactgctggactcgttttgctgagtggggtgtccaggctgaggacaaatctgagctacattcctcaagacaaaggaaggcactcattgagaaaaaggcaaagaaaagaaggagatacaaagagagggtcatgctaatagcccggtctgattctggtgaggaattgggtcatgttttctgtcccgttagaccagtatggaaggaggctgtggtgtgtgacagccaaactcctgagacggtatagagaagataccttatcttcacggacacagtctgattaccgcaactccgattacgatctgatctgtgtgaagacccttcctgtacctgctgatcctcgacagcttgggagggtgtcggttttgtataaatatgatttctcaaatgtctatacaaggctaacatatatttgcttataaccttttcttgggaacaaaatcacaagacagggaaagctcagttaaataaaaatgtgtggaacacagtttataatcacacatctttctgctggaggggttatataaattaatgcggaagaatgtgtgggtggacaagaatgatagcatggcacaatagcaaaaaagctacgaataacaaaatgtgacaactttgcgccaaggacaattgactcacacgctatcattactttaagaatgcctacggaaggaaggagaacctgagctccgggagttggacgaccag

SEQ ID NO: 15382 - DNA, 438 bp, Homo sapiens
agaataattttttttctttcagattaaagccgcagcatctctcagttgaaggcagaggtataaagtcaaagactccagaagttcttggaaaatgataagtcaatctcttgacaaatgatccagggggcaacttcgaattcctgtttctatctctacctctctgattactttaacaagcactttctgattggaccttggtaattccagcaagccaagactttccatgggacttcaccttaccctcttagattactggcaacctcgcatcccctgaattcctgttcagggagaagagcaagtccttccttcagggactggagaatgacaaccttcacagaacccagagctagagactgaggactcagaatgtagactgggaataagagaactacagccaggggccaaatccctccagccacaacaacaaaaaaaaaaaaa

SEQ ID NO: 15383 - DNA, 847 bp, Homo sapiens
agttttgtgatgttttagccccccaccgtatggaaatatttaatttattttaagttccttgctttagagaagctttgctgccatgtatggagacaaatgactgaggacaatgtccggccaacaagcagaaaggaaatgaatctaccaccaactatgtggacatggaagtggattcttttcctgttgagccttctgatgactccagctcagccgatgccttgatgcagctagcagctgctactggcctattgagatcatggagacctttttctctctgctccttcctgctaaacccaactatagaaataatgcagcagacagccatgggagaagcctggagagcatgaagaggaaggagaactcatgacttatccaggaccccagaactggaggaacagcagaccagcggggcatctcagcttctcaacccaacataaaaaggccacctagactcagcatttccccacccccaaaccagcaacattgtgaccgttcaagtaggaacatatttcccctgggctgacctgatattcttgcccctacagcatggggcatcaaaacggactcttgacaataacaacaatcagggaacccactctccctgtcaggctcgaagaacgattcttggccttaagaagacactgtctctatttcggaaaacccatataataatacttagaagaataagcgcctgttctcagagtagtttttcgctcccctgacggccagaaactccccgggaactgggcaacccactatttccatttcctcagattgttttctcacatgcacttgacaacgccaatgagttgtcctaatacggacggagcgcttctatatgtataag

SEQ ID NO: 15384 - DNA, 868 bp, Homo sapiens
gtttttttattatttgtactccttgtttgttatatctatattatgttacattttatataacgacaaggaccacgacattttcagtaccgtaaaagctgccaacaccacgctacaggaggtgccacattatcctattttcattagggctatatacagcataaagaggctattagttggagagcagatgcatgaaatgtttttgtcaaatggcatattctaaggtgaacaggttttcacaaatggaccattaatcacaatcctctgatactaccaattatggaagcagaccaacaattaacctgcaaatgagaagagccctttcctccgttgtaatattaagagggcaatcatattggaaatgcaaaaaggaaaactgatttgctgaaacatagacattcttgagcagaaaacgcttcactttttaaaaaataataacaaacattttattggcttttttaactggatgaattggcaacattaaatgcctttgaaggtatacctggattaattagctacccttacatatctttattttattggcatttctgctgaaccttggcttccttaagtccagctctctaaaactagtaccatctgaaatattcgaaagccttgtttaaaaagcaaaaatagctaaccattcacttggatattttggattcttggtgagattccattgaaaatataaaataccttctactaatcctcgacaaaagtgatttcaaattttgatagcacatcgcactccaattataagatcttctctacgttgcgaaggagcattctaatgaaacttgttcttaataaatataataaagtgaccattgtgaggaacaataatataaaatacgtcccctacagctcaaag

SEQ ID NO: 15385 - DNA, 474 bp, Homo sapiens
ctagggaacagaaatgaactgaaatcagaaacagaagggccaaggaaagaagtccatttgaatggggcaaccactgaaaggagtgactacccacccaacaagagctggcaattcgctgctattaaccgtgactgtgattcccagtccgcccggcagttcctgagaaaggcctgcaatgtctcatatgcagtaaaagctgtaagatgcaccctggccagcacactcgacctgatggatgtacaatcctcaggaacagtaatggattgagcacacttgcgattgaagcagggagaggaggcccagacccctacaaagggcctgctgatttaacagtcgctttacaggtaattgaacttttcatgtacctgaaaggctcaaggtgatggtagaagaaacggatcaacaatgattgaatcaaaaaagtcaataaatacaaaaggattcctcttagtgatgatcacaaaaaaaaaaaaa

SEQ ID NO: 15386 - DNA, 832 bp, Homo sapiens
  misc_feature (1)...(832): n = A,T,C or G
agtaataatggacgagaagtagcagcaagttaaatcnnaactttctaggggttgaaaatagcaggagatcactaccttggaagagaagaaatcaattatgcaattgaagaaatcaattattttcacttatggaacttactgactttaggcaatggatatatgacttcatatcttttagagaatgcttgggaaaaaaataaaactgtatgttccaatccaaaaacttatctacaactacctataacctatatttactttgaaaaaaaaatcttattgtacagactagcctctcttttcaattatcattaggaatctcagagctgtagttttgttttgctgttgttgttggtttttgtaattcacctgtaagtcacagctgtctagctgaacacagcatccaggcaagccacgtatcttacccaatcatgtgtcccaacttcatatattataattatctgcattatctcaatttgtattaccttaaaactacttcaaggggaggctcgattctacaatgaagctctaaaatgtgcaatgttaggttactgtttttgtaattccacagtaaaattccatatatacccttgaagggtaggattatgctaaatcatgatcatgcttaaggatcccagtatcttaatcatccgtgtaccaacttcatattatataattatctggggtatctcaattcgtttacccttaaaacacctcaagggggaaccccaatcctacaatgatcctttaaaattccacttgtagactactggtttggaattccactacaaattccctacttcccttgaaggtaaggacatgctaaattaactttgag

SEQ ID NO: 15387 - DNA, 779 bp, Homo sapiens
ccttaggaggcacaagaagaggtcattgtgaatgcacagcaagaaggtagatctgcaaaccagaaagagagctctcaccagaagaaggccatgctagtatcctgatctgagacttccagcctccagaacagtgagaaaaacatttcagctgtttaagtcacccagtctatgatattttattacaacagtctgagctaactaagacacacactccagatttggttatcatatttattatatttaattgataagttacatttccattgtggcttgtcaaaagacttcaccttgttattgtaactagagagtcatgcattgatctaaactttcagatttctcagacaaaaagaaaagtcttcattattcctactaagaagaacaaagctaaatcaaactgatgatcttctctacattttgtgatagatttctagctctagttagaaactgatacctcatgctttctttctccattcccacaccttcgtacccaggagcaacatttgtttgtttgacagcaaaatattaaccctggagacctgtcctggcagaattttatttaatctttacttagtaacttaatctccataagaccaacagtgacatgatttcatttgacaccagtgtcacctcagtcttgaacagaaaatgtgcataatgatttgtaataactttatactcattcaattacatgatgaattttggactttttctccaagatcattatagggcacatgtagcaatggatggagaaattacgataacagagataggttttcatt

SEQ ID NO: 15388 - DNA, 1048 bp, Homo sapiens
  misc_feature (1)...(1048): n = A,T,C or G
agccgacgatcgccgtcattgactctaacggcctataccaccagcagcaccggccaggccaagcacacagacgacagacggaccaccgagcgangcgacagtccgcgagacgacagaacgcacggaaggaccaacccaaacagactcgagcacacgggaggacacgagaatcgcaaaagcgacccggccaaaaacaagggagcaacgacgccgcggcggcgcgccggggacgccgcacagaccgacgcgacagccccgcgcgcgggcagcggcacagagaaaccggccgcggagaaacgccaggtagccagcccgcgccgaagagcaccaacccgcgcgccncgcggagcaccacacgcagcgacacaccgagacaccggggcgccggcggcacacccggcgagcatgcgaggcacacccagagcagggacgccaggcgcgcgagcacgccaaacgcccagcaccacacaaccaggctaactcgcagggcccgaggagaccagcggccacaccacacacagcagcacaagagcgcgcacccacgaaaccccaagcaggcancgcaaccgagccgcacgcagnacgacgaccgncgcaccccaccccacacccgccaccncagaggcaagcccacnaccaccacacccagcgcgacatccgcacncaccacagacaaaacagaccaacgcaggccancacgatccancgaccacaaagcgaccaccatactcacactgagggaagcgcaccgggggagagcaacagcacaaacaacaaaccacagcagcaccacgaagcaaaaaaaacgcacaccgcaccaccccacaaacgcgccagcaagaaagagacgagcacaaaaggacccacacacacggggagaggcgagagccccacaaaaagcgcgggcacaacaacaccacgagaaacaccccccccgcgacacaggcacagtgaagacacccaacacaaaaaacgggcgaaaaaaaagaaccggctcnagnggcnccaccaggggtgtcaatccataacaaacatcnnttggaatgac

SEQ ID NO: 15389 - DNA, 721 bp, Homo sapiens
aggttaatcactgttctgaagatggtgtttgtaacaccagttatgcttcatacttctgaggtaggagtctggacatgactcagcaggcaagactcaactctggcagtggggttcagacatcagacaaattgaggactagctaaaacagggaagagttggaagcacctctccagaagacatgcccaccagtgtgccatatcagtttacccttgccatggctacacccagaagttatggatgaagctgctatggatgaagctggaggacattatgctaagtgaaaagtaatacacaaaaagaaaagtactgaatgatctcacttaaatgtgtaatataaaaaagtcaaatacatagagaaagagaataaaatggtaactatcagggattggggagatgcagggagagggagaaaaaatagagagatataggtcaaaggatccaaagttgaagatatgtaggatgaacgagtctagagctctaacgtacaagacaaggatgatggttaataataatgtattatatataagatttttgtgaaaatagtagaattaaggtgctcttgccacacatacaaaaaggataactatgtgagatgacggatatatgttaatttacttcactagagcaaccatttcactgtgtacatgtatatcaaaacatcaggttggatatagagatttaaaataaaaaagtaaaaaaaaatcgggctcgttggccctaa

SEQ ID NO: 15390 - DNA, 795 bp, Homo sapiens
  misc_feature (1)...(795): n = A,T,C or G
cctaggaggactatccttatgcccactgcctacagtatgcatggctctatgaatagaataaattcctagaagaagaatttgtgagtcatctatacgtatggtttttattttttataattgccaagttgtcttccccagagactgtagcatttttttaatgactatttacttttcaatttctcatcaaacaaaaacacccacaaggtgaccttcttcggcactgttaagcattcaaactatgaagactaccatgggccacacctggtatctgtatactgaacgaaagcagagctggccagaaaggagcataagcgttcgtcttggtgaaaaggacatcctgtttttaaagaactttgaggtatcatctacatgcagccaaatacataaatctaaggtccactgcttgatgtacccacgaacatgtatacgtatacccattccactattcttaaaatctgcatttattgtatttcaatgacattgaatatactttcacatgtacagaaagcatttgaaactctatttctatggattgtgttcacgtcctttgcccctttcctgctgagttatgatggtggcttaatgtttcaatggacctcctttctaacataaaaggtatcttttggtgcatgatcagcaacttttccctggtctgaattgataaaagcaaattttattatgtaatataaatagctttgttcttacttttgccatgggaactttcccaaatgagaaagaagattaaaatttcctgggacaaaggtgggnggcttggcctctggtatttcgaaaggt

SEQ ID NO: 15391 - DNA, 772 bp, Homo sapiens
cttcaggtgactactcgctacgcataataggagtttgaggttttgtttttttgttgttgttgttttgttttgttttaaatcagggtctcactctgtcacctaggctaaaaggttagcatgcagtagcgagatcatggctcatggcagcctcaacctcccagactcaagtgatcttcccatcattgaggtctatttatagaaatagtaaattgaagccatcaggaatgatctccatatagtctgcccaaaattataaatttagctgaggacacttttcacctggactttagctcttgctaatgtaactgatgattttctatctaccaaatagtcaaaaatcagctttcctcataaatgaccttccttaagtacatgatatgggccaggcactgtgtaattctaagctgtacttgagactgttaaccactccctaatccttgcaactctgccccactggattcaatgacactggcttattctagttttcctcctccatttctagagctgctcctatccctttacccaccctataaggtaggaaggtatttctcaaggctctcaccttgacactcctctctcttccttctatataattctctggactagctcatttaagctcaaagcttctatcactactatttctgctaaaaatttccaaatccatgtgcccaagccaaactttgttcctaagttctaaaccatttactttcaacagcctgaataggcatcctactcaaatttcccagagacacctcaacacatttcaaaacta

SEQ ID NO: 15392 - DNA, 798 bp, Homo sapiens
  misc_feature (1)...(798): n = A,T,C or G
tgggtctgcatactgttttctaacttcagacttagaaacagcccatctacaagaagttcataaagtctagctaactcctttcctccacttgtcttacgtaagctgcccccacatatggctccagcttgctgctaccttgtccgtgggagcagcccctaatgtggccctgtctggcagccttctctaattcacaactgattggtgtattttaaggctttgtgtgtggaaacattaaagttttccgtatataggatcatgtcatctgcaaacagagattgttttacctcttccattctgatttggatttatttcattggcaatgtcaattgaacagaacatttataaaatcatgctctaggatgaaggagaatttatcccttggatacgagaaggcttctacacacacaagtaactaaatgtgacataccacattaacggaatgaaggataaaaattacatggtcacctcaaatattacatgatcatctgtcaaatggagaaacagcatttgccaaaactcaacaccatgatanaaatgctcaacaaactagatacagaggaaatgtaccaaagcatgataaaggccatatatattacaaatccaccataaacatcataccaaacagtaaaaaactgaactattttcctattagatcagaaacaaaggaagaatgccaactctcaacacttctatacaacactcttattcacatctaatacattgatgagaatgttttctgctattcaataattctattgagatgtttctggtttttaaaattcagttattatggttatt

SEQ ID NO: 15393 - DNA, 754 bp, Homo sapiens
  misc_feature (1)...(754): n = A,T,C or G
cctaggggtctctatggagattcaagtataagaaatgagaatggagcagatgcggttacacagtatgacagccaggccccagaaaactaagaaaagactttgtgtccttttgtggtgagaaaatgctgaaggttttaaattgggaggaactcaaaaatgtgtaaaattcaatgtttctgaaggggcataggagaaggagccaaggattactgcccatagaaagcgtggataaaaaaaaatacttaatttcagtggtctaaaattaaggaaaagatatgatgaaatgactattttcctactgtgtgatattcttttaaaaatgagcattgtttagtctggcacagtggcatgtgcctgtaatcccagttactcaggaggctgaggagggaggattacttgagcccaggagttgaagtccagcctgggaaacatagtgagacctcgtctcanaacgaacaaaaaaaagtgttatctgtccattaagaaaatcatatatgtaaaataataaccatacagaacacacatcctgattgctgtatttgtttttattttgacagtgaaatttatatatctagtttttaagatgccaatttaagattgggtcatacaattaaatgtaaatgccaccagtgtaattagtgtctatgtttaaaatcatatgaccctganaatgaggtttaggatgttgtgatttataaaaataaagccagcatgggttaatnttttattattaaaaaatatttgattagcaaag

SEQ ID NO: 15394 - DNA, 782 bp, Homo sapiens
cttgggaccacgtgaagttcctgcttatccctgagcacagaagatttcagttttctgtcagaccatagatcaaatgaggcaatcacatttttcccggggaatgaaaaaggacgagcaccctcttgaaactacaaagcctgctttccacagctgctgcttatccactctgtttcaaggacacccccatgtaaccctgcatgacatgctgtgcccttctccctgggactgtgagtctacgtgactaaaacactgctgtccatctcatctgtccaattgcaggtctcatgtgttgagtcattctcataccctggagtgggaatcccttcctcatgaacaagaagagaaaaggattgaaacactattgaataagactaagccaataggagaaatacaacaaaagaatttggttatttaaataaaatacatggaaatttgtttaactttttttttttttttttacaaaaaacaagaaggacttgttttgcgatatatttttagggaattacattttaagtttatgtttagggcactaaacataagttaagattgtaatgaatcattaacatgcctgcactatccagagattctgatttttgaaacctggccttgatgggggctaatggaaaatgaaagcgaaaggccagaacaacacacccaactaatcatatctatatatagccatcttcttgccacatatccccttgcaacaacccccctcatttacattacacaagaaatattctccccgctctaacaaagcgcgtcggtgcccaacggggggg

SEQ ID NO: 15395 - DNA, 784 bp, Homo sapiens
  misc_feature (1)...(784): n = A,T,C or G
ctagatgcagctcaatgaagaagtatgaacagtggggattgcatcttgtcttccattttccctgggacttgaaaaggctgcttatatgaattctcctggaggaagccactactttgtacttgactctctacttgcaggctgacagctggcccagagacaacttgattgtgaaagtgtctactgagatggacttcaactgagaagaggcttgatttgtccacacacacacacacacacacacacacacacacacacaatgacaggccagccgccttctccatctctatccattttaactagatttaaaaatgtttgataggatactttgctagttacataatcacataagatatattaaaacggctacctttaaataaaactactacaaatctacacttaattctttttttgagtagatagttttgtacttaggttaaactagaaatttggttctaaaaagtgaaaggagaatgttgaggctaaagagagaaaactattacagtctcctgtatagaacacattttcagcttggttttatcatgtagagtatatagagaagtggcagcgcattgntctgattctagtactgttcatattctctaaaagccaaaatttgtaacttaacaacagggggatatgttgccacagagcaaaagaaatctgtgggtaatcatgaaagagaactttccaaagcacattttcctggattctgtatatgtgaacctcttcttatacatgaaatgcataagaccctcttctgagacaaaatctgacaaaaatctac

SEQ ID NO: 15396 - DNA, 766 bp, Homo sapiens
ctagattagaccgtggccaaaaaggtgtcttcaaatagatcccgtctgctcctctctggtgaaattccgaaatttagtcttcaagatccacctaacaagatacctaaagggtattagatcgccatttgatattacgtgatgctctttgtttctgggacttcaggatcatcagatatctatctgctattaaatggtaaatggaccaagcgtgtctattttgtttatttttagagacagatctcactgttgcccatgctgaaatgcagtggagcaatctcggctcactgcatgctctgcttcccaagtacacgccattctcctggctcatcctcccaagtggcatgggactacaggcacccgccacagtgcctgcctaatgtttgtatctgtagtacagacagacttccaccatgtgagccaggatggtctcaatatcctgaccttgcgaaccacccgcctcggactgccaacgtgctggaatcacaagtatgaaccaccacacctggaccatgaaccaagtgttattaaggaaacagaactatgactttaatcatcagatttatactggctatagggatattagcatatgaggtaaacatgaatctagaacactctacatatgttcatactactgttagctcagatattgcatgagtgatagatatgcatgtcggatttataccgtcagcctctgtaattaatatggaaacttcgactctttacttttacatcgacatacgccacactttattccaccttgagagcg

SEQ ID NO: 15397 - DNA, 793 bp, Homo sapiens
  misc_feature (1)...(793): n = A,T,C or G
agatgcgggaaggaaaatacgagctcagaccaccgccaggtcagggaggcgtctttgctgactgccgtccgagggcccagctgcagctttgccagctgcctgtctctgggttcctggctcctgtgtggtgacaaccccttccatcccatgcctcccggtgaatcccagcctctccagttcttagtcggcctggccctcgaactctgactgcaagcctgtggctctcctggattccacattctaggacctggagtttcttcacatttcactggctgaaccctacagcactccgtccccttttcattgctattgctctactgtttcctgtggtccctgattatgttgggcctctcagaggcttcgggtagacttttctactagactgtgaggctgtggccatctgcatgtacaacacaggaaggccttgtggtgattacagtcatgaaaacctttgtcccagcacataggctgaaggataatttgacatgagggtgagatttgactccattcaattggacattaaatgaaacacatagcatgcctttatttggtatttaaattatatcttagagaaaatactttacatgctgggtgcagtggctcacgtctgtaatcccagcaccttgngaggccaaggcgggtggatcacttgaggtcaggagtttgagaccagcctggtcaacatggtgaaaccccatctccagtaaaaatacanaactgtccanggtgtggtggcacacactttgtatcccatctacccangagggagaggcaggaggatcacttaacccgg

SEQ ID NO: 15398 - DNA, 787 bp, Homo sapiens
  misc_feature (1)...(787): n = A,T,C or G
actctctgtctgtgctttgctgtgtatgggaaacatcctttctgtggaatgctggcaacagggagcttgagttcacattttgctgttggcctgcagtatctcacaagctttcaagaagccttcagttgaggacccaagagaggctactggatgctgatcttgaaccgaggatgtacactgtccctgtgaaagtgacatgcagggtcacggggcgtgggatggaagctgcagagtagatgaaggcataggatagaccatgactattctgcccatattgatgctgcctttagatttcatgcaagagatacttaccgatgggaccatcaaaggctggaccttccagcanactggctgcagagctagaattatgactcagctttgctgactcccaagcccatgctctcccaagcttatcttccagcaagggtgagcatatattactaacttcaatatggaaagaataataactgagccacaggaaaacatccatttattttgaaaagaggttcattatgcagaagggacttgccttttctcagatgagatgttggactcggacttttgagttaatgctgaaatgagctaagactttgggggaactggttgggaagacatgatcgggttttgaatgcgagaaggacatgagatgggggaaggggccaagggtggaattataaggtttaactctgggttcccacccaaatttcatttcgaattgtaatttctatggttgggaaagggacctgcggggaggaattggatcatggggggggcttccctctgctgg

SEQ ID NO: 15399 - DNA, 790 bp, Homo sapiens
actagggggagtttccctgcacaagctttttttgcctgctgccactcaagatgtgacttgctcctccctgccttctgccttgattgtgaggcctccccagccatgtggaaatgtacacgcgtcttcatatctgattttgaaaatggaatgggaaggcaaggacatccagagaagagtggctttatctaacattatttaacctaggaatatcgctatggaaataattaatagctcatttttcagataaggaaaatgtagacaaagaacttactcaagcccgtttcttcagctgccttccaaaacctttacagcatgatccagtttctaattgtttttttatatttatttcccttgatggcaatcatcataacaggctgaaaatatgagtctatatcaatgtaagatttgcagacatttaattttttttctttgctgatcaagagatggttgtacagctataaaaaggaaaaaaatgctttaacactacaacatttgagttgtgatatttaagtcatttggagaattgcaagtggcaacacctaaagactacctttgtattccatttgttttaaaaaatgttccatttgacccaggattcccacttctggaaatttattcttataaatgtaattaaaatattgaagtaaaagatcaagttatcttctgtccattagaggtatatttggaaattcctcagtgcacaaaaatacaataattgttaataacaaatagcacttacagaatattattgtactaacagaattaaaacaaatttctattaacattaaag

SEQ ID NO: 15400 - DNA, 778 bp, Homo sapiens
  misc_feature (1)...(778): n = A,T,C or G
tagagtccagtagaaccgaaagttcataaagtggtgtatacttgtatagcttttgaaggaactcaagaaacgtcacccagaaatatcccacattggtctgctgattacttcaaactgagggaactttgggaacagcaaatgcagggagagactttctctgaacttacatcatttgcctaaagatggatcctacaaaaggaatgaaatggtcatgaatccccttcccaggaattttattaaccagggtcaggggattaacttgggccacaagagaggagacgagagggcaacacaacatcccaaaaccatttactctcctttaagtagcctatatccttcctcccctctctcctatgaaaaggggatataagcttttatacctcaccgggtttgggggtattcacttttatttcatgtgatatccctgtgcacataatgaatttgtacacctcttagtctgcctgctatcaatttatttcatagactcaattatcaaatcctcagaaagaagagggaaagtctttcttcccaaacactttcaacctccaaatcaagaaactccctaaatccagttgactattaaatgacaccggttcatactgtgcatgattacttatacgaagattttcttctgctatgctgctcctgaatcaccaagaccaactcctcctctttagcctactcagtatgaagacaacaaggatgaagacttttaatgatgatctacttccactttatgaataggaaatatanttcctttcatatnggtttcttaata

SEQ ID NO: 15401 - DNA, 789 bp, Homo sapiens
  misc_feature (1)...(789): n = A,T,C or G
tcagatgaaggagacattctgaaattgtcttcctggtaccaaggtctctttggccagcaagtggcaaaggagagactctttccttaaggacactgttgtttttggaggtagccacccccaaggaagaggctggcaagcagaatggtggctggctggtctgtaaatcccttggaaatccgccaaaataagtctgcctgggttcagaatttatgttggtcaagccggtgtcaacattcgtctcggcctcaagcttctgaaagctgttttcccggttgaggaccttcattctggccccggattcaaggtgatgagaagacaggtgcaggtgggcacccatagctgggctgctgacctggaatgaccggccagggcttttccacgaagtgccagcacacctgtctgatgtggggctcccactgggctcaggaagctccagagaatgcccctgggacctcttgccctggttcctctggctcctgngttctgaggtcctctttgcagagacagaagtcagcctggagcccaggggaagcatgccagctcccaaggtgccattcttaacaccaagttctggactcagctggacctacaggaaaggaaaggaggaacatatgaaacataatttccgttaactaagtgccaagagctgactatgccttattcaccctctgccatgccatgcccatagcagactttcagtaaatttgtttgaattgatagaagtgataagtccaatatattatgagatatctaatcagacccagccccaaatacctctctttgggactc

SEQ ID NO: 15402 - DNA, 607 bp, Homo sapiens
gtagagtttcttacaaaatcgtcctatccagcatgcacttttggatactctttcaactcagaagtcaacataaaggatgattgctgtttggggttcctgagcaccttgaaagctcttgatgtgtacagggagttcaagtgagtatagagagagttattggaagttctttcctgccaggacggaggttcaaagtgtatttaatgttaaaattgttaagaattgattgctctttcgcctgcagttataggttcttctggagaagtgttcacaatttattttcctaagtcattatgtttgtgccactgtgagttttcagattcacttttgctacttgcttatacatgcaatttttatcttataaaatgaaagtcgttattctgctcatgtttaagagcacctgaatttatttttagaggccagtctatataccctttgttcattttttaaattttatctattagtctgagtacttcctatattaaataaatgtatttttactgttacttaaagatttcttgctcttgtgttactcatatttgtctttgataatgatgttgttgcgcgttgaaatccctttgaaataaacattgagctaaaaaaaaaaaaa

SEQ ID NO: 15403 - DNA, 776 bp, Homo sapiens
cagggctggtctcgaactcctgtactcaagcaatctgcccacctcagcctcccaaagtgctggaattacaggcgtgagccaccacgcctgggtgaaatatttctaaagaaaattttctttttcttctgcaggaaaaaggaacaaatgccatgctcatgttctttttcattacgtgatatgtcaggactatccccctggaggctgagaagcagtaagctggctgagcttcccacccaagcaggacaggtccagagtggctgctttgcagaatagcttccattcaggaagtatcctgtgaaaaaagtaaaggcgagagctaaaatgaattaaggggacatcctagcctcaataaaagaaagaagcctgctaacaacacgtctgcagaaccccagaattgacggcacaatcacatgggtgtgactcctcagatgaggagaatgcctcagtggttgttattctggcatttctccaccatcctttttttttttttgagaccaagtctcgctctgtcgcccaggctagagtgcaatgacacaatctcagctcactacagcctctgcctcctgggttcaagtgattcatatgcctcagccttccaaatagctgagactataagcgtgtgccatcacacccagctaaattttgtatttttattagagatggagtttgccatgttggccaggttggtcctaaactcctgggctcaagtgatccactcacctcagcctcccaaagtgctaggattataggtgtaagccaccatgcccagcccattg

SEQ ID NO: 15404 - DNA, 786 bp, Homo sapiens
  misc_feature (1)...(786): n = A,T,C or G
ctagtatgcatcctgccacctcacttataggacttgattggttgaatccacttcttcagaagctggagcctcagatcaaaaccagtggattatatcgaactccagaaaaagagtactgtgcacctaaagacaaaagcctgaacttcaagtacttattaatatttagttgcctaatatgttttctgaaaccactttctaaataatatncctggaaacaagtcaacagaaatgtcagaaaactgagcacagtgcttgcaaactacacagaagacggttctgctgggatccctgcctccctctcctgtgaaccaagcagccatcacagcatcatggagctggtaaatgctcacagctcanaactaaacactgcagacaaaactaaaccaccagacaaaactaaacactgcagagctggcttccagttcacagcttctccttatcctgctcatttcccttgttttcaaatcattctttttgtctgcaatccatttttactagacattatgaaagcatttaggatattctacttttggcaagccattctttcaataactcagaattaaagttgggttttcattacctgcacggtagaaagccctaacctaccgccaaatatgaaaaaatggaaaaaactttcatggacacgtaaaatattattaaaatattagggtctcaaaaaaaaaaatgggctcgttggcctaacgggggaactctgggcccttccttttgtggagggtactcatgaccccgctcactgactcgttgcctgggccttggcgtggggag

SEQ ID NO: 15405 - DNA, 793 bp, Homo sapiens
atgattatcccataagactgcaaggcatgcaatcataaaggtaaggaaataaacacatagaagtacagaggaaacaaacagcaaactgtgatttgaaccctgggctcgaccgatgtttcaaactcttggccatcatgttttacttccctacatatgtttcaacacttccctacagtcagtaaagtgtcatggattctactggctttgattttggatgacagaattagagtgatttgattgtatgtatactttaattaaaatgttttcagtttaatttactacggttgaaacaggatctaaaatatgacaaaacctcctagggcatctttgccttcagacgcggcactcacaacccttacacttcatcagacctaaacataacactgagtggtctcatgaaatataaatcctacttttaatactctattatatgaatatatatatacatatatatgtattagcattacaacactctcgtttttttcatcgtcttatcttggatatttgtacaccaatgttcattgcagcattaatcataatagccaattgtagaaacaacccaagtgtccttaaacaaatgactggataaaaatatgtggtatgtacatacagtgaaatattattcagccataaaaagaatgaagttccaatatatgctatatcatggatgcaccttgaaaacactacgctaagtgaaacaagccaggcgcaaaggacaaatacatgatgattccacttatatgaaatatctagaattagaaaatccatagagacagaaatatccattaccagg

SEQ ID NO: 15406 - DNA, 305 bp, Homo sapiens
  misc_feature (1)...(305): n = A,T,C or G
agatactggctccatactacagaatgaatagaaaaaatatgactcttttacaccatcttctgttattcattgcttttgaagagaagcatagaagagactttttatttattctagaattgcagaaatgactacactgtgctataccagagaattccagtagaaagaaacttgtaactctgtagcctcttacatcacctttattatacagcatgaaaaaccataacctttttttaaggacaaaagttgttgccttcctaagaaccttctttaataaactcattttaaaactcanaaaaaaaaaaaaa

SEQ ID NO: 15407 - DNA, 785 bp, Homo sapiens
  misc_feature (1)...(785): n = A,T,C or G
aggatcctcgggacaggaaatgggaacagaggaaacaggagcagaggactcaaaggaggcatcaagttctacctccagaattagaacagaaaagagaaaggaaagctgcaaacccagtcaatcctggctgtgcatgcatcagaaccacaccagccttccacgtctgagatcccgagacaagctgcctctgaaccagtaagagcctcttgctccttccttctgaggagctacccggtgcctgagtactgactacatactctccagaggcaagtgtgtcttcagacttcccaccttcataggcacagtccagacctagtcgtcttattacttctttgttatggggcactttgaaatatagaaccacgcctttatgttctaggacactggtctctccccattccctctatgttagaacagcactattggtgctgtgacataggtcaccccctctcatggacttacacactcccttttccatttctttcattccattcaagaaatttagaaacaagtgatttctaattaaaatattcacctactttaattatttcataatagtaacaaatgacttgttaaacattcccatgtggttgcatatggatgtgggagactgctcttctggaaaaacaatgaagctcggagatgtttgtgacttgcagagctgggaaaaaggataatgaagtggaatagttgggcagatacacagtggagacgatggagcctactaagaaaagcctcgggcaagncctcaggaggaatcagaggaaggcttgtattacaggaga

SEQ ID NO: 15408 - DNA, 558 bp, Homo sapiens
  misc_feature (1)...(558): n = A,T,C or G
tggctcttagcaaatatccggctgtgatcaatgatatttcattctggttgccctctgagaattacgcagaaaatgatttctatgtcttagtccgaacaattggaggagacctggtggaaaaggttgatctcatagacaagtttgtacatccaaaactcactccttgttccggggactgctggcctgccacttcctgctcacagtcgcagatggggcttcctgagtctgtgcactgtcagtcagagctgagatgctagaggacgcacaagaccagccactgctaccgcatcacgtaccgccacatggaacggactctgtcccagagagaggtcaggcacatccaccaggccttgcaggaggctgcagtccagctgttgggtgtggagggcaggttctgatgtcaccacttcactcaggctgcagccctcttggggctccaggatttgctgaaagagaanaagatatggtttgtgaactggngcatcaatcatcttttgataaatggatcagttttaggactttcagaaaataaaagatcgcccttgaaaaaaaaaaaaa

SEQ ID NO: 15409 - DNA, 782 bp, Homo sapiens
ataggcatctatcctttctctggtgacaaaaataaacatgtgattgataatctgattgtggctccagggacatttgaagtgcaaattgaagaagttcgacaggtgggatcctataaaaaggggacaatgactacaggacacaatgtggctgacctggtggtgatactcaagattctgccaacgttggaagctgttgctgccctggggaacaaagtcgtggaaagcctaagagcacaggatccttctgaagttttaaccatgctgaccaacgaaactggctttgaaatcagttcttctgatgctacagtgaagattctcattacaacagtaccacccaatcttcgaaaactggatccagaactccatttggatatcaaagtattgcagagtgccttagcagccatccgacatgcccgctggttcgaggaaaatgcttctcagtccacagttaaagttctcatcagattactgaaggacttgaggattcgttttcctggctttgagcccctcacaccctggatccttgacctactaggccattatgctgtgatgaacaaccccaccagacagcctttggccctaaacgttgcatataggcgctgcttgcagattctggctgcaggactgttcctgccaggttcagtgggtatcactgacccctgtgagagtggcaactttagagtacacacagtcatgaccctagaacagcaggacatggcctgctatactgctcagactctcgtccgaatcctctcacatggtggctttaggaagatccttgg

SEQ ID NO: 15410 - DNA, 786 bp, Homo sapiens
cctgaaaccgacactgaaagactgtcatcctcctgggggctttattctgggattatgggcacttattatcatggttttcttcaaaacttatggaattaagcatatgaagttcattttttagagttgatgatgaatgaagaatgcatggaggactgcaaacttggataataatttatgtcattatatatttttaaaaatgtgtttctcttgtatgaattggaaataggtataaggaaactaaatttgaatcaactattaattttataacttaaagaaaaataattgttaatgcaactgcttaatggcactaaatatattccagttttgtattttgtgtattataaaagcgaatgagacagagatcagaatacattgactgtttttgaaaatagtaatttccccttatccccttttcatttggaaaagaaacaattgtgaagacattaaattctcactaacagaagtaactttggttaattattttttgtatatcctcccaatcttttgacttatgcacatattttttcccaatatggagatcatatggaatgtactattttgtaatgtcttttttcattttacaatgtattatcaaccttttccctctaaaaatacattgtgaatgactgcatagtattcactttatgaatatttaattcatttcacagtcttctattggtggaccacttacattggaccaaatgttttcctttggttattcttaatgattaatatttactggtgtcacttatggatcctgagcttttattaaagcaagatgaaaaa

SEQ ID NO: 15411 - DNA, 1054 bp, Homo sapiens
  misc_feature (1)...(1054): n = A,T,C or G
ttttatgcactctctccctccattacgggacccaaaagaaagacctgnaggggctacgngcaagagaagttgnagnaggagcctacatcaccctgaatccctgaatgcctaagaggagaatagcccctgcgagcccactctggacttgcaacatatgaaaagaaatttgtatcactgtccagccctttgatctttgagattgtgttagtttctcgcttatgcttttgcttttgcttgcttactcgctttcactttgcttgtctactcgcacacagaacactacgcctactccttgttctgataacaaattgcatgcgacgctcctacgcgcatacacatacatacatattatatatggctctactttcggccctccacctggtctggaccctctcgttgtcccccttccccttatatctgactgcctcaccccttagatccctgcactcgacttgtgttcgttagtatcttggattcctactgactgcatgaccagccgctcttgcctctcccctcaaacggccctgcactaccagacctctcccaaatttccctgtgctccatcttcattaaacaaacatagttattcctccacgccccctcacctccgcctctccaccctcttcataacgaccctcccgcgcctagcctcctctccacataagatcatccgtccctcccttacctcatgcgcgcccatcacaccccctctactctcttcgcgtctgagtccgcctcagcttcactgctctngtctctcccccatcactccactcattacttcccctcaccgtacctccctcaccttccccgtacattccgcgcccccaccacaacgctttccctcattactctagtgttgcctatgcacatagtctcttctctttcatttttccactctctcccccacagcgtcctccacaccctcacacacctcggcattcatttacaattacctagtcaatcgctattaccacgccctcctctcgctctcattccctcctctgcagttcatcggtggtctatccgcgcgcgcccgtttctgtgtatnttt

SEQ ID NO: 15412 - DNA, 745 bp, Homo sapiens
  misc_feature (1)...(745): n = A,T,C or G
ctagaagtcatcttcagaagcacctcagtacataaaacagctaaaagaggaagttataatagtgatgtaggatctgaaacgcactccctggccctcactgaccctgaaagcacctctgaggacccccgaaggcctgcaagacccagtttgaaaaccactgcattccattgtttcatgtgtatttttcatttttgggtgagctataagcttcaacctacatctttttcacctgtgggtgagctataagcttaaacctacaagtgactgaaatccatcttttatttttcctattaagcctaggcattacaatagattcttcaatatcactggattctaatttggaaacactggcaaaacagtttaatcacaacctacacacatcttaattcagaacttatggctaacgtttttgaatgaatagtacttttttaaaaagtaaacataccaatgactaggatgttgtttagctgctccacgccatcaattttggacagcaactggttgacaacagtgtcatgaactcccgtgctaccagccatgctccctctctgcttgcagatggcatcaatttcatcaaagatgatgatgtgcaaaccactgttagcaccaagctattaggggaagaaattatattaaagatcataatttgaatgtcttatttaacaaactaatcagaaaaacaaaacaaagctttcaacagattgacttcgcttcattttgactaataaatatggcaagtgcanaa

SEQ ID NO: 15413 - DNA, 108 bp, Homo sapiens
  misc_feature (1)...(108): n = A,T,C or G
cttgatgatgacttatgccgttgtgacgcctggaaaatggaggagattactttggggaaaattataacgataaattttccaaacatacanccttgaaaaaaaaaaaaa

SEQ ID NO: 15414 - DNA, 919 bp, Homo sapiens
taatttttaattagttttgttagttggagtggacaaaggaggcgcctgaggagcaacgtaccggcggttttctgcagctgtcacaggctgaactcatcagctaccatagaaaagagaagcagctctacctgggcatgtttggttaacatagaacaaagacgctcctccagcagaacttaggtggaccattaaacatgcacgaaggaaaaatctgaccctcagcaagagaaattaaccctatacctctgacccaggcaggatctttgcctctagtgcttgcacacacttgactatttagacagcctgagtttttttctcgccatgcatctgcttatttccattccctctcaatacacagttattgctgcagatattcggcttcgagaaatctaatcggcatcccatttaccgttccccacttgcgctctctctcggcccagtgacgttgaattttgccttctttgactgttaacagaggccaaacacactgatcctcggtcccctggctcgtgtgaggtcgaggcagttctttgtgcagacgacccctgtcctttccattcccaaggcgttgtgggtcgcgcgttcccccagagctcttgcgggggccccgccacgaaataactgcgatcctcaagaccgccctcaatgtcgacagcaactattataagtggacccgtgtggctagaccatctccacatacggcaagcctccactcaccaaagactcattcacccacccgcgcgccccttccagtatagtgtcgggttccgtacgctagaggccgactacaaatcaaaagaggtttcccaccgtacaacacctcccctctagtggctgtaaagtgggccaaacgcgcgcttgtcagatgacgtccactccttgcttatgggatcgcggagaggggacgcgcctccacttg

SEQ ID NO: 15415 - DNA, 795 bp, Homo sapiens
ctagggtccacaccaggtattaatccttggcatagagtgtgaagctatgcaattctaatctcccatctcccatttttatgggatgctgtcatcactattcctgcttgtccattttcatgctgctgacaaagacatacctgagactgggaaggaaaagaggtttaatggatttatggttccacgtgcctggggaggccttacaatcatggtggaaggtgaaaagcacatctcacatggcagcagacaagagaagagagattgtttggggaaattcccatttttaaaaccgtcagatttcatgagacttattcactatcatgagaagagcgtgggaaaaacctgctcccataattcaattacctcccaccaaggtgctcccatgacacatgggaatggtgggagttacaattcaaggtgagatttgggtagggacacagccaaaccatatcaatctgtgcctagaccctcccaaatttcatgtcctcacgtttcaaaaccaatcacgccttcccaacagtaccccaaagtcttaactcatttcaatcttaactcaaaagtccacagtctgatggtctatttgaacaaagaagtcctttttgcctatgaaccaataaaataaaaagcaagttgcgtatttccttgatacaatgggtacagaagacaggaactgggtaaataccgttgctccacctgggagaattgtccaaaccgaaagggtaaagaccccatgcagtctgaattcagtaagcgggaaatcttaacctccgaaagacttctttggctcatgttcacacc

SEQ ID NO: 15416 - DNA, 799 bp, Homo sapiens
gctaggcgtcactcctttctctggtgacaaaataaacctgtgattgataatctgattgtggctccagggacatttgaagtgcaaattgaagaagttcgacaggtgggatcctataaaaaggggacaatgactacaggacacaatgtggctgacctggtggtgatactcaagattctgccaacgttggaagctgttgctgccctggggaacaaagtcgtggaaagcctattagcacaggatccttctgaagttttaaccatgctgaccaacgaaactggctttgaaatcagttcttctgatgctacagtgaagattctcattacaacagtgccacccaatcttcgaaaactggatccagaactccatttggatatcaaagtattgcagagtgccttagcagccatccgacatgcccgctggttcgaggaaaatgcttctcagtccacagttaaagttctcatcagactactgaaggacttgaggattcgttttcctggctttgagcccctcacaccctggatccttgacctactaggccattatgctgtgatgaacaaccccaccagacaggctttgggcctaaacgttgcatacaggcgctgtttgcagattctgcttgcaggactggttctgccaggttcagtgcgtatcactgacccctgggagagtggcaattttagagacacacagtcatgaccctaaaacagcaagacatggtctgctttacaactcaaacttttgtccgaatcctcaacatggggggtttaagaagaacctggccagaagggtgatgccactt

SEQ ID NO: 15417 - DNA, 1335 bp, Homo sapiens
  misc_feature (1)...(1335): n = A,T,C or G
aattgtagacatatagataagaaataaacatatacagagaagtgaaaaaacaagcgacctgcattgggcgaataaatcgacaggaggctcctaacgcgggtgaacctgggtcatgtcacgatgggcataagaggacgcagaaacacagctgcgcggtgacgtcgttgtcctatcgtgccgtcggtcgctcatcacctacgcatcgtcatcgagacatcactaagtagtatgcctgggtctagtatgtgagtaatgcgctacactacgcacccgcgaacaccactcgagctaacatcactacacgctcgcgtgatgcagatctcagctgtctagcgcgcatggagtccgattcgcgcggtcttcgagtgagcgcgagtcgttagttcatgtaacgaccgagcgcaagagcgcgccatatcgacatgcacgtaantaactagcgagtgcgttcgacgccgccagaccgcgtccgtcggcgcagtgcgcgcntcgacacgactcagagcgccgcatgcctcgaccagcaaccgcgcacgtagcgcagtagtgataggtctaaagtcccagatataacgaggaaatgaccacataggtcatcaaagatacacagacgacacatcgagacgtgtgtctctgtagaagagtagatataacgagtagtgtatgtacatgatgaacccatctcgctacctcgcagggtacctactgctgcgcttatcgttcgtaggatacgganacataagagccaatatacgaagccgcatgctcgtacctggtgatcacgtggtgatgatacgtatcagcacactacatacgcggcgcattatgcgcctgtaggngagctgcagctcagcgcaacgccagcagtcacgntctgtaacagtactatactcacacccatccgaaggtacaggcgagngcgagagtcgttggtaaacgctagatgtattagtggagagcaagatggacgcatagtatgaggagttatatcctcacataagccgatcaagtggactgcgacgacgctacaattagtatatcgtgataagagacgctatgcggaatcgatctgaagtcacgnctgcacgactcgcaatcccacangggtgtctgtatgatcgtcacgcgncgacctcgtcgacgctcacgtactctagcctcactcgccgtagtcaccagtgtctctgaacatcgtcttatagtatgtacatgtgcacgcagcagactatcagtcagcgcatgctagatgcgtaccgctaaccaggtgtgagtgcgcgagcncncacctgatctgctcgctgcgctctctcacactatgcactcgtagctactaca

SEQ ID NO: 15418 - DNA, 613 bp, Homo sapiens
  misc_feature (1)...(613): n = A,T,C or G
cctagttgacaacgaccaacagaagctattgagagaccagaaagcaggacctctttggatgaggagatattctgctggatggcttcttaaaagtttcctctggacttatctgcctcattaataatggtttttgtcttagaagtctctgtttgattttgtaaactgatatgacttattgttctgttatgaatgtacactgctgtacctttaataagtccattgcacattttcaccatgtaatctataggcattttttctgcagtgttagcaacgtcacctcgtcactattatcacaatcaccttgatttggaaccattttggctatttcactaccagtccatgaatgagcaactggagtctcactgatgttaaaaaattcttttgatattcactacatccaacttactgatggactctaaatgtattattttttgtatatgtaagaagtcagacgtcactttttactcacttgaaatatggaaatcttcaaagtcnnnanaaaaaaagaacaanaacaaacaaaaaaannaccnnnnanaaaaaaccaccacaaacacaaaaccccgaaaaaacaanaattcggccctcgttgggcctaacgggggggagcttt

SEQ ID NO: 15419 - DNA, 350 bp, Homo sapiens
ctagggatgccgatggtgcttctgctgcacgcgatcttgtgggcagtacctgaaagactcagtacctctgctgttctacactgggcccacgtgccttcccagcgcctaagacaccagcctgagactactgaccaacacacgcatctgcgttgacatcaacgccttgagggactgaatgatctgcagagggaacatccaaacgtcgagagtacacctgacaactagatcgccctcctgcagtgatgcacaaggctcttctactaaaacaggctgctgttatgatagtaaacgcttggttatctgactttcgactaaaaaagaaaaaagatggcctcgtcggcctcacctga

SEQ ID NO: 15420 - DNA, 545 bp, Homo sapiens
agagctccttgtgtttgatgatgtaagagatgcaccattgtctcacccctcaccccgacaatgcggtcccactaatgtcgttaacaaaaccggactgggcaattctgaaaactttgaagctgaacattgtctccaaagtgtatggggcgccatagacacaacgatgtttattcatcagcagggctgggttttgcaaagcccggagatgaggactggaaccagcaaagagtgaagaaaaacgtggcctgagcttgaagccagggaatatacagggaaaatgtggatttggaaattttatttttcttccataaagatattacggaagcatagaatatttcaggtcacttatgttctgtgaaggtttattttatgttttcaatttgcttcattaaaagccacagttccccttctccctccaaaaatttctgatgtgaaactgtgcaagtatttttatcacttactgaaatatttcattttaatttggtttatgtttttaaatgtctttagtgaagaaacaaattaaaacacccatcacatgcaaagaa

SEQ ID NO: 15421 - DNA, 228 bp, Homo sapiens
gctaaacgaacctaccagggaggttggactttcctgcctctaataaggacagtgaaatgtgattggaagtggcagtggttgtctgatagcggaagctccatccaccgaggttcttaagtgagaatgtcctgaatggagtcaacataccctaacttccaccaacctttgatataaatgcagcatgagtaagaaataaacatttattgttttaatccaaaaaaaaaaaaa

SEQ ID NO: 15422 - DNA, 876 bp, Homo sapiens
  misc_feature (1)...(876): n = A,T,C or G
ggaggggacgcgggcgcaggcggggtaaagagaaggagggagccttgaaagaggcattttgcctgttgtccaggctggcctcaagagatcctcctgccgcagcctcctacggtgctaaaattgcggctgggggggcaccatatacatctaaacaaatnccatttcctaaatgggtcctgtatctgaccatttgtaatccactagactctaggcagacaggcattccatttgcaaatatagaaaggtttactggtactgccttcttttgagtactttattgggggggggtgtctgcattgggtagagggtgaaataaaatattgagtagtgaaaaaaagggggagaagggaaacagatgagagaacaaaaggaggggagggggctggggaaaataagaggagaggaaaggggaaaatgcgcgcccttgggccctaggaggggggggctcgggcggcccttccctttgagggggggggagtgggagggcccccggccggagactcgttgggcgcgggggcctagagggggggggggggggggtgaatctcactcccaggggggggaaacccggggtccccacaaagtgggggggtggcgcgccgaaaaaccacgggggggccgggggcgcgggagggcggccccgacccccaaaaaggggcgcgcggggtgggcggcttccgccgaggggcgccccccgcgggggggggggcgcagaggtggcgcggcatggagaggggggcggcgaggccccgggggggatttgagggagccggagggggtcgcccgcggaagaggggctgggggcggttgtttgatggggaccggggccggtacgcggaagctccgccggcggcgttgcctccgggggaggggggg

SEQ ID NO: 15423 - DNA, 1583 bp, Homo sapiens
  misc_feature (1)...(1583): n = A,T,C or G
ccccccaccaccaccacanaganacaactaacaacagaaccatacatagaagataaggaagagcagagaaagaacgctccaacagaggcggaaaacacgacgcaccaccaacaacccctcgcacgcgacaagacgcaaagaacagacggagagncagacaaggagggngagcacaacggacgcacagccccaccagccgccacctcctccccacncgaagagaacaggagccgaagcgccgaggaaggaggggagcaggagcangagacgagacagcaccacgacccacaccagcacngcgcccgagacgcgagagngnacgagaggccgccggcaggacgcaacgagacgaacnccacgcaacgacgaagacgagaagcacgngcggcgccagaggnagaagcacgcgaacgnacgacaaagcgaagagagcacaccaccggacgaggaagcgcacagacacagggagacaacggcagcacggcggagcnangagcacgagccccagctcactacagagcacgacgaaccacgcangaagagcacgcggccgccgacggacacactgacaacactagacgcactgacagacggcacagcatatacaccgaccacacgacagacctgcagcagaccagagaaggagacacgacgcgacaccgagagcgcagcaggaggcgatgagagtgtgagaccgancgacgcgaggcgaccaggacagacgagcacagcgnanagcgcacgcngncgcgcgcgacganagtgaccaaccgcngncgcactaacgcacaacacgcgcacgacagcacacaccgctcagcancacgcacgacgcgccgaagccagagacacatgcactcggcgaccatcangcacacgagcagccgcacgacagcgcgccgngcanggccgcggagccgacacgaacacacacccaggcgcagaggctggncgcgagacgnncagagncaggagcgagnagagcggaggagacaccagtagaacgacgccangagctacgngngcgcggcgaggagacgagaagaagcgagagaggggacaaagagacaaggagggagagaagggaggcgagagaggagaaagaaaagacaaagagagggtgacgagaagacgaagagaggaagnagaacgagaacacgcgagggacgggagagaagccaggatggagcaggaagagagaacgagcgcacacgagagcccgcaaacaccccgcacgcgcccacacgaagcccaccacgggcgcaaccacaatacagccgcagaagagggcggagcgccaggccagggaatagaagacacgcaacgcggcgcgcgangtgcccgcacacgaagcagacgagaacaaggacgcatngacagccccgatagagacaagccgacgcatagaccgcccgagcagccacgccacagcgccacacagccacacgaacacgcacacancgcaanagacaccaangctcgcacactgcgagcacacggcagacaagacgacaacacagaccacgagcacaagacaatagaggcgtgaagagagtaccggagcgaaccaccacgacagccag

SEQ ID NO: 15424 - DNA, 173 bp, Homo sapiens
gtgctcctggttaagtctgatcatttctgttctgaaatttgagctgaccttcattataaacttcctgaagcctccccagaaactgagcggatgttggcattacgctccctgtacagcctgaagaaccatgagccaattaaacctattttctttataaattaaaaaaaaaaaaa

SEQ ID NO: 15425 - DNA, 1347 bp, Homo sapiens
  misc_feature (1)...(1347): n = A,T,C or G
agacgagagccgaaaaacagagacacggaacgacgcagacacaacaggagaatcgagaggaagcgaacgcagcagcagaggaggagagcctcanattaagaaggaaaaacacagagaccagcagagnagccctgtgcaggagcggagcgccaaaacccagacgacagagacgacgagagccgacagagaacgcagagngacaccacgagagcagcatatacaaacagcgcaacgcaagagcagagcgccagcgcgacgcagagcggaccagcacgaacacacaaganaacagacgggccgggcaccgcagacgaacgacggaggcgcggccgacggcgagcaagcaccgaacgcgagccgcgacgacggagcggcagacggagacgacgccgcgggcagacagcgagagaaggccagggcggagncagaaagaacgcgcacagcacgaaccacaagccgaccagccgccacccgaacgcacgaaccagaccaacaacagggcgtccggacgtagggaggagaacgcgaggcggcgacgacggcagaacccggcgagaagcagaagacaaaaagcgggcggcggcgaccgcgacgaatgagagagggcaggagagaacgagcacagaggcgaacacggcggcaggaagagggcagcagacaaacgaagcacgcgagcgaggaagaacgagaggangccagccagaacacacacagccgaagccagggaggaggggaccggaagaagcggagagaaacgaaggagagcaaacaacaggccgcagaggaagcacacgcagacgaaacgaaagcaaggcgtagctaaggcgggggcgagagagaagcaggccgacgaggcgtagaggacgcacgacaagacagaagacggaaagagagagaccacccnaccgtacacaacgccacaccaaagcgaagaccgagaagacgacaacgcggcaaacaccgacagccagatcaaccgcgccgacgcgcagcgcaccgagcgacagagagagaggaagcagggaaggaggaagagggaagagggcaccgcgcgcacccgaccacccacgccggcccagacgcgagaagcgcacgcaggacaccggaccgcgccacacgccccgacgcccggcagacgcaaacaccccggaaaagagacgaagacaaaggcgcgcgcaccacacacccaccaccaagcccaagagcacaaccgcagacaagaaacagagagcagagcgaagccaacaaacaggacgagccgagcgcagaagacaacgcacagaggaacaccgcgacacgcaggataagcgagagcagcgcagcgacgcagcgcacaccgcagcgacg

SEQ ID NO: 15426 - DNA, 787 bp, Homo sapiens
  misc_feature (1)...(787): n = A,T,C or G
gctggggtcttgttctctaccctgacgtagtgacgtggcgcaatcacagctcaatggcatcttcgaacgctcngggctcaagtgatcctcctacctcaccctgagtaactgggattacaggcatgagctatcatgcccagctctcattttacctttttgaatcttagaaagaggaaccagaatccatatagccaattgaagcaatgtgacacatataagaactcaagttaggaattcaaggttattgcctggaatcattgtactgaggtttatagccaatcatagatcaaagatcaccagaaggaccatgtcagaagactgggcagtaaataatttgcagttgtttgttccaatacattctaatgtgccctttgatcttaaaaagttcatggacagatgatggtgagggaaataaaggacagcagagttcagtgatgggaggttgggatgggggaaagctgcaatgccgtgtgatgccctcagttccacagggcacattgtgcaaccactttgctttcccctcagcaggacatgcactctggcctcacgttgagttgcataagtagggatttcaattcttctaaaaaatttactttatcaatgaggatgctgtttatgacagcaaggacatcaagcccctttgtttggacataaggtctanggaaaaacccctaactcctccctcttctcccttctcaacagtctgagtttgccccaggtgcagtgcatttcaggttataatagaacaagaggagagtctcatcttggaagaaaatgggagggacca

SEQ ID NO: 15427 - DNA, 778 bp, Homo sapiens
ctaagagagttatcaccccttgactgaatagagcctctggacttcatcttccagtggttagcagcacctcctcactccaggagagctgcaggaccaggcagctctgtgctcccttctgtgttttatctgatggcatttaaaaattacataagataataatagagaataatatcctcaccccattaatgtgtcacacaacaatattttggtcaacaacagaccgcatatacactgtggtcccataagattataatggatctgaaaaaattcctgttgcttagtgatgtcttaatgaccctgtgtaggcccaggctaacaagtgtgttttggtcttactttttaacaaaaaaatgttaacggcaaaaaacaatcaaaataaaaaataaataaataaatagaaaaaaacttctagaataaagatatacagaaggaaaataaaatccccataagataacctcccagtttaacagggacaccgggcagaaaccaatagaagttcggcctctttggcctaaacggggggagctttgcgggcgcttcccctttggggaggggaaattaatagcccccgttcactgaatccttggcctcgggagtttggttgggggaaaggggattattctaattgaaaggtgggattggggttttatcaaaaatatggggagtaccccagggaagaactttgggataaagggccattataagggccagaacccctaaaaggcgcggttgtctggcatttttcaaaagctcccccccccggaacagaaaaaaaaat

SEQ ID NO: 15428 - DNA, 687 bp, Homo sapiens
cctagctattttggtacccgtttgtgacttgcagccctcccaaaagtgatattataatccccttggattggtagaggatcttctaccagacagaaatgtaaagagcatggtctgcaacagctcacatagaaggaatcttgatgaaagcccaataaagtaccatctcttccaacttggcatggtgatcacagctcatcactctgtatctcagttttctcatctgtatagtgagaaagatcgaatttaccacatagggcgtttatgaggatttaaagtcttaatacaggcctaccttggagatattacaggtttggttccagaccaccacaataaagtgaatatttcagcaaagcaagccacacaaattttttggcttccctgcccatataaaaggatcttcaccaggagtagattccacttctcaagaaaccactttatttgcttatccataagaagtgactcctcatccattcaagtttgatcatgagattgcagcaattcagtgacatcttcaggctccacttttaattctaatctcttgctgttttgctacatcttcagttactttctccacagaagtcttaaactgctcaaagtcatccacaagggttgaaatcaacttcttccaaactcctgttaatgctaatattttgacctccctccatgaatcatgattgtcttaaaaac

SEQ ID NO: 15429 - DNA, 850 bp, Homo sapiens
  misc_feature (1)...(850): n = A,T,C or G
gagaagacactgcagaaaaagagccaaacggtcatgcagacaaccccnccacacccgttttgngcggcaacgnncagcncgactttgngnagnannacgagcacgccncaagcaagaaggnnanncnccggtggcaggaannggaaacacncccggacngaagagacacacaggggagcagccacaaaggacagaaacacccaccaccgcggcccacgccacgcgccagaagacaagagaccancagaacagggagaaggnnaaaaaaacacagacacacaaaactttttaactactttcacttggaatatccctgagaaatccagggtttttgtccaactctgggtgagaagaggagaccagcccagcccacaagtacaggggagcagacagcaaagaggccagcacagggggcactcccgtgcccatgttaaaccgccaggggaagcccagccctcccggctgggtccaccctcgatggggcggcaaggccacccaacggaaacagagaagacaagccccaaagccaaaacacatggcaaaagcgacccaagggagtccagccccaggagagagacagcacgcgacgtggcccccgggactcccggagggccgcgacgcccggccgagagccgctgcgcgaacaacgcgtgccaaggcgcgcgcacaacgagcgcagaacaaactccggcgccggcaccccgcacagagaagagtaggaagtaaaggagaggagcagagacgacggccagccgaaggggagatgcaagagtaaaggaagacgagaaacacgaaacgaggaggagagacaagcacgataaccaccccagacctccactccaaacacccg

SEQ ID NO: 15430 - DNA, 882 bp, Homo sapiens
  misc_feature (1)...(882): n = A,T,C or G
ggagggaaaaagnaaannnanaaanaaaaaagnaaggaaaaaagaatttatttcacgcaacctacccgctcttgccagtgaggaccatttattttttttgcacaagaaatagtttatttaagagactgtgtgttactgaagaacagcataaaaatatgatttttttacttgcaaaaatgaaaggaaaaaaataccacgcatctgaaatgcccagttgacactgaataattactgctgcaccacggaacggacctactataataaaaattctgctttgttttctgcggttcccaaagcactcccaatcaagcaacaggaatggaggcgtctaggtttttnaatattacctcccctgcagcgacagcgtcaangcacgtgacctttaggaggtgggcgtattgcccatatcaaatcctgatgataatgacatatgatattgctcggtaactgtccctctcctgtccccccatgccatcctcagcccacgtcctctacctgactgactatatactaccgggcgaggaaacttgcactgaatgctttgatgtcctcttctttacccttaatcggccttaagcaggtaaatctttgccccgtgcctacccccccttcctaccccccacataccgtgtccgccgctgaacagtccaccctactccacccctcgcaaaccatcatctgcccataccccctctcccattctatccttccacattaccccaatttcctcctcatcacaccaattaccaacactcccttatcttccacttatctctccttccatctaccctcccccctccacgtaaccccacacctcccaacctctctggtctttcgtcctccactcccgtacaaccccgcccgtaacacaactactccact

SEQ ID NO: 15431 - DNA, 857 bp, Homo sapiens
  misc_feature (1)...(857): n = A,T,C or G
ctcacaataattattatcactccctactataataagatagaaatcttaaccttatnagcaccggggtttcaccttgttagccaggatgaagttgatctcctgatctcgtgatccgccagtttcagccgcattacaggtgtgtgccaccacgcccggccaagatgaagttttctaatcctcatagtaattatgactatttcattccctctcgaaagataacaccaccaaactagagaacggaatgcctttttccatctctctacatttgctttcttcaactttgaaaacaggccagctaatgcgacctacgatggcccttacctgtctgtgatgtcgtaagagtctatctggaggtgcctgaaactcccccgcgctccctgtgtactaaaatgcggacccaccgtttcgtcaccatcggtgccgactcttatgatacccctgaaccccctcctggttgttttttatttgtcacacgccagtagtcgtgggccgtgtctgtgtgtctactaccccgatgaattcgtcctatgttaccatctatcgtcacaaatttcacacgcgaattaactttttttattactttctattttcgctttgtcaaccggccctatcagcttctctacgtagcccttcttcatctgtatactaagcgccgcataggtagcctgttatgggtgcgtcttcccctgctcgtatatgcgtctctccctaacttcatatatgcattataccctatcactcacccccagcactcctcgacaatccctaatttttatatctttttttcgcattgcctactcatatcatcgaccacaacaattaggagtataaatgcgatacatactccagttcttccg

SEQ ID NO: 15432 - DNA, 1159 bp, Homo sapiens
  misc_feature (1)...(1159): n = A,T,C or G
ccgagcaacctcatctgtgcccccattccgcacaaaccaccaccacaacgtttgcgaggacaacgaaaaaccatggtttgccggagnnnaactggaaaccctacatggagnatagcgatatgtgtttaggcgccaggagcacaccccaccacgcaagaaacggaacccgcaagcaccaaaccacgacaaacagcccaagccgaagcccccgagaagggacaccaaccaagacaaacggcgaaaacccagagccagaaagcccacgcagggccaaccacacgcacgagaaacgaagacgcgacgcacgggcatttcttttgaacacaacaaacaaacccgacatagaaccgacgtgccataactatatgtcggcctatatacccacccactatgttactaatggatacattcactcatatgtaccaacctggtcgtttctcctctacggnaccattcatgaacgggtctctgcatcttgactcagcacataattacacttacacacctctttcctgttccccaacttgatacgtgtttcagtctctaacattccgccaccgcacngcgaatgtagatatcatctctcatgactcttgccattatccgctcccctctccccacgtactcttccgtgttcatatccgatcccgttctgactccactttcgctattcgtatacattttcatatccctctccgctctcttttcgctactccactctatatattctatcacagaatgtcatatccacgccacctgctcccgtcttctctccctcccaccgtcccgcatctgtcctgcacgatcacgatccgacgcanacatgtttgttagaagacattcggatcgcgtacaactcttttatgcacctcacacgtcacaactccatcactgcataccatgactattttccgnatttccacctccaccacaccctccnttatctaatataccgtatttattatctctctctagatctatacatttccacacacgtcccgcctccctangcccaacacgtatataccattatcatnagtcagtaccancacaaactactcgccgcactcacattgatacacattactcntatactcatcgctcccacatcancatcgcagtctatatatcacacacgcaacctcacgagtacaccact

SEQ ID NO: 15433 - DNA, 792 bp, Homo sapiens
ctggtacaacttgaatgcacatatagattattggtgaccaaggtcatggcatacagtattatgttcagctgaccttggactggtaaacagtgttggttgagtgtttaatacctaggaagatgtaagtgtggaaagcaaaatttaaaattgcctgtgttagcagtgtctgggagctcaacttacatcacttgggccatgagtctcttcatttcttgagtccactttcctttgtattagcctcattttcaggttctgaatagtgacccctgacagctccaggtttacactattcttaatgacagcaaccccaggggaacagggaacccctattttcagttgcacaaggaagtcctgagattagctctggttggactgacttgggtcacatgtgcctcactgaacgaatcattgcagctagggaagtggattctgctgaacagtcaggcctcagtcatgtgtccaccactggaagttttttaagctagtgtttgcataatatatcttttgtccacacacaaaaacaataaccaaaagaacacaaaactgcctgtgttttacctcattaattaaaattaaaagtctttaatctaaatttcttcatgtcaatgcaaaattttaaaatcttacgtctattaaaataaaaacggcaatatttactctattattttaaaaacatagcttattttttaaaaaccatccaacttctgataagctagacacacactattactgggcttaactgcgtctttcagaaattcatttgtggaacaaaatcccccaccctcaaatgct

SEQ ID NO: 15434 - DNA, 745 bp, Homo sapiens
  misc_feature (1)...(745): n = A,T,C or G
cctgcctgtgacaagacaactttcatgtcaaaagatcaaggtgaagagaatggacactcatgcccatgtgattttgctgccccaagtctactggaggatcaagctgcaggtttcaatagctatagcctgaagaatctctgtaatgaactaaaacaatcagtaaaagatcagttgcagtggaagacattatactctagatttttctaggattattaaatttgaaaatgatttattccaaattttaacttagcttttaattttactagtgtcaaaatgttgtactactttggacaactgatttttccaatagagagtcattagcatctttgcagggtggtttaaaaaccaataatttaatccatattctactaaaacttttaatgtaagcattttacccagatgtattttttccttgttttagaaaatctgattttaattgctaaaactcgtttttaaatattaattcaatgaaagaaatgctatggttttctactttttcattttttaaactcaaggggaaacatgggtgaaaaacaaaaaatgttctgcatagagcctcctttaatggctcactttggggatgtatgaaaagtgaaccantttggttnacccccccaaaaaaaaatatcngcttccttggccccagcggggggctctgcggcccgtttcctttagggaggggaaattatggaccctcgatcacttcctcctgcctctcgcccttcgctggggcgaccggttcact

SEQ ID NO: 15435 - DNA, 859 bp, Homo sapiens
tcccccctctacctccttgatttgtttataaacctgggcgtgtcgggcacatttcataacaatcaaatggtagcttactaagagtcttcctctggcacaaatggaagattaaaaaagggagcaagcagataagatgaagaagatggcgatcaagacagagcaggtattctgagatgaagagatcggggtctccttaccctgcccaggattatctcacactcctgggctaacgtgattctccagtcctggcttcccaacgcgccgagtttcatgcaagatcttctgcccccggccttgctgatgtctctccctcatccccctagattttcctactccctctcacaccccccataccttttactaacggattcacgtttatctgtccctgaccgcattcccctaaccttcctcctccattctccctctctccgttttcccttccacctcccctctcctcttttttatactattctacctcgcctcttccgcgcctccgcgccatcactcctcttcgccccccaagatcgtcgtccgtccttgcctgttgtccgacccccgtttgagtgtcctcctcgcccccaccagtcttcccccccgtcttcgccagccgtcccgcgcgagcctctcctctctccctccttctcctcagtcgtcccacgtccgctctctcttcccccagcttaattacctaatcccccttccccgtcaccccccccccctcctctttttttctgtttcccgtctcacgtatgccgccccccgcctccccttccttattacataatatggcccgactcctcccgccactacttttatctcccccctacacccatcctccttatcacgcggccgttgcgct

SEQ ID NO: 15436 - DNA, 787 bp, Homo sapiens
cactagaaggagagctacggtctggcctccgggctggatgcatagggcactgggacgacctcacgttacattatcattgtacagctctcttggatacaccgctattttcctcgctttaatctgacgagtgagtgtgcctacctgcgcactgaccaacacctacgatactgactgtacctgagcattatacacatatcatttgagacagacccgagggtccagatatctatgactgcagaggctgcgacctgtcactgcctaccgttgtggatgcggatcattgcaccctgacagcggacactagatctatttttattgacagcgctggaactgactttccgatggcgatacatagttatttgagattaatgtggccatgtatcatcgagaatatgtgagaataaaggacccgtcagagctgagtgatttgagtttgtgaattggataaatccatattcctgggcctgaatcttcagaattttttgccatacttacgaacaggaacggggtgaaacaagcaggggtaggcaatgggaattaaatggaccaatgacaggtctaaaaccaaagggggaatctattcttgccagagatgttggagatcctgctttcaggggaattggcaatgaaatcttcatattgacttttcgcccaacctttctggtacctttattaattcctcttgcacacccaccgaattggaaaattatgaccgcaagaggggggcggcactggaggttgcatttgaaccaggcccgcaagagggcttggtgccgaccgggagggt

SEQ ID NO: 15437 - DNA, 784 bp, Homo sapiens
  misc_feature (1)...(784): n = A,T,C or G
ttagcgttctaaccatgtctagcgatcatctgtngtcacagaagcccagaaaagtatagtgagtatctttatgtgcacatgtatgtctactgcttccttgacaactactgcagatgccgctatcaccatggggatggttcttctaaatgaatcaccatcttctaaaggcgatgatggactaagactgataagacagcctagtggattgggcctggagcacttcttcttcacttttctactttcaatatcctcgtttcaagaccctctgttatactcatagctctttaagtactagaagccatttgtgagttgcattatgagaatggtgaccatgaagataaactgatcctgactttatactatatcgaaatacttcattacattgttatcatctaggtcactcttgcctactttatccaatctgtgcgacatcctactaaatttgatccacagaaatcgatggtaccattttactggtgtacaaaagagagattaaagcgttcctctcgcctgtctttccattgatgtgccacattactgacataaagcacaatgtatcattcattcaatgacaaacatctgtttatccattagatacgatccgatttttactagaaaaccttagcatttagtctcaaattctaccacccgacctacactagctacatgactcatatatatgcgcacgaatcttagcctatttttttctaagtttaacggcaaaaacacattgccctttgttagcaaagtgaaggacatttgcgcatgaaccctcaaggagagt

SEQ ID NO: 15438 - DNA, 789 bp, Homo sapiens
agcccacaaggggaagctttatcagcatcttccacggtcttccctgggcgcaactggtggagttcaaggtagaaaaggctgtgagattatgtgaaccatctcccatacgacatccctaggggttgaaaactctccaaggccttcactcaagacccaccgattcatcaactacttttacttcactcagcgtcgacgagaaagtggggatatagtggtgctcagaagtgactgaatgcgggagttgagactggaattccaaaaaactgcactgtccgcttcccacctggactgaagatcagtagccatttctttcctttaggcatactttttttcccttagaattgaaattcacctttattaataataaaaaacacaaattcagaagtaggttagttcactcacatattatttcagtgagtattactgcacagtcacaccaaatagttcatttctctttgttacaaaaaattatttgtttgtagctaaaatatgttcatgcatcattccttctactcctaccctcaaaattccattgtcttttaaattccattttcttctttattgtatttggagttccaggtggtatatctgctgttactcacaaacaaattacttttctatggcttaacagaggcatattcgaatatataaacaaggtctataaagtgatttcaggactcttatacaactctgactcataatgattgagtaaaagcccagaaggaaattgcagaggactcattgccatgtaaagaccactggacgatgagtgagggtactcctaaaggt

SEQ ID NO: 15439 - DNA, 850 bp, Homo sapiens
gcggggcttcctaggctacgtagcagcgtggacaaacacaacacacggccctatgatctcacgtcgtcttttgtgaggcagtcttaaaaaggcccagaagctcaacagcagtctcaacagcacataaaaccccaccgacggcggccgcgcttgcgcctgcgcactcttgacggccgcccgagtcctggcaggggaccgccaggttaagagatctcgggtgacagcggattcgagaggttacagtggattccagaggttacagtgcgaagagcgcgagtattgcaaccgtgcaagtgtggtattgctggttacaaccgtggatttcatcgtcgaaatttcacttttgccttttttaagactaaaaagctaagctgtggatgaatatatacgctttactaaaaactcccatacgaagattatagactcaaacttgaaaaacatatcatttcttttttacttcagcgggattatactatcgacattctaaaagttgaattttatacttagcaacataacagtgacttgccttcatgtgaacaaaagtacatactcagctactctaatgtcgctatggaccatatattatggggggggccgatctttaattggggattggctgggagtaactgcctcggtgtgaccagcggcaactatatgcctccaccggcggaggtcggggtgtgtttgtcccccctaatcacctgaaagctcgcaggttcgtatcgggggccccgcgcacttagattcaagatacactttggtatacgcactaatatatataaattgtctcacgaactacgcgctggttcacttctagccctcggccgcgttcgtagtcgcatccgtcggc

SEQ ID NO: 15440 - DNA, 1242 bp, Homo sapiens
  misc_feature (1)...(1242): n = A,T,C or G
ccaaatcacattttccttggttagtcaaatgtcttctgacgtcccaagttctgagtccgctacctagcggcggtacatacattcagccatcgttgtagaggatgctcaagtcatctccaatggtatacattccaatctgtagagtgactcttgaagacatcccatatcaacagaagtgcctatgtagtttgacgagaacttgtagctctctcttgcaagaagtatctagtcacctaggcgtctgcacatgcgctgtatcaatacacaagctctcttactagcgagtacatgtgtcatcgcaacgattatacattgccagagcaccaatgctcgagctatgttttgtgcattatatctgttacgttgaagcagatacactgatgatccgcgaaaattccctctgaaactagtattgcttgcctactcttgagattctctctgaaacatccttacagggacgcgctctggtgtagaatagtcagactagatatagctttcacttaagtctcctnatcttagaatcgtcacaagccccgcgtttggcccctcccacaatgggcctcttatatcagttatatggcattcncgtactggcagtgcacacgcgttncaccttgtgagggatgagaggagagccgagtctccatttgactgccattcgtttttatcttcgcaactccagctatcacgcctccgtctattatttcctatcttgctatatacaatcttggcgctcacatttatgcctgcgacggcggatacgttgtcgacttgatatattcactacacgacatcacacagtagatacgtctccacgtggaattcgataatattgtcgagtcttatatattgcatcagttcaattcaggggctcatcgacagcccgaatcgatagatgggtttgggtgtctcgcttgatgatattgtatgtcgctaagtaaggctcgtcgcgtcaccatttcttcgagacgatagctgtcatctctcaggacactcgagactcgtngtcgaacgatacttctaggaggtggaggtggatatatcacgtagacggcgtatctaatagtcgtgcgctncacgtgagtcgtctagatctcacgctagtgatgntgatatgtgatcatacactcgtgccatatcgtcactcatgatacattaattcagtacgcgatttctccttagtacgactcacgatcgcggagtgcttgatagtattgtatggtataacttatagtcgcgtat

SEQ ID NO: 15441 - DNA, 244 bp, Homo sapiens
ctgtgtgaaaacatgcctttggtacagaacacctacttctagcaaaacagatggaatcctgaaagcattttcaacttgcatcactccaatgccatctgagtctatcccacagagatgaacatcgcattagtcatcttgcaatgccgtggagctcacatataaccttccatgaatcataagaagagaaaatctctctcaaaagttttatccagaataaaatattaaaatgtcaaaaaaaaaaaaa

SEQ ID NO: 15442 - DNA, 285 bp, Homo sapiens
cctagagatgaaaagcccaggggaatgccatttacaatggagatgctgacctgtcactccacagaagcctgaaggatggcacatcgatcggctcccaggccctgcaactcccagataacccccaggcaactgaagagcagaaaccaactgtttgtggccagccctgagctagggaccaaggaagaaccaagacatgtaatatcttatatcctctccctggggacttctcaacttgttggagggaaaaaagatacattaaactattagaaaacaaaaaaaaaaaaa

SEQ ID NO: 15443 - DNA, 836 bp, Homo sapiens
acatcattatctattatactttttttattataagtgttgtgttagagctagaagctacattaggaagctcagtagggtcttcggctgcatgccatctccagtgcccagcaagagataccaagaatgtccaaaagcagaatgtcctaacacaacagatgcattggagcaagcctgccatctgaagtaggctgagtctctctgcaaacaatcccatcacccctaccaatgagctttgcctctactcacccatctgagctccagccttcgcgtgtgactccgaacggtggagttttctcctaaatccattcatcttgccaaaacactgttcacaatagcaaagacatggaatctactaaatgcccatcaatggtagactggataaagaaaatgtggtacatacacaccacggacaaccatgcagccataaagaagaatgagatcatgtcttttgcacatacatggatggagctggaggccctcatccttagcaaactagcacaggaagacaaaatttactactgcatgttctcacttataagtgggacctaaatgatgggaacatatgggcccatagaggggaccaccttacactggttcctattagacgatggaaggtggaatgagggaaaggatcaggaaaaatgactatggggcgctatgcttactacctgggtgatgaaatcatctgctcaccataccccatgacacaagtttacctatgcgacaaaacttcacatgttactccttgaatttacagatactcttaacataaaaataaattggccttataggtcataaaactagagacctatgacgcttatctataacgaggataa

SEQ ID NO: 15444 - DNA, 642 bp, Homo sapiens
cctagccaggaactgtattgtgccgtctacaagtggcacaaacacaggaacccctttccctcttcctggcctgtggacctttctgtgaggcatggggtagcaggagagaacaacaatgacaacgccctttcaggctccctcttctcatgaacagctccctctatagcacagagaacagtctctccaggcctctctggaaagcagcattttaaattgcctcacaccagctcctgtctagagtccagccgaacaacagaaggaaagtttacctttaccagtaacccaagaatttctaactagggaaaaaatggtgccatttttttctactggatcacctcccactccagcgaagatgaaaaggctagctaattccagtgctggcatgggtgtgagcaagctgacaatgggtaggctgttgttgggattatagaccaataaaacctcactggataatagtttagcattacagatttttttaaaccctttaacgtatatgcttacattttacccatcaatccaaatctgtcagcttattctcaaaaaataaccatacaagttgtaaaatgtatattaaaagataatgttcatgtctggtttaatatgaataaattaaaagagcacataaatacaaaaaaaaaaaaa

SEQ ID NO: 15445 - DNA, 789 bp, Homo sapiens
ttagaaacaggctccccgagctgttctacctcggcatcatctgtgtctttgcctacatcgcgggacattccattgggcccagtcctgtcccctcggtggtgaggaccgagatcttcctgcagtcctcccggcgggcagctttcatggtggacggggcagtgcactggctcaccaacttcatcataggcttcctgttcccatccatccaggaggccatcggtgcctacagtttcatcatctttgccggaatctgcctcctcactgcgatttacatctacgtggttattccggagaccaagggcaaaacatttgtggagataaaccgcatttttgccaagagaaacagggtgaagcttccagaggagatagaagaaaccattgatgctgggcctcccacagcctctcctgccaaggaaacttccttttagtggccctgcatgaaggacgggagcccatattcaaggcttgcttctatgacaatgggcctcccggccccaggctctggggaggataatagcacgggggcttttgtccgtgccccccatttaaccttattatggctattatcaaatacccacaacaatgcatatttaactgagaaggtacaaggctagccattgacgaatgaccttggagaaggggccgagccctcaatcttgatcggttaaaaatcattttccgatttcacatgggaccaaaattaaacgatctaccaccgcctctttttaaagtaaaactcttcaccgtccccacataacacaatgatacatgcctattcggctcaccacc

SEQ ID NO: 15446 - DNA, 793 bp, Homo sapiens
aaaccaagatgagatgttcattgaaaccaaggattagacagctgaattacagcagccatcatcttgcccacatgcccatgtagacataaagtatccgtcacaacccagtgtaagcactggccttacttcctgtaccttcttttcattcttttttacggttttattgtttcaattccttcaagaaactccaaaactttcctgtcaagtatcacccaaaaatgactctgctgaccttatttcaaatcattgataaactgccttaatatctgaaacagaaacgtggcgcaacaagcaactgctcacttatcctcaacgtctcccaattgatatcatccttaagcccgtagatatggccctcacacctgtccgatcgaactattataatcagtccagcaaaaacaatagataccccccccacaaccaccacactacggccaggcctcgtccactcaccacacataccggtcccttccgaaataatcactaagaaacccccattccgtcaacacacacaacacaaataaactccttaactactcaaccaaccgagaagacccccccgtactgtatctccctttccggtgagataacgactacaacgccctcacctacaccccaccccgtcgacatgtccgtcttccacttatcggtcatctctgccttctccgcccccgtcttgccgtcagatgtgacctatcgcctccaccctctcaacccaatggatagaccatgcacaccacaacaacatctacctcgcaggacgattcatccagaaatacatcacaacgccccc

SEQ ID NO: 15447 - DNA, 443 bp, Homo sapiens
  misc_feature (1)...(443): n = A,T,C or G
cctctccactcacttccccttccgtcacacgtaatgtggatacccacaccccgagaattcggctagtaaacgacaccctgagnatcctcatacccctggccagctcttccccatgaaggtacaggaggaaggttaaacaagtaacagagagacaggaggagtgaagagctagtgtgaagtcacggtggactagaaagctgggggctctgcgctcctgcccccctcctctcccacacgtgcaggtgctgcccacacacccacgagagaaggccaggctgtttgaacgctctgagaattggcaacacccatgactgtctccaaatcataatcccgatcctaaagaaagaataaaacgctttttccacctttgtcagcataaatagatacaactccggaaaagcctgtccttttcaagtaatgtttacttacggaaaaaaaaacaa

SEQ ID NO: 15448 - DNA, 818 bp, Homo sapiens
  misc_feature (1)...(818): n = A,T,C or G
ccagcacagaggccggtcagggggttgtctgcgcaaaccaacttcaggacgcatgctcctcgatgatcctgtaacagaggtatcgacaacaaccctggagcctccttcaaattatgggacatcaccaacaatcaatcactaagagaagaaataatttagaagaagaattcatttttggttactcaaatataacccaatttaaaggagactgttatttctcttctctagtaagctacagacaggatctgctccctctaataagatgcttggttaataacatttatttacagagtaaaactttctctttatttccctccacactaaaatatttacataaactcaaaccacttatgtagcctattacaaccagtttcttgtcagagtgagcacgaaaactctttattaaatgtcattgcctttggggctgaaccgaacatacagaaataacccgttttattaaaataaaaacaaggtggcctgtgaggactcatcgggtggatctttgggggctgttccctttacgtagggttaattgatgaatcgcgctaactagagtcagtaagcttggaagtacagcttcagtcgaaaggtatcagctaacctccagggcaggaataccggtgtagccattgatcaaggcttatccacctaagaaatggntgtaagaacagcggggtagaggcctgttgttctgtaagggtcacgtttttgcgtttgggtgtgagtatgcgacccgggtcgagtctcgggaacagtgatgttgaaaaaataagggagatagcgccagcatttttgttcggatggtgttggcccgtcgc

SEQ ID NO: 15449 - DNA, 763 bp, Homo sapiens
  misc_feature (1)...(763): n = A,T,C or G
ttcaggtacctggatccaaaattanacagaagaccacttcatgtgacttgaaccagatctgaaatctgaaatgaagcccagaagagtgtagctgaagacaagtgaacctacttgacctgcaaacgcacatgatataaaaatgaaaaaccagttgccctagttgcctctagtgatgatacaggaaattgtcttgttaccacgatggaagctaatgtgagtctgcatgcagagaaaagcagagtgaaccgaacctcagagaacttgagacagagccctgattttactaacccaggatcctacctacctctgacctaatgatttatgaaataataagtgtccttattgtttaaacatattgtgtcaaggtttcctcttacttacaggtgaaaacatcttatttggcacatatccctatgctcaagtactgtctatgtaaatagtttataattatattggcaccaggtaattattggcaccaattaaaggcagaatttacctttaaagatgtaggtaaacaggtcggcctcccatcagattggtatttttagtgctagattgatagtaatgacttctggttagagttgactggttgatcacataaattcatttcctttctgtaccaacactctccataaaatgataattaataaacaggaacaaagtcaaatactcaatgacaggaaattgggaagacagtcttcagagaaaaagattccatcacaatttttggaagatggataaaataagaggtgatccaaatatt

SEQ ID NO: 15450 - DNA, 825 bp, Homo sapiens
  misc_feature (1)...(825): n = A,T,C or G
agagcaggacgggcttaggttgtccacccccaaactttggggcgacgaggcacaggttggggggccaactcnaggacaccgacagccgagggggaggccaggttcaaagcgagcnccaagacgggngcaacaacaaccnccncacccacaccggcacccgnggctgcagcagcggagcccacacgagaggcggcgcaacaggacggcacacggcncggcccagcccacccagagccccgcngcgggcccagacggaccctgtctcacccctgaaaacatcagatgcagaaaaagccctggacttgtagctgggaagcctgggttctggtcccatctccgtgactgtttcacgtgagacctcagacaagtcacgccctctctgtgcctccgttttctgcatctgccaaaggggttaaacacttctgccccacttcaaataacaagactatggggagaacccaattagggaggaaacatgaaaaaccttggacatttatagaaacagtgttacgtgcagaagataaccttaatatccgaagtgacccccaggccccagagcaggcaaaccggaatgacttgcgcaacttggcgcatgctatgtcgcgagagggcacttgcggaaaaacacaggcctgacagagaaaaaaaaggtgcggatacgcgggccccttactagggaaaaaaaaccatatgggccttcttggcctcagtcggaggagcataggagacacctacccttgaggaaggggaaaggatgaggccgcggacctagcacgcggggacgggtggagtgggttaaggcgaccggcgcaatgtcgatgaaag

SEQ ID NO: 15451 - DNA, 763 bp, Homo sapiens
ctaggtgatgagtctatgaagcatgtgttctctttctacaactatctggacccccggtacatatgaaggctgaatgcctttgttgtggggaagagctgctccgacagagaaatggctttccttgagaaaatggctcactgctgaagaagtctccattatgaagaggcttcttcctaaattaatgatttgcttcagtgcaggctgatcacagaaaataatataaggtacagatcaaagactccaaatattagaacatgggctatggaagatccatctccaagcttcccaactttcttttccagagattaaggaacaagataggagaccatgcctatgactcgtcccactgattgtcaagtagaaacagtggaggaattggaagttagcttagctgaaaagaaaactaaaaggaaaattaaaaaatttacaaagcatcacttatgaaaatgctctttaagagaagattgagaattagaccatttccactcaatatcaccaaaactagacaagaccccttcatgaagtcctagagtcatctctataaattatgatgcataattaatatagttaacaagggtgataatctggttgattttgatggtgaggctttttactggaaagggcaactacttggctttaagggggggtatgggggggggcacaagctcccctggaccttaataattaataagtggaaggggggaaattaatgggaaggcctaaatttcttttcaaactgttggccccctttggacctcttttt

SEQ ID NO: 15452 - DNA, 787 bp, Homo sapiens
  misc_feature (1)...(787): n = A,T,C or G
cctagagtgatctcagctggatgtgtcagaaggttctntggagaaaagttatgaaattattatcttcaagatttggaaaattagacttactagtaggcatggtagaattttctgaatgacttatttgaatgagcaagcgctctctccagggctgggcctggagtgttctccaaggtgatctagcggcaaagttgttcctagttatttacaaggttacctccaacatcacctccttggaatccaggagtgacctgggatttccacctgagtcatggtctgcattcagttcttccctgtctgcccagagtgatacaccctctaaaggtgcacctgagactggctcttcttagcaactgaggtgtgtaaggaatctgaaaggccctcccatggctgcccatggaccaatcggtgtattcttcctcccttctgaggcccataaaagccccagactcagtcagactcaaagagacaacaagatgaccagctgcagggaggagctatcctctctgcagaaagctggacactcattgggacaacctgactaagagaggagctactcgctctgctgagagctgaggaaatgatgggacaatcagccacagagagaaattaccctcactgctaagagttgaagaaacaatgggacaaccagctataaagaggagctactggctncgctaaaagctgaacacttgtcaggactccctggctatgaagaggagctgcccattgtgggactcctatgagctggtctattggctaaataagttctcttcatcttgctcac

SEQ ID NO: 15453 - DNA, 1190 bp, Homo sapiens
  misc_feature (1)...(1190): n = A,T,C or G
ataggggnngaaggttgttagatagagaaaaacacaaaagagttttttgnattgtaaatacggttctccnctctcttgcgtttgttaagattcaatctatgcactcgcccgtagtncacgagtcacgctggaggcgccgacctccacggcgcctatgtagtgtatgtgtacatgaggtagactattatccctaggtagaggcatcttctccggaattctctcaccgtcagcgtgcccccctcaatcatcgtctccacccgcacaaagaaccacagcctactactccattatttatatgtcaacctgttattttctatctacacattcctgtacactctccctcccacctcaaccacaaaacactaccacgcgcgcccaggcgcgcagtcccgtgcccgcgatttgctcgcgttgtagaaatgatttattttacacccaccccccacgctttcgccccggcgcgcgcccccgccaccccccccaccccaattaactaaatctatatttaagtggacgtcatgctgccccccgcccggaggagagaacagacaccgggaatcgaagggagggtaaggacgtggcaccgattcttgttggtgattttactattatgtcctacccccccacttagttctcccgccccagtggctccgttacgacgacaccaccaaccaaccacacccccccacccccgccccgactactctcccctttcccgcatagtagaatttccttcttcgcttttgttcactcattttcccaccacacccacatcatccgctatccgttcaccacacgtccgtccctcatccaaccaattcctaccccccccccgtcccttcaacccctaccctctcttcattaccttacgccacacatccgaccccatgaaatctctctcaccagcacctccagtcctctttccgcccttccgtatcgacttctgtatatctactcagcaacgacccaccccacgcgtttacacgccgtattgtttccgcacctccccacgcaccaatcccgactcattcaccactcatatcctcgacgccaccccccactcccgcccacacacccccctcgccgcctgcaccctcatcgctgctaccggccgcggtcgtcataaacctcatcccctccccccccctctcttcctccacctccattatcacctgcaacctctctattcg

SEQ ID NO: 15454 - DNA, 794 bp, Homo sapiens
gtaggaggacaaaacaatcccagttacttgctgacaaaagtcaatgacaagacagtgaaacagtaacaccatttgcgtatgtggggctgtctggacagtcataacacttgagtgtggattttgggacaaagaggagtgaccccaaccagaagttttctctatgcactccccaaaggccaactcatctggttaatggaaaagaattatagatcctgcaagaagacgaacagttcatggaagcatgaggtgggttgctcggatgcttttatgcctgggtgctcttggaaagctaaggacagacggaaacacaactcaggacacatcaataagagaagcctgctggcacagaggagggcaggtaaaaccacctttgtagaagaggctcatttgaaaatgctcctgaaagatatgatatcagaacactatcttatgtagagtggataagactttgatgatcttgaaaatgcttactgaggaatacatagcatttatctttctttccttgattaaagaactttcatatatacatttttatcctgtatggataggtaggagaggtgatgccagcccacagagatgaccagtccctattccagaagttctgagttgttgcttaagtgaagaagtatgctggtctgctttcaaacttctggaaacttcagcttaatggtagaacagttagaaaatccaaatatctagtttcaattgcctgagtagtccatgtactgattttcaccacctctgataccatcaccttgggtttaacgttatcaccggctcccccagattcattg

SEQ ID NO: 15455 - DNA, 800 bp, Homo sapiens
  misc_feature (1)...(800): n = A,T,C or G
aaagataataggaaaggcagaaatagaaaccacgaaaaaactcaaagcaccgnagcanctaaagaggaanagcagaagcgaggggggccacgagcacaacacactgccgaagggagacaaaacaaaagagangggcagaaacccgaagaaaacaaacaaggaaccacaggcacacggcgcggaagaaaaaacaaagagggagaacgggagaacccagggaaacccagaagcaggaaacaacggcgcagcagccagaagacctttttaaacttccggcatccaaggaatccatagagcatcaagctggcatgatgaagcgaaaaagttaagccctctgcctttgataaacactcccaaccccaagaagagggcaaggaaagacagaacagggcagttatccatcatacggatgatgagatcatgtatgttgagcctaaaaaggacagactcacagtaaaacctcaccacaaagtttaaagatgacgactacgcaggacatgaaaagaagtctatatcggagaataataaggacgcatacacaaccacacagaccaaaaaggactcattagccaaaagaaccatctctggaacagacacacacagaacctgatgcggtggaccacatcccacacatgacccataagcgagtacattcaagtaccaaaagacgtagacagaacaacaaacaaaaccacgctccatcacttgacggaccacattccaacacacctaaaacccacacagccagcaaggagaaagaaggggagccaagaacacgactgtcacaaaaaataaaacta

SEQ ID NO: 15456 - DNA, 828 bp, Homo sapiens
aataggtcaaaagccacgactaaaacgattaaagtggagcgcggagagcccctggcagagacccaactagaggtaaccggttttacaagagtaactcaaagtataaatagcattcttgcatttttggaagtaaccatgtgactatctattagtcatactgttgtttattacaattttcttctcgtcaaaaaataaagcttgccaaggaggaaggaagtttgtgatataacaatttaaagctgaagaataaacacatattttcttactttctcaactggttttttcatctgaaccacagaacacgaaattgctcaagtggctgtttttctgattcatccaggagtggtacttaaccacgtatccttccagaactgtaggagaggctgatactaattaattcaacagcattctttaggacattactgctttcttatgctgtgttaagaaagatcaccttaaaagcgatggaatcacacaaaaagccatggtctaaactttggctactgaaagaaaaacaaaaactatgatactctctctcaaagacaaatgcgtgcaaagacacacgtggggggggggagcacacacacacacacccaaacacacacaaggacccacatagaggatgaaagataacgagagctgcaagcgggccagaaccgtatctataacatacgcgcagacaccattatccttttgctaagtacccagccactatatagtctacaaactgcacttagcagctgcccgaggtcctggatcaccccacaccgcagttactaggaggatactgagaaaacaagctattcccctaatcgataaaaattaata

SEQ ID NO: 15457 - DNA, 632 bp, Homo sapiens
  misc_feature (1)...(632): n = A,T,C or G
cctanggaagaccttccacgagtttttcgatggaaataacatcaagagtttttcatcttcttagtgtgcaaggtatggatattctgtgtgtgagcttcaagagtatctaagggaggcaataacatggttgataatataccagagactacaaactgtttgtgcatcccagaggaactggaagcttgtgcaggtgaaaagactggaggaggaagtatgttgatgatacccaggaagcccaccttccacttctttggtcatcagaagtaagaaaaaggacaattaaataagtggttaatagttgtttagagaaagagaattttcactttatatgccagtcattgataatatttgccacagtggttgctgttaagtaagtttcttcctgcaggcctgtgagaaggcatagtacatgaaagtagcagtgctatcaacctgattattattttacagtatggacttttattatataacaagcaataccttacatttatgtatttacttatttattactatacacttacacatatgcagacacagtaataatcatttaagtggtacagataggcgcaaaaccaaaaataaaagtctgtcttcttacttcaaaaaaaaaaataggtcttgttggccttagg

SEQ ID NO: 15458 - DNA, 425 bp, Homo sapiens
cttcaggggaaggtggcaatgacttcctgaggaaacttcatagaattgtgtgcactctgaagtaggcaagatggagcatgtaagaattcctgtaatcatcccataagatggctgacagagttttatttggtctccatgtgggttccacagtttgaaaaataaatgtttcggaattcagaattcataaactagacaagcagcgtggagatgaagaccattgacaccatggggtctgctatagtttgaaggtttgaatgtgttccccaaagtttatgtgtcggaaacttaatccccaatgatacaatgttaagggaaaggacttttaagaagtgattaggtcatgagggttctaccctcatgaataaattaatgtcctcatggttggagtggatttctgattaaaaaaataaaaataaaaataaaaa

SEQ ID NO: 15459 - DNA, 755 bp, Homo sapiens
acactcatgttaaaatgagctccttttttccagtctcagcccaggagggatcttcttagagaaagcaagcccagcccatccccacagctggctccctggtgcccattctgaaaggctggacccatcctgacctgtccctgccccaaggactgcctggtgagggatggcttaccaacactgtgactcagtccttccaacatgcccaacaggtcaattctgggatattccttacaggaattaatgagagcacattgccggtaatgttggaattagtagattacatttaaatttaaaaattccttttatggggtttaagaatagagacaagacacccatgcaataaagaaaggaggagactttgcctggtctaatggagaagctggagctgcatcgttgggtgcagtggccagtggctacacctggcttttgagcccttgcacaagtggcaaggacacattgagatgtgccctaagcgcaagatacacacaggatttcaaagactgagtatgaaaaaagaagaaaaatgttatattaatatttttatatccggtagcatgagaaactgataacattctggatataaaagatgaccttttgacaaaataggttttaaactgcacaggtcttgcttataagtgtaaatttatactgactctgacaccccttaaaacagcacgacccacccaccacttcctccgccctcaccacctacactgattaagttaaaatatgaacgtacatacctatattattat

SEQ ID NO: 15460 - DNA, 788 bp, Homo sapiens
  misc_feature (1)...(788): n = A,T,C or G
cctgaggaggcatgagacataattaacatatgtaaaatgaacattggtttggctctgaggtgaggagggagcttggaggctttcagatcacaggttcgggatggcacgttcctaattccctcttgaccacaaaatgtgaggatctagcctcaaatctgcaacgcttgcgcctaagaaaaaaattgtttttaaatttccatttaacagaaatacagatgcagagccatataatcatcggtctttgatcactcagcaaatcacagaacaaggaacaaatcctagaggggatgacaggccagtttttgaccctatagcccagcaacctcaacacagaaccggaacctttcccacattaatcgcaaggcaagcaagcgacagatttttactttttagttcaatctttttaaatcaattataaaagatgacaaatatacacctctcttgggatactttagatagggccttatataagtattatatgtcctaaatcaggcagatctttctttatccccgtcacatattttacatttctgaaagtaaaacaggaaattacttcaagaaaatgcctggaagaaaagcaaatattttcaaactattcagaagaatggaatttttcaaaaattaaaagttgccaaagggagccaggcatggtgggtcacacctggaacctcagtgctttgagaggcagagacaggatgatcccttgaggccagcagtttgagaccagcctgngtaacatagtgagaccctatctctataaaaattaagaaattagctgggcctggtgg

SEQ ID NO: 15461 - DNA, 834 bp, Homo sapiens
agatttaaattaaaataatattatagatataacagttaacagcaaatggcaagtttcaacttactctctcctgctgtctgtgaggaggcaccttccaccatgattgtaagtttcccgagtccttcccagccctgcggaacttgtcctaggtcaaaagaacagaactcagtgaatactttcagtgaactcaacacacaaaaatgaatggccatggcatctcatcagagtgcagctaatgacctacctacatgagagtgaagcttttcttggacaccaaagagagattgcttgcttccaataaccccataatgcccagcataacactaagcattcagacattttaaaatactttctgaatataggagacaggatcagcaatgatacagagggaggcttctctatcatcacaagattcaaagtgaaaacaatagtagagagtcactgctgacctatatggatatgtactataaggaagaaatgaacctatattgacaacaacctctgagacttgaagatcatctattactaaagcataacctggccagctctgatttaggtgttgtattactgaattaaactgtggcattactcactaaaatcaatgtcatgccacacaataaataaatttggcttgtttatgtctcaacatgaggatactatctggccacaacccattactcgacaggtaaatctattataccatattcattaaccgcattcccttgaaaaaatatataacggcaaactgtttcaggttacctcacagcagtatatcgagtaaacaaggagccagggagttagcagattaaaaacctttccaataaatagtattga

SEQ ID NO: 15462 - DNA, 460 bp, Homo sapiens
gtacatttttgagtcttatggcagtgctgactgaggacgagaccaggaattattaactatgaggatgctggtggctaaattgaggagacaccttaccaagacctcatttattttaacacttcctgggagacctttattgtcaaactcgaccagatttattcaacaaacagcaattcgagaaagcagtggaaaagagctgagtcacagtgaaagtgacatttccctttgcagctgaagaaaccaccggctgttattaactgcttgacaagtcctccagtgtgaaggatcacaatgggatcaagaaggcttggctgggctatgagaaagaaaagaactgaatcaaattggagcctgggaaactcagttcacaggatcccctaaaagttacaaatgtcacaagtgtgagtgaccattcatttacttaatcaggcaataaatcttttattcattcaaaaaaaga

SEQ ID NO: 15463 - DNA, 777 bp, Homo sapiens
  misc_feature (1)...(777): n = A,T,C or G
caggataaggagagagaatgtgttgagctttctctgagtgaggcttgtgcctgnactctcattatttctgagtagagcccagtctgcctggaacattggaaaacaacaggacatacaagcattgaaggccccactgtggccacttcaggagaaaatggcaaagacaagtcctgattaatgaagtcacctatgacgactccacttcagacaattaactcaagttcccatcttcagctcccggagaactgagacacatcattaactgttttttatagtgactcctccaccctgaggtgtcctaaacattcttgtgaccagagaattttcagctgataaacttaagatatgatagaaaaaaatggagttggggaaccagttactctatgaaaacttttgtaagtagtttcccatggattaataagaaaacctccgctcatattacacaaagataatttcaaccccattatagacacgtgatgttattatttgtggtaagccaacattttcatggcacatgcgacgttgccagtgacagagcaggagcattgccatcttggacaagcactgccattttaaagttccccttgatcaaaaactgcctaaatcaaacccaaagggcatcagcctaatggctaatgtcagtatgaccataaaccacaactgacatctctgaccagaaacattctaaccctaagataaacccctccccgaccaaggacatgccagcgccaagataacctcccctttgatcggagaaatgtagccccagacaatctc

SEQ ID NO: 15464 - DNA, 771 bp, Homo sapiens
agagacaaggtcttgctctgttgcccaggctggcttccaactccggggctccagtgatcttcctcagtttcccaagtaaccgaggctacaggagtgcaccatcatgcccaggtggatttctaaatttccaagattgttttcctgttgactatggacatccacataatcaagtttgaattgtgacacagcaacagtgacctcaagaagacaactgaactagatcactcgggggacctgggatccaattgaccttaggtcctcgtaaataatcttggtggctgaactctgcaaactctaagggccttgcagctctcatatgcggcagttctgttactactaggtctgtaaggctggcatcctgcacgcaaaatgccaatagccttgttcataaaattattagcacagaccaactgacacaaactgagtattactctttataatgaatcttattttttatttttttgagacagagtcttgctctgtcacccaggctggagtgcaggggcgcaatctcgggtcaccgcaacctctgcctcccaggctcaaacaattctcatgcctcaacttcccgaatacctgggattacagtcgtgcaccaccatgcctggctaatttttttatttttagtagagatgggggtctgccctcttgtattttagacaaacgggggtttgccatcttgggcagggggggcttgaactccttggctcatgtgatctgcctgccttgggctcccaaaaagctggttttgtggggatgagccattccttt

SEQ ID NO: 15465 - DNA, 748 bp, Homo sapiens
tcgctacctttgagagttggccaagtactactaagtactatcagtcaaatactatttgagctcctgatgtcattgccaatgtaaaaaaaaaaatgacaagaaaaaatccaaaatatctcaagattatttctattgaatagcctcagtttgtttctaatctttccacagcccatgttcacatctgtggcctcccttttatgagctctggagctgtaaatctgaaagaagacagataaggtagaaaccttgttaaacttattcctcatcaaaatgacaaacattcaaacaggagtggcctgcctttatctccagttaccacccagtttggatggagtcagtttcccttttacaaaaggtttgcagtatgagaagggaacattttacccaagagaccgaaagtcactcccaactaggtatttcccaaaggagttgtactgaatgttccagagtgcagctgctgagctaactatctgggttgcaataaaatgtcttgaattttatccatggttggacagattgagttttctgataaccccagcccatttccctagaaatgcaggtttgtatccacatgctgacttattccgggtgcagagagcactgattctttacaaagggtggagacttgaaaggcaagtactttcaaggtggacaggagattggggaagggggagactaatcaaaacaacctttaggagtgttctgattggactattacagaccgtggccagccccgaaagtgatggat

SEQ ID NO: 15466 - DNA, 809 bp, Homo sapiens
  misc_feature (1)...(809): n = A,T,C or G
tgatgtgggacgagaacttggtagccaccaaatggcagaactaaaacagctgtaacacaaacaggtctgtaacatgaccatgcttgcctcattgccagcaatgcgaaagagagaagagggaaggagcgaagaactgtggcccttcagagagcccaaacccaggagctccccaaggcaggcctatgacaccctctttggggctctgcagttcctggcattgccaggcttctggacaccaccaggttcccagtgctcacagtggaaacacattgctcacagtatgcctggtccagccacagcctcacaggcagtcagcgcctatgctggtgctgccacagccagtacacctggctatgcacagtggccagaccctgtgctcactcagacaccccttgccactccacgcctcgcttatccttcacagacgcgggatccaggccagtagcatgagccaagcacagcctgatgggctgagtgggcagaatgagcccagcagcccaagcaaaactcaggcaaaggtgccactggacacaggggattctggctggagaaggaataccctaaggatcccgtgacaataatttntatgttctttcttagagtctcttagaaaatattatccttgattcaggcactattttacaatgttttaaaagttccaaaatttaaatacttcattgaacttttaaaaatgttgttaggcccgggcggcggggcgtcacgcctgtaatccccagcccttttgggagggccgaggccgtttggtcattgaggtccgtgagatctgagaccatcgtngcttacaaggt

SEQ ID NO: 15467 - DNA, 763 bp, Homo sapiens
agctttggaatcactgaaatgataactgcactttcctgaaaccctgcagactaaaactggatggtctgtatagcctttggagaaatcaccacagcagttttatgtagaaataaactttctgcctattactatatgggccacttagaaagctcaccggatgcaaactgcgaaccggaaaaatcccagattgccactgtctgctctcactccatatgaagatgcttcaagtctaacatctgaaaatcttgactggctgccctctagacccaaaggtttgttttcttttctttccctagaaatgccctttgctacgtacatgactgttcacactatttggggcctgacttcggtggaagccagtctgcaacactgctgctgaaatgagacacaactgtcaactgactagctgaaaggcctcttctcaggactgagagcctgggaacagcctgggattacagaggtgagccactgcgtccggctaaatcttctttttgtctgttcattttcagtgacccttcagagggcaaagagaaagttgtcctgtggcccctccagaagttgggttgaggataatttatttttatcagagtcttttatcacattgtataacatggtttagtgtaaaaacatctgtgctcctcatgaattacttgtagagatataagtggtttatttcctcctacctattgcccagaagagcttatgtgaatgaagcaatttatcagaaccgtcctttttttatctgaacctggtctatggatgc

SEQ ID NO: 15468 - DNA, 383 bp, Homo sapiens
ttacacaccacctcatgatgccaaaattgctgccagatgagaaaggtcttctctctacaacagttgaatagaagccctagtcctctcattgcctggatttgcatcctgtgcccaatactgaatcaattgctgcagtccctggaatcctaaaccttctctgttcacagcaatctggtgtctcaaaagtctttttcatgatatcctacgccaaaataaatacacaacagttctgtttattttttaattaggtccaaacaacttgataagtatccataccctaacaacatagtagctgcttgaatatataatacacatatatatttttaaaagcacttttatttttaaataaacataattacttagtaatgggaaaaaaaaaaaaa

SEQ ID NO: 15469 - DNA, 757 bp, Homo sapiens
tgtgctgccagactgaactgcagtggcacggttttagctcactgcagcccctagctcctgagctgaaacaggaggctgagacatcacgatgtagtgtgatgattcttaagcatgggggtcagactcagacagcactttactgcagagctggtgaagaagctgccactccacctcctctccagaccatccttcaggaaggcctaccaagatcctccacttgaccctggatgtgagccccgtaaggcaaaatttttttgatctctgatatttgtttcatctgaaggtgaactcctcagatcatcaatactctggctgtgtctatgctagcattattaggcaatgcagaattgaaaaaaaaatctagcaaattaaataaaggaggccatgagataaacgtactttagcctaaaatatttagataatgaagaaaaatggccttgttagctaaaagatataaatctgattcagttttcaattctaacccttggatggactaagctctattctctgctcaaggacaccaggtagtccatttaaaatcaagaccggatttcgagagagtgattcagaccaagttcctataacattcaatggttgggattgtgctaggggtccttaattataacaatttaagaaaggatgaaggtactggaattaattttgctttcagaacctaacataaaaaatttaaatctattaaattttaaaatcttcaccagccaatgagccatatcgccacaattccaaattttcggat

SEQ ID NO: 15470 - DNA, 809 bp, Homo sapiens
  misc_feature (1)...(809): n = A,T,C or G
gctagntagcaacantctcgatcccnctaccaagtcagaactgatcctccgaggcctagaacttggctgcccangtggtgagtgcacatgaaccctcctccaactgaaagttaatggtgacctgtactcacctgtctgcaatgacgaatgctcccaggccctacctggtgttgacccctctcttctcagctggatcccttcctgcaagctcagcatctgataggaccaagttttttcagcagtggctgaagaatcacacacatataagaggagttttttgtagacggcgaatcgactccagccctagcaagttatggctctcctctggacacgaatctcccttgcagaagaatcagatgcgtcctataacaagtgctcctgtacctcgtaccaggagatgtgaaggggccgttatggagccttctccactcccggggtcttgcctgactctcgcggatgcaggtatgaagcagcacaaagagaaacaacagtggtggagaggcatacggtctcaccggggagtatacactggtgttttccagaagctacgcaatgtgcaatatgacgaaagaccgactacagaagcaggtagaagaatccagctgtcttctattaagccagacacttgaagagatttgcaaaagtgcaaaacaatgccactttttctcattgattttgtcttttgttttttttggctgcggaaaatatggtcatttttcataaatacatgctatttgacctaaccccaaagggcctatttgcgctattttggtgtaataaatcccattttaaatttataagaaaaaaaa

SEQ ID NO: 15471 - DNA, 748 bp, Homo sapiens
acaaggatgagacagcggccttaatgattgcctacatgctaaataacagtttttctggtagaggtacagacgctaatatctattagcttttgtaagtaccaaaggacaatacacatagaaggatcacattaacagagaactccagatgaaatgtacgatatggacaattaattaccaaccaaaacatttgcctagactcaaccccatcaaagaagccttgttgttgtgatatgaagcacgaaacctatattttttttttataattagagcctcttggcaaccctggcgaaaaacagggcccccaacataatctgtacaggatactatgtcaaaaaataggctcagacagaagattggttgctaatacataagaaaaaaacacttcgtgtggtggtatcaacctggtgactgtagaagtcctctgtatgaggattccgtggaagagatcaattgacgcacgttgattatatatcacccactctgctctggtcactcacacctggcgtcacatcaaaaacgagcataatctaatccaacttccctcgggctcacagttgattacgtagcgggcgagtagggtatgaccttctgagacaaaaacagtaggtgatgctttgtattcaatgcgtggctattaggccgggggtaatcgtagtgaagcttcttgtgagaacacaattaatagataagatagaataaattgcagtaatcattacatgttaaacagctagtattatcgatgcacgcg

SEQ ID NO: 15472 - DNA, 771 bp, Homo sapiens
tgactatggaaatgatgttagtcaaaaagccaattcgagtgattttcttttttgagttcaaaatggatcataaagcagcagagacaacttgcaacgtcaacaatgcatttggctcaggaactactaatgaatgtacagtgcagtggtggttcaaaaagttttgcaaaggagacgagaaccttgaagctgaggagcatagtggccggccattggcagttgacaacggccagttgagagcaaccatcaaagctgatcctcctacagctacatgagaagttgccgaagaactcaacatcaaccattctacagttgttcagcattagcagcaaattggaagtgacaaagcttgataagcaaaaatttaaaaaatcattgttttaaagtgttgtctccccttattttatgcaacaatgaaccattttttggttggattgtgacgtgcaacaaaaaatggattttacacaatggccagcaatgaccagctctgtggttggaccaagaagaagctccaaggcacttcccaaagtcaaacttgcactaaaaaacgttatggtcattgtttggtggtcggctgccagtctgatccactacagctttctggatcctggggaaccattaaatttggaaatctgcttagcaaattatgagatgcaccaaaactggaacatttgcagttgggattggtcaaccagaagaagccgaatcttcatggacatgcctgaccggacatttcacaacccaacctttaaaagttgaccaaatgggccatag

SEQ ID NO: 15473 - DNA, 842 bp, Homo sapiens
attatttttttttatgtctttattatatgaatctgcttcccattggtgactgtggagcatcatatggactttgacaccaaacggctggatccctgtttaacgaattatacctactttcaaatacaaccgagatgttccatttttgaaatgcttgtccccacaactgacacagtgcgctatgggtatctaatggaaaaactactggcagtctatcattccgtgttgtatactggaataactggagtgggcaagtctgtgattgcaaaaggattgctaaataaaattcaagaatcagctggctatgtacttgtttatctgagttattatagtaaaacttcatctagaaggacacaagaaatcattgagtcaatactgtagagaaaaatattaaacattctaagagcaccggtaaacatactaattgtgacttttagtgatgatttaaacttgtccaaactggatcccctttggctattagctcttcgattgacttacttttgatactatctacatctttgggggaccttatcgacataaacaaaactgtttattgatagaaattcaggcttgttacaataaatatacgcatgtgctcattacaatctgtgctccacaacctctgattcttcccaaatttatcagaacgctatagtatttctgtgtcttcatatgttcttcatatacaaaatttaactaattctttaactagggacccataatggacttactttaaggtttagtacttttttaatgtgtagtttaaaaccaacttttctcatatttaaaatctgttataaactatttattcaccactttataatctttttactaactttcaatag

SEQ ID NO: 15474 - DNA, 786 bp, Homo sapiens
cctggctggcggaaaaatttcatggcagtttctcttgaaccaggcagaaaacaacccctgaggctgctctgtgctccctagtctcctggtttgcattgcacatccattttgagcctgctgctactgatgagaaaatgacctcaaacaaccgcccactaaaggtcccatgttgtgacgatgccgggggctttctgcatagcgctccgcttctcggactgagcagcttctggagttttgtacaatgcctgggcctgaggaaacctgccaggatattcctggtaggatgaatgatcacccccccgtaacagacagagacacccagagcagagacagagttcacactgtgggatctgactcaatgtttgaattcttaggagctcaccacttcattggatttctcatgactgaaaaaaagagaccactagaatctggatgagatgagaatttaggtgctgttttagattcccctagattaggtggatacccaaaagagtgtgtggaaaaactgcagggagggccgggcgcggtggctcatccctgtaatcccagcacttcaggaggacgaggcaggcggatcatctgaggtcaggagttcgagaccagcctgaccaacatggagaaaccctatctctactaaaaatacaaaagtacccgggcatggtggcgcatgcctgtaatcccagctactctggaaggctgaagcaggagaatcgcttgaacccaggaggtggaggttgcagtgagcaagatcgcaccactgccctccagcctgggcaacaagagtga

SEQ ID NO: 15475 - DNA, 762 bp, Homo sapiens
ttcagagagcccaggttatttgttcccagtgatgctaattcagcttggctgcctcagcaggataaaatatttcgaccaatctactttttggaagcagaaggtgggaaagtggctactccctgagctgactgtgcaccaagggacagatccttgttttatataaattgactatgaaaattcccctagacgaacacaggagggaaatctggcacaagccccagagcaggataaagacgtttgaaaatcctttcagaaatcataacttagatgcctcttccatctgcaccatttctgcctgttgtctgcaagaaatatgatcctctgtctcacaggttctcaatgtacaggacaaactctggaatgatatgcagagtagaaggtgttgctgcttttcacagtggacaattcaaaacctcatgggcccctctctgattagactctcagaggctgagagccctgtggtaagaagcctagtgagagatgtttctatcaatggctctcccttgtcccatcttccttcaggggaatctctgtgtactatgaacacataaagcttcggccacacagtaaaacagggagggactaagggagatggcatgattattaaaaacaaaattgagatcatgacactgtggcattcattaaggccattcctattttggacttattctgggcccatgcttagaccgtactttctgaccctcattaatattaggctgaatgacttgctggggccatggaactgcgagcgaaagtgaaacg

SEQ ID NO: 15476 - DNA, 781 bp, Homo sapiens
taggctctctactgtgcttctctgaaaaagttgaagagtcatgggaggcagagctggaattactacccatatttcatgataaaattacttttcctgtataagaggtgactactaaggcagaattcaagtcttcagcctggaatgttgatttcagcttgcagagaagccccgtgaatacggcctcacctgtcaagaagcctgccactatgatcatttagattttcagtaatatagttatttcaaagcccaggctatgaaatcagaccgcttgtagctgtgagactttggggaagttaattatcatacttaagctgaaatttatcaatggataaaatagggtaataattttatctacctcatagaatgattgtgaggattaaatgaaataatacatgtaaaattctaagcttagttttttttaatagaagagtttgatcactattagctataattaggctaaagtacatgtgcttatgaaagaggacatagattgttttaattatgtgaagaggtataaataattgatactgagacttctgaaaggtagctagatcggcagaagagaggatatttgagggagctagggagaagacgtgacagaaatagagaacatcaccaccttgatcccagctctacctggacacatctttactcagtattcatcagtcaagggcagaccaaagatggggcctgaatatggagtccattttttaacttaaacacaacttagtcttgattgttttttttaggtcattacctcaaatatcaccatattgctttt

SEQ ID NO: 15477 - DNA, 498 bp, Homo sapiens
  misc_feature (1)...(498): n = A,T,C or G
cctaggcgacaccctttagctccgtgnctcttctcgactggaatttagtcatgaagtctagactacaatggtctattgtgaccaagaagttagaaatatggtatgaggaaaaggcaagacaaccctagagatgagccctgatttcaagtggccactgaaccaataccaacagccatctacaaccaggactccatcttcacctcttcttcagtcctttctcttggatgatatttctcagcatctctctgtgggcctgtgaaagtgcggataccatccaggatacctgaccagtttctacaaccagacatattcctagaatctcctgtagttcttaactaggatcaatccacagctctctaggctgggacctggtggaatgtaagctccatcagggaagggtcttttactgagcgtttatcactgtattcctaacacatagcacaaccctgtcacatagcaggagtttaataaatatttattaaatgaaaaaaaaaaaaa

SEQ ID NO: 15478 - DNA, 797 bp, Homo sapiens
  misc_feature (1)...(797): n = A,T,C or G
ccctagaagaagcaagaggaggaggtttgagaagagagcaggagaaggagaagaagatagtgacaaggatagctaatgcaaacctaagagacaaagaaattcaactactagaaggaccacaggcaaaattgtgatatgggattatcttcctctaatgtcattttacttcccttttttttcaccattacttacatctgtcattttccttctactgggacccaacgtcttgtacattctaacttcttggaagtctaaatcaaactaggaatcaggaagaagatgatcatagacagcaaaaaattacacatatattgcattattttactcatcaggaaaaggcctgtgaaataagtatttatgaaatcacaggaagagctgaagtagaaggacatctacaggctcttcttagtagtcatcaaaatatacctggtaagcagctacctacctagagataagatacctcctaccttacagttcactgggattctattagaatttatttttcactctgcattaccttttttggtaatctactatatatcagtgatatagaaattaactgtattctttttaaccccaagagttttctctttgactcaaaagatatatggcctcttgtggtctccaatcaaagcttttattggatgttttatttagtgaaagatttctttctacatattcccattaatgctnccattcactctccatttcctgatcagcacccttttttaaccactggattagttatggtaagaagaacgtggtccacactctacaaaataaagtaattgaaactt

SEQ ID NO: 15479 - DNA, 810 bp, Homo sapiens
  misc_feature (1)...(810): n = A,T,C or G
cttagatggactctgcctttgtctcccangctggactgcagtggtgccatttcggctcactgcaacctcttcctccagggttcaagggattcttctgccttagcctcctgattatgacttttttaaagttatagaatacacttaggaacaactggaagaaatttgaatatgtacctctattagatgttactaaggaattgttgtcaactccttacatatgataattgttttttatggctgtaaatgaacatgtcctcattctttaaggagatacatccctgaaccatctagatgatcttcattgattcccaattacttcactaagaataacacccacccacttataagccccaacaaagcctacgcgtgaaatattatcatatctctgcactaaccatgctccatcatacgtcatgtctattagacctaatctaaatcaaatccacgtactctcgatatttctactttcgcaaacgcccgtcccacgcccccttatctcacggctcttttacaccgctctacatccccctcatccgtctatcccgctaatcatttcttatcgcctcctccgttctttaatatttctgagaacccgcgctcatgtttgaccgactagatatgacgagctatccacttacacacgatgtggatgatccgcacccttcagttgtctactcttgaacagttttaatatagtatttacgcgtcctcacagattttactaaacacttatattcgcaccctcgcaataacgaacatagaaccatctactcttactagcggacactaacgcacactacagcgaataat

SEQ ID NO: 15480 - DNA, 1189 bp, Homo sapiens
  misc_feature (1)...(1189): n = A,T,C or G
aactgactcatagagtcctcagangctgtcataactaccagtatactcgaacggagcgcagagaggaagacgcacacaaagtcggtcgnaananagagcaaaacacaanagaangcacaagaagcnngtggangacganggcgaagagacaaccgacaacgcnagcnncacaggacgaagacagcgcggnagcgacaacgcaacacagncnagcccctttttntnagcgcacgccagcngctatacgcaagtccgcgnacgaggaaanaacacnnacgggcacgcacgcgcacacgcaaagcgagatcccgncgcnacacacggcgcagancgacgagcccaacagattaatcgttcaggcgcaatacnctatgtctccacaagaggcacgcatatcgccagatgatagtctactactttgtnttcataaatcagtgcagcattcagctcacatagcgccagtaataagatgaataagacaagcatcatagtactctatttatgcggaagagcatgtcgtgcgttgtcttcacatcatctcttgttacatccacgtgcgttcaactactgcgaagtcgattagtacgatttgcaacatactctatctcttataaaacactgaaagtacaaccttctaccaactcagggctgattattactgggccttttgcacctctaatgggctcataagtagtccaatcctcagcaccatggtcagatcatgtatcatttacacacatcaaggcggcttcagaaaaaattaaaattcctccacaaccagatgtttacacaataagaatagatgcagataatctatctccccacccaaccaacaaatgtacatatgacaaactctctaactcatccacagagctaattcaatcccctcagcgtttaagaatattaaatgaaccatataactcatactagagattgaactcagctaccttcgtttgttatgcagaagacgaaagagctaaagagactaaatctccaagctacatgtgagttcggccctcttatattatgaaccactataataaaacaaataaatcaatggtagcactcctaacgtcagcacagtgatagtgaattcgccgaataattatctnaccttatcagaaatactgacagatatcatagtaacatagcttaacaaaccccctgttctggtctcccgcaactgtcg

SEQ ID NO: 15481 - DNA, 782 bp, Homo sapiens
cctaggagtactctggaagaaggtagatgcgagcactgcagtccctggactcctgctggctccgaccctgctgtgcctcctctcctgctttgtatgcatcccagatcagtcgcagcacaggggtctgtgaagatacctgatatcaatacaaacgtttccattttattttgctctgaaaaaatcagttgataaatgctgtggatggatgtggatctttaagctgtcatctgcttctgtagaatctccaggtgccagctgacaaatgtgaacttcaaaataacaaacataatgccatttgtttccaagaccatacgaactcattctttagacatcttttgactatgccttgtgctcctggctaatagagcaaccagaataaattaaatgtggttcttaacatgaaggagtaccatgcaataatctgatgaaacaggagtgagtgctatgagtgttctttttcatttcacggaaaaaattacctttcaggcatttcccagttcccatgaggagtttcctctgtgttccacttcctaactgccaaagttgacttttgaaatgttggagctgagtccttcttaaaacttacatgagtaggctttttgaattcagaggttggaaagcttcttcagatgaacaagttaatgtaagtaaaataggtttaatgagtttttacgaatgtttattcccgttagattaattaccaccaccaccaaaaaccctttactgaacccaaaatttaagccattccttgcttttgagcagtgaaaaaaatgagggaaaaa

SEQ ID NO: 15482 - DNA, 764 bp, Homo sapiens
  misc_feature (1)...(764): n = A,T,C or G
cttagatcatcatacatggtgatgtctcgcanagtcctaacaaaagaagagcatgggacttcatcaaccttcatcattcgcggaaacaggaagaactttcctaggcccactaaaatcatccaaatttattatagatgaagaatgtcacgaaagtgtattaatcagttcaacagtaaggcttcttgaaagtttggatttaaccagtgcagtgggacaacttctcaatgaagcagttcaagcacaaaacaacacatatcagaactaggaatcagtacttcttttgtttccttgctggggctttggagcatgtgcagctagaagaatgtcttcaacttgggtgtgcccatttccataatagtatcaggtatgtcataaggcttaaactttcgtagtgaagaggtaagttctcttgatgtacctgtccacaatatattagactgcatggacagcacaaaatcctctttttatctggatacagttagtgtaagtttgtgtacttttctacaggtccctctatatctgtttcgatagaggattggtatggtcctaaaaatgttgtctctaaaccctgaccatcccctacttttttgggagaacctcttcaatcgaaaaaaggtttaaagcctagtacacccggtgaatagactcagttctcatacctactctttattccttcggctttgcatattcggtgcacatgtgtcctcccctcctcctccgcttcttaattaataatattcccgtgtggcttgcaaccactcttc

SEQ ID NO: 15483 - DNA, 737 bp, Homo sapiens
cctagatgacaaccacaaaaaagagtttcggaatgccttcttccagctgtctacatttgttttctccaacttttaaaacaggcaagctaaagtgacctaggatggcccttacctgtctgtgatgccgcaggagtctatctggaggtccctgaaactccccagcgccccctgctgtactaagatgggatccaccactttgtcaccaatggtgatgagccttaggcagccctgaaaccctcccagggggcttttacatccagagccagagctgtagcccaggcagcctgaatatgaagacaaaaataggacaaaagcaacaactatgacaaaactattccacagtatttactatatgaagactgctgctcccgcttgtttatggacatcggtatgatgcgatgagcttcaccattcattagagaggtccccacccttgctacactgtggatgctttccttaccctgctggtctctgaatgctctgccacggtcctgggcctccccactacccagcatggatgcctaagctgaactgaatgaccttggactgaattggtcaaaaagagaaggggagaggaagaggaacaaaatgccaccaatctgatttttctttttttaagaccacaccaatggcttggaaatgactatcatttccatgggcttcttatgctcacggctggttggcggccaacgttggtgaaaaggaattaaggcgactggactccaaaaaaaaaaaaa

SEQ ID NO: 15484 - DNA, 1164 bp, Homo sapiens
  misc_feature (1)...(1164): n = A,T,C or G
aaggacagggcagagaaaaacggagagcggacggacaaccaacaaagaaaaacctggagggaaagcaacgccacccctgnagagggccaaccngaccagagagccgncgaagaaagaagcacacgtgagccgagacaagcagcccacngaggcccggaagcaggcacgaggcccagaaacacggccccgacaagagaagagcgcacgcggcagcacaaccagaggcagcacnacgcgacacacagcgacacaccgancggacagcacagcgcagaacacgcacaaggcacgaccgcacagccagacaccggccggccagcaagcgacacacaccaggagcaccgnggcgagcggagcgacgctctatngtacacagcagcaaaacacgagacaagccgcgcgtcacagacagcacgcacgaccagccgacgccacgagcaccccgcgagccgagcacggacacaacacgccggacacgcggaccaagtcggcagcgacgaagcagaccgaggagaagcagcaaaacaggacaaacgcgacaggcaaaccgcaacagacaaacacgccaaccaccacacgggcgacggagataccacgcgcaccgccgacccacgaaagcgccaagcagaacgagcgcccaagacaagcccggagaacaacggccagaagaagagcaagagcccgcagacgcccaccacggcagcgaagccacccccacgcaaagaggcaacgaacgccgaccaaacgcgccacaaacaggacggcacagggcagcaccgacccganccaacaaccgacatcacacgtcgacgacaccgaagcagcaacagaaacaccaccaaaaccaaccgcaccagacgacaaccagacacaagcgcgcacccagacccggcaggaacgagggcagagccgacgagccccacgcaccacgagcgaccgaaacacacaccagcagaagcaccgcgcgacgctcacagaccgccccagacgcacagagccgacagggagaagcacagacacaagcgcgcgaagcgagacacgagcggagaggacgacacagaaaggcacccaaacacacaccacaaacaaacgaagacacacaagagcgaaacaaacggcacgccacccaccgccacacacacacagccacgcgaccccgagcag

SEQ ID NO: 15485 - DNA, 793 bp, Homo sapiens
cttgggggaacgcgctcaagctcagagatcacaaccgtgagccacctgcccaacacaatatgttttttatgaaccctcgggagagactgacccccattgggaaagcctgctctattattttttaagaagggaagaatacctagcgactagacctttgccttgggaggcatgtctttatgtttatacggcgaagttgattttttctgtcatgggcattcgacagctttttacttcattttcagccaatctttcaccagatgtgcttagttccttaccccaccacaggcaacaaacacggcatctcctggatgccttttaagggcgctaacagagtctttacttcgagcataaaggcattactatgcataatcattcgggatcttggtattaaagccagtgaaaatcctataaaggaatgactttatagttgtaggcataacactggtaaacctctgctctcatactggagatggctagatgcaggaactgacatctatggggtggctttgaacgctatgttgatgccagattaattgtgtacgctggtacttcatttaccagtattcctttgtacaaaaattcacttagatgctgaattcacgagccataaaaaacacggtgtacatgtttcttgtaagcataggctatggccctggtgtgatagagatggatcagtgtggttccatgaaataaatggcgcctgattaagtttgccggcttacttaggcgtctatggtaaagatcccaaaatacacacgtttgcccggaaactacctacggcgaagcggttggt

SEQ ID NO: 15486 - DNA, 831 bp, Homo sapiens
  misc_feature (1)...(831): n = A,T,C or G
atccatacctcccatacccacccccaccacagcatnttggagggccactcctgaattttggggctcagctgaaccccacactgggtgccttgacatgctgtactgagaaagaagcatccagttctctctgaccttctccatcccctctgtctctcccaaagcacaggatgaagttgctctctgaagtttccttatctgcctgaagtccagattcaccaaagaaggaaattacctttggcccctttttggaattttcattttctgaactcatatctcaggaagaaagactgcagccggtcaacacaccaagacagagctttgtcacaagcgctgtctgctgcatgggccaaacagactttatccctggccattgtatgtgtttcaagcccattgacttcccatataaattgcttactatccctctaaaatcatccacacttacccacttcccttacctttaagaaaaagggtatgtaaccatctgtaccccattgcatggtgggataatcactcttggattccccacccgtatcgtgcatgttattaagtgcgcgcgccttttctcctaataatctgccttttgaaatgtgacattcaccagaccttaagaaggaaagggacactttcccttgcgctctacaaggacatgaggttgttcacaatgacattccccgaggttataccacacgtcctagcacccagaggggacttgaaaccatatctgacccccggaggccctcactaaaacaaacacgccattatgacaataataaaaacggccttagttggctcgcagggggagccatgcgaccgctccccaaaagacgagag

SEQ ID NO: 15487 - DNA, 771 bp, Homo sapiens
ctgttgcacgtttgcgcctgttggcagaacaacagctggttttgctgtgcatggcacctgtgttcctggagctgaagtgaatgggtcctgcctccagcacctgcttccccacttctgccatcagaaagactcgttcgggaaaacattccttcattcccttccaagggcaccacagttaataaggccacaaatttgggcctgtccatcctggtgcaagtatctgatgaagtaagaagagatccgggttagcaaggatacgattacaatgcttttatttttttaatgggacttgggcggtgaggaaattctatgttccccgtcatttatgcagactccagctaaacgtatgctagttgaactcatgccagctctgtggaagtgagggacagatacaagaaacatgggaactttccaagaaatgaagcttctttgctgccatgtcgatgatgcttgtttctgagaaactcaaatgtatggaagtgtagagtagagcttcccaaacagggtgccgtagttcacagatttgcacacaggggtgccagcataatgatctctgcagctcttggcacaccttggtatgtctggagtatgagatggacttaacatatgaatatacatataaatatatataatgtatctggacatcttagggactagacaaacaaggtgttaaatgtgttcctctctggatggtagggttatggaatcctttaatcattttacttatttgcttatttaaacttctgaatctgtaacacaaaaaaaaaaaaa

SEQ ID NO: 15488 - DNA, 510 bp, Homo sapiens
ctcgtgggggcatctaggagctagacttgtacatacataccaaatatgtccagagcttacattctgatgggcacctcatacaaattaagtgagtcagaataaattatgggtgacttgcagtgactgatattgaggatactgattatattcctgaatcacagcacctgcatttagtccatccccaaagaatagaatgattgtcacagccagcaatatttatcaaagtgacatttttttcataatatatggatctactcttcgcctcctgaaatttacagactttgattaagtcatgtgataatatatgcaggacattctggaactactgtgtatcaaaaggacaagtctgctgatggcatccccttgaaacgcccgcaagttgtcaaattcaagaaagtatgttttctggacatgatatcaagggacatacttggcgacgggtgaatcacttatctgcgaaaagtcctccccctctgtattaaaattctggggcccctaaaaaaaaaaaaa

SEQ ID NO: 15489 - DNA, 774 bp, Homo sapiens
  misc_feature (1)...(774): n = A,T,C or G
caggtcgagcgggaaagtgaagtgagaggctggcatgtgtagaagtgccagtggagggcgctgtggctgactagaaggcctctacgttttaaaggacagctgttccaaacggagagaatgtttccagagaatctactaaggaaaacatcaggtctgacaacaaaagagaactgagagagcgaagaggaggcagctttctgcactttgcacactgggttgcagttctcacagaatcccggggctcatgacaaaatggaagcttcctccttggacctgcatttaccccaggcctcgaaacaaagccccccagtctatagtttccagtgtcacttcacagatcttttcataccacagcaacccatactgacaggaatctgcctgttgtctccagcacagattcctattgaaagcaactctatgtctaacctgacttagagcaggcttcgggtatattttaaaacccaccgcatctattcaggacatattttattatcaaacggatctctcttctgcatacatatccaaaacatgagcacgtacactagtagaacggcctgttctatagacaagttaccacccttctctactcacatacgcatttcgttcccgaatcacgctgaaccatgaaatctctggccctgcgggtctcgatagctggccaagcgctgattcattgtaccacccgcggcgcgctgtatgattcccgcaagcacatcaaccctngttatggacccccgggattaacttcccagacgaatacactcataccagatt

SEQ ID NO: 15490 - DNA, 566 bp, Homo sapiens
gtagattttaccttgggagttacttcacatgagttctgggtctggtcaaatcacccattattcaaacacattgcagccttcctgttctttaggaaatcaaacagaacttcagcagtatgcagtgaggccattttaaacagtgaaatcaccaacataaagcacaaatatttgaaaacatggccttaaatagaccacaaaaaggaaacttgttaacagtagaagaactgaaacaagaaggcacagcatcaccctgtttgaccccagctgggaacacatctatcagatgactcaaatgttttcttgctctgtgcatgtctgcaaatgaccatgaaagccacctatactgattttggggttacaaaatctgtcatatgaggacctaatgcctagagtcattgatgccatgttgtgtttaagaggaggcaatgaagaaaattgcaaagatgccaagcttgtattccgatatcaatgagttgtttcatgtaatttggtaccaactagctccaggcttcatgttagatgagataattaaatgttcatttatggctaaagcaaaaaaaaaaaaa

SEQ ID NO: 15491 - DNA, 861 bp, Homo sapiens
tttatgtctttttgccttaaaaaattacaaataaccaccccacaacacatatgcatgtctacacatagctggtgatagtacgagacggatctagcagaggcaagcaagggtagcttcatcaaggcaacacccatttcttgaaacaatggctgtctccaaacaaagtctccactgctctgtgtttgcctctgaaaactatctagctggttatgcaaaaatgccctactcttttgctatgctaggataaattaaatctattatgttgatatgttaaaaaaaaaaaacaaacatgcacacaactgccaataatatttcatgctttcgcccaaataaaaaaaacaaaaacaaaccaatcacacacccccccacaataataactgctcactccttaaattaaaaaagacaccgtactccccactctacctcatccccatctcaatcctccaaatctatagtactaacccccaccccattccccatattatccccacaaccccactccaccatcccatataccactaaccctccactttccctcccacattactatattcaacatattccatatactcaccctactacacaccaaccatctaccatataaaatcataccacccccctcacctgtcctcccttcccccatcccatttaactcttactacaccccaacacacgctgttaaatcaacacctctgtcccacacatacctcattcataatacaaaccacataacaccctcttcccacatcactaacccccacacaaaccagactctatcctcattcaacaccaccacttcttcacatccatactcaaaacgcttctccgacacactcatccatattccccccacacacccac

SEQ ID NO: 15492 - DNA, 463 bp, Homo sapiens
agagactaaccagcagaccacaggactgaacttcagtgccccaggatgagacttaaagaagacaggatctggccaggcgcagtggctaagacctgtaaacccagcactttgggaggccgaggcgggcggatcacctgaggtcagaagttcgagaccagcctgaccaacatggagaaacctcgtctctactaaaatacaaaaaaatcagccaggcgtggtggcgcatgcctgtaatcccagctacttgggaggctgaggcaggagaattttttgaacccaggagacggaggttatgcctaatttgataaatatgctattcacaattaccctgaattgagcattatgtattgtatacatctaaatatgtctctgtacctcatatatatgtacaattattacgtgccaattaaaataaaatataaaacacctaaaaaaaaaacaattaaccttaaaaaaaaaaaaa

SEQ ID NO: 15493 - DNA, 307 bp, Homo sapiens
  misc_feature (1)...(307): n = A,T,C or G
aggcagttttgccactgaatgcagctatcctcagaatagtttgtcccctggataatggcaaggatgatagatgtaggagttgtcaactctaaaagtgagagaaaaagagaaagaagatgagaagagtcagacatagagaaacagaaaagagaggaactaaatgtgggatgaaaaagctaagctctataaaatgttacttttattgcttgaatgacaagacagtatgattcacttaatcaatcattgatttaatttgtagttcccttcnatccttttaataaaagaggaagtttgaaaaaaaaaaaaa

SEQ ID NO: 15494 - DNA, 953 bp, Homo sapiens
tatcattatatataaaaaaaaaaaaaaaaacacccacaacacacagcatggccttttcatccatgtggctatgatcagttcctaaagcagagggatctgcagcctaatgacacatcaggaattgatggacaccccagcggacagcttctatgaggtgtgtgggtggcggatgacaaatcataaaaaaaaacactaactaacaaaacgcaactcggccacacttgccctccaccaaagaaaccccgcaaccaccacccctttagcgaggtttaatctatcgtcaataaaacacctaactctaataaagccaaaaacctttttttttttttttccaacgccagcacaaccaccataccaagaacccacaacaagcaagccacccctcagtaacaacccgcaatcaccccaagcaacaaaaacaaatagcaccccccacgccacctctccaccacctaacactccccgacacaattatacacgcatcacagcgccgtcgcacaccctcctacacacacccccacctcccccacccccgcttcaactactgaaaataactaccccccttcaaccgccgacgcacctccacaaacacaacctccgaagatagaataaacaatcacacactaaacataacacacctaaaactaccactcatcctatataccccactccgcacacaaccccaaacaccataacccataaccaactataggaaatctctctataaaaacctaacaacatctaactctcaaacaaatacctacaaacgcactcacaaatcctcaccatatcatccaccacgactcaacacagaaaaaaagcatgtaagtagaaactaaaacaaacatccgtaacgcacgcacctccaaccattatcacgactcattccatcaccgcctgtaagtcatcacgcatcacccctcaccctatacgtattaatcatcctcacctca

SEQ ID NO: 15495 - DNA, 651 bp, Homo sapiens
cagaagagatcagcctatgctatacttaccatatgggaacatgggagagagagagaagactttctcaacatgacatcaaggacttcaaagaggaggatgtcctagggaaagggagactagaagaactggaactaagaggaaaatgaagacatatcctctactactttgatgccatcttctccttttctcagagactggatctcagctctattctttccttttccccctctttattcttttaagttaacgtaacaagtaggacttttattttttttaactaacatgagtagtttatcagtccatgtctaccctctacctgcttctgtgaactgtcaacacaatgtgaattttcctggttagttgtatcaaagtccagagattagcctttagaagcaactatatgaggacaaaggatgggatgagtagattttatttgctgaataaggtggaagcatcacctccgatgttaataattttttttcctttactttcctaagcacactctgcatgttactttggttggagtgttagttccaatttaggcagcaggctttcttgtaactctttttataattctctctgctttaatagtttcggtcgctggaaggatgaaattataaattatttggaaactgaacaaaaaaaaaaaaa

SEQ ID NO: 15496 - DNA, 191 bp, Homo sapiens
ctagattctaggttccattctcctttgagagtcactgccgacaaaagagaacgaatgtggaaatcttcctctgaacatatgatgtacaagtttcctctctccccctccacaagcctgtctttacagactataaatgcatgctaagtgacaagctaagtaaaaatttctgaagatatgcaaaaaaaaaaaaa

SEQ ID NO: 15497 - DNA, 1178 bp, Homo sapiens
  misc_feature (1)...(1178): n = A,T,C or G
atttttacttttgttagttttataaaatatnagtttcnccttnnngggcgtcagggctgcaatagtgcacttacggccaaaaaccttgtggcgcaacagnaagcagtagtattgagagctcgagtatcaatacagccaagtaaacatgttttggatgtggccagaacaacagcaatgagtctgaatagaaagcaaatagtgaaccatagtcttcccccagtacctcttcagaggagagtatgggatcaacttgatgtcttagtattgtcatactttatttcctggacctcactcaatttggagcagcaataagatgtgctcactgcgattaagctcagcctgacataatactgtctttctattatctgctcgtcgtatatattttttttttataacaacaagaatgctaacagaaacttcactatccctcctctctataggggggcgaccaccctctcgattttatatttattctctctgtgctctgtaaataaaaatgagtgtcggtattggttgcatagttatcactcactttcgttagactagcgagtcttttgtaccgagtataatttgcagatcttctacctacggtactttcacatcgtctacctattaacttctccacgtcctctttattagtcttagtcgctcttctctaattctcctttagtactgtctgctcttcgccgtatttgcttaactgaacatacgcgtaagttntatcttgcagtcatacgaatggctaatagatagcaggtacgtgctcgtatcgtatgagtcttgttatgtattactctgccctccgtctgtatactatgacgtatcactactcctcacatcgttcatctactatgtcgtctgtgtatgtcttgtctgttttcgtatctcctaatatgtatcgtatattactacgtttctgtcgttgcctcatagcactgattctntctctccgctntcatcactctcatccgtacttatancgacacacatattatgagtgacttgccgctgtatcgcgcatagaacaatgtatcgtgtcnttgctagtcacctcgacgcggccgctcaagttaaacacatntcttngtcactcgctatgcatctcattatatatttgttnaacactgcatctctctctatcgatcttcattatgtcacgctcactcctccgcgcccct

SEQ ID NO: 15498 - DNA, 887 bp, Homo sapiens
  misc_feature (1)...(887): n = A,T,C or G
ttcatngcagcattgggtatttggcgcaacctaaccgcacgaaatggtattaggaaggccaaactttgggaggtgattgtgtcatgatgggggagcaaacatggataaaattaatgcccttataaagagacaccctagagagatttattctctctttgtgcgacgccaagatacaacaataaggtagtaccctgcaatccataacaataccatcaccccaacaacaactatcccggcctagaagcaccattgctacagccctacaacgcaacagaaagaacttgcctcgctttcaacacgacgaacagggcagagaaagaccacacccctagcggcgcccccgccccccatatcgaatctccgccatcctcctgcataaaaaacaaacaacacaccaaacaatcaaacccaccctccacacctcaacacccacgaaccaaccgtcatgaatattgccctatgacgcacgaccaccacgctaacaaacgacacgacaccaccacaacactcacaactagatgtctcacacaacccacgcacgacccccacccgacaaataacccactccacccatcgcacagaacatacccgaagacaaacaccaccctatgcctgcatacaagcaccgcccacccaaacgaacgaaccccctcacccatctccctccacaacgcaacgctccgcctaatatacaacccctccccatatacccagaacaaacccaaccacccgtccgccacccacaaattcatccatccgcgcaagcgacccactacaacccccatcactatccacaacacccacaccaccacacaacgtccaaccacccacgccgacacgcaacagcaccccaccgcccaaaaccacaaantcccacacccccccct

SEQ ID NO: 15499 - DNA, 885 bp, Homo sapiens
  misc_feature (1)...(885): n = A,T,C or G
ttttatttatttttttatggaaaaaaatttttaaaaannnggcttagtcactacattgcagaactcgacagctatgttggcaaagagacatttggactgacccccagtccaagtgtctacctgtatcttctttcctctcaaaacctgatgctgctcttcttcactattcttgttttgagctactttcttgtcatgaggatttatagaccatatatttatgaaccacttcacacacctcacagatcacgttagaacaattatgaaaactgaaagtatgataattacacgacatctgcataaacataaaccgagccatacattttttttttaacagacggctaatagcccccaaaactacccaacctctagccccccccctcacaccatcatctatgttttgaatgacaaaaacgccagttctgcggctcccgacacactaccagtattccatgtacatcttcccatttccgccttgtctccgtaccgacactccccaatttagacctcgtctgcccacccgcccctacctactccgcacactaatgtcccaccggccccgctttacaataactcacttcccttttaggccatcatgcacagaaaaagaacgcctacctcacaccttactcttcccccgccctcacatctacttcgacactctacactcgaagcccggtacataccctactcactatatgcctttcgccagccaataggtgcagacaatcgtagccgcatgactaccacgctgatatcctcgtactgggtcgtccacccctcaggccacgccccattccctccacccatcaaaaatcaatgccatgtactccacgcccattcactacacctcgacacccgccggacgatcattcccccaccacaccc

SEQ ID NO: 15500 - DNA, 773 bp, Homo sapiens
ccacctgcagaggaaatgatgacccgaggggaaagtctgctgttaatggagagctggaccaccacggattgcatactcaaagaatcaatacaaatgcagatactctggctgctaccattgccatgagtaatatactgaacttcatctctgacctgagcctcaagtcttctgccagcatccataaagctgcggcaggctcagctctagcttttctttcttcactgagtcaaagctgatgtgtgtgaccaaaagaatactatggaagtggtggtatgtgatttctgaagctaggttataagagacattgtggttccacccttgtcctcttggatcacttactctgaggaaagtcagccaccatgttgtgaggacactcaagcattcctgaggacaggctcatgtgaaggaagaactgaagcctatcaccgacagccagcaccaacttgtcaactaggtgaataagtcgccttgggagcagatccttcagatgactgcaaccctgatcaacaccttgacagcatcctcatgcaagattccaactctctcatgaggtctgctcatgagagatgagcagaactacccagctcagccacccttgcatttctgacccacgggaactgtgaaagacgggaaacggtattgtcaagttaagccacttagttttgggggaattgatcaccccagcaaaagaaacctatggcccactttaaaaagataaccatgaaaattattcatttaacatgaaaattagaaatttgataaaagtaacaaaa

SEQ ID NO: 15501 - DNA, 770 bp, Homo sapiens
agggtttatcatgttgtccaggctagtcttgaattcctgatctcaagccatccacctgcctcagcctcccaaagtgctggtattacagattaagagtgcaggtgcaattttgttacatagacacctagtgtaatggtaattttgttacatggacatcttgtgtaatagtatacatcgtactcatcaggactctatgtcttggctgatgcacagcaagacttttcagaatctaccttagaagtgattgaaatcaaggctgtgttcattccttacgtcaccaaaccgggaatggagagaacgtcgatcaggatcagtttgaactcttgagagtctaacagtttaagacggagacagtatcactggaaatctgcttgaagctgtcgcttttcctgccagagttatttaggagctaaagaataagaagtaagcaattatgagattcactagatgttaaaaacataagaaagcattttccataacacatatacaaaaaccagaaaaggggtggaggagaatcttcattatgtaataaaaatgaatccagaataattttaagaaaatgcctaaatactgtttttcaaaagaattatctttcttggaaaccaaacggcttaattcttaagtattttatctctgaaatcagaaattaaaatagagcatattattacaaatgcctttatatttttcataacatgttgcttatgataaatacaagcacttttttaaaaagatggctttttatattttcactgtcacaacatgagctaaat

SEQ ID NO: 15502 - DNA, 138 bp, Homo sapiens
agattgagccattatagaaaagagacttactgagttatgaagaactccatgacattgggccactggtaagttggaattttgattccataaaatagagtgtatattaaaatcatagctaattaaccaaaaaaaaaaaaa

SEQ ID NO: 15503 - DNA, 806 bp, Homo sapiens
cagggaaatataactaatggagttgttctgaggagaacatagccaagaggagcgatctttattttacgtgcaacattgtaaccccactataaattatctaagagtgtggagatgaaaaaaagtaaagagacccaccttatgaaactgcaagctcttgggagcctgatttccagagaagagtgatgctgctttgtatttttcacacttgaacacagtgaagaagatgaacttttattaggattatagtgccatggaggcttactgtgctttgataacgttcaagaaataaaatgccatttctttctttggatgcatgcaccccttttatacggcgaccaaaccttttgttaaaaaaaaggaggaaagactttgttatcctataatctataaagtggtctgctccctttcgctctgctctgtgggtttttcttcccattaccttatcgcagcgtcgatcatgaacccgtatctctgattccatcgggttggtctgttggcgggatcttatctagcgctttcctccttttggccgtaatcttgggtgcgcaacattgtgggctatatctgcgtctctcctaagccaaataaggtgctcgcatttttttacataattattcgccaccgcgagttaacttccgtttctcggatccgccatccgtcagttttccccccgatctactctttatttcttgctccgcttacccaccgtcgtttattaactccgataagctcattccctgtatagactttagggttgacttcttctcagctccctccctcgtctatttatttcacaccctcttatt

SEQ ID NO: 15504 - DNA, 418 bp, Homo sapiens
  misc_feature (1)...(418): n = A,T,C or G
cagggattccatctgttttctccattatgtgacccctccagtacccaccagaggccaggatgcatgagatgggtgcaccaccaagctcctacccagaacagcctggctgccaccaacgtcaaaggcaatccaggagttccacagaagggccctgctgggatgtgatgcaaacacccctcatcccagccccatcaccagccactaacacagcacatggactctcacccctgctgggaggagaggtccatgatctccagaacagttcttcngttcctgggacaagaaaatggagatccaggagcaaatatcatccttacacagtcatgttcccatctgtacacaaggagcaatatgctgtatgccacacacgggggatgggaataataacaaccataaacaacacccaaaaaaaaaaaaa

SEQ ID NO: 15505 - DNA, 127 bp, Homo sapiens
  misc_feature (1)...(127): n = A,T,C or G
gctgcggaaatcataactaatggagtgtttctgagnagcatcttaccaagaagaacgatctttattttacgataacattttaaccccacttaaataaactaaaaattgaagatgaaaaaaaaaaaaa

SEQ ID NO: 15506 - DNA, 775 bp, Homo sapiens
ttagatgtcaactttttgtaagattcggatgccgtcctttcgctccatcctaatgggcacttggtcatgtgcccagcaacattcactccagaaagggaatctgcttcctgtgcaatagaactctgtctggaacaaccagggagatgttttcatccacatggacagagatttccggcacctactggttttcccacccacactgagtgttgccctctaaatgagtcactctggtttccacagagaggtcaggtgtctctcgggagctggactttctgaattcactccaccacgttttatctgtgtaaccttgtgcagggtacctaaaatctctgttacctcatctgcaaaatggggatacctaatacttggtgagttgtagttgaattaacgcaaggcacttggccaggagcgtggcacacgataattccattgtgaacaccaaaaaaaaataaattatggactctttggcctcagcgggtggcattctgccgtcttttccctttactagagggaaatctgtaggccctggctcactgactatctacgctaagaccttctattgttactatcctttttatgttaatttataggcggttctccgggtcattcccatccattcggggccaactccggtatttacagccgatctatacgtttacctctatgtcctcacctcttattttgcttgctaggtggtgcatccaccatacgttccgcgatcctgtttaattttcccattcgtcggtcgtccttatctatttgccagcccccactg

SEQ ID NO: 15507 - DNA, 269 bp, Homo sapiens
  misc_feature (1)...(269): n = A,T,C or G
tttttttgattagtttcaataaaacactttgatnncancctcaacaccggtcaaaccttgctttgttctctaggctggagcatgctggcgtgatcacggctcactgcagactcatgcaaccctccaacctcagtcttctgagtagttgggaccacagatataccttttgctttcacagatattatctttgcttaaaacaagaacatgtgtttgaaataggaattgtattccataataaaagattttcccaaggcttaaaaaaaaaaaaa

SEQ ID NO: 15508 - DNA, 833 bp, Homo sapiens
  misc_feature (1)...(833): n = A,T,C or G
ttatttcttgtgttgtccaataatactttttttnnnttgaaacacgatagcttcagtagacattgctggaaaaacacatcaagtgtataagacgtgttcaaaaatagaaatactgcccttgatctacgaactctcttcacaggaagttttaacattttaagtcttcagagtctttaaatgtgaactggaaaatgtggaaactggaaaataattactttgtgtgctttttgtatgagattaaggtctctaccatagcagagtcctttacaaggagtatgcaggacaaggctaaagactgaagcaagaggttagtactttacttaacacaaacttgataacctgaaaactctagcgatcaccccctttcattctgatgattgtttacaagtcaataaatgaacctctgtcggtatgtctccctgaaaaaaagttacctgatttaacgtaagcctgaaagtacccttatccaatctgataactttaaaaggtccacttaacactcccttacctgaacctcaaacagattaatcacatcatcttcctctttaaattcgagttgctttgaatcgcgtcgcgtctatctctcaccccatccttcattctccttacgcttctcgacccgtcactagtaacctttctattgtctctgtacacctctccccatacatcaatgcacataccccctcagccatttttcctgtatctcccctatttacgcctcatgcaatcccacaatacattagatgtttttttaatccgttaacacatttatcctagatttataagttttctccaatcttatcgggtctaaccttcctttttcccccacctcc

SEQ ID NO: 15509 - DNA, 292 bp, Homo sapiens
ccctccaggtagaagcagaggcctagctggtattaagggttacacacagttttcaccacattattgaagagaagggtccagctttggaaagagatactatactaataagcaagtgtggaagaagaagaggaagaagaagaagagaagaagaagaagaagaagaagacggaggaggagaagaagaagaagaagaagaagaagaagaagatcttcagttctttgctgctttttgtaaaaaaaaattaaagttctttttctttgggttaaaaaaatttttttttctggcctcgtt

SEQ ID NO: 15510 - DNA, 151 bp, Homo sapiens
  misc_feature (1)...(151): n = A,T,C or G
cctagtgaagccagagtgttgcctgnaagcctgagctgaatatacagatggatagaaaacttggagcagtggaagtgttggaagaaccctggggctaatgtaggctaaagaaattaaatttgccatacatcttccgttaaaaaaaaaaaaa

SEQ ID NO: 15511 - DNA, 1101 bp, Homo sapiens
  misc_feature (1)...(1101): n = A,T,C or G
tattctccatacgcgtctaccctacctcccccaacacaccaaaacaataatatctccaggcaccatcggctggcatacctgcagtccaggaccaatggaacagaaaaaaaacaagaagcgtggggattgatttattcctggagccgataaaacagcatgggctatttgcatgggaagtcaagctcatgtgtgtctaagctgccgacaaaaaaaaaccccacccaacaccaacccaccaaactacaacccacaacacccacactccaccccaaccccaccccacccccaatttttacacaccatacccatcccccgaccccccacccgcaccaaaacatattacgaccttattcccttacgaaacaggaaaaacaaaaccactccctcaccccacttccctaaaaaacgcccaccacaccatcaccccgcctcccccctaacaacacctacaacaccatcaacacacacacccccaccaccacccgcacccacgactacaaccgcccgccccacctacatcaccatcacctccgccaccgccccgccaacccacaccaacaaccacctacaaccccaccaacaaccctccaccgccgccccctccacacacagctccaaccccacgacgaaaaataatgacccacacaacgacacacaatcggatacccccactccacgacccctgaattaaacagacgtaccacaccctgctcactgtcaacccaccaatctcatacacctatacacactcactcgccgcagacacccatacacactcaccgtcgccgccctcacccacacacactacaccacagcgtacatgaactcacacgacacgaaanacgcgcacagcacatccagcgaggaatcgaccactcacatgagcggcacacacacagcgatctcacgtaccacagcactcccncacgttaggcgcgcgcgccgcgtcacacaccgccatacacagatnangagcacccacaacgccgctctcgcgctcgggtcanacangcaccagcagcggcctcgcgcgcgtccacgctgcatgngcgcaccaatactagagagctctcacatcagccaccaccacnaccgattacg

SEQ ID NO: 15512 - DNA, 790 bp, Homo sapiens
ttttatcaattaacaaaagaaacacagaaaccttaggtcctgaccgtggtccaggactactaagaccctggactgcaggacaaaccttgcttcaggagacatgaacatgtcacaccataatagtgaactgcacagaacattttggggtctagaaacagaaacatagcaagacttaataaaatgcgagacacccttggagaaccattcaaggacctcactaagtttttttttcttcctggcactctttatacttacctcagttatttgttaacctgtgtaaagtgatgcagttactaagcaatcgacgtcgaagcaaaccgggccccccaatcgccacccaaactcaacttcggaccctataagaatgacaacgcacccctataaggtaagcaagagtgcattatgcacgctccccccgatcgcggttagcctcgcgctcggcgacctatgactcaccaccactgaataacccattgccgcgcgtctatctatctgcttaagagtgccgtacccagtgctaatcagagaaatagcacgcattcataacgaaacgccattcatcacgacacccacctcacctaccctcttgccgccacgcgaggtgctcgagtgacacgattatgaaaggacatatagcagccataatgctcgacgtatgtagattgctacatctgtgattcatcatctacttatgcgcattccccacacaacgcaattgtgaccaccacacatgtgattctgagtcatacgtcacaaacacatcgttaaccaagaagctgaataatatgtg

SEQ ID NO: 15513 - DNA, 954 bp, Homo sapiens
tttaaatacgtctggccgccccccctcccccaacacccccctcactaggacaaggcagcctgtacatgggcaccatgttccacctgagcacaagacaatattttttgatgctcagcagaccgatgcaaaagatatgggcccctgaagaaatcacggagctgtttcctccagatactatgatataagagatcattaaaccgccctactctatacttctcgaacatacaacccaagtcacgcatgcacaaccctactcgccaccttttttctccccctcccaaacctcctctcctccaccgactcacctaccattattttattcttactgtaatatagacgacgatcatatagcgaacctgcacgacacgcccccacacccgaaaacagacctccaccacgtatgcacccatcgacccgaaccaaaagcaagaacactaaccattaaatcactccatccgcgcccacgaagcctcacatccaagatttacaaatcactagaatttacatcaaaccaagcccccgccacgccttatactactcacacacacagactccaacaccacacaaagtataccttccccccatccttcatatcctcaatcccgaacatcacatgctcgcccgcaacctcgtctctcacccctcgctccacacccatcccacatcccacccctatcatcgatatttcccacatcacacgcaacacccacatcccactcctacccagtctccccccacccaaatagatcaaatacgtacctactgtactacattcaatataaatgtcccctacacctgatacgcgtctcaatcatacacctcaagtgcgcctactgctcgcttgtcggccgcctcccaccactcaacaaacgccataacattacctactgacttcagcaccctatcgaccatacacttaaccccgttacgcctgtacgtcaacaaccctattct

SEQ ID NO: 15514 - DNA, 935 bp, Homo sapiens
  misc_feature (1)...(935): n = A,T,C or G
gtttttactctctctaatcttatgttacatgcatctactttttggatttcagtaccatgcctgggcattaattgagcactttcttctcaaatctggctttcctcctgaccctcccaatttctctcaaacggctaggagaaggaagaaaaacccatcgatcgtgactcatgtttcggcggacaaataagctatgttttaccacctgcttgtaacttgacatccatctcaccttcaaccctattaccacccgattactccttatcatactatacatccctcccccgcttagccaccctattgatacatacccacacttatcttttctcctcccaccttcccctaattttttttaatcactttccccgctttttttgtcccccgtccccctcctccgcccttagccccacgcgccatactgtaccctctccctccttcccttctgtcttcttacattgcctcttcgccccctcacgtcctgctcgttcatttttttattccctcttctcggcctgcatctcttttcatctcctatatgctcccacgatctctcagacgttctcccacttttttcttccgttcgcccgttattcttcgctctcttactcaccgcttccctctcctctacgctatctctcttcttctgcccccactccatctttcatccactcacgctcctatcctataacatttctaataccctatcgcctcacagcattttttcacatacttctaccacacaaatcctaccctcgtttcactccacaatcgcgtaccacgtttatacttactaccaacgcctcatttatcatttcactctccctccctccctcccccaccttctctccactacctccgccactcttcttctcccgttcgttttacaacattatctcacatttcacaccgtantacgcttacatactcgtactatttcg

SEQ ID NO: 15515 - DNA, 1119 bp, Homo sapiens
  misc_feature (1)...(1119): n = A,T,C or G
cacattggcgccatagagggtagaggtaccaacaaaacaatgtaacacacagaanannnnaaaannncttttgngnagnaggaactgtnnactancacaagncgtcnaggannggnanannaccgngannggcagcncanccccctagaagctctcaccnttcctgcttttctatagnagagggcagatgcatcctcgcttacctctatcacaccttcacgcacatagaattaggtaccattatacctcgagagcactacccgcagcccatngtcagcaacctgcgataccagacttgagagatctcattcaactaccatatcatagcgcgagtagaaagtcgcactgaaccagagaaatgctcgaccctgtctcgcgaatatttttttatctgcaaaatgtagaagaagaactaccacagcacgacatttccggagaaaaataatataacaccgactgcaactatgagcactcttaacaatcatgtgttgaaaaatagtaagggacgacgtgcgaccttatgctaacaacaagcaagaaaagagcattggatgttatcactggcaaaagaaaagacaacacgactcgccaacccccgccgcncaacaccacgcccaacgcgaacaacatccaaataaccaccacacacccaacccaccattctccctaaaaaacacgcaatcagaccaccaccgactaaccaactagcgacactaggaccacacgacgcagccagaatgacgaacgcgaccgaacagaaatagccaagtagaggccacgcacgcccgcaccacggcgctcccaccaaattatacactccccacctcacgaacctctcaacgccacagtcagaaacactatcgcgaccatcagcgcacagacaccacgcgcgaacaggaacaaaacacaaataaccagaaaccgaccgaacccccaagaggacacgccagagggagaggccaccaacgggaggaaccatgttcgcgtctacacactaccacagacacaccacgaaccctacacccaaccgacaccatcacagagacaaacacgcgcaccacaaggctctaccgctcagacaacacacgcacgaataataacagcgtaaacaatgagaag

SEQ ID NO: 15516 - DNA, 1168 bp, Homo sapiens
  misc_feature (1)...(1168): n = A,T,C or G
atcctccagtcacgctatatattggtaacgaccgacacacccacgaccacaacaccaaaggtccgtactactgtgctgctggtaccaagtctggcagtcgcagtcggaaggagatctccgagtatcactcttcaacactactactctcacacgtagtgtacaacgcataatactcactcgctctgcagcacatcatcgagacaagtctgaggatctacttcggcactcccacacacaccagcagacaggactaaatctgctcttcgtcttcgatctaacctcttcgactcgcaaattggcgcgaatccggcgatatactgtcgccgcaccgcacgcatgcgatcgcacactgcgatccgattatggagatcaggacacgattgataacacngagcgctaccccttcttctcccaccccaacaaccctgtactcaagaacacaatataccaaaattgtagtacatagcgatcgcacctatatacgccacaccgatcgatcgcgcggccacccacaatatacgcacaacacacgaagagagtcaccgacaaggacgacacgggccgcacacacaccacctatcataccgcaccaccccgccagctcacgtatcagacaccacactccgtctattcacatatcagattcagcactacgtcgcccgctcaactagttataatatccagacgacgccatttaatacgatactacgtcctcgtaagactgcacgaatcacctccaacagtacaagccggggtggagttcatcgtacactcactcatcacgacatcaccctgaggcctggacctgtcataaactctaactcagcccatctacaccttgtagatttcccaacaatgtaaatagatcatacctacctccacgcagcacacccttgcgcgtagcgccgcgangaacatctggcaagcagactgaggaatttatccagccaccacgcttgcgctgaccccgtcgctctcggcgccatccattgcgaacccacatataccaaatacgtgagtctacaacgacatctgtctcgcaccctcctaccgctcgatgcatattcagcgaactagagagttgctcacataaaacaccatctcccatacagacacttctataaagatactagtaatatacgacacgtacgaccattaatactctatt

SEQ ID NO: 15517 - DNA, 772 bp, Homo sapiens
gaggacctcttttgaggacactgagaaaaaagcctgaggagaaagtcaccatgacggtgacagaaagactaaacagcatgctgtgatctttgattcacagtccccatctcaccctggactgccttcctttggaattcccttgtggaaaaaaaaaattaaactcttatttggataaatcattgtgacatctgagctgagacttgaatgaagaaaagctgtccatggcaggatctgggagcagaaggatccatgcagaggaaatggaaagtactaggggctggatcgagagaacacgcttggcttgtgagcataacacacagacccgcgtctccatcatggagcaactcttctcctctctccttacctgagcctcactctgttgccctggctggagtgctatggcgagaactcagcacacaccaacctttgactcccgcatccaaactattcgtttgactacaccttctgagtaattggcggctccggtgtgctccacccccccccacaccctctggtacaccctgtcccccccttgccgtccatcctgactccgactcctgcacttccggctgactcccccctcaaccccgacaccgcctgccactatccgcaccgcacccccactgccccatccctctttcggctctacctatcgacaggggcccccccctgacatggcaccctccttcgccgcccaacccacgcccgaccgcagccatgcgcgtgccttgtaacacgcctgcgccgccctggtggcccctactcttcattt

SEQ ID NO: 15518 - DNA, 881 bp, Homo sapiens
  misc_feature (1)...(881): n = A,T,C or G
tattattatacgacagctcagccaacaccacatgcaaccgaacaccctcctttcagcagtagctatatgggcaagttctgcaagaactggcaacagtctcatattatgtggacaactctacaatgcatgtttcgttgggctctcccttttcgctgctccaaactccctgtccctgacttttgcttactgggtccagtccccaatagagcagactgctcttaggctccctgtcttacgagaactcaggggaacacgtggcctatgctctagcaataaaatcttcttgcattgccacacaaaaccatcatcggccccccctgaccttacccaaagagctcatgaggacgctaacatatatagtgggccaacaaccgaaccccctccatggacacactccaccattccatgcgagctgccaacagtccgaatcacctcgaatagaccgccccccctcacatatagcacccatacctcgctaaaacaacaccacccaccacgcactcaaaatatctgacccgaatgccacaatcccccaaaacggacacccttctgatacatagacccaacgcttccacccatccacccccacccgccccccttcaccacccctaaagaacggccgcaagaggtcatcgcccaccacaccacaccacacccactcaccccacccatcccgcccccccccgcgtgccctagcaccttcaatctccttgcgtaacgatatcgctgcgtccaaccacacaacactgaccccccataattaggagacgacaccaacacaccaccacccccgcccaaccgaacaccaaacatacactggcatacagaccaacacctccagcccaaccgcncccaatgcacaccagctcaacaacctctat

SEQ ID NO: 15519 - DNA, 808 bp, Homo sapiens
cttagctatttacaaaatcctattatttgtcttataaaaaaattcggcatagccgttgcctggtgtgagggtgctcaaggaaccctatggagaggtcacatgacaaggattcaaagtctcctgccaacctgtgagtgaatgagccacttggaagcagatcctccaggctgaatcaagccttcagacaactgtaaccccagctgacctcttgactacagtctcagggaggaccctgagctgggaccacccagctaagctgctcttgaattcctgagctgtagaaattataaaagataatacaagctttttttttttgctaaattttgggggtaatctatcccacaggaacagctcgcactttctccacacgttcttggtggatgaacgaacgaatgaacaccgaacgactccccttgaaacccgtctctcacgttatcccccgaccattgtgtcccttcccttgactatcgatggaatgtctgtcacacccccccaagataacctcacacttaatctctttcccctctccccgtctacatatccgtgcaactccttttctcctcttagctctctacccccccatgttctccaacactgactacaataacacccaccccctaccaccgtctctaaataacatcctccagaaatataagaacctaaaatccgcaccacatctttcttatgtcaccacgtacctccatcgaattatgtttgcaatgagtcggtatcgcgccccgtgactttttattttttttttatattaggcccttcaccattctccccaccccatctttgttttgttttg

SEQ ID NO: 15520 - DNA, 786 bp, Homo sapiens
atgggatgggcttctaggtaagatttcttctaaaggaagtttctgtggatttcatgaaaacaactggcatttaggtgaaaagcaaagctctctatccaaagacgtcatggttcccaacccagcctctccctgtgacggcaccagcttgagtgggcagccaggatgccgactggctctctccgtgctggggtggggtcagggctaaagcccacggaggaagccagagggagaactttaaagcggggcaaagtcccagttccccagtcccatgggaatgaaccccagtcgggagaaacaagaagaaactttcctagatggcttctcatgaaggtgcagagcaagaccccacaccggccggagacaggcagatccagcgtcagggcacaggcctcgtgacaacagaccatgggcaggacaacgcacaggaactacggtgaagcggaacattccagaaacaccacccgccgccaccgtgggggacagtgtgggactgccaccaccattcctttgtcttgaaaggtccttgctgtctttgcgcttaaacgcttacaacttcatgaagaccccatactaaagcgcggtgccgtgtctactgcatcaccgcacttctcaccaaggggataaaggttctgctcgataccctcccacaactatgatcatcctttcctgtgtcaaagggtcgcctagacaccgcacgcggaaacccactgaccccattattatttatgagtgtgttggacacatacctaaaatcacgctacaggaaattaatgacctgctccgttt

SEQ ID NO: 15521 - DNA, 1159 bp, Homo sapiens
  misc_feature (1)...(1159): n = A,T,C or G
ccaacaacaaaacaaaacacataacaaaaaaataataaatatttacaacattcccanagagatggtgatattggaaggcagacgattacccatctatagtacctgacccttcactcaagcaccactgctagccccaaacaactccatcggctcataggccaccatactaacactactaacttatgacatccacatagctcacgcacatcgttccaaacatagaggtctcttcgacttcgcactccggagagactacctaagagcncatctgcgacctgttggcgagatagacctcctcatactaacactaacactacacgcccactgaacaccattattacacaagctataacgcgcttatcccgtcccatctactacccccatactccctgtatgtttaaacgacgactcagccacacgcattacacaaagcaaccactaatacaacgaccccccacctactccacctcaacattataatcccaatatcaccaatcccatcccacatatctcacccgaaaacaccataccgcgaccacgtaaagacacacacataaccacaacagtactcaaccatgaatcactcccccctacctattatatatcttcccccactcgagagcacagacgccacaaagatagttacatcagctgtaaccccacctataacacaaaaaccactcatacaccacctacattacacgcactctattgcagcacactccactcactatcaccccgcgcctatctacgccactccaccttccacaaataagtgaataccacaacaacaacacacagatacatcgacctaactcacacgaacacaacaagcacccgcccgctttcctaatagaagatttagactccatcaacatcaaatatacacacacaacccataacacacaacacaaatacacacacgactacgacaataccttctcagtatgtttaaagcaagaacattatatcgagcgaccacgctacacgacgtcatacaaatacaatctaaaatatcactatctgactaccacccacccnctcacattccaagtaatccgatattattgatattctctcccctataccgcacgtctcgcgcgcatgacacataaacaccgatcacagattcatataatacctcagtgtatatttacgt

SEQ ID NO: 15522 - DNA, 854 bp, Homo sapiens
  misc_feature (1)...(854): n = A,T,C or G
agcacccggaaaagaaagccaacataaagtcagaaaanancctcagttctaccanacacggcctcggccgcatcaccaccgacatccgggagggacagactttctactatgtgagaagacnaccaccagccgcaccggagcaagaaccccaaaggcaaccgcggccaagggggcaccggcgcgcccagcccagaggggaccaaaaaacaacagcgccccacagggaggcccgccgagggcccagccaaaagcgccagaaaaaacggaggcacggacacgaagaaacacaaggacgcgcaacccacccgcaccaagcacaaaggaaccaaacaccgaccggggccacccccagcacacccacccggaagagcgaaggaccgccccaaaaccacaaaccaccccaccccaaaccccacgccgcgcaacaccgcgagcaagccacacccaaccaaacccaaccacacgccgaccgacaccaccccaccaaaacacaccaaaaacaccagccccaccaccaacccacgaaaaagacaaacccgagccggccgccgacccacccacacccacaggccagcaacaacaacacccccccgcgcacacagccgccccaacaaaaagcccccaacacacccaccccacccagaagacgccacgacgagcacgaaacacgaaacaagaccggcgacacggacaccacccaacccacaacagaacaagcccacaggccggcaggcaacagcaacacaaccagaacgacaagaaaaccagcaacccacccacagaggaagggccaacacgaaacaagcacaacccaccacaccaacacgacagcgaccaacacacaagaggcagag

SEQ ID NO: 15523 - DNA, 919 bp, Homo sapiens
  misc_feature (1)...(919): n = A,T,C or G
tcatcccactttcaaaaacacatatttacaggggggatgcttangaagccaaccccatctatgngcaacgaaacactcaaaaatcccaaatgaggaagattctgcaaattttnaaccgctgctgatctcaaggccatcaagaaaaggaaaaaaagaaaccatcacaatccagaggagcccaggaagatatgacaactaaatcttacggcagccacctaggatgggaccctggaatagaaaaacggcagtaggcgaaaaactactgaattttttttaaactctggagtcccgtccaacacccaacataccctttttcttcccccccccagcatattcacctaactccaaatctactccgacccacctcccatctaccgcgtcgatccccccccccccgacaccccccaatgggccgggcaccctccctaacctcctcaccaccccactccacccactcaacatgcccaaccgccgtgagagacccctccgctaacccactacccatctattacactacctcccaacccaccccatcacatccacgacacgtaaacaaagtcgctaattctatctcctcgcactcaccatatcgtcttccacgcaccaccacgcacccctccgcgtactgacacctctacctattctccctcccttccccctatcgtcccatacaacgctacgcctcccccatttatcttcatatgagagaataaacatccacctccttcctaactcacgcccccgtccctgcgcgctcattcaatacacttcgccccagagctattctcctcccaagtacctagaactatctaccatccgccgcttaccccacaccaaatcagaacggctagtgtggtgtcgggcgtccacgcaccaagcccacactacacctccaccccagccaacccaatctatcttt

SEQ ID NO: 15524 - DNA, 129 bp, Homo sapiens
ttctattagcaacttaactaatggttgttttgtgagaccatcataaccaagaagaacgatctttattttacgtgcaacattttaaccccacttaaataaactaaaaattgaagatgaaaaaaaaaaaaa

SEQ ID NO: 15525 - DNA, 953 bp, Homo sapiens
  misc_feature (1)...(953): n = A,T,C or G
acaaacaccataaaaatatacacataacctacccacatccnaaatttcggggaaactacaggatttttacagagaaaaaccgagtggattttgatatattccacccatctttttttcagaagaaaacattacttccattgtatcttgttcggcagtcatcggagaaaaacatactacaaataatctgcactggacaaacaaatacaaaatgcgcctcaactcggcctcaacgcgcggagctctcgaggtcggtcacccttataaccagggcccaacttatctcttctcgcaacacagcacacggtagcgaaacggctgcccccgcaccaccagtgagccccactccacattgactctaaaagcgcgaccaaccgaactctcccccgccgccacccgcctacattcagctgaaacaaaacccgcaaccaacacaccccaatcatctaaacccagcacctatccctaatagtactcacattaccggccccatttcctacgagacctttaaccataccggcaaaccatacgcaagatcaactagatcatcaaactctccactcccgaccaaccacaccaaacgcataactcattaaacctccctcctccaccctccgacacatacaccgctacagcctcgacgcacacgaacaacgcaccgtcctacacaaatcatgatgccacgcattaaataaacccgcatcacacgaacgcgaacaccggagcacaactaaagatcacaacgataagaataaaagcaactaacacacgaagcaactgcgccacccttgaggttcgacgtaggccaagacgtaacccagcactcaccactctgtatcatcatccacagaacatgcagacaccacacccggagatatagcaaatgttaggtgacggccacagacaccaccgagccacaggaagaacatacacctcgaaatgatggtctacgttgg

SEQ ID NO: 15526 - DNA, 818 bp, Homo sapiens
gcaaccactaatcaaaaaattttaaataatttaaaaattcaggaaagcatgaaaaggtacttacgtttcctctgaagtcgaaagagaagaacatcaacaggattactcacagaagttgctctgcaacctctaagtttgggaacctgataaatataaagtgattgtagctatttttctgaggaatgatactgtgtccagaatttattccttccggtgggttcttggtctcactgacttcaagaatgaagccgtggaccttcaccgatggaacaccaggctatagtttcaggacgccagacttgacccacacttgaccttgctaaaaatagcaaccccttcacaactggtacagctacgacaaacaactgttcccaactttcatcgctattcagctcttcccccctcttgcaacatccacctttatctggacatatcctcccaatgactcccaccttttttcttcctcaacctccatcttcatcccatacactgctctactcacacgctactcttcattcttctcattaacccccactctccaccccccattacctctctccagattcacacaccaacaaaccttccctctacctaatcccccaaccctcctctctatccccctcaggggatctctactagactacaaaacacagcgacaaccgatattaaccacccttccctccttaattctcccccatctcctcacctctccaacacaacaccataccgacatgattcaatagacctcccccgatattctgtcttttgtccttactacccactaccaccatacctacctaatatctatgagttattgt

SEQ ID NO: 15527 - DNA, 829 bp, Homo sapiens
  misc_feature (1)...(829): n = A,T,C or G
cccaccaccaacgcactccacacacanttccaaaaaaaataaacttaatactgcanctgctcctgtatggaaacctctcacaggctttcagagctgtgactgacaggagagaagttgtggacatcatcttctgggaatccaagtaagaactgctctttgggacccttaactgcaatcagagaaagattgtaacatgtcccaaaggagcttacaagaccaaacaacaccaccaccaacactctcatccaaaatgagaccttcattgccatcatccctgaaggcatttctccagctcctacttgaatactttcagtggtgagccattcattgccgaccccgaccactacctcccctttcccctgcactacacccatcgtccggcaccccaacaccggttccctctccaccacccgactaagcttcatccatcttcacaaacccccccccgctaacttaccccccctcctcccacaacacacactaacatatccccctgcccccatcgtaagtcccgcttcctaaaaaccccctcccctccagccccccctaaacccaacaccggaacccgacacgcactcccatactccctcccctcctctcccaccaccatcttccctcgctcccaaccctcccccccgccatcctcaaataaccttctcacacccctatcactcctccacccacccactataatatcccctatctccccccccgaccccccagatcatgagcaatgcgatgacaccattcacacacccccaccttgtaccaaggttgtctctaggaccacccacaatcccgactaccccaccataccccaactcctgtt

SEQ ID NO: 15528 - DNA, 822 bp, Homo sapiens
taggacaagaagagggactaatgaaggataagaaacagcactggggactctctgggtacagaagggttgtgataaatcatgctgctccccgcaacatcgccccagaaccctactgctatagtctccgtgaactggccactgtccctcttgtttctcctcctacccagcaaaaacatcaagtatctcaatttgagaaacagatctgccatgtactagctaatgttcctggccaaaatggttaacctcttggactctgttttctctttcacattcagaggcacttggatggctgggattccttcaattcttgaaatgttatgatttttagacatatagacacctagcagtactatctatactgacacaactaactcctgaattaatacgatagtctggctatcacactctacccactgacttcctcgtcgctctatatgccactctcattcttatccctcccccctaagctacacttataattgcgttttaccaactacgtctgcgtttcctctctctcatttcttcatgctggggagtctattactcttactcacagatatccactcctcacactagcaattccgtacttctcccaactcgcatatattactactttagctcatcctcatcctcattttcatatcctctagtcacccacctccacttattcctaagatcatccaataccctccctccacccattattcctacattatgacaagccatccgcactcaccctaatctctttttattttcgcttcgcgcgtcgctcaccaaccgccacaccctcacccaacatcatatataatgaatgcagttttt

SEQ ID NO: 15529 - DNA, 220 bp, Homo sapiens
  misc_feature (1)...(220): n = A,T,C or G
tagtactacctatnggcctgtcttacccccatcctgcgcctataaaaaccccagattcagccacaatgacatagacaacctgactttggggaagagacgacttgacttcggggaagataagctgatcttctcatcccctctccagctctctctctgctgagagctgtttttgttgctcaataaaattctccgctgtcattacccttcaaaaaaaaaaaaa

SEQ ID NO: 15530 - DNA, 943 bp, Homo sapiens
  misc_feature (1)...(943): n = A,T,C or G
ctcctctcactattcccatctccccgccataacccccatcacaaaacttcagcaaggcatttggtagtcttacttacagaaccgtagagggctgaattgtggactccaaaatcattgaagaagacctaacacctagaacctcaggctgtatttgaagacaggatcttcaaagaggtgattaaattaaaatgaaagcattagggtgggccctaattcaatctgacttgtgtttttgaaagaaggggaactttagaaggaaagacaccagcgatttgcccacaccattgaaaagaccacactgaaggcacaagagattttttttttttcatctacaatccaagggagtagaggcctctatatgaaaccaaaaactcgccaacacgtttgatactctggacttgctggaccctctaagaacctgagcataaaaatataccgtgttggccgattcaaagccacaccacctctcgnggctctccgtatcatcaacaccctcacaactcttcagagacgccgtcgtctcccctacctattatagggacacatcccgcaacactcgcctcacagcctcgacggtctatcacagcttctgactttcacctctgacttggtctcgcgcacagacctactggactaacacaaattactgtgggtcgtcacggctccacccctcgaatccacgatgtacccctacaacgcaacaaacaaccgcaactccactcctcggttaaatatgtcgacgactaccgctggactgttctatccgtaattcgcgcgtatcgtattaccatacgcccccacttcctactctgtatcaaagcgtcagcgcaacaaccactacctactaaggccaaaacaactacacactcatcatcgttcaccacccgtctcacatgtagaatgcctgccaacccacacgacgccacaccgcggcacacgagcg

SEQ ID NO: 15531 - DNA, 877 bp, Homo sapiens
  misc_feature (1)...(877): n = A,T,C or G
ttctgggcactccaggtgcgtgtccagtgcacgaagaaaaaggcagtgaggagtgaatgttgngcttctcccatccacctaaagcacctcattgctggatagagcactgggtcctagctcagcacacctttggccttgagggtgacctgcaaccgggcagctttcatcctcagccctctcccctcaaaaaccgaacgcactatgaggacgcgaacgccattttttgttaaaaagagcttacggcggcgagaaagaaccgaaactacattatcttacgacgacactgtaggaatacaccccattagctcttacctcccccccccattcaccccccgttcccgccgccaacaaaaacacatcctcgaaactacaatatcgcgcctactatataccaagaccgaacgacaaaccatacgcacatagtacaaaaccccccctcaacccccagcctccacgaaaacaccaccctccattcctaaacaccccccacaaacaaaaaaacaacacaacaactaaataacacccaccgcccgaaccaacacgagaaaacacaccaaatgacgcaacctccactccccgcctctgcccccccgtattcctccagactacccggcacgaacacgaccggcactcgcacgcccccacaccacggcgccctccgcgcccccggcccgcctagcccttacgtattctcgcattatgttcacaatcaacattaccatccacccaggaccaccccgacaccggacgccggcacgttcacacagcagcccctggaccacatccaactcactgtcgaagagtacgtcgccgcaccaacgacgtgctccagaaaaaccacaaaaacataccacatacaccacatcgccacagacag

SEQ ID NO: 15532 - DNA, 797 bp, Homo sapiens
  misc_feature (1)...(797): n = A,T,C or G
cctaggggaaactaatcntcactgctgncccagggaagcataaatcttggctttttcgggcatggtggcacatgcatgtactcccagatactcgggaggctgaggcagaagaatcactagaacccaggaggcggaggttgcagtgagccgagattgtgccactgcactccagcctgggcaacagcagagaaactccatctcaaaaacaaacaaacaaaaaaaatattgtttttctgacacccacccttcatatcacagtccgaccaaaccccaacccgttcattgacagaactatccactcattgaatctagcatgattcattgcatccacagtaagaaattcgaggagggagattaaataaaaagcttaaacgagaaagaaaaaaaatggcgctagttggcctctccagaggagctctgcggacgcttccattcaggagagggataaaccatgatcctagctcaactgaacacgtgccccccgacattccgccgccgcacagcgtattcagacaactcaaaggcggaaaaactgataccctcaaaaacacgcgcaaacccgccaaccaacaaccgacgaacaacggcaacaaagagccaacaacctgacacagcacctcataacgacgccctctaaatccccgacatccgcgccacaaacaacatcaaagagaatgcggcgatcgacacggggaggactagcatgaacaatatatgaagacaccagacttcacgaatcagaaaacgacacaacggacagaattcaagtaaaaagcaccaatcaaatacacaagaag

SEQ ID NO: 15533 - DNA, 789 bp, Homo sapiens
cttagggtacctctggacctgcagccgctgcctgtaggaatacaccaacagaggaggtgagaaagtaaacagcagcctaaagcatctgcatctatctcccgccttggctgagggaacactctgccagccagctcctgccctcaccagaatgcacttcaaaagggaaacaaatgacaatcagctcttcagaggctgctctgcttgatttaagtgtgtgtggccaggaactctactttcatggaagattggattgttttaattataaagggtggggtgttttttaagtaaatgcacatcctgtgatttatcttcagcaaacaggcccaccactttccccgccctccttgctaccatcacgcacgatccctccatcacgaacgacagcacctttccccactaaaccacccacaaggctagactttctaccccggcccgctttgtgtgccacacaaatcctcccttcaccccccatccgcactcttcgagtctcccagcgtctagcgaccatactcgcaccccgccgagtgagagtgcacgttcaactcgacaaccgccccgtagcgacgaactgcgcctcggcctattaagtgtcgaacccatgctgctgctactgagtagcgcctctcccttctactttgcgtaggtatctatttctgcctccgcccctagatattattgctgattagcatgatgagtcacgtccgcctcgtgacaatcgtagagacgcgggccagtgtgacgtccggttactcgattgtcaacgccagaacaaatagttggcgtacttgt

SEQ ID NO: 15534 - DNA, 812 bp, Homo sapiens
  misc_feature (1)...(812): n = A,T,C or G
cacaatcgacttcgcaccaccccacaaacaacaacacaaaagttcagggtgacccttccanacctcagcgagaccaccagaggagctgngcctgtcagncatcaccttgttccctggcgccccagaggctcttgtcctttgcaagaatggagacgaccgactgcaatggaccaaaactggttcccacatcgagcacatagcatcccacctctgcctgcatacagatatgttccggcgatggcaccgacaacggcaaggaaatcgttttttttccatgcgagtcctcactcatgagccaccactggaacatggagagctcttgaagacccctgccagaagcagcaagggccacgaagtggagctaacctgccccacacaacaccggaaagtgaagaagaagaaaaatgccaacaccaaaaacatcacacactgcctaccacaccacacacctacataccacatcgccaacccacaccacgctcgccctccggtaaccccaccctgccgacacgcgccctgccgatgacgacggccactaaggcctccccaacccccctcccggccaacacgtacttcctacgttaataaccccaacgcccaccgcctactccccatgacactccgcccgccaagccctactatggctccaccccctcaaccacagaatctaaaagaccctattgttctccgcgcaggtcgcgcatgacaaccgtcgtctcaatacctacaacatgagtcgccacccgcacgtccaccgcatccatcttccccacaactccacccaccgctcaacctcccgacaagcagggaag

SEQ ID NO: 15535 - DNA, 325 bp, Homo sapiens
  misc_feature (1)...(325): n = A,T,C or G
ccctaggcccacgacatggattcactgngataccaggaaccctctaggacccagaagtttaactgtcaatcaagtggcatgtgagggaaagtccagcccagcctgggtgccagaaggtctggattcctggtctgcacattccctacaacgctgggcagagatctcatatgtacttctggctcagctactaacttagctgtgtggctttaggtgacccacttaacttctctgtttctgtttctccatttgtaaaataaaaggtttggactagggaatccccaaatttcctttcagtataaacgttccatgattaaaaaaaaaaaaa

SEQ ID NO: 15536 - DNA, 234 bp, Homo sapiens
  misc_feature (1)...(234): n = A,T,C or G
ctcattactaaaacaccgccaccggtaaagagaaacacccaaaccacttcancaagagacactactgcatttacatgagtcacacagtctacatctgcttctcctgtggctctgccatcagctccaatatcaatacgaacttgtattggatttagcggtgagaagaactaaataaaaggaaacactcattcacttttctattgagaatattaaagtaaataacctcatacaaaa

SEQ ID NO: 15537 - DNA, 521 bp, Homo sapiens
ctagttggtgacaaccaaaaatgtctccagacactgccaaatgtcccaagaagaaaaactgcagccctgcccttgagaaccactgctctgaagacaattgccatattaacaattggcgtctaatttttcaggcttttttctatgaatatagtacctataaatttatataaattgtggattttttgcaaaaattgtcacactatagtgttaataattatcaatatattactcctttctattctgtacattttacaaatattgcatgctttttaaaattgttatgtttgtacactgtctgaagtgaactttttttaaagcattctccttctgataatcatttagattatacacaatttttcactatggaacacaatgctacaaagtgctagtgctctttgctttatgccaatgacttcagcagctgtaagaattatctggattttttaaaaaaatataaaatattaataccgaagttataggacatactataataaagtaatagatatctaaaaaaaaaaaaa

SEQ ID NO: 15538 - DNA, 828 bp, Homo sapiens
  misc_feature (1)...(828): n = A,T,C or G
cctgatgtatcgactgccccaattcgaacgagccaaagaccatcctgtgagatgcggattgcaacagctcactgcatcatggactacacagctctgctctgtgccaaatccgctgccgcacatgtgctcactagtgccacatgcacagacaatgtcagctctgacatagcgatcttgcgaatatggaanatagagagaagaacactataccctggggacttcgtgagtcatagagagataggaaattattgttgacgtcagggactctaggaaccttccatatggatccatttaccaactactcacacttaatacctgtatacaaatatcatgaatccatatgtccaagtgtcttgatgacttatttctgagatacgcaaacacagcatctatttcatgacttcaggctacaaacgtgctgaatgagctatgctgctctggctcagagactcctgcttggctactccttaaaactttcttgggctggacaaccatcccagaatagctttagcacactactccacagattatggtccttttccagactctcacactctgacaatgttactttgacactcgtgtacttgcacaatttattgcatacctgacccgtgactcattagcacagaagtcacaatggccactgatgcactgatagcatacttcctgcaggtcattcacaggccagagggactgcagaggaactgtttgttaggagggctaagacaggaactgcttcgactttatggatagaaagggatgaaggctggtccaaggaaagagaaaagccccccaactggcacatacttaccatggggtaggggggcg

SEQ ID NO: 15539 - DNA, 627 bp, Homo sapiens
cctgagacggagttttgttttgttgtcagaactggtctggaactcctgggctcaagtgattctcctgtctcagcctcccaaagcactgggattacaggaatgagccatccacctggctatcattctactctctatatctccatgagatagtttcttagctccagcatatgagaacatgcagtatttgtctttctgtgactggcttatttcacttaacagaacgacttcctgttccatccatgttgctgctacaaatgacatgatttcattattttaaaataattttaaaaatctttttaccctttacatatttttaaggtggcatttgtcatgttttaccatacatttaaatagttacaaaggatgtaattgtgggtatattgaaaataattaaaatttcaaatttcaaaaattctatttattaaatgtatccagtggaatctaaaatgttaacagttgatatccatccagcatcatccatgtatccatgtaaaaatatataagcaattttatgctggaaattgtacattatttcttttcctacttgaacttgtatttttattccacttcccccacagaatcttatgctaaaataaaatatttttatgcaagagaaaaaaaaaaaaa

SEQ ID NO: 15540 - DNA, 522 bp, Homo sapiens
  misc_feature (1)...(522): n = A,T,C or G
ctagagcaanctgcttactgggacattttgaagctttatnnggccagctgccaaaaaaataaatgcaccttaatttttaaattgaattataaagccaaaacatcactacaactaccatcgctcactgattcaccaaaaattgggatacaagttttggtgtccgcaaaatggaatacctctcaaatctgtaatacaagcatgatatagtcttaaacaagaaccactcctgttatgacaactattactcttcctccttttaaagtttactcagattctgaattatggataattacaaagaagcttggtgaagttacataggggaagaagtttcatttttcaacttcccagtgaaaaataagtaacacagcatcacagaagggaaaatattctgtcccagaggacagtgccaggactttagcttatttcttttgcttctgtggttggttgtctttggccatttctcaagatgtgtaagcctctgataatattaataaaagcactttatttgcaaaaaaaaaaaaa

SEQ ID NO: 15541 - DNA, 585 bp, Homo sapiens
ttccccaaaagtttttagtgtaatggccaaaccccccaaggggaattaacccccgaaggccagcagggcccatccaaattttcttccggtgtttaaaatgaggcccattttaaaaggtaggcattgtttacttttagaactttcccatttaaaattttcagccccccagtttacttgggggaaactgaaactgtggaaaacaaaacttgtgcctaaggggggactactgtgttatttaaagctttaaactttaatttcaaaaaaatatacaacattttaagaaaatatagttcagtgcatataccacattgattttaattagttgatcttttatatacatgtttatctatgcaagaatatgtgtaagaagtgtatggaagttcagttgttttctgattttatgacttctgataagcttaggaattccttagataaataggaattatttactaattattttaaggtcgtgcagtcaaataaaattcacagaaatgaatctcaagttgatattagagaaaaatgcaatcattgttaatattaaaaattcctcagtaaaagaaatatatttgaaaaaaaaaaaaaaaa

SEQ ID NO: 15542 - DNA, 476 bp, Homo sapiens
agctccagaccctcttctgggaaggactcagccacgcttcctcctcggatcacagaagactccagatgcaagctgtctgtttccaacagtgtgcagggcttctctgactgggaggctgctcctgtcagctgttcaccttcttcactgactccagagtgtgcacgtgagcctgcctggaggcgcttggacaatcatttaccccatttaaaaaaaactggcctgcgttcttgactgcaaaaactcattatcataaaaatgccatgtcctcttaagttagcctataaacttaatgtaatgctaataaaaatagcaatagggctaggtacggtggctcatgcccgtaattctagctcttgggaggccagggctggaggatttcttgagtcctcaggatttcaagaccaccccgaaatctcactatactgtgagaccctgtctctataaaaattatttttaaaaaattaaaaaaaaaaaaa

SEQ ID NO: 15543 - DNA, 867 bp, Homo sapiens
acattaaaaaaatgaattaagtaagggttaacaaaaaaaaaacttatagaaaccttactggacattgaagctttatgcccagctgccaaaaaaataaatgcaccttaatttttttattgaattataaagccaaaaatatcctattgctctattcctcttattttggtgtttacatgtgactttataatttccttcacttgaaagattttaactttaaaggaaactttactctgaacgtttaggacaattcatagataatcaaattgattatcatgttttcaatgctaaatattacttcatatgtctttttacaaccttcagaataagaaagccagctatgaaataccaagtcttgactagtacagccgcctatcatcacatagaaaaagttgttcaactactttgcaaagcattggaaatttatcaaatcatctaatatactatctcctttgatccttaatccaagaggaaaataatccagacctgatcaattagtatcaattcgccctcaaaaccttatgtaatttttatagataggcaccacctacatattattgatactgttgcagttttagtcaaaatgcattgtacaaaatgtaccccaaatcaatatatatttctgtttttgatgaaccatatatcctaccgggtttttctctacattttacaaatatcatttttgtttttcacatgcattaaccataatgtttatggtcctataacaaaataaatttgcccttcttagcctatagagttgaattttcttggctttttccttactaatgtgtttatctctcatccttttttacttgaccccgttgaattgtactttttgtttaagtaatctggattatgccctataatgcg

SEQ ID NO: 15544 - DNA, 1104 bp, Homo sapiens
  misc_feature (1)...(1104): n = A,T,C or G
cttctcgtgtctctcctgcgcccgtatcgttcctgtgtccgtcgttctgctctatcgcgttgttctggtattttgccgttctcgcncacctctcgtctgtctttcgtggccttgtttcgttctgacacgtgatgcgggtctgtgtgcgcgtcttctgcgcacttctccgtctcgtcgaggccggctgcgcagtccctgccgcttctcgacgcatgtcccgtgcggtcggttggtgtgcgttgctacttttcctccctctcgctctcccctcacgagcccctgccattttccctgtctggccttgcagactcccctccgctgctctcgctcctcttgtcgtgccgcccttttccccgcccttcgttatgcgtctgctttcctctgtctcgtgccttggtttgggctcaccctctcggtccctgtctttgtggttgctttagctcgtttgatggcgttcctcgccgcgggcgtgtgcgctctttctttctgtctgtttcctattttccccctctttcctgcctccccctctctctctctgtgtgttttttttctccttctatctcgcgtacccgggttgttcggggtcgctctgagcggggctctctcggggcttctctctcctcctctgttctgttgttgcgcgtggtggcgttggtctgtttgttgacggtggtgttggaggtgcgttgtgtgtgggttcttttgttggtgtcttgctcttctggctttatacgttttatcttatgcgtgatgcctttcttgtacgcttctgtctttgtgtcgtttctgctttgctcctgttgctcgtctgtgtgtcgtttctgctctttgtttcttctctccttgtctctttatcaatccagcccccgctctccacctcacgtcctcctcccgacctattacaccaacaaaatcaacaaagaataaataagaatataagaaataagagaagaagaaaatatataaaatataaataaaatataaaatataaataaaagatgtgtccctcgcttgcgcactgcatgccgntgcgcagatgtcttgccgcgccaagggnnnntttttttantttttcgtttcccaatatnttttaatataatacta

SEQ ID NO: 15545 - DNA, 785 bp, Homo sapiens
  misc_feature (1)...(785): n = A,T,C or G
cctgngcctgcctatggatcaatcatcatgtacttccacttgcccatggaccagtcagcacacacttcttccattctgagcccatgaaaaccctggactgagccacgttatcggggctgcctgcctatggatagaatctactcacttctgctgacagctgttctgccattcaataaaactcctccaccttgctcactcttcaattgtccgggtaacctcattcttcctgggagggacaagaactcaggacccagatgaatggcgaatgtaaaaaggagtgtaacacgttcttggcaggttcgctgctgggagtgatgccatgcccctgtttgttggaccgcaggagtgaagagcagtgacacttctgggggcccagacctgtacctctatcaccctcccgtcctctgccagtaatcaggcggccaccccacgtgatggaaagtggcgacagggctaggccagcccgagcgccaagggctggtgggaagtggcagcactaaacgagctgaaacaggctctccgccattcactgggctgtgggtaatgggaacaagagagctgtagagcacccnccaccttggggctccagggttgctggtatctctttctcaggaaccaccacattctcttcgtccaaatgctggcacccacatgaaagctgcttgtggtatgcttgggccagctactggtccagctgtaccctcccaagagccaatgcctgtgccaacacctggagctgcccgccccaccacagagccagcacgcccggctgtgtgcatgggctg

SEQ ID NO: 15546 - DNA, 789 bp, Homo sapiens
tagactctgagctctatcacttctactcaagctggctgggatgcctctccctatacttcaacctggaaactctctcaatactgtgggaggataaatgcatccctactattccatcttgatcagaagtggaagtaaagtcctgatgattttaattcattattttaaaacctccatatcccaggtaccaatgcccaaggacaagttatcattacttcacttggattagtatgattgccttttgtgtctagagttttcttccccttaatctaccttcacatagtcaccagagtaacaaaattgaaatgtaatctgaccactttcgtctactttaaaaatcttcaatggtccccgttgcctataggattagactccgtttcctcaacacagcatataaattcttcatgactttgagtctcagccgagcttgctagtcacctccctatatggaactttatatcccaacaataatgaatttgtacctacttctcgtcctcagcatgttgtttcttatctctgtgcttttgtttatgttgcctggaattactgctttctctttctcctcttcctccctggccaatataccatccttgaagtttcatctcagatattaccttctccaggaagcacctcccctcggtttgggttagaaggtccttaacatttatggtcacttttaatattggaatttaatgataccatgatgtttggggtctccattctattgtaagctctttgagaacaggtttatatcttaatcaactttattattgaatggcagacccggagctg

SEQ ID NO: 15547 - DNA, 728 bp, Homo sapiens
aatccagacctataccctgcgtacagaacatctgtctgtatgtagaaatcaaatctgttatggacgcctataagaacataacgtgtcgacatcccacccctagccgtccatcaaaaaagcgaaccattcgctttaggaagctggaagacaccttctttgcatttacacaatcactttctccctccattcgccaatgagatgtgaacaagagacagtaagcaccacccactacaatctgttataattataattaaatttatttttttgaaaggaagtctcactctgtcccccaggctggcatgcagtggcacgatcttggctcactgcaacatccacccactgggttcaagcgattctcctgccttagcctcccaaagtgctgggattacaggtgtgagccaccatgcccggtctataaactgttttattatctttagtgttgcattcattacaagcctgcactgctatttaccatgttaagtttttaacctcttttcaaaagactgatgctcattgggccgagctggagtcactgtcacccaagggcctggtttgtatatgacactggtactataatcttggaaaagacctatgttcaactatagaagaggatacataaaatattaaaactgtcacttatgcttagttatttccgaaaaaagatgcccttaggtatctttttaaattttgtttatataaagttgcaaaataaaaaaaaaaaaaaaaaa

SEQ ID NO: 15548 - DNA, 178 bp, Homo sapiens
ctaggttaaaggggtgcacctgcatgttacctgggtataccgcatgatgctgagatttgaggtatcaaagaagaagtaagcacaaaaaaagaagttgttaacaagaaaaattgggccttttatctaccacactgagattaaataaataaaactgatttgaaaaataaaaaaaaaaaaa

SEQ ID NO: 15549 - DNA, 463 bp, Homo sapiens
tgatcatcttagagaaggctttccacctgtgcacagtggaacacttacagtatcctcctaacttcttttcctgactctgggctctctttctccagttagccaatgggtaataggttaaccctttccaacatgactaacctctttaatgaaatgaaggtgatgaagatgaggaggaagatcattgtgataacgaaactacgaaggccactggagatcaaagtttcctgatgctacaagatggtgagaggagagagagaagacagagagaaaccttcggaaactagggttgtttgattctcttatatattcgcaatactaatttttttcagatgagtagcttgcaaatattttctcccattcaacatgttgtctcttcactctgttgatcatttcctttgcttttatggcctgtgcttttgtagtcttagccataaaatctttgcctagaccaaaaaaaaaaaaa

SEQ ID NO: 15550 - DNA, 733 bp, Homo sapiens
agctgttacttcctcctcttcaaataagccatacagaataaaggaaaaatctacagaatattggcaattgggatgaccgttggcctctaccttgcctagagaggaaagaaaggcccaaggaccttgagatttcatgtgcagcagcatctgatgggccggttaccttctttgccctgcacattttctctattcctctccccacagctctctgccctgagaggttgacctggatgagctgcacccacaagctcatttgtcctcaggtttccagttgagttccaccaatgggaggcaccatcaggagatgcagacttcaagaagagtgaagctgggatgtttacttccccaactcgctctaccgagctgcgtgtgagctggctgggtacttcggtgaagtttgcagctcccatcggcgcccttttctacatcagcctccgtagctgcccaactttcttttgccattgcagccagttgagtggcaaaactgccccctcaatattttactggtccttggtgggcttcattttagcctggcccacacttttgcaaattacctttttctttaaactctcaatcacccaatttgaacatgcccaccggggatgctgcttttgatcctgcctgacaaccttgggtttctaggttaataattgtttcctttcccctgcgcccaaaattatgctgggttgaaccataaaggaaataaaagattgccttcataaaaaaaaaaaaa

SEQ ID NO: 15551 - DNA, 577 bp, Homo sapiens
ccagccaatcatcggaagcacttgttatggaagtgccacatgactgaattagcctggggttctgagctcccacatggaagacagctgccttggaaagttgcctgtaccctcaacagaccttgagagagcaaataaataaactgtcgtgtattaagccactgggatttggtggtgtttgtttccaaatcatactgtaacctatcttgactgatatgccaaccactaaaaaactgttaatatatttatatttaaccatccagtgttattttctatgtatagatatgtatagaaatttgaatcttgctacacatgctgtttttgtaacattttacttaccaaattatgtattatgaatattttttcatcattaaatcttttttcaaacaattatttttaatagtcatacagtattaaagttgtgtcatatttaatctagcccttcactaatactggacaattttgctgaatagtgctatactggcttactaactaacctattccatgtctttgtgcaaatttccaactactttcttaagataagatctacaaaataaaaatgctgcatcaaagttgaaaa

SEQ ID NO: 15552 - DNA, 335 bp, Homo sapiens
ctaggttgatctgagacaaccatctgagaaacaacagccaccacttgacttctgcttctgcagctcagcaagttcctctttgatccctattgtgctagctcagaaccacacaggggaagtgacactgggatgtgcagagcagaactcagccacaggtctgcaaatttctagttgtatgtccttacgcagggcatttcatctttttagccctttctgcttctgtacaataggaacagtatgatggttctgttccatggtgtgtaaaaaataagatgatgttttaatgcaaacttagttaagcatataaaggaaaatatttttcttctacattaaaa

SEQ ID NO: 15553 - DNA, 421 bp, Homo sapiens
tcagtatctcgctctgttgcccatgttggagtgcagtggtgcgatctcggctcactgcaagctctgcctcccgggttcacgacattcttctgcctcagcctcccgagtagctgggactacaggcgcccgccaccacgcccggctaatccatttctgaagtgagtgatttggatgtataaagatgtgtcacataagaagaagtaaaggggaagactaattaattggacttcaaaatatgattctaccacgtacacaatgcttttaattccttggtgttcttgacctctgctctcagtatattttatatttccagctcttttgtcaccactctataattccttacatggccttcggtgtatgtcatccatttttttttccattccatttttgttgtataatgaatacaactgcaaaatgaaaa

SEQ ID NO: 15554 - DNA, 434 bp, Homo sapiens
  misc_feature (1)...(434): n = A,T,C or G
gcagctcgcacaacgcgttcacagtacacatgtggaaaggagagaagaaacgttaggcaaatcccangctcctttgtgaagaatgacaatcgctacagaaaagcacatggatttgcagcttcgtggacatcacctgtgagggtgacagctctttactctcaatggaggaaagtgaagccaggcttactgaggaaaaaaaacaaccctcagaaatcaaaatcagacagctatacccagtctggttgccccagagcgggaagacctgaaccttggcagggctggctgctgtgctgaccagtctgatatcaagaagagaagtgattttccgatcctgcatccggtacagctgtgcggactctgctcttcctgccattccaccaagaaattaaaaagcaattttcttttgaaaaaaaataaaataaaaaaaaaaaacg

SEQ ID NO: 15555 - DNA, 782 bp, Homo sapiens
  misc_feature (1)...(782): n = A,T,C or G
gcctggatgtaacccttctgaagtctccagcgctcaagcaatctgccaagaggactgtgtgccggtgaactgtggcttcctttaacagccaggaagaaagtgaggccttcagccaacaaccatgttggggaaccatcttggaaactggtcctccagaaccccaccttcagatgtctggagcctcaagagaggccaggagtaagaatcacccactgacaactgctaatttctgacccttagaagctgtgtaagataataatcatgttttgttataaatagctaagttttggtataatctgttatacagcatacattgagtaattcaagctcccacatcaagtgtctgactacatagggtttgaggtggaacttanaatatatatttaatgtaagcacccttctgattttgatgcaggaactcagtctttaggtgtcagaatagctgcaagcttgtattagtttaaaagcacctatgcctgacgtcagctccatatttgtaatattttgtgagtaatcatctcccttactctacctcctgatcaagcacatggagcaagtggtattacctgctaagttttctgctttttaaaacaagtaggtggacttctcattattataaaaatagtacatactcattgtaaaacactgagaatataaaaacatattaagagtggaaagcatacttatagattctccaagcctctctactttgatacatgcccttcatatttagtcacaaataatcattgtactatcgtcatacaggttctcattaagtttca

SEQ ID NO: 15556 - DNA, 290 bp, Homo sapiens
tgtattctgtccataaccaatttcgaagatgaggatacatctttaaagttgcagagaaattaaggcatacgtttcagcagcaactgagaaggcctggaggaataggcattaacatgaggcaaagaaggagtttttgtttgtttctaggtgaaagtaattgtctaaacaactggagtgaaacaaatgattgtgaaccccggagaaaagttctgcctatagatcctgagttggaagacaaaagtatcagctgtagattttaataatcaaatatataggcttaagctataaaa

SEQ ID NO: 15557 - DNA, 1157 bp, Homo sapiens
  misc_feature (1)...(1157): n = A,T,C or G
gggaggcggcggcaggcggcacggcccaggagggggagggaagaaggctctgtgaggacccagagaagagcttgagggggaaaaaccagaaaacagaagaggaaggggacaccccgacacctcgcgacacgaccacgcgcagaccgcggacaggggcgcggagcgcggaagccccacaccgaacggaaagaggacaacgaaaggagcgacgcgcaaagcggacgcagccaccgcacgaagacgacgcgcgacagaaagcgcgagcggccggccaaacaggcaaccacagggacgggagaagggaagcgcggagcgtttttcttcgcacagccgccgcccgcacaccaaccgccccggcgcgggcaccaacacaccactcccaccgacacgcaccgcccagaccacggccgggccagcagagccgagaacacaagcaaacgcggaccccgacacgcgcaccagccgcaggacgcccacaccacccgacccgacaagcgagacgacagccgacctcgagctgcgcgcgaacagcgccaggcggccgacgcacgggcccgcgaacgccgacgccaaccccaccgcccaacgcaagcccgagccgacagagagccgagtgggaagcggcgcggcgcggccacacacccgcacctcagcccggccacacgcccccgccacaatcgcacgaagacagacacgcgcaccacacgcaacccacgaccaatagcggaacaggatgccagcgcgacgcagggaacgcgccacacgccccgaaccggcacgcgcgcacaccgacctacgcgagcgcggagcgacatgcgcgcacagggggcaccagcaccgacacgcaacccatccncggcgaagaacagcagagaaacgaggcaggggaccgggacacgcgccgatccgcgcgccaccggacgcgcccagcgaggacacaccgccgcgcaacgacgccacaacgagaccgcccgcgagcgcgcgagaccacagagacacggacgcggacgcgcgcagccaccgctacccggcgagcgcccgagcacgaccgcatgcacgcccgcggcgcgcacgcggcaccactcccctgacngnacgcacacagcaccggcaacgcacacgcgcgcaagcgccgccgccactgctccaccacgccg

SEQ ID NO: 15558 - DNA, 226 bp, Homo sapiens
  misc_feature (1)...(226): n = A,T,C or G
ctaanttcagcttgcttgcccttctgccttccacatgtgaggatacagtgttcctcccctccggaggatgcagcaacatagcaccatcttggaagcagatggcagccctcaccagaaaactaaacctgccaacaccttgatcttggacttctcagcctccagaactaaataaaatttagcttatgagaaataaagttccattctttataaattaaaaaaaaaaaaa

SEQ ID NO: 15559 - DNA, 200 bp, Homo sapiens
ctagagagcacagaaggggagaatagagcagcagctgaacaccggagagaagtctgactccagagggatggcttgatggcgggacttcaggagaagaataccttcctgctccatcccctttccagctccccttcccactgagagccacttccatcggcaataaaatcctcctcagtaaccacccttcaaaaaaaaaaaaa

SEQ ID NO: 15560 - DNA, 442 bp, Homo sapiens
ctgataaattctttccttcgaggtatcactgcagactcgcccgtatggattcaccactgctaacaagccctcagaaggaatcaaacctcttgactccttgattttgtacttctgacctccagaactgtaagataataaatttctgttgtttaagccatccaatatgtggtactttgttatggcagccctagaaagctaataaatgggtcgtagaactaaaaagcatttaaaaatgttttaggttgctatcttctcattaatctgtatttttaaaaaaatgttatactctcacttctattgacctttgtgccattttttatgttcacttggttcgatttactcacatgtttgcccaaagcaattttatttaaatttgttttctaaaaatgaaacacttagggttcttggaactttgtataaataaatttttactaaatccaaa

SEQ ID NO: 15561 - DNA, 134 bp, Homo sapiens
  misc_feature (1)...(134): n = A,T,C or G
ccctaggctgacaggaaaggttcctttggcatccacagnanaaaacttattcaataaaacattttataatcctcggaacacctgtgccacctttctaaaggccagtcagttccactacttccataaaaatgaaa

SEQ ID NO: 15562 - DNA, 337 bp, Homo sapiens
cctagttaaaacagtctatctcttttttgtaaatttgatggagtgcaaatgaagagctcacctgaacatgaagagtgcgaaaccgttccataaagtgtgggaaacactagggcttgatgccttcagaaaaccattctggctttacctctaaacctgctcttgcccctactatgtttgagaaggagcttcttcagtaacttcatacgccttctaagaacacgttatgtattttgtttttttgttttaaaaaaatcacataattcatatgggacatttgattaccccttttaaaagtagtgcttataataaaattacttaattgttaaaaaaaaaaaaa

SEQ ID NO: 15563 - DNA, 186 bp, Homo sapiens
aggtcctctactgctcggccccgggtcacagaaggcaaatcaaggaagtgaactgtttctggacaaggattgaaaatgggaaccctgggaagggggcaaacactgaaaaatgatggaaaatgaccctacaacgtaattgtataaattcctgtctttgtccaaaaaaaaaaaagaaaaaaaaaaaaa

SEQ ID NO: 15564 - DNA, 968 bp, Homo sapiens
  misc_feature (1)...(968): n = A,T,C or G
aatggaagaagaaactttccgcataagaaaggaaagaaaaacacctanttgtatacnccgcccaacgcttaagaggggagaacaggctgccctctcgagcagctctcctataaggatttacgagcacaacaggcagtcgcttcgaatagtgagccctgctgtcaggacgcccagcaatcttcacacgtcactaccccgccatgcgagcgtaggactgagctgagccagctgcctagctgaccgcatggcggagtcactgtgagagtaacagcgcttatgtccacttatccatcggggattcgtttttttattgagcgattgactgcatactactcttaacctgtgtgagtaacagaattacggagttatataccacttaagacgatacaagcccagtagcgctcgcgacaacacttcctaaataccttaagtggcaacggtgacctacaatgcttgagttgagttaagatgccttcactgccctgatgactgatccatatatgtgagacatatttgcggtaaagacccctcgactcatctgaggtatcactcaacgatctatcccaatcttccttccacccgacagcaccttggcgacgcctaccaagggaagacactttcctctaccacgccgcccgttacgatgagtaaactgaaccactagcctcgctcttcaccagtaacttcttcattgataaaaacatgaccggaacaacggtgatatgacactatgttcgacctcacagctgactcagccccgctcagtcacgaacgagcgctcacgaacgaacgcgtctattatatctccaacgtcccctgagaaagaacagatattcgcgttgcgccgacacccagaaccatactcacataggcaagtgcgagataacagaccaatactcacccgccgctacgacaaaccgagacgcccgccacgatgcgccctcgccgcactgatggggaaaacaagg

SEQ ID NO: 15565 - DNA, 337 bp, Homo sapiens
tccttcctgcagtgaggtggagccaaatgactaaattctgtgtgttggagagataaatgccacttctgggcctgacccctatggcccctgccatgctggcctgaagaagagggtgcagtggagcatgctgaggccatgttgatcaggctggtctcgaattcctgatctcagctgatccacacgccttggcctcccaaaatgctgggattacaggcgtgagccactgcacccatccttttgtactatttcttacacctacatgtgaatacacaattatcctaaaataaaaagttctaacatccaaaaagaaatttaaaaatggcctctttggcctcat

SEQ ID NO: 15566 - DNA, 215 bp, Homo sapiens
gcaacaatgccttcacaaccacatcgccacggcacaaacaaaaaacacaaccctggtggctgacccctcctgccatttagagcctgctcccaccctcccttctgccatgactggaagctcccttaggcctcccctgaagcagaagccgccatgcttcctgtacagcctgaggaactgtgagccaattaaacctcttttctttaaaaaaaaaaaaa

SEQ ID NO: 15567 - DNA, 865 bp, Homo sapiens
ccttgtcgccatcacccgccaccccccctccacacacacacgcacagcctggtaggactcaaagaaaatgctttggttacccaacattttggtccaagaggagaaagtcttcagattctttctaaggaatctttctatctggaagaagagaagtgagtgagaagggttatcttactgagaaagacccactggctgggccattccaggagggacagtttaccgcagataaagaacgggcccatccagattgctgcgaatgctccacctacattcattctctcacaacacctacatccccgccctactcttcttccatgctctgtccatctcgcgcgcgcaattctccatcgcccttcatcgtccccccccccctctttccctcggcgattcttgccttcccactttcttctttttttcgtctatctctactcaaattccctcacccccagacttttgttcggctattctcttttgaacccttcctcgcttctcccccttctctctcacctatccgcttccttcctgccattatcctaatgacgtctcacgttccccttcccccctccttcccctcttcctctttgcccctcagccccgcgttgtctctggcttttcattctccccatgtccctccatcttttttatccgcgcccccccatccttatcttcttccccgacgcaacgtcggtgcctggcacccttcttagtcctatgcccgtcccactcttgcgccagctctcctcttctcttttttttgttccttccctacccttgccgtccgttgttatttccgcctatcgcgacttacccgccttccgcccccattcagccctttctttctttccatcatcacaccctcgtttct

SEQ ID NO: 15568 - DNA, 807 bp, Homo sapiens
  misc_feature (1)...(807): n = A,T,C or G
cacattctcttccttctcccgcaaaccacacgaacctaggtgccaccagtattattttggctanatgtgaagctatgcaattctaatctcccatctccttttttatgggatgctgtcatcactattcctgcttgtccattttcatgctgctgacaaagacatacctgagactgggaaggaaaagaggtttaatggatttatggttccacgtgcctggggaggccttacaatcatggtggaaggtgaaaagcacatttttatatggtcgccgacaagagaatacacattgcctgcgggaaattcccattcttcaaaccgactcatttcatcgacattattcactaccaccagaattacactgcgtcaaatcctgttcccataatttattttcctattacctcagtgctaccatgacccctaggatccgggtgtagttccaagttcagtttagacttcgacattctccccaatctagtctttccccccgtctcccttgtttgccaatacttctgtcattatacgcacagcgtccaacaccatcgtctcataaccaactcactttcgcctctcatctctcctccccaatatctacctcacatttattccattctccccaactgatttatccactctccactacgtcacccgctcaaaattcttcgacaccagtcccatttccccctcgtcctcactctgttttatttgattgtgctacactcgccacgatatgctaacgaccaatttataataatctcactctacgccgcgatagtcaactcctaacccccatcttccctacctccacct

SEQ ID NO: 15569 - DNA, 354 bp, Homo sapiens
cgatatatataaatctatagctatcccacacaaaacaaacagcacgctggtcgttacttaagagtaactctttatctggaagtcctagccagcgcaatctggcaagagaaagatataaaggacatactaattggaaacgaggaagtcaagctatcactgtttgccaatgatatgattgcatacctagaaaacccaaaagactcatccaatagactactagacttgaaaaatcaattcaataagagtctcagcttacaaaatcaatgtacacatatcagtagtactgctacatagcaacaacgaccaaaccgaaaatcaaatcaagaactcaatgacttttacaatgactgcaaa

SEQ ID NO: 15570 - DNA, 213 bp, Homo sapiens
accaatataggtcctcgccccgacacgaaaaagaatacaaaaaaaaacaacctagtgcctgctcctcctgccatatagagcctgctcccaccctcccttctgccatgactggaagctccctgaggcctcccctgaagcagaagccgccatgcttcctgtacagcctgaggaactgtgagccaattaaacctcttttctttaaaaaaaaaaaaa

SEQ ID NO: 15571 - DNA, 193 bp, Homo sapiens
atgagaagacgtctccctatatcacccaagctggtctcgaactcctgggcccaagcaatcctcacacctcggcctccgaaaatgctgggattataggcatgagctgctgcacctggcctgcttttcattaaaacttcaacctatttctaaattgccattaaaaaaaaaaaattgaaagttaaaaaaaaaaaaa

SEQ ID NO: 15572 - DNA, 834 bp, Homo sapiens
cccaatttcactatacaattacacccacacacctctacacctcctccccgtataccctgagttgtatgtagccagcacattttgaaatccatactagcaagtcgaatcctgcaacaaaaataagggtgactctctgcttgccaaacccacagaaacctgtgaagtggatgtgccaagggtccaacccccatattcctcagactcttctattgccattctttaccaactttcgtctcatttttacatcactgctctgccacattgtaccaaccacacagaattgccctatatcactcaatacatgatcctcaccaaaatctcctccgataacataaattgttaatgaccaagcatgacatattggacactccctattatggtacactttgttgcctaccttatcctctcagctcccattacgagtcctatctatccttaactatatttcctcaagccagattcaatatcctccgagaaagcactttttgatatagatcctgctgacccaagttctgtaactcaacaaactatacctatccaacaacccatcctctcccgcccataccctctcacttaacctcatccccgcatattgtttggtctcatcgcaatactcctatatagaataaagacgtctcattaccctcttcacgaagttaccatatacccgttacttccttatatctccttttatctatcccaactacaataaccatcctctgaccacaccccacacaacttccttatcaccctcccatatcagctctaacccatactgattatcttaaacaacacaacacactaccgattctaggcaccaccctttccacacca

SEQ ID NO: 15573 - DNA, 927 bp, Homo sapiens
  misc_feature (1)...(927): n = A,T,C or G
taggtgacatgaggcagccaggtaagaagaggaagtaattgcacaccattttccaagaaccaagaaagatgaaaacacaagagatttttctcatcttttttttttttttctggtggagggaggtggtggatgaacactccacaactcggtgggacatgagcgttgatactctaacccccaccgtatgcttattgatctttcccctcaacttagagaacctcctcgcatattccttacccgctacactgcgccatgcgtactgccgcatcccccagcagccgggatcttttcagttatatccgtattcgcgccgcgacgccggaacgtgggcgtacgacgcacgtctatttaaagctcggcacgcacgccgtcgtcgctgtcgcgtttcttcagaaacgcagagggatacgcgcttaggagaggtgcaatgcctatggcttcttaagcccttctggctggggtattgcttgtattgatatcggcgcaattacgcggcactccgagccgagcgtgtgttgaggagtcatgcaccagaagagcgacatcattcgaagccgctctgtgcgtctcactaagtataagctagttggcgggtccgcgagcngcctgcctgtcactcggactccctcgcaccgccgctcagtgcgtgtttgttccagttcagatgcaccacccaacgctccgttcctatccggtgtagcgctgcggttgatatcctacgcacagccgttcataacgcgtcacattattcaatctgtcattcatctatcgtccgcccgtcatatatgcagccggcgtccgcatcattccatgacgcttccgcgctgctggttcacccctaacgctccacacgctggatattgcgtcagggcgcgtgctgtgattgagcgtccggcaacggcgtgtcgccgcaccgcgcgtacgccg

SEQ ID NO: 15574 - DNA, 470 bp, Homo sapiens
catggtgagtactcgctacttaaatcttaaaaatgaacaaagttaaatcactcacacatatctatgtcaaaatttcctagacaataacagtaatccaggcagtttgtactgacataagaatgaacataaagaacaatagaatagaactgaaagtccagaaacaaactaatgagtctatagtcaattgattttcaataatagtattgagaccattcatgcggaaaaataaatttttcaacaaatgggtgtaagacacccaggtgaccacatgacaaaaaatgagtttgcacccttacctcacaccatattaaaacaaataaacaaacaaaatagataatggataaagatgtacatgtcagagcaagctagaaagtttttagaatgattatatgaataatcttttgacctgaaatttagcaattgattgttaaatatcaccaaaaatctacaaataaccaaaaaaaaaaaaa

SEQ ID NO: 15575 - DNA, 327 bp, Homo sapiens
agaaagaagttggaagaggaaacattaggaatttcctttcagactccaatcaaaacagcccatttgaatatttttttaaagtcagtattacttcatttatgggttaaaaatagaccaatactactgataaccaaaattttaaaactgtacctaaaaataattctatcttattgtgaatatatttgaaattcaactgggcttgcatttctgccatcaaacatatggcccaaatgtcttagtacaaccaattttttaagtaataatatttaaagaaaaaatgatcatcagtattaaataaaaaaatgactaacgttaaaaaaaaaaaaa

SEQ ID NO: 15576 - DNA, 358 bp, Homo sapiens
cctaggttaaaacatctgttgctcctttcagcgttatggacccaggaaatcagcaactaaggaacaactgcttactttgaagtcagtaaggacccaggaaattagaagctaagggatcgtgacctttgaagtaaataaatcttgcctgtatactaatttcagaggatataaactgttccttaatactgccttaaaaattatatatttgtgtgtatgtataattttaatgtatatgttatatttaatgtatatattatatatgaaatacaattttatattttatatttactgaaatataaaatacatgtaatgttacaggcttaataaaaagtgacttaatatcttaaaaaaaaaaaaa

SEQ ID NO: 15577 - DNA, 851 bp, Homo sapiens
  misc_feature (1)...(851): n = A,T,C or G
cccacctctattcatcgtgcgaccagaccacacccccccccacttggtttttctgattaagagtaaaattcgagcgagaaagatggaagacagcaaagaaaagaatggtttagngaagaggacaagactagccaagagaatcagagaaagatgctgcattttatcatcaaagcccaaactcctttcttatcttgaccatactaatcaatatacgccatcagcataaggacagctaccccacccacaacaacccaccaccccacacttctttcctaccccaccaccagatcccactaattctatcccacccctttttcccctggaacgttacccaccagcccccccagcacagcgtcccgcctaactaacgacactgcgcgggacacacacgtagtactctccaccgcgccgggcaatctaccgcatcgcccacaccccctccccgtcatcgccccaacgcacccccctctaccgctcatccagagtagaatctcacgtaacgctcaccctagcgctaacaccatcaagtcgccccaaatcctctcctgcgtcacacataccgagattacactacgggccgactccagtctcactatccccccccacctgactcgtcatgatatacttgtcgatgcccttcctatcctgctgcacccgtcgaccccgccatactcccataagccgatcctcccccccaccggtcccattcgaactagaatacaggcactgctttttctcccctccagaactgtccgatacaacacgccgtctgtacgcccgctaccccatcgacccacctctcgggcctcctccttgtatcaatcatcactacgatggaccgggcacaaaca

SEQ ID NO: 15578 - DNA, 857 bp, Homo sapiens
aattataatgatacgatacccctcactccacccacacccccccctaggtgtcacgtgttgcccattctgaacgcaaactcctgggctcaagcgattctcctgcctcagccttccaaagtagcttggagctacaggcacgtgccaccacacctgggcgtctattatttcttataactggatatgaatctatggttatatcaaacgtttaatttctaaaaggctatataaaatgcctttaaattaagacgctaaatgactgaaatgaattttttaaaataagctacttcccaagaaaaaaaaaaattataaattttttttttttgaacaaaaaaatgacgatcgtgctgaccactttcttaatcgtgtgccctcctattattttcgttttttcattaccactattgtgtgcagcccctccagataattcctcttacactatccaacttccttccaatttcatataaagatcaacagctaataaaactatagattcgtatacaatttatatactttatcttcatctcacatcgctaacaagcatatataaactatatattctgcatttcttaccttctacacaacacttccctacaaatcgcatgaattaccctaactatttatgcctagcatctcttcctatctctgtgaagttcgaagcgtatcggcgctgttacttttaatccctgtcgtcgctcgtatgccctcgatatgtactaaccgcctgcttatacgtccatagtttgtggcactcaatcgctagtacactgacgtctagataagctaacttccaatcctaccaaatcatagattacactcacgcaatataccgcttatactagacaacaccactatcttcc

SEQ ID NO: 15579 - DNA, 435 bp, Homo sapiens
aggtttaaccaacttgagtaagtactccccgacttggaaacactcaagtttcccacacatgactggatggccctggtcacactgggaacggaatgggggcctcccattggaactcagggtggagggggaagctcgaccagctattgtggcccccacttccattgacaaaaaagaaaacctgcagattccattgatctggcatggagctggatgactttcaggatgaagagttttcattaaaacacaaccacaacaaagcaagaaaaaagagcaattgatgtaagcatgccagtcaggttcacatgttaagaaacagaataaaaagaaataaaaattgataaacaattgtagatcataccaaggccctgcataaatatgacttgcttttatgcataatacaatacatggcatttttgtcttggaaaaaaaaaaaaa

SEQ ID NO: 15580 - DNA, 259 bp, Homo sapiens
agattaataatctccttacctaaatctctttcttcccccctcttgctgttaatccagaatgattatgaagaattcagaaatgaagaatttggtatctaacgttttcattttactgccagtacatacctgcccaaaaatcaacataaaaagaacatttaggaacaggaaaaatattttacagaaaacaaacattttaagaataccactttcttgctccagggtgaaaaatcaacagtgatcatcctcaaaaaaaaaaaaa

SEQ ID NO: 15581 - DNA, 216 bp, Homo sapiens
tggactggtgtcccattagatgtagaagaagataccaggagtagatacacacagagacaagactgtatgaggacacagaaagaaggcagccatctgtcagcaaacatgagaggcctcagaagaaatcaaattttgggcaccttgatgttggacttccgtcttccacaattgtgagaaaataaacttctagtgtttaaaccatgaaaaaaaaaaaaa

SEQ ID NO: 15582 - DNA, 759 bp, Homo sapiens
ctggatacatatccatgctcctttgctatgcgcctcccagaggcctccctgcagaagagatgatacccacctccccgcctgatgctcttggatcactttgtcattatcaatataaccgtaaacccaattggtcatcttgtgaaggggttgtttacaaagccatacggttttagaattgtaaggaatcttagcaatcagtctgttccccaccctctattttacatatcagtgtcaaaaatgttatgtgattttatctgtatcatgtgcaatggctaaaagggtagttaacactcctcaatacaagagtgtccaatttcaatgtgtgtttggttaggggttcattttttggttttcagaattttttcactgataaatgtgaaatatgaggtagttcatcatctgttcagaaatccactcaaagaatggaccattattattagcataattatggataaaactgatgtaaaatcatttaacatggatttgattgcaaaatttttgagtctctggaaactgcactctcatgaatatgactgaaggataacttgttaccaagcaaaaggtgaaatcatttgaagagacaacgctgttgcagagtaaatcatgttacggtgattgctgagtgtttcattgccattctgttttttaaatcctttacatttaaccagaatggttacttaataatctaaatattactcttaacactcatgtgattatttctacagccttacacaaattttaaagtgggtaagcatgaac

SEQ ID NO: 15583 - DNA, 797 bp, Homo sapiens
ctatcttatttaactttttaattaatagcccctcccccctcatttgggtatagggtactcaagtttaggaacaagatggagaaacagccagatggtggagcagttagaatctcataaaatatttgttaattaaatttgccatgttatgttgaaacagtttgaggcacttcaaatcaattacaatagtaacaagtattaagatcatggaacatgattacatatacaatattaatgacaatatttgtaacatctatgagaattaatcaagtaatacacatagatctgatgcaagcacatgctcttcggaaaattgattattcgattccattcaaactatctcaaccgagaactactaattatttatttcttttgttttttactttgatgtgttatttctttattcagaaacctttttatggtttataatcaattattgaggataacttctgccaccatagaccttttgtacctgccttttttttattcttatttatttatttcatgctgtaggtatctatttttctatctccggtttatttacatttaaatcccaagaattcttattttgttcgatactttctttaatccttgatatatttcatcatacaccttattgtccctcttcgtttatcttgaaactttttgatttttctattattacattatattatgtcattcatttttactcatttatttctactttactacactacattttgttgccatatgttttatgtccgactatatttttattacatctaaaattctatcttattgtgatgcttgttttatatctg

SEQ ID NO: 15584 - DNA, 338 bp, Homo sapiens
atgaggtcccattcaggaactcttcacagcccatctgtagccgtaagttatctgcaagttactcaggaaatacaaggatgctcatcatgaaaagacatttctcccaagctctcttcctttggtttccaaccatacggagactgggcctgagtgtggagactatctccatcagctttctgttcttgaatactcttacgagtttgcttgttttggggtttgcttatttgaaacttaagttgctattacgagcgtttcaatggcgatgatgatgatgaatataagtttaaaataaaacaaagcagaataaacaaaataacacactggtaaaaaaaaaaaaa

SEQ ID NO: 15585 - DNA, 785 bp, Homo sapiens
tagatgagaaaactgaaagtgacatagatcgtatttattgctcaaggtcaccaacacagaagaagctaaaaagtggctgagtcagcttcagcagcttcatattcactttccacagttacgcttccctgttgcctcagtctcagctagtccactacagaccatcttgggttgacactatttgtatctatggcttatttccattactaaattatgagatcccaggatttcaaaactcttcttctactggttgttatctgaaacaaaaaggccaaccaggaactagagaagacaaaaaactgcttttcatcggaccttgatgaactaaagaaatactaacattctcaagggaaaaactacatggagagatttcaagactataaagattcagagaattgtcttaactttcagaagctatgccaaagaaatctgaatctttggcatgtcactcttgatgacacatgtcgactttcatagggtcatgagataaatagtaacctgaaccacttgcttccaaagcttctacttcctctgaaggctgacatggtgtgtcttatgaagtcacaagtcccgttatacctgcagcaatcaatactgcaattaaagggaactagtacctgaaggaattgatcaaacaagtccaaacctatcatcctctccagtcactatacatttgaaacaataaaattacacagtaaatatactgcacacacacacaaaaattcctaagaggattgggtcataaagatacaaatcaaaaaattaataaggctatatacaaaatttaa

SEQ ID NO: 15586 - DNA, 736 bp, Homo sapiens
agttttgaccttcgaatatggaaaaactgaacttacataatttgaaggatgttggtccacacctataagagtttctctatggatatacctaggagtggaactgctgggccattgagaatgctcatttttggctttgcaagatacaagttagtttttcaaagtaggcacgtgagaaaacattcccaacagactggtggaaaaaatatatatatatacacatatatttgcttaaaaaatgaattatttgtattcaaaaggagaagaaactctcttctggcatttttggaggtgatctctgcacacgctggctccgttttgccttccatcatgagtagaagcagcccaaggccttcaccacatttcctatcttgaaccttccagcaagaagaatcatgagccaaataaactgcttttctttataaactattcagcttcatgtatgcctttacagcaacactaaatggactaagacaaattgataaagaaaatgtgatatctatacatctctctgtctataaagataagataccaattacaatggaacattgttcagccataaaaagaaaaaattctggaattcagatgtcatggatgaatctggaggaaattatgcaaagacaaatatgctagacacagaaagacaaatactatataatttcgcttatacgtggaatctgaaaagttgaactttgaagcaaagactgaatggtggttgcaagggctgggagcaaggaaa

SEQ ID NO: 15587 - DNA, 800 bp, Homo sapiens
  misc_feature (1)...(800): n = A,T,C or G
ctagggcttactatttgttgcccattagaacaagaagggcaacaaacaaatgattcagaggaaccaatgattcaggaggaagtgggacaatgtcagggaagagcaaagatgctaaaagactgcaaggagaaggggcttaagaaaatagatctcctggaggatgatgtcataggatacaccccaagaaaccacagagctaagaatcctgtgaactgacactctcaaaatcctaacaccctgttaactatgtatggattggattacattactggaacctgaagaaaagaacgggaaaaatatttttctggatttcgtgtatatgttccgctaattttgttgcgttcagcactcttccttcctccataatatgagatcaatgtctgggtttcactactcgtttttcaggtttccaattaactcccacctcttccaaaataccctccatcctatctgcagttctcatagagctatccgtctgctccctcctttagcacttcattctacattaatcactatatgatcacaatttttttcacacaaatatattatgagcttctaatgtttaaaaaaaaagtcttatgtttctgcattntccacaactattagtacaaagttaagtgccttaaaggaactgaataaatactttattccttgaagtttatgttatatactaacacaacaacctacacatgcttatgtacgtaagctgtgtgcaattccgtataatggaatctatctttatatctatttatccccttgagaaattataatcttctgattctatcttaaaaaatttttaa

SEQ ID NO: 15588 - DNA, 849 bp, Homo sapiens
caaagacagtataatggaaagagaggataaaggtaacaaaataaaagaagacactccaggtgttcccaatgagcactactctttaaactggtgaactttgagtggagtatcccctacaatgtgggcaagccccattcaatcagttgcaggcccgtgtagacaaaagcctgacctcctgcaagcaagaggaaattctgacaacagagtacctacctttagatttcatctgcaacatcagttcttcctggctcaccagcagactgcctttggacacaaattgcaactctttcctaagtcttcagccttccaggcttcctcatcagaatttggacacaccaagtctggaaaatctcataagccaattctttaaaataaatctctttcatttacatatatatacgcacatcctattggttctatttttctggacaatcctcactgattactaaggatcaaaacttcttcgtaatttcttcagatcctccaatatttgagcaagtaggcaagacaagaatattttggggagtggcaggatatcatggtctcagtattgcaatctatagcagcatgcaagagaccacaataatctgtcatgggagcttcccctggtgccagggtcccggagctgggctctccatgcgtggctgttgacccaagggaactaggaagcacctaccccttttcaaaatctctattgttagaatcttcaatactctactcttaataatcttaccttttattaagctacacttttaattcaccgttgctaagatagtagcttcgctgaagaaaaccgaaatgtaaaccttattttgttcaataaacagacatttctcaaataaatttgcc

SEQ ID NO: 15589 - DNA, 797 bp, Homo sapiens
tgaaagacacggccacttccaaccagattaccaggacgttctcctccctgcctccaacaccagctccccatcgtcatttctgttctgccttcaggtgaactagagtgtcagcctccctcaccaggcttcccaccagaccgtgagaaacaccttctgagcccaagtcaaaatgcaggacacttactcgagaattgagtataaaagtgctatgtatttactcctccctcagtctcatgagcgtgttatagaaaccacacaatatcaacgtgttcacacgtctgttttgggtggaaggacattgtatttggggcttttaatttgtagacgccactgaaattgacatcattgacagttagagtaaatagaaactgttagatactacatagatgtatacttgaaacataagacacaagcaactgtttttcataacagcagttactgcaaactgtgtgttctgatgaaagtacatcatgactgatagtccaaatatccgctgctgtgtaacatactattacagaacttagcagttaaagataatcattgtattatgttcacagattctgtgggttggaaatttggcaaaggcaaagtggggacagcttggcatggctttgtaatgtctagaggcttggttggcaagacttggaggctgggaccacctcatcatgagggactggaataatttggaggcaggcctactcatggggctggtaattgatggcatctggtggctgggatttcaacggggcccattatccaaaaaacccttactttaccctcccgaagagctgggacta

SEQ ID NO: 15590 - DNA, 364 bp, Homo sapiens
cctagatattgcattgcaagaagttatatagggaaccatgccgtttatcttgtgtccatcagatcgacagatcctatcaaggagggtagcgggggctagctgttgaaagtgacataaaccagaacaacaccacagcgcacactcagcacacactgacacgtcatcaaggacaggaccaccctgaactctgtgatgggtgactacttgaccaggcgacacactaggtatgccaactccgaggaagaccagcttaccaatctatactacttctggctccagatcgatgtgattgacatctacttggcgtagtgaataggaccattgacctatgcaagaaagatgaatcacgctcgatagcctcaaa

SEQ ID NO: 15591 - DNA, 391 bp, Homo sapiens
ctagggaagacaaattgcagtgaatgtatgactctagttcttaagtgttctcagactcttcaccaggagcagatttcatctcaagaaatgactttctttgctcatccataagaagcaactcatctgttcaagttttaccagacacaagaacaccagattgagaccagcctggccaacatgtgaaacctcctctctactagaaatacaaaaattagccaggcatggtggcaggcacctgtaatcccagctacttgggaggctgagtcaggagaatcgcgtgaacccaggaggtggaggtggaggctgcagcgagctgagatcatgtcactgcactccagaccgggtgacagagcaagactctgtctcaaaaaaaaaaagaaaaaaaaaaaaa

SEQ ID NO: 15592 - DNA, 775 bp, Homo sapiens
cctaggagtacggaattttgctgttcgccgggcagacggttcctatgtaactggcttccatgtgcttgaatgttgccttttccaaaaccacccatggcctgccccaccccatatcctgtgccataaaaaccccaggttccacctgcagagagtggaggagaagaggataagcagctggacgttggagactacaatttgatgatggagagaagcagcttgacttcagagggattgcctgacggcattgcttctgaacggagtctgggggaggaacaccttcccactccatcccctttccagctctccttcctgagagccactttcatcaacaatatatcctccccattcaccacccttcagttcattcatgcggcctgatttttcctggacactgaataagagcttggctgccacggatgtgaatgctaaagactgtcacagtgactctctggccttgctggtggagagcaaccacttcatgtgaaaaggcagagggcccactgaactgtttaacacttaagccatccatggacagcaaggccaaaagagagcactgtaacacacgccctccagggcttcgagggtggtgggtatccccctagatactgccacaggccctgcatggagttttgttcctgctggtgcccaaggcactcaccccaccttctgcgcccactcacctgcatgctgcctctcataagggggtgaagcaatgggtttggagtaagtggagtttgtccctgctgtcaccaaagtgaccagctagctccagcac

SEQ ID NO: 15593 - DNA, 735 bp, Homo sapiens
gcgcagcgcatggcagtgtgaagaacaagatgcgagacccctactaccggctaaagcccgagctccactgcccagcgcctatgtcccaccactagtcactggcaccctgccctagacaaacgctgaccgggacgctactggacatagcaccatggctacctctgaactggagagactatccacaaggttggctgctagacctgctcctccagagccacagccgaatcccagaaaggcctctgcaaagaacacagagatggttcctacacataatactgcaaaagctcatgctggcaccgaagggaatctccctgcaaagaatgaagatgcccctacagactaggcacagaaagctaatggtgctgagatgccaaatgaccctgtgcatttgtgataactgtgtacttctggtgactgaacgctttgagatattatatgccaatcgagttgtatacaaatgcagattactgtgtagcttctgggtgactgttcttaagcgatgttctgttcacataattacttcattagatgaattggggaagaatgggccatcttgtcactaatataaagccccttgaagctggacctgaatacgggaaagcaccttttccttatgagggtcaaaagacctcctcttggggcccatgaagaggatcccctgactgtatacacctgtgcctttgggataaaaacttgtggtttggaaaacaaaatagggtttctgtgcttttttct

SEQ ID NO: 15594 - DNA, 198 bp, Homo sapiens
  misc_feature (1)...(198): n = A,T,C or G
gctgatggagcanaacctctgaagcagacaaaggagagtcagcatgaaccagttctcagaatcttctctcaatatcaggactacatttggcaccaaaaccaaaactggttagncaccgatataattttacctacacatcctataatggcataatattattattgaacaattctaatatactaccctattcctatagng

SEQ ID NO: 15595 - DNA, 773 bp, Homo sapiens
ctagatatggcattggggaatcgttacatgaaaacttcacaaaagaactgtgttcgatttcacaattgaagaatcacctggagcgtaccaggtagcaaaacggtgtcttgctgctgcccggccggactacagagcaatggcgcgatctcggataaccggagcctctgcctgccgtgttacatctattttactgcctcaggcttccgagtagctgggattacaggcgcccgccacaggccctgctattttttgtattccatactagagaccaggtttcaccatgttgggcaggctggtatcaaacttctgacctcaggtgatacggcagcctcgttctcccaaagtgctgggattacaggcgtgatccaccacgcccagcctgagcacatattgttaaggaatccacaccgaagactatgagaactaacaagtgaatttagtatactgtataacacaagccccatacaaatgtatgagaacatatcacaccgagtgtatgtatgtgtgctatcaacaaacaattgaaaattcaaaacactatatgggatcatagcaaaagctataaaatgcttaggcgtaatattaacaaactatgtgaagaacctgtcctgaaaatttcaaaacgctgctgagagaaattacagagcaaaatagatcgatcagcgtatgaaacaacaacatcgggctcgctggcctcaccggtggatctctgcggccgttcctttaatgagggttaatgatgatcctcgttactgactcctgccctcgtcggg

SEQ ID NO: 15596 - DNA, 771 bp, Homo sapiens
taggagtctggaattttgctgcgcgccgggcagagggttcctatgtaactggcttccatgtgcttgaatgttgccttttgcgaaaccacccatggcctgccccaccccatatcctgtgccataaaaaccccaggttccacctgcagagagtggaggagaagaggataagcagctggacgttggagactacaatttgatgatggagagaagcagcttgacttcagagggattgcctgacggcattgcttctgaacggagtctgggggaggaacaccttcccactccatcccctttccagctctccttcctgagagccactttcatcaacaatatatcctccccattcaccacccttcagttcattcatgcggcctgatttttcctggacactgaataagagcttggctgccacggatgtgaatgctaaagactgtcacagtgactctctggccttgctggtggagagcaaccacttcatgtgaaaaggcagagggcccactgaactgtttaacacttaagccatccatggacagcaaggccaaaagagagcactgtaacacacgccctccagggcttcgagggtggtgggtatccccctagatactgccacaggccctgcatggagttttgttcctgctggtgcccaaggcactcaccccacctcctgcgcccactcacctgcatgctgcctctcataaggggttgaagcaatgggtttgagtaagtggagtttgtccctgctgtcaccaagtgaccagctagctccagcac

SEQ ID NO: 15597 - DNA, 156 bp, Homo sapiens
ctagactaggcaaaagcttatgatggaacagcaagagggcagccaactacattcctggaagacagccctgaaaccaacactgatggcacctagatcttaacttctggcatctggaactgtgaaaaaataaatttccattgcttaaaaaaaaaaaaa

SEQ ID NO: 15598 - DNA, 860 bp, Homo sapiens
  misc_feature (1)...(860): n = A,T,C or G
tttaatacagcacacccattcatttacaccccccccacaaaacaaccctagacanaacaagttgctgtgcttacctagctggagtgcagtggcacaatcacagcggactgcagcctcaaaatcctggctcaagcactcctcttacctcagcctcataagtagctgggactgcacgctccaagaaatggaattttattaacacatgccacacgatggcctttcacacaacccgccactatctaatacttacaaacgcccgagtatcatccaccatacagccacgatcacagtcccccgtagaagtcgccacccgcacgcccggaaccgtacaccgctgctatgtcccccagactaacccgataatgtcgagcacgtttacccccctctctcaatttcgcacccacatgccccaatctccccccgcccaccaccacgtctccgcagcggcacccgctatcccaccctcgctgctcgttactgagcgcaccactccatcaaaactgctgtgttgcgcacataacaatctatgccctcccacccgactacccctactgtaaacacgcatacagatacagcgttatttcaaggtcattcgattagatacaagcgatgttctgtcttccccaaaaatccatcccccctccacacctaacccccatcgacatataacagctcatctcccaataaccaacaacccgctataccatataagcccccnccgtcggttattaactccgcctcttacctctatcataataattcaatcccgtttagtgtgcctacataccttgccaccgaccctcttattccacaaaccgcctaattccaatttaccccatccgcctccccaccccgacgcg

SEQ ID NO: 15599 - DNA, 988 bp, Homo sapiens
  misc_feature (1)...(988): n = A,T,C or G
ccaaagaagccgaccaccagacgaacccccaacccaaccaaaaaccctactaggacacgacagcacttctcgcaggnaccttagcaatgctaacgcattacacgatgccagaacctctagtctacctcaagggccctcagtcgactcttgatgaagcacgagcgctcacgctccagcgctcggccaacatccctaggccgtacttacatcgcaacacagaaatcagcaccgccgctgcggcatggtacctacgaggacgcgcaaagtccagatcacaacgagacacccacacaaaatcaagacggtaccctttttcgagcaaaccggacccgacaatgcccaagaagtcactacaccgggccaacaaccacagatatcgacgtcgtcgccagcacagcccccgccgcacagaccccgaacgcgcatggccccgcttgtcacgacgctctccaggtcgccggcggacgcccccctgaatcccattgataccgccgcgcaccccctccctaactcaacaaagaaagcgccccacacacgcgcacctcgcacctcgcgtatcgacggcggcacgctgcaaccaagactacagtaaaagtcacagaccggcacgtgggttacaaccacgccccatcacagaacactcaacaaccgtcggtcgtcgaacacacgactacatacgaggtactcaagtacctctctcacgctctctgaacactcagatcgcgatcagcaccagaaaccagccgacaagacacccaaagaacacagtaatcccggtctatcagcccttccatccacacgacccaatacaatagtttgtcgcgccgctcaatctgaatataagacccgctccgagcactctatatccatgaatgcccgattactgtaatcgcggaggacgccataactacgagtacagcctcgctttatactgagacagcaccatcacgccactcacacccatttctcacttcagacacccgacgag

SEQ ID NO: 15600 - DNA, 914 bp, Homo sapiens
ttggctttcaccccgacctcccatcccgccaacaccacaaaaaccttagaactgactccaggccctgttccactcacccgaaggagccctgctgggtgagccctgctccatgcctggggaccctggaccatctatcaggagccaacacagtgagccagaggagtcggctcctaacttgttaaaatgcagccacgaaaccacttgagataaatatttacttcactttaacctttacttatgttaagatggctctcactcactctgacgacgtattatatactgccttgttgcaaatataatgccacacacctcctgcccagatgccgtaaccgctcacacgctcccgaaccccccctccacatatcacgtatcgtacatgcccgttgatatacgcaccacaaacctggctgtagcgcggtaaccaccgagaagccatcatcctacacaccctattgactattaaagaaagcgcgcctaatacgtagatcaatgcaaggaactcgccgtcgcctgcgacctccgacagactccgattccacaacaactagttcacttatcgccacgcccacacagactagaacataacaaatcacgcactctaacatactcgcgacattacgttcgatatactactattctcaatcggattctagcggacttctcgtctccacacctgcgtcccgctccatagaggcacccccagacaccaagtatcacgctcaatgtcgcgtaagcgcagaagtcccaggtaaccatataaacaccccgattttcttattctgtcgacttccacggtgtcgtaaacgactttgtctgttcctcgccgacgacccacatcctcctgcctagagacacttctttctccgaatacgcacactcccatccccacgttcgcgctcgactgcgcccccgcg

SEQ ID NO: 15601 - DNA, 1409 bp, Homo sapiens
  misc_feature (1)...(1409): n = A,T,C or G
gcagagaagagaggaaagaaccgcaccgagcggaagcgcgccacaaccaagacaaaaggccctgcatagggaaaacggaacnacacaccttggngagggggagcaaaccaagcagacacagacacgcaaggcacaacggagggagaacggaaaagagaaacgacacacacaagccagacgcngagaccagggagacgacaccggccggacagcggaccagcgacgcaagcagaaaagcgagaaaaacgggccaagcacagacaccccacccgcgccgcgaccgcacggacgacaggacacccgaaaccacccaccccacaccacccgacgccgaaagaaaaccaacaacaagcgcgaccccgccacactttttgcgcgacagggccggcgcggagacgcacagacgccgcaacagacagcaagcacgacccacccccacgcgcngggcaaacnagccaaaacgaaacgacgcacggagcccaccccgaccacgggggcccaacgagcggagacgggcgcaccggacggccggcgcgcgcgaacagagaacccagcgcgcgcgcaggcacccacaccagaacgcagccccgccacgcgcggncgccgcggcgcgcacggccngccagagccacacacggagncgccgcagaacgnggaacgacagacgacacgcgcacncagccgacgcgcgagcgcgagagncacaagcgaggcagacaacgcaggcaaccggacacanagggagacacgaacgcgcaacgcagagacggagcggcgacggccacgcagagacaccagccgagcagacgggcagcgagcgaggcacacgacagcacaacacaacgnacacgcacgccgacagcgacgcacgacacgacgacgcggcacgacggggcgagcgcgcgcgancgcngcgagaagccagcaacggcgcggccnacgaagagaccacgccagacgcgagacggaccacgcgcganacacancagcgcgggagcgcgngcgacgcgggacacgacacgccacaacacgcgcacacacacnagcgcaggcacagcacgcgagcgacagaggagaagcagcgccggcgggcgccgacgcgccgcagccagacaccccgaagcggagagcgcgcgcgaagcgcacggacggncgncggcggcgcggcgcgcggacgcagcgcgacgagcagacgaggacggcacgacgcgcgnacgacgcgagggngcgcaaagagagagaagagacgcaagacgagaggcgnccgccgcccgcgcgcgcacagganancgaagcggcaccgacgacaccggccgcacagaagagacccgcacaagcgacggcacganacagacacagaannanacacacgcgcagaccacaccgagcacccgcgaccacgagcgccg

SEQ ID NO: 15602 - DNA, 773 bp, Homo sapiens
cctggtcctacatactgatggattactacaccagctcgtctgtaagaccccagtggtgccagctggtctgaaggataccactgactcagctgatctgagggtcccacgagaagtggactcactaaagaatgcagtttctgtatcgtgatgatatcaccctccttgccctgaccaagcaacaaccccaattttccaatccttcaccctcaatggtccccttaattttccacccaagaactcctcgaagagaagggcttgaggatccgccctccccctctcttgctttctaccccctctatccccccacctccgccacacaatcctcattcctgttctcccctcctatccactctgtaccgccgttaccgcattctcccccccctccccccctagccgatgactactccccacctccatacacaacacttttcatcacgactaacagacctcctcaacgtgtgcccgccactacctccttgtaaccacgagaccacagcgaaaactcaccaattaagtctacaccgtatagtagataagagaaccttcagtaaattaccacgacactcccgtcctccgtacccacccgctccactcaccaccagtcacagtcacacgcccggaaccaaacacccacaaccaattattcccccccctccatgatgatgcccccttccctttcaatgaacccgtcctctccacccgcgaatcccccacatcctcaccataaccccccgcctctagatcacatttccgatccaccttagacgccacct

SEQ ID NO: 15603 - DNA, 894 bp, Homo sapiens
  misc_feature (1)...(894): n = A,T,C or G
cagaccaagccccaccccccccgcattcccccaccccccaacaaaacccttactaccagcttgagagcaattaagattattttctttataaattacctagctctgtggtattttgttaaagcatcagaaaattaaaccagacaggtggataaagcttctcagccacatgccagcaagccacatgctctcagaaaggaaccgacccactcaaagacaagttcaacgcggcaccgcctgcattctcgatatccccctctttcctctcacagaaatacttttgtaatccccctgttcctccctaaataacagaccaattgccgtctgccgcttctcctccctcgcccacaagcctccctcttcccctcccattccgcactgctccctcttaaccccgcctcaacgccccagccttcccccccacatgcgcgtcctcccccctccctcccacgcttatccgagttaaattgcgccccgctgtcgtcgcgccttgacccacttcatggtcacaacaacgtccacaccacaccagtttacccctgcatcccctccatgcatccaccacgacctccatcttccgaatatcacaacccccaatccaactcccccccctacttcggcccacaccactaacgtcccaacccctcgcaccaccactgtacttcaagcccgtcctcaggctccgccatcacaactataacgcatactaccctaacgaccgctataaacccaatcccctactcacgataaatccaccacgcgcctanagaccatccctcacgcctctctaaatatataattcacatcctctgaacccaccatcattacctccgataacaaccccttatctcttcagaaatttacaaatgttacgtcatccccttccataccgcccat

SEQ ID NO: 15604 - DNA, 248 bp, Homo sapiens
ccctaggtggaacctcatccaatcagcttgaaggtctcaatcgaaaaaagactgacctcccttgagtaagaagaaattctaccacaagactgcctcaagactcaaactgcagctcttccctcaagatgaagactcaaagtgcagtctccaacatggggcctaccccatcagactttcaactctccaagcctccatcgtgtgagccaataccttaaaataaatttttctctatcttaaaaaaaaaaaaa

SEQ ID NO: 15605 - DNA, 966 bp, Homo sapiens
  misc_feature (1)...(966): n = A,T,C or G
taatgttataaccataaccctctccgcagattcgcccccccccacaaaaagccctacattgaacatttgtgaatatcacaaagccaagctgaagacaatatcttccctaataacagtagtgcaatgacagccagccagaaaagttctccaccttggcagcaatgagactaagacttttatgcctgaattgctatcttttttttccaggtcagcaaatttcttcatatattaaagaggatttaatatctggaaaaaaaaaaaccacacacaacacttttttttcaaaagaagaacaacccacgataaccacgaaactaaggcgcgctaccaacctcgcattctcccacactccttcccctttccacccacggccaatccaccgcccaccgccccatggtccaaaaccttcacgtcccattcgatcacgccggcgacccctgcaccacccacccccacccccccncttcgccgagctgagcaagtcacgcctcccagcacgcccggcactcaaaagacatgtccgcaaacagaacccaccaataagggagttgcgacgtaacgagatactctgtagtgtctacaccggcgaccgtgccggttcgaacgcccatcaaaccagcctccgccaccacccaaacagcctccagcactaaccacctcgcacctcgccttactcacgtctgctcccgcgtcaccacgcttcaaccgacacaacaatccacaccgatccaaacggtacaacgacccatgcgccaaaacgcaccaattatacccacataacacatatataaatcgccacgcgctttcccaattatcactcgccccgcgttccccgtgataacaaacacaaaccgtntcccgtcaccgcgaccccacaaaacaccatcgaacacgcagcgacgcgttactcctccgaccgcctatctcgcgctatataaacgttaaccacttcagtcaccccaccac

SEQ ID NO: 15606 - DNA, 885 bp, Homo sapiens
aagcaaaaagaatatacaaaccaacgaaatcaacgcacgcaaaacaaaaaaccctgaataaaactaacggaacatgaaacttggaagctcgtatgacacagcttgatcgaatatgacagacaccagaaaatcaccgactcaacacccctccagcacctactgcctagttgcccagccgatcacagaacggaatgcacgtagaaagatttccctgggtgcccgagctccaacccgcctatcagtggactcatcaacgcctcatgtattatgtcggcaagccaaacccagaaacacatatggttattctatctggtcgagccattacaacctactttacataacaacacccaacggagaatgaccgagtcttcacgcatttccccccatcccaggaccgtcaaccgtccaagacaaatcaaaccagccaagacactatcgtagctcccatgaccaaagataaacacacacacccccgctgatacatataagtaagcaccgccgagacgaccttcattcggccaacaaacatcgtagaagaaacgaaaaatataccaccaccatatacattgagaccaacaacgacaccgccccaacactagccacacaacaaaaaaaccccacctcatctcctcgtcggaaacaccagacggactagcacattaactcgacgccacaaaaacggccgaacgacaccaagaaaaccagtccagcaccaccccaaacgaccaaaaaccaaataaaatataaccgccccatcgctagaaaactcccccactccaaacaacaaatatccgtattatcctcgcgaaacacagaccccaaaccgctacataaaaccgagatacactaattcaattttagcgcatccacaccatcagccaggcg

SEQ ID NO: 15607 - DNA, 814 bp, Homo sapiens
  misc_feature (1)...(814): n = A,T,C or G
ctatcctcaaataaatgtattcacattcacacaatgcacccaccacacgtantaaccttcgtgggtggcgttatcggcctcattcttgcatacatttgctacagacagcactatgctcctctggccaacgcagcttgccatagaccctacgctagtctgcgagtcccagcctcactgaagatagaggagaggcccacagctgacagtgcacccagcttgcctctggaggggatcacccgaggcccggcatgaccagtgtactgagacgatagacactagccagtgcgcacaagagccagcactggctattacttaaagacaaacagtactgtgacttcgcttatcgatccaaatgttaatctaaaataatcccacccacgacacaggatagacggttgaggaacgtccatacactcaatcgcctcgagcacctaaaactaatcacccgagcggcgccacaacctccttattgtcgcaccgtcccacatcactccagaagccgagctaattcacacacttagcgcacccccccccaacaggattcacatgtattatatcataacccttcataaattttcattgttcgtcacacccgaacattatacctcagacgctccaataataaattttattaccggcccccccttccagaggccacgcaagatatccttagccacgcccattacccaattgtactccccttcaccccatatattatttgatacccatattttgattgcctaaccatttccaccccaccatctatatgataggatagatcccaccacccccggcgtaacatacgtcgacagag

SEQ ID NO: 15608 - DNA, 932 bp, Homo sapiens
ccaacgtaaacataagccccaacccaacaacccagcaacaacccaacacacccctactacgaacgcctgtgcagttccagagactgccagaagatctgcagcaacccctcaggctgtacggacatcgcgtatcccaaactcgcgctggaactcctgcccacagggcctcccagggctaaaggacggactgagaacgtcgcagacgcctcactaacaccaactaacctaacaccaccgcacacgccgcgttcgacaccactgataagcaccgtaactcccgcgaaccgccctctctctcatcacatcagttattgaccaagatgctcaaacaccaaacccgcatacaaaatctcaatacgatcccccgacactgaacctcacaaacaataacaaacagacacacatcaaacaaacgtaagaccagaccgacagcaccatcatcgacactataacaccatcgacatgaccgcgccacaagaccacgccaccatcctccacacaccattatacacctcatacacttcgcattcccactcaaaccctcgagccacacgactcgtatacctctccatctacgacagctcattatacccgtggaatccacacgcacccccgcaacgcggaggctcaacccaacataaaccacatacccccaccacactacacaacacaccatcaccacaccccacccacacccacaccccacgcccaccagaaatgcaactcagtccaacgactacccacaaaccaacgaccaacacacaataccacacctccacccccgctcatcacaaaatagtaatacaccgatccacacataaataaaataaatagatccaatatcactaccactagctagaattacaccccccccacccccaagtgtcggtggatgtaccatccataccagaacactaaagaaacactacaag

SEQ ID NO: 15609 - DNA, 869 bp, Homo sapiens
actcacaacattccacccctacttcccccaaccacccaaaaccttagcagacactgattacattatttgttctgcagctgggaactgtggggatatatgatttgccacatactgaggaacatactggctattaaatagagcatctgttgagggactcttctaccaccacaccacatgaacagacctctggcgctacccagacagagacacacctgccacacggccgccacctacctagccacagatagcctaaggcctcaccgccacctaccatccccctccagacagtactcaatcgcgcttcgaccccctccatcgcgacacactggctgaccacacactcctcaggccagcgagagcaaacctgtacagcaccatccaacattagcgcacgcccgcacccgtccgacaccgccaacccatccgacatgccactccgcccaactcccacgacgctcatcaaccgcaccctaccacctcgctcccccctcatctccctctttacacctgcctcctccctacccccccacactaccccacgtttccctttcccctgccactcccaccccccactgcatacccactcaacccaaatccattgcccacactaatatatcaaagagatcgcacccactcacactttcctctatcaccgccccgcaagcagacatacaattctaccccccccccctcacgcaccccgccaccgactattgcctgaaccccccccccttacctacaacagaacccccctccccccacataataatgatttaaccctatcacactcacccaatatattctccgcccccacgctcgtaaatgcccttgcacacaatccctcccccagggaacaacgaccaacaaag

SEQ ID NO: 15610 - DNA, 287 bp, Homo sapiens
  misc_feature (1)...(287): n = A,T,C or G
aaaatcaaacaaacaccacaaccgcaaaacaaaaaacaaaacccaaaaccttttagagangaccacctccngcttaacacagccagacaggaggagaacagagncaagagctagagaccaatgcgagcgggccatctgggggtgcctgcattcaactgcggttgaagaaaagagcaaaccctgggttcatctactaacataacacctacaccaaccacagcacaggaaacacacagacagcaccaccaaaacacacgaacaacttgcctagctcaaaaaaaaaaaaa

SEQ ID NO: 15611 - DNA, 916 bp, Homo sapiens
  misc_feature (1)...(916): n = A,T,C or G
gctacaggaaatctacagccacacgacagcacaccacaacaacaaacaaaaaaaacttaataganaatctcgcgaccgtgacctggagaacgaaccaacggaaagcgggaaggagaaggcaacctgagcgcccagcagcgcccagcccgacctgaaaggcacaggcgcagagcccagcgccacaccaaggcacggacggcagggcggggacaccccgaacaaaaaaaccaaccaccccaaaccgcacacccaaccgcggaacaacccaccgaacaggccaagcaaaaccgaaacctttttttttacaacgaaccaaacacacacaagcgccgaacacaaccccccaacacgacaccacaggcaccacgacacggagaatgccccgagaacaaacaggacgaaccgacnaaacacaaaccccaacacaacacatcacacagcaagaaataagcactcgtaccaaagtcgaacaggacaccacaggccccgaatacaacaggccatcgacagaaacaacaacaacaagtcgaagcaacacacccgcacaaaaatagaaatccacaactaacaacacaaacttccgcctcgtattccagtcacccaaccaccagccaacaccacacagggcgattcagacacgccccagtcggcatagtgtatagcgtccgaccaccacacagagattcattcacacaagacgagcgcagatatagagccgtgagcagccacgcagcacttagccatacaagagattgacaccaccnccacgcacgggaccgctcgaatagacgcccccaatctacacaaagaaaatacgaaaccacaacggtccaagcccaaacagacaacgcaccccaccaccgcggctacgaggtaaacaacccatcaacaccccctcgcatacgatccaccaaaa

SEQ ID NO: 15612 - DNA, 747 bp, Homo sapiens
cctagtgagggctgcttgaagaacttggatcagtttctcggggtctgtggtgttggcccagggtgctggcatcatctgcccaggccagagaaagggcacttccagagccactggactatggtagaagaccagcacttgatagtccttctcccacagatggagtttcgctcttgttgcccaggctggagtgcaatggcgcgatctcggctcaccgcaacctccttcttaccagtagctgggattatagtcctggaaatggcttcaaaacatgactgaaatctccttgaggagcataatgtggagggtgggccctaatccaatctgtcattataagaagaggaactttggacactcaaagacacccccttggcgtatgttcccagagccatgatcgcgtgaggacccctagaggcctgatcaccaccaagacaggcccccgaaaaaacacccgcaacctccccctctgttctttggactcgccgccccacacaattgccaaggaccaaacgtaaccgatctataactcatacatcctgatcccacctccctttgaccctccccccccagctctatggcccttctcccccacccgggggcgcaagcaaacaagcccgggccaccgcccgattgcgctctacccccccccccccgttacaagaaaaaccgcaggagcatgcccaccatgtgcacccgccccacgtccgtgctaactccgacatccgaccgcgccccatatgacccccaaat

SEQ ID NO: 15613 - DNA, 924 bp, Homo sapiens
aaacgatccacctgtagctccccccccccacccccacccccccccccctagcaacacaatgtctgaaaagtctaaatgaaggaagcttttgtcactaacctcaatggaacccccgtgctggaaatcacccagggattgtgctttcctgcattctgtatcctgtgcacagggatcctgatcattatctcacacctcttgcgttgcttatgaactacctggaaaactccatctcctgtctgcctttatgtgttcacattctcccctcgccaaccccataccccatttgccgcttccccttccccacctcacacccatctcccaacccaagcccgccgacaaccctaacaatccaaatagtccatcaagcattgagcatcgtagaacattaatcaagccgctcacactaaaccctcggcgttgcaattttactcccgtcctgagcccactatcttcatgccgtccagtgctctcaacaccacgccccccgcacatcactctatcgcgtgtgtcacaaggattactgcgaatgtaatacaacgctcaccagcccgtctactcccactcagggcacccgtttgagaggtttcctttatccttgtattcctcgcctcactgtgccgtgtgacgcacaactcaatcaacctccccacaggaagcacgttaataccgctacagagtaacgtcatcacacgcagatctagtaccacctctttaatccattcaagccatctgacgccactattccatagacccgtccccggaagacaaccgtgcgaggtatcaataaagacgtttcccatgccctccatccactcttcagtcgacgccagtactgtgagtatcgaccggcctatgcaccgcgagaccctccgctctcagcacagtaaaacgcacttgagcccaccctgagccactctcctcccc

SEQ ID NO: 15614 - DNA, 847 bp, Homo sapiens
  misc_feature (1)...(847): n = A,T,C or G
aagcatacaacaccccgcacgagaggaggaacgngggctcagagtacagcattttggactcanagaggagacaatgattccaaggacgttaaaagagaagaaattttaatgcacacagtaggccgaaattctctcccattgcaccaaaacaggaagcatgtctactattccctctctttactgtcccaagctaactggaacaaaacaaaaacctcgccggggcgcggtggatcacaccgagaatccgcacgctcgagggaggtctatgcgggaggatcaccaggtcaaaaagccgaccagcctcgcgcaacctacagaaatacctgccccccctacgatacgccactcaggactcagtggtggtccgacgtccagttcaccgcgccactcggcaccgcgcgccgccaccatacgcggcgccggccgtccagtgagggagaacacccgccaggccaaggacaaggcagggtgtaggtgtctgaagactatagcgtgtatgaaatagtgccgctctgaggaaagcagtatgtggtgcgagatgatagagggtcctcctgcccgccccccgcggggccgccgctggtcacgcagaccgcaagcacagccacggggctgacgaccgtagccgggcgccagccaggagcgagacggaacgcagattcataagcaccaccgacccgcgagcaagacactcaccacaaatgtcaggagcccgggggcgcgctaccggttatcagtgttgcgattgcactccaagtgaccgtctgcaggagccacagccagccacgacaaagcccgccggccaggaagataaggtagcgagcagcacaaccacaaccctaggcct

SEQ ID NO: 15615 - DNA, 902 bp, Homo sapiens
agcggcagccacggtgaggagaaactggggagtggccgcgccgcccgcttattagtcacgttggagcattgtagactgctctacccctttctgcctttacatacaagatgcactgttgcttagaacacttggtcccacctctctagcacgcaaggatctgggcaggacaacaaccacaggcatgtgctttctccatgatcgcgacgccatgcagcagggtatgatgcagcacagacggccctcaccagatgcgatccctacacaaccctgaagccaacgtcttgctgccgggctaccctgaacaatcacccacgcgaaaagacgaaccgccgccgacgtgcggtttcccgccgcgcgcggaacacacgagatacctacctgctcacgcaagaacccctactgaaacacgaacccggaaaatcaccgctcacgaaacagggactatagtacttaggcgacatcacacagctcacgcgccaccgcaatacagtctaccgacgtgaagagcgtagtcgacggcccgcaagggctctccacgcaccagcgatgtcccactggaggccaggcgtattgatcatgacgcaccatgaagccgcgccacaacactctgagtgcagaacagggcaaacgagcccaccagtcgtgtactggcgcgcgccgagagaccagcacgcggccgtagaatgcgacgcctaccacgcgcggatccccggagccccgcgagcgcgcgccgcccgagcaggtcggaaggcggtatgaccctcgacaccgcaacgacgcgcgcggaccaaagccactgaactgcgcgcgggcgaggcgaccgggaggccggctaggcaacgagcaaacgccagaccccggaggtccagcgctgaggaaagaagccgccgtccagcgcgcgc

SEQ ID NO: 15616 - DNA, 980 bp, Homo sapiens
  misc_feature (1)...(980): n = A,T,C or G
ttcttcctcactcacctcctcgccatactggtggagcggagcccnnaccgccgtnttgangactttctcgaagnacacattgtgaaaaactccaccggtaatacactcggaggngagagctatatggctcttatttaccgcctggtgatcgagctcaaaggcagccagccatcactgagtgggaactggccacaaaaacctatgtaagaccaactaccaccacgacgtccatgcaaccgagcccaccccatcttaccagccttcccaaccagcggatcccatacccctctgctcttcaccatccgaactgcccatgcttccgtatatccaccattacttaaccggagccacagtcgcatgacctcgttctacaccgccatcagacaacgctccttggcaccgcactccnccccgtcccctcagctgatgtccaagcactccgttgaggaaataccacatatattagccggtcagcctaaggctcgagatacacctgttgagagacngcgtcgcaggacgctgtctcgatcacgggactcatcgtgtctgcgactgggcgagacagcgagacagttaggagaggatatcgtctaattattccacgattccgtcgtcagctgagcccccgctcctcacaccgtcggccccccgcgcacccgcacacggcacgccgcgaccacgcagcctgcgacgcaaccaccctcacacactccccgcactctcctcacgctctactaccttctcaaattatcccacacacactagcaccgtcaccgccataacacaccaacaacaccgtccttcttgtgcgcttcgtcaccacacacccaccacgccagcggctgcgcgcccgcccgcaggctccttacacccacgcacagtgcatacgccacgaggcgccctgccgactggtctctnccgctcgtgcgcatcgactccccaccgtactctataccatccttctactagcggtgccaacc

SEQ ID NO: 15617 - DNA, 776 bp, Homo sapiens
cctaggcgcactggccagagctcctacaccatcttggacaatgaaaaaaccttcacaatgatagccatggtgaaacacagtggagtaggaagataaaagagactgagaaccggataaccacggagttccataccagctctcctgatacctttcataaaagagtgaaatgagcatctacctttttgttttgcttcattattatttggctgggttttcttttaagttaccaatagtctatgtgtacttgtactttagctgcttttatgtattaatataccattgaatgcatgtaaatcttcatataagtcataaactatgtaagattagataacacagccgaccccaccccaatttacaggagctatttcacaagaccctctatggatgcctgaaactgtacatagtaccatcccctatctacactatggctctttctatacctacctacttatgataaagcttaatttataaacctgggacagtcctcttcgtactttagggccattctctctgccctgcaataatgactgcgcgccgagggctgcacccactgccacactctgtattcgcaacctattatatcttcctacttggtacagcgacggtcccacacccacggcacctacaacccccagcgaggagcctccacgcgctctcgcacgaatccccgctcgtccatgacgatgtccactgctcctgggtggggcgactctcctgctccctcacctttccctgctatccagcccacggacggaactcctccccttccttcccct

SEQ ID NO: 15618 - DNA, 907 bp, Homo sapiens
  misc_feature (1)...(907): n = A,T,C or G
acacgccagtacgtacttacacagccccgctccgagaaggaacgggcgcttgaggaanaacaatgcctgaaagttgnagaaggaagcttttgtcagtaacctcaatggaaccaccgtgctttaaatcacccagggagttgcgctttcctgcattctgtatactgtgcagagggctcctgatcattctctcacagtacttgcgccctttctcacctacctggaaacctagattcctcactgactctgtagtcctaaacagaccccatggcacccactattttcattagggctgcattaatcaccctagcaactgatcaacgccatactccccccgagcaagactaaagcataccacgcaaccgccccacacactcccaccaccgcacttagttacccagtacatccacccaccaacaatatcacatccgccgctgccaccactccgcgcaaaaacacccaacacactcacacatatgcgaataacctctacccgcaaccgaaaatagtaatactactaactgcataaatctcacatcaaaatcgcaccccaccgccacccctctctaacacacaaaaatcggcctccatacagtcccacaccagacccaccgaccttctacacccccaccacacccacctcatnaaccacatcagtcatatcaccgacacgagccccgcgcccaccaatatagcgatacctccacgcaaactagccccaccaacaccaaccacatcactaaccctcgaccgcgacagtacaaatatgcacaactgacatactaatcagcacgcattatctagcactacaaaacactcccttaccttaccctcacctccactcgacacaacaacccacccccgccacgaccccccctcaacccacacccaccgtaatcaatgtataatg

SEQ ID NO: 15619 - DNA, 1434 bp, Homo sapiens
  misc_feature (1)...(1434): n = A,T,C or G
ataaaagagangaaaaaaaagaaagaagagaaggaagagaggaaangggcaacaaaaaatgggaaaacgtggccacaaccaccgggggcccaaaactgagaccctagttgggccgaacccccaacgaggcgccaaacatgtaagaacacggactttgcaacagggaaacgaaaaaacaaanacaaagcgaagacccnagaggaacccccaccacccgcaacaccccaccacgcgcacaacacacaacaaaaactagaacacaacaacncaccccacgctccncacccccacgcacacaacaacaacgacgcgccaacccacagcccccagcccacaccgcccccacacacaccacacacaagcgagacaacgaccagcccacccccaccacagcacacacaccaacaccgaaaccacaacaaaccacaccacccgagagagaccacaaagaagnaacagacgacaaagacagaaaacaagagaaaaaatagaagagnaagaagacaagataaaacccatagacaagncanaaagagaganagcagccagaaccccacaccacaccaccgatccacaccacacaacacacatcacacaccacgcacaccgagcgacagcgccgcgcgccgaccagagccgagagaggcaactacacacacgcacacactacgcgcgcacagcgcacgacacccgcgcaccaccgaccacagcacgcggcncgccgacagcggaggcgacgccgcgcgcacgcaccanacacacgcnagaagaacacaaccgcgacgagcaaccaccaacacacacgcagaagaaacagaccaagcacacacagacacgcagacccgcaaccacacacgcctncttcgtcactccgggcgcgcgcgcagacgancccgagaggcatggacggcncagaccgagagatgcgcgagcgagacactagtcatagancacgaagagagacagcacatagggacacaanacaagcacgagacgcactgcagctacgcanccacacagcgtgacnacataagacacaacacgacacgagtacaaatcgcacaccagaaacacacgccactaccgagagagacacgangcacacgcccagagcgacatcaactgcgatgcggtcagctcgcgcgcgnacacggacgacagcgggctacgccagagcangacggccngagcagtcacacagagcgagagcgacagagcgacgacacggtgcgacgcgccacacacgagagagcgcgagagngctcgcatcgtgatcgagcacgagagacacgaggagacaccacgaatacgcggcgacagaaangacgagagagcacaaaagacacncgaaggagacgagagagagagagcaacagccgcganacagcgacgngcggacggagacagcgcatacgagacaggacgagaagantg

SEQ ID NO: 15620 - DNA, 801 bp, Homo sapiens
  misc_feature (1)...(801): n = A,T,C or G
cgaacctcacagcaaattcgacgagtggcaactctccccacaccgacgaaccacaaccgctagtatgacaacactgcttanaacatctcgagtagaacacaaagaaaaccatacaccagagatgaaacatttttttgaggcttagaaaagaaacctaagcagatggaaatgagacatgcacaaagaggacaggaacttcatcagataatacagcaaacacaccaagtagaagaaactgagcaaaacaaagaagttgaacaacggaaaagactggcacagttcaagaatcgtgaactggagaagcttcccacagaattccactcactattagatgtaactaccaagaatcaaccgacaaccgtactaacgcagcaacccggttctgagacccatatgatagcccccccctccaataccaatttgatattcctgggtgccccatgcacaagataacatacgagtcatcctgataaacccctataagcgaaggcttgcactacccccccccaccaaccgctcggtagtggtatcttaaactaaacactacttccttactactccacccgccacaagtcatcgcttttatactggttcatgttataaaacacctaatatatgtatcgaccgtggtcctaaatcacctaacatagacgagatgagttagatttaagaatctgtctcatttctatactccccgtcaagaaaaattattcttacgacaatataggcattaaagatatatgcacggagatgagaaaacgccccctacttccaccgataaaaagcctagtccacagagag

SEQ ID NO: 15621 - DNA, 933 bp, Homo sapiens
  misc_feature (1)...(933): n = A,T,C or G
cctcaccccccacaatcagaccacgacaacgtgaagttcagcaaccacacccaccctacgaatnacacnattttcggaattagnanaaggagacaaatgattccaaggacgttaaaagagaagaaattttaatgcacacaattggcgtaaattctctcccattgcaccaaaacaggaagcatgtcttctattccctctctttaccgtcccaagctaaatggaacaaaagaaaaacctccgacggggccgcggtggcataacaccggtcatctcacacactatgcgaggccagaggcagcaagagatcacgcacgtcaaggaaatccgccatctctgtctcgccacattagaataccctcatatctactaataaatacgacgaccccgtccgccacgcgatgtttacacatccactcgcaacgccgttgccccttgttagtatgaccgcattgatcctaccctcacgatacccaatacggacatacacgtcaacggattccttacacnatagagccctaaccagcgccgactcccgcaccacacgccccgccctcgtacacctaaagcgcatatgacccttcatcaatatattcataccctcagtctaacacacaccacaccgctgagagcaccgctcggacgacgtcatatatcctccccgcacactacaccataatccatgacgcaagcgtgatcacttgccctgctcgcatacttctatacttcccacacatcaccgtcacgatccctctcgacaccacttagacaaccacaccgcactccccgtcgtgagtaagtcacaggcgtagcgtgaccacgaccacgatcgtctcacctcgccacacatcagtacaatgatcttcaccctcttcacgttccacaccccctcagcgcacccacatcccatnaaaaattctggttcaagcggtctgg

SEQ ID NO: 15622 - DNA, 301 bp, Homo sapiens
ccccccccaatccatcactccatcccgccaacacaacccactagtcgtatcctactggatttccgggagcaacacttttgagtggcttgctgatctcttactcttcctggaaacacgcgctgactgaccagggcgaaaactcactttcctgatatatcatatactcactaaccggctgggcacgaacatccccgctctcacacaacactctcacactcgggacaacacaaacttgaccgagactaccgcgctgcacacactgatgaccctcctctgtacccggccacccctccgacacaac

SEQ ID NO: 15623 - DNA, 1062 bp, Homo sapiens
ggcgtcctcaccttagcctcaccagaccccactttcaaagtagagaggcaaccgttatatgttaacacagctgacctttggatagaacaacaggactgcagttgcgcacttctatgtagattttgatcaacacagcacaagccggacaaatacatgcatcttactatgtatgatcaaacaccttactatcacagtaggaatcaagtttatcggtattaaacacggagcttcccacaccggcgtacacacgccggcactcttgtggcacctgcgacaggctgtatgagacgtgaggcacagcgccgacgcatgatcaacccttctctgtgcccttccgcgtgactcccgtgtatataatatgagcgtaatgctaccatagatagtcctagtgatgcggcgagaggctgtatctccaagtaactcgattaagcatgaccgcacgacactgagccacgcctccacaccagtcgctcgtttaccctcgctcgacagacccaacggcgcggcattcgtcggaatcgatacatcgtaggactcaagggcgcggaatgtgtagacggagccccgcgattattcacttttaatatacccaacaattatctccctaatttcctacgcgccgtcttctatcccacaaccgcaccccgctagcgtatccgatcttcgaccccagaggtcttgagtcacatgtcaccagcaaaactataagacatagaacgcgtacggtcagcgtctggcgttcgtgagttagtgtttcacatcgtgcagacattcctcgaaccccgggacgaccgtggcacactgcccgactagtctacgtaatagcctgactgcattgtgactgaccacgcttggagcggctgacaagagctagctgagagaataggtatgctgcaacatacatatataactaggatcggtctcgccgcagcagtagtattacgctctgcgccagcatacgcgcattgaaattgatgttagtaataccggacgctgagatatcagaagcaagcgcatcgccgcaccgaccgtcgttcaggccggatggtagtcgctgtcgag

SEQ ID NO: 15624 - DNA, 805 bp, Homo sapiens
cgccgcctctacccacacctccctatgaccaaaacacacccctgagttttccgggcaggctttcttatcaggtgcgccctttaaatggattgggaccctcatggatttcagatgtgctctcctgctgaccttgaaaacgtcatctgcaatgcgaacgtgttgatggagggggccatgtgccaatgacctgagggggcaccgtggtatctgccagtacttgcgcacctaataactagtacgaaaacgaacacccaacacttagcactcatgaaactgaattatgcctcacaactatttgaagctctgaagaggattctgagcaccagaaagaaatgacacatatcacccaccctcgattgcatccttgccagaccttctgatgaccaccaaactaattcatgcctagattcacgcccatcgacactggtataacccactgcctattgcttcaacccaccttagctctagctcacggcgacaggtccacctcacgacttacacctaacttgattacctttgtacatattcccagtcttctttcaccctcccttcgcccccacgtaccattatggaacagtagcaaaccctatatcgatctccgccgttcgtcattcttccaccagcacccatcctccattctcctttcccctcgcgcttctctccactaccgcccccctcatcactccctcccgctagcccccccagatccccaccggccccgtcctcagttagagattttgatgcaactctgccaactcactgtccgtatacccccgcttggcgcataccctttcccatcttcgcg

SEQ ID NO: 15625 - DNA, 808 bp, Homo sapiens
  misc_feature (1)...(808): n = A,T,C or G
tctaactccagataattattgtttcgtgccatcattaatactctatccnccgtctctctaggtntgcagcataggcaaagcatcttaaccttccagaaaatacagtatgaattggacaaaagaggatgtaaatcagtggttagaaagtcataagattgaccaaaaacacagggaaattttgactgaacaagacgtgaatggagcagtcttgaagtggttaaaaaaagaacatcttgttgatatgggcatcacacatggaccagctattcaaatagaagaactattcaaagaattgcggaaaacagccattgaagattcgattcacacatctaagatgggaaagcccagttaaaatgctcctaatgaccaaactgtgtctcaaaaggagcgtagagaaacttcaaagcccaaacaaaagggtaaacagaacccagatttggctaatccgtctgccatgagtaccactggttaaggttctaagttactaaaagttgagcctcatacaagattatttagattatacccaggataggcatccattcccagaccttgcatgcgcatcatatcccttttctgacttctctaatccactggagttacatgtgtgatgttaccttgtcaagactgaatatcgacctgtccatttcattgcttcgtatacttcagttttagcttttttaaattctctcccgttgtacttactacgaggtcgggagcaattcttcgagcaggtatcgactttatttatttttgtcgtcttacttacgttggggttttcttttgggatacactagtccattaggttgag

SEQ ID NO: 15626 - DNA, 735 bp, Homo sapiens
tgatgaactttgactcatagctactgatgtacgcaagttatctctatgtggctgataatgccggtgaaactgttaatgtgggaaggccctttcttgctggcttcttgagctcccagattcgacttcagatggtgaggcagctcattgtttcttcaacagggataaattggcaaccatttggaaatattaatatgtcacttcttactttacagatctctgtggaggggaagtgcttctacttccgcttctaatttataaatcaatccagagctgatgctttataccttatcccaatacccttaagagtttatacgaaatctcgcccccctcgcgtaactagtcccaccgcttcctacttctttccgtccatcccctgaacgcatcccttcgccccccttcacatattttcgtgtcaaagaatactattctaatttactgctccgctatatacccccccccgcctctcgcactctcttcacttaacccccatacccccccctctatcctctcaccccggcaaccaaagtcacatgacctccccactattcttctccaccattcctactctgtatctcgtcgctaatctcccagtcactcgcatttctgctcccgcattccacagtactttcattcagactcttcatcctcaccgatagagagttaaaggtagcgcggatcgtacgaatcgtcatcattccgctactacatagttataacttacttacaactcttcat

SEQ ID NO: 15627 - DNA, 1321 bp, Homo sapiens
  misc_feature (1)...(1321): n = A,T,C or G
acccgcccgcaagcccaaccacaaccgcacacaaacaacaggagcaaagcaacgacgacagagaaacaagaaaagaccgctggagaagggaaacgagaaagcgccacgcgctgaaacaagggacagaaacacaaagacgacacgagcaacaccccaccaaggaagacgaagagaggtctaccaacaggcaacccaaaagaagcccacaaagagagaacaaaggaaggagaacgaccaggaaggaggggggcccggcgagagccagcccgcgggccgcagacgacccggagccacgcgcacagcaacgcaggagcgcgaaggcgggagagacagagagccagccagccgcgagggacacagccaaaacacccgcgggccccacggccacgggggcaggacgagagagcaagacaaacaacgcccacaaaccaactcgcgcacaccggaaaggcggagccccgagacggaacggagcccgcggaagacgccgaaagcagccccaaggacggggacgcggaggacgacaggccgcccgaagcgagaaccgccgaggggcgcacggaagagaagcaaaagcacgacgaagcggaagcagacggtcaaccgagcacgggccgcgcgcggaagaaagagcaggaagaccgagacagggaagaacggccaaggcggacggagcggaggcacggcgcagcaggccggcggcaaccgacagcgggagcggcagagacacgaaggaacaggaagcaacacggggcggcgagagcgcccggcgcccgagcgaggagcgaccctcgcagagcacgagaccgggcgcgcagggcagagaacacgcagaggacgacgagccgaacgcgngagaggctgagggcagggcgcggagaacggaacgcgcgagtgagacgcagcacgggcggcgcgagcgagcacgagacgcaagagtcagggacggttcaggagggagacaacacggtncccgcgcagagaggagagaggcacaggacgtagccgggaggtcgcaacgagagagagagaagacgagaggcgggagcgagagcaggtagccgcgacgcgcagacgaacaaagaaccagacagcgccggccggcccgaggcggagcgcgagaccggcagagggaggccgagacggcaggnacgacacgaggcgccacacgcgccgcgcaagcaccccagacgcntcctgcagcagcgcacgggagcaccggcacgccacacgctcgtgcgcgcacagagaggagcggcacgggagncaggacacgcacacgcccacgacgaggagcgcgcgggagagagaccgagcacgg

SEQ ID NO: 15628 - DNA, 779 bp, Homo sapiens
ccttctcccaaccacaaggcaacccaacaccaaactgggccacctctcctttttcttgtctgggcatgaaaatgaaaggcactgtgcgctactcgagttttggaagccaccaccatcacctaagaagaccataaagattaacgaaactgaacacaactcattctgttcaataaaacagaacacaaaagctcattcagaagcgttaggtgacttacctgacactacccaactaccagatgacaaatttctatctggtctttcaactgactccagagtgaagcttcttggattacgatgcactgccctctaccatccttttacgatcactgcgcgagaattaaacaccataaggcagagtatccatccttatggaagcagaatatgtggacgctgacctgtcccctcagactaacggaaagatcgcgccaccccacacagtatcccctctatgcctattgatcaccgccgctcccatgtcttcacacccggtcacgccccccctcgcgcgatctcggccagccggaagtcaggatcagtccccgtactacggcccctgagtatctagtactctcattcatacgaatgaagcctctggtactcggtatatgctcttgcactcggctctattaatccccggtagggcgttctttctcataggtggaggagtggccggcccgcgacggcccaccttcgcctcgttcgagtatatatctttaaacgacacatgtgaaccccgaggcgccggccgccgccgccccccctatcccgttcgccccccc

SEQ ID NO: 15629 - DNA, 799 bp, Homo sapiens
  misc_feature (1)...(799): n = A,T,C or G
cctttacttctcctatatccgccatacattatactcaatttccccgtcacccctgnatagactaaagagaaaatgaaagtgtttgagaatagcttaacaattaaaagcaacttaaaagatcttgaacatcagcgaaatgacccagtgagtccaacatagtgctctagggatgctgaagtgaccaatcaatgatgaggaagatgacaagtacatacatatcacatgctgtcctcacctgtgagacggtatctaaaatatcaacaagaatacttcctgtgggaagtattttaataggaggataaaaaggagcctgtgattacagaaaacgatgttcctatattcaaggaaaatactcttccaggaaaaacacaggagactttccaggttcaagaagacagctcagattccagattcgagaagccattatattactggaaatttaacttgatgaatacaatttcatgctgggtctatgaaaaggacggagttaaaccgtgatggccaaaatcgtcctcaatttatttacctctatatccgcctgtcttgcctttcaatgtgcttggaactcaagggttgaactcaactcctgaattccctcctgtaaatattttctctgcgagtagatttttcctaccttatttaataacgctgtttgcattctttatacgaatttttaatattgggccgacactctcaccatgccttctccgttgtcggagtgagtgtatattcttatgccgctaccaagaactacatcaatactctatgagtcccacgcctctatcagtgaaatggagcc

SEQ ID NO: 15630 - DNA, 844 bp, Homo sapiens
  misc_feature (1)...(844): n = A,T,C or G
caacgcctcccccaaaccgcacaggcccacaacaagaaacgaaaccttatatgcaagngcatgcacgttggcgagaaaacaacaagaagagaacctccttatccatggaacttcagacgataacgaacatcctcagcaggcagctcagatctccaaagccctgcccgatgccggagtggattaccaggcaacgcggactaccgatgactaccacggaatagctaccaccacaccacaccaccacctacacacccccaccacccctttttttataacacagacatcttcaaaccctaccaccatcaccatacccatcccacacacacgcctatcacaaacgcacacaacgcccatctcacccaccaggccgaactcgcaaggaataacacgtcccccccagccccgccgccccccacgactaaaatctaccgctacccccacacaacccaaccgccaacgcccgcacccccaacccgacgaacagcgcgtcgttcacagcaaccgccagccacgggcgcaccgcacgcatacccaccgtccgacactgactaggacactaggatcagcgccgccacaaccgcgaccccaagccggcacaattacggaacctccgccacatccagcccctcgcagccacgacataccgacgccacgcgctaacgaccaccaatgcacacggcaaggaaggtcacgacgacaaccaccccgcccaccgtctcagcgccccacacggcacgacgcccgccgcagcctcccgcacaaaacaaacgtgcacaacgcgccgcagcccgaggcggaccactgatcccgcccacccgcgcctctaacgggcgcaagcagcggg

SEQ ID NO: 15631 - DNA, 837 bp, Homo sapiens
  misc_feature (1)...(837): n = A,T,C or G
cgggaatgccccccagaaacacaaacaaaaaggggaanaaaaaaattttggggctaaccggccgaagcttgnccggtanacacacagacgcggaagaggaaaggaaaagaaagttttgacggacagggacaccccaaacactgcacagcaaacagaaacggcgcagcggcgacgcagacacaaaaccaaagaagacgaccgcgagacaaaacccgacaaggccgaacgaggaaaagagggaagaagangagggagacgacaacgaaaatttttttttcccacgacgaacccgaccacaaaaccaacagagcaaaacaaaccagcggaggggaggacacccagggaacccgccctgtggatacaataaagaccagaagtgacaagcagcccaaaagaacgagttaccgaacaggaggcacccgtcgggaggaatcatgccagtggatatagcccccgcaggcatcagcacccatgtgaggcgtagggcacggacgcggacacgggaggagcgagcgagccgccatgagcgtgcgcggggcaggccagtcggagatggcaggcaagggtgggacggtcccggagcgacccgaggtagtgcgtggaactcgcgaaacgcgccgaggcgatcacncggacaaggtcacgtaaacccgacagaggtgtgggacgccaggacaccagcgcacggcactgatccgagggcgggaggccgagagggatagaacagctaggggccacggcaatagtaccggtatacacgtgtcgaggcctgcgatgcccgtgccgcagtgaaatccaaccggaacggcgaccaccgaaagcaggagacgagagcga

SEQ ID NO: 15632 - DNA, 746 bp, Homo sapiens
cctagtggagacacaaattcactaaggagattgaacgcctttatcaaatgacaagatttttagatttgtacacaggagcgccagtgcgttattcagggaaataaaaaatgtttatttcaaaaacactccttaataatccctctgccttcacctcagagtctgattcctgggggtcctatccagtgacagagtatttaaagaacaattaaggagtctgcaattctctgaactcatagtttacattgtagagtaaatatggcagcaaatttttatgatttgttgtgttgagatatggattctggaaagtcttaagtgaattgtaagtaaaaatgagtatcttaaggagactattagcggaagaagaaaaattatgagacactatgggaaatgctgacaaagaaagaagacatctgttggtggtcgaaaacacagaaatagacattaacctctgttgggtagttgggaccatttatagcaacttttgtcacttgacaaaaacgcgcttacacccacaaaccaaacatcgaaaaacaagacttggactaggagacatccaagcgggtggtataaaatacaacctgcgcgctctacgcttgggcaaggaccgtgaccaagatcgacaactcggaatttatactccccactctgtcgcaccccgccccacaaccagtgatacgaagcttgaaccacatttgacagcaaaaagatattacccagggtcgccgaaggaagcggctctcaacaca

SEQ ID NO: 15633 - DNA, 769 bp, Homo sapiens
catgggattcaatggaataatatgtaccaggctctggaacaagggggcatgacatctggctgggtttgctggatgattctttttgattcaagcctttattttttgtgtggatggtacttgagcaacttgattcctggaacatttggtttacggaaaccatggtatttcccctttactgcctcatattggaagagtgtgggtttcttggtggagaaaaggcaatactttctaagttctagtctgttcttcttcaatgagaactttgacaataaagggtcatcactgcgaaacagggaaggagagcttgaaggaagtgccccgtcagttaccctggtgtatgaggccatcgaatataaggggcacaaggctgtggtacaagagatcagcttgacttttgcagaggttaaatcaccggcctgttgggtgaaaatcggtgcccggataaaccgctatcattgagggcgccagtccacgattacctgaccccgggggatttcatcctcgataaagcacgagacaccttgagcgacacaccaacgatgtgcccagggatcatacctcccgcttcctgaatgcatcagtgtttactgtgcagacactttacgacggcctggcgcgggcccacgctcgtcgtcggtgatgtggtcgccgccgtgcatcccgcgactaaacaccactcagcggccaagagggcctgcgccgaagccgcatcacgtggcccgtcgagacaaagatgttcgcctacgcccagtcatccgacaacttacgg

SEQ ID NO: 15634 - DNA, 101 bp, Homo sapiens
gcgcttacatcaccaggtgaacatattccccaacgggaggtctggaacaacagccgtgcacagcagggaattattttctgtacaatacaagtcactggcta

SEQ ID NO: 15635 - DNA, 802 bp, Homo sapiens
  misc_feature (1)...(802): n = A,T,C or G
atgttgttcctctccataagtncttcctggaggacgtgtgagacaccaggctgcatgttagaaacggctttgctccggaaggctaccagggtcatcgtgagggccttgcagatttcagaaatgaagtgacctgccttgagtcttccctcagcctcctcactccactgtagtctcaggagagtgaggacaacaaaactctcttctccccacattaccacttcagcgctgacctgtggcttgagaatctaatctgtgtgcaccgtggcaaagtcttggttctacaggtctcacctgacagctagtcctgatttttccatgatgtgtgggtaaaaagtgggttcttgaagggaaacctcaatgtagcttagctcttgagaaaacagtatgtgcatatgcttcttggatagaaaaagaaaaaggaatgagagaggaaaacgaagtcttatagaaaaacctggccggatgcggtggctcacacctgtaatcccaacactttgggaggcccaggtggacagatcatgatgtcaagagatcgagaccatcctggccaacatgggtgaatccccgctctactaaaaatacaataagtagctgggtgtggtggggtgcacctgtagtccagctacttgggatgctgaggcaggagaatcacttanccctggggcggaggatgccatgagccgagatcactcccttcccttcagcctggcgacagaccgagcttcctctcaaaaatataattgacaatcgaacaaataatctcgcctcgttggccttacggggggatcttctgcggcccttc

SEQ ID NO: 15636 - DNA, 816 bp, Homo sapiens
ggtgtaacactgaggcccattgaggtcatcacctgcccaactggacagctgtgaagccacagctcattcacttgctgcatcctcctgcaatttcagcacactttctcttgtgctgctctccctggaaagacagtgcttttccccaacaccaattccaccggcatcgccctagaaaaatactcacaaagaacacggggagctatgtctagggatcttcaatgaagtattgttataatggacatttagttacaacttaaatgttcaccatctgggtgaacatttccactgactggggaatgaccagaaacagaaaacagagaactatgctgtataaccatcacatgaaattctgggcagcggtagaaaggaatgaatgaatctgctcatgcttacatgaaaagagacatattgcgaagtgaaggaagtttcagaatgaagtttacaagtatgattccacatggtacagaacaacaagagatgtggggtgtttttgtatgcaagacatatacatgtatggaaaacatatagggataagggcttgaattacgcaagccaaactgatgaccaattcacccattgacaacggggaagtggtagaaaacatatattgctgatcaaggggattctagccctaattcgactggttgaattggtccacaagaatatgtgttcatgtggccctttggcggctctataaaaatctaaactaggtttgcctaaacaacaaaaaaccgccatattggcctcaacgggggaattctagcgcccctctcccttaagtgaggggttattaatagaccccgccaactgccatat

SEQ ID NO: 15637 - DNA, 809 bp, Homo sapiens
  misc_feature (1)...(809): n = A,T,C or G
atggattcatcctaggatgaatgtttcccagatcagcatcaacattgcctggtaacttcttggaaatgcatattatggaatcacattccagatctactgaatcagaaacttgcaggggagctagcggagaaacccaattaatcctgaagagtgggatttatcctctagtgaaatcttcattgaaaatccttacagtaatcattgtctactagtaaaatatttctgagtttgcaatcttcgtgaagtttgtgtactatccctaacatgtgacactgtatattagttgtttcatatatgtcaagcctatttctctagaatcaattgtaaagtatctaatcataaaatttgtgtttttatgttagcctagcacagggctgggccaaactgtgtctaataatgttgtcttgattttctcttcattgtgaagagaaaaaaaaaatggaattgcattacattttcttttgatacaattgaacattgagggcatattgtatttcatgtatttgctaaatccaggcgtacatttactcaacagcattggaaataaacaacaataaaactttggagctattatctgccattataacaataatttgacacanaattgcttgtatgttttcaggattggaacaagaaaaatatttttttctcatcagttttttccagaatttctaatacaaaacataaaactaccttccaaatttcatatttttaccacctgcatcactgtatatttactgtggattaaaatggtaagaatatcaatacagtttggtgacttcttaactaggttgggggcttccatttaa

SEQ ID NO: 15638 - DNA, 824 bp, Homo sapiens
cagacccgatggctctgcactactgtatgggctgagccgcggatctcaggctcagagcacattacacctgtgttaaactgcgcaagacccacggatccgcgtcttagaacacttgccacgctagtgagaaactgatctagactcatggatccaagctaacataacattgcagctgtgtgaaacctgagcatgacctacggattcacgctcaaaggactcgccagctgcgggacactgcgcaagacccggggatgcatgctcaaaaaacgttcctcctgtgtgagactgtacgagagacctatgtccatgctcagaatgcattctccctgtgtgaaactatagcctataccgcgcgggacacacagcatcagactaacatctacacctgctgacgaaactgtcgcgagaccagatacatccagtgtcataaagcatgctacctgagggagactgagcgagacccgatgatccaggctcagtactgcttcaacctgtgtgaaactgagcaagacccgaggtgccacctcagagagcattccatctgggtgactctgcgcgagactccaggatccaggctgataatgcagttcccctgggcgaaaatgagcaaggttgctcatgccactgttgcgactgtctcgcataacggcggacgagattgaggaggtcttaacaaagaactcaatttcatttttaatgagagaattgaatgatatcttatcctgcaagggcacacacggggcaccccaggtagctgttggacgggccaccattggcgggttttccaaaatgcacaccgggacactccggaaagcattaattgg

SEQ ID NO: 15639 - DNA, 796 bp, Homo sapiens
agctccctgggctcttccgcggtgcgcccgcgcgctacccttcgcttgagagtctcaccgtgttgcccatactggaatgcagtggcgcgatctcgactcacagcaacctccgcctcccgggttcaagcgattctcatgcttcagcctcctgagtacctgggattactggtgccgatcactgtgcctggctaatttttgtatttttcgtagatgggggtttcaccatgttggttaggctggtcttgaactcctgacctctagtgatctgcctacctcagcgtcccaaagtgctgggattacaggtgtgaaccaccgtgcctggctatagctcaatttttgtacatacctatggttattccctttgggtaaaaccctagacatagaatttttggggaggaataaaagggcattgatatttttcattgccctcaaggcactttattattcccaatataaaatctgtagagctaatcattgtcttccctgtttatcttctacagtttttttttttttttttggtaagtgtaatataaaagagtcaagtcagatagggtttgaacccaaacccgattgtctagtgcttttttcaaatgaaataaccccattttatagagatttagcctcaatccaaaaccgtcatgagtgctcagttataactataaatggtacctccacctaaacaggtaaagtagttgagtgggccatgagaaggctggccctttttcaatgtcagtttactggattgcctctggccttttgcccaccatattggtccttattggggaataatagagtg

SEQ ID NO: 15640 - DNA, 792 bp, Homo sapiens
cagaattccgcaaattaacaaatttaagactctgagaagatttgcactgataaagtctgcagtcaatgcctcctcctaacaacctatggaatttgattttgtgaaaggaaaggataatctgatgtgcgctattcatgggaatatttgttcaggcacttaaacagactgaagggggatttcagaaaatgtttgactctctttgtggtgacccttgcaacttctctcagtcaaaataggcagtggatgtcagaaaacgaggagcaaatcattatttctggagacctgagagaaatcagacccagctggatgtcttatacctcctcttctttgtcagtagactcctgaattattaagttcaataagaaaggtaagggatggaaaggattcggagtgtcttatttcaggtgtaaacctttatgatgtcttcgtatattcctgtaccgcgtgcaagcattggaggtttgtggctggaaatccttcaaaggtgacaatgtacagaagagttgatatgaatcaagactggatgaatgaagccattgctccttatattctgtctacagaaactgctgtgggtgccgtgatcagaccagaagcttcttcctacttcgtttataagtcctcccaagcattcggaacactctggctttcattttgaacgtctgcggcttgacagcaaccatgtgagcaaaaatagtccatggggcataacaaccttaaaccggtcctagtgggcagggtactgcagcctgaaaaattgacttgtcatcattttatgctacacgcggtcccgat

SEQ ID NO: 15641 - DNA, 804 bp, Homo sapiens
aatcctagctgtctctagtacacagactttggattggagtcgcctcactaagaaatctggatctgcaacttcctgtaagtatgactttggacaagttacttcaactgttgaagcacagttttttttatttctagaatgggttaatattgatcttatactattgagagaatgagttgagatgatatgggaaagcatgtagcccagtgcctgccaaatataaaaaaaaaaaatcactgagtattagttccctttctccttgctagaacatgcagtcaattgaaacagagttatctactacaaatgatgcagaaactacagaaagctttcccctgcatagcaaaatcccagtgtgactcccataaaacagatttgaagcagctctacttgccaagcgattgagggacagtcctaagtgaggctgtcaggagacaaggagtatgagaagagaagagaagacccagcaccaaagtttgagaaactccaaaatttaactcgcaggtacaggaggatgaacctgtgaagaggatgagaagaatgggctggtaggaaaaaacagatgacttgaagctgagaagagagtgcttaaaaaagaagtcaacagtgccaaatgctggcccacaggggcaagcgggagaataaagagtctgctgtcttttgggatataaatgtcggcgtgggcccttcatagagctgttctgatggaatcctgggggtagaagccagactgtagtactttggggccttagaagggaaggatagacttaccttctggaaaagcttctcgccacctggggaaagccaaaa

SEQ ID NO: 15642 - DNA, 798 bp, Homo sapiens
cctcctaggccctgctagagcacccattttagtgactagatgcatccgccacagaagatgacaagaggagaaacactggaggagtatatgaaggcataccatctgaagctgtcagtatggtgtccagtcaaacaaagacggttcggaaaaattagaagaaaataacatcatgactcaagaatcaagagcttgctcatcagtttggaaggaatttggctccgtgggacgttgtattgtgcacagacatttccaaggaaattctaaacagtcaccctttttttttgcattcccccaaatcttaagtgtatacataaaaccctgggtacatattgttgtggtaatagaagggaattggttaaacagtacacttgtttatggaactttctgtggccacctacgaaagacaagttaacaaactgtcattggaggctgttggtgcccagccagggccgctgcattttgacaacatttccaccctggccactcagcacatttcatggaggccatgtcttttcactgatacttttttggaaggttctatgtgacgaatccctgctctatttataacccacgatggccagggtctttaaatctccgcccctatataatatatttggatgtaacacttggcctttataacttcccttcctctctcgcccggccagttgtgaaggcgccccccaccctcctctccgcatttcacttacttctggctaccaactccatcctcaatctacaacttcctcctctaagaacatgcggagataacacgcgtctccgccacagccgcagcgggca

SEQ ID NO: 15643 - DNA, 799 bp, Homo sapiens
tgaacttctaggacccttttatgaccctactttactgaattaattcgtggacctcgaataacgacttgaagaaatcatctgttgagcttgctcttatagcactcttccaccacttggcacttactcactacctaactggcatttggtttctctcagtgtggtttatttcagtaatcttacctaatgaattggattgaccatgccatgatccaatcaaagccatggtgattggctgtcttgacaactgggaaaaaatattgatcttattctggtcaattggttgatttatatagagataggttaataatgtcatcagaattgctcttatcagtatcattaagtccaagtaagcaagttgctaagctgtgagcacatctgtaatctttacattccccttatcttcccactgtctctctcctaacaaagtgccttgttcacagaaggaaattttaaatggttaataacctaaaaggtctcacaaaatggtaatgatattttctacgatatctggagcaaagcaaaccaaatattccagttattatttttaacgccacccatgatttttttttttcttaacccattgcatatagaaccatgcgcacaatttatacaaggatatgttggcctgatgtgttgaccctaagatgataatactgccccactcatattcaaatccccatcaccctcaatggaaaactctaccttttagaactgttcggccaataacatcctcccttttctaagcatacgaactagtttaacacgccttttaataaattactctgttggaaatgggcaa

SEQ ID NO: 15644 - DNA, 809 bp, Homo sapiens
ctagaccaggaaccaaaagaaccaattagggaaccattcatacttcaagatctctaataagaagtagcaatatttaatatggaatcaaaagcttgggaatcaaataatgaagatcttttatcaagtagtggtgtcacatctaatggaggttcttcaagttcattttttgtgtcatctattcgtggtacaataattgaaaacacatcttcagctgggactttgacacaggttccttttttccctaaatatgaagtggaacttgattctcctaggaaaatcatcccatctcctggaagggaacactttgaacgtgttttggaagaatattcacatcaagtcaaagatttacagagaagactaaatgaaagcaatgaattgcatgagaaacaaaagttttatttgaggcagtcagtcattgatttgcatacaaaacttcaggagatgcaaatggagagagatgctatggctgacatcagacgaagggagagtcagtcccaggaggatttaagacatcagcttcagaatacagttcatgaacttgaagctgccaaatgccttaaagaggacatgctgaaagacagcaccacacagatagagcacctacaaaaaatgatgcttagtcatgagggagtgcttcaagaaatccggcccatcctacttgactttgaaaaagcctacgccaaaaaatatgtgaacatgacagcattgttactcttcactttccgaagcttgggctcagcttttcttaaaatacctagaaaaatagacccacagatttctcattttaagggaggatttttccgtagagg

SEQ ID NO: 15645 - DNA, 811 bp, Homo sapiens
  misc_feature (1)...(811): n = A,T,C or G
cacactcccctcccttgtggcaanannntttaaaannnnnnnnnnngctaatagtggaaactgaaaccatagaaatctcttacctgcccatgctcacatgatgacagtgacccgatcctgggccctctggttccaagcttggtgctctttccaccaccacaggcaaagccatcacagcctctgtcatggatgctggataattgggatccgttgcacaacctacattctctgaaagatgattgacatccctgcagtttgtactgtgtgaaagtggccacgttgtcaaaacctgggcaaacacaaccttctcaaaaggttaattggaattcagttgaatacaaagaacgaagagtttttctcacatacttttaatacacagttttaaagttatgattggaataaagtattttatctagattagcactgaccacttatggtagccaccagctatgtgtggctatagagcacttggaatgtggctaatccaaaataaggtatgctgtaagtataaaatatgcaccagacattttaaaattgttttattaagaaaatgaatgcaaaataactcattaatttttaactgattacctattgaagcaataatattttggacgtatcggattaactaaaatatgatagtaaaattaatttactttttttactttttaatgtgactactagaaaatataaattacatgtatggcccacatatttctactgggcagctttgttttaaaaagattagagggtgagcttctcaaccagttattaatgtatttgaagttactagagatgttttatattaccgatg

SEQ ID NO: 15646 - DNA, 779 bp, Homo sapiens
  misc_feature (1)...(779): n = A,T,C or G
cctagactaagagaaggactatacactgnaaagagcaatacgaaaactttctgcaagccaagattgaagcattattcagtgtggggtcaactttgggtcatgaacaaaataattttctcaacttcaaggcacaaacaatgggcagtggtgaatctcccaagttaggtacaaccatatacggactattctcagtgtcctgctgaccttctcagggaacgctcattcttctcattgagcatttattctaaattacttatggtatatttagattaggtagaattttctttgctagcttgagcacatacatattacctaaaagaccatttgtaaggtaatacatattcacaattcaacatagaaaattttaaaattgttatagtacaaccttttgtaactcctgaaatctgagtataaagagaatttcttacagcttcttaggcagaaagaaaaacttactaacaaaggaaatcgcattaaactttcatgttctcttctcaaacattagaagctaaataagaatagagtagcatctatcaaccaatgagagaaagggtcagaaatgtaaaaccctgtaacagtcaaagtaaaattcacctgccattgtaaaataactcactgaagtgcatgcgagaactcagaccatatttcattcatcccttcttgtctatggataatgcttgggagaaagatcctgaccctgatacaataaattctttcctaaactacaaggggagaaaaaattataaatagtaaactttacctcataaaaaaaaaacggg

SEQ ID NO: 15647 - DNA, 782 bp, Homo sapiens
cctgagaacagagatgaccacatgtccaggaatgttcgtaaacattttctcctctacgtggatgaaaaccttccttcagtagaagagattgagacaggcagctgtgagagagagcatgaggacattgcctgagttcctggattcatctgtccctgaagctggactatgccccagacttccaagctgaaaaaaccagtatagtcctgagctttcattgcttatacttattcaagttgggtttctgtagctcaaagtgtcctggctaatataggaacttctgcaaaatgcacaaacttggcctccaagtctggagtttctgatgtggtaggtatgaaatgtagctgaagcatgtgtattctttttaagcttctctaagctctatatcctggctcaaattgagaaccattgctttttttttctttttggatttcaaattcacaggacaaatttggtcatattcagttcatggtatgttatcattattggttcatgcaatgtcaacattcctctcttattttgctaactatattttattgccatactccacctccctgaagaccacaattctagtatatttaatgaataacttttttatgtgtttctgtaaaatatgttttgttgctttctgtgcatgtttttctcagttataaaacagcactttggtatataggtcagtctgttcttacttttaaaaaattaatatttatatcttaggggaggtttaggtttatagaaaaattgaacaaaaagcacagaaggatccttttaatataccaccctgg

SEQ ID NO: 15648 - DNA, 1017 bp, Homo sapiens
  misc_feature (1)...(1017): n = A,T,C or G
ggaatgtgaaagcagtctaggtagagaccagagaaaaaaactagaatttctgagttccttgtttgcctgaagtccagacctgccaaagaagaaaactacctgtcagtgcttttccctgagtttttgcttaacatgagacctatacttgcagagagaggaagacctaaaatcgtgtcaacaaacgcaggacagaactttgtgtcacaaattcatatttccattgcggtcggggccgaaggaggacatggcgcctaagaccgatcatagtgttctctcaacgaccacctgttctttcttctctacctcgggtttgcttatatggcccctcggaccanaattgaatcatgtgtgtactgcattccctactactagtgtgttccactttgcctcagcaaggctttatactggccctcacggcaggcatgtgagcacctggttatctaggcatgtgatctcctgtattctggcaaatgagtcntatgtatggctaggaggaacggattttgattaggaggtatagccgttgatggtcctatgatcccctgtgtgcttaaccgcgagtctaggagaattcatacgctggttcttcgtgtctcacaaaagagttggagtcgagcggacgcaacagcttacatggttcctgatgctcttgatactaccagttctacacaggacgtaattggtccatatatgtgctacagagttatgatgaatcatagagactgaagagtagattcatgtactgatatcggcattcacgaggggtactagagtgtaagatatcgtgataacaatatgcgtcgatagtcgccctaggaagagttatgtcgagctgtagtggtaacgtgctagtctccttctggagaggcccaagatgacgaggaaactatagagttgcgtaaaactagttcttagggaattaagggtagagagtnnataatagggttgccacgtggaggngagtgatggtcntcacgatggggggaagaggtattaaataggagaagataggtttag

SEQ ID NO: 15649 - DNA, 839 bp, Homo sapiens
ctaggaccagcaagcctgggacctggtgggaacctgacaaatcggaacctgacgaccggaactccaccacctggaactccaccacgggaactctttcagaagcgaggggtccattggttaaaaagatccaggactaacatccacctcagcataccttaccataaatgacatgtacagatgtttaaaaattcctctttgaagaaatacccccactccccgcattgggtggagaagaaagaaagaaaaggaaaccaggaattcagttgcttttttcttcagcggctgccagtcacagctccctctctctgggtctgagtccctcacaggaaaagagaaaaaagaagaaaaagggctttctgcccacaatttgaattacccccttttatgaccatatctcttttccctactgaattgatatcttcctgtgccacattttagccttttgcaaaaacttgccagaattaataagaacggagaccaattggatttgcgaactctcaaagggaaaagaactccgcacatattgaatttaattgtccttgttttatgaatgcaaaatatgccccactcgagattccgccttcccttggatgaatacaatggggagttctattaagcattagtgggagcattatatacataaatttcagggttcaacacttgtctcaagtcccttttccttttgaaagcaggggaactctcggcccccgaacccccggactttgtgtcttttaaaatataggacctcgggcccccgtgtctacgtgggggacaataaaatttctcaaagtagttccccgttgctattaaaaggtataacgcagactttagtgcgctcg

SEQ ID NO: 15650 - DNA, 792 bp, Homo sapiens
ctgggagagaaacctttttctgtctggtgtttttcaaaattttgatgatggactcacatcaaggatgattagctttgatgtcatttgaacaccaccaccatcaccaccaccagcatcaacaaacaaacaagcaaacaagcgcgaactcaggagccctgtggcccagcctccagtccatttcctcactgtgatctggctaagtcacctcccctccacctcagttcagtcacctacacaacaggaatggtggctcctggcgtgaaaagttcttaggagcattcagcatgatgctgtgtgaagcacttggaaactgcgtgtgcaacacctcatatttctggccacaggtcattcagacatctgccctttgccctggaggagaaccactagggacttgtgcccataagcaccaattctggcttttaccctacccatcctttgccatcccagactatgccatcaacaaattctagaaatcaagttagaaatgctgttcccacgagggtctctgtggtctctcagaacaacaatcagctggccctgctgggcagatgttgcccaatcctaacccacacttagctatcaacttaatcattctcaactaaaaacacctacctgaacacttttaggggggtaagaatagtataatctcacttagccatttgcattttttcttctttttaccaaaagaaatttatctttttttttttttttgggaccggatctttgctctgttggcccaggttggaatggaaggggcccatctttggccaactacaagcttccgcctccggg

SEQ ID NO: 15651 - DNA, 880 bp, Homo sapiens
ctaggaagaacactgagtaacacatgtcatcctaagtacacagaaacgaagacgatgatgcaccaactactactgatttacatgggaagagagagagaacagcactattaccttcactaataatatcagagcaatgaactactaggatcatccagacttcccttacagatgattccttaacaaggaggctaattgctccatggtcacaacagactgttaactctatagacatcattcccaagtcccatgcaggaagaaaataagacagggagcattggctttctaatgcctccctactactcagaactctctgagcactgtattcacttgctcaccatatactccaggagctagtacggcattggctacaccacacgcgcgcaaggacatatacaccagagacctggctatctcagatctatggcgggaagagaccaagagactggagggaggactgtgacatcactaccccaccgtaaccggatgacaatactggattagctcccgggcaaaataaaaatttacttacccgggctaagttggaaagttccctaggaaccaagtgagtttctaatgcccatccctctaataagaaccgcgtcattttaggggtaaacagaaggaaagaaggcacgggttaaacctttggtcttaacttacaagcaaagaccaagctcctctctctttgaattgaaggtgaccaccatggttaccaacttcttcccttttctcaccagaaggacaatccacaaacagacctgcggcgcaagatgccccaccgataaaaggatgattttgggggccccttgcctattgttcatcatcatggtccatacaagcccacgaattaaaatagaccccccccaactcccttagagat

SEQ ID NO: 15652 - DNA, 810 bp, Homo sapiens
  misc_feature (1)...(810): n = A,T,C or G
cctagattttagcattatagtttgaatgtttctccatgcccagttcaagaaagaaatcactcctgttttcttctttgacttacttgggttatttttttacacttggttgtctgattcatttggagtttgttctggtgattggtacaagacatgaaactactttttttccaaatgagtatccagttgtcctaacatcatttacttttaagccattttttccaaaacagatggaatctgaggcctggaatttgttctatgtgtgatggatgagctgagatgccaaacagggagcaatgggccaatccacagattggcagtgacaagaaaccactgttacctctaggctaaagtatccaaggcaggaaaaaaatgttcctgaagtcctgggtttgggcccagcaaacaaatgctaanatcatggtagtctatccaatgagatctgaagccatagcagagctccagcggcttagctacctatggagaaaggtgtagagatgccttctttccttctggccaccaatctcccactaacgattcccattggcaaaacccagatggaagcccactgattagggagcctgagaaatgccatctaaagtttacccttttggcaaaatgttacaaaaatgtgtggaaaagagaggggacttttcttatggcaaagacccaccagaacacttaacaaaaaaggttaaaaagagccaggccccccgggttacaccggtaatcccagcaggtttgagagaaccagattgagttttactttggttgcccagcttggacaacatggggtaatcttggttatttgaa

SEQ ID NO: 15653 - DNA, 1113 bp, Homo sapiens
  misc_feature (1)...(1113): n = A,T,C or G
tgttgagagtcttagagaaggtcagatgtgagcgcatcaccggagcagaggtttagggaagagaaacgacaacacacaagaactttaanaaggnagnaaacgccatcgacgcaaggcagnagagcccgagaacacgagcactgtttgacagaccggcggccacacaagccacaaaaacatcacacagacannccgctcagatccagcncacacacggaacgctcgagccancacgacgccatcgacgcgcacccatgtcgtcatcgctgggaggccctagcagggacccacaaccgttgccactaactggccctcgacttttacatagacgcacaaactatccccggccatgaagcatgcccaacaaaatatctctagcacgccgatgcaacgtaacaccaacgaagccaactcatgcattccagtcataataggtggtcaacaaaggacacagtcgccccacgctctctcgttcctcacgcagcggtcccgccgtacncccgcggagcagcccagacgaggtatagacctaccgtcaatcccacgcacacggccatacacccccctcagcgctagaggcctcgcaataacgtgggactattatccgggcaggccccgcgcctcgagtgcctccccggagatccactcgtacaaggcccacacgctcaagagtnccagcacggtgtagagttcatgagtcgccgagattccacagaagcatcaagggtacagactgcgcccagcatccgacgcaacacagctaactaattaacagctatgatataccctgcgctgagtgtgacgtctaccccggcttcatatctccctccgcttcaccccgctaccgcctccgcggattggatacctagcantgcgtgatcccggagaggacncaatcgaaggtggcggatggagcgtccgtttactcgcgaagagggcntcacgggccgcagacactagaggacgggggtgcgtctaaaggctcataggttgagagtatntaatattcctatagaacaagtgaaggnacagtgaagaagagncggagaaggcattggaagaaaanntatagaagggtnaagaagtancatgagagtagcatagaatctncat

SEQ ID NO: 15654 - DNA, 790 bp, Homo sapiens
ctaggacccaacgtgaccacctggttttacttcaacagcagagcgactcatacagccggcagtccactttgttcttctatagatcctagcctgtggtgttggatctaacagcttcttccctgacccaagattatgaaggatttctcctgtgttctcttctaaaaattttacatttaggtacataatccattttgagctaattcttttaaatagtgcaaagtatggattgaagttctttttttgttttttttgcagatacatatttaatttttccagcaccatttgttgaaaagactaatgttcttgcctgaatagcctttgcattgttgttgaaaatcatgttcacacatgtacactttccactgatctatttgcctctttgtgaaaatactactattttgattaatatatatttatagggagccttaaaatcatatcttaagaagatagtggaagttttttaaccttacttttgcttgtaaaattggttagggtattctagatctttttgtgtttcatataaattttaaaatcagtttgggaatttatttaaaatttccttctggggattttgatggacattacactaaatcgatggattcgtttgggggacaactgacattttaacaatattggagtcatctaaccatatgatccttgaaatttgctcctttatttagaatcttttttacaacctagaacagagggtttcgggttcgaagtggattagggttcaatatatataaaagaattaaccctaaattttaatgggttggtcgtttgggattat

SEQ ID NO: 15655 - DNA, 843 bp, Homo sapiens
  misc_feature (1)...(843): n = A,T,C or G
gtgttttgttattgattagagggtaggggtgggggggttggnacttcanagaccagcttggggctcatgcctgtaatcccacccctttgggaggctgaagctttttgatcacttgaggacgcgagtttgagaccagcctgggcgatatagggagactcgatctctactaaaaactttttaaaattagccaaacatgatggctcagacctgtggtttcagctcctagggacgcttgggccgggaaatccctcgagcctgggagtctgacgctaccgtgattatgctgctggattccacgctgggcaacacagcaagaccgttgaaaaccatatagatccagtgaccttgtaacttacagagtggtcggtgtttggcgtgagatggcgatgcgcttttctcaacgagctccatagcgtagggccccctgaggttacagacagccctgggtttttgtgatttacccggtcgtcacgttcccccccctggagactagccctcaagtgtgcactatgccaggatattctcatttatcagtgatcttgcacgcgagaaatgagcctgttttcggagtgtaaacgccggttggtactgtgaaagcggtggtgggtgatccttatcctcacttgtaaggtttttggattgctttaaggacactggtgtcctgcggtggatgtatggataggatagagcgggtttacaggtagaacctggagacgtgttggtatgtgtgacactggttgttttcgtttcgactgttgtcttctgaggacttgttatcatggggctctaagtttccgtgcggtggccttggggtgttggttctccgctgaggactgtgagcga

SEQ ID NO: 15656 - DNA, 784 bp, Homo sapiens
  misc_feature (1)...(784): n = A,T,C or G
ctaggcttgagcaaataatttcaagctagggctgggaaacacaaaagtaaatagtatgaaatgatgtcagcaataaatgggaaaagagtagggaactcaaaaatgaataagctggcaaaactgtcaggagcaccttttttggaaactctgaaactgataaaaaaaactcacaaaatccaggggaacatgtaatgaagaaaaaactgctgaattttggtaagagagttctgtggtcatcttctattctccaagttgtcagtggccttgaagatggcagccacatccctggtgtgggttgctggcaccagagggagcactatggaccttatcctcaaggaattgtaggtgtgttttgacctccctgatggtttcctgaaggttcaactcaacggcttgcctttgtttcacctgcctcagagcttcctcanggctcangcagcttcccaggcagtgtttgtcaaaaacattaaaggcaaacagccagtgtcacagaaagcaaggtttgaaagccaggacaagcaataaacagaccaaaaattctgggaagggagaggctggaaaagagatagttgggggaataaaggcttgaaagcttcatttattttggngaatctagaaggccatcgcattccctggcctggtgcttactcaaaaaaaactaagaacaccgaaatttcaccttgactgaccgtagcttttatgcaacaggagggaaaggttaaggggcgttgaaactactcgttaacattgaagggggccaaaaccatagttactggcaagatgg

SEQ ID NO: 15657 - DNA, 799 bp, Homo sapiens
  misc_feature (1)...(799): n = A,T,C or G
ctggaggcggttggagctgctgtccttgccaanagataggcagacacaaacagagcggcaccattcagctcagctgtccattggctgggctgtcagggtagatggagtccatgttgcctctcctggtcttggactattggcctcaagcgatcatcctacctcagcctctcaaagtgctagcattcaagctcacaaacaagagttttgaacctaggcaggctaagcagtgatcttgaggactgaaaggggaaactgctgtcaattaataggacatcaaacacccatactctactggaaaaatgtgtccacagacatttgcttgagaggaggaggtggctggtgaagagccctatggttgctctcctgtgtcttcactcttagcagctacaacatgcacaagattcagtgcattcaatagttagttctcagcatcctgtgaactggcgatctatttncagaatgatttagtgcagtttcctctaagtccatgctaaaagaggtaataattaggctcaggagcattaaacttanaactgggggttctacttatctacaatgactgtgctaattagggcctctcataaatttctctgacatacttcactctacaacctcgagcccttacctcatgtgttcccctgggatctagaatggggctggaaaaccactgagatgggaagcctctaatcctggactccctggaggaagagtaattcacttaaggttacgggactcttatttaaacatattcaacatgattttttttttttggcctaaccggtattcagtcaatcggtag

SEQ ID NO: 15658 - DNA, 790 bp, Homo sapiens
  misc_feature (1)...(790): n = A,T,C or G
gagacccagtgaaattctcttacctgcccatgctcacatgatgacagtgacccgaacctgggccctctggttccaagcttggtgctctttccaccaccacaggcaaagccatcacagcctctgtcatggatgctggataattgggatccgttgcacaacctacattctctgaaagatgattgacatccctgcagtttgtactgtgtgaaagtggccacgttgtcaaaacctgggcaaacacaaccttctcaaaaggttaattggaattcagttgaatacaaagaacgaagagtttttctcacatacttttaatacacagttttaaagttatgattggaataaagtattttatctagattagcactgaccacttatggtagccaccagctatgtgtggctatagagcacttggaatgtggctaatccaaaataaggtatgctgtaagtataaaaatatgcaccagacattttaaaatttgtttattaagaaaatgaatgcaaaataactcattaatttttaactgattacctattgaagcaataatattgtggacgtatgggattaactaaatttgataggaaaattaatttactttttttactttttaatgtgactactagaaaatataatttccttgtttggccacatttttttactgggcacttttgttttaaaaaaaattagagggtgagccttcttaaacagtttaatttatgttattggaancttacttgaaggtcgattttatattttaccgcaagtggaaataaggataatagaggcgccttg

SEQ ID NO: 15659 - DNA, 798 bp, Homo sapiens
  misc_feature (1)...(798): n = A,T,C or G
ctttgtacccagtctggagtgctgtggtgtgatcacagttcattgcaacctcgaattcccaggctcaagtgatcctgctgcctcggcctcccaaagtgctgggactataggagtaaaccaccatgcccaggctgttgctggtttttaaaattttatcattctgacggagttttgctcttgtcatcctggctgaagccctgtggtgcaatctcggctcaccgcaacctccaacctccacctcccaggttcaagcgattctcctgcctcagcctcccgagtagctgggattacaggcgctcgccaccatgcccagctaatttttgtatttttagtagagatgggatttcatcaagttggccaggctggtctcaaactcctgaccacaggtgatccacccaccttggcctcccanagcactgggattacaggcgtgagccactgcgccttggccttttgtctggttttaattggtttttttaatatatatttaattataggacttctttatatgtcctttgcccgatacatggtctttgaatattttctcccaatctgtgggttgccctttcattgtgctaagggaatcttttgatgagaagtttttaatttgatgaaggctaacttaccatttctttctttttatagagtattcccttccatctggctgagagagcttttgtaattccctaagtcataggatattattctcttggccaaagagctttgggggtttngacttttaccatactggtctctngaaccatcatggaattaatttgtggtgttgggaaagaaaaa

SEQ ID NO: 15660 - DNA, 797 bp, Homo sapiens
  misc_feature (1)...(797): n = A,T,C or G
ctggtgcttgattcccttagccttccccatgattgtaagtttcctgaggcctcccaggaacttcctgcttcctgtacagcttgcagaactccatgtgaagaaggtgctgacttcctcttcaccttctgctatgatataagtttcctgaggtctcccagtcatgcttcctgtacatcctgaggaactaacctatgggaagatcaagaaatgtcacttctgagaaaaaaaaatgtctaatgcaaggagtgaagagagctttttatatcttacactgaccacaacacacagttcagaaaacttaaataaccctaactaaaatttgaaaggtgcttcaaagcatagaaagtaccttgacatgtgttttcccattggattcttataaacctataaaacggtgcttactccatttcagaaatgagaaaatggcgacccagaaaataaagcagcatgcacaagactacatgctacacaggggactgatctgacaccaaaacttgactgcagattgtctgctttcaactctcaccagcanaacagacaaaagtgctttggacatgcaagtgtttattatgttgcattttggaactccagacctaaaaccaaacatagacaaatataaaaacaaaaccaaaaaacactaaagatcaaacccattctcaaaccccaacacccagaaaataaaaggaaattattattatttttttctcaaggggaagcaagtggttgatttcattggggaattaactctcaacccttgatagaacttatgggcttcctggatcttcccaacccaggct

SEQ ID NO: 15661 - DNA, 860 bp, Homo sapiens
aaaattaaacacatcctatatacaatgatcgaacttccttcttccttttaacaaccgacaattgcgaagtagccaaggtgtatctggaaacctgcagacacatataggcttctagcaaattcaggggaagtttgtttacactggggcaaaagtattttcagcaaacttgattggacaaacgggcctgtgtcttattttttggtggagcgggggccaacaagctagtgaagccaaatcgtaacttacagcaagcagcatgcagcatacctggctcttcgctgattgtaaataggcattgaaaacctgaacccggaaccacacgtcttttttttttgcaaaccaagcgcgatcataggtgccttctaccagggggggccccgacaacacaacaccagggtctaccaaaaaaaaaaagagctgtggatcggacgctccaccattcggcagtgcgcacctaagcctcacctatcccgttcccacttaatttcatggcttcccgctaaggaatccacacacccaacctcaaactaataacggggctgtgaagaagcaacggaaatcactgcggcttaatcctaagccaccccgccctgcgcgattcttacccattgatcccctatatcccgttcatttactataccccctccccatatacacacccctatctgttccactacaagtaccattaagacatcatcacctcgtaacgttgactggtcacacctctccctataccaaatacatgtcgaccacgtagacccacataaggagaactgtgcggtcagccgccgcgatgccgcacatagcacattctgaatacaaattacaacgagaggtcaccgtaaaagaaacaggactcg

SEQ ID NO: 15662 - DNA, 1127 bp, Homo sapiens
  misc_feature (1)...(1127): n = A,T,C or G
ataaaatttacttaaaaatatcacccacttnctttaaactacagaaatgacatgctgacatgctattcacatgtgaatacaacacaaggagccaaaacaatcttgaagaggaagatcaaagtgggaagaagcatagttcctgatttcaaaacctaccatgaaaactacagcaatctttttataaggcatagggagccaaatatagatgaatggaatagactgtgagagactaatatataaatcccctcacatcaggttattcgagaccccgaattctcttgtatacgagtcgcctagtgcacacctcttctcacagcgagaacagcaacaccgtctctcttttttattctatatagtatggcntacggcgcaccagtacctagtgcctatccgtccagtacatatcacaagtcgaggggcctccacacctncctcctaagcatctgattgtctaatagttgtactaacagaaaataaaacaaaaanatcgtggattgtattactgtcactacacacngtactccatatagaaacaatctaactaaacatctcctttcatccacgtaatatacacaccgattcacagacttgatacaatgcgactcgtcattgcatacccacgatacactcatattatcttatcgcacacctatagcgttacatatccaataatacaacttaatatttatattaattactgccacgtattctaatcacggctcttcaaacctatatactatgtatcccctttccactcccgctcatcgcttcctctgttatcggctcaatatatccacggaagttctccgctacaccttatatctcttttactactcgctccacatttatttgcttcttcccaatgtcctgattttcagatcaatattcactctgttatctgttccgtgcacccgtcgtgtaactttatatatctgacacctcctctgtacattattaacttaatttcactccattgtacacgttattaccacacacatcattaatgagttcttattcatattctatcacctctagtactcctcacctactttatccatatcattgtataccttactttatcactattatcgttntacatcttaccatgttacataacatatcattgt

SEQ ID NO: 15663 - DNA, 544 bp, Homo sapiens
  misc_feature (1)...(544): n = A,T,C or G
tgacttgcacagctcgtcaagaagtttgggcccctctcgccaaaattaaacataatttaaagaccaaaacttgaatctccatgatacctttccttttttactagcgggcaactattactgaacaaggaatacaggcatgacttgagacacccaaattttatgcgaaccacttaaaggtccctggtccaccactaacnctcctaacagtcaggggccccccttaatgaccctattccaaaaaaaacccgccctcctccccaacccgcagagcctaaactcccaccaatccatccctggtcagacaacccatcccaacaccacaacaaaccgccccgcaccaactcccttagccgctccgcaagaacacacccccacccaaccaaaaccacgacccaattaacacacagccaaacccccaacacaccacccccgaaaaacgaccacaacgactaactccacccccttccgtacaccaccaacgatcgacggcgtatgccaggcagcatcccacatgccaatgacagaagggccggcagaaacgatc

SEQ ID NO: 15664 - DNA, 280 bp, Homo sapiens
  misc_feature (1)...(280): n = A,T,C or G
ttgagacagcnntttccggtttcacagcttttggacacaagttggctaatgggatgacaatatgggacaaatcactttgcaaggatgagctgttgagagaagcacaaaacaatgaccctgctctgccctgtatttattcggcaatgatttttttaagaaggagggcgagacaacaaggnactcnaaccaagagcgaatgtgattttgaagactttattgctgcctaaaattctattataagttacttagtgggaggctttctaaaacaaaaaaaaaaaaa

SEQ ID NO: 15665 - DNA, 648 bp, Homo sapiens
  misc_feature (1)...(648): n = A,T,C or G
ttttttcggaccgcccggggacaaaatcatatttctctcttcaatgaactcgcaaccttagaatgcatttattcaatcaccttggaaagccatggcggcagcagagaaattgcttcatcaccattgagattttttcctctttaaatcacgaccttatatatactgcctttccttgggcgccgcccactgataacanatacattttatattcaagcataaaacccgtcgcgctttttcgccttaccgttcgcattctcacagcctcattacttcagaaagtgacgatttcacaatgtttttttatttactcaatttcctcctcttcccacatgacgttaccctgttccattcatgtttgtgcgctgtttctccctctcttcttgaggtgggcatccgcccatccatctgtttcccgtatgttcccattatcccaaaatcctccatacgcctcccccttaccctgacctttctttgcccttgtctctcggtgtattctgcacagcttgacgattcgacccaccattgctaagcctattacgtctttcacattgcaaacctatggagtaatgacgaccttcccctgtttctgcctgtgagcatacatgggccgtcttacacaatatgtgtcctcgtaggcctggttgtgct

SEQ ID NO: 15666 - DNA, 787 bp, Homo sapiens
  misc_feature (1)...(787): n = A,T,C or G
ttgtctgtaacagcctccacccccacctccccacctccagtcttggggatggactctgacaaactcaccatcaggaaacgcaaatgtttcccatctaggatggaagaatgggattctgaactttgtttctttttctgaaacggcggcccaaaaagtaattgcatggctgggacagatctatttaaattgctttgaagttttcccaggaaatccccacaaaattgtgcaaccctgggaatcgtcgtggaaaaaaaggcatttgcctcctttggcagagaaccacaaccataccaacgatggggtccgtaacgaacctttttnccctcttttttgatgaaacttatttaaacgggtgtcccttttttcgtccttgccctctctttctccctgagtaccgttcttatcctattgtcattgcagatttttttttatttttcgccatttcattctcctgaacccctataatttaacaataatccgttctacacatttatcacgtaatatctcatactcacactttagtttgtcttccccaccatcgatctattttcgcattatttgacgttttcccatattattttcttactcacgcccctttttttcatcacttccttcttctgctattctctttatcttcttcccttctttctgttatttcacccgtatctactacctttcagtttttaccttaactaccatacttttttatttggtttctagactattatcccctcatttcaaatcctttacatctttcactttatttaccatctttttattcttcatt

SEQ ID NO: 15667 - DNA, 825 bp, Homo sapiens
  misc_feature (1)...(825): n = A,T,C or G
taattccatttttagttantanncccaaanntttcccttcggtctgtttgtgcacacctatgcttcatgttggaccactattgtccctctgcccatctacaacttaagagtttcttgaaccccaaaaagcatgactaggcttaatgaagatagtcagttactaaacttacttttattactctatgggggcccacaaacatatatgtcatttttcctgcactttttggcaaacattttgttaacaaacatttaaaacatgtttaaaggtagagataataattactcactcccctcccaccttctttttttttaacttctacagctgngaacatatgatccaaatgaggggggcccccactctcacatctagctgcgccgggataaaaaaaatcacgctcggatctcccttccttcccttcatcactcctgccgttcacatcaccttaccgcgaccttgtttaataaggagtttataactcgcaaccacgtacaccacatatgattgccaaggtccctgccttatattaaccctccttccaccattaatgctatcttttactcacgccccatccgtatctttcccttttttcccttaccccactccacagccttaccccatcccatgtgcacccccattcagatttccatcacaactagttttatgccaatcctccattccttgtcattccccaccgttaccgaacctagtgacgttgttagctgtacaccccctgatcgtttcatttccagtcgtttccgttttgcgccctctttccttccagcgaccactgacacttttctttcccttcctatcaatccactgcg

SEQ ID NO: 15668 - DNA, 833 bp, Homo sapiens
  misc_feature (1)...(833): n = A,T,C or G
gttgtctatagtattaagtatttcgtncgcgccgcctttttggcctgtcgggggaggcttgtgtccacaaaatatttgtgattggatggagcatactgtacacagccatgagatcctgaacttgttgctgaagcgcgcaaaaggtctgaagatccaacccacatatggaggaaagaggaataagtttttagaagaacatccgggccacacacatagcccaggaatgggggacctggaggctgccggatccctgaatttcctgttattaaaaaaagataaaatttctctattgtttaaaaaaacaaaagaacacacatttttttttttttaaaactaggcctccttcgcctcagccgtggaggtggggggggcccctttcctttaatgagaggctggtctcaagaaaaaaaatcggtcgccttcctgggtctgtcgccttggttgcgtcatggtcgttttaccgcttcaccatgtggttattcgtctaccaccttcgcttacggcctcaccttcttctgcccctttttcttttattttttttctctggtcttcagtctttacttactgtctttccatccaccgcctgcgtcgttgttccctttgttcccctgttgcgctacggttggcgttcgccctcccttttttcacctcacgttccagtatcgtttttatcacggttttacccttccgacctgtcttatctgtcctctcctctcgactatcgtttcacgttgtcccttttccgccggcgtgtttcttaccttctttaccgttttctcctctgtccttccgtgtcctcgttacccaattatggcctctagtgatacttctcg

SEQ ID NO: 15669 - DNA, 841 bp, Homo sapiens
  misc_feature (1)...(841): n = A,T,C or G
aagacaatgccatttccattatgtacaacacannnntttcaacacaagctggaatgctggggcacaatcacgggaactcctggcatcaagcaatactatcatctcagcctcctgaatagctgggaccataccacaagccctgaagaatgtgagagcgctaggatgtggctactgtttttaacattggggcggccaacacaaaacaatctgcacatggctaatcaagagaagactgcattttcctattttcgcctatatcataccaagtgaacgttcgacatttaccctataatgatgataaactgtttttttggacattccccattctcccaaccacccttccgactgggggggcccccctaagtttgcacttttcagaattcaaaaaaaaaaaatgctgcacctacgcgtcattgtgccattcgtggacaatgcgccccgtttgcccatcaccatattatttcgatctctcccctctttgccccaccagtccaccacttcctcgggccattttcgctttacggatggtttctactatacacaccacagtatcttacatgtttcatccccgctcacccttcttgctgcgcatcaattcacattacaccgataatttacgcttaactcgttccccttttagatctccgtttctttttcctgtatcgcaccgttttacaccgatgctacatacggtagaatagcaacccttatacttgccgtgttaacagaacacacatccacaacactccgacttacatttcattccatacccgttttgccccatcatagcaatctgttgcctacttaaactttttttatccataaccgccattcgtcaact

SEQ ID NO: 15670 - DNA, 742 bp, Homo sapiens
attcaccgccgtgagatcccgaacttgaagctgaagcagtaaaaggatccaacccacatatggaggaaagaggaaaaagccaagagatgaacatccatgacgaggcaccacccaggaatgggggacctggaggctgccggatccctgaatttcctgttattaaaaaaagataaaatttctctattgtttaagtcgtgattagctggatcttcttttacattttttttaaaagtttcaaaactgtaatcctcaaaacaatattcaagggctgccttttggcttagaagtttcttttgtcaaaaaatatatatgtccactacaatgaggctatattaaatttatgtatcaccagaatcactcacttacaacatgacaacattatttttagacaccatgtctctaaaatgacattcttatgtgacatctagtcaatacataagtattacacgaagattcatacatctggatatagtagcatccaccggcccttatttttcgctggcaacacaaggagaacttaggagaaccatcccctgcccccaattccccaccgtttcttcccaatgagaagcgataatgtgcattccagacttacgtgtgcttactgaactggactatagcaattcatttctgtgactgggacacgaggtgtgaaactacccggtcggtgccatacatggcagctgggccgggctgatgtcacatacgcttttctatcgtcggtacggtacaacggtacacg

SEQ ID NO: 15671 - DNA, 779 bp, Homo sapiens
tgccgttcaggctcatttctcttccctcaatttctctggcagtgagcagaaagcccaacggcactttcaacagtcttcctagaagcctcctcagctagatcatcaaattcattcgatggagtctggctctgtctcccaggctgtagtgcagtggcacgatctcccctcactgcaaactccgcgtcccaggttcacgccattctcctgcctcagcctcccgagtagctgggactacaggcgcccgccaccacgcccggataattttttgtacttttagtagttacggagtttcaccatgttagccaggatggtcttgatgggggcgcctcgtgatccgcccacctcggcctcccaaaaaaaaaggggttacaggcgtgagccatcgcgcccggcctagttgacatcttgatgtattgtttatttgattgtttagacttgagaaaatgatagtaaagatgttaacagcacagattaagcttaaagcaggtcatgtctatagccattacacaaaaatttaaagaaatattattcttccggtatctaaaacctatgattcaactaagaagcagctcatgatattgacaaacaaaggaagttacaacttaccacctcatttactttaatcctattaatacacaagaatcaaggtgtattcttatctgaactatattcattcatcagattcaaccttggcttggttaaaatacattcggctaccaaagattaaaagaaaattttgtggaaaaccaaaaattggcctcccgccctagcggggaccc

SEQ ID NO: 15672 - DNA, 392 bp, Homo sapiens
  misc_feature (1)...(392): n = A,T,C or G
aacgcggcgtgaaagggnnnnntccaacnntttcaaatcggactgttggtgcgcaccttgcttcatgttggacgaaatatctccctctgcccatctccaactcaagagttccttgaaacaccagaagcatgacttggcttaatgaagatagtcagtcactaaacatacttttattactctatgtgtgccaacagccatatatgccatttttcctgcacttttgggtaaacattttgttaagaagcatttaaaacatgcataagggtagagatcataactactcactaccctaccacccacttttttttctaaccccacccctgtcaccatatcatccaaacgggggggcgccccccctctcacatcttcactccccgttaaaaaaaaaaaaa

SEQ ID NO: 15673 - DNA, 178 bp, Homo sapiens
gctcccagcatttagttgacccaggcaactgaaaccgaggaagcaaaaccatggaccgtggaaagaagcatcatataggactactgtattatgtattataggtggctgtggtatcaacatacttagttgataataaaaatgtttgcaaagtcaaaccaaacccaaaaaaaaaaacaaa

SEQ ID NO: 15674 - DNA, 809 bp, Homo sapiens
ataatatctatattctaattaagttctgatcgaattcaacactaattttgcagttctaggtacaactgtaactccaaaaaaaaaaaatcacaggaaggaatggatgggtccatgaaatggcttccggagagttctattctcaggagccagggcgtttgtggggtcctcctggacactgaggaaaggctgtgccagcccccttcaccaccacctcagcctgagcccctgacttctactttatctgtcttctataggaggcttctgtggcaagatgtctcttggataaattgccaatttctactttaaatgactagtttaacagattatttatttatatataccatagcttaccaatcaaaaaactacagtgggccaactactgtagttaaacactgtgcagacacaacaactacagaaaaactaatgcaactatcattttggctcgtcatttttttttcacgaaccgcattgcctttaaaacatgggtgcacatcctcggatgctcctccccttaaaaggtgaaccctctttcgctatatccacctatttgactcccatctaacaccctatcgtgccggacacccttctatatccctttctacgctatgttccaataatatgattccacatgaccgtttctccccgcatactttaccttttggtaggtctacaccatgccttaaggtcatattcccacctttaaaccttttgcttagatactttttacactctattttcttccttcttgcacctattccccttctcctacatattaacatacattatgcctcgcttcataaaaccaactg

SEQ ID NO: 15675 - DNA, 812 bp, Homo sapiens
  misc_feature (1)...(812): n = A,T,C or G
tgaacattgtggcactagcatatcgggcacagaagatgtgcatatatgcctaccgtctctagacaccaaaaagcacttgtaatcacaaggtgactgagagctgacctagaagaaataacccaacaattaaaaggcaatctagtttaacggtcntgccaaagggcgcggctagatagttattattcaccagaaaacaaaacactggctattatgtgggctttggtaacagcatggcatgtagtaggctttactattcataataaacatagaataaaatggtttgttttaaagatctgaaattatacttgaacataaaaatcagggggggcccccattatgtgtgttttcttttctctaaaaaaaaataaacctcgtctcggtgcttgcgctctctcctgtcngcttgtgtgctgcggcggtcgccccntctgctgnggcttcttcggcgtctggcggtggtcctggcgctctggggcccgtgtcggtttccctcccccgtgccttcggtgctcgtctcccgttccggccgcctcttgtcgcctccccgtcccgtcccctcgtgcgggtcggtgcgcgtccgtgtgctcgtctgttcgccggtcccccggcggcctgctgcgctttcctccgccgcgtcggcgtttttctggtgcccgtncgcgnttgcgcgctcggccgcccggcgncggcctctgtctccccgcgcgctcccttcgcgggtgtctcttgctcgttcctctcgtctgtctcctgcccgttccgcttcctgtgcttcctcccttctctcccgtccggccgctttccgcggtgcc

SEQ ID NO: 15676 - DNA, 782 bp, Homo sapiens
  misc_feature (1)...(782): n = A,T,C or G
atggagccaacaggatatgaatgtgatctgtccaatttccgactactggcttaggccgattctttttatatgaacacaaatgattcctggcctcatccctttctccttttgcatgtgatttacatactaatatatatgccganagcacgacaagttttattttaaaagtactatccttactatgtgtgacaaactaacattttctattgttcttttatgaattactagtcacaactcactaaatccattttacatttttttttttaaaagaaaaaagtatattttaattaaaattttagggttcgcacgcccaaatatttgacctttttttggcctaaaaatactaaatctttcctctcctttccttcatggatggtcttattatttatccttccttcactaacttcctttacctttttattttcctctctctttttcacgctttaccctctatatttgccgtatatgccttttacctttgttatgtctcgtttttgtctgtatttttatctttttacacttatatctctcacctgtctagatccgtattacccttcaattcgttcccttctactaatttatctcatttacgcgtacttatttcatatattctttgaatctcattattaacatgccatcatcttattcattatctttattattgtattttattttcccctcttcctctcctttgttccactacaagcttcattttctttacctgctctcccctattcttctttttcgcactaatgttcttattgcagtctattcttctcatt

SEQ ID NO: 15677 - DNA, 505 bp, Homo sapiens
  misc_feature (1)...(505): n = A,T,C or G
cagtatcacgagtacatacgactacggnataatgnnggggaaaggnnnntttgtaatacactagaactcccacagtttctgccacacagttctctccactagacttngatactgcaacaaagagcaacaaaagaggattccaatggcattggtttgaagccagataattaattacataaagtcacatttcggaatgaatagcaccatgatttttttccaaaggagcgggcaccaaaccctcaatttcctatcaggacaacctgcaaaatatttttgataaagtgagaagagatttagtaatttttttatttattttctaaacttaagaatagaaagtacgttccctgcttttgaaaaggcaccccacaactgatgagaccagaacggcggcggccgccacctttatacatatatactaactgacaaaaaaaaaaacacagtatgctggtatatcccttttgatcattatcaataataatcggactataaatcaaaaaaaaaaaaa

SEQ ID NO: 15678 - DNA, 813 bp, Homo sapiens
  misc_feature (1)...(813): n = A,T,C or G
cccccctccccgcccgccccgccctaaaannnttgaactcgcaaggtgtccgccaattgctgtgttggatcaagaccacttatgggtcactagtaccaatggagctggagtttttttagagccgaaaatttctgtctcaactggtctctgacaagcctctgactgattgtcttcttgctggccacgcggcgccagaatcataattagacggactggctgcacctttcctgagaagccagacttccactgatggaagagctttatacacacgcccaggagtgcagacactgccctaaccgcttccctcgtttttcccctattaataaagaagaaagccctttgccatggggggccccccctaataatgctgcaccccagtcgaaaaaaaacaagggcccgcctgcgcttggtgaaccatgccccgcccaagaagcgaacgccgggacgtgctctttgcccagctcgcgtagctcgccccgcagccccgttcggcgagtaagcggcctgtggcgccggtgccccctggtacctttgctcgtccccgtactaatcccgccccaaccgaacgccaatctcctggctcgtggcgctggtcccgcgcgatcgcggtcgatgcggcgcaaaggagacggcgtagctcgcggcgcgtcgcgcnagacgcagcggaccatgcacacccgcgccggcatgcccgctatttcatattccgctcatctcttgcggctctctctgctatgcgtcacggccgcgccgtgccgcagccggcgaaacgcgcgcctcactagggtcgtccctccccgataccacgggact

SEQ ID NO: 15679 - DNA, 952 bp, Homo sapiens
  misc_feature (1)...(952): n = A,T,C or G
agaccgagaatcagacgataaggnnncnnncngggcaagnnnttttacaaactggtaggtgttatgtgggcaaaaatgtaggatgatgagaaagcaatgatgaggaaaataaggatgacataacaggaatttttttcaaaagcccaataaagattgtatagttgaaattaccgtttattcaaaaatatgcttttttgattgctgtgggggggcccaaaaatttcnaaaaaatgtattgaaattgatatcacatttagatacagttattaaaataaattgtaaaattttttcaaaaaaaagtgcggcctctatggactacaacggcgtttggtgggttttcaaagaacatagaaagaacggacaaaaaaaaaacagtgggggcgctccactaaanacgcnaagattgtttggttaataaaaaaatagtctgtttgtgtcttgccgcggtgcgtaacgatagaatattaatgatgacttggcgaacaaaattttgaataaattgattagatatcgaatgttcgtagatatgggtatatacgggggattatatgttggttaagtttgtttttaggctatgcctgggaaaatctatatgcacttcatattatatcctcatatccaccatctcatgctatgttatactttcattattaagttttacttgttcatttaatctcgcctatatcttttatctatttgttatgagtatggcgaggtatgatgctaggtatgatatctttcgttatctcttgttaataatctaatacgattattactattatgtagagttaggagagtttaatgcgctattgatatagtcacagacagcgaccagccaggcgaggggcgctaattgtcttcattctatttggttgcttctccgcgcacaatgataaaatgtgagcaagacattcttggtactctacgttagctccgcttntagcagatcttc

SEQ ID NO: 15680 - DNA, 872 bp, Homo sapiens
tccttttacgattcctactgcacgtcgatgcgcgttcgttcttttttgtcgaatgctgataggtatatagggagaaaagtgatggatgaagagaaagaaggatgaggaaaatcaggatgacataacaggtaatatgtttcaaagacaaaataaagattgtatagatgaaattactgtttattcaaaaatgtgttttttgatttgtttgggggccaaaaacttttgaaaaaatgtattgaaattgatatcacctttagataccgctattaaaattaattgtaaacttacttttaaaaaaaattattttcctttctagcctcatttttttttttaagacaattacttcgtttaatgatcgttttattgggggggggccctcccttattatcgctacactcttgttgtaaaaaaaaaaatctcgtcccgtacgcgcagtctacttcttcgattcgtctgggccctccctaactgtgtataggtataatataggacacggcttgatctcgtttactttcgcctcttaatgcccgatttctttctattttcctaacgtcggtttttcttaatatgttctgaatgttatgcgtgttggcgcaattatttctgcacactagtctctgtgctaatatcttttgacctatattcgcatcgccgtatattgccatccttactccgctattatctacgttaatgtgcggcgtagtcatgttctatataacgcctcatccggtgcccgcttagtcgttttctgccacttcttaatgccaattcaagacgctttatcctcttctattcgttaccgcctggaacgtgtagatgccctcgctaactcgcaccctaactcatcttcattgtttactattcctgtcgat

SEQ ID NO: 15681 - DNA, 892 bp, Homo sapiens
  misc_feature (1)...(892): n = A,T,C or G
tgtcgccataccgcaagagccgctcctccccgnggnttgtacaatcgacaaaaaatttggcaagtatttatggaagaggaaagcggataatgaagagtgggaaacagcaagtggttaatatcaagacacatacaaaaaacttacaccatatagagacgcatccattggcactctataccttttttaggaatacaggggggacaaaaatgatctttatacttcatcaaatagttcatactctcgtgcccagatacttatttgtgtattattataataacacaaaaatgtaatatgactgcttccataaaaacagcgtttccgtccttatacaaacaacactttaaataacctaaaaaaaacaggggtcggcgcccccttttaatattatcctttttggtcctaaaaggatgataactttggtgcccctttgtcttttcattaaggcgtaacatttctaacctactcgtaccataaattatgatatataaataaatacctaaccttgaatatttaatatataccgcgctaaatcgtccgcacttgacaatacacaacctatacaaaccaaaaatcttttatacataattttattgtactatatatccaccagtacgagctaatttcaaaaaccaaatttattaatacctatattgacattctctatcgatcatttaccggttattagatatatatataatatgagtatactcccgaactaaaaacaacgctcttaaccatatcaccacatctcgctttgactgaaaatactaacatcgctctactctattcactattattatgtaaaaataataaattctataaggagtcttatatcacctcacatatatacaacaacataaatcttccccgtaaaggctttatagtgagtcat

SEQ ID NO: 15682 - DNA, 996 bp, Homo sapiens
  misc_feature (1)...(996): n = A,T,C or G
ccttacctccccaaaagccctctccgacgaactttgaaaaacgataggcatataggggcaaaaatgatggatgaagagaaagaaggatgaggaaaatcaggatgacataacaggaattttttttcagaacacaaattatgattgtatagttgaaattactgcttattcaaaaatgtgttttctgattntgttgcggggcacacaaactttcaaaaaaatgcattgaaattagcctcacataatccatacactaaataaaaacactatccctattctccaccaaaaagacccgctataccatctcctcgcaaaagtttttcttttttacaaaacataaaccagatcagtcagaaataaaatatgcggggggcgccctctaaaaactagcgcaccatgctatgatgaataaaaacaaaatgcctcacaactcttcgtcaacatcaccgcagaactatattgctcttataacctcccctcgcaccaacccttcctaattttattataactcatattacgttgcacacatccaacatatccctcacaacaactagtcgatcattcttgtgtattaattatgctctgcacatactggtactcacttncattcttttttctcgctcttgtcctgtatgtcatacacctacccacactaccccctgcccgacaattacacgatcgattctccactctcctatgaccacccagttgattcaatctcatactgtactctaccacttcttacgtttcatcattatccctctctgcagtcaccctctatatcgaaatccacacgctctctcctaaggactgtctactcgtacaccttctcgcgcacatccatgattattaccctccaaccgcgncaccacccacactttgcgtcgtcactcaatgtatccctacatcatactaagcgcattcacacatctcaatcccctcagcaacccacgatatccgcggtctctcgtacagctctaacccanacccgactaccaa

SEQ ID NO: 15683 - DNA, 829 bp, Homo sapiens
gtgaagaaaaagtgaaggaggaagagaaagatggaataggacagtcaggatgacatatcaggaagaattttcaaaaatgttataaagattgtatagttgaaattactgtttattcaaaaatgtgctttttgatttgcctgagtgtcaaaaaactttagaaaaaatgtatgtgaaattgatatcacatttagatacatatattaaaatcaattgtatatatcactttcatacagatttggcatttattacaattattttttttttttattactgaatcatagataccagttttcttattatagtgcgggggatatcaagcgtatttgataacttctttctctaaaaaatatattctctaatcttaccatactcctctgtttttactatacacttggacctattgttcgatcttcttactttagttcaaaacgcacgtctatcctcatttttcacgattaacatctctaagttcatttatgctctcttccgacaaattaatgtactccgctattttatttccctatatagtcttatattcttcccccctatccttactcgaactgccgttatttactattgtcgctagttactacactctcatccttattgtgcgcgttctcgcttgttcttactgtgacgcttccgtttattaatatcgtccccataatatatctcgccctcctctcttctcccttatgtcttttatctgtcgctatacgctgaccgatcaacattctttatcatcatccctcttctctcatacacctctcttcctctatacttttcctccaatcttcttctctcatccggcctacatctcgacgtcatt

SEQ ID NO: 15684 - DNA, 873 bp, Homo sapiens
  misc_feature (1)...(873): n = A,T,C or G
tcctacaattgatctagtatagtcggccccgncngtgcacgcgctcgagtatggggacaggtctcatgagccctgaagactgaactcagaggaggttgtttacatgatgttcttctttcccagcccaagagagtctgctattatgaacagcaggatctcattacttcaatgattttttgtaacaagagggtgccaccaccaacagccaagtggattaggcgcacgttcggttgattgatacataattaaaaacactacgcctccgacaacgcaataactatgacaatacagttagccaacaaccgctttcactgctttgcgagaaacgagccgtctctctaggatacctcaagggggggggcgccccacattctcgcttcgctcgctctgtctttcaaaaaaacaaccttggagcctctcgcgcacgactttttcgacgtccctttgccactccccgcaacgtgcggaaatcacggatccaccatccttctcaaccccgtccgaacaacgacctacttacgctaatcgaacggcgaccaaacacattcggtcgagtttttttatgtctttccgcgttattagttctcattcttatcaatctcctaataccagtgcttgttcttgcgaaaccgaggtcaatgtgactcgattcacgctcgaccttacgaactcaaacctcgttccgacgatctacattccacaccgactcacgcttctcggccatactctgttttcgctaatactgtatatccttgactcgaaaccaggtcacgacttcgtactcacgtatcgcattcgtcagtctattttctttccgatttcatgtgaccactttaaccgatccactttacggcggctcttccatgttactat

SEQ ID NO: 15685 - DNA, 164 bp, Homo sapiens
gtcgcagcatgggaattgggctcatattggacatatcttgctgaagtcacacaaatggtttccagtaaggtgattattccaagagcacccacacctgtgaccacaagagaatttctgtatatcttattaaatatatgataactaactatgggcggaggccaaaa

SEQ ID NO: 15686 - DNA, 188 bp, Homo sapiens
gtcgccgcacatatccactcgctgcgatcgaccgattgcggctaacgaagttgcttacgtgttaaatccaactccgttacccccagattttcttcaactggcattggcgccgcgtaactagattgcgttagtacgacctgtttacggttttgcccacattcgatttgggggggacggatatgtagaga

SEQ ID NO: 15687 - DNA, 784 bp, Homo sapiens
gggaacaactgtgctccacagaaaaagtcacatggaaggactggatgggtccatgaaatggcttccagagagttctattctcaggaccacagaggcgtttgtggggtcctcctggacactgaggaaaggctgtgcctttccccttcaccaccgcctcaccactgagcccctgacttctactttatctgtcttctataggaggcttctgtggtaagatgtctcttggataaattgccaatttctactttaaatgactagtttaacagatgtctatttttttatataccatagattaccaatcaaaaaactacaggggggcgccctccctgagctaaacactgcgcagacacaaaaaaaaaaagaagactaatgctaccatgatttaaccttggcattgtcttttcaacaattggattgattttaaaacatgagtgcctatgcttgggtgaaactcgccttaaagggtacaccctgttgcgctatgacccggcttgggaaagcgttttttacactgtcgttggctatgaaactgtccctatcgattcctaagtgtctgtcattgaagacagatgccccgtcatcgcgtgcggctgcccgcacccttcttggatgtcgacggggcctggcttattgcctcccatctccgcttgtggccgtgcgtgttcggaaatacttgctccgtaagttgttctgagactggcgacaagagtcatgccgagtcgggtcctcgttggacggagagcacgactcgcatccgccgccagtcgcgcactacatctccctc

SEQ ID NO: 15688 - DNA, 858 bp, Homo sapiens
  misc_feature (1)...(858): n = A,T,C or G
cgccacaccggttcacattctagggaagaannnntttgaccnccnnttgccatctcggctaaatgttattggacccacanattatgtaattatcttgctgcaagtgcacaactggtttccagtattgtgaatattccaaaagacccaaacctgtgaccacaagagaatttctgtatatcttattaatgaattttttcaactattggggggccaaaaataggaaaatgtttttaatgaactatgccctgcaaatatgaaaaaaaaaacattggtctctcttgttctcacggatagtagctctacagtcgccgccacttgagcttttttttttttaacaagctagctgaataactttcctatctcaaggggggggccccccccaacagcaggaactcttcttctgttaaaaaaaaaaatctcggttccccctggctnccgtgtttttgatacattatccaccatttgttcgtattatctcatctctcgtatctagatacctcctcatttccgccgtcttcatcctattgggagataggacatcaccctattcctcatacgagcgattaatacgatcactacctgtgacatcgctacccccctacaatccatttcatcccgtcattattgtactgtatccctcaacatgttagcttgattctggctttctagttttgtattaggcatgagtgataggttttttacaattgccaaaatcgtttgcggaacgcatcttacgtttatctttatacccctctacatctctactctcctcatcattcctacttccgtcttgtctgttcttttcaatactgacatagagatccaacgtggtgtggtgtccgtatcttcttggatgtc

SEQ ID NO: 15689 - DNA, 890 bp, Homo sapiens
cggagtgagggcccaacagtgtatggatgaagagaaagcaacgatgaggacaatcaggatgacataacttgaattatttttcaaaactccaataaagattgtatagttgaaattactgtctattccaaaatgtcctttttttatcttgttcgcgacccccacaactttcccaaattatatacttgaaattcgattctacccttctcctatcctacttctcctattaatatccgtacaacttttctctctatcctgcattcatcccctccaatctgtcctcgtctttttttttttttccaaacacacccccgacgcccaccccctctttcccctccattcgtgggggcgcccccccattttccctcttatttgtttttcattcgtccaaaaaaaaataacacctttcacccttctcctcctaccctctctctcctcacatctttttcttccacctcctctccccttacttcctttttattgtctcacttttctttcctcccacctttctatcttctcctccaacttctaccctctttttctttttttttatacgccctcacacccgatatctctctcatctacattcccacttcccttttttttcccatcccccctttcctttcaccttcttctccttctttcctttttccctctccattatccttcatccctcttatccccgtctcaccacttccttactttcccctcttcacctccatatttattatttctactcctctttctcctcccttcctctccactcccatctccttcatccccccatctcttttcctctcttatccttccgccctaagcccatatccctcttcacctctctctatttcttctccacacttcctttcccttctcactcctctatcatccctcta

SEQ ID NO: 15690 - DNA, 363 bp, Homo sapiens
agatgagagggggagtcagcacagcctgtgtcagaggaaagcagtgtggaaaaccttcagccaggagggtgctgctgaggcatccaccctactttctgagtctgttatacaaaattcatgcactttcttattatagcggcgcaaccattgctattaacaaacagtcttcactttctggttagaaaaattaccaagaatccatgaccttttattttgggaatatgtagggtagaattttttttgtgaatttttaaatgtttttaaatacttgtttattaggggggggcccaaataacatatcccattacacattaaaatacaaaatatggaaaatatatttccaaaatttaaaaaacctgaaaa

SEQ ID NO: 15691 - DNA, 794 bp, Homo sapiens
aacagtttttctcaaaggagcatctaaatatcaataatatttgacaaggccaaaaaccaaagagttacgcaggaatggaaaactttctgcatatattatttttttatgttccggggggccaacaaatgtgatataagacaaatgttatagtgagcatatacttatatcataattatactaagcaaattcatgcgcccacaaataaaaccgcaccgcctccataatgacagttttttttttttccatccaaaaatacatggaaaaacctgtactagagggggatacccctatctcatctattttttgacactgacaaaaaacatctgcttaccaacctcggaatttcgctgggtgtatgtaacaacaatacatccagtgtgcataaagtacaaaagagtattttttagtttaacaacccaactccatatgtcgttctcacctgtgttcccacacacaagtacgtccgacgtgttccgtcccctcacctgaatggttgcgacctaaaccccaccaacacttggattgtggccacctttgttattgcacttgccaacagccggtctcccccttgttgcacccgttgcaacacactacactccctagcgcgatgaccataccttcccttcacctcaccatctacaggtcgcagtaaggtattgaatactgtaacacgcgcccataacccaccgatattcagtgacccatttcccatccccgctttacccacattattaatgtagaccttggcgcctatcacccaagtcatatatcacctcctccacacccccccagct

SEQ ID NO: 15692 - DNA, 1226 bp, Homo sapiens
  misc_feature (1)...(1226): n = A,T,C or G
aacccactctttgctcacgcgctncacatgtggatcccgaacaaaacagacagagacatatgtatgccacaggttcagtatgtgactgtcagactccacagcacgaatacacgctactgatgaattcgtagtcttcatcggcaagtatgtacagaagagcatacactcttaactactagccacgctcctccacatcatttatgtggatacgcacggaaacgttggtcttttatcggaaagcacacacttggggcgcactcgcacctaggtgggtcggtgggccgattggttccacggaccgattcaatgcgtaccacatatcatctgccgatacttgtactcttccacttcaccgctccgtcgatgaccactccacccacaatgcccttgatcatcatacctgacataatcttttctttaccgccngtcccggcagaaataatcgcacatccgcatctccgcgcaancgctatagacaggagangcgtacgcccancgcgtctcgtttacttcaaattcgtaattatataatgcatggtcatacaggagtaacgaacgacgacgcgaagccgttcatcactgctcgcgatagctgcgccggtcgtgttgtgtggttacatcacctacatgcacacgcacagatgtgtgacaccgactgtgtgacacaccactttatgtgttgcgtcacctgtttgtgcacacaacgtcacactgccacgtgttcgtgtcataccccctatattatcacaacaaccataccgtgatcctgtccgactttggtgccctgtgcgccncccgcgatgaatgttgcgacgccacgtaccaccgccggtaacactgtggttgtcnttggcgccaacgcgtatgttttttatacacgcgctgtcgcaacatgacgagtcttgccgccatccgtgctgtacctcgcgtggtgtcacatcnacatccgcattacaaccgatctaccgtttcaacctcagtcccatgttcgccgtgcccgacgtcacccatgccgtaccatagccggcctgtgtggtatggtcctgtacagtactatttgtcgccgccgcatccgttcacacaccgcactcttactattgggtacgtggatgcgcacgcgcacccccactatcgcgcgcaagttgtttatgatcgagtantgtgggtcacgtgtgcaactgcatcacccagcgtatgcccgctcccgcatcacgcccgcccgatgc

SEQ ID NO: 15693 - DNA, 194 bp, Homo sapiens
tatctctgtcgtatttactctacgaagtcgatatcttgttctttccccgttccacctctgcagtaccaattcgacagctctgcaacaggaaaagagggccctcaccagaacctgaccatgccagcaccttgatcttggaccttcagcttccagaaatgtgaaataaaagtctattgtttataaaaaaaaaaaaa

SEQ ID NO: 15694 - DNA, 325 bp, Homo sapiens
  misc_feature (1)...(325): n = A,T,C or G
ttatgatcgcttatccgacgtgcgagacctttntttgtcgttccacccctgtataggcattcctgcagggcagatgtcatctactttatttctattttcccaccaactaccacagtggttggcacacgtgacaagccatgttctgaaaaggaacagaccagtgccgaggagcatggatgtcctcattgaacaagaagctcaggccacctgacggagtttcattataaacctgaacaattatgtatttaaaacataagcgaatcgacgttgtgttgctatgcatcttataagaaaaacattgttgaaggaaatatgcatgttattt

SEQ ID NO: 15695 - DNA, 832 bp, Homo sapiens
  misc_feature (1)...(832): n = A,T,C or G
aaaccatcacgtcggaaacgagcgaccgcaaaatattccacaaacaggcaacaggtgagcacactttaccggtattggcctctcagaactgggacacaccagcctccagaactgcaagccaaataaacagacaaaagtataaatcatccatctgaggattctgtataacagcaaaaagtgaactgagacagggcaccaaaaagagtggcctgtaagtggtttcataagaggagaaagatacctgaaatcactgtataagtcctctctttatgtgatgcactgtaccacctcaggactctgcagaaagtttctgtttttttagaagaaccaaaccagaagaggacacacaacgggagagcccccacccganagaaccgcgcacagaaggaancacngaaccgggaaccaccgacacggcaccggaacgcgcaaagacggaacggcaacgagaccagaggaacacgaaaagcacaggaggcaggagggaccacaggcagaangcgacgcaccaaaaaaacacccccgccaaaacgcagggagaaacaaaacccacaagagggcaccacccacaggcaaggggacaaacagacaacagngaacaaaaagaaacgcccgcggcggccagagccccggagcgcagcagaccaagaccgcaagggacgggaacggacgaacacccaccacggacccgcaggcgcgagacaaaaagcagagggaacgcgcacacccaccacaaaggagggaacacggcaccacaacgaaccccgaaaaacgagggaaaaacagggagcaaaggccagaaaacggcagcaacggaaaaaggccaacgacg

SEQ ID NO: 15696 - DNA, 406 bp, Homo sapiens
  misc_feature (1)...(406): n = A,T,C or G
atgtcagtgagtattccatcgagcgcnatcgttttcatgttttcacgtacgacaagaactgtttgcttccccttccgccccatgattgtaagtttcctgaggcctccccagtcatgctgaacaaaaccttctgctggaatgaaaaaatatttggaaaaattcagagaaaatacacagaagagaatatgtctgcacatacatgtgtacaaatctctctttgggagcaaggctggccagattaaggaggaagagtaaagctatagaatctggcccagtatctattgctttaatacaaagaattcaaaatcccagggagatatttttttacagaattggggatttaaagtgcatgaggtattgaggggggggactatcctgaaacaactgtctgttaaaaaaaaaaaaa

SEQ ID NO: 15697 - DNA, 813 bp, Homo sapiens
acaaataatgtactctcttccgcggcccttccccggtcttatgaagagtgagtgagacaccaatcctcacagcccccaccacgtgctccctcccatgcctggcgctgctggagtcattatccttcctggtgtgacagggtcagaaccaaaccaatttgcatcagtctttggtgatgttgtgaagcctcacctgccctgcaatcctgctgctgtaacaactgcttcagctgcctgttctatagtgctcttcgctcctttggaagactgatcagatctggccaccccagttctggctgaatgttctacagcgaccgcaatggtagggtaggattcagggctgcacgtggctgacattgtaccttcttcgttttgctcttctgagaaggacagaaagcagtccctatttggtgaactggatggacaagtgcatacattaagcggacgacacatttgatgtcgttggcataggcaattactgattgttacattcatttctatcaccgaaaactgcgagtgctctcacttcccgtccattttctcaccccacccccgcaagatgttaggcctcgcatttttttgcaactttgagccatctgtgcacaaaggactccacatggacaccgtcacctctctccattttccactccattccgctcctcacgcattcatctattgatgtgagagaccatatacgtgattgcctccctttaccaaccttctctatattgctattccaaccgcgcattcgcccgtgtcttttctattatatttaccttacatccacacctaattccggttccgcaccaccaggta

SEQ ID NO: 15698 - DNA, 844 bp, Homo sapiens
aaaaatcaaagtccccgcgcacttcgttatgactcttgaaagacaaggcaggtaccttcagcctctcaataaaagctcaaagaactgaaactcaccagatcaccacatcctgaaaatgagatcccagaccccacattcatcatgcttgcttccttactcctccctagttcctgttttcttatacattgttatatggcccccattctataaaaacccctagttttagtcagttagggaaatagatttgagactgagctccttggtggcaacacccaattaaagccttcttccttggcaatattaatcttcttagctcctgctttctgcaaggtgagcagcaggtcctacagcagaggtctccccgtttcagtaacaatagcagggaccacataaaaaggacgatttcagaaatagatcacagtcccagagaaaataattccctcatggagaaacagggcttctgattttgctgcagcaagatattcatacaaaagtgcaggacacagaatcagttcatggatcacagtgcaacgtgggaactagagctcaggaccaaagcagtaacctagagagatagggtcaattaagatgtaaaaatgggcttattaaccctttcccatttagagggaaaaaaaaagtgtagatctctgccaccgctcgtttaattttacttaaacacactctttgaggctgaggcaaatctgactgatttttaatgggaaaatgaaatttacacaacctgtcttggagttattttctaacagaactaacaccacaatggtgttgaatataagattatctatttcacaaaaatcgatttactcaatgaatcttcacccagcaa

SEQ ID NO: 15699 - DNA, 869 bp, Homo sapiens
tatccaatcgctattactcacgtgtcccaacgttgtctaatctcgccatgattacatttccagcgtttcacattatcatttgtacaagatcacacatgcctgtcctatgagtgctgactgagcaccacgaactgtgctagaagttataagttacgtgatctgacctgagtccacatatggtaagcaagagagccaaaacaacacagctgtgcctggctacaaagtgcatgggcttaaacatgccctcgtcgctgcatcctgtttcttgacagagaacgtctcatctcgaagcataaccagaccccctttgaaaatcaggctagcaagttatttgtttttttcccaccttacactattatgctatattcacatacgaccgggccgctcttcatgcaggatgattcttttgggctaaaaaaaattagttccaatcggtgtgtctgtgctacaccttgccatactaggaattacaaatgtgttcttagtttacacagtaagcctgtttctggtaacttgcgttacccacgcgtgggatagactgttgcttgacccctcatattattgtgactgacccccctgacacggtgtgaattgacacgttttttgtataaccggtccaccctccgggcgcgaccatttttgacgcctgggtacgctaatcccctctcagagtctttgtgacccacactttcttcctcccactccattctgcccgacgtaatatctctctactatgtatttgcagcccctcgtttctccaacctttacacatgttcagtgtccaccgccaccaatcaccccccgatggttgtttttatttgtccctattcttccgtctcagagtaccctggacaaccccgcccccggac

SEQ ID NO: 15700 - DNA, 838 bp, Homo sapiens
  misc_feature (1)...(838): n = A,T,C or G
atcaaaccgaaatgcatatgatttataggccacaaaatggacatacgccaaatgctctgggcgcactgcatgttcatacttttctcgcaggtgtgcaaggggcactaaaatggaataagaatgagtctcaagacaaaatctacctacttcactattttaattagcgctctggtcatgcactccaagctttctccttctgttaacccaacattacttttgtgctttacttaatccgcaagtctgnttaaatagcccataacgagcaaatgcttcttctctcataaacccaaaaatcccaccccagatcttcttcacccttttttttatacgcacactctgaaaacaatctgatacacgtacagagagcgccaatcatgatgatcaggatgaccaaggaagaaatgtttcttgacgccacagtacaatttcttcgtgggcactcgataaagaatgccatgttcacaaaattaaaaacctgtgtggacggtctaaacggcacaactttgcttccacttcccttcaccaacggctacttataatcctcctttcccccctactatgctcccacccccgcgaacgcgatttatgtcacccttttataccaccgtcccctgccttcacacactcttgtccccgtgtaatacaaacactcccaccctttacccctcctgccccgtccacccccatcgttctggtgtatgggcggtttataattacgttcccccccccctgtcccaccctattcattatactttttcccacgccccctaccccgccttattacataatctgggaccgttccaaccacccctgtatccctttccatcccacccctccc

SEQ ID NO: 15701 - DNA, 866 bp, Homo sapiens
atggcaatgataatcctactgagccaaacctaaaaagccttcaacaacgacaataacgatgcgccaaccctgccctccttcctgaagactttctgctactcctgcctggaactcatttcctctggtcatctcccacctgactcctcatcatttacagcattctatacggcaagttcgagacaacttttcatctactcctcggtgctccaacttaactagatacacttgtcataagcagcccccatatgacccatctgtcatatttctggtcaatttctgttagccacccatccatgcaccccttacggaatagaattttttttttttttccccaggcgccttcacactaatccaatctagaaggggaccccccccacgtgagctcactttactcatcaaaaaaaaaaacggcgtttttttcacgaaccctcatacgaagatgcatgttgaggccccataaacctaaaacatatgctttagacaaatattactgcccttatagacaaccccacgggactattcccgagtttaacccacaatgcattgctctgttacaccgctcccccgaaagattatccacccacaccccacacgggcaatcctccactaatttattccacgggcaccacactgtctccacgatgtgaacacattacactacaacccttcaactttcattgtcccaaacttcacccccccatcccatacaacctctgaattattttgtactccttcttatgaccccccacatacacaccccaaatagattttccttatcctaaccccaccaaccccacgatatatcttagttaccgattcccataatctccgactgccgaataaccgcacccaccccccccctcgac

SEQ ID NO: 15702 - DNA, 896 bp, Homo sapiens
  misc_feature (1)...(896): n = A,T,C or G
ctcacccgtatcgaacacgagaaactgagaaacttgtgcacaacggctggcaaagtgggaacagngttctagaactagtggctcattttatggccaaaaagttttcattggatgcatttttaacccaggccaaacattttgaaaaaataaatgaaggatttgacctgcttcactctggtttttttgtatccatacgggggcccacaaaaagacacaatacatgatgtctccccttgcggcagtcttcacccttctctaccctccatgatcccccagccacacatgggcacacccccataagctctccatacagacaaatctattctctacgacacaaaacagcaagcattcccgatcattataagggggggccacacctaatcaaagatgtaatattgacctttaaaaaaaacaaagcctctctttaaatgttcatcgttgtgtgaaagcatgaaaaaaatgtgaaaacttttcaacattattgttcgcactttgtaaaaaatcccaaaactttatctagttacctgtttgtacacacacaccgtgtcgtacgaagttaacctttatcacaccgttttgtggctcgcactctcaccgcgaaatgggttaaagtgggcatccgtttattaactacacgatgcaacacacctctgcaccactcatcccgccgttggcacatcactaaccgcccaggacatgatgaccaaccttgccccccaacacacctgcttcagtcagagggatatgtaactataggaatggtgcccgccacataccacaccaactacaagtcagctgttgccgcaacgccagcataaccaccacaggaatagtaattcgtaacgacacatcacgaaccgcacgcaataatcaccctcccaccatcacaccagtcc

SEQ ID NO: 15703 - DNA, 737 bp, Homo sapiens
ggtgcttgcactgagcttggccagccactcgaatagaggagtggagctgctggagaagaaaccacgcagggtcaggatacacattatttccagatgagtcatcaaagatgttaagtctcatatggcccagatttatagtccaggggtcaatgcccttgggagatcctgtagaccagggtctgtcactcagattcagtaaacattttagagcttgggcctaaaaactatggccttttgtctgttattgtatggctgtgggggcaagcatgctcttaaagtttttacatgttaataaaaaatcaaaaaataatcctttgtgactgattaaaatcaaacaagattcaacaataaaaaagagtgtgtactgtgcatacccaccccttttttactcccatttttgcgcccttcttggcttcccatggttaagtctccgcctacttttcctcctttggcggctatatttatgatcctccgctattattttcctgctccccgtcctttggacggggatgacgcgtttcgttcacttcatagccgtcctgtgtgtcttccatgaccttgggcggacatcttcgatgtgaatcttgttgtacaaagtgcaggatagcggctctgaccccaccaatagcccttgttgttttgcctctcttccgaatgccccacaccctattaatagtattttggtcctttaccgtacatcgaccgagtgggcgacgtcccccaccgccctccattac

SEQ ID NO: 15704 - DNA, 334 bp, Homo sapiens
gaagctgctggaaggaattcattccctttttgctgttctgccttccaccttccactgtgaggacactgcaagaaagccctcatcagacaccaactgccagcacctagatcttgaaattctcagcctccagaactgtgagaaacacgtttctgtttttctataaaataataataataaaaaacttccatgcaggaaaaaaaatcaagttcaaaggtcctgtggtgagggcataccagctttgtttgtgattcagtaatcatgcctgtgtgactgtaatgaaagaataagggagaactgagcacagaaagaaaaaaaatcggcctaaataacctca

SEQ ID NO: 15705 - DNA, 293 bp, Homo sapiens
aaccaatgaattattagaaactcatagaaaacgtgttgactattcataggaccaaatgaacgcctttgttgggaaacctacaacacatcaattgttattatatgtatatataagcaaaacccacgggagaacagcacatcagtgagaattggatgccaaaatgaggtaacgggagacttatccccaatttaatattgatgttgtacctcctcggcttaacgctcagtttttttgtgttcttttaccgctgatagttgttagtccaatttaccctctcccgcgcgcgcccgagc

SEQ ID NO: 15706 - DNA, 461 bp, Homo sapiens
atgggagaagaccacagaagctctgcattcggaacttttcctggattctgtcccatttgcttcttcccatgaccgattttgatctaccaccctggcccatcatgcccccatcctgtacctatagaaactctgagaccctcgcaggcagagacacaagccgctggacgtcgagaggaacacattggtggaggaactcacaggtggctggatgtcaagaggaacacactggcggaagagcacactgacaagcaccagcagacaacggcacgctgtgttgtacgccggcaggccatcaacctgaagaacgatgtggagtggggcctgcgcagtcggaggagagtccagctgctaaacaatccgactccaggaaaaaaacaccttcccattccatctcccttctggctctcccatcttctgagagctacttccattcaataaaaccttgtacttattctccaaaa

SEQ ID NO: 15707 - DNA, 429 bp, Homo sapiens
ccaacaacaacaaaaacaaaaaaaaaccacaaaaatttaataccaaatcctgtcttgctatgttacccaggctggagtgcagtggctattctcaattatgatcatagtgcaccatggccccaaatttctgggctaaagccatcctcccacctcagctccaagactacaggctcacaccacaacacctggtcctctgtttacttctctttttcccctactaggttataaactcctccaaggcaaggatttagtcctgctcacagttgtaacataacacctagctcagtgcctgcacatagcagatgttctttttttaaactaaaatctatttctctcataattttttgttaagttgtggcggttccaattgaaaaagagacaacatgaatgaacattaacacataaataaaaagctcagatgcgtgaaaa

SEQ ID NO: 15708 - DNA, 187 bp, Homo sapiens
ttagcaacagcatgaggcaaccatggcacgaaaggaatgaagtaacttccccaagatcactcagcaagtgctcatttcagaaacgcacaaactgaaattggaacgatacggagattagcaatgttttaaataaaaaataaaatataaaataaaatgctcctgtctctgcaaaagaaaaaaaaaaaaa

SEQ ID NO: 15709 - DNA, 698 bp, Homo sapiens
cagataagaaaatcaagaatcagaatgattaggtgaaatgcccaagaccagacaaataaatggtaggacaaggatttaaacactggtgttctcatccggtacaacatgctgtcaccctcaaaatatatacatatgtactgctgccaggttcaaggaacaagtccaagtttatgcagtcctgctctataatgttcatcccatccattctcagcttcctacataaaagatactaaatgcgtttgcccttccaagaggtagaagaatacataaagtcctctatttgcaagcatccaacttgtgcatgactcaaatacaggaatggcgaccactcctctctgatgtgcaaaactactgaaataggagcctgtaaaggttttcacacacacccgtatgcccccatgggatcctagatacctcgtaccttctagcagagccactcatccgaagatgactcactcatggcaaatgccttggtcttgactctgaagctactgcagctagaaatccaccaccaggtatggtagaagagaccccaacaccatataagcagccacgaacatctccttaagaagtctcaatttctgtagaccctggcctaaactcaccactgtgaggatgcaaaagttgtacgcatctgatcctttggacagatttttctccacggaataaaatacctgcttattcatctgctcaaaaag

SEQ ID NO: 15710 - DNA, 565 bp, Homo sapiens
agagcttttcttcttctttttgctgctgcactcccaaaaaactcattgatatttcctaaagcagatgtttgtattgcagagacaaccattctggcagaagctttctgttctccagcatgtcatgctggaggagagtgcaccaatgattttggcatacaccaaggatagcaaattggtttcgttttaggagccaactctgatggaaaaataaagaattcggaaagctctatcttgataaagacaagaactgggttgatgaagaaaatgcattttttatcagagctatccgacataggaagtggagaatggtggccacctgccaagttaacggcaataactttattccaagaaagaaatgaagtcttcagatatttactaatgtatcaaggcaaattggagattttgagtcaacaggaaaagttgattcttgatggatctctctattaaaagaagacaatgatccataagaaactatattgtcagtgcttttctctgtcatttgtccagaattaaacttccacaaatgtgtaaataaaaaagaaaaatccgccttcgttggcctcaa

SEQ ID NO: 15711 - DNA, 581 bp, Homo sapiens
cgcatccatatccatatcagagctgcccacggtggtctgcctgaaagccccagctgtcgagctgatccattgatatgtgggacagagatccccagactgcagaggagtctgccgtgggccatactccatcaatccacatccttcccagacaagagtcaccaaatcattcttaaaaagtgttagagcctccaggtttaccagtctcaaatatgccaaaaattgggtagagaaagggaagagtgaaaactattaggaaggatgggagtaggggtctgagctgataaaagttttttcttgtagttgtttgctttcattttacaggttaactaaaaacctgaaaaatatacataactagccttgcacggcgacttacgcttggtatccagacactttgcaaggccatggcggtcatataacttgaggtaaggagtttaagaaccagctgggcaatatggtgaacccccttttgtatgataattcgacctttgcaggaagtgggtggctgtttcttagatggcatagtttctttagatcgtggttaggggattgagcggagccaagagatcatttagatttgtcag

SEQ ID NO: 15712 - DNA, 818 bp, Homo sapiens
  misc_feature (1)...(818): n = A,T,C or G
atagccactgtacactaatctttaaacatgcgttggctagtnttttatgtaccgcaaataaaagtttgaatgaaacccagtttcggcaacaatgctgtattagattcgttctcacactgctatgaagaaatactcaagactgcgtaatttataaagaaaagtttaattgactcacagttctgcatggctggggagccctcaggaaacttacaatcatgacagaaggcacgtcttcacagggcagcaggagaaagaatgagtaccaccaggggaaatgccagatgcttacaaaaccgtcagatcttgtgagaactcactttattttttttgaacaccatgggagaaaatgcccccatgatttaattagcttcacctaatcctgcccttggacacatggggctaataaagattacaatcctaggggatatctggatgataacacagaaccaaaccatatcagacgccccgaacacaaatcttatcgcgtccttcttgcttaaaaattatttctgacgagatttcttcgccaacatcatatataatggccagctacttcattggttaccgacatacgttaaaagttccagaaatttagaaactctgttctaagattgatctaatgccataagaattctcgcatattttataaatgccacacaccatttcatctttttgcaaattcttatttattgtaataacgttttcagtcaatatgaaccactattggtcctgtcttctatttaatccattactgctccatccatctaatgttttgtacattaatctctttatcttcaacaaatacaccgtctatttca

SEQ ID NO: 15713 - DNA, 273 bp, Homo sapiens
  misc_feature (1)...(273): n = A,T,C or G
cattttaacaccgaaagcaaaataacnncnnnagcaccacacatctcatgcggctaggatgcagtggcacaatctcaactcacttcaacctccgtctcctgagctcagatgaggaaaccatggccgagaggaatgaagtaatttccccaagatcactcagcaagtgctcatttcagaaacgcacaaactgaaattggaacgatacagagattagcaatgttttaaataaaagataaaatataaaataaaagaccactcggaaaaaaaaaaaaa

SEQ ID NO: 15714 - DNA, 837 bp, Homo sapiens
  misc_feature (1)...(837): n = A,T,C or G
gtcacacatgtagcccatgcgtttgtgggcaaaaatccctggatagttccaagactactttgtctccaaacagtcatttcctcgtggttttttatcgggcgctgacagttgaagagcatataggagaaaacttggacagaagagatcttttttttgtccttcagggggccacaaacaaggacgtgcccttctcaaaacacaggatcttttcttttgagatgaccggggggaggggtacaaagttgaaaaagggaccccccacagatacatttgctaccacctttcggtggcttgaaggaccaacaaaagaggcacagacaaagaggggcccgtngcagctcnnaacagttttttttgtntttaaaaggattaaaatgtctttgtttgtgtgctggctgggttgtccgctgggatccgagggattcagcacaatcgatacagcgtaatctaagatagcgagtnaaacactataagaacgacgatagaaacaactaacagaatgtcgttgtcagatgtacgagcacgaccgcggcggagattaaggtattcaacgcgcaagagggaaaactattacataatagaaaacgaccgagaaaacggcgtatattctatgataacagtggagtccgtataagaaacatacggtgaaacagaagtaacattcttgggttaggatgaaagccaggaaccggatagaacaaaagagagtgccgcgtaaataatgcggaaacatacacgaacacagaacgagtgacacgcagcaccgaacggaagcagttcacacctcagaatacgaatgacgataaatgattgaaacaatcgagatatatagaagcg

SEQ ID NO: 15715 - DNA, 911 bp, Homo sapiens
  misc_feature (1)...(911): n = A,T,C or G
aaacctttactccacaaccacatttcgccaaaannnnnnttgcacaacaggcaacctggtttacaagctgtgctgctctcagacctggcctacagagaagaactgacacagacttccttagatgtgttgacttcctgtcactggtgcattccttatcaatgtggctggagtgtagtggtgcaatcacagctcactggagctcaaaattcctgggctcaagagatcttcccgtctcatcctatcggagtatctggggctcacaggttcgaatctgtacaagcctgactgcaaagatatacaataataaggggaatttttttttttaaaccaatgcttggaggaattgtgaggcataagagggggggcccccttacggcttcctctgtctaagcgtgtaaaaaaaaaagatactttatatctcctcgaaattttcagtctcaaaaaactacacttctttccatgaccaatacgcattgtctgattatcataccaaaccattcgataattatcgtcaacgattaagttaaacggagcgctgtcgttgcttactaacccctgacccaattaaattttaaactcggtaccccacgtttgcctaactctcaaatagaaatctataaaagacgccactatcaccccttatcatctttttttaccgtcctctcacctatcaaaacctttcgcgctaatcgatcatacttcggaatgatacttcgttactacaagtgataagttacgccattgttctcccttgattttcaccacttatatgttcgcgtgatcagcttattatgttatcaatattgtattatactccacgctatgacctcctcatcaacagagcgttacactcgatagtttcttatgtacttatcacctcatccgcacaatccatgctaaatcgatgaccc

SEQ ID NO: 15716 - DNA, 678 bp, Homo sapiens
cgaatctaaaatgattcttcaccactttatcatccatagtatccatcgccagcacagaatacagttctgtttctttcatagaccttcgttggatttttgcccccttcaaagggccacacggagtatacacattacaccccggcttttcctgtttcacgaaagctcgtgccgacttatacccccaactgttaaggattttgggattacaataggcgcatcatgggatttctcagtctccaccccggcactgaggcaatttccctaatataaatttctgtctctctccttacgcatattttgggggaaccctcaggaacctttattaataacaaaagataaattcagttttaattgtatgtgaggcattgtggtggagatatataataaatacccccacccaagtgggcaaaggtctgggatcaaaaaatctatttgggaatcttcagcaaaagggcgataggtgaaatcataaaaagggttgaactcttctgggactctcatgtattgtaataggatgaacggcaaaaagaacagatacacatacatgtaggttggttaatattatggttggaatgtggactttgaattcgatgtacttggggggtgggtctttgtttataatgaagtcaattactcagtaatgtgcatataataaattccgtagggggtgtggttccc

SEQ ID NO: 15717 - DNA, 860 bp, Homo sapiens
  misc_feature (1)...(860): n = A,T,C or G
aacatgattgatcatcacatgcaccgcgcattnnntttgaaaacaacatatcatatgggacctttactgacatagagttgacatcattgggtcagaaagagtgaagcagtttttgaaagattgaatatgaagtgtttcccatatcctttcagcaggtgctaagggatgccatcagctttgagaaaggaaaacagcttcacccaagtaaaatggggataattcccacccctgccagtttcacaaagcttgaaatgagaatgtggacatgctaaaagcattggctcattgaaattgaaaaaaaaaaatcttgtcttttttttttagcaagcataggcctttgtccacattatggtcagggggcccccaccatactagaccatcgcgtctcccaaaaacaaaataattcattcaggatcactagcatagtacgaacgaatcaatatccgatgtgtatacatcgttctctgctcttcccagtatacaagtaatatattaagcgtttctatcactaaccacgctcagaattgtaattcactcttagttgctacgtccgtatttttgcgtttacgttccgccttttccattaattcattctaattccttaggctcggattattcgcgcactttcatcttatgaaacacgacagattactggaacatatcttgccgaaacatccacaacatctatttttttcaaaatcctatatgctatatatctcaagcaacagcacttataatccatatataattaccactggcacaatattatatcttatactaaatagagacttacgcacctcataacatctgatcttcaatagtgactttcaaatacgaaccgcatcccggcattttagcgc

SEQ ID NO: 15718 - DNA, 316 bp, Homo sapiens
  misc_feature (1)...(316): n = A,T,C or G
attataatccaaaagcaaatttccccccnnttttccacacacactcctgctggaaaccactgaggctctaccaggtgcagtcatgccttctggactccaccatctccccttggacaccccccccaccccaactgatggatgcaagttcttaagcaccaaatggcatcagagtcctctcagtgctctcccctctgcgtacctttgtctctttaaatattctgaaatccaacaaggctacatgaacactggcacttatgactcagtgtcctacagaatttgaataaagcatctctctgaatttttaaaatttttttta

SEQ ID NO: 15719 - DNA, 824 bp, Homo sapiens
  misc_feature (1)...(824): n = A,T,C or G
taattatcacaatgtatacacctctgtcaaggnttttcagtcggtatctcttcgcaacatgtccaggcattggttgccatctggggacaagaatcacaacagccatcagatttaccgagggcccaaaaaaagcatgcaaaggcccgttgtggggctctgggactcctgtttgttttttaatctgaggcgcggggcccaaaagacgatgacactcctcatgcgaatatcgcatctgatattatgagttgcattgtacagaattacttttgacccccggtgatgggtttagccatgcccattgcattttgctcctttacaaagaacgaacaaagaaccgagcgggattatggggggcgccgcctctctagcctgttattacccgcgaaaaaaaaaaagataattagtccgatgagtttaacataacagactctcccacattagactctaacagatacagctcctgcactaggaatggaggtcggatgttttagagtaagaaccaatttctattgaaggtttggaattctttctctcggatttgatctcatattgtccaggttttgtattattttgacgagtacgacattgcgcggttacgctacgtacgactatgattattagcataccatattatatcatacgagatatcacaccttggaggtgttgagcggttagcggaatatagcggcaagttaataactgttaacccattatatttgcggcttggattacgttatcgcactgattatgctctgctctgggcgtctcatttgacacacaactatctatgggaatcagtggttagccagaaaaatatagagtcg

SEQ ID NO: 15720 - DNA, 730 bp, Homo sapiens
agcaataataaaatcattatgatccacatttaacccacttaaaaaatttctacattctcagtttctgtttaatggcctatcatttggcaagttcaacctgcattaatttttacagcaatacagtatgttttgacagctaacagaactagtttcttcactttatttttcatcttaaaaattatcttgcttatcctttcattcttaatttccatatgaattttaaaaccaggttgctgcaatccacgcaagtaaaaacacttggcattttttggaattttgttaaaattacagactaatttgaggagaatgtcaactttaaaagagggtatctcaacagcagcgttactgatattttgggccaatttttttttgtcatggggggggctgtcctgtgcactgtaggatgctcagcagcaccctgatttctaattaatagacactaatataaacaaccttcctctcagtgtgatgacaaaaatgtcttcagacaatgccaaatgtcccaagagtcgaaatcacccccgattgagaactactgctttaagatactgagtcatactatccacgacagtagtgagtcaatccatttatttggctgtccttaattctcttgaataagttttgtattttttccataaaagtactgcagttattccacagaactttacatttttgttaatattgcaaataaaatttttctaggtgtgtaatggcaaaaaaaaaaaaaaaa

SEQ ID NO: 15721 - DNA, 749 bp, Homo sapiens
tgccccacgcttgcatggcagaatgaggattcaggtcgagcctgtctaacacataaccccatccctttccatcacgtttttatgcttacctagcatgggctctggttggcagggcgtcttgaaagagagcttctcaaatgcaactgcacctgtgcatcttgctaagatgtggattctgatgcaggacttctaggtgggggctgagactccatttctaacaagtccccaagtcatttctttgttgctggcctgcaaagcacaatgtgagaagcatgagggggggcgccccgcccccctcattttgcagcagaagaaaaaaaagatgttgaagtcaagtgacttacttcaagtagcatggcacgttagtggaagcgcgaggatacagacatgggaatgctaatttccagtacagagcctttcctttaccatgtgtgccaaataactaaggtatgtgctctttgcttcaaccccatccttccgtacttagttatcggatgctggggttgcgctatagactcgaaattatcgcccccccccataccctctgttgaaccataatccccttccgatggatatattgcgtggtcgctgaattcgtttttcaattgcattcctctattgacgatcagtcccgcgtgacagcttgaaaacctgccatcctccacttcccatctctatgcactgcctgctcgtacaacttgatcgctataatatacggcctcaccccaccccatccactttataagtcc

SEQ ID NO: 15722 - DNA, 824 bp, Homo sapiens
  misc_feature (1)...(824): n = A,T,C or G
gaaaagatactgtgctgaataacgcgcgaaaaannnttcaaatcaacaggnctccttgnggctattccagcatctttatgtcaagctgtgatctgagtccatgccctccaggaaccagacatttagattcaagaaacacagtagccaaaggattgagaatcaacagccaacccctgcctattttctggatttctttagccacagaattggtgttgaagcccattgttttcccagtggactactccccatagtggttgtacctgccctcatggcttgaagaactgactgtaagctgttaactgccaagtctttatttcttttgaactcataccagagattcagactcacatcaccacctggggggcccgtaactacacttggatttccacagacaaaaaaaaagatctcattatcttctaaaattgctcctatttggggttgcaatcatgtgttttctcacttagtcaaagatgctaccatgcaaggacatttaagatagtgttcttaatggcaaccatcatttttatactcacctaagaacaggcttctcattttgcatctccaaagcgcccgtaccatagcccattacaaattcctcattacgcttctgccgccttctccacatttatacctctcgctctgattactatcgtgtaagcgcgtctaactgtattgaactttgtgattatgtaatcatcacctcttcctttttagcccatcattaatccgtgccacgcctagactgaagtacattgggtagaacttgcgaatcaatcttactgcaatttctattggtttcgctgtgatcagtataaaatgttact

SEQ ID NO: 15723 - DNA, 729 bp, Homo sapiens
cgccccgggcgctgaaataaatttgtggtgcgcccgaaccccccccccctccccccagggaatgggggttttttttccccccgcctttttttgttaagcccccggccgggggtttttttaaccacccccttttagcccccccaggtttggggggcccctctttttttttttttaggcgctcccacgcgggggacaacggggaaagggaaaaggggggcggggttcccttttcccccgggggggttttttaaaccccccggggggggttttaaaaaaggggttggcaaaaaagccccctttcccccccggggggttttggaaaaaacccctttccccccccccccccttaaaaaggatttttggggggccggggggggcttttttttttaggggggggggttttccccaaaaaaggatttggggggggaaaaaaaccaaaatccttttttttcccctccccccaagggcccttttaaaaaacaccgccccccccttttgggggacaaatttttttaaaaaattggggcggggggagggggttttcccttggggggtccccgggaaaaaagttgcccccccctttttttttttttaaggggttgttttaaaaaaaaaaaaaccccggggggaaaaaaaaaaaaaaaaaaaaaaaaaaaaaaaaaaaaaaaaaaaaaaaaaaaaaaaaaaaaaaaaaaaaaaaaaaaaaaaaaaagaaaaaaaaaaaaaaaa

SEQ ID NO: 15724 - DNA, 747 bp, Homo sapiens
atgcaggcaaccttttaccttgttcctcccaagcttgatgagtcttgattttcatgataagtcagccccagatttaaacttcactctgtttgcataagttctttggctacttattcttacttccctgctataaggaatacctgagactgggtaatatataaagaaaagaagtttaattgactcatagttccacactgctggggaggcctcaggaaacccacaatcacggcagaaggcaaaggcacatcttacattgcggcagaagagagtgaatgaggaagtgccacactttaaaaccatcagctttcatgagaacttactcattttcatgagaacagcatagagggaactgtctccatgatccaatcacttcacaccaggtccctccctcaacatgtagggatcacaattccagatgaaatttgcgtgggggcacaaccaaaccttatcaccagagttttgttattggtttccatttgtttagcattggtggtggaggaaagacatttcttcttggcactttttgctctgtttcattcttccattttgttttgtgctatgtaaaagtgttgctttccatacaaagattaatgaggcagaactaaggcattagcattattagcctgttggcataggcctcacaaaccattgagttctctattctcaccacacagatgtccacttggataactttgctgtttgtcaccaataaagctggatatgattctcaaaaaaaaaaaaaaaaaa

SEQ ID NO: 15725 - DNA, 1468 bp, Homo sapiens
  misc_feature (1)...(1468): n = A,T,C or G
aagaatattatatgatattgtataaattatgagaatgcaggatgaagagaataaacggagttttttatatggtnggttggaagaaatgaaagaggagagtattttttattgtcnnttgtaatgcaataggagttagttataacgagactaggacgggacaatacggtgtgagttgtgccgggatgtgtttctctaatcgatgtaatacgtcctctcatatgtttgcttcccagttatgagcgcgtccgtacgaaagacgtcgagcggatgatgaggcggcgtgccaatcggtcgtcgtacataggagatgcgcgcggataagggtgatcggatgaagtgttatagcgcgagagacatcgttattacctttactatccgtccacaaataacaataccgatgcgttgacctcgctgttgctctagtgtgtactcataataccgtgtgttcagtgaggggcacgtcgatcgtgtcatcgcgcgccgcacgcgcgtctgcgtttcgtgccgagcgtcaatcaagcataaatcatacacacacagcacacactcaaagctagtatagcgccacagaacaattataccacaatttcattctatatcaatccacaccactccccgcggtacacgcgcgcggcaactcctccgagcgatttgttctagtgaagataccacagatgtgcttttcgcctgccgtcgtttctgcgatgcgatgcctgtccgccatgttggctcctcgtcccgcacacacgacgaatgcgcggcggagaggcgaggacgacgagacgatcgcgagatattaggttcgcgatngtgtgtgcggctgagacaccccgttgtacagtcttttacaatcgccccgaaaacacgttgccgcagagtcactccgtnttacgctttagcacgtcattttcgcattagcgtcccatcctccgcctatcacctgattaccactcgctctctccgctcctattctttaactccattcccctctcccagagcccgtcgattgcgtgatccgaccccgttcgttccaccccgccgccccggtttccaacccgacttcccccttcaccaccagccatacctctatttcccccccccccacaccgtacggtgttcgccctgcacctatggcgccgcgcctttccgtggattttttgcccatacctacgatttattcaatatgcgatacaccacctctatacccccctcccgcactcatcgcaatacggcgcccttactataacccacgagcccatacctgtcccgtatacgcattccccgatccagtatgcttagcgccggatatcgcctttccgcttctccatatatttcgcccccatattccgccccgcctccttgccccgatcccgccccataataacactctttatacacttgacctattgcccgcccatatcaccacgctgtgtccacgtacgtatgcgaccgctctagtcgttattat

SEQ ID NO: 15726 - DNA, 837 bp, Homo sapiens
  misc_feature (1)...(837): n = A,T,C or G
gaacatcttcctctcactcttgctnccncccaagagntttttaaaattcaggtcaatagagcccaaaaatggggaagatagtgacacagactgctccaggaagagaaaagagcaaaaaaacacccttggatgaaaagaaaatagaacaatggagaagatgtggacttgaaacacagtcttcaatctgccttatcatttgcttttactatgtcttaaaactaattatttattgttttataatttccattatatattattgtctggctttttagctgcatatgcttatggtctccatattattaagctatcgtcttttttttttttaaaaacgagataagaccgaggaaatataagaattggggggcgcctcattttaacttctttgacgttttggtaaaaaaaataaattactcacactgtccatcttttaatgagttcacaatcccctcgaggtacatctgtcacacccgtcaccgtttaactcacatgttcccactcagttcacgttcgaccaagttcgttattcgtttcccgaatcatgcactctggtatgtcttccatctagctttcctcattccgcttatgtcttccatctttcatatcgtccacatatcccccgattcaactgttaaaatcaccgtacgcgcctgatatcttcccactacccgcatcaaccggtcttcttcgcgagatgtggattttccaacgcgcaattttgtgtcccgtttcttttcctctggcctctcttttctccttttatttttgcctccccacccccattgccattcatcgtctattaccttcggctaccctgtctcacacactctatttcttccg

SEQ ID NO: 15727 - DNA, 807 bp, Homo sapiens
ttgcattacaggcgcagtcacagcagtggaagagctggctcatgtgtggctcaggctgactccacaatcagagtgattatgtggaaatcaatcacaattttcttcttagaagatgtttgttctgacataatgactgactttccagctaatttttattcataggcttctccttgcacaatgatctctatttctctcaatgttattctgtgtctttcttacttgcctgcacattctgaaaaaaaaaggaaagcaattccctacattttattttgatactttttgttggtagctaacatattcagaacacaatgcaactttggggggggcagcacttataatatatattaggaaaacaaaaaaaaggtaccaccagttattttagacaggtatctcttaggtaaaatgcggcgaaaatagatgggcaatgatagaattcatatgtgaaagagtcaatcggccatcattctgccaacattattttggcgggtcaggggacattccaacctctaatttttaagaattaaaccgccatttacattattgtcgctcaaaacacaatgcccaggatgcgaccgtctatctgtcaacatcacgccacccttttttcatcaatccggttccctaatcatcccctggaaggatacgccgtccctggtatcccttccaccaccccacttctcccgcctaatcttctcaccctcttgtgtgtaccccttgtgtagtgacgactgcactgtggcattctcatctgatccatgacttttcgatacgtcaaatcctagacggctagcgatcaatatcatggcc

SEQ ID NO: 15728 - DNA, 783 bp, Homo sapiens
tttgaagccctagcaggactctaggcttctatcactggtaacagaaattaatatcctggtgaaatcaggcaagaaaaattgaaaaggcctctttgaagtgtcttccagaatgtaggaagtgaatcacacttctccattcataaaacaggtggcattaactcctagaaggtccagaaattagtacagaatagaggagcctacctcccagagaaagggcatttaattagtagatctatgagagttaccttcctagctagagtttttcaatttggaacttttctgagcagctattacgcaatcttaacaagaatgtacagaaaatcaataaactgaaaagttcaatgtagtataatatgactaaacttggaaatattgtgcaatgcggcattatactgagctaatcctagcagattcttttcttgttactacaatccctcctaatgcattatagtcctcaggtaatgtacttttactttaaggcaaagtcatttctgtgcagcagggagtgatcccttgaggaaatttgatctcaagtcttttttttttttttatttaaggcaaaatgaatgtcaggtaaaatgtctagataaccccttgaaaactcagaactcatgcacactgaataagtgctatgtgaagtaaagaatgagtaaatgcatgaaatagcaaatacagcaggattgttttcagatcagtaaactgtgcataggttatgcaatgctaggacgaaaaaaaagaaaaaaaatggcctcgttggcatcagcggtggagctctgcggccag

SEQ ID NO: 15729 - DNA, 864 bp, Homo sapiens
  misc_feature (1)...(864): n = A,T,C or G
atactcgcataaagattccgaaanaaaaaanntttaaannnnnnnttgcaagganagctagcgaatttgcgcacatggatggagcaaaatgaattctctcaatgggagaaaacacagtagaatttccttatcttggaaaaacccaaaaaatgaatgcatcttgtacagtatgtctgttcacattctgagctttctcatcaatggcaccgaaccactaagaacataatgaaaggatgctaactgatgctgcttcaaacacaagatggtgaaacttcgtgtgagcagtctttgggttgttactagtgaattacagaaactagtgttttgtgttgggccatttctcgtggttaaccaaggacattgtgggggggggcccacaattgattatgttgcgatggattaaaaaaaaaaaactatttttagggtcatgctacttgacctttatcaatatcacatgcctttgatagttacaagacacttctcacaggtacaacactacctcacatctttatattcgcagataaacatgtggtgttatatgtaagtatgtcgttgcatccagtataatagaaatctcttctgcgccttgtgcttaaagaaattaaaaataaaaattgattccttttctctcctctcatcatattaataaagcaagcacatatactatcttacgattattaactatttcgcagagaatttcgtgtgtattcattatactcaagacttagaccattgtatcgctataaatttccgagatgatgattacatatctctacttatatatagatgttttgatcgtctatcgattgtatcatcaatattctatttgactattgagatacgactgtctatatgttagtttct

SEQ ID NO: 15730 - DNA, 827 bp, Homo sapiens
  misc_feature (1)...(827): n = A,T,C or G
ttgaaaatgctatgccaanttcgcacaatgtccagcccaagcttttcaactatagggacaaagaacgtcagagtatgtcagattatcgcacaagcgctaaaatcagatgccagtcaattggatttcgataaaacacgaaatatcatttttcatggatttagcgggccaaaacaagactaaactcaatacagtggatgaccagaaagcatgttctcccatcatagatgtgggacctttcctggctctggagaagacaacctaattggagagtccagttttcctagttaccaaagaaaaaaagaatgttgatattccttaaaggggggccccccctcaagcaaacaataggcctgtctacaaaaaaaaaactctactacgcttaactcatactatatatccaaaaaatatacaaatacataacccgcattcgataacatccgtaactttcgccacacacaaacaaatacacatccactccacaagtaataaaacgcataatccaacctgactttcatatgatctttacacgctccccagcctatattcccttaacacatcaccccaattccaaaaattaatacaaataacatatcttcgcgctcaccctcgtatctacattttatttattgccgacatctatgatatctatccatataacacacatccgtatttccgaaccttatattcaaatatcacaaccacccctttttttcactacattctctcatacctcccgtaccccacgtaccaacacactcgcaacccacctacatatgcatcagctaaaaggaacgacctaccagaacacagatcctcttaataatagc

SEQ ID NO: 15731 - DNA, 743 bp, Homo sapiens
aaatctttggttttaccatgtttgtttgtttttttgtctggtatcccaaggactaaaaattagcagacacgttttgatgttgagtgaactagtaagtcacagtaggtggtagggttcaatggtttctctgttagtaagttttaaagaatgaagatagttataaatgtactgagtggccgtttaattggtaagggtcgctggcccaaaaacactagagcatggccacgtggtttcctgtagagatggcctcagtttccaacattccccccaaatgtttgcttctcacccaatagaggggggatcttgagactcccaagtggaggttgtgagcttgcaccctgcctcactgtgtagacagactgtatggatatatgaagtgggggtgggggccaaggggctattactgctgtttggaaatatttgcctcttgtagatccagccttaatggttttgtgacatcctagtactagcaaacctgcacaaagtgggtatcagagttaatactgtgaggagacaaagtagtgagaatagttttgctaaagacaatgaagtatcacataatgtctgcattttaccattgatttgagtgcatcgttagaaaaacttaatgtaatgaaaaacccaggacatttttggaaattgtatgctctctagcaactttgtgtgaatttttatacaaacactgttttatgagttacataaaatgttataaaaatagaaaaaaagagaaaaaaaaaaaaaaa

SEQ ID NO: 15732 - DNA, 1019 bp, Homo sapiens
  misc_feature (1)...(1019): n = A,T,C or G
ataatttatatcaatatcatcaaanggannnttaaannnnnggctgataaatcagctttgctattatgtcaaaaggtgtggcttatacctgcccattttgggtcgcatcttagaaacatgggttaaggtttacaacaagccaaaaagataagaattcattcagtattatttttattatataaaactctttttttgacacacaggcggggccacacaaaacattcattgtcggatagtatcaaccgcgcacattggtgaatctatattcgaaacatatcgtaatatccatgatactcgcaaaattgtcgaaattaattgtgctgggacggtcgtgttttttttttttacaaacgccagcgaagtgttagcactttatttttatacttaatggggggcgctccctcatatattcgcttgttcgctctgtttgttgtcaaaaataaaaaaattgtcttgtcttttacatatattctcgtcctttttaactggtcggttctgttattctcatcactgttaattatagtgtttattagcacgatcacggcgttcactgttcttatttgtgatcgctacctatttatntaagatatacacctaactgttcgttcgtcttcttggtaagtccatacttctgccgtgcgtgtatcagttgtaaaactacgattccggtgcttttgtcgtacattgcattacgactataactgactatattcccgttattcccgcgcataacactcttcgtatttgattttgccgttactcatgtttaattgaccgtttcgcatgtatgtcatcacaccaacgaatagttaatctatcgcatatcattctcttcttaccaccactacctactctctctgatgtttcccctgttttgcttttcccgctattcatctatcttctccctcttatattctattctgcatcttcgtctgttactatagcccaagtgttaccgttcaattatacatattactcatatatccctactctacacatgcatattaatatcttatccg

SEQ ID NO: 15733 - DNA, 834 bp, Homo sapiens
  misc_feature (1)...(834): n = A,T,C or G
tagaaggcagcaatatttgtgcgcgaacagtaatacagcttggtgtctgtctatggacactatttgctgttataccagaatttatagacgaacgaatctgctctgcactcccgtcctgtggagggcctccattgtcatcattctcagcttgaatggggggccaaccttgtggccgaggaggctgttattgaaaatcgagccctgtggatgatgattaaaagatgtttcggctatcagtcaaaaagccagtatcggatatggcagagggactttttttttgaccctagttggcccccgctaaaccaaacctcccagtgggggcgccccgganagtggcagaggagtgtcttacaaaaaaacatatttgagagcaatgaagaacaactctgaaggacatgtgatatccaagttgatattacagaaaaacaatgacaaaagggaccagtttcattgaatttaagaaatgagactctcgtaacatgcacctggagtgttggggctacctatcaaatcaggggggaccaactaaaagtgtggccggaataaacactgtctatagaaaaaaacatctcccccataccagcggcacgtcgtattgggttccggaacggcataacaagtcattcccagaataggcaataatggggcccattacatcgctaagcggccaggaagaaacagcacgcncaacaggagaacaaaaataacgaatcctctccacaaaagaagttggagacactgtattttgtcgaataacatgagatacagtggggaagccgccgagttgcgaatcaagagatgaggcggagaagatgctcagaggagtcagtgatc

SEQ ID NO: 15734 - DNA, 759 bp, Homo sapiens
  misc_feature (1)...(759): n = A,T,C or G
cacacaggagaaccccgatttttattaaaaattacaaaattagccggggcgtggtggtgcatgcccgtaattcccagctacttggggagggntaggcaagaaaaattgctttaacccaggaagccgaagggttgcggtgaactgagatcgcaccattgcactcaggcctgggccacaagaacgaaactccatctcaaaaaaaaaaaaaaagaatcattctttttcaataagataaataatacatttgtaacatgaaaaaattaatatggtcttcacagaagagttcaataaggccatgttctttattttctataattaaattaaaccactttatgagacccaatttcactgatggaggaagagcaacgtgcatttaaatttgctgattaaacctaattcacattttcttgcttaaaacactctctcacagaaatattcagtcaattcaaaatataccttcctatgagggcatttttctttccctcctcctttttcctaagatagagtctgcattcaaagtaagcttttcaaagcttcatagcaagaagcaggacctctagtttatttaaccttgaaaagaccaacgagcaatttttcctttgcgtaggaactgtgcttttgatagcattgtctctatctacaatgttcttctattttgctgcaagatttcttgtgatttttctcctttgaaatgtgtctggttttttttaatatcattgcaaagataatggctacaagaggcaaaaaaaaaaaaaaaaa

SEQ ID NO: 15735 - DNA, 274 bp, Homo sapiens
taccaaatgtacattacataggggcgcattcacctctcccagtaaattgctggtactggaaactgaagaattaacatgggcactggctgctctcatagctggcgactgctcaacctcctccggttcctattgctggtcctgattccatgtatctgagctctcgttctcttgctggtcgatcccgctattcctatcgtagcgcggtcgaggccattatctaaataataacgaacacacagagaccaaataaattacatggcctcgttggcctcaa

SEQ ID NO: 15736 - DNA, 762 bp, Homo sapiens
caggagctatcctcacagcttcagtctgcatttcttcttgctgccgccatgagaagaaggatgtgtttgcttccccttctgccactattgaaagtttcctgaggcctccccaaccatgctgaactgattgatctggagagagaaaaatatagagactatgctatcttttataaacacagcattacctttcagtatgtcttagggaacatgaagaacatctgcagctatcactaacagctgaagctgatgataggctggaataaaagaagtgtaggaagcagtgcagtttgcctcaacaatatataaacaacccacgaatatatcctcataaagcatacgcgtggactctgttactgactgagttgagtcctccccgaactttatgttgaagcctaactcccaatgtgactctacttggagatatgccctttaaagaggcatttatgggtaaatgaggctgtacaggtgaggccctaatccatcatgactggtgtcctgataagaggaacagactccaggggatgcgcatacacagaggaagaggacatgtgacgacatgacgagacaagaggcatctgcacgccaaggagagaggcccccagagaatccacacctgccgacaccctcctgaaattaaacttcataactgtgagacatacgtttctggttcgttagccacccagtgtttagtacttcgtgatggcatatgtaaccagaaccctgactaatgcagaccctaataatgggcctcaacaaattatg

SEQ ID NO: 15737 - DNA, 743 bp, Homo sapiens
agcaaaagaaacgtgtgcttataattttaagaatgaaagagaattaaagtgattacgaaattgttcataaactataaactggagataccctgcagagctgcaagagtaaaaaaggattatcttattacaaacaaaaattgtaaacaccttccccacaaataaaacattagctctttggtcttctttaactggggaccggggatgtgagatggtatgaaaagaattcctgcagggctgatgataaaacttgcaaactactcaagtactgtgcttgatttaatcttctaaaaacactgcactgtttgaacattttatcatttggtggtcatttcattagctatgcctggggtcagggggaaccctctgctattcttagaaaaaaactattaacaacaacaaagaatttgttgaggtggaagttgaagctttttgactagacagctgtagatttctgtctctctgtcaccacctgaccctatccagtatagagaccacagagccagataagcacacccacaacctgaagccaccttgagccccttcacagtgcactcctataagcatgtggaatgtccactttattttagaacacaatctggatggtcagatgcttatcgggcaaactccaaattttaaccacactaaatgtcaaatgcagatctataagttagctttttaaacttttaatggattttattaaaaatcccaaaatttctggcaacaaaaaaaaaaaaaaaaaaaaa

SEQ ID NO: 15738 - DNA, 784 bp, Homo sapiens
ccaataccatgatttagatctattgtcccccatcatctatgtccccacataaaatgaagattctgtgaaatcagcccttgagaacttcttgaaatgcagaagcacggccatgcgataggccagtcaaggttgaatccgggtccattaaaacagaaatgaggaaaggaatcccgacttatgtccagatgaaaatttccaaactccttggctgcattccttagaattgataggaactactcgagctgccacctggggcccatagcggaagcttctctctgaggatggcgatgagcccacatcagatggaaactcctgggttctctgatgactgcggggccaccataccagtcccggacacccttcatttatgttatctttaggttaaataccagcggaactgtcagcctgcaagtctcaaagatggatgctttgtgaagtgctacaaaaggatgatccttcccacatcctcatgaatttacgtcacttttgtggaagaacaaggctcaagacagccaatgccaaagatcatcctgtctccaggctctgctgaacctgccgatcggtggcaaatgacggaagacaatgaatccactgaaaggttatggagaacggcacgcacctgacctaaaaaccttaatgggaatgttttcatgctaacggccaactgaaacaatctcatcattacttcttattaggatatacattcacatccggctgtcgtcttaatctggcaatccctgctatgcaaatatagtactttcaatgtgagcatcgagcccaccct

SEQ ID NO: 15739 - DNA, 759 bp, Homo sapiens
aaaggggggtgttttttttccgggcgttttaagaggcgggaatcccccctctccggggtgggtatagagcactttgcacaccggccctaacgccccccaaatgttcttttagccccctgtgggtaaaccccccggggggggcacccgggtttttttgtggccaaggggccccccccgcccacgggtttttgtgcccctttggtttctcccccccttattgggcggcggtgtttttttctaccgcccccccaaacggccccggggggaaccaaaccccggggggggggaaaaccccctctcttagggggcccggggggggcccccccccccctttgggggggggggaaaaaaaaagctttcccccgaccagggcccctttttttacagggggggggggtttttccaaaaaaaccgggcccccccccccgtggggtttccgggaattgcccacttttttgggcccaccaggcccccctttgggggggggaaccccccctttggcccgcccccccgggggggggggccccggtttaaaagggtttttgggccccggaaccggggcccctttttttttgggtttttttctggggccgggattttttttttttttggtttttgtccccccccccccaaagggcccctttttttcggcccaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaaaaaaaaaaaaaaa

SEQ ID NO: 15740 - DNA, 736 bp, Homo sapiens
tcgctaccttaatagaggcctaacaagagcactgatgaacaaaagtagaagagaataaatgttccatctcaagaaaagagagcttcttcctctaacttttggttctgtcctgaccctcaatacattgggtggtgcctatccacaaggagagggtgctcttctttactcagtctactgattaaaatgctgatttcttctggagatatcctcatggacacataaaaataatgttgtaccacatattatcctagtcaagtggcacctaaaattaaccactccaaccatgctctataaatttttcaggtgctttatgtgtattaatccatttaattctcccaataaactttgaatctgtgattatgtagcctctttttacaatgagaaaagttaaaacgactataaaaccaaataaattatataaaacagcattaaacaaaataagcaatacagggaaactttcggggaacaggaagttagctacacatttgactttggacttttcaaaagaatataacccaaatcctttaacaagacaatagaaacaaagaagtggaaaaagtcttttggtatcccaaggagaaaattgccatgtttatggctggttgtgagaggcaaaacctaacagaagccactgcagagaaggagccccaaaatctaactacacattgacataagttatctggttaatccattaaccataccatcccttaaggggtgagaacacctagattctaat

SEQ ID NO: 15741 - DNA, 747 bp, Homo sapiens
caattttaaataagggccggtaaaatttggcctttttttttccggggttttaaaaagccggataatcccagtgaacggttgggttatagggcattgagcaccgccttaaaagcccccaaaagtttctttcgagccccctgtggaaataacaccggggggaaaccacggaatttttttggcccaaaaaggccccccccagaactgttaaaggggcaaccataggtttccccccccaatacgaacccgaggtttatttttccacgctcaagcaaaagggcccgggagcaaacaaaacccagggtcgggtaaaacccccccctatagggcccccgggaaaggaaaaaccccggaaatttttaaaccccggggtccaaaggggggcgggggttttccgggggccctttaaaaagcaagttttttcccaaccccttagtcaggggttattttggggcccccaaaaggggggtcccccgaaggggaaaaaataaagcccccccccggaaaaaaaattggttggttccttaaatatggccccgcttaaacttttacaacaacccgaatcctttgtttaaacaaaaaattttgccttttaattttcccccattgggggggggttttaaacctttcaaattttccccccaaaaaaaataaaaaaaaaaaaaaaaaaaaaaaaaaaaaaaaaaaaaaaaaaataaaaaaaaaaaaaaaaaaaaaaaaaaaaaaaaaaaagaaaaaaaaaaaaaaaaa

SEQ ID NO: 15742 - DNA, 510 bp, Homo sapiens
  misc_feature (1)...(510): n = A,T,C or G
ccacgcttatatgatataattcgtaattgaaaccccgacacgtggagcggatggttctagcaactatnccgtcacacacattgccacggtactgctactcacaggccacactatatggcctgttagaaactgggccgcgcagcaggaggtgcaagtatcccgctgggcgctgtggctcatgcctgtaatcccagcactttgggaggccgaggcaggcggaccacgatgtcaggagatcgagaccatcctggctaacacggtgaaaccctgtctctactaaaaatacaaaaaattaggctggcttggaggcggtcccctgcagtcccagctactcgggaggctgaggcagaagaatggcgtgaacctgtgaggcggatcttgcagtgagcctagatggtgccactgccctccagcctgagcgactaagcaagactctgtctcaaaaaaaaactacatcaatcatataacagaacagaatgactacagtgaaaaatggcctacttggcctaa

SEQ ID NO: 15743 - DNA, 732 bp, Homo sapiens
  misc_feature (1)...(732): n = A,T,C or G
agagcccaatggaagctataggttctnacaccgtgagacaaggtaaggttcctggaggtaaagcccagaaaagagtggcccctccctgagactgaggcccacaggaggttttcattcacatcctagactaccctcagcttccagtaattcttcaagattaccacttgaatattcctacctgtttgtgacacccgcagcctttaatccaaggaagatctcagctgtgactccctagacactccacatttccaggaggcaggttgccctctgttccatgacgtatcctaaaaaaaaacaccgatttttagtttgtccagctttttgttgttgttgctgttgttctaaggagtttttgttgttgttgttgtttttctttacttactctatatttgaatttatattattttctttttttgcattttgatgattttttttctggttttgccaaatttctattgattctatatttcgcactgacaactttgtaaatgtagaatgcttctccattacattaacccattaactttttaaacctggaaacgataaatttgctttataaatatttatttactggtcacgtttctgcctggcatgggactaagacaaagactggaatagacaaagtccttaacacaatacagggttaatagctaattattctaatacaccaaccaacacttacaaaggatgccctagatgtctgataaatggtacgaaatatttgctttggaa

SEQ ID NO: 15744 - DNA, 760 bp, Homo sapiens
tgaggataagaagaagaagaagaagaagaggaagaggaagaggaagaagaagaagaagaagaaagagtagttgttgtttattgagagcgtgctggcaaatcaggaggggtttaatcatctgaagactctgctaattgatttacatttcattctccatcatcttaatcttcctactagaaaaacaacaaaatgtaattctacaatagtggacagtttttttattcttatgtatttatacctcaccttatttcataaaagacttcaggttattaaaggtactccattgtaaaccaacatagggcctggagaaagcacaagacatctttcatgttagcataaaaatgtcctgattaagtcctttaatccattccatcctaataatatgacttatcagcctgctcatgttgaactagaatcattaattatggatgttctttttgtacctttaaatgaaaaaaaggttaactgtttaaatatttgtaaagatataaaaccaagttgctaagatacagagtattaagtgctattattttggctccttatgagtaaaatggtatcgtacacttagaagcgggctgtcacattggaaggtaacgaatgccaggatttttgactgagtgttaaaatgtagtagttggagcgaacgcaactcataagttgccgagacgatatactggccagtcggcgcatctagaatgaaaaaactgttataagttgactaagtaggcaggggtatctagacccgagagtcgatttatcg

SEQ ID NO: 15745 - DNA, 736 bp, Homo sapiens
  misc_feature (1)...(736): n = A,T,C or G
gaggcccacagccactctgaagacaaggaatctgagacctggctggagaagaggacttgcctanagtatcccacacagcaaattagttggaaaaccaggatagttgagtaaatatcctggagcccagccaagtaatgaagccagaattcagaaagctgttttggctagatcttggatttttacaataaagggtctgtaagggatatttgtgaaaaatgttgacacttgacggctgtcctgattcattcagctacctaggttatctctgcctctctttgacttgtgttttgtcttttaagatggcagtcttgctcttttgcctgggctggtcttgaactcctgggctcaagcagttttcctgctttagcctcctgagtagctggggctacaggaggacatcactgtgcccagctctctccgtatctttgactaggttattttacaaccccatacgatagaaatgaagttatagaaaactgataggaatacaaataattattatccatggaaatgcaaattggatctaatggaatgaaactgattttttttccagcagatagtgaccacctttgtatccttttgtaaattcatttcaacattccatatttgactaaaaatgtgcgacactcccaatttgcttttgaattcattgtaatatctaccaattccctcattaattaatgagttaaataaagcctttggcatgtatttattttgtatctaaaaaaaaaaaaaa

SEQ ID NO: 15746 - DNA, 742 bp, Homo sapiens
agccaaatgacatgaatgactgaaagacatgtggagcacaagactcaagaactaagtgaaaggactcacacttcctgatttcaagtaaagctacagcaatcaagacgtggcattgatgtaagaatagacacatcaatgaatgaaacagaatacatcttccagaaataaattcacacaaatatagtcaagaggttttttgtgtgctaaagtgtatataatatttaccattttaaccatttttaagtgcacagttcagaagcattaagaataaacaacgttgtataaccatcaccattatccagttccagaatttttcatcacctcacacagaaactctgtacctattatcaacaacaaattttcattccccccttgccctcagtctctggtaaccactattgaactttctgtttctatgaatttgccccttctcagtgcctaatatgagtggaataatacaatgtgggtcctttgtgcctagtttatttcacttactgtaatgttttcaaggttcatccatgttataatatggatcagaattttatttcttttcaagcatgaataatagtccatggtatgtctataccacattgcttatccattcatcagctgacggatatatggggggttggatctatcttttggctattgcaaagatgatgatatgaacaacggcggtaatgtctgtttgagcactgctatgaattgtttggaatatatacttaaggaccggaattactgg

SEQ ID NO: 15747 - DNA, 1422 bp, Homo sapiens
  misc_feature (1)...(1422): n = A,T,C or G
cagatccacagcgcaactcacacgagagtacaacagcgtcacgcggccgtagaatttctacatgcagccgtgcctgangacagctagttaccaacaaggcgnctgcactctttcgaagtgtggctagacacaaagacgcacatagcactgtagtactcatagtagagcaacgcacatgcagttcatttgacaanatnacgcacctcttagtagatcacactctaggtcgtgnatctgtaccgacgcgcgtcacaagagatgcgatgagaagnaatacatcaacgatgtgacattgtcagtgcacgcgaaagaagtcactgatatgcacnacctcataactagatcgagcatacacaatgcacntctatacgactcacagctgaggatagcaagtgggncngtacgcatacgcgtacgcgacgaaaagtataatggcctcacaactagacacgtcgacgcattcgcgacgtcatcatcagaatgtctattagtcaccagcattctataaaagatacgagcccacgactcaacantaacatctcatagttgtcacttcatatcactaggcttgtgctatctttttgctcatncgcaccgagcgcaacaaagtcacctaacatcctcctacagccacncgacttcgtagtccaaacacgtctcgatatatacgtctcnccgctcgtcacgcgtcaggcatcgatgantaatcgtagtcgagcacgtcgtggcaatagtgacgacgaggccacatgcgttatagacgtnaactcatgaggatcaacgcagcgcntcagacacgtgcatactaatactcgacacagagctatagttaatatcactcgaagccacacgccgcgactaagtaaccgagcacagatgcatgctcgccgaccacgctagtgacatatactccatgtccacaactatcccacatatcaagtctaacacaaatcacgccaatntcgtagtatccgatccaacagccgatcgatcacaccctactctcacagaataagaattcactaacacacataccgccagtattctcatagtactaccatattgccgcactggtaataacttaggctctatgtcatgaactgtccggcgtacgaagcaaactaatttacaacgcacagcataaacgatcgtccagacccgcgcaagcaatatgccccttgcacgtcgccctgcgctaaaccttctaccatgatcctacggtacaatccgtcgcagacgcgcctacgtgacgccagtagccactcgttatgaaagcagaggatgtatagaagtatcgatatcgaagataacacggcgacgagagcgcggtcatgacgcagtagcacgttgatagcaacgttacaacaatgaagaagtactaaaggatcgacggacgctctgccactcacaagcganacacat

SEQ ID NO: 15748 - DNA, 719 bp, Homo sapiens
aagcgatctcaggttcttgtaactggctaaagcagttctgcctggagcaccgaagaccaggatttgagtaatcttcactcatacagatcggcagattcacgctgttcattgggccatgtcatgtgttcggcccaaccgtgcaagacgagtcctttcccaaacgagaagacccaagctgcatcttgaaaaatcagtaaatgtgctcctgagggtacaaaatcaatcaatctggagttcacgcgatgcctttctgagatccacaaaaggggtcctccttactcaaaaccaaagactaaaagagtccttcatcagggctctgacctggggtatgggcctgagcttccttctggattgatgcttagtgtaacatacccaagatgctcacaaatgctgaggacctccagccagttccaaatgagtttacggtaggaggatctttaataggattgactctagacttagcatttcctccaaatgccttcctggctgcaggataaaacctctgccagcccgaaccatgcaggtgccaattctgtttcccaggcccacatcgcttcccactaactccctgacccctctatgaggccagttcaatgttgaccccctccacacagctctccttggctcctctgaccttcatttatttcccagtccctgagtgcctgataatgataataaaaagctgttctgcttaaaaaaaaagaaaaaaaaaaaaaaaa

SEQ ID NO: 15749 - DNA, 728 bp, Homo sapiens
aaaaaagctcaaatgctcgagagattaagtaagaagggaactaaggtggactccagacacgtctggcactgaaacgaataagctgatttcaatgatggataagtcacaaggtacagcgggagaacctctggactccagaagcagaaaaggccacaaaggacagctaacatttgggatgccatccctttcaccactccttggacaaggtcaggatctgagaattctttccatatgatatctccttagtaagcaataatggtgctttctttttttaatgtggctcagcagtcaaagacagaaattagaagagttgaacaagagaaaagatgaaattagtgaaaaatagaaacccctgatttagaaaccttatagattccatttccaaaataagtctcactctaaaaatattgctcttgaaggctgaaatacttttttaaaaatctcaaatggtacattgatcttactaatggctttcaattgttttcaagagtttctaaaatccatacaatctaaaccaccattcttctatgaaagaaaaaaaaataaaagttattattacgaaaaagaagaagtctaccaagaaagtacaacatgactccttattgggacatcttattatcactggatacaagaaaggattcaaggattaatgggggtatgcccaaaggacaaagggatcaagactgaagaggcttcttgagggccaaatttgcgtcaaattataaatg

SEQ ID NO: 15750 - DNA, 880 bp, Homo sapiens
  misc_feature (1)...(880): n = A,T,C or G
agatatagaaatagacacatgttttgagggagagcaaggccacaaaatagcgaagaataggacatgagggtctttagaaaggtngacgttatcttgtctatgattcctttcaatttggaatatagtttggngtatgtatatattatanaccaatcatgatacatcacaaataatatgtgggtggtcataaacaaagacatgcatcaggcaaaacctataaggacactgtaacgaagcagaaggaacacgccactttgttgaaatagaaatacacaatatggctancaccttcacacatagagcgatcgnagaagaggaatattaacttagcgaatgactgtcataacctaataataatgtgggagncatattggttgggcacatgattagtaatagtacagnagagcacagtactgatcttgcgaatggactgaagtaaggggagagggtgtagggagtgattangagtgatcgctgtacattactacgttattaacaagagggagacacgacccacactgcctccacgggaaaatcttctnaactacacntcattacacgctgctancaataaaaacgacatccacaaagcgatgacggaaatgtcactaattacaaacatcctaaaacattaaaacatccgnggtaagagaaattttgtgggcttaggtaataaaattaagatactatataaaacatctttaccaaaaacaaaccacctcactcttgatcaacactgtaaatnaatcagcatgggggtaaatcaaagtcccagcgcgccgttgggcaattaagacttctatctccacctcttaggttnccctcactctgctttgttatgtaagattatatacctattatttcaataaaaaaaaaaaaa

SEQ ID NO: 15751 - DNA, 273 bp, Homo sapiens
gacttcaagatacctcccgttttaccatgggatctgcttcacccgctctgccgatgtcaacgtggccgttagacgcaacacgtggggcttgatccctaaggcaagggcgtgactttcttataacgaaccctagaggcataccgaatggagcgaacgacccctttccaatatgggttaagagaacttaccacccgttcaaccagaacaactaaccgttttcttggcttcagcggtggagctcacccggctgttacccttattttcggcgctgtg

SEQ ID NO: 15752 - DNA, 740 bp, Homo sapiens
agattcctccgtaacaaccttagccacccctgcctgtgttagtccgtgactgtggagaacgcttggataagttgaaagaaaaagtgagaaactcaaataatggaggagtcattttatcggatgttgcctctctaccacaatcttactatgattatttaagtatcagagcctactttttcttttttctcttttcctcttttctttttttaatatattgcccagagtttaaatcagcagactgaatgggctgtaggggacctatatcaccataacagcactggaactcttcaaagttattcaaaagtaccaagactgtattcacaacttaatttagatgccttccacatcatttcttcaaatgcaactatgatgaaatttatgtgcacagttgggggatgtggataaaaatagtgttaattttctgattatctctagaactttctattattaaattgtaactttttgactatccttatgtttcatgatgactcggaaacaagagatctttttatccagttgtttcttccttttaacctggtttctttaccatcttggagtttaagcaattttctctatgttgaaagtccggagttttcataggccatttctttggaactatggtcgggaatcctctgatgggaagcctattctgcttcccttcaagatgagcacctgggatcctccttcttggatgtagttcataaaataaatctacggggggtgcatcctacaagaaaata

SEQ ID NO: 15753 - DNA, 760 bp, Homo sapiens
  misc_feature (1)...(760): n = A,T,C or G
ctggtagattggaagaagcaggtatcctgacgacaaacaaaccaaagttttcaccccatctctgccacttacttagaagcttggtgactttgggatgtttggatccagattttgcatgaacatatgatatcagcagaaggcaaccagattaatgatggagatgcagagttcaaacccgtgtactgggatggcctcctggaatcttcccccagatcagccagtcaagtatcaaaacagtcatcagaaggtgggggcactaagcccagtgaggcagctccccagagccaggtggaagaggaagactgcagagtggaccacaccacactggggcaaaaacatagaagaggcggcaagactgcaattgaggcaagaacactgggctcgacgttcctaaaaaatatatcattgctgttgttggtgcagtcaggtaactcaggtttgactctcagcttcagagtttctataatgtttagcagcagaaaattgttctggcaagtgactttatccttccatgcctcaatttcctcagttgataagtaatgaataataatctcagagttgatatgaaggataaatgagataatacataataaagagctaagaacagtgcctgccacatgttattccttcaataaaggttagctgatgatgattgcaattataatgatgaggacatatttaatccacaaaaatagatgcatatttaaaaaatagatgcataatttaaaatagatttttggatgctaaagagtagcanaaa

SEQ ID NO: 15754 - DNA, 573 bp, Homo sapiens
tactgaaggctgaaagtgcaaaaggaaggtgcggcaaagatcgattttttctaagagctctctccttggctactagatggcagcctgctcctggcccagtgttttctctactcatgcccaaagttacggaggacccagcaaccatctcctgcagcccctggagacctcttgactcttctgtgatgtccccagtgatccagcagccctggccttcttttgatggcttgaacatttggtcttcattgaacagtttgtatattggaaacttgccagcctccatccacattccaacccccgtctgcatccctcggaacaaaatggttcaatctgtctacctcctttcacattccaccaagatattccaaggcccagggttcctttgaccacctcacacctaacaagttccctcactgtctctcactctcccctgaagattataagctgcctctgtcctgctaaaactgtagacctgagaatgaagtaaggtgcttcaggtgaggcttgatcagcccagagcagaaaggggccacctcctcccaccctataagaccctaataagtgacctttgaaccc

SEQ ID NO: 15755 - DNA, 763 bp, Homo sapiens
ctgacacagagtattggtctgtctgcccaggctggagtgctggcatcatcatagctcactgcagcctggtactcctggcctcaagacatcctcccacctcagcctcccaaatagttagactacaggtataagccactgtgccatgctagtgttttccctctttttttttcttttttttttttgtagagattgagtttcgctttgttgctcagactggtctcaaactcctggcctcaagctatccttttgcctcagcctcccaaagtgttgggatgacaggcatgagccaccgtacctggcctcaatttcctgattttaaatagaagtacacattgttaaaatatcagaaccaaagactttaaataacaagtaaaagtctaccttgttagctaccccctagtattagttgactgtgctgccatataaaatctcacagcctgcatagcttagacatttgttttctcatggttctggaggccaaatgtctgagatcaaggtgttggtagagttggtttgtcctgagcgccatggggaaggatttgttttaggcctgttttcttggcttgaagatggctatcttctccctgtgtcttcacatcgtcttcctgtgcatatgtccgtatctcaatttcctcttctatcaagacgccaatcatactggattagaacctctgcttaatgacttacacaaggcccattctccaaaattatattctgagatgttggggggttgggacttaacacgtaaatttgaggggggggg

SEQ ID NO: 15756 - DNA, 732 bp, Homo sapiens
accataatcctcagacacgaatctcaaaccccggggttttcactaactaaaacgaaagggctggggcaaggggagtcatttttatccaagctagaggtactcaagattataactgggccacacactagaatttcatatgcccaaagtaggaaaataatcgtaacaggcataagtgaatgccctttcctggaacaaagaaaagcattgaagacaaacttctgaatcttggttgcagtggggcttacacaaatttacacaagtgataaaatgacacagaactatatacacacattgtgccaaattcaatttcctggttttggcattatagtataattatgtaagatggaaccattggggaaaactgggtgaagggtacccaggaccactctgtaccatctttggaacttcctgtgaatttataataatttcaaaataaaacaagttaaaaaaaaaccccctatgctataagttaggccatctaaaacagattattaaaaaggttcatgttaaaaggcatttataattatttttaattatttaagttttaatacaagaacgatttccctgcataattttagtacttgaataagtatgcagcagaactccaactatcttttttcctgttttttttaaatttgtaagtaattttataaaatccccctcctccaaaaaagcaataaaaaaaaaacaaactaaaaaaaaaaaaaaaaaaaaagaaaaaaaaaaaaaaaa

SEQ ID NO: 15757 - DNA, 309 bp, Homo sapiens
tcaagtggtggattgtgtcatgtggccatcccaaaactcagagcaccctatggccgtctttgccctctgtcgcataacttgaaaactgcctgatggcctttttgcagtggttccctccaggaagccttgatttcagttgaagaagttctttcctggcattccaatgcccctgtcagctccatactccgcagacacccttaacaaaggctgtcatgcacccaatgtgacaaatacccaaaataaatgataattcccctaataaaaaaaaaaaaaaaaaaaaaaaaaaaaaagaaaaaaaaaaaaaaaaaa

SEQ ID NO: 15758 - DNA, 2022 bp, Homo sapiens
  misc_feature (1)...(2022): n = A,T,C or G
agtttaatntgtggggtgtnnggttgggnnnaattgttnntgagtntnagtgttttagtnatgtattgttgtgtatganatgtatggtagtgtagtggtgtnattatanaggttnntttagttntttagtttnnantntnataagagnnnttntatggagtttttgatgttatntattttgaggantgtgnnnnattttatgtnncntnnnttttgtagttagtgttaatgtnnttgttgtgtanntttttattntttntnatcaagttnnttnnnaatatgtgtggnnnatnacnnttaattnnatagtggtctatatagtagtgttncgaggtgagagtgtgctngtttcttctntcggtccantcatgtgtggatgcgtgtcagtccgtgcacatcgtgcatgcgtnatatacgcagtagctgcgagctctctcntcatgttcgcatgtatctgatcatgcangttcgtctctctagaggttcgtagtaatgtgtttntgtanatgtattgatgatgtngtgttntattgttataatgtagttgtagattnnnnttatattgnnatgtgttntnnntntntatattcgttattnnnanttgnatgggtnttntntgaggtntcgacacaatcttacgtccacgatgagagaatacacgatacgagatgtctgcgtcgaatcgagagtgcacatanacgacgagtagaggtgagagatgnnnatgtcnagaagtacgcgcncantagatngncncncgcacgcgcgcagtgctgtgtgtacattgtcggcattgantagatgtatgtcgatagctgcgacgcgcaagatggtcntcttcgcttcagacatcacgcgcgcgcacgtgggtcgtgtagtctcgtgctctcncncaacgacatnactgcgtcagccgagcganaccactctcgtcgtggtgctcacngtattgttgcgttgtcgctgatgatagttcgcgcanactgttatctcgatctctcgcgggctagagntggtatgatggcagagcagccacagagacagcgcgccntagtgacagccatncnactatattcgcacgcagagatattcatcgcatgntatacgantncncncnncacaggtgagtntctnagntgtnatgtctatatatgacgagtgagtggagttacgtagtacagtatccanacacgtatatggtatncncactcatgagtgatgtgtcgtanatgatgtagtgtctatacagntngntangtagactanttatagtagagtaggtgatatagnnttntggatangtangtaggtatangatngnnatantgtggtgtaattgtatgatcgcatcgattctgctntgtctgacatnacaggatcagcngctcatctcnncaggtgtattgttgtgatgtcgtcatccgcgagcagtctatcacagtggagtgtctgntntcngcntcatcatctactgctactnctcagtctncgtcgcgacatcactgttgtcgtcgtgtatcantantgagtngtttagctagtatgcgtntcgactgcgcnatcgtcatctgtgttcggaggtacgtcnacngactgntggacgtgnctntcgcgactcatctntcgtcgcgatgcttgtnncangtatgctatagtatcgtanctagctgctgtcnctnatacntacnncncacattaccacnagaggtagtcagtncntattagatgatgtncgancntcnantgacgatgatgtngttnngtagttagtatnctgcncngntgcatgtgtagtnnnctncgcggtgcagancgtctgacgtggtnnncngncncgcgtatagtagtgnagtcatngtnttcnganatgangtnctgtcacagcagtcgcagttcgatcacgagtatgntgnntacagtcncgactgncnnacaanacggatagtngtaatcagtataacngaatgactcanataancgtctagnagtagcgnnntgntgcgtgtcagcagctgcggatgg

SEQ ID NO: 15759 - DNA, 1960 bp, Homo sapiens
  misc_feature (1)...(1960): n = A,T,C or G
ttgcgagtggcggcagcgacggcagtgcggatgagtgcacgcccgacagagttgttatggatgttttatccttgatagtaatganatggcgcgatgacgcgacgtatgccatatttctattgatgtntattggcgatgtgcgtcgtcanggagagcggggggtntggttgggtgtgntgtgtggtgccgccgcctctcgagtgtgntgcgtggtgccgcncggatncgtcgtatatcatatagatcatgtgatgattcggagtggtagagaagggtggacgagttggtaatgtgatccgagacnatgtaaatatatcgagcatcacnacgtgaatatgaataatcntcantcataagatgtcacgagccgcgacactaganntgagcagagaatgtagctagagagtagagaagaattgatatgcgtgtcggtggtagcgcgcgcgggtcgaccaatcgacgtgctatgagtatgagtgcgcgtgtgtaatgagtattatggtgtggtgatggttgttgcgatgtgtctgcagcagaccaagacccgcgcgacgggcgcggcggcgcgcaggcgcgggcgccagagtaggnacgttgtgtgtggcgaggtgctggaggagaagcgacgggctcgnatccgncaacaggcaggacgagcaagagagaccagcagagacaagagtagtaggacacgcgacagagcagagtcnctacgtttgatagcgcgtagttctgatacgactgttagtgtgtgatgcattactgagaaggaggccgcggtgcgcgtatgatatatccgagcatagatacagcaacgcctcgttctatgtatattgttcctcccttacataatatacagaacaatcgtatcgagcaccatcgtctgnctactcnatcgcgcatatcgcgttatcacacgagattatacgcacacctcgccgcgagctcgcatcttattatcgcgtgaatacnactgattaattctagctccagtgcgccttctgtcgtacgatcatatataattacgtatctcacgagagcacagtcattgtacatgtatacatcgttcgtccgctcttcgagnatggctcacgatacgacgtggggtgtgactcaacaagccgcatacggtggacgttgactcaccagacacgcacgattacagacacgtcagcgcgaatcgacagcgaatagtagtgagaatagcccaacgacagtcacagatagccaagacagatcactggaataggggtcgcaacacgcagcgggcgacaggcaactgatgatagaacgacacantctaccagcgatacctaatacgctaaataacgatcgcgacacgcgcggagtacgatgacgaacagcgtagacgcagagaatggtgatagtcgagatcagcagtagcagagcagcgntgatctgggaactgttgaaggatgagaggtcggcggaggtntggtcgaggtggtgtgcgcggctatgggacgatggatcggcgagccggccttaccgcacgtccntcgnctcggcgtgccctatgtcgttgagcgctcacgcgaggcgattgtgatgtctgcgtaacgaacgactcatntgcgtgtgcgagngaatagttagagcagttcgtcgagacagtgaatagtatgtattnagagaacctgttataantgacgattctcccgatatgatgatggttgtcgcgctgtgactatatatnatgtctcatcgtggatgtgtgcatgtatggtgtctctcactgttatgtctgntagcggatcgagagtgcactagtgaatctcgatattcacgtataatcagcgaatcatgtgtctatatactggtcanctctatagtacgtatgcgctgatctgataggtctntccgatacgtgcgctcgagagtgacantgtaaantattaggtagttntaagacttgacatncgttgctgacacacgcact

SEQ ID NO: 15760 - DNA, 814 bp, Homo sapiens
  misc_feature (1)...(814): n = A,T,C or G
atgtcacaattaattaaagttaaaagaatgacagaaaattcaaagggacaaaactttantgctgaaaanaactgtggttanaccgacttcacctgccagccttttcagggattgactcagcttttgtgagtgcttcacccgaagtcccacaccttaccggggtggcccacatccagtgactaatctttgcaagaatataagtcctaatcacactggccaactctgaaaaacattgtagctcctgtgttccctgtggagtccactgaggctgtcgttgggcttgcatatgaagaccaacttctccttcctgcctgctttacctcctttctgcagttattgggtccaagggctcttcacactaatactctgtctcagagtcgatttcccaaggaacgcaaattgcaaaaaggctataactatacttcttcaagtccatattaagaacgctgcttttttctggtatttaattttaaatatttatgaaatttctataattcgttttccttttatctcatagacttttaagagtacttttaacattgcaagtatatgataggaggaggctagaatatcaatttttggtacagatttccgattttaatgaaaccttttcgaccaattatgtactatgatcagaacaacctacttaaactatcatatattgaaattgataccatgagtgctgcagaactgtgtactaattattatgtcaccagctacattcaagaaaaccgtatattactcgtccgctctctgacagatgaatgtcataaaacgtcccacgattganaatcaattcattactccttacgaa

SEQ ID NO: 15761 - DNA, 731 bp, Homo sapiens
ctggtactccagatgtttgggcttcgaggcatcattggcagattactcctgaagaaagacaagttcaggacaagaacatagatggtgcttttgccctgttgacccctttgccacctgctccctccaggagagaaccttggtggtgaaacagctaatggttcacatcctttggcccaccgtgatgtgcttcagaaaactactcatttgagcgacatataaattactaatgatgtatgaattatgattacaatcatttgaaacatggatagaagtgtaaccaagcaccagaaacgcctgtagaaagtcaaagatagttttgttatgaagtggccctgtggatagggcatttcctttttcaaaatgcttcttgtttcatacatctccttttggggaaagtattgctactattcaaagcgaactggctagacaaaccactgcacgtgcatgcaaagacacacacaaagacacacccacacacagttcaatccaatcgaatggtaggtgtttcccctacgtgtctccacacaattcctacttttacgcacatttagagagttttaacattatttctttggtccacaagagggttttttttttttttttccttgggaacacagctatcgctgccagcgatatctttaaatttacgcaccggacctagcttttcattccatgcgcggagcatcctgcccaaacctttatcacctgacgaagggcgaaatgctttgttg

SEQ ID NO: 15762 - DNA, 742 bp, Homo sapiens
ctactaagggggacagctgaactagatcagagcacgcccagaagttcttgaaatggagcacaccagcaaatgagttgaagaagcggcagaagttttttgaggaagccttccagcaggacatggagcagtacctgtccactggctacctgcagattgcagagcggcgagagcccataggcagcatgtcatccatggaagtgaacgtggacatgctggagcagatggacctgatggacatatcggaccaggaggccccggacgtcttcctgaactctggaggagaagagaacactgtgctgtcccccgccttagggcctgaatccagtacctgtcagaatgagattaccctccaggttccaaatccctcagaattaagagccaagccaccttcttcttcctccacctgcaccgactcggccacccgggacatcagtgagggtggggagtcccccgttgttcagtccgatgaggaggaagttcaggtggacaccgccctggccacatcacacactgacagagaggccactccggatggtggagaggacagcgactcttaaattgggacatgggcgttgtctggccacactggaatccagttttggctgtatgcggaattccacctggaaagccagcgttgttttatagaggttcttgatttttacgtaattgccaataatgtgtgagaaacttaaagaacagctaacaataaagtgtgaggacggtaaaaaaaaaaaaaaaaaaa

SEQ ID NO: 15763 - DNA, 734 bp, Homo sapiens
  misc_feature (1)...(734): n = A,T,C or G
cctttggagggatgtnngattggcttcttctccaccatgattataagtttcctgagacctccccagccatgtggaactgaatgtattgtgtctccaccataacatccatgccctcaggaagaaagatttgaacagccaaggatgaccgatagctgaggcttgaagacctgagcacctataagcttcttatcaacacagcaactcagagaggtcagacttgttgctcaggactacaagagcaagcatttgagtggccaagagtgaatctgcctggccttttatgacctgggcctggaaacaacagaccatcaattttgtcatactttttattgattgaagccagaaaggtccactcagattcaagaggaggggacacagatccaccatctagttggaagaaatgtccaaaaatgttgctgtaaagttttaagactaccaaaatctacatatctctgatcattaatggatatcttttcatatatcattctctattcttgtatcctttttaataaatcaccctttcatttagttttttctccttattattagatttgtgtttatcactaattgatcagtaggaatctttatatattttattccaaattccttgggaatgacatgaattacaagtattttctctttggagttaaagtttctttggggaatcttcctggtatcaaatcttaaataagaagcaaaaaaaataaaaatggcctcggtggccttagcggggg

SEQ ID NO: 15764 - DNA, 445 bp, Homo sapiens
aaccaagggtcgagtaaaacgaccccccatagggggccagctggccaaattcaaaattttaaccctgggacccaacatgaacaacttcatgcataaagaaacttccactaagcaagttttttggactcaaaaattttttcccaaataggcaagtcctagggatcccctctttaaaaaaataaaggtgaggtgccctaaaccatcgagcccgggccttttaggggtttttcaagggcgagggccgaaattggggtttttaaagtaaggtttgggtttttttaaccattcccgtttcttttaaggccccggaaaggaaaaaaccccaaggttttttttttttctccctaggggttttagccaaaataaaaaaaaatcctttgtgggaaaaaaaaaaaaaaaaaaaaaaaaaaaaaaaaaaaaaaaaaaaaaaaaaaaaaaaaaaaaa

SEQ ID NO: 15765 - DNA, 731 bp, Homo sapiens
ctgagggaatcctggatgcaatttgagtccacacagacctggctgaagtgcagatcaggagggaaaactggagcttggagaaagcttttctaaatataaaggaaaaataaagtgaagatgaagtcattgatttggaaagaaacagagaatcctagtgtgactgtaaccccttgtttatgtatctgggctgtggctagaaggaagaacaagtggttttggcagaaggctgctagcaagacgctgtgtcttttaaaatcttcctgagatatctgggaagcaacaacaacaacaaacaacaacagcaaaagaaaagagggaagacagttatgggtgaaataattccactggtggcactgtgaggcgataaccaaggcaaagcactatcctgattgcagacaaaacatggaaggatgagtattcctcaggatgaggaagctgaattctcatggcttttcctgcagaactcaagataaggcgctgttagtgataccacatccacatccaccatgaatgaagcctggattcggattacaaagctgaataaaccagatttccatctttggcataagtgtgggtatttacggctatctaaaggatctgagtctggagggaaagatgagcctcagggtcaataaggtgggaaagctgggtatataaatacccctcggaggtccgagcggatagcaccgggcttactagaaatggctacaacccactctcttgggaaaggc

SEQ ID NO: 15766 - DNA, 424 bp, Homo sapiens
cctggcgttcctgtactcttatattcatgatgaagtccagagacttgatgcagatgcactgctaggtcttcatccatgttgctatagaaacatatagcgactaatataaccaaggattgggaggagaaagagagacacgccaattggggaaatgagactgtctagttcataatgctactgatctttcaaacattttcataagctatggatacaaaactgcgaatgatatgactttattctacaaaatgctttttttgatattgttgtgccattgccctttgccaacatcatataggttatgggggtttctgttttgaaaacacaaatactgcaccgtgtttatattgctactcattactcatcaataatcaagacactgaatgctcacacactaaagaaaggacaatggcctcggtggcctcaa

SEQ ID NO: 15767 - DNA, 439 bp, Homo sapiens
ggccagcccttaggaaactgaagtgatggagtgtggcttttgaagctaggaaagttcctgcttttttgggtcactcattccatggaaaggtggcaccccttatttggggcccctcaaacacccctgtggaaaggccctaatggtgaaaaaaggaggcctcctgcctggggccccgggggggattttttttggaagaaaaccctccagcccctatcaagcttttttatgattgcaaatttgggcaaaatcctgattgcaaccccataagccattttggggcaaatgtacccaaaccaagccccttccaaatttttgacccatggaaactgggggggataaaacatattttttgtccttgtaaaaaaaaaaaaaaaaaataaaaaaaaaaaaaaaaaaaaaaaaaaaaaaaaaaaaaaaaaaaaaaaaaaaaaaaaaaaaa

SEQ ID NO: 15768 - DNA, 722 bp, Homo sapiens
ttagggcatcattggcagattactcctgaagaaagaaagttcaggaaacacagagaccatagcggcacagacacaagtggctggatgttgagagaaacatgccagccgaagaacacacaagcagttggaggtcaagaagagcagaagagcacaccgacaggcaccagcaaatgcaggtcatcgacagcaggactatgtggaattccgctgggggtggtcggagaagagccccgccagcagctgaatggcccaaaccccggggaaggccaccttcccactccattcctcttccggctcaccattcatctgctgagagctacttccaccactcattaaaaaaccttgcactcattctccaaccccacgtgtgatccaatttttctggacactacataaagaacccaggatacagaaagcgctctgtccttgcgacaaggcagagagggtctaactgagctgattaacacaagcggcctgcggagggcaaaactgagagtggcatggtaacacacgcccaccggggttttcgggggctggtaaacactcagccctcgaaggtgctgtggggtcggcgatgctcaggacttgcccggctgcttgctcccctacgggtatgagcagcggagcaccaaatatatgagccacactccatttgggggcctgctgagttacattagggaaccttgtgtatacaaacctcacctcattcttttgggaacttt

SEQ ID NO: 15769 - DNA, 752 bp, Homo sapiens
attaggcttccgtggtgtttgagaaacaattatttaaagaaatcttgaagcagattaaaaaggctattagaggaatatcaggctatctcttaatacctaataaagcagtttcaatacagaaaagccaaggctaaggggggaaataaaactccctggttaagaattctatgttccagactttggaaacagtattatgtgatatatgaagttatttgttctgccattctgtaattacttttacctccatcccatcttctacttttaacaattaaagaattatgatggtgatatggtttggctgtgtccacacccaaatctcatcttgaatttccatgtgttgtgggagggacccagagggaggtaactgaatcatggaggcaagtctttcctgtgctgttctcatgatagtgaatgagactcacaagatctactggttagtataagggggagtttccctgaacaagttctctctctttgcctgctaccatccatgtaagatgtgacttgctcctccttgccttctgccatgattgtgaggtttccccagccacgtggaactgtaagtccaattaaacctctttcttttgtaaattgcccagtcttggatatgtctttatcagcagtgtaaaaacagactaatacagatggtaagtgtattaactggaaatccaagaataaaatgaagtaaatagaaatgcaaagaaatactataataaaattacatgtgactgaaacaaaaaaaaaaaaaaaaa

SEQ ID NO: 15770 - DNA, 1074 bp, Homo sapiens
  misc_feature (1)...(1074): n = A,T,C or G
acctggggtgtctgctgcgcccgcttcgactgaggtgttgcgactatcacgtcgatatctagtgtggtggagtctgctggtcgacgcggtcgctgctgcgtgcctgctccactcgcgtgcgcctcccagtcctgctactagtcgttcttctgtcacgtaccctgcgtgtgccgcgttcacttcgctggtagctgctcttcctcggcgttctcacgcatatcattcgtcctcctccgcttacctttccgcagtgcgctgccgggccgtcgcgtgccgcctctgtcgcctccagtcgcgggactctgcggggacatgcggaggcnacggccgctcctctaccgtgggggccgcgtgtggctactcgtgccggcactcagctgccataacactacctgtcttaactcgtgtcccgctctcctctaccacacgctgcccgaactctggcgggacgcgacgagcgtgtggttacggggggccctatggaagccacagtcggcagaggctcactacggaatcgaaacgccgcccgtcgcatcgccnccgctcctccctcgctttcctgcttcttctgcgcgtgcggactgcaccgcgagcgcgctggcgctacgggtacgttgtgggactgtgacaccggggacgtgtgccagtagtggctggcggcgggtggtagtagtgtaattgtgagtggaggctgagcgatgagtgtgtgctgtgggggctccaagcgtgtcggcttggcgaatatatgataacaagtaagaaaacgcaatatagcattctttgtcttgaataacaataatatggttacgtgagcgccgacgttctgtgtttgtgggtagttggggcggggggtacgcggtgaaaagcaacacgtagacacacacaacgcacaaaaaccccacaccacatacaacaaaaaacaaggaggaatgaaataagtgataaaaagaaaaaaaaagaaagaaagaagaaaaaatagttgaaggtaaaaaaaaagaatgtgcctcgttggcactcagcggtggagtgtttnccgcccagggtttttcttttttccttttcagnccctcatac

SEQ ID NO: 15771 - DNA, 308 bp, Homo sapiens
cctagggtaactgggactggactgtcttgatgtgaacaactgcaacattgctcagaagaaatctaacaactgtcttcagacacagcaaaggactgtgacccaacagaaggaaaacatgagttgaactcttgaacccaatggcactttttggaccacattgcaggaggagaatcccaagcagggtttgggacatcaaggaggttaaggcgggtgggctgatgagcttgagactgtactcaaatatgctttcccaacattcttattttgctaaattattaacaacaatgggagacagaaaaaaaaaaaaa

SEQ ID NO: 15772 - DNA, 811 bp, Homo sapiens
  misc_feature (1)...(811): n = A,T,C or G
gggaagggaagagtangggnnnnnngnnnnnnnnnnnnnnncctatatacaaacattcacacttacctcaagctgtcccacatgacgggcgactcctgaccgcaatgaccactccagggtggagggcgctccaccttccttcacagacttcccatctacttcacaaacaggatgctgtaccgactgatagaaacgggataccaagatatacaaactgttgatgacagcacgacctgctacacactggggttgctccatacgagaatcactgctcgggggggggggcctacatgaatactgacagtgctgaaaaggcatgcggattggccgatatcgggtgccacatggtcaatgaacatttgttcctgtggagcctgcaagatctgactgatggcactctgtgggaccacggccacatgaacgactaggctactggactgcccttgtgaagcacgcgacacgtactcctggaacaggattcctccactccctcattgaaactacataataaccagcatcctcatatgtcgatctggtgacaaaattgactgatatatctggtcctgggacgagttgccttgctgaattaactacaaacccctaaaatgtctcggacctagcctggactttttgccttacctatttggaaaaagattaccgcaggccaccattattgagcggggcggaacagacaaaaaaaccatgggccttttggccttagcagtgaagtttacgccctttactttaaggaggttaatcaagaactcgatcattgatggtgccctgggcgttcggtgggggaagggattaa

SEQ ID NO: 15773 - DNA, 762 bp, Homo sapiens
cctggtgccacgctcaattagtttatggtaattggccagcatctgccctgtttccattttcctccaggtaattcggttagatgattgcttacagctgctaagacaaaatttggaacttattctgtatctaggagcattctagtaattcccattagtgtttacaattaatgttttcaggatcttaaaaaaatagagagatgactctaaataatgaaggatttgtatttctctgatgtatagaaagaattatcttctctggatgtagctatatatctctcgttcaggttaattattgtttgtgtgcatttgtcaagagaggactatatcagtcagctgcatttgttctagtttcataatcaagttttaaaacatgaatagaggaaaataatctatattgtctggaatttaaaaccaagttgtatcccaaaaagatacatgcttcagtttcttatagaattttaaggagaaaagtcataaaaatgtttattccaattttaggaggctgaaatcagatttattatacgataagacattcatcttggtgatacagagcaaatacatatattattctaattttaagcaaaaatttactgaaaacatgatgttgataacaataatcttttaagcaagagactatgaaatagtctattacaagcagggatgacctaaacccacaaagctcatttatcttctatggaacatcttatggttacatggtgctttcacctaagcgtaggatcggacaacttgcaccttccaaag

SEQ ID NO: 15774 - DNA, 791 bp, Homo sapiens
  misc_feature (1)...(791): n = A,T,C or G
cctaggaaaaacggaagggagaggtaaagaaaaaaacctaataaaggagaaagtaaagaagcaatacctgacagcaaaagtctggaatccagcaaagaaatcccagagcaacgagaaaacaaacagcagcagaagaagcgaaaagtccaagataaacagaaatcggtatcagtcagcactgtacactagagggttccatgagattattgtagactcatgatgctgctatctcaaccagatgcgccaggacaggtgctctagccattaggaccacaaatggacacgtcggttattgctctgtctaaacaacattcccagtagttgctatattcttcatacaagcatagttaacaacaaagagccacaagatcaaagaagggatactttcagatggttgtcttgtgtgcttctctgcatttttaaaagacaagacattctcgtacatattatcaataggctataagatgtaacaacgaaatgatgacatctggagaagaaacatcttttccttatanaaatgtgttttcaagctgttgttttaagaagcaaaagatagttctggaaattcaaagatatagtatcccttcaaaacaaataggagttcagggaagagaaacatccttcaaaggaacagggtggtttgaccgggagatctagaaagtgctcagaataagggcctggcttttggaatccaggattatcatcacaaagcaacttgtttaaaatagttccatcactcctaccctggtattttataaaaacccaaaagggcttcccgaatggaatttcca

SEQ ID NO: 15775 - DNA, 768 bp, Homo sapiens
ctaggccactgctgcaggacagtgtaactgacttaaaatgcccctgccctgggctacaaagaatgctagagtggagacaagagtgcagactctgaaataacctctctttggacacagaagctaccactgttgcttatcagacgcagcgggccctgggtttttctggggccttaagcagtgaaccctgatcagctggcctgagtaccaacccaagcccatcaccacaagcctcaagacagggagatctcactgaaacctttcctctaatccaagtgacatcattgtcgcaggtgtttgtacatgaaagcagactgatgaaggtgtgtgggtccacggaagaaatcaaaatacagtgctagctcatatttttcctactctctccctgttcccaggtaaagttatagcatgttcaaggatgtgcatttatagcataactggtttcattcctcacacctatctttgtgtagaataactcataccaaaggggactaaaggcccattcctatcactggtttgcagcacactgaagtgggaaatagaattctgaaagcatgcacagggggaattgaatcacgaagttgtctttcagtaagtgcttttagcttctggagtctcagtttactcatttctaaaatacggataatgcttatttcataggatgttaatctatgtaacttatgggcctggaccctcagatgggaggattcttcctgctagccttatcttttcaccttggatgccgcagttttaactagaaggaatgctaag

SEQ ID NO: 15776 - DNA, 1193 bp, Homo sapiens
  misc_feature (1)...(1193): n = A,T,C or G
cctcaactctcaacacttctcttctctccacacacttccaccagcgagacagagnaacaccgccttatgctggnaaactcgnacatcggcaagctttcactggagccacgagaacatgcgctctaaggctttaccagttgacccaagtcacccaatagcatcttcaccatacccaatcatgaggacangcaacgagcactacgtctctcaacaatgatagtgagnacagtgcggtccaactgcgnctaggcgactccaacctcgcgctgagcgcgagacagcaattctactcgccatcaccataatcaatgcccgtatcgttgtgacaatcagcacttgcctatgctacaccgtactaactactctagttgagagcgaacgtgctcaacgcggcatccacatattgccacacaggccttgcgggtggtgaaagnactagcgcgacgcaggaccttaacttctaactgatctggtnctccttctaacgcatcagcacatctcaattcatagacctccgacatccacgccccccacgcgatctgacacccgcacccgctcattcnacttaccccaccctctcaagagcagacaacctacctttctgtgccacacctggcacaggccctccaccgcaccctaccatcgcgccagcagggcacccccaccacaagtacccgccttcccnctatcctagcgtgcgtaccttgtgcgctgtcaccggcgctctcgtgcaagattgcttagacttacgccagatgcccaattattttatatagtatttcagacttctcattttatgtttgattccttcatccgtttcaccggtgcgcggcctccctacacatgccagtctctaatcaccaccgcgcccgctccgnaacctcacaccactcaccctcctccccacttcacaacacaagctcgacccgcaactgctccttcttcacccacnactactcaccaacctcccacgccgccgaataccatcatcagtgactacttctagcgtccaacctcctcgcttaaccgcacacgactcgtcaacgagcttcaccacccatcctagcacttcgcattcgtcagatagatgcgtacatacttacggaatacttgctcccacgcaacatagtcctcctctctgaatctacatgtctacctacctacaacgtacgcgctctcagactgtacatcct

SEQ ID NO: 15777 - DNA, 208 bp, Homo sapiens
  misc_feature (1)...(208): n = A,T,C or G
aggaaccggaaagtccgctgctggacgcaccagcccaggaccgctagtgcccgggtcggatggaggtgctcgaggccatggagtctatggtactggggaaggttaaaatgggtcagcaaataaggcnactgggcgtcttcttgtgtaaaaaaactagaggaaaatgttngaaaagatcaaagcggtatgtgttgcctctggtgtacta

SEQ ID NO: 15778 - DNA, 784 bp, Homo sapiens
cctgattgaaactggctacgaatcttagaagactgaactttagctacagaaaaatcattattccattgtcatgatgaaaaagcagagtgtcagatttaaccaatgtcatatacctactactgaaaaagagacttgacgacagtcctctgacttcggagtttgaccccacattccttagtctgtacagcacctgtctgatatggaaaatgagtctgcctgcattgtatgtcttatggcacacccatcagcccctgtacgcctattacttcatttttggtcttcctgtggtaaatattagagttagtccattgagttgaaaaatatttaaaaatttctctgcattttagcattgtggctgttaaaagtaacattagttattaacctactgaaaatttcttttcaactagttctttatttcatttcaaccactgttcccactgtcactgccttagttcaggctctcaaaattactcttctgcatatttataatagcaatcatttattcacttaataactatttataactactatattccaggcactgtgtttggtgatagtaattaaaaaaagacatgtttccagttcttaaattatattgataagcttatggaatttcagcctcttagaggaggaatcctaagtgggatctaagcctccattcttccctggctatatccttcatgctgttggatcatttttcttttgtgttaaaaagctgtctttgacttcccatttaaagcttgctgcaggataagaacttggactcaagaaagagatagaggct

SEQ ID NO: 15779 - DNA, 129 bp, Homo sapiens
ccctggtgtgactgtgcagcctgcttgaagaagccatacggaatccctacttccacttttaattaaggaactccttcaacatggcttacagtgcacatctgcacacaataaatgtattctttcacaaaa

SEQ ID NO: 15780 - DNA, 849 bp, Homo sapiens
  misc_feature (1)...(849): n = A,T,C or G
tggaatggccggggatttggtacgatggagaaggnaaaggaaaagggttactgggatacgntcacccacaggtcctgagctataccaagcctcagattcctatctgtggtctttgtggtttggactgctggggctcagaaagcaataccccaaggatcagtgctttgacatgctgagaagctgcctgagaatcaaggtcatcctttgaaccgtgccttgttacctccaccctcaagcacagggagagactttctctggaatttccttacctgaccaagaaggcttcttgtgcaaagaaactcggaaatctcattatctatcccacaaaagaagactgacgacagcaatcacaccttggacagacttgagcacaagataatgccttgctcattcagggtccaaagagaatcgtctgcaagttaatcgctggtcccttctttctaccaaataatcatttagctgccccgtcaaaagaactgtctacatcccttatcttcctttaccctgtgaaatagggaccacaaccttctggtgtccctttagggtacctggggtctctttctactgctatcaattccccggggttttgcccggcaaaaactaaatgctttttctcctggcgacagcttattttaggagaactcaaagggggaaaaggaaactttttcctggcccctaccggaccaaccttttcgtaaccccgtgccctctgcacagacctcacttaaataaaccaagacgcacggacacggcgtgtcgacttcaaaaaaaaagctcggacattctggatggcaccacagcctcagacttcccagttaaactaagggctccactctaacaatggaaacg

SEQ ID NO: 15781 - DNA, 841 bp, Homo sapiens
actaggtcctcttctctggtagaagggggggttttagcagcccagtctcactgcctacctgtaaatagatctctttcttgaaacttccggactattgggaaagatgaagccttgcagaaagatttaaatgttttcaaaaggtacactgggaaatactcctcagaaaaaagccgtttttgggcagagccggggtctgccatgtgttgcaccgctgctgaccacagtggaagaggctccacggggctatctctgctgggagggtgggggacatttgcctaagtggctcaatggctctctacttacaattgaacctggtaaattcgagattgggaacgatcagttagccttcatttagaagaacaacttcgattacttggcatgggctggttcccgtggaatatgcctaactatctgcttcctctgagaggttaatatcaccatctctatccatttgattacaagtctaagatgactgtcttccctataggagatgaaaggagacctttttcaacaaaaatgcacctagctttttcttgctctgctaacctatcgcgcaatgtgcaatgcccttttgtcgccctgcccctaaaagaacaaacggctcctctaagcttgccaatcctgcttactccatctggtttgccccccctttctctttaacgaattggcatgtgcgtccgttattcccacttctttgtccttccccaaggattatgactggacacacgggggctttttctagatgtgctccagcttggttctactacgtcctttcttttacaattcatacctctaaagagttatcacttatttttcctctcttctaccctgaccgggctat

SEQ ID NO: 15782 - DNA, 744 bp, Homo sapiens
agcctaacacttactacaagggttatgagtgacgactctgcacttgacgagagtatccttcaatcactcacctcgaaagcatctctcattctgactaaataaccaatgtgttttatgcggacattgcattttaaattaatctttgaaaatttacactaaattttttgaactttgcatgataaaactgtagtatattaataatgcctgtacctaaggattttttaaaagctaaatatgcactgtgtttgtaggtgctaggtgggaagcaatttctactcaaacaaagaaattaggtataacaacttgttaaagcaagaaagtaatgcaatttttaatgcaagttatgctttatgaaaagacaactattaattaagcaaaaaatgactatacttttataagatgtcattagtgatacagcacaccattattttatgtcctacaaaaggaattaaagtaaaaatgatttcttgtcatatttattgtaatatgcatcctaacttcagaaatgttaattatgaaagaaaataaaacccaccaagttttaatagaatatctcaccgtatttccatagaggccacatatcttaacattgtgttactgaagttactgcatcacattctgtgagaagcattaaaaaggagttttattcttgtttattactgactatcaacacatttttcataaaattgagtaatgttttgaagaaaagggtttaagctctaagcaaggaattttctattaatg

SEQ ID NO: 15783 - DNA, 461 bp, Homo sapiens
  misc_feature (1)...(461): n = A,T,C or G
cttggntcaatacctttccatataactaaaatggattcaaagttggcatgaaattagaaggcgtggatcccgagcatcagtctgtgtaccgtgtcctcaccgtcgcggaggtttgtggataccggataaagcttcactttgatgtatattctgattgctatgacttctgggtgaatgcagacgctctggatatccacccagttgggtggtgtgagaaaaccggccacaaactccatcctccaggagggtataaagaagaagaattcaattagcagacctatcttaagacatgtaaagctcaagctgctcctaagtcattatttgaaaatcagaatatagtaagtacatacgaaacacgttttctttcaaaggaagaagttttttgagtgtctcataggatcaattacaagtgataacaaggaactataataaattttatcgcctaggtaaaaaaaaaaaaa

SEQ ID NO: 15784 - DNA, 620 bp, Homo sapiens
  misc_feature (1)...(620): n = A,T,C or G
agggagttaggtatggtaatatatatttatatacagaaaaaagacangacttttggaagccaacgnatggcagcaggttcctcactcattgcactcaccctacccaggatctatttttagagaaaatcccttaatcagaaaggaagactaagagaaaaaggaagaaaagatctacaaaacaactaggaaaaagtaacaaaatggcagtagtaagcccttacctatcaataattaccatgaatgtaaatggattaaattctccagttaaaagacagactggctgaacggattaaaaggcatgacctaactaaaggtggccattgaacaattatgagtttgagctgcaggagtccaatgtcatgcataattttttccacctttggccactccgaggtcagcaagaccaggcccttcctgcttactctccctcagaatcctcgatgtgaagaccacgaggatgaaggcctttgtgagatgatcacttccaatggaataaacttaaatattttttatcttcccttatgaatttctggaaacactcttttataaggcgcttaattggaaaattaccgggatacggattaaatatttaaaaaaaaaatctgctttttgggcctcac

SEQ ID NO: 15785 - DNA, 506 bp, Homo sapiens
  misc_feature (1)...(506): n = A,T,C or G
gcctgantgggaactatcacagttgcctttaagaagaagcactctacgtgtccatcgacagacaaatgaatagaccaaatgtggtatatacatacaacggagtactattcagcctgaagacggaaagaaattctgacacatgcagcaacatggatgaaccctgatgacatgacaccaagggaaactagtcaaaaaggcaaatactgtatgattccatgcatacgaagtacttagagtagataaatggataaagacaaaaaatagagtggtgcttgctagggcctggtcgggggtaggaaattgggagttactgtttaatgcttatagaatattcatatttcaagttgaaaaagagttccggaaattggttacacaactacgcaaatgtacttaacaatattgagctgtacacttaaaaaatttaaggatggtaaattttatgttatgttatgtaataccactactaacaatcaaataaaattttaataaggagaaaaaaaaaaaaa

SEQ ID NO: 15786 - DNA, 211 bp, Homo sapiens
  misc_feature (1)...(211): n = A,T,C or G
gattccacctggtcttagcagaaagctggcccggaagttgtaatacantggagatccaacagccaccacgggaccaagagaaaaaagccaaaagaatcacagacctggccttcacattgtagaggttcttagccagggccaatagttgccgctctctgaacttcttatcgtatgagaaaaataatcatttacttgttcaaaaaaaaaaaaa

SEQ ID NO: 15787 - DNA, 521 bp, Homo sapiens
tagatgtagtatggtagtagagagcaatgaaaaaacatccagcctctagtcacatctggactcagtgagtgctaacacaacctcacaagaatgtgaccacttgcctcactacctacccctgccactcccacccccattttccttttctccttctcctgctgctctttgccctttaaacattgaaatcctcaaaaccctctttggaaaaagcacaggccatagatcctactataacgtgtgtctctttttcctgggtgtgtcctcaaccttggcaaaatcagcctgtgagttgattgagatctgactcagacactttggcttacaagtgttaaggcacagagcaacctggggtccagtgttgcctcccaagagcctttctgagaatgcttcactaatttttaatggcaatagggcagcaagttatgtgactgaatgggttcagaacatgttacccccaaaaatgccactttggcatattgactatattgaaccaaaggaaattgacaacaaaaaaaaaaaaa

SEQ ID NO: 15788 - DNA, 789 bp, Homo sapiens
  misc_feature (1)...(789): n = A,T,C or G
ctgacctggcatattctgacacatgatgccatatttcacatcctgacactatccccgaaaccaccttggacaagctacaccatcaatataggcctggattcctcctcccgcaaatatacaagaatgcctgcctcaaggttgaagtgaactgagattgcacctgggcaacaagagtgaaactccatctcaaaaaaaaaagaatgcctgcctcacagggttgctcagggtcatatgcttgaacatatacaaagtacttaaaccagggcctggtacattcatttgtttataaaacaattccatgcctcttgtcaccacaaggatcagcatggaccggcccctcctgtctgccgcctcgtcccctgcagggttgctcccccgagactaatgctcctcgctcactggccttcctctgtcccttaagcatccaagttcatttccatcttcaggccttgcctcagcctggtttttcagcctgacgccctcttactagatctttgcattggagtccttggtggcattccaaggctttctgaggaaagtatccactgtgacctccaggcactctagctatggctcttttattattattaacactattattaacactatattattattactacgatcagaaattattntatgtttacttgtgtgcatatttactctctgactcccctccatgaggatgtcagcaaagcanggatcttgtttaccactatttccccactggctccaccagggttttgacatgcttggccagggcttacagaacatttgccgaatgaaagg

SEQ ID NO: 15789 - DNA, 631 bp, Homo sapiens
gcaatgaaattggaaattgcatgccttggacaacatgtgggcgttgccacaggatgaaagatgttaccaatttagcctgacgaccacttcaaagtcaagaggaagaacagatgggttggcattggaaaattctcctacttgcttaaataaaaataactcataaaatactaaagatggaaaattgacttaaaaattaagcaaatacaattcaattttttgtttctattgggttttttagacaataaagttgtgtctgatctaagatcaatcaaaaagtatttgctgagggcctaatatctatgttatgagctatgtaatacaaaattaatgagtgttaaagatgtggactgcttctgaagagagtatgtataatcacctggacaagctacactcacatgtgtgtatgtgtatatatgttgtgtgtatacatgtaaaaatatgtgtatatctatctatatatctataaaattgtattagcagcagattttgtactggaattatatgtatatcacatgcagataaaactaaatgttaaattgtgaggttccatcatgaaaagaactataatctgtgcaatatgccatgcagatattgtaaaataaatttttaaaaggagaaaaaaaaaaaaaaa

SEQ ID NO: 15790 - DNA, 946 bp, Homo sapiens
  misc_feature (1)...(946): n = A,T,C or G
agaagcatagaaggagtacacaaaataagagcctaaaaaaagacctagtgtaacccgccccgagttgagaggcagaacagagaccggnngnnaggagnggagaacgacctcgcaaggggcaggacacaccgacgaagaggcggcaagaggaagggaccgcgacacaagccaggaacaccgccagccgcgcgcacacagacccccacggacaaccaggcgagagcgcaccgacgccaaaaccagccgacaggcaggaggaacccagattttttgaaacgcaggggagcaacaaggcaaaagcccacacgaaaacaaacgcccccagcccaacagacccaaaaggaagcgaaacccccgccaacagccaccggaaagcagccgggaagagtaccaccgcccacaacgaacacacgaagacgacacggagacccaagcggaactagagaatgcaacgcaggcagaaacagaaaaccacaagtaccgagaaagggaacgaaccaacagcggcgacaggacgaaacaacacgccagcaccgcacaccagaaaacgccacacccaaaagcgcgacgactgcgccaccacgccaaccagcaccaagaggacctcaaccgcaagacagacccaacaacgccaagagaacacgactacagagggacgaacaacaagaacacacgaaaccacccacacacaacccacagaccaaacgccaccccgacacacaaccacacccacacagccgaggcaaccgacgccgaacgaccaccgtgctcacagaaacaagacgaaacaaggatcagtccacccacaccacgacgcgacggcacagacgagaagcgagagccgcgaacaaaaaaacagcgcgcccacaaacgcaaaccacacagccggaagagagcaggagcgagcacgacgcaggcaaccacaaaccgcacaaagcacanccca

SEQ ID NO: 15791 - DNA, 635 bp, Homo sapiens
tgtcttaatttttggacaggacaaaaaaaactaaaagagggtgtgtgaattcacccagttactcgctcccgttgttatcacctttccccctataggtaaaagctctcaacgccattaatttaatattagaattcctattatgaatcatgtgaaagcatggcattcgctctcaatagccctattttaaatcaatcatcagctttaaggtgcgaagtatttaatagatctaatcaaatatgttgattcatggctataataaagcaggagcgattataaaatcttcaatcaaaatgaactttacaccaaccacttgagaatttcatgagccctttaaaatctgaactttcaaagcttgctattaaatcatttagaatgtttacattccctaaggtgtgctgggtcatgtccaatattagaccctaatattttcatagaaattaggctggagaaagaaggaaccaatggttttcctaaatacccccaaaaaacgaactgtggcccctatgagttttcattttaactgtgttcccaatgaacctctactaaggcagatatggtatggatcgtaaaattttaagcggtaaaaattttttcataacctttcattttaaagtttaataataggaaaatcaact

SEQ ID NO: 15792 - DNA, 566 bp, Homo sapiens
  misc_feature (1)...(566): n = A,T,C or G
gcctaggagcctactgctcttcctcatgttanacgcgtttgcatctagagggaaaattgtgagtaaaagccatgactacaaaatgcacatgtggattccaccgtggaaaagtggggagcccggggccgggcacagcatccgaaatgaagaaactataaacattgaaaggaatgctggggcctccaaaatctgcgattacatttctcgtaaatggcaactcattgtcatcctgcagacatggattaaaccacaggatggggtctgaaccgggaacacttgcaggttaacagcaacaacatccactccaacagaatcacccccgtcacagtgagcaatgagcaaaaacatggctcagaaacagtttccccagatgttcaataaaggacatttaaatgagacatttaccatctggttaataacatagcattgagtgggacttggtaacaatatcccaatacgtaagcttttaaaatcagttcttttccctgagcataaaactgcttctccatctgccctatgaaaccaggcgataaataaatgtttgttcaacctcaaaaaaaaaaaaa

SEQ ID NO: 15793 - DNA, 984 bp, Homo sapiens
  misc_feature (1)...(984): n = A,T,C or G
atgtcgttcagtaggaatgttatgctagtggatcgaagtgcgcatactatagaaggcggtactgcatatcgcacgagtgagtagagcgtaacggagttgaacaagtangagtgaattgagatgggtgtgagtattattaagagatagctagaacactgtaatgtacgcagtatgtatgantgtgatctccatcgncgtcaagagatcacggtgcttaagctgacacaatatcagatctattcatgaatattcatgcgtcctagtcgtgtgatacgaatcaacatcgtatatcgtgtgcgcgaatcatgtacgattatacgtcttattatcatgtgtattgtcataggtcagtgaatctcatgattacaatatagatgtgccttctgtctgtaaatccagtttgcatagatctcgagtggaaccgtgcgttttgcacagctgctgggatacgaacgcgtagtgatgcacactctaaaccataaagaagagtttaatagctccgtcgtcgacccaagaatgcgtacgaagaagcgttatctcactgtctctttatctacttgggctcgtagtttaggatgtataccatgacgttgatgcatttctgcaaatgtacgcgtgaaataaaatgtgtcaataaggcgttgggattgtcaaggtggtgtattatttgttaatggcgtggttatttatatagggtatataaatccccagctgtatcgagtcgggtacaggagatgccaataagcggttatatacgtatatagcttgcaaaaagatttgtcgaaatgtcttacagatcatatccatcggagatgtatatcccgagtgtacttgtgtttgtacccataggttggcttctcttgacatgacgccgtaccttagtagcgattagtctctaattctccacgagcgatgtttactaagtccatgtcgatgcattgttaatcagatctatgcatgtacgtacctgggagcaaacaatgt

SEQ ID NO: 15794 - DNA, 748 bp, Homo sapiens
agtggatgggaaatgttgattaaagggcttgaagttttagacaggaggaatcagttcccaagatctatcatcaagcttgggggccatagttaataataatgtattctatatttcaaaattgctgaaagagtagattttaaatgttcccactacataaacactggtatgtgaggggtgggatatgttcattaacttgatgtactccttccacaatgtataaataaatcaaaacatcacatagtaccccatgaatatatatactaatattatttggcaattaaaataatttgttaaaaagaaagtgttataagggtcttaaggcttaaaaatgtatagtattaaatctaggaagagcataataagactcaaatatatactataactccaagaataaccactcaacaatagtacaaaaagtgacagatgaaacaccattataaatgaaaggtgaaatgtaaacattatttaaaattagtatttgaaaatttcaaatatgtaaaatttttaaaaaatatttgaagaaaatatataattaactcaaaggcagggaacaaaaactcttatgtaacatataaaaagagacagcaagacagtttacttaaactcaacaatttaaataattacataaaacatacatgcactaatctgacagcctacttctaaaaacgagacataactatatactatcaacaagaaataaatgttaaatataaagtagatggactgaaagtaaaaaaaaaaaaaaaaa

SEQ ID NO: 15795 - DNA, 371 bp, Homo sapiens
cctaggtgtctcatttttatttagttgatgtatgggggttggagaagaattatgtatctctacactttgcaggtctcggttcaagagaaactgtatttaagaaactgaacctaagaaaacatacagagtttcagttgaagaacacttgaaggtctgaacacaaagaggcatatctgcacatagaactgatttagataacaagatcctgaacttcgaacaaaagatgtgatggaataagacggtgtggaggggccttggagcaactgagtttattttgcatttggaaggaatataaataatttgtagccagcgggcagactccagcatattaaaatggccgaaatatttttgctacttcaaaaaaaaaaaaa

SEQ ID NO: 15796 - DNA, 724 bp, Homo sapiens
ataaaccctaattgactcctgggcttttattccatagaaataaaacttacattaacacacacacagacgcacacacaaactcacattattatatatgtaatatatattatatttgtgtatacacacacacacacacaagcaccttggtggtatggtcaggtgtgggctatatccatatacacaaattttagaacagttttattcataatatctcaaaactggaagcaacctagatgtccttcaaccttcaatcacgttcatggttaaacaagctgtggtacctccatatcatggaatcttacctatcaataaaagggaacctccatatcatggaatctaacctatcaataaaagggaacatccatatcatggaatcttacctatcaataaaagggaacctccatatcatggaatcttacctatcaataaagggaacctccatatcatggaatcttacctatcaataaaagggaaaccttcatattaatggactcttacctatcaataaaagaaaaacctccataatcagggaatctttacctatcagtaaaaaggggaaaaaaatacacacacaaccctggatgaaatctccaaaaaagttatagctgaagaaaaatattttttattaagaagggtacataccgctatgatttccattaaattcaccattatttaaaacgaaccaaattttaaaaatagagaacaggtttagtgggttacagag

SEQ ID NO: 15797 - DNA, 735 bp, Homo sapiens
ggctggaagtctatcctagcactccctcaacatagggaggagagaaacaaattttccctttctcttatggtatgagtttatagatccctgttctctgcaagtagtgacttcaagtattctgcttatctaagcagtggagcgaaggtcataaaccatctgagcaggcctgagatacaaccacctgggcaccatagtgaaggttatgggataagcccgtgctaggcactagagtaaacctaaataatggacatctgggctgcatagcaacggtcatgtgtaatcctgagttatgagcctgtcacaatttgcttaactgcctttgttctgcctctgtatccttgctttcgtgccacagtaagcctgcttcaagctagcccaccccctttttgaagtgactatgaaagtcaagtgctgtcttggttctgggcccagtttttggatgttaagtctgctgggtctgagtgcactcaataaagatctccctgtatttatcctgaggtgtctctggtcctcctgattcccgcaacagtacaagttagctccctacaaccttggcattatcactactgcacgtgacactctgcagcctaagaatcatcatataaaatctccagcaagcctttgtttcgtcgaaatcaactcttcttttgctgattctgcccgttgctcccttgcaacatattttaatgctttcttgaataaatctgcctttctttaccaaaaaaaaaaaaaaaa

SEQ ID NO: 15798 - DNA, 774 bp, Homo sapiens
  misc_feature (1)...(774): n = A,T,C or G
ctagaggtacggcagaagaccatttagnagagagctaggaccattcacctgcctcacagactgctggaccgatctctgggggtgctgtgtctgggacatgctcacctgaccagaccagctcatgcgccctgtcctgccagtcagtgccacctctgacaggtgtgcctggcccccatctcttctgattgttgtgaacaaatgagtagcttggcacagacagctctaccttgaccactgggggaatctagattaatgggggttgctactggacaatgcatcgacttgatctttttaatgtgcaaaatccatctattattgatgattagagatgcgctaactgactatgttggccaaaggcttaggtgggataaatataatcatgaataaatgcattccaggctagagggcaaatgtaacacatcaatcatggaatgatttctctgctcacacgcgtctgtatgtcttaataaatgcgtacaatgctcactataaaaaaaacaaaatgctcttggggagctaggaggcggattctcttgggccgcttcctttagggaggggataagcaggatgctcagttactgactctgtgaactgaggacgtccgttccgggaccccgtttcagttaataagaggcgggagttctgtttacccagacataggggaaaacgcgggaagaactttgcacaaaagcgcacaaaggggaaggacctcaaagggccgcttatgcggttggaatggagtacccccctggcgagcttccaaatggaagttag

SEQ ID NO: 15799 - DNA, 700 bp, Homo sapiens
  misc_feature (1)...(700): n = A,T,C or G
cttaggcaagacggagagtatttgatcggtcaaatagaggatatgagaagaaaaaaagataactcctatgtggaaaaaattgggggtacggagtatcatcctctttatttagggctggaagagatgtttattgaatttttcatactacttaaatctgaactagctcgcaaacggtgttgataaaatcaaacatgctattagccttgatgtctatacaggtgggcatgcatgaaatctttagagacttcatttcagatatgatgctgttccttatataattattactaccttttgatattttcctaggtgccagacactttacataccttatctcggctagttgtcaaactcttgtaatcctgtttagcagatgaggactatacatcctaaagagataaagtaacttgcttaaggtgcctagagtacacccagttcttttgactctaaaatcttctccaatatgacaccagtatttcccanaattcctgttcgattggtatatcattatggggttaaacagaaagtttgattccatatatatgtatatatgttatatatggggtgtgcatatatggtcataaaatatacatgtttatatattacttccacttatatacgtgtagtgccttgagagcttgcatacaattttaccctcttgcccccaaggatacaatggctaaacaaaacaaaaaaaaaaaaa

SEQ ID NO: 15800 - DNA, 893 bp, Homo sapiens
cctcccccgcccccaccaagtacttatccatcgctatgttctcccctacacacatctagtaccacgctgccttttcatgagctgtaacactcactgccgaagatccgcagcttcactcctgagcccagcgagaccatgagcccaccgggaggaaggaacaactcccgacctgctgtcttaagagctgtctcactcacctgacaacgactgcagattcactatccgagccaccgagacccttacctactccttcaggcaccactctctgctaccgcttgtagtgatcctatctagcgccaccttcttccatcaccgtctctctgttaattcaccccacccgccctgaccgccaggacactctcaattcattactcgcccgttacacaacccccccctctcctcacccactaccgtctctcctcgcaaacacccttcgtatgcataactccacctacactacattcacacacgtacagtgttatactctctcccacccaatgtactgaccctcacaccaatttcttctcaactcttctccgtcatccgctgctcccctacctccgcgcgcataatttcgcaccaccgtcacccacaattaccaaaataacaatgcttatctcaatctctacatacccgctttgtacacacactctctctccccacacctttcaccatcgacccaattcgtcacacaccccctcccctaaacacatctccacgcgccacccatttcttgatctaccccgccctgcccttcgtctccctttactctaccgcatattactgcacctccgccgtaccttcttgttgctatccgtccactcaatccaccactacataccaatcaccaccccctctccagatgtcaccaacttatattatctattacctgt

SEQ ID NO: 15801 - DNA, 1150 bp, Homo sapiens
catccggcgcgcactctcacgcacatgtcgtcaaccccactgtcccatgttgtatagacagactcgctggagccctagaggcccttcctgcacccaaacacgccagtggcaggcaacaacgcactcagtaggaagaagcaagtagcactcgtggcagctctattcacgcatcgttcaccacgacacggaacttgttgcatcgctataccattactcgacaggacaagcctcccacagtcgcatctaccccctagcagcgcactcttcgcctttcatcaaatacacgtccaacactttgcatcttcctcgctcgcacgcacccaacgctacctcacgctatacgccaacaatagttcctgacacttacccgatacgtactcgaggctgctcactattcatctacatactaccagtacagacatgatcggctagggccctcctccacaatagtaactcttctcgcacagcgctgcctgcgatgctacctcacacgctcgtcccctcgtgcgaacacaacgcgataatcatccagcctccgcatataacgcacccgcttgagagtcgacgtggcggataattttcttgtctcccacgctacaatccgtcgacaaacccttgagccgcctgtctagacgtgacacggtctcgctacgcttgccgagcgcctacgcccaaataagtaaagtgatttaaattgacccacaccaccaactcctgactccctctcacgtattgaaaaccaatgcaagccacttctccccacgtgtataatttatactagggaacaccaccacaactgaagccctccattcaaattgaccgtcatgtgtgtaattcttactctccccaacgttgattgtatagcgcgcaaccagcgctacagaacaaggtacgaccaaatgactttactcttccccacacattacagcggtgtctactcctaacacgcaccgaactgcatgcagtgtcgccaccgacccatgacaccaccgtcattagatccatctataacataacgtaaagtctctgccacgcatgtaacgcgtttatcaatcgcataataccgataatctccacaaatcacccgtaacgcacgaccgcatgactacacatcacctcgtgatgacgtacaccatcatcccgtccaatg

SEQ ID NO: 15802 - DNA, 537 bp, Homo sapiens
aaactcagtggaagattcacagagtcctggggctgtctaaggaactatggcgagatagagtgttatgggttgaattttgtccccctcaaaaaggtgccattgtcttctaaatgaacaactgaggagttcaacatgacggaggacggatatgtccttctttgcagtgacacaatcagaagaggtactgctcccccacttaaatatgacggataaatgtttctcacaacagacaggagaagaatggatccatgttctcgttgcttgactccttggcaacaaaagaatggctggtacccttggataggggacatataggacgccaagttgtctggcatgcctgcgttgtctgctgtgtgaaaaccaatcctgcctgaactcgctgagcttttcactgatgcacagtgttttgatagcggccccggctcttctgcctccctgcactagtccatggttcgtcccgcggtatcacgtagtcgtatcgcccccagactcatcctctacgagctttgttactatataataggtaggagagggcgt

SEQ ID NO: 15803 - DNA, 763 bp, Homo sapiens
  misc_feature (1)...(763): n = A,T,C or G
ctgtatcccactgtatgacgcactctacggttttttgatccattcaccttttggaggacaccttcgtaatttcgacttttggtaattaaagaaaggctcctccactcccagaagacgcagtgtgggcctttgtctcttcccttctcccgccaccggctcggatccgccttctccctgggaaaccatcatggcactcagcactttgctgtctgccgagtgggtcacctcctgagacgtgccactgacagggcagtacaccattaagaggggtgactcattctcaggggtccggtactgagtcttctgtcaatacattcaaacaaaaggcgttataaaaccaactgaaaacaagaaattctagaatgtgccctttccaacttgacccacgcatgctggttcagggagcacttcaagtcctctgagctctaaaaataagcctcagtgagtttccatgagcctgggggtgtaagaccaacaccctggctccttgggatcacgggggatgggagcctaactggagacgcattggcccccaggcagcccaccanaagccgggcggccacacccctgggcagagccgcgggcaggtcaccaccctcctggacaatctggggcgtgcccctgggatcctatgccccggcagcccccgcccatctttaaccgaggaaccccgcagcatcaccgccgctccgcctagtaagcatacccctagcgcgtagccatctggtctcggggactagccgcataataagagatggccagg

SEQ ID NO: 15804 - DNA, 776 bp, Homo sapiens
atgctgactctgagtacctagaatcaagaggtgccacaagactgaagaatcctgaatccataaatgatcacatggaatgccacctgccaactgggaacaaccacgtagaacttttcatgagcaagaaatacaatttcattgtatcaagccaccaagatttgggagtgtatttgttgctgaaacaagggttgttccaattaatataaagggcaaaaataaaaatctcacattttagtgtattcaacatgaaataactgaaaaagcagaatgtcatttagtgggctcacaaataattaaataagattttccacaattaggtaaaaaagaatataaaccaaattaatttataaaaaaagatgaaagttaatactttgttctaccttgagtttgagacttacaaaatctatacctgccagttactaagtattttgtaatattgcagtctccagatagtcttgatatagtctgatttttgacaaacaattttccctatttatttctttaagagggtgaaacgaatgctatgttatatgaagctttttagttgacatagaaccttttagccgaagcaatatgcaattggcttttaattagattctcccaggatgattcgcacctcgaatcaggattctaactctctcccctacaaaaaattgtggttatacgcactaacaatacccatcatcttctaccactaaatgacgagacctggtaattccaaccggtgattcaatatcctgacgctttgaatcctttttgagtaatataattttcat

SEQ ID NO: 15805 - DNA, 773 bp, Homo sapiens
atggtagttgcgagcagctcttgtgcagttcgggcggacatccactgggactgcactggactgtctgactgcccagagggtgccctttccacatctgaacgccggactctccaccctgagagtgcgccagcgacaccatcttgcgaacgtggatcctaagaatagccacgaagcttaactgctcgtcgctcagatcaggaaacacctcacttgtacttacacaccaatgaacgtatttccatgcctcggactgccttgctcctttatcccacaaatattcctaatgccccaacttcaaggaggatactttgaggggtgttatcccacctcctgactgggctgtctgaccaatataatactttctgcactgcataaataactaaatggagaaatggcagtatagaccacgatatctaaggagttggcatgcttggctcttggcattatttggaggagctcatcctcctgtctcttttgatgagggtgaattaatgctccgtgaccaacgtctggctaagtatgcatatgagggttcgcgaatccggctccagttttctcgaacgcgcgattcggatttccacaggataacgggacacctgctgtacatccctgaggccatgggcgctcttagggccgagaaccgtaaactggccatttattggagtttattcatcctgttcccggccgcctgctaatacaacattatcctgtctctctatgcaacgggcgcaactccaacagggataggtaggatcgcgcaacgctgccccggt

SEQ ID NO: 15806 - DNA, 723 bp, Homo sapiens
ggacaacagagtggaaagaaaagtggtaaattcaaatacctgtggcgcgttcaagtgggaaaataaagaagaaaaagcccataccacttcagtcttttttgattatattaaatatccagcaggctggaccccaaacacgagctatccacaaaggctgccatagaagaaaacaaatctcaagacacagattcaataattttgtataaatgctttatgaatttttcactttttataaaacaataaccaaatgcacctttgtgcaagctaaaataaagctcttggagaggaatatactgtaataacaagctaaagttatagtataagcatttagaggattctttcatcttaacgttccaaataatgacatatgggcaaatattaccacctgagttatatcaagaatggtagaagcattattgctccggttataccatcgctacgtttggtcttgagtttgactattaggttcatgttttactaatttaaacacaattaaaattttgaaccccgaagccattgaatgtgacgcttatgaaatatccctatcaaatcaatggtccacagacaccatttcctaatatccgcgcccatcatttcaccgatccccttcaataaacaaaacattaatccactacttgcgtaacttccttagtggaatatcgcgtacacttttgccaataccaggagcctacattaatcatccatacgtcacgaacctcctgc

SEQ ID NO: 15807 - DNA, 780 bp, Homo sapiens
  misc_feature (1)...(780): n = A,T,C or G
atgggggcccactttcaagccgacatggnaaaagtttaattagattgcctcaagcaagaatgttattctccaagtttcacgatattggcattaactcccggactgaagtaagtgcaatttacacgtgtgtgatgcctgctgaagtggaggacagtattttctacaaaatcctgatatcagaagaggctggaagaaaggcatttgtaattgacttcatatttacaattgcttaaaaatccagcaactggtgatcataaatatgtttatccctttaacacagaaagtgtttgatatgctaagttagacccagattcaatgcaagaagaaaaatgtacccacgtgaatacctggtggaatagaaacactgtttataccactcccagaaggtgtaattttaactgaattactgtcaatttgtcaacaaactaccaggcaatttattaaactactggttattcgggcacctaaactattgacatatttaagcaacacactactgataaacttggaaaatatatcctatgtctcgctactcaaaatactctaacactctcaatcatattcattcaggcatccatgccttcattgcaccagcttttacctagtctctgttctgaacccttgactgtcgacttaatcagcccagggcctctatactcatggtggggaacgtataaaaagctttcccataatactgtgtgggatcatccaaatttatcacgataaccgcaccgcccgacgttacaataattaacaacgaaagttccagcttatttaatc

SEQ ID NO: 15808 - DNA, 765 bp, Homo sapiens
  misc_feature (1)...(765): n = A,T,C or G
atgaaatggaactataccagnattattgagaaaatgaagatcagcagtacagaatcctgcccttcaagagaacacagtctacatggggagacatttggcaaaacacttttcaccactgtgtgaaaaagccatgtcactatttacactgttgtgcagaagcaacggaaggaagcacattagcatgaacaaattgaggctgctgctctgaactgtactagtagtgattgcattctcccagacacttccaaggagagtggggagccagtgtcacttaagaatgccttggtaaagaagtaaaaatggtcactcccattaaatatcaaccattaagctgtggttttttttgtttgttttttgtttttgtttttttagcaaagtatgattgttgccctgaggacaagcatttgtgcaattattcgagttgcaagctgaactagctgatcttttcacaaactcaatttttacttgaaagaaagattgatggtcacactatggctatttagaattggtatgtgacatatattttacaaaaatgcactgaccccattatttgaagaaaaatactaattgttataaatgataaaattagcaagtttccaggggaatgctggaaaatgtatatttactaccatgaacctgcacaacttgctaataggtgaaggctcttccatagtctgggagtaatataatgcacatgacaatttgatgacgcctaacgatatgctttatggttggaagatcttgtagctatgtagtttggttttt

SEQ ID NO: 15809 - DNA, 797 bp, Homo sapiens
tctcccgcctcggatagatgctcgtttatcctactatctatttgttttaagttcaaagtgactctcatcctgaaattactctctaaaaaagtgctcgtagttgagtttgggaaatgcagatctccaagaaacgtggagcaacttagatgagcaatgaaaggatcagaggtttaaccacgactccattttcttcaagccccctgaagatcctgacgatctgggatgtgctggctacaccctgttccccgtcaaccaggagcgttactgaagttacagtataacaatgtcaggagactgacacgaaagcaaatgctttcaaagactgcgtgtgaatcctgattgaagagatcataggagaatatcagaggctagtactcatttctggggcacccacctcctagaaccacgctgacaagttcctgctacccagataccctgcagtagtcacaggtaatcttctgcttacgcctgctgcacgagtttcacgtgctacacctgcaactacgccactcatcttttctaatattgcctttgccgatgaaccgaatatatctggcttttgttacccagaagccccaagcgttactttctctgcgaccgcacgtgaaaagttcccgctgattatgtcgccctcttaacccctccaccttcgagacttctggtttaccgccccctcgagcccgcctctgtatgtctccgtgattgcgtgcggtcacccaccaccctccgctacccttctttcaaataacccacccacttgcttcctctccatcctctttattcaaagaaataacatt

SEQ ID NO: 15810 - DNA, 786 bp, Homo sapiens
cacgccccccactgagacgacagccctacataacaaaccaacacaatctagaactgtacatcaccgctaagtctgcgcttcactcctgagccacgagaccatgacacacctggaggaacgaacagctctggatgggaggaacaaacaactccagacatgccgacttaagagctgtaacgctcaccgcgaaggtctgcagcttcactcctgaagccaccaacaccaacaaacccaccagaaggaagaaactctgaacacgtccgaacatcacacggaacacactccagacacatcacttctaacaactctaacactcactgcaagggtacacagatttatatcttagaataccgcgagacctagaacccaccaaatgtcgtacccgcgcccatgcctctaactcaacagatggagacttccctccgattcacacgcctgcggcgaccaacgactttaaacccacctccccgtcccgaccgccctcccacataccaagggtacacacattgatatactcactcctccacccctccaccaacacactacaacaacatcatcccctatttttcccctctactcgtctctccgcccccaccacatagactaccataacaatatataccgcagcgcacaataaacacaaccccccgaccgcgcattcacgccagccctcacactgtccacacagttaaacactactatccaaccatcaccccctccccctctctcccccaatcaccaaccccatccaaccaaacgctccctgtaatactagcagatcaccgc

SEQ ID NO: 15811 - DNA, 813 bp, Homo sapiens
ggaccaacccacaaaattcctgcgcaataaaacaacgacacgcatgttataagaagcatcttttattgctctccctgtggttactgtggaccaacactggcagcttcatgcttacaatctgctgacaaacccttcttagttccttcaattgaagaatgtgagcaagcactgctcatgtgcctggcaagcacgcataccactcaagagaaggacagtggccactcaggtcatcaggtgaacttgtgacggcgccatcaagaggctgcacgcgagctccagaaactgaaattcccactatcaacctattttccatttcccccctatgccccgcccctgctccaaattaagatctccgactattagaaaatgctagattttcagtattgctatacacggatcgcataccccaaactgaacaaacaaacaataaagcctttcacacagtgagcaaagacaccagaacctacccctttactggatccccacataactatacagatttgaacaacagctccctgagccttaccatgaacctcagctctggactcctggaactcaatcaacgcttttattccctacaggtggaaactcgctcccccaccatggactcattccccttggtacattgtactatggcttaccctacaagacagccaccatttagcctatttcgccctacatcggcggatatactacctaacgcttcctattcatgcaggggtcaaagaaccatcctaccctctctatcatactcctaagagaacgtactacttcctctcacggaccgaccaaccttaaagttcgtatcccttg

SEQ ID NO: 15812 - DNA, 1561 bp, Homo sapiens
  misc_feature (1)...(1561): n = A,T,C or G
aaaannnnnnnnnnnnttttnnnnnnnnnnnnnnnnnnanaaaaaannnnnnnnnnnnannnnnaannnntnnnnnnnnnnnnnaannnnnnnnnnnnnnnnannnntnaannnnnaaattntaatttnanattnnnnannannnnnnnnnnnaaannnttaaaaccnnnannnagtnnnnnnnnnnntnnnnnnnntnnannannnnaatatattnnntatttntnnnatgtntnntnnaaatataatttttatttaatttatgtgtgcgattacaagttaattttgtnantatgacaagcgttaatgtacatgatgtgtagatantctntngttatatagtanantatgtaatnatattttntgtgattacatgtacaggagcnaanataataacttaatatcgtataataatataganaaanttaaatagatacnnaatcannaaaacaaattcacgatntatataanccttataaacatcacacgtacgcgcgcgaccatctcgcagcacctnccaggccctgccacaccgccgcgcaccctgacgccaccacaatantatcactcacacacctcacccaccacctatctattggccgcctcgcctctctgtcttatctaatcctntctagtcgttcaccaagaaacaacacactctcttccttacttcatctctccgttcttccattctccgtctcttctctcgtctccggccacgtctgcncgcgtcctcgcctccacacntanctatacgcatatgagaaccncactgttgtgcatgcgtacacgctcgtgcgctcacacgcgcggcgccgcngtatcgctacgcgcatcancncnacagctgacgcacgcgttggactgtcggcactgcagagaccaccactgctcgacatcgcgactcgcgcgcgcgcacngacactgcgacctcgacaacacaatgacagatacgacgagacgcgcgcgcatgaaggcagcgccgacagcgcgcgcgcggcncgacgagtgtgcgcgtncntcgtacgcgcagtacgcgctacaggntcgtancgctccgtagtntgacgtgcgtcnantngaagtgtagctctacgcgagcgcgcgtcgagatgcacagcaggcngctaacgcatctcattangtgcgcgcntcgcgagcccgacatctgaaagcactctgacgtgcagntnattacgcgtgtacantacgacgntagtacnacncgtgatagctaacgttgggtcagcagcgatgcangtcatgagacgtgcactggancgtagactatacacatcaagtggcctactagatatgaagctagccaatgntctgctgagtgatgtntcagatcatcgatgtcctanagttagtgtngtttgtttgactaatatctatnagcatcggnatccctacgnatgaagttacgacgcgcgtcaaccgctatcntctnactanagtatgttgataatatgtgagtacgtgcgcgcagtcccacgctgcganncngacgacacggatcaaatcattactgccnctcgcgctgccgcgcgcgatctct

SEQ ID NO: 15813 - DNA, 314 bp, Homo sapiens
aatattaattataaatatcacacatcaaacaggatatcctcttatctagtgtcaacatggcatgttgctattctatcctggatcctggaattaagaggacatgtacagcagagccactgatggacctcagatacctttgttgttccaagttattgagactggggaatcatttgttacaacagcaaagctgactcatatatcattaaattgtctttgaggcatgaacaccaatattctttaaagtaaactcctgaattactttccttccaggactacatgctctgaaattaagttgattcacaaaaaaaaaaaaa

SEQ ID NO: 15814 - DNA, 868 bp, Homo sapiens
  misc_feature (1)...(868): n = A,T,C or G
gtaaatgaagttagaaacagataaagacaagaaataaaaacancaaaaacctttgggggtgaacaaggacaacagctcccaccgagccctcccagtgcccccaggaagaagggcgggggctttccctgcgtcctcctgtcgcccaggcaagagagaagcagccaccacaagctctcgggactagctgacttcgcaccttcgctgcgcgacctgaggccctcactgagcctgaatatccttatactgggactcccagaacacatcacattcccgaccctttttttttcggcctagcctcgggcatactgacccagaagtgcctcccgcccacaactcctgcccccacactaaccccgacaccagacgacccttctcatcccatcgcatcccgcactcagccgaatacacccagcgcgcagcagcgtgggacccacctaacccgtagcctcacccgtcaaaccaggcagcgaagtctgcacccccgaacccgcccgcgccgtaacgccccagagcagacccccgcacaagagagagaacactctacatcatattgcccccgaacgaaattcccgccaccacgacctgtgccctttcgactgatggataagataggcagacgacgcaccacagggacccacccaaggattcacagctcacccgcgaacaaaaactcagcgcgccaacgccatgatcctacccatgggttcgcccaccacaaggtctgaagtaaatgatacacataagggcaggtgttgatacatcgaaccctctgacacccatccccaacccccagcacacgcaccacgccaccatcgactactccatcccatatcacgccatgccccacgtccctggaacgccccgtgcg

SEQ ID NO: 15815 - DNA, 934 bp, Homo sapiens
  misc_feature (1)...(934): n = A,T,C or G
atgctctgtgattaccttcaacccacagccacccacacaaacggttagcgcgtaacccttcacagcttcaggaggcaaacccagttgagttctcacctccaagaacttgcagtttttctggggaggcaagaccgatgcccatggaacaaggtgtgccagtgagccccacagacaggggcaactccctgcaccacgattcacttcaaaaccacgcaatacacattataccttccctgctgaccatgcaccactggatattatacaaccaagttttttattcctacaactccctatagcctctagcctctgctcctctgaccccatctcgacacaactccgagcaacgtacgccccactaaacccgacgccagaaatcactctcccccacgcagaatcatcatgcttgcccccaacctaacccctagtcccttcatttatcgcatccgcgcactgcactcccatcactccacacaatataccaatacatcccccccctaacacccgccatacctcanccgaaccacgcatcgcacccattctcatccatatgcaacgatccccagagtacatccaatccatatataaataatactcccctatagttatcgcacccttcatcaacccgttcccgccaccccaatcacgcaccaccaattacacctaccgccgactacttcattacacttacctcattcgtacatccaacccaactcgagcacccgccaccctatacacttgcctcgtttctaatcctcacttctgaacgtcaattaaatcacacttccacacgcccaccatcccatatcgaagccgtgcccattcagccccctacctcctatatctcaagatagcggcagccaaccagtgtacgtcccccggtatcgctcatgcgctccgcctacgtcagcagaccaaacctccacctcgactcccc

SEQ ID NO: 15816 - DNA, 782 bp, Homo sapiens
  misc_feature (1)...(782): n = A,T,C or G
cctggtatagcgaggcctgaggtaagnnagaagagcgggagtcggtcggtggatcagtcagaacccttccagcattgaccagttaagttcaccatcttatataggtgtggtctatgctgcccaaaacaattaccacagaaacatcggagatcgttgatcacagatcactgtaacagatataataataatgaacaagtttgaaatatcgtgagaattgccaaattatgacagagacatgaattgagtatatgttgctggaaaaatggtgtctatagacccgctcaacgcaccgttgccacaaacctttaatttgtaaagaaatgcactatctgtgaattgccctataatgccgcgcaaccaagccgagcgcaatcgaaaaccagaaatcgtccggtctcgttggcttcatccgtggatctctgcgggcctctcccttcatagacgcctaattcttgatatcccgccactgctgtgtccgatccagagattattgagccgtcgagtttggccgggattattccccagacggtcaaccctctctcccgcgcgtttctcagccaacttacgatcatatattttccatgcttaggttcccgtggcgccacggtggtttgccgcccccccattcgcccccagcctgcgtcgtcccgcgcgccgcgcgcactcgggcttatagagagttctatcttcacactacgcaataaaacttgctcctttacattacttcccgcctccagctctgagggatccggtggcgtctttttgttatagctacggcgcgt

SEQ ID NO: 15817 - DNA, 796 bp, Homo sapiens
  misc_feature (1)...(796): n = A,T,C or G
cctgagggaacaaagcttgagatgaccagcctgagcaacatcatgagatcccatctctacaaacaaatctaaaaaattagccaggcatggtgtagcctgcctatagtcatagccattcaagaagctgaggcaggaggatcacttgagcccaggagttccaggttacaatgagctatgatcttgccactccatgagaacttggcaacagtggaagactctgtttcttttcaataaaaatgtaaaaagaaaaatttatttgtaaacatggtaaggaatacccatatatactcattacctaaattttccaatttttaacctttctcccttgtgcaccctagtttgctatcattttctctatcacaacataaatacgtaattttataacttacatatagaagtcctttatctctaaatactagtgtctgtattataaaaacagaaagatggtcccttatatataaccagtgtatacataatctacacattcaaaaattatacaaaatgctatctcatctctcatatggccggatgtgctctttctcgattcacaaaaaaaaaacaaagatggctcactggctctcccgggggcagctccgtcggcctcttccccttgtgtgagggcaactacacgagcctaagcgacctgactcccctgcggtccgctcgctcgcgttagggntagctagttcgacccttctccaatgtcgagtgctatggtttccctcccgtctcgagcggcacgcgcacgcggccgaattccacgcgacacgcctatcataatgctccgctacccgcc

SEQ ID NO: 15818 - DNA, 789 bp, Homo sapiens
ctggtctggcaggttctatttttgaggtctgggcagggaccaaggcccagcaagtgtagccaaatcacttagcttcatctgccttccctggccttgatcaccaccacccttcctgctccctcctcttctccctcctggaagaatggatcctgtcttcaggccctgagcatcactccggagagtgagacagacagacagacagacagacagagaaagagaggtggaggctgagagcaagaacaactctgctggaccttggaatcagagagatttattccatctctgctaagtctgaaatatgcttgctgggatatctccttgcgaccccttatcgtctcggacccatttacgactccattccacatgaacgcccgcccctaagtccgagccccagtcacgttcgcatcggcgtctctcctgcccttcgctccacccctgcaaggatacgcccaccagcctagcgcgctcagctgccatagtcgggcctgcccccgttatctacggcccctccgaaccctcgtctatacgcctgcggcccgaccgtacccgcccgcgctgagcccgagcctgcaagagccacaccaaaacctcccgccggcctccgagggggcgacgccacctttcactcgcccactacacgccttgctgtcgacgaagcctgcgcccgaccgatggcggcagcagcttaatgtcctcacgcccgcttcccagaccccctgccggacccacccagccgccccccgtcggggacagttctacccgactgccactcgactaacaccgcgcccg

SEQ ID NO: 15819 - DNA, 1167 bp, Homo sapiens
  misc_feature (1)...(1167): n = A,T,C or G
ctacgtccttgcctgatttgccgtctgataccactactctggtccncgagagaacgaacaagccgactattggggtcattctcactttnatncgggnatcgtttggaagcgcaagnaataatcatgtgttagcacattcgctagtagcatacattactagctgtctcgatcttctcagaggggtccatctgtcaaccgccacagaattcgatgcactcgcctcgtagaagaagcgcgctgcacggcacaccatgtcgacactctacacatactaaccagcatctgcgtcataagcacactgccgctttaggctgttccacgcgcaggcacgtccaatacgcttgcatactatattccatcctcctcgtttattttttcgacgtgcattatccgactacaaggcccacgcgacggttcgtgcttgcgatctacgactatgcacaacaacgcctatgaatagcggctgacgtccacgcattcgatccaccaagaatgcgacaccactctcatctacgcgacacgtccctcctcactccacaactatgcaatcccgcttcctctagacattcacgctcccactatccccgttattgtcatcgctatccgcgcgttagtaccgttgctgtatcactaccacaaatatcacattccgcttgccgtcgcggcgtcctttgaatagcgcttatctctccctcaaacatgtcctacgcccccctctcgcagtctcaaattccctgcctctcctcatctactctccattcgcctatatctcgacaacgccagccatattatacccgcctcatgagcatcgcagctcgccaacatcgccatcgacgcgccgccaattaccactgccgtaccattcatacttacttcctatacccatccccttcccgttctncaattcgctctatcctaccacttacgctcacatccacacatttctagccatcactccgcactatactagcgcacttgtctatgccaccgcgtcagtgccgctgactatctcattatatgtctcctacctccatcacgctccgtntccacatacgttacttttatacgacacaactatccgtcgtaaattcccctcacctacaccgtcgagtggtatcatcaccccgtacatcatcaactcgtctatatccgaccgcgccctcccct

SEQ ID NO: 15820 - DNA, 1198 bp, Homo sapiens
  misc_feature (1)...(1198): n = A,T,C or G
tcactcgcctacctanattcatgcactgcaccgtccaccttgctcagcggtacgtcgctgcgtcgatcctcacaacangctcgcgtatgctcagacatccttagcagagacagagactaatngngcngctcanagatacttcaacatgagtatctcgcacgtgacttatcacgtcaccctacatcctcatgttcttagccatacgcacacacacatagcacatattctcgcgtcggcgcgagctacgtcgcacgatagcaacaaccgctctctctctctccctccacggcgcgcctaatcaatnacttgagtgcctcaccatcatattatcgatagcggatacatcgcaactacccatacccgaccatcactactccatttcgtgtcgaagtcgatgcttattttcttacttctatctaggaatgattgaacgctgtcgagatcgccgtcgcctaactatgtagtattcactatctcccatcgtcactcctctattagtctttctccccttccattttcgttcctatatgtatgatcgcagtgcaatacacgcgttcagtatccaccaatgatgatgctccccataccgtaccccgctctctcctccctccctttcgccgtctagtctccccatcacccgcaaatcgcttcctatcccgccgccgtctatccagtaaccgcttacgtcgcccctctcttacgactctgcctacccgccttgttgacgctctcctcccctcaatttccaccattacattacccacctaccgccaccgttcctgcctatctagcatttgctaattacctcgccctctcctttctcctcggtagatatcgcgtgtcgccgtctatcctcatcaccgcgactgcgttagtcatactaccgcccatgtcgttcgtttgcgctatgccgcgttccgtacgaccgtgccgttcgcgtccgtacccattgatgttagtgcggtctccctctttgtccgtctccttgtccgtggactatccgacataccttctctattccatccgtcatncttctgcttctctacttctattcttctccattctctcagcgcacaaacccgcaccttctcttacgctgctctgcgacgtcttctgtgttcgcattcggcgcaccagctccgaccgttgcatccagctcctctactacaccgtctcgtacctctcatactctcctctt

SEQ ID NO: 15821 - DNA, 862 bp, Homo sapiens
gccacagtgaaatcctgcgatcgccagccccctccaacgcagacccactacccttactagaagcaaactgagcacatatggttaaggaaattgcccaaggtcacacagttggtatttcactgacgttcttgaaagaaaaggcttctggttttatggactgacaccatactacctatgcgcgtctgtaaaaactgtgactctccctattctaatgctgtcaaccacaagctgagctttctgaacatcaccacggacaaaccacttcccttttatgctcttccagtgcgacctctaattgggcaccacccctacctgcacactacccgtccccataaatgcacactcttaccctatcgctgccgcataacgaccattattactttcatcattacccaatctcaccaccctaaccgtatgccccccgctccccaacacttcctcaactctctatcgtttcccaaccacgcccagcacccacccacatcccccccatcaaaccgcatcctctaaattaactttcaccccgtccctacactagacggtccccctgttatttcaccccccctccttacccctcctattccacacctgactcctcccccttcacgcacccccattttcccacctccacacacggacgataacataaacataccgtaaccaacccacaccacctaccctcgcactcgtattcacagcattgaaccctccaccccactcgcacacacaccttcgaacacgcccaagcacatcaataagcaccacaactcccgttctcactatttaattccgcacccacattattaaatcaccccccccccccactctatacccacctacatcatataacccgcatccccct

SEQ ID NO: 15822 - DNA, 816 bp, Homo sapiens
cctgggcgaacgtgtgctagtcttaaatgtacagaacgggccagaggagtcttatgtacccttgcaggctcatcagcggatgctgctagtgtccaggtatcttgacaccgtgctgctggactgggatcccccaggaccactgcctgaaggaaggcaacacagtcccggacgcacgcagagaggcctgcatcagcatactgcgtctggatcaattctctatagggttttgttacctgtatccctccttgcccaacaggaacaagcacttttttttttttttcttcggaggaacccccctagaaactggctacctgagacgactgcccacgagggaccccttgcgatacacagagaacataatcgcatgagctaacattcaacccctgggcgtttaatcacaactgtaccctcccaacctctcgacccgacctacacacacagataaaagcctaccgcgacccagctctagaggttccagctgcccaactcccacataccaatcgaatcatccccgccagccacacccgcctttcctactccttcgctacacaaatacccgccgccatataacgccccgcgctcgaaccacctctctgcgccacctaccgctaccaaggggcaaccacgattacctgcaccacgaataaacaatcgcgagtcattcagaccctgagtacctgcgccccccgcacgcatatcatactccccccccgtcccggtgtgccagcaatagaacaccactcacatcaaacatcaccccacgacagcaccaagggactccaccacacttcaaaccagtctcacgcaccgcccgct

SEQ ID NO: 15823 - DNA, 970 bp, Homo sapiens
  misc_feature (1)...(970): n = A,T,C or G
ccacccccaccaaccttatacaacactcgccaccaaaccccccttactatcacggnagatgacttccagacgctgagctcatctgacagcctcctcctaatgagaccctttgctgctcccaagcttgtgtgagaggctggatggagaggaaccccccacaaacctggagaaacatctccaagggaaaaatgatgtcttcttctgagtctgctttggccttcacccttcacatcgcaagaggaggccagctcagttgagtcctcacctcccagaacttgcacctcttctggggcaggccgaccgatgcccatggaaccaggtgcgccaatcagtccccctaattggccgttcgtttctgcccctccgcctcactctctcatccgctacacccccaccttctcgccattcccagctgtgccaccgtccccctgcatttgttcttctctcccgattaccaaaccccgagctacccccctccacctatcccctatacctccgcttgatccgtcggtcccctcctctcgaccgtgtctgtcgccccttcccctatctttattcattgctccacccctctccctatcctcgccgtcgttattcccccgccatcatagcgcacctgcactctaccaccttattctagcccccgccccactatccacccctcgaccattccttattacctatattttctcctactgttacaccctcctctaaagcgccgcctccccatctcgttattcgctccgcccggtctatagaagcctctctctctcatctactcctcctcctttcgcatcgccatccttctactcccgactcaataccatgatcattcttccccgcctcgcccatctctctcgtgcgactccatattcccactcgaccatcgcaattcctccccgccgcactctacttctcatcactctcgcctcatccgntacatcttatatactcatccctccccaccatg

SEQ ID NO: 15824 - DNA, 802 bp, Homo sapiens
tgagtgaagtggaagagatcttgcaacatttcctgccccactgaccccctactttgggccttagccccaagagaagaagtatgactaccctactgttcacaaacaaagatgtggaatcaacctaagtgtccatcaatggataattggatatagaaaatgtggcatagatctatacaatggaatactattcagctataaaaaagtctgtaatcacatcttttacaaaaacatggatgaaactggaggccattctctttaagtgaaatcactcggaaatagaaagtcaaataccgcatgttctcacttacaagtgggagctacataatatgtactcatggacatagagtgtggaatgatggacattggagacttggaagggtggaggtggatgggagggcttcaccaccatccaccaaccctaacggcctatagcaacagcgccatttatctcattcgtcgcgcaacccttatctctctgcacacataaaattacgaaccatactaaccgccgttaagaccccaccgtgacggcccgatgcgcaccgatattgccacgccaaccaaccactcaataactatcctatcgcttctcttgcctcctcaccttcccacgaatatattgtgcacaatttgtacatagcgctaacactcaaccaacacctacgcacagctagagaggagacgactacaaccccccacccagcttaccccttaaatatattgcccttccatcgcattgtctaccacctctgcctcaataagtaacacgattacatatagttaacgacgcaaacggggccgt

SEQ ID NO: 15825 - DNA, 784 bp, Homo sapiens
caggtttttgtgcatccattcccagaataaaagcatacattgacagtctaagctgggaaactaaatttccatgatttgcattcttgcctttttcagtgacctaggactgaacccacaataccgctgaactatgtatgtgtgtcacaggagcactcagatctggaacagatggatcagagacactgggtttctcttgctactgtatagctgccaaagagtggcctctttttatcctgactagtcatccttgaatttggagttgtccatgaagctcttctactgtccggaaagagggcgcacacttccttagttcccatcagcgtggtgggaaagattcctacagaggctgaagaaataacattgtggtgctttttaatgcttatcaatgcagatctttcacctgggggagcaatctgttgtttccactccagttaaaaatatggagtttccttcgacaaaaaacttaatcgccctcgttggccttaacggcggagctctgctgtccgttacctctcccggggcgtctttcacgctcccccagtcgtgacttctctccccccctcgggtcccccctacgaacacccgactcacctatcctgactcgcgcactcccgccccgctcccctcgctcggcgtctcccccaggacggccgggcacacctcggcctcacccctgttgtacgggagccacggcacgtctcgcggcgctaaaccgcgaacgccggcttgcccagccctgtcggtgcgttgtctcgtgtttgccagcattaccccccgtgttact

SEQ ID NO: 15826 - DNA, 835 bp, Homo sapiens
  misc_feature (1)...(835): n = A,T,C or G
cgcccccgcccacccccagactcaccctcccgtaccacaccccactcnctcaatccaggccctggggagnataggggatctgcggtgcactagtgatctgggtctccaaaaaccaaaactcaacattgctgatgggtagcgcagctcccaccgtggcagatttcaggataccaacgtgagctctctgcagaactgggaagggagcatgcaatctgctcctgtgaaccatacgagccagctctgccacaccactgaaatcctcctgaaacccccgcggaaaagactagaattattatttcttatcagcaaaatagaaatgaagttggaatctaaaaaaaaatcctccacaactctacaacaaaaaatgccgtctagttggcactcacctgcggagcgttgcgccaccttcccttcattgagggctctttctcgtattctgcgtcacgggctcgctgtaccccgccgtctgcaatcgaacccactccccctacgttgtccaaccaaggacttgccgtcattcacgttatgctgttaacacgcccgtatcgcgtccgtacttcaacccacccctgacgacaagccgaaacccctggcataaattctctcccccctttaatatcccgagtcgcccccactcatcctgcttgcacagtaacaacccctccgcgagcgggggcgcgccgctcccgctaccaggtcatcacgtgccctacaccatcaacatcagatagattgaccctcgcttatcacccgcgcagcgtctcctacaaccgcctgttaggcatacgcatatcagcgcttaatcaggtgtcacatccggtgcaaaccttggcgc

SEQ ID NO: 15827 - DNA, 798 bp, Homo sapiens
tctctaaaaaagggagtggcactgaaataattcttgtaacatcaaaacggcaaaacacaggatgaaaatatggaatatgttcaaacctgaagacaaaggctcaaaaatcacggcttccataactttgcctatacttaggagaaatcctggaagaaaaacgtgtcacaagaaacagaccaaaacctcgccccaaacagcagaccaaagaccaagctaccacaccatacaatacctgatcagacagcgaacgacacgctcattatccacttgcgtttaaaaaataccccctcccatcgcccgatctacagcatcgcccccaccgcctcccacccgccgcgttcccactctaaacaacacccatccaccgaccgacctgcagcccgaaactccgaccgctaccagcacctctacccaggagcggatccccgccataccgactcgcttcatcccacgaccgcccgcatccaccaccttacgctgcagctgtcgcgcaatccacccggatatcatgtatgccgccccgtacgttagccgagcaccccggattgaatggccacacacccacgccggagcccgcgtgttgccccccatcgctgctaatttctactcataggcctcgcccgcagcaaccccgccgctacccacaacctcacgccccatctaccacccattacccccgcggaccggcatttcaccaccacaaccccgcccgacgaaagacacatccgtcgcaatgtacgaagtgacatagctggacctcctctcccctccttcccatgcatatcctctggcggaact

SEQ ID NO: 15828 - DNA, 1066 bp, Homo sapiens
  misc_feature (1)...(1066): n = A,T,C or G
accccgtcccgacacaaccccctatcacccaccaacgcccagagccacatattctagttttgttcctncaacaaaggtaatcaaagcactcaagtcccaatggcgatacagatgcaactcctgatctatctacacgtgaaacaaagaactcagcaaccataggggacttgccagtaatttcgctcccccttgctgccgcgctggcagaactgccacatcgccataacatatcgcctatcagctcttagcgcccatgccactcgcacccatcacaagcgcgcccacactcccgactcatctagagaccctcttgacctttccatcacaactccccctgctctcgccccccacggacgacgacaaaacctttgtttcttctcgcactccattcccacgctgtccatacgtactctatctctaatacgcaatcgtccgcgcgtcactctaccacacgagcgccaggcagtaccactcaccattacccgccgcaaagcactacaccgaggacacatcacatgcaccgcatgtctcgcgtgtncccctcccgcgtaccgacctcccacagacacgcttcccatgatataggtcactatatctatcaacattaacatagtctgtccgcccgtgcacactactccctctcactagtaaccgacattcgcccgacacacgtcatcgcaccntctacacctcctaacggttggcacagagaaggctgcgccgatacgcgacagatacgttgactaccccgccagcacgtcaacatcccctcgactcctctcctcatgtatccacataagtcatcactcgacccactcctcactgtacaaacaaccattccctcgactcctacccactacccatatccaaatgtcggaccgaaatcccagcaagcgcccggcaacaacagcccacttcaccccatgtttgtataggccttgtctcgcaacccattccgccacgtagaatgatccttcatatcaatctctcaattatatgtgtaacgacatatcttgccaatggtnacccgatgacccagcattcaattgcctccacatggagacgg

SEQ ID NO: 15829 - DNA, 897 bp, Homo sapiens
ccgcacccccgcggatacctcgacgcgcaggccgtagaaggaagtgttgtgtccctacacaaaggttataagagcactcaagttcaatgtgatgcagcgcaactctgaccttgttacgctgaaacaaagactcagaaccaaggggactgcctgaatttgctccccttgctccgccaggtaaatgccacatgcataatacctcacataagatcatgtcaccatgtacagtaccactccagggaattctctaacccagaccatgaggctggagaatgcaaagaacctgacgcaggcagcgcacacagaagccgcctgcatcccttatcacgccgctcgcgtccccagttcacgcctctgccagttctgtccacataatacacaactatcatgaacccctgtgctccacaacgcccaaccatctgtagttattatacagctatcaaagaaataatagtccgcgagaggtcagaacaaaacacaaacccgcttagacaacccgtgctctcttccatatagcccacactaccgctcactccgaaagtaccaaacgcaccgacaatcaacacgattcacctcaccccactggacgttcaagcgccacccgaccttaccgacctcccccatgatatactccgatgtgaccctgtcaggttgcccaagccagctaccacacctacacagatcaagacaatcgcacgccacatgtccctttactgcgaccttacttctctcccccataaaatcgctcggtttctccacacatatcacgagtcgagcgaattagtcgtccacgaccccctaacgagtcgcatattacctcaagattgtctagatgagagaagcgataagattacgcaagtactcgagagggacatgagtttgcctcatggtatgtgg

SEQ ID NO: 15830 - DNA, 804 bp, Homo sapiens
ctaggagccagcccgtgaactgtgagtgatcacacctggtacctataaaagcagcatctgcattgccttcaataattagcattatgctttactgtgcatgctgctttgcctttatactgcaccctgaatcaaatgactttaagacccagaattagttaatatacacaacactgctctcttgcccaatatctccaaaagatctgaagaaattttattcaaatttatcttgaaaatgggtgaaagtgaaattaggcaagcaaggcaatttttttttttttgcctagaataagaacacctggagatgaaaaacctggagctgcctctataacccatgctactttcctaagaattcctgaccgctagtgaaagcactcaacacgtgtcacagttcgcctccacacatatcctgcatgctggaggatcaccactgctctgacaagaggaccccgggagaccaccgtccagtgcacagcaacgcggggttcccgtatacgtctcagtagcgtttgtggcaaccgcccgcaccagcgcgctcccccgtgcttaaaccaacgtcaccgcctcaggtgccccgaccaacgcccgccctctcgaccgtccgcaccgcgcggccatcccactcacccggcccccacgcacccttactcctatcgccggcccatacaccactaaccgcgctgggctggaagatagacggcatatgagcagaggagatatcactcaggtgacgatcctttgataacatacctgtctctgggcggggtcgcccccgtgttcccgtctcttgactacatggttttagag

SEQ ID NO: 15831 - DNA, 874 bp, Homo sapiens
gccccgaatacgaagcaatacgagcgagcacccagcctccaccccatccccatctagctggcaggtcccacaggattacttccacccagctgtggggagtaacatggcagacaagccaaaatttgctccttcttcaaaggccagcaagacattgcctaaagggactgacttcagatctaacgaaccacactggctccctaaatgaattcatgcggagagcgagagctgggacgcatacttgcaccctgccacagcagacgcgggcagtattcgctgaggaacaccatcactcacactgaggaaggccaagccaacgaaaacaccccccgaaccttttgtccgccaagcacccctacataaattaaccccacccgcctcactataaatgcctgaaccccccgtcaatccctcagcctccgcacgttaccaccgccgtaaccgtacaataaacacacgccaatacactgcaccgtacactaaaaacccgcttactataattccgataccctcccataaccgtaaaacatgaaaccgtcctcacaccatctcaccacccaacccaccacgcgacggctagaaaagagtccctaatcgtaagacgcctacccccacatctacatccccccccccccccccgggcccccatagacgccacccacacatagcagagtgggagaaagtacctccccctccatcctcacccatccaccacacaccgctcgggtgcgtattggaccattccgatccacgctccggcaccacccgacaacctccagtcacatagtagtagaaatcaaccaagttgtacctcctctccacaaacccctaccttccatgaacgtcctgattctcacccagaccaccagcgtgcggc

SEQ ID NO: 15832 - DNA, 839 bp, Homo sapiens
tgactagcagactaagaagataaacttttctctggaaactggaaagatactagaaatcagagtattcgtgctccttcgaaaaatattgaagaaactctacagagtcttgctcttcgacacagttttttggactccatacagaacactctgcattatgaccagacaatggacttattgccacggctggaataaaggctggagcgcaatcggcgcgacctcggatcactgcaacctcccgctcccacggtcaagtgcacctactgcctaaaactatcctgtggctgggattgcaccagccttactctgtcagccaagatcgtgcgacctcccaccatcttggacccctgccacccctgcctactcggtgcaagctatgcttcccgcttcaattgtcgatgacggccagcgcatacaccgctctctccacactcgactcgtgcttgcactcccctgcgcccccgactacgccccgccgcccccaactcttcgccactccgcttcgccactcctgggctcggatatcggttacgaaccgcgactcgctcactcaaatccccgccctactagaagtcctccccggccaccgtcccggtccccgaccgcggcagtcctccacctttacaaaaccgccactcactcatccgccaccgaggatatggcaccgctcggtcccccaaggacacggtggcgatgtccccctgctccctaccccagctgcgcagcacgtgcatgcacatgtctcgtccctgaacaactgttccattgtgtactcatgctaatgcccgcgcctccctggcgctgttcaccggtatttccatactttgctaaccttgtgtggg

SEQ ID NO: 15833 - DNA, 255 bp, Homo sapiens
caaggaagagcggacctccccccacccccacgctgaaagcagctcccccccgcggacgcccggtcgcttcaagcgtgggctgtcgaagcaccgacctccgtgtatcgccttcgcggttgcgcccttgaccacacttatacgcatcgaccgcaaccccggcagcagcgctacctcgctcgccctcgacaatctccattcgcccaccacctatcagcccactcacgtcggcgacacccgcgctaaccacgcctaccg

SEQ ID NO: 15834 - DNA, 237 bp, Homo sapiens
gccctgctctccctccaggctggaatgcagtggtggtgatcatagctcactgcagccatgaattcctgggctcaagtgatcatccttcctcatcctccagtgtagctgggactataggcacatgccagcatgcccagctaattgaagaaaaacattttcagatgaaattgttgtacatatatcttcaagtgtgttagaaatatacatcttgtgtattaaatttatttgctcagaaaa

SEQ ID NO: 15835 - DNA, 812 bp, Homo sapiens
  misc_feature (1)...(812): n = A,T,C or G
gcggcgcgtgccaccccgactccgattcaaataaagcacatactcctcatttagggtgcttggcagcagtcatccagttgaggttactggatggccctgaanccacgcggctggtgtcctgatgtgaagagagaaaccacaggcctgggagaaggccacgtgacgatggaggcagagactggagcggcgcaggcacaagccgggaacgccagggccgccggcagccccaggagctgggagaggcctggagcccgttctccctcagagcctctggagggaaacaaatgatgtcacgacactgtggccacctgaagaggcggccagagagcaggcagcaagacgaagcagcacaaatacaagtgatccactctgctgagtgactgctccccccgaccctctgccctgccctgcatgcgggcttccgttaccacaccgtgtgtgagcccccagaggcagcttcctgcctgtctgtgtggtcaagtatggttatctttgggtgtggaggaattatcagtctttatcggctgtcgcttccgttcttctttgggagagggccttgatatgtcacacaggatggaatgcctatggccaatataatgtctctgctgcctccagactttggcctcaatatattccttgccttagcccttctatgatctggcagtcagggctttcctacccccctcaccccatctcctgtgtcttctgagggcaccgggttttcccttcccaccattcaacgtccgacctgctgcttcatgtattccctcgacctcgttgtctctgtgtcgtcagcacgcatgtcgttcgtg

SEQ ID NO: 15836 - DNA, 880 bp, Homo sapiens
ggcggtgccatctgcatgtcacaacccctataaactaacgcaagctcgtacctttatgatcttcgctactgtacgccctttctgtaggagagcgatggcgcgatctcggctgactgcaacctctgtttgccagttccaagcggctctcctgccttatccacccgagtagatgggattataggcacccgccatcatgccagttaatttttgcatttagtgtagatagggggtttcaacatgttgaccaaactgcgactgaactccagccctcaagtgatccactcacttatacctccgaaaacgctgatattacctgccagaataaccatcgaccagctgcatacaaaacctacattcacattatacctcataaaaacttatcatttgtgaccactctcacgttaatgaaatcgtataagaaaaaattaccctacctaccggcaaataaaaaccaaggttccctatcagcaatctaacccgaccgatcagactttcataaccctactctcgagcgtcgacaaacttagtatcactacatgtaaacacagtaacaaccgaggtatctatacgaatacatcaacgggcggttacttagtgacgtacggcttaatagattcatatcgaaaatagaataacattataaacctccacatgacgaaatcgcgactcgcttgtaagtatactccatacaatgacagcactcccaaccttcataaaggctacgaaagactcaccaaatcgcttcgttcgaaagttccgagttctaagtggcataacgattacactgactgaaacttcctcatataacaggaccatcactaatactcacttcccaccacacgtcgctaaagcattccgatgatactaattatagtaatat

SEQ ID NO: 15837 - DNA, 475 bp, Homo sapiens
agatgttgtctcgctctgttgcccaggctggagtgcagtggcacgatctcagctcactgcaagctccgcctcctgggttcacgccattctcctgcctcagcctcccgagtagctgggactacaggcgcccgccaccatgcccggctaattttttgtattttttaatagtgacaaggttttattgtgttagccaggatggtcttgatctcctgacctcgtgatccacccaccttagcctcccaaagtgctgggattacaggcgtgagccactgcaccaggccaagatattgtattcttgaaaattgctaagggaatagattttatgtgctcttatcacaaaatatacatatgagttaatgcatatgttaattagcttgacttagccattccacaatgtataaaaatctcaaaacatcatcttgtacatgataatttttgtttatcaataaataaattgtttaaatcgcactgcaaa

SEQ ID NO: 15838 - DNA, 318 bp, Homo sapiens
ctagaaacatctcatctatctacttgagcactgggttgaaaatggaaatcaggagccctgagcacaaggttctacattccagctggtgcaaaaactgagcggtcatttggcactgcactgtcactaaggatttcaccaaaaaggtgatagcttctatttgcaaaggggcagtgaccatgagctctattgaaaaacatgaatatctgcatcttcggcctgctgaatgctcacgtaggtttctccagtccccatgaatactctctctggcaattttcctcatgcaaagcagacactgaataaaacaggttggttttaaaa

SEQ ID NO: 15839 - DNA, 774 bp, Homo sapiens
gttggaattatgggctgcctaccttgggtgacaccagatgctacggtgatgcagctcatcatataactcttcggaatcccccttggcagtggctgcaggcttcccgtatttctcctcaaagcatcttgaaataggactgtattgtatgggcatgactggactgcatattttaggcattttcaggaaaagaaataaagaatttgtatgtgaatgaatctgagcaagcatctgaaagaagaggaatggatttagagtaacaaaagactagcatgatgtcacatgacaaagttcagagacgctcctcttagccgaggtggcttcccatggtgttactggtcatctgcactctggtccaaaaagcagtcctgtggtcagtgctaggccataagtcttcagttctgaacacggtgagatggctcttccatgacattcagtgtagtttctttctccttctctcactaactttgttagactagaagctacattatcctcttaaaagtttttagctcttatcccaaggactttctgggatatttaagagtgttgtaatctcttctttttaaaaaaattatttacattatggtaaaaattttataacaaaaattttataacagaattcactatcctaatcatttctaaatgcgcatttcagtacctataagtatattcccattgttttggccatgaatctgtatgtttttaaatgaatcacttcatattcctttctcggcaagttatgatttttcaacaactattcaggcttggattttatac

SEQ ID NO: 15840 - DNA, 325 bp, Homo sapiens
ctgagctggcagcccactgtgtaatgtcctgtggagaggcccacatggcaaggaaacgaaggactcctgccaacagccagtgaggaaccgaggccctcagtccaacaacccgtgaggaactgaatcctgccaacaaccacgagtgagcttggataagaaccccactccccacgtcaagccaatgacagtcccagcaaacatgtgactgcagccttgcaagagcccctgagctggaagactcagctaagccatgcccagactcctgacccaaggaaactgtgagataataattatttgtggtttcaaaccactaaaaaaaaaaaaa

SEQ ID NO: 15841 - DNA, 811 bp, Homo sapiens
ctttattattaggttaagggcgactgtcctacacccccctcgagctgaccggagatcttgagattcctctccttctaataacatattaggctggaatgcattgcagtggtgtgatctcggctcactgaaacctccggcaacctccgcctcccgagttcaagcaattctcgtgcctcagcctcctgagtagctgggactacaggtgcacactactactcctggataatttttcttgctgcccagactggtctcgaactcctgacctcaaataatccaccagcctcggccttctgaagtccggggaactacaggcgtgagccaccatgcctcgcctgttttctcttttcattcttttaaaagtggaaaaagtaactgtgaactggaaagcacttccattttaaataaaaatgaagtaatttgagggattaatcatctcacgaaacaatctttgaatgatgagaattgacagaattcattgttctgtatcccacaaacaaccaatataaccgtggctcgttcacacctcacctctctttcccgctaatacatacaatctacaatcccgttgtagacgaggggcgtaagtttacggcgaccaaccacccctaatccgattcaataccataacaccgcttcagtatgccgcgctattcccaaaaacccgcctcctcgccaattcttccccgtaaacggaacaggatcacgcccgcacgccaccttagtcagtagaagcaccgccagtctagcgagcccatggaacatcaagatataatgcgactcaacattacatggattcgacgtgtgtagaccg

SEQ ID NO: 15842 - DNA, 753 bp, Homo sapiens
  misc_feature (1)...(753): n = A,T,C or G
tcctgtcttctccatggccacacnatgtttccaccatccacctacatcaagaagtcaccttgattcctcatgcatcactcattggcaagctcactgcatctccaggactcacgccaggcctgcactgcatccccgctacttctcctaggctggcggccccatctcttgtctcgatggctacgataagtcccatatccacctccttccctctccccgcacagctttctgctacagtagcagaggtggagcctccaccaaaatgcagatttttccaaaaatccttacagggacgatcatcaccctagaggttgaacccttggatacaacagaaaaatgtaaaggccaatatccaggataaggaacgaattcctcctgatcagcaaagacaagtgactggaagctggcaagtaactggaagatggacataactttctctgactacaacattcaaaaggaatttactctttttatgttgcgttgagacttcatggtagtgctaaaactaggaagacatcttacacgactcccaagaataagcataagagaaagaaggtgaagtgggcgccccgaaatactataacgtggatgaaaatggcagaattagtgcgcttcgctgggagcgcccctcaaatgactgccgcgccggagctttatggcctgccactctgacacgcattattgtggctacagtgcctgatttattgctttcacaaaccagaccacaagtcattgcgttttctctcactaaagaca

SEQ ID NO: 15843 - DNA, 830 bp, Homo sapiens
  misc_feature (1)...(830): n = A,T,C or G
gatatttttatttaaaatattgtgtaattngaaaaaacgcccagcgtctgggccttggtttccagcacttacccctgagcaccataaaaagctgcggctgtaacccaggaatcatatatactgtagtacggacgcgagattatgaagatgaaagcatagatgtagacttatagatcgttttacatgcacagaacatgctgaggaaggaactcgagaagaaacactcgcttgtccgggaaaagaatgtgcaaatggatgacagtatacatgaatcgtgcttctgcatgtgcctggaggacgacaccgtatgaaacctgcggtttaagctcgctgtggtagaaaaacagtcttcattgggcactgcttgagttaagcattttacgagatgtaaagcaacagacctaatattcgccctggggatgccacagaacatcgaactaatctctgtaatcacaaaaataatcaacaaccttctatgatagcgcaaaactaaagatctgacacgtatacccctccacgtgataattacactcataacccttcctcgtacctcaatcaacaaccaatctctaacggaccctatacccctcgaaaacagtgctgtttcgcacagaggtccatcccctccaaagtgtataaccgcccctgtccagctctacggagcccgtacaatcccaaagtacgcgccccaccccccacgcaatcccagaacccctaaaacgcccccatcacaggcgatcgttgcaacgatcccccccttcgctctctcactaaaatgtactccaagttgagggtctaccaccaaacggaaacaccatcccgtacatccc

SEQ ID NO: 15844 - DNA, 403 bp, Homo sapiens
gaactgagacacggtagatgtgaagtaatgtttccaaagtcacatagctaacaagtcgggttgcgggaatttatccccagcctatctgactccagagtctgtgctaacgtctagcagcttcccttaaagatatctgtactttaacaagggcatcttggagacaacaagatacatgctggaatttcaggtggaacattcggctagtgagaaagacatctgcagaaaacaggccctgcagcacgccttacccatgattatcttttctctacttgagagctgaccacagtgcaatcaaactagaactcagggttgagagctgaccgcctaaagtgggattggaaaattaaactcactcattatttcttccttcttaaataaaggactatgattaaaaaaaaaaaaa

SEQ ID NO: 15845 - DNA, 830 bp, Homo sapiens
  misc_feature (1)...(830): n = A,T,C or G
ataatattatatgtaataananatgaaanaaaannnnnnnnccttagaggaaacaccgaaacaggttccaggggacaacagaaaccagctgacatagcttacaggatccggttcgggaggaagccgaaacccaaccggcaccagaggaaggacgagcagcccaacaccgcgacgacaagagaaatccagcactatcacaaggccgcctacggaacaacaacatacacgcaggatctacctggcgaacactcatgcaaacagagaaagacatctgtactccacggggcgtgctaaactccgtaaccaagaatatacttctctactcgacagctgtccacagagcaatcaaactacaaatcaagggtgagagctgaccgagataagagggatagcaaaagtgaagcctctcagaaaatcgcccctaaggaagaatggactatgattcaccaaaaaaactatgcgggacattcagaccttaacgagggagatttggccacgttctcatggagcacagggctacaaacagaacgtcgctcaccaaactcgcgcgatcgagccgtcgattgggactagcggctccactcacctaaaagacggcaatacggcctcccacggactcaggggaggagctatgcaaaaccatgccatcaaagggggcgcaaaagggaacctaaccttacaaacgcaccggggttggactttcaactgaggctacgcgccctgcctacccaaagaaaacatacggaaatccacaagtagcgagaccaccacagaaataaagattacacgcactgccccctggaagctggataccgcacaagacgggtccg

SEQ ID NO: 15846 - DNA, 558 bp, Homo sapiens
ataaaccataacttgcactcctgggcttttattccatagaaataaaacttacattaacacacacacagacgcacacacaaacacacattattatatatgtaatatatattatatgttgtgtatacacacacacactcacaagcaccttgttggtatggtcaggtgtgggctatagcctacacacaaaatttagaacagttttattcataatagctcaaaactggaaacaacctagatgtccttcaaccttcaatcatgatcatggttaaacaagctgtggtacctacatatcatggaatcttacctatcaataaaagggaacctccatatcatggaatcttacctatcaataaaaggcaacatccatatcatggaatcttacctatcaataaaggggaacctccctatcatggaatctcacgtatcaataaagggaacctccatagcatggaatcttacctatcagtaaaagggaacctccctatcatggactgttacctatcaataaaagagaccctccataccacgcaatcctacctatcaccaaaaaaaaaaaaa

SEQ ID NO: 15847 - DNA, 347 bp, Homo sapiens
ctgtgacctaggtgccacaacatgtgaggggcctgggtcccagaatcatcatgtggaaggctgtcactctcatctacatgggttgactatatgaatttgaatttgtattgtctcaagccactgaggtagggtgtagctgtttagcatcgacagttcctttaactcatacagaaatgcgtattggaagtggggtgccttgcatgcccactgagctgactagctacctcatgaggtcagagccatgtcttattccttcctgtaccccagtttctttttcagagcagcccccaccccaatttctgaatgaacatatgaataaatgaacatatgaatgaaaaaaaaaaaaa

SEQ ID NO: 15848 - DNA, 843 bp, Homo sapiens
  misc_feature (1)...(843): n = A,T,C or G
accaaaacaaagaaaaaaaaaaaatcaaanggctaaaaagaaaccccncggcccacgctgggcgccaccgcgaacacggaaatctgggaggacgcgccccgcacaaccacccagcgacgagaggaaggcctcgccgaacaccagaggacccagcaaagaaaacaaagagggacgcggcaaccctacacgagaacactggcggggaaacgagccccgcccgcaaccgcaaaaccagcagcgctcggcgcacaccacacaccccacacactgggaagggaacgaggcccacccaccgcacgaacaccaccaacgcagaagcagaaaaacccacttttttttttgcgcgggagacgcacgcggcccccaacacacgaaggggccgcccccccccaaagaagccgcccccggcaggagaaaaaaggcaggcagcgccccaaccgacccagcacacgcccaccggccccaagaccccaccacccaacgccaaccgcccaacaagaaagacccgccgcaaccgcggcaccgaaaaaacccgcagaacaaacgccacgccccaggcaccgcaccccacgccgaccgcaccggggccccagccacccaaacagcgaaacaacacccccgcaaaccgccccccaaccgggacccccccaagccccccaaacccgacccccccccacccccaaacaaccgccgccgcccgcgaccaaccaccagacccaccacacggaccccacaccgacccacaccgcccgcacaacaccccacaccccggaccgcaacccaggagcagaccgcgagacgccagaccgacagggaaggaaagcacaacccgccacgcgccag

SEQ ID NO: 15849 - DNA, 692 bp, Homo sapiens
aggtgtgtttctatgaagacactcagaagcggcccatagagacaggatctaaggcctcttactaacagtcagctccacaataccagccatgtgagtgagccatcttggaagcagattttccagccccattcaagccttcaggtgactgcagccctgactgacatcttgactacaacctcacaagaaaccctgagccagaagtgttcaaattagcagctcccaaattcctgactcacagaaactgtgcctctaaatcacctaatgagattatattgtatcccagaccaattttgaaggatactactacttggcaaccaaaatcctttaatcctcttgtagtaaagggattttaacttgtagttggctttccagttaggaacaggatttcccagttcatcatgaaaggatgcaaccatatatctaagttcttatcaataatgtataactgaaatatgtttaatttctccttcatttgcttaagaggaaattgttgactctgcacttctgctctttgatgcccagaatggtgatattcagaaagtgttggaagcctgtgtcttaaacttggctgattcaccatcatcctatgttcctaaattaactccttgaattagacttacttgctgatttgctatattgtgcctgaatttgcaataggtaaaaacaaattgctgtagtcaaaaaaaaaaaaa

SEQ ID NO: 15850 - DNA, 827 bp, Homo sapiens
ttttctattttttaatgaaataaaataaaactaataaaaaacccaacaacctcatgctacacaaaacaaggggtctaccccagagccacccaagctaccttatataaaagcagaaaatgacattccccaccatgatataaggaagggccgcgcctcatagaaaagcaacacggaggcctcaagaatatatagatacacaaaatgaaatgacaaacaagaatagaaactgggacaagcacaagaaggctgacagacatctggaagcggatgaggatttttttattggccccaaaacctactcttctcctgacaaacttaaaaccttttttccttctaagccctatcaccgatcatgacattaccacacgtcaagagaagacaatttttccaatgaaagctagaggggaacgctgaataataccgacaggtgctgagaccaccatgaccctgataactcacatctccaacaagacatacacctccatttattaattcctcacgcaacctccgacccaccttttattcagatatctaacacttcgtgataaaaccttctcctactccgatcattcatccatcaccaactaacactgagcctatagtcaacgataccaaataccgaccatcccaataaccactaattatccattgtatatcttccactctccgcccattaaaacaatctttaattaaaacaacacactatctccaacgacattcatcttatataccaagcttaccaccgaatccacatcttaagatcaggcaacaaatcaaactcccaatatactactcatagcaaccaaagacacacacccaatcagcat

SEQ ID NO: 15851 - DNA, 753 bp, Homo sapiens
tacccatacaaatgaaaaggcctctcgtgtcaagaatactagctcggtggagagcgcgctgttgctgaaagccctccccggagggagacacaagactgctcccagtgcacaccgggccaggcgccaggcgcaggtggcctgtccacagacttcaacaaacacagaacggcttgctctggcttttcattttctgtgtgttaacgatgcttgggcatctggggccttgctgcccctctgggcctggccagttcctagacagtgaagggcctgccttcgggcacggccatcctatgcgagcagctaatctggtgcccatactcagaatcgcctcctgtattgggccccacactccagagggcagtgtttctcagccttaatcacccagggccaggtgcgggacagctgaagaccaccctgtggcccagatcctgctgaaattcttaaagcttccagcccgccggccctaaccagccggctcacctcacctcgccctctccttctcatgataaaggccctggcccaggacttccgcacgaccctgccgactcctggccgacgcgccgctactgcgtggtcttgcgtgccctgcctcctgtttctagggacctgggagtgtaatcttcctaggatggtcacttgggtgtctgcacatcttaacatcccctgacgaagatgccctgggtacatccacacagccaggtgtttacagatctctttagctgtggcacaagttgcttggacccacattgcggg

SEQ ID NO: 15852 - DNA, 809 bp, Homo sapiens
  misc_feature (1)...(809): n = A,T,C or G
aattaattctctgtaacagaatttttatataaaatgngaagaggannccctcacttcaaatntgtcgatgcagccatttatgatccatagagctaaactctctcatagaccacagggcaatgtggtttctacaggatacgaggaatactctgagggacagggagtagccttccaagacccatctgctgacgctgatgagaagaggcatttcctttacctaacctgacgaacatccaacatcgaactgtagcctatactattccaaacatgctcataatacttacattaccctacaattcggtaaaaaacctgtaacatagagttttttttatgataaaacgataaatatctcatgtaatttatggaatactgtactgaaagagaaaaacagaatgggtgcatgggaaccatcatacaccagagaaatgatactgcaaacgcatctgcaaccatggtgtagtctacgagcactcatgctaggactgtaggtactctaagacactcatcccaagctagtgtgattacttggttcgtgaatggactgttcaaaagaatctccattactgaatctttgaatgcccaactaccaacctaggttcaaggacactgggctttaagtaatgtacaccactgaatgaatgaatgaccaagggcccatatttcatcaaaaaactcttttctcaagcaccctcgaaacataagggatatggcctctttggcccaacaggtgaaccttgtaagccatatccttaaagaaggtaaaataggaatcctgctcactgataggtagtccggaacactgacggcga

SEQ ID NO: 15853 - DNA, 429 bp, Homo sapiens
gtccgcgccgccttggtctcctaaagtgctgggattactggcgtgagccatcacgcctggcccttaagaccaaattcttaacatggcctaaatttcctgctcagtctggcgcctgccttcctcctccctgcccctggctttggtcacactgctctgcagcctcagtagccttcttctgattcctcgaagacatgtgttttccttctacaaggtgtttgcatgtgatttccatgcttcctgggacctcttctcctactctctaagctgaattaacttctactcatccactatattttagttcaaacgtcatgttctcagagaagctgtcctccaaccctctctccctatccccgagaccagtttagctactgctcttgtgcgttctcaaggcaccatacagcttttcttcatgggacaaaaaaaaaaaaa

SEQ ID NO: 15854 - DNA, 860 bp, Homo sapiens
  misc_feature (1)...(860): n = A,T,C or G
agagaagaaaaggaaacaatctaagccctccagaaaaggttgtatgcgaaggcccccatttaccagcacaaacaccagaggagcngcggcagaaggcggccagttgcgaggggccccaaacactctccacccngcccangnncaaggngcacacaggngagcggcngccnccccgcgnggacagcgcccaggngccccncanncnggaccagcacngacagcccagccagnggnnccaggnccagcccngacnncanctttttttctcnggccacaccacgagnggcacaacccaccngcngantccagcncccggcccaccgggaacccaggcnccaaacaagcagggagagggggaggggnggggagagagngcgcggagcgaggacgaccggaacacaaagcagcggcaacgcacacaaacgccgcccgaacccacaccgaccacacaccaccagagagcgcgaccaccaaggacacaaacccggccgaccacgcaccgccagccaacaacagacagaaaaaccaaacaaaacagccccacccaaaaagccaccaaccggcaagaccaacacaaaccccaaccgcaaacagacaccaaaagaccaaccaaaccccagaacacccccaaacgcgaaaacgcaaccaaaaaccgcaaaaacgagagccgacacacacccgcaacaaccgaaccacccaccagccaaacccacaagacagcgcgcacacaccaccacacaaccacgagcgaacgcgacgaaaaaccacagacagcacgacaccgccagaacaccagacacggcaaagaaaaagacagcacccacaacaaaccaaaagaggacaaccaccaccaacaccag

SEQ ID NO: 15855 - DNA, 1310 bp, Homo sapiens
  misc_feature (1)...(1310): n = A,T,C or G
ccaaaggaggnnnnnnnnnnnnnngggcnnnnnncnnnnntccntcccacccnncntcttgtaatatccactggtacataatagccaacttatgtgaccanagaagctgagattgcagtgatgtggccacaagccaaaaaacggtagtggtcagcagaagctgaggaaggcaaagaaaagattctcccctagagcatccagaaggaatgcagccctgctgacatcttgcttctcgcccaatgataccgattttggacttttggcttccagaactgtgagagaatagatttctgatggtttaagtcaccaggcttgtggtagtatgttatagcagccacaggaaactaatacaaatggtaaccatttcaaaactccattgttcaagagcattttgtgaaatcactgaagtcttcagggttgaaggccacagtggcaaaaaccaggattgcccaaggcctttgaaggaccaaaattcttcttgttgggaagataacctgggaagattattttaaggggcccacttttataaaatctttacaagccaaaggttatggggaaaacctaaaaaaaccaaggggtccaaaaagaaataagtttggccacccaaagtggggcccatttttccataccaagcaaacgcaaattttaaaaacccaaggaattttaatttgaaaaatggttaaaaaaaattggtttttcctttaaaatattttttcccttaaaattggggcctttgggtttttttgggcccaattttctcctcttctaaattgggaaaaaggttcaagtcgggaaccaaaaaaaatttccttttaattaaagcatgaactatttttttttccccaaattttttttaaaaaggttttataaatatggggcttttttaaccccacccttccccttttagaaatttgggtttatttctttaacccccaagattccccccatatttttctttccccccccccccctttttaaaaaatttacacacaattattcaattctgcaaaggtctcattccccatttttttaagaaacctcttttttaataacttgggaaacaattttcttttgggaaattctttttgggggcctaaataattttatttaaaaaaccctttaatcgaaatttttcggggggcccgccccatttaatttactttcccccttggttcattttctatttaaaaaaatacattcttaagaaaggataacccccctttctttaaattcttggggcccctctcaccttcattccatccaaccaacctctaacacttatctttgggtgccacctctactgtgctttg

SEQ ID NO: 15856 - DNA, 2147 bp, Homo sapiens
  misc_feature (1)...(2147): n = A,T,C or G
ttttnnaaaacattcttttgtaatgtnnnnnnnnnnnnnnnnnnnnnnnnnnncnnnnnnnnnntccntnctcttccttgccntnnncttnnctctctttctctttcccncnctagncntntnctctccnnnnnnnnnntnnnncnnnntttctctatntnancctncgtnttaggccctttnanaccgcgntcatatgagcttctctatatcgtnntnngngtttagggcnnacncccanacctcttccnacctcttcatcttctttccatccgctcnacctagntcatatagcgtcacagcacattgtgctatttgtgctctatcntctttgctcgctctatctctatacatacatctctctacctctacgtgcatccaatttcttgccaaaagtgtcatagcgttcgtgagacatctccnacgacagttccctcttctcggatattattttgtaaacctcgtcaccccaaagnaaggtnttgaaacttcctacagtcctttacccaacttgcttgcacctttcaatcgaagctcttatcaaaatctttttttttacctcatcttctcattcttcctttttccagcgtttatccccttaaagaagtaacctcgctcaccccatttgaaatccctccatcggggcttagggggggcctcgtatttttgccagcctggcagccaaaatttttttttttcatcttgctcgggaattgttaaatatttcatttgagatggaactttctcttggttcccaagcaaccaaatatcaccccttggctatttcttacatcgggcgggaaaaaaacagtaaaattggcctgggcttttattgacccttttggccccccccaattttttacacttccaaatactaacacatatccacataataatttgtggcccccttctcgttttttgggggctcccctttcaacatccctgcgtcttgggtgtaaccctctttctttagtaccgtgtgggcttccgctcttttctttctccccctttttttctanaacactacgttacattgggtgcctcttcaaaaaattttcttacaatttgggaaatttcctcctttttccggtcctttctctaaccttgggaaaccacttttcgtgaatcttttgtcataaggtcctttaccagtgtggttcacttgtatttctttcctacgtcctttttgttcctccgccttctgatataagacccgcggggtaactgatatctacaatgtggctctcttcacaatacctttctcataaattatcaagtgcggtcgcccgggcgtccttacatatattgttaactcccccggcgtggtctcttaaatgctacctcctcatacacccattatcgcaataacttttattcattacgtggtggtgtgtcgcggataattcaatntacccccgctccaccaattggctttatgataaacaacgacgtatatcattaccctactactgcgcgttcggtatggcaaactaacgcccccaccaaatgatagatgttagagttctctcgctaacttgccttattctatcactatagtgcgggtggtcactcccaatacgaccggagacacaatcccctccccgccacttcagacaaataaaaattaagacggtgacgatcccatctgtcttagttctctcgatcgcctttgtatgagccctcaatcacacattgtcttttttttctccccctttttttattaggggtcctcttttcccccactgaaggccctctactctactcacttttttgtcagtctccgctaaattgtacatctttttgccgcccacctaaaaatattatataatttctcccgccaatcattgtcctcctttctcccatatcggtacttctctcagatcgcaacagcgggctaggtggccgtccctcaataatatcaccctcctccctcgttgtttaacattgggtggatcacttcttagatttttgtacatagggactcaatttacaccccactaaacgcgcttatcgcttttttattttcgcctcctctccgctctcttttgacgactatattgcttctcgtcccacacttctataatgactagtcacacacaacccctattaatactcgtttctcgggtctcactcccctacccactact

SEQ ID NO: 15857 - DNA, 574 bp, Homo sapiens
cttcgtaatattagaagtgcttatagattttatttagaagtttggtgatgtttttgtgaccaaaaatatgctgcaggaacttaaatcttgtttatatcaattagtgtattgttaaattgacttctttatacatcatttccattaatgtcacagttttaaagaacctatcaattatgttaagagaggacttactgttctatgatatgaattggtctgatattatccaattaatccatggggtatgaattgataatattttcccataccttgggaagtttttttttatctattttccatcacatggtatgtatctgcctgtatatatgaattgataatattttcccataccttgggaagtttttttaatctatcttccatcacatggtatgtatctgcctgtatatatgtttctaaacttgtctcatttatcctccagtattagttattttggtattatgaacaaatttatttgcatgaatttataattaataattcaaaattaaattaaattcagtattaatttaaataccaaattaaaacattactatcaaatattaaattaaaaaaaaaaaaa

SEQ ID NO: 15858 - DNA, 2686 bp, Homo sapiens
  misc_feature (1)...(2686): n = A,T,C or G
aaaaaacccccccacaaaaaaaaaaaannnnnnnnnnnnnccccnccccccccccccatcccnccccccccctccccccccttccccccccccccccgcctcacctccccccccnnnnnnnncnnnnnnnnnnnnnttcctctaccccacanagatctcaccctctccaagagcaagannaaatgttaaagggcgctncctctccctctctctggcccttncctcccctnccctntngtgnctntntngcgcaactngccaaaccattttgtgctcgctagcaattgcaggttgcatcgcgtctcactagccccagattgccatacctctcgtgagccccccatagcgccattcgcatcggtctccacagcgccatnagctacagccctcacccctcccagnttagccgcattcacgccatacgccacataaaggntaaanagcncatcgccgtgaaatggcaacagcggccatccccccctcngccgcgccccctctctcgtaattcgccaaccccccaatttgccaagaagtgttcttcttccccccctccctttaattaaaaaacaaccctccccctttcccataccctccaacctcgtcaattgtnnccaatcctcgcctcgcctcctcccctcctcttctcgccccgccttctacggcacgcccgccacaatttaacacaatacatctcttacgagctcctaccccactcccgccctctccgctctgctcacccgctcacctaaaactctaccccacaccacacaccacctaccacacagactgcgcgccccccccccccgatcctcggccgcccccccccccacctcccgtgtcagagaaagacctccctcgcccagggccccccgcccctctcccccccctccttcttaacgccgtgggaacgccgcgcctctacaaaaatcctcccctactttggcacatccccaccttgcccgccgttcccaaacctttggcaccctttccaggcccttcagcccggcccctctccccccgctcccccggtctcttcccncccagctccttaggccccgccggctcctcgaaagcccccctggcggctcccacatcccacacagcaccttctccccatacctctctccaaacaaaatctgcgtccccaggtattctacaaactagtacctcgggcggcattacaaaactttcctcccccctccaagtccgcaacaattcccccactccgccgcggccgaaaataatgacacacccccccgccccaacggtgcttataaacataccgcaaaacaccccccttcgcggctcgcgccccagacaccccccaatcacctactaagagcgggctcccccccaaactaagcccataacatacaacacaccgcggggcctccccccacccacctggcaacataacaccccgcccgccgctcacccacctctcacacacaaacagtgggcgaggctcccccccgccnactacgatctcactatagccaccccaccctcccacgccccaccccacacccccccctctattcccttatacctcacacccactcctcctgatggcggcgcgacgctttcttactcatcgccagcgncactatccgctcaccgcagagaacactctagttcgggagaaaacccccccccccataacatccatcccccacttctcatgcccgaaccccgcacctcagtaagaccgcgaccctctttctccccccctccatncacaccccccaccctcccccccttctcccccgactcaacacgtcctgttccgcccccctnacatctaaagcagcgcctcttccggagtggtcgtcttctccgtataccataactaaccacccccccccccccccggccctggtatccccttggcgagagtcgggagcgaaaccctctcccaacaaaattttcaacnctcccactgtgccttacagaaacatcgcgttacccccccccaccccatacgccgccgactccgtggtcatcttacacacgttacccgcatccctcccgctcagcttctattccgttcggggcagcaacaaatcaacgttctccttcctctccacgccccccctcttattactacgatcacctccacagcgcatacgaaagccaacccctataccgctcgtcacaaacagctctagtggagcaatcttctgtcctcgacccacatcgaaaaacgattcccgccccccacttctcggtacatacactccccgccgcgtccccatcttttctacttatccccccgcncctgcagcgaaacgcaatcaacaaaacccccagccccccctcccacgatatcttccaccccccccgtcccatcacccgacgtctcgattgacaccgacccccctctctcccacccctgtcttcctattatccctcagtgaccgacgtttccgaacaacaacaaaccaccgcatatgcaaaccaacttaatcacgacaccaacccattccagctcgagtcacccactatggntaatctctcaagagatcgactcctactcccntctcaaacctacacccacatctaatctcgtatcacaacaataccagccaacaacaaatcaccctctctcacctacaaatgccttatcaccaaccgccgacacctcttcacgcccctcactccccgcgccactctacgcctctcctcc

SEQ ID NO: 15859 - DNA, 3157 bp, Homo sapiens
  misc_feature (1)...(3157): n = A,T,C or G
gggggaaaacccccccgccnnnnnnnnnnnnnnnnnnnccnncccccccnnnnnnnncnncnccnccccaccctctcccnnnnccccttccccaccccnnnnncacnnnccacacaaacaaaaaaaaaaaaganctccctcnccctnggggggggggaaaacccagnaanaaaaccccgagcacctctgtttagcacaacgcgagcacggggaaaaaacccaaaaccaacaccactcggggcttctcgaccccccccccccacgggaacacacagccccaccgcgccagcccacaaagaacgaccacccaaaccctcgaccggcaacaaaccagacaacccgccaaacaaaaccccagacgaagggacaagacaccccagcgcggccgcgcaaaaaacagccgcgcccgngagacccaaccacacgcgacacccaaaggaccccccccgggcccagctaactcccccctaataaaaggcgaacccgcgcctacccaacaagacaccaccgaagaaccccgaaccatcgagcctccaaccccagacacaggaaccaaccagacgggccccaccggccggcccaccgaagaggaggggaaaaccggggcaaccacaccctagcgcgcccccccaacaaggcagggagggagaacaaggcgagccaaccacacncccaccccagcggaccaccaaagcacaaaaagacaagcgagcacaagacaaagaacccccctacgagaccacgcacacaggggggacccggacccgaaggcaaggcggcgaaaccaaggaaggcaagccacccatggaaacaccgacagaacaaacccnccaagcccccaacacacacccacacaccaacagggaccgcaaagggcaaagcaccaccccccacctgccgggggggagaaccccacccaaagagggaaaccaaccaggcgccgcgggcaatacaaggcaacggaaaagaacacaaggcagcccggagggggagcagaccgggcggcgacagaaaaccacagggaggaggcggaccaaaaccgccaaagaacagcccagccacgctaccccggccaagggcaagagaaacaaacacgcgagggacaagcgcaaaagaccacaagccggagaggggaaaacaccccagcacgcagaggagaaacaaaacgccaaaagcaaaacaggaagagacggagcaagacccacaaccgcaaggggcaaacaaaaaaacaggccccaccgggacacgccacggcgaacccgcgagtgcagaacgcgccgccgcacgcaacgacacactacccccaaaagacgactcacccagcgacaaaagcgccggggagtggcgacacccccacaaccacaganagcaacacggaggcagaggcacactacacgactacacgcaagagaacgcacgacaaggggggagcagaaggggggcgggagaagagcgngcccgacaccacctcacagaaagcaggccncacggcaggaggcggaccaccacacgggcgagggcagcacgcagtgcacatcgacgcacgtcacntcangattaaacgaaccgagaggcacatccgcgtcaaaaacacgcgagagcagagcgcccacacagacacacacaaacaaaaccgtaccagcncacaacagcaaccggccacgaaaaaagaaagaggcacacgccaccacgtgaacgcacagggcaacaaacaatgcggacgaccaacaacacccacggagcggagggagcagaacaagancaatcgaagggcgtcagagaggaccaacaccctacgtaggggagcaangggaggaacacaacacccgcacgcagcacgcggcacaggaatacccaatccaccnnccccggtcgcccgaacgcacgaantgacgccgagaggagcangagagcataggacacgaagcaacagaaaaccaacgacaaggatgggaganacggaggagggccaagtaggtaagcgcacaacggcaggnggagcagaanccgaacaaaaccagggcaccccccaatgagacangcgccgcggggcgaactagccagcagaagcaacgatcgccgcaacagacccaaaaacggaacatcggggaggggggaacaaacgggagggacggcggccggcaccaaaagaaaccataacgaacccangcccaaccggcnccgcaggcagaagcagacggggaaggagcaaccggaccctgccccgacgaacaccgccacacgagggccgtcacaaaacacagaaactcaaggtacngccacaaaaaccacggcgacggggggaggganggcgcaggaggagaaaagatagacaaaacagagcgaccggaggccgcaaaaccaggaccacgacgggccgcggcgcacacaaaacngaggcagaggctgagggacgaggagatcactcgcaccacgccaggacgacacgacggcgcgaccgccggcgcggcngaacgacgagcgccaaccgcccnacacacccgacgccccaatacaccaagaagaggggcggggcccgcgccgactcaccacgacccaacgcaggactgaaccaaaccaangcacttaccggaaacaacagcnaggacggggcgaggacgcaacaacacaccttcgtacgtgcagggagtgaaacgacaaacgaaagacancaccgccgcaccgcaagccangcaccagccgatggaagctggaatgaaaacaagacganaaggagagggacgatcggcaaagaccgccgcccggccgcccgagcggagtgtgcgcgacnaaccggagagnccaccagtaggagcccgcggagcgggnagaacngacgcagggccacncgacaggcccaccacggaaactgccggcgcagcatcgtgccaccacngcngaccgcaaagcgacgacagaggagaccccgacaggaaccccgaacatgcagacaagggagagcagcagcagcaacctagcggcgacgacaccggcataggcagaaagaggaaaagaaccgcagagcagagaaaaggagaacgcgtcgaagcagaccgaaagcgcccgatagacgnaacgacgaagaacgngacggagaagaaaatgaagaaccgcccggaccaagcggaagagtaagaaaggggaagcgaccagaata

SEQ ID NO: 15860 - DNA, 839 bp, Homo sapiens
atcattccccatatgttccacacccctcggttaaaagcaaaaaaaagagcttgagtgtgaacttatggcccagtttctgggagtatctcttgtgaacatcacatttaagctggagaagaatgttcagtctgccgtttttggctggagtattttagaaatttgtcaatgagatcaagttgattgattgagagtgccattcagggcagctgtatcctgactgattttctgtctgcttcatctatcaagtcctgaaagaggtgtgttgaagtcttccactacttttttggattttgtccatttcttcttgaatcacatcagcttttgtctctcatatttcgctgttcttttgcccaataacactaaagttattttaactccctatcgattattgctacccacgtgtctctttcctcatccctttgtacttcccatccctgtcccctttctatttcacacgggaagctttcttcttaatcacctgtgagatcccttctttcttcccaaagctctttccggcattttttctgttggatgtactgcggtttgatgacgtttgagaagtgttattatacgctcacccgactactatactacaaacctgcatgctcacaagtcttctctttctccccttccctccttttttgcctcctcccctccccttcatcgtcccccctctactgttgagagcagacttcaatttttccgctcccatttatcctcccagtatccccctttcttccccctcccctatttgtttcccgtccttcactttctcttccacttttactcctcacataaccatctccccatatccctttccgccacacctgctaatacca

SEQ ID NO: 15861 - DNA, 761 bp, Homo sapiens
agggagtttatgggggaaggaaacagaagcacttacaagtctttctggttatggaaaagaggcctgcaattcaggagctggtaatccgtacagccaacgcttgaaggtactgggtcctggggtgagtcctagcagagaaagttcactagctcagtctgcaaccgtgttttgacgtaaatgtcattatcatccccactctacataagacgaaagcaaagcactgcaaggcaaagttacacattcacatttgcacagccagggagtagcaaagccaggagctgaatacgtgcaggttggttcctgtgatggtgaatattgagtatcaacttgactggatcgaaggaggcaaaacactgttcttggtgtgtctgtgagggcgttgccaaaggagattaacgcttgagtcggtggactgggagaggcagacccgcccttaatctgagtgggcaccatgtaatcacctgccagctcggctagaataaagcaggcaggagaagatggaaaagcagacttgctgagtcttctggccttcatctttctcccgcgctggatgcttcctgcccttgaacattagattccgagttctgcagctctttgacctttggactcataccaattgtttaacaggggctctcgggcctttgcccgaaactgaaggctgttctgccggccccctggttttgacaatttgggactggggctgccccataatgctccgatgttcttaacttgcagacggctattgagcactcaacttggga

SEQ ID NO: 15862 - DNA, 3324 bp, Homo sapiens
  misc_feature (1)...(3324): n = A,T,C or G
ggggnnaaaaaancccccccttttttttttttttnnnnnnnnnnnnnncccccccnccccccncccccccacacacaaaaacacgatttntagtaaatcgtgtaagaacgagagacgaacaagcagcaagcgtcgcccaacaanaaaacaccaccnnacccncacaaacaaaaaaanaatantncctcnntccacncnnccncccgcccacagcgacaacacacagagccaaagagcacggcgagagcgcaggaacgaggtgtttttaangaacaagacagcnaccacaccagcaccnncccacaccccccnnnnnnnnannnnannncnccnnnnnncnnccccccacaggtgcggtngaacagagagacaacactaacaccgaacaatcaacacnaacaaaccaatattcctcaactaacaaccacacacaaaccaaagacacncncacccacacaacacaccncgacacgacaccacccaacacactcaccaccnacacaagccaccacaccaccaacaaacacccacacaccacgctcccgcaggcagcacaagacgacagaacaacagaaanagcagagacaaggagaggcggccaaccaatcaaacacgaacacaaaacaagcgcacacacaaaacaacacaccacgcggctgcacaaacagcaccancacaaaaaagaaaaataagtttaagagaaagaacactagacaggagaggcaccagatataccgagcacccgacagaaacgacccgagaaacccagaaacacaaaacacacaacaaaagaccacacaccaaaaagagagacccaaaccacaacaaccacacaaccacaacaacaaccaacgagaaacacccggagcacaccccacaacaacgaacgaagaagcacccaccacagcagacgcccacaacacaaacaacaccaccccacacaaaacaatnccacacacaaaagcgaacaccacacccagacaaacacaccgccccaaccacacagaagacgacaacaaaaagaaacgcaccccaaagaaaagaacagaccacaaaaaagacacgccaagcaaaaaagcccaccgccgaacgaaaaccccaacacaagacgacacaaaaagaagaagaacaacggcaaaccgcgcccctacacaaccacacgagagcaaagcgagntcacaaaacaaaccaacgagcacacacacaccccccacagacgagcgcccaacaccgcagacaaacacacaaaaacgaaaacaaagcaccaaacgaaaccacaacagcacaagaaaacaacaaacccacccaaacaactcaaacaacgacaacagaaggacgtaccagaagcaccacaaagcacaggacgaaagaacaggacaccaaaacacgcaaaccancaaaagagcacacaaacagcgcggacacgacactgcancgacgaccacaacacacagcatgcacncaccagacgcacgcagcacacagacacacagcnncacacaggagacacgagaatgagcgccagcacacagcacacggacaaacggccacactcctnctgcgaaagacacgagaagtacgacgcncgcacagacgacacgagagagaaancacggagncggtangacacacagagaccacagcnagaagcagcgcgcggaacgcacgcaaaatngaggcagagaagaggacgaacgcaaacatgctaacaaccacacgcagatcgaacgacgctaggaaacacgagaccggcacagcagaagacgancgggtccgcgaggacgcgaancagcacggacacagacacagtgaaancatacacagagaggagcagtactcgaacgcgccgccagctcnctagcccaacacaccacgnccacgacgagccggtgacagaaaacagccaacacagcgactaatgcacgagataaccctataccacaaaaaagcaaccgaccaaagaaagaaanacatagagacgacacataggaatgagagaaagccgacacacgatcacacccctaccacaacagacaagaccacanaanccaagcggaaacgacgacaagagaaaaaacaaaggggacgaaaccaaatgaggagcagacaacgagacangcccgaccacgcacgcngactgcccacaatgacacgaaaacaacacgacagaagcggcccgacccaccacaacncaaccagcaaaagaacgcagcaaaaaggagagaaaacaagcaaccatacaagagcaagagcaaggacaccccaccgtgcactcaccccaactaatgncaggagagaccgagcaagcataaatagcagaaagcgaacaattccnacaacaccctcggcgttaaacgtggaagacggactcgccgatcagtcgacgccggcccggcncaacagcccacgaagcgatcaagacgaacacgacgacacnctcaccacaaatgacagtcacgaacacaaacgctcaaagctaaaccagtaagacagaggaaggacacgaagcaatagagagaacagacgcccgcagcggcacacccaacaacacaaagaccacctcaagagggaatccgagagaaggccatcaacgcgacaaccaccgcaaccncaactcaggcaanaacaccagacgnaganacangtaaacacccgaccgccacgaacacacatgaaacatggagacntcaaccggcaaacaccgacagaaaatccccgaaaaagaaacgacaggaatggcaaacntgaatgggacaagatcaacgaccgcacgaagagctgagtcccatctcaaataacagcgcaagatcgcacagacgagcggactgtgtaacaagagaaagcagaagaccgacgtcaacggccactcaacactacgcaccggaacgacaagnccaaacgacgccctgcggctccccgcggaagaaagatgagaaaggccacgccaacgcaacgacacgaccattccgacgcgccgtcaataccntcggacgtatgtgaaatgaatcacaagagaaagctgacgagaaaattagacagcagagtgacaccgacaaccaaaatgacctaacacacccccaaccccaccacacagcacacacacaagacaaaaactcccntntcaccaccaagtcatacgagacagacgaccattaacaacaaagcacaaagaactactcggatcgcnaacgacgaccgaccccactaaaacaacgcgactctaccacgacgacccaggccacgctaaagaaaatagtaacaagacgcgcacaacagagagtccaagaagaacgacaaacgcgcctgacgagaagcacccgtaga

SEQ ID NO: 15863 - DNA, 1187 bp, Homo sapiens
  misc_feature (1)...(1187): n = A,T,C or G
aaaccggaaaannnnnnnnnnnnncnccccccccttttttttttnnnnnnnncctagcctctgcacatgtctctggtcttgacaattgacctatgtaattgtcttggaaatacatttagtcctcaggaaggaacatctaccatcatcctgcccaagctaaggctacctgaatgtgctgagaaattctgatgaggaaatgctgcagacctggactaataattaaggaaaagttactgatgaaagaccatgatagacaatacagtgagacagcctattgcatttaaatccacagacacagaacccacagatacagggggctgactgtacaccagctatctcctttaaatgtgaataagctatttttcttgcaggcaactaactaaaatgcctaagctgttcttcaacagtccaacacaagggccttctttgatccgtggatgttctactggagttttcataaaacgggcttttagttattttaaatgctactttgggatgaaggattgtgggattgaaagccaaaaggggaatctttcagggaaacttggcctttttttttcccttgctaagaaaaaaactcctaattggtttccaatggccctttaaccttcccccaaggttatttggttaagccaaggggaaatggaaccccccttcttccccttgggaaaaggccaacccctttttggggccaattccctttttttaaagggaaagttttggtttattcctttctttccaaaggggggtttttccccctttttccatttaagatttcctttttccccaaaggttttaccccggtttaaccaaaaaaatcatttttttaaattcctttaaaattttaacccaccccccaaggccaaccttttttccccaaaaaaaaaccttggggttttggggggaatattccccccaactttgggtttccccccttccttttacaatttccaaaacccccaatttgtgaaaaaaccccttaaaaccccttttaaaactttttttgtgtcaaaaaaaaaaaccccctttaaatgggtaaaaaatgggcaaattcccccccaaaatgtggggggaaacggaaaaaccctttgtaagagaaaaaagatctttggccccttttaacccttttccccttttaaaccccccaaataatgtgaaaaacctggaatgggaataaacccccaaac

SEQ ID NO: 15864 - DNA, 826 bp, Homo sapiens
gtgaactatataaatgagaaacgcacccaaacgatattaaaatatacaagacgagaactgaatttccgcatattttatgtttccagcgtccttcatcctgaagattacaggacaataccagagaccttggcagaagggcacagatctggcttcccggagactgctaaaggctccaggtgaggcaacccagcggtgtcgtgggagttaccgccacagggagcagaccttcaaccaaagaagtcctcaacaagaggcagaaagctacaacgactctatctccattcctcccctcaagggactggccacccaacagactaactctcctcactacgcagtgaccccatgtgcaaaatttcctggtaccccacccctccttcctgccttacttttctttgaccttaactacacaatcttgggactgtactccccattcccattccccgctccacgccttatcctcctttttttctcctaggatctcacaaccaaccacaggtcacactcagttattcctgctcaacaaaatgatactaatgtgattcatagaatttaaaggagcgcttgatctgacgctccgaatttcttcctttttgacagttttttgtaggccagaatgcgcagcattttttagtctacaggtccttacacctaaactagacgtacaattacacatcacctttctacctaatgcaatattacttcgcctatccccccgtccatccaccaccacttttattatccaatcctagcctgttttttccctttagttacatcgcgcataagaatcacatctatcctatcctcggatgtcctcatagtatccgcg

SEQ ID NO: 15865 - DNA, 815 bp, Homo sapiens
  misc_feature (1)...(815): n = A,T,C or G
agtaggtgtctgggaagcggcgcggatgtggagggtagggaaagaattagtgagttaggcgacctcgcgtgcctccctgtttgacagccaggtgtggaacaggcctgtcgtcaaagaggatttgattggactgtgctggaagagctccgaaaagattacgacgcagagctcacccaccacgcgtcgcccccaccatgcaatgcagaatttgaaacggtgctaaaccgccacacagacacacaacctaccgactggctggaattaaaatcgcgttttcacagagctcgtagcagcatgcgtggtgtgctcatcaaggctgggagatgttgtttgttcgctgccctgtttgctgcgccacaagacacggctggctgggcatatatatttattatctgactctcctgaatacatgcacacttcacacagggaggctgtggctccccaggcgccgatcctgaggctgtatcttggggcggtgtactgactgcactgcccggtatggcgcctgtgggtgtcaccaagtgcacggggtgccactgcaatgcccctttagcgtggaactctgtacntcataagaccgagtggtgggttgtgcatgggacgttcctgagtttttggcatttcgtatcccaaactaattcagccactggtccttccgcgcgactcggaaacggtgtggtcgttcgccagtcgtcggtgccgtatattttcccgttatacccgttcctgccctccgctaccggtgcggtttgtccctttcattcctctattgggggaaagccagagacagatttgggggatattatcgattgact

SEQ ID NO: 15866 - DNA, 855 bp, Homo sapiens
aataatttaaaaatattcatccaaatccatttttttaataatatattttatgcaagcggccctcatcattccatcatctgacagctggtgcatgtataaaaagttggcaccttctctgtggctgggggcgaaaaaagggatctgggaggatcttcaacagctgcctcaatgattcatatgctaccagtatgtgaaaaatgcattttaaatttattcaatggaagttacagctgacgctcctactatttttctttaaatactgacatttcttgtgataaattttacaagcgtcacacaccacttttttcggtggatgaatatctacttgtacacactacatgtgtagaaatatcgctctgattttcgatttattcggacgacatattatccctccccattcatcacattccataatccttataactccctttaccattcccctcctcactctctcttcttagtcatttttgagatgttttctatacccggtctaaaaatgacacgacctgatcaatattaaatcacttcttaactagttacttggtaaataatttaattaacagacttctgatagtcttgtcccacactgtcccactatgccaattcacaattaaaattattgtccaactaacttgaagtttaatcctgaacgacctctctactacacctatatatataaatttcctcgacactcttaacagttttatccccttcactattattccttcacaatattccccttatcacccaccctcccctaccttaaatgcctaaatttcacaactttatatccaatgttgctttccccactttatactagaagtattatacggcttcacacaacagaagatgaat

SEQ ID NO: 15867 - DNA, 702 bp, Homo sapiens
ctgatatacaccttcagcttaccatgagctagtccacatgagggcgcgactcctgccgcaatgtacactcaagctggagcgcgctcacccttgcggtcacagactatcccatccctacttcctcacacgtggaatgcgtaccgactgatagaacagggataccgagatatacaaaatgttgatgaagcacgacctgctacacattggggttgcttgatacgagaatcactgctccggcaggggggcctacatgaatactgacagtgctgaaaagccatcggcattggcccatatcgggcgccacatggtcaatgaacacttggttcctggttggagccgtgcatagctcatgacgtgactggccagctctggtgggcaccaccgcgccacatggagccgactaggggatctagactgcccttttgaagcaagcgaatcgtactcctggaagagtcattcctccactcccttattgagactacataataaccagcatgctgatatgtggatctggctgcacaaaattgactgatatatctgtttttgtgacgaattgccttgctgaattaactacaagcactagaatgtgttggaccgtgcctggacttttttccttgcttatttggaaaaagtaatacagcagtccccccttatgtgagggggtgtcgaacaaaaacaaaaaacatgcacttcttggcctga

SEQ ID NO: 15868 - DNA, 189 bp, Homo sapiens
caacgcgaccacccgcgccacaaaaaaaaacaacaaaaaacgaaaaggtgagggggaacagacccgccaactagaggggagaaaacgggacggagaggccaggacggggagaagaaagaacaaaaaggggggaggggacgccgaaaaaaaccgaagacgagagcgcgagaaagagacgaaagaagaagc

SEQ ID NO: 15869 - DNA, 1809 bp, Homo sapiens
  misc_feature (1)...(1809): n = A,T,C or G
ctacaccctggaagtagagagccggccgagtcgagaggcgagacgcaggcatgatcgggcacgtcgaccgcccaccaacaacgatgcgatgtactttgcaccgcacgcgagatcagtcagctttgggatgatgaagcgcgagtggtcgaggttgatgccagagatttcctaccggcgctcgctcgtcacgcgcatgttntgtggtgccgcgccgcgcgctgcactagatcctctagcatacccgctccagtgacgccgacgcgctctctagtgtaccttagtacacaacacacgaccgacgctaccaccacaagcnacatgtgtgagctacgtgcgtagtatcacatcctgcttcgaattcgtgcgatgttgaggcgacattggtggcctgctctcactcgctgtcgcgnctcgctgccnttncgcctgatgcagtctgntccccgcgtctactatgcggctaggacggactgtcgagactcgatgccaagtgcggtcgtgtcatggagcgctcatctgatccagcgtcgcgtgtcgtgcgctactgtgcggcgacgagacgagacacatgagcacagcntatacgctacagtctcgatctacctgtcgnatgtgatgntatgcttcgcagcaactgcacgctcatcactcgaactacgcgtcatcgtcgtaccgcgcctatgcgtgactcgctagctgcgcgtcgccgcgcgatcagcgaccgtagacncatagagagccgcggcgtgtcgcatanatgtccacgtgtttaaatgcagttgtacacacgatcccgtgcgtgacggctcgaatnttagcgagctacgtgtgcctacgtgtctcgatcngtgtatcgnatcgactctcatcgcgcagtaccgctancacgagtgcgttttatgcagtggtaccgacgcgtgaggatagtngtcgtatagtgatgtcatcacgcgagagtangacatacagtnacnatgacgtcgtgaggcacaaccgtngtcngcgcgtgatagtgagtatngtagtaggncagacnacgagtgacatgagtntaccgaatacaactgcattnngtcactcagcagacgcgcatgaatacngctggcaggctctagcagaggctgnatgacgggcgagcaggtgggacgaggtcatgtatacgcgaacattagtgcgggacggctcgcagctctgtgttcncatagcatactcctcgcatcgtagacaagtatgcgtccgtgcgatacagaactgncangntnagtgtacgatcagacaacgtacagacatcgacgcagacncagcgcgtgcgactacctacactcctactcgccatcatctatacacatnacactgagcatncgtctacagatcgattgncagtcagtatantcntatcagcangctacacnagcacacgcagcctgatgatacgactgctcangtaggatgaggnaggcgcgctntcngnntcagtgttcacgtcgncgcagtcagtcgatagtgcgtttacantcgtgcagcgtcatacgcgaccacgaacgtcngntcctantgctcgactcagctacncatcgntcgcgcgantagacgctgcaggagcgtgcatgcgtcngngcntnantgtacggccagtacggantgtcacgacagctacgtgctctctgntanattcagattgacgacgtcgcagactgagatcgatgcgagcagcgcgtgntgangtatcncgacactgcagcgcttntacgccnacgacaatcgctgancatcgtntaacgtacgaccagcgtacancgcgcagcagcg

SEQ ID NO: 15870 - DNA, 1247 bp, Homo sapiens
  misc_feature (1)...(1247): n = A,T,C or G
ccgagcaaaggccgccaacaaccgaaagaacggaggggcgaggaaaggggccttggaagtnggaccggggcggggagggcctcgggggggggagagacccaggagccgggcgagaaggcgccgcacccgaaacgaagaacagcgaattataaacgcgacaaacgaagaagaccccacggagagcccaagcgagacagcgaagaacgaacaacagaaaacggccgacggagaaccaacggaggcgagaaaaacgcaacaggacaggccccaggacgaagacaaagaccacgacgaccacgacaaaccgaagagacgccaagcacagaacacccagagcgaggagcaaagaacacgaagcggnaaagacggcgacgtctttcttttcacgcgcggcgggaagagcgcacagaaggagcgacccggcggaagcaacggcagaagacagagacaaccaacacacccgacagaacggagagcgcaaaagacgacgacgggcacgcacacacgaaacgaccgcggccgcgcgcgcccaggcgcagaccagaagcagagcacgcacagcccgacgcgcgcaggcagcgggagccagacacacccacacgagacccgcgacgcagagaaaaacaccacagacgcaccacacgaggaaacaaaaccagaggcacaggcacgaaaggacacgcagacgacgcgaagcaaaacaagacaacacgaagaaaaacaacagcgcccccgacccacgcagcgagagcaccacacgagaaagaccaatagacccgcagacaacaacacgacccgacaacggaccagagaaagcgagcggagaagcgcggaccgcgcgcggccggcgtcgccgcgcgccgacaccgccgcgaaacaccacagacggcagacgacagccgcaacccgcacacgaccacatacacanacgacgacaaaagaancgagcacgcacacaccgacccaccgaggacgacaaacaatgaagaagacgagtagagcagagaagagcgaaaagatcacgaagacgagcgaagaaaacaggcagagagcgcgggggcgcggagagaacacagcaacgaacggcacggccgagaaacaagccacggatgnacagagcgcccgcaggcgaaggcgagcgccacggcccgcgaccgagacgccaccgcgacgacgacgacggacgcgcgacggccacagagaggacgcccgacagaggacgacgagcaccagcccgcgccccancg

SEQ ID NO: 15871 - DNA, 1436 bp, Homo sapiens
  misc_feature (1)...(1436): n = A,T,C or G
gagtggagaggcactcatagagatgacggggatgtagagagtgcaggagaggcgagaagaaggggggcgggttccttttgtttgggttgaactnggcaggngggaggagggcnccttcgantnganngnanngngctatcanagcgngcngaagncngnnagngncgagngcccagacgcgccgcagncgggggnaggacacgttaanacgacatcacgcgcggacaanagnacggcacncgcacagcggcncgacgcacncggcagnacaggacnccagcgcaangccnagaangacgcgacanacgaagccagaacaccgcagcnacagcgaagggcgcgcgcagnccaaggccggggcagagaaggcgcaggcaggcgccgagcacgcgcancgcgcgcgcgccacaacgcgagcggcagcgcgcagacggccgcagacgacgganacgnaggcggagcaggcagcggagcanaanaccgacgaccacacgcggagacaagcaaaagaggtctttttctcatgagaagagagcgcagcgcgcgcgaccagcgcacggacgagcggcggcgcgcaccgcgagacgcgccgacgagcgncgcgaccgcngagccagcaacaacacgcgccgagacagccgcncacagcgacgcgcaacgcggagcagcaggagcaccgacagccacagacccacaggcagacagccggggagaaacacacaaacgcgcagcaagacgcggagaacggcgacagaccgacacacccgaccganacagagcacaacaccgaagagaagcccagggcgcccagcgcgaccagagcgaagcggcgcggcgccgcgccgcaagacgaaagcaaggagacgccacgcacgacagcgaaacgcgcacgcagagagaggcgaaacgcacgccccgcaccaagcgangcaagaacgcgncgaacgagaancgcggaacggcgcgcgacaccccgccgcaccgcgcacaccgccgancacgaccaagacgacgagaacaacagcagggacgaacggcagcgcgcnggcacgaacgaaacacacaacaaagcagcgcgaccacgcgcggacgaagagcggaaggnacccaacganacgagccgcccgcagcacacgaccgacccgcgaggacgcgcgacagcgcacgcgaagagagaagagacgccgcgcaacaacgcacgcnagcgacaacggaacgacnacaagggagcacaaagccgcaccacgacggcagaacgggcggaagcgacgccacacggccacagaacgccagaacaggagaccacgcacgcaggacaggacgacacaaaccaccgccgcgcgcgcagggacaggagaacaggggcggcccgccgcacgcgcggcgtgaccaggcagcagcgcgacacacaangaaaagcggacagagcgccagca

SEQ ID NO: 15872 - DNA, 2157 bp, Homo sapiens
  misc_feature (1)...(2157): n = A,T,C or G
gtagtatggcacagtacgcgtcgatacactaacgcgtcctnactacnctacgactagcgtagagcacactctnctacgctgtgtgctgtcgcgatcgaaatctcncggacncgagcgcngacncgagcattttacgtgagatagngcgngacgtcgagctcccagcagnagagcgatagtcngcagacgtancttcntatctgcnagcgacgcgagtgcgcaagcactcacgacagacagctgatnanntgcactacgtatgcacgactgcgtgagcgacgtgcgactgcgtataggagagcgccgcgccgtcagtcctagcngagtcagcgtgnangcgacngcgcgcgtancntagtcatnattatagtgacgagncnagtaacatacgtagtannacgcngnnatgntgtnagcaagnagtanacggnagcgcgancgctcaatcgcgcgactcnatgcagatagccntgagtcngcatcntcccatccgccgtacgcacccagacatgttatantatgcatcacactccnatgagcncgatacccnctcgantcncnacgctatngtgntcntagtcagtcntcgcantntacctatagcacaccacganaccggatgcgatcgatntngatgtcaatcatgcgncngatgtccncaccgctagnctcagatagagcagatcatgtaatcacagtnatcgcgcgagtaatcgttagcgggatgcatatgcgcgctgcgacantcgtatgtctgtcagcgtccnagcgcacaggnactgtgtatgatgtgtgatntataatgatcgcgcgctggatcgcgncgaccgcgatcacacgtctgagancaccgcgcgcgaggtggtantnggtantngtcgatacatcagcatgcgcgcgcgtctgaacagncgagcccatngcgctcgcaggcgtgtaccacaggcgctacgancngaactagcatgctacgngttgatgtacgagacgtagtcggtngccngtcngcctactgtacatacgtcgtgncggaagaatgtacgcnatcatacgcagagcacacatatgagtcacctgagttaaagtacgtcagcacacagcgacgcgcgcgcgagggacgagtcgcangtcgcggagacgctatgtagatcatgtgngacgtgtgcaagtggagcgccgcacgcatcgatgctgacgacgtaccgagtatctcgcgactcacgcgtctcgtgagtctcatagncagctctcagtagactcatcatcgcggattcntctatccgactncatngtcagcgagatagtanatctgacaggatgcaggctacgaagagcatcgagtcgacgataggnagtgatcagcacgaaccgtgacatcacgngacagacaagacacgcctagtctgnctgcatnagntagatagttagcagtccatgnagtctatnaggcagagagacacactcccgtantagagnatctatccgtacatgctgcnacntacgtatctataatagatcacgctcacgaatcagtctactgaccactcgtcgacatactatcntgattactgtgcaaacnatagctacagcaacaccngcacgngactgataagatcgtcntcgntcaatacaccacatgtctgtgcgagagtgacagtcantatcgcgctgacgcgcgcaatatagcgtnactagatgatagcgacggcgtaactcggaccacgatgacnagcacgaganacgcagcagcagccgcgcagacganatatactacgaaagtagagatcgtgcgaccgcatgnagagacagatgtgcacntggtncgatcatgactagatgatgtcaatnacaggaaatgctagagagatgcgtncatacgagagngagtgatgacaatgcagcttgacgagatacgtgctgagntngtcgaangngaatagcgtacgatcnagagacagcacgatcnagcacacgcgcagtccatnctcgcanctagtagctgcgtaggtcgaagtgnacacgcacgaganacntcgtgacgagtagacacgaatgagagnagacacacgtcacgctgcgacacagtcatatgcgctacgaccgcacacacgcacgctctcagnacagatgatgatcagtcgcgcgaatggctgctgg

SEQ ID NO: 15873 - DNA, 1596 bp, Homo sapiens
  misc_feature (1)...(1596): n = A,T,C or G
cgacgagcacacacgcagaccaggaccaacgaaagaaagcgacgcagncacaccagcacacaaacgaagccctttgnttnaggancggaccggcgnggcgcacagaggcccttcagncggggcggcgcacaaccgagcgggcgnagggnaggagcggaccccgccgccgaacgagaagcagaacagggntacaccacgcagcgcgagagcgacagcccgccacagcaaggaccaagagagacggacgagacgaacgcaggacgagaggacgacgcaagcggacgcaaacggaacacgccgaacgacgcacaacgcgaacacgngcaggacacagacgcnagcagcgagaggcagcaacgcaccgacaggaagagcgcagaggggcggacacgggcaggagagaggagcagcagacagacgaancgagccagcgacgacacaagacggcncacaccggagcgacgctcctatttttctgcgcgcgcggccgaagcgaaggaagcgagacgagnagccgccacgtagcgacgagngcaccgaagacagagcggcgagctaagagcacgacgatagacgcacacgacggccggagcacgacacgacagagcgccacgccngccgcgacccgcgaggaacgcggagcaagcgggcggcagcgggcgggcagcgcggaagatacgagcgagcacgggtgaacgcggagcgcgacgcacggataagaggccatgacgacgcacgaacggaggcacgaaggcacgcaacagacgcacacgnacgagacggcagacgcgcggacgagccgcaagcgaggacagagcgagccacgccgaagtacgaagcgagagtgatacagacgcagcgcgcgacccagccgcgcgcgcacgctgcgcggcgcgatgagagagngaaagagcagccagcgacgcgcacacaccacgcacagagaggcgaacgccngcacgcgacacacagagaaanagagagcgcgcgcgagancagccgagacagtcgagcgcgcaacgacgcgtacgagaggcaccacgacggacacgcgatgagcagagcggacgactgacgaccgcagccgcgcgggtcgagaggcaacacgagacacgagaagacagaacacagcgccacacagnctcaaacgacagcgaccgtcacgagacgancgacagacaggtctgaccgccgcgcccgagacgacaggcgggcgcgcgacgaacgcagcgcacgcacgagagactagacgacagaatcacaacacacacgcgaacgcncacacacgcacagcgcgcgagagagacgactcacagaacgnagacggcagcaacncacagcgcggcacgcgngcgaccagcaggcacacggcagganacggacgtagcgcacgagcagaccacagaagactgacgacgcgccacggacagcangcggcgcgcggacgaaagcgcgcagctanacggagcagcgcgcacgcgcgangcagcgcgacgagcagagagactctctcatgagcacgaccacgcactacgacgcgncgncgacgcgcatcgngaagaagcgncgcgacgaccatcggacgcagcgacgggc

SEQ ID NO: 15874 - DNA, 1363 bp, Homo sapiens
  misc_feature (1)...(1363): n = A,T,C or G
tatacactacagagcttatcaggcatcttaccacgacgtacgntaantctatatgagagaactagcaagcgcacagcagcagaagagaagcnttanagtngacgatggtacctnccgangacagacgagngnnnctcncnancangagngnacagacaccgngncaatanagcgngcgngaaangacgcaactaaaaactagcnaccacgcccntcancaggacagnctcgacaagnaagncgagactattngtgtcacacacgnatgaatcatacgccatagtcatcactactacaatacttagtgcatactctagtaataatatatatagcactagnctacgccacgccgtacaacgcacaacaaataataatactaatactctccgcacatacactaatcataatatatccctatcctcaccactacacataacatacaccatatataattagtatatcacctatcaagaccacagccacaatcacacaatcattatatatactacaatgcacttagcaattcacgtgacttatatatattnacatacatatatcatgaactaccctactagtacaaatcatcaatatcacgaacatcattatatacataataacaaatgacacactcatgactcatataatatactataactcaagtaatatcgccactctatactttaaatcatagctacgaatctcacgatcaaacactgaccatatagcagagactcatcaatctcctctactggattcacacactatagacataaccgtagccaacgatcaacacaactctacacctacacaccctataaaatataacagtacatatcataattataataagttactacagatttaccatcatacgttgtcatcagctcatatactagtcagactagagatntgagccaattatatacaactatcatcatatactagcagacgatagtgtctcacaacaaatcataacagataggaactcacataaacacactctnacatcaatgtcttagaaaccaccacacataatacacatatcacacctacgactatctcatatgatgataatctcaactctaacnatcaactgcctcgaagcactgaatactctatatctagctcatccgcacagacatcgacagcgaacgccatcatgttatcactccatgcacacgcaaaaggctatcatcctatacaagtctacactcctatgtcagtcacatatgtctaacatgatacaaacaagatacacatacgaatatatcatcctccattatatattatcctacgcaataaaattcacttactaagataacaaacccaaacatataacacacatctactacagcaacatcct

SEQ ID NO: 15875 - DNA, 1027 bp, Homo sapiens
  misc_feature (1)...(1027): n = A,T,C or G
ggaaagggaagaagcgggagacaaggacgaagcaggcgggttcggaggagactggaggaggggctcngagggggaaaccagaaacagagaaaccaagtaagagataaatatctttatgtgccgaagaaaatggcagcgaagcgcggacgagagacgatttaaatccgaagacaccccggagcaaaacgcaacagacaggggaggagaggagaacaggacgagccaggaaggagacagaaatagcaatacagcgaccacaaagaggtggagtcaagggagaacaagaagaaacttttttgaagaggaggagcacagccaagagcgcgagacatagaaggaagaagcgcactgagagagacagacgacaaaaagacgagaagcccacacacagagaaagaagaccaataaagataaagaccttcaagagaaaagccacgcgacagaaccagcaganaaagtaacagaaccgcccggacaagctggcgagagacgtcgcagcaccaagcaatgccacgcgacccagactagcgcgaacgagaggccgcaggatagacatggatacgagaggcgaaagagcacacaaatagtacgcaaggacggcggattaggtgattcgggggggagaaggcgacgaaaatgagagaagaagctaaacagcagaagaagagagcggaaactccgacaaggaataggagaggagaagcagcgaccggaagagagcaaaggagagaagcagatggacgaaaagaagaaccaactgcgagtagacaccaacgacaaagcgagagcaactacacacgatgatagagaaagagggccgagcaacggagagcggtgaaggtgagagagcgcgagagggagaagagagacacaccgtatagacgttgaacagccgcgacagccagacacagagagaagaagagtcacaaagagcacgaccccataatagcagccggagcgagacggcgtgaagggaagacaacgcggagagggagaaggaggcaagtcaagtgcagcgaaacgaacg

SEQ ID NO: 15876 - DNA, 1749 bp, Homo sapiens
  misc_feature (1)...(1749): n = A,T,C or G
gccacagaaggaggcccaagccagaaaccacggagaacacaagcacccaacgacagagcnccttcnctcaagtnnnaaccnnagaagacagaagcgnccctggcgaacggnggngagataacaacgcacaannncgngannnagaagaagagaaagacgagagcaaagacgcacggagcgttcacacaggagcaagcaccgacacacgacaaaggacgacacgaccaccgcaagagcgaccggcacaagcaccacacgacccacacacgaccggcacgaccgccacccaccacagacaagacacacgcagccccacaacgcacacagagacacgaagaaaccagaacacgagcaacnacagaaccgcacacagcgaccacaagaagacagacacacaaccccaagcacagggaggacgcacgagcgaacaggcagagaacggaaagagagagaagagttttttctctgcggaggnaccacaagcgagaccgcagacgcgacacgagaaccacgacaaggagncgacaaggagcagagagcagnacgagcggagcagancgacagaccaaaacgcgcgcaacgcgcaagacnaaccgagacacgncgcngcnagacagaagacagcgggaagcacgcgnaggacgagaagngnncanaggagagacagacaacagagagcgnaacccgccacnnccgcgcgcgcaacgccaggaccaacaggccagccacgacgcgaancaggagcgccngcgancnancgcgcggagtagagngagangacgcgcaaagcgacacaaggaacacgcgacaaagcaacagngccgngccacagagcggcngcacacacagcagcacacnacaccacgaacagacgnagcacacagcgacgacgaccgaaagananaccagcacncaaaacacacgacacacgcggcgagagaagacnagacaganaacnngcccaagacgacgngcacacagagaganagagacgagagccgnncgacacgcacgagcgangcaaacgacaagcgnnncanacaacgacagacagagcaggnagcaccncacagcgcacggacgacagncncagancagncgcgcgnancacgacgacagcaagccgcgaagcgnacggngnagcgangagnacagagacagcgggcgaacgacgtcgacangcacaacnaggnagacgagaggcgacgcagcgnagagcgcgcgcgcacacgcaacacgacgacgacgacgcagagntgagacagacgacgcacacgacagccgcagacgcacgngcnaccacgaaacanagcagcgagcacagacacgncaacgaaacgcntcnangcnagancgcgacgcacatcaccgagcgacgagagagctagacatcgaggcgcananancgatagcacgcnacgccgcagacgagactcatcgtacgaccacacaggctatgagcggagagctacatatgngagaaagagtacgaagcanagcaagacggngcacaagcagcganaatcgcaaacacgcacataggacgcagagagcgagcacgcagagagcgcgcgcagcggnaacagagagcccgacgtcagggcacgggagtcgacggacaggcaggcgcggagcgagcgacatcgcgacgacgcatacacgnacgaccataccacgcgacggccactcgacgcgacgcggacgacgcagagcgcacagcggcacccacgcaccgcataccagacacca

SEQ ID NO: 15877 - DNA, 281 bp, Homo sapiens
  misc_feature (1)...(281): n = A,T,C or G
taggaagaattccaagtccctttgcaagtcaaagtcgaggatattttttattcaggccacggaatggaagaaggtcagcagggttggtttaaaatggatgccanctaattttccacagagcaatgctatggaatacaaaatgtactgacattttgttttcttctgaaaaaaatccttgctaaatgtactctgttgaaaatccctgtgttgtcaatgttctcagttgtaacaatgtgtgggggggttcaatttgttgaaaattaaaaaacctaaaaataaaa

SEQ ID NO: 15878 - DNA, 789 bp, Homo sapiens
  misc_feature (1)...(789): n = A,T,C or G
ctacttaatccccaaagatattctcttatactcggaaatgacgcaaatggaggaggaggaantcctaaananaaaaattccttaggtctggggccggcactnaatnanantnnncccctangacccttcctactccaaagagattcttactattactgagagaataaatcatttatttacatgtgagtgtgattcatcatcccttaattaaatatcaaattatatttntgtgaaaatgggggggacacacttatctngctcttctacaaaaaaaaattataaaatntnntttttctccactaatataaattaaactaantnttttcaaataaatcaatnnccctcttnaccctcnncataaaactctacaacctcttacctttantaanggttaattcataatcctcnctcactaactcnctacnctcantcnnttcnctncnacaaaccntttcanctcactcaaaagcntaataccnttatccacaaaatccannaataacccaaaaaaaaacctttnaacaaaaaccctacaaaancccaaaaccccaaaaancctncttncttanctttttccctaagcccccccccctaacaaccttaccaaaatccaccctcaattcaaaagtccaaaccccacccagacttaaaaataccccncctttcccctaaaaactcctcctacctnttccttaccacccttccccttcccaatacctttcccctttttcccttaagaaccctacccttcctctaactcccctttaaattcccactcccttaatccct

SEQ ID NO: 15879 - DNA, 251 bp, Homo sapiens
catggtgaaagcctttcagcatatagttcttaagcaagcaacattaaaacactgataaaaataacagcagccaatgaagatttgggatgtaacacaacactactggcgtatgcaagacgcattcactgacacggccaattcaacaaccactccgaccaccatcatccctacagaaccaaccctgactcacacatgcgccccacacgcatcctcccactcccatccaccatactcacacaccgcatcggccc

SEQ ID NO: 15880 - DNA, 176 bp, Homo sapiens
  misc_feature (1)...(176): n = A,T,C or G
gcgcagagccacgcagaagacgagaggaacacggagatggcgcggcgggcgcacccagacgaagcaggggacgccgaacaagaaaatttagaaggagaacgaaaaaaagagaagnttaagggggggagaaaccagcgccgcacaccggcaagcagcgagggggaaaaaaaaaaaaa

SEQ ID NO: 15881 - DNA, 1570 bp, Homo sapiens
  misc_feature (1)...(1570): n = A,T,C or G
gggagaggagagcgggcaggggagcgctggtagcaagagcagaagcgttttttgctgggcgagcagagaaaacccgacggagagctttttatgcgcggggcccgcgcggggacagccccgcgcngtccgcgaccaagcggaccacccccgagtctccacgcaggaattaaagagagagagagacaccacagaagggacccctccccctattcgactgcgcgattagataccagatcgccacacacaatatctacataggttttcaaagcgtagacttcaaacatgggtaggagagtgatatgcggtgtgccaccgagcacagattagaccgcaagtgacagaaaatgacgacaaaagacaaacaacacaataccacaaagaaaaaacaagcagagagagagggacgagaaccaaagatacacatgaattcagaatacacaaataagagatagagatagcagatgagaagattatacgagactatcgtgttgccgtacgcgcctagccgcgtgcgtggtgccaggaagcggcccggtgcacacgaaaataacataataacgatagataattaaaaacaatataaataagcaaaggacaaagaaatagactaaatgaaagatataagtacaaggttggcggacaagaccgtgaactgagcccacacattaataatagacaaatgcgactcgatacattagacgctccagacgtgatgagacaagaagccaagtataagccgtgcgccacgccgtgttaagccacatacgaagaaatatcccacagaatgagaaaagacaagtgagagaagaacacccagagacccgtaataaccaatattagcgcaagatacgaaagtcgtacacgatcataaacaaactcaacatataaacgcacccacgcataaacagccaggtactcgggtaatatagttaagtaccgatgcccgcctagcagcagacgcatttagccccacatatttttaaatccacgaacacacacaagacgaacaaaacaacgataccacagaaaccgcccgttcgcccgcggctttacgcaccgacgagtatgatcccgaggtatgcagagggagaaataacgcgcgattgaacctaatataaacgcacattcganacctaaataatgagacataaacaggaccagatattatacagtgtgaagacgaatacacacactaccggcgtcccgcactatttcggcagcgtgtcattgatcacgtngacgcgcacacgaattgaatgaatcgacggtaaggacgntattggtgtgtcggtagtgcgacgcgcntggtgaangcagttggctgagctgtgtaggtgatacgctgacagattcgttaatccgcccaccatgtattgagacccaccgagcaagacctatcactatcgagaacatcacacccacgcacgctatattatgatatatctacatgacgcncgcaatatcngattatgtatcanagtgtcccacacgaggccagcgaagcgccgataagcgtaggcgccacactgtatctgtatcgccgccagctattaggaagcgtactcccgcc

SEQ ID NO: 15882 - DNA, 789 bp, Homo sapiens
  misc_feature (1)...(789): n = A,T,C or G
ctgaaatggaaaaacaaatttaaaattcaaaggaaactacaaaggaccctggatagccaaaacaatcttgagcaagaacaaagttggaggtatcgttcttcctggttttttaaatcatctacagcatggtactggcataaagaccaatagaacagaatagacagtcgagcaataaacccatgaatatatgaacaactgatcttcagcaaaggtactaacaatacgcaatgaggaagggtaatctcttgaataaatgatgtttgaaaactagatatccacatgcaaaagaatgaaattggacccgcttgttatacaaaaatcaactcaaaatggactgaagacttatatttaagacccgaaacagtaaaattcctgcaagaaaacgtaagataacacttcttgacattggttttggcaatgatttcttagatgtgacaccaaaagcacaggtgacaaaagcaaaataaacaagtggggctatgtcaaatgaaaaagcttcttcacagcaaaagaaacaacagagtttgggctgtgcagagatagggttagaagttataacagtgaagagaaatggaaactcaaatccattttgatgggtaaattagtactgcttttcctgaagacaatttancactatacaaaacatattgattacacatatccaaaatacataaagaactctcacaattcaataacaaggaaacaaataacctaataaaaatcaagatctcaattaaaaaaaaaaagaggaaaaaagnaaaagngggttcgggcctcttggcctcagcg

SEQ ID NO: 15883 - DNA, 292 bp, Homo sapiens
aggctcgcagtcgaatggtaatgtaaacacagtcaatgaaacatcaggactggaaaacaagtctactgagaggacctatgggaagaacatttggtctattgccaagtatgcgataagaaataaacatttgccaagcagaactgcaaggtaaacacagagaaaacagaagagtgtggccctttaattctcgaacaaacattaaggcttaaaggaagaatatgaaaaaatatagactgtttctaaataataaaacatcattgtttctggacgatgatactttaaatctgcaaaa

SEQ ID NO: 15884 - DNA, 607 bp, Homo sapiens
atttacgtttgatttttattcaagtcatgggagctcatgacagatgaaatgcctagaaccatgcttagccaaatataggaaacactggaaaatattgagtaactggaagaataactgaattcctatgtttgcttcatgactctgacgctattcacctaggctttgcagatatcatttattactctgggggctgcaccatgaattttcctctgacccagtgttaaaaacctttgggattttcacagttgactgttctgtgagccatgttagggatgcatacgcattgtcttgcactagacataaatattaactcaaacacttttatgttatctttctatttcgggtatgcacggcctggcttgtcctgccttgttgggtgaagaactttgaggttctgttacatgttgcgatcttgggtaatgcgtgtggtaaactgtgtatgaagcctctgtgttgctatttctgctgcctaatgcctgtgctttctatcaggttattttgtatgcttccgtttggctcgtgtgttttctacatttatttgagtgtgttttctttcgtttttggtatcctactgcctcagtgtcttggttgttgttctgtgatagac

SEQ ID NO: 15885 - DNA, 688 bp, Homo sapiens
tgcttttctttatgaagaaaacaacttggaagactagtagatttttgaacatccataaatatttgctgagaaccctttacacaatgagcaaatggaacatacaaaaagaaagtacacatgatcctcctttgaattatctttttcactcttatcagcttcatcttatcaggagaaattaatatatgccgtatacttctgtggtcatcctcctccaggatggcctccagtgatctccacttcccggcattcgcacagtgtggcattccctcccacgttgcactggggttgatcgataagccactctagggaaagcagctgctgcgtcatgagcacgttcagcagcctgtagagaggcacatgtggcaggaagggaggcctctggacatcagccagcgaggaactggggcctgccaacaaccacgtgagcgagtttggaaatggattctccagccccagtcaagccttgatgggactgcagctgttgccaacagcttgactgctaccttgtgagagacagtgagccagagccacccagctaagctgctccctgttttctgcccctcagaaaccgggagagataataaacgtttgttgtttcaagctgctaaatctgggggtaattcgttcacagcaatagataactagaacacctttggtctactaggatcaaaattatctaggaaaacaa

SEQ ID NO: 15886 - DNA, 802 bp, Homo sapiens
ctgacacaatatgtgttattagatgtattgcacaataaagtgatgactattcagagcatgaagataccaagttaaggttgaaacccttgcttggttgaggatcacatgtcagacttggtatcaaatcttcacctctaagaacacaacaggactaaccccagtgacctctctgggcctcagtgtcttcctgtaagaataaaggtggtgaactgtttgatatcaaaggccctcacctgttacaaaaaagtaggacccttgacatattggcagcatgatctctcgaagatttttcacaatacactggaagggacacagtctaaataatggagggatgatggtggttgggaatatggtatttataatcttttaatcttttctccttcaaaagaatattgtagcttggaggcaatttatagtacttgcatacttcttcaattactcttgggatatcagcattcagtaacagtaaaaagattttttgtatacaaattaagatctgaatgtctgaccttttctctgatatgtgatatttgtcactttttccatagaagtgtttataataaaatggttcttataatttacatccaaaaaaaaaaatcggccttctttggccttagcggaggaactctgcggccggttccctttagagaggtggaataatgatcctcggtcactgacttgctgctgctcggtcgtgcggtgcaggtagccgtatcagtttactcaaaaggcgggtatacctggttatacccagaattcagtgggaatactcagtgtaatgaacttgtgaagcataatggca

SEQ ID NO: 15887 - DNA, 791 bp, Homo sapiens
tagatttctggaattccattaggacaactggatgccaaccagtttgaagacccccacagaggaaccgaatcagcatgagaatacagctgtttcttctccctgtcccatgacttcaccctgcactcttcaacccatcaacaattcaacacttcggcctcctccaacacccttgaaatccctagccccaaactcctcaaagatatgaattagaggttcctttccatctcctcatttggtgaccctgcgattaacctctttctccgctgcaacccagtgtcacagcctattgatttgtccctcacattgggcaacaaacctattacggttacaagtgaggtttctttttcttccccatcgtttcctactccttcaacttcctcaaagcaaaaagggcaatttattcctgggtgtttcataaaacacaagggcaggataaagcgggaaagaagttagggctagaatgttctctgtcccttgtttctgcctctttctttttccatctgctccatttttttttttttttttttttgagacggagtctcactctattgcccaggctggagtgcaatggcacaatctcggctcactgcaacctctgcctcctaggttcaggggattctcctgcctcagcctcccgagtagttgggattacaggcatgtgctgccacacctggctaatttttttttttttttaagtagagacggggtttcatcatgttggccaagcttgacttagaactcctgaccttgaccctcccaaagggctgggaatacatggctgagccccagca

SEQ ID NO: 15888 - DNA, 831 bp, Homo sapiens
gttccgtcttattggttttttattattccctcttctctataaatgcagattggaaactagcaggaagaagatgccagaaaaccctggcaaggctctgaccactgtctgcttaggaatggccgcagagggagagaaatgtgtttgcaattaggacgacccagagcaggtccgattacatctgcacgcagccacgctgtagagatttccagagtgaacttatcgtgtgggcctaagtggataaaaggcaacttaggctggagccattacaagaaaataaatggggcctcccgccttccactctcgagctgcccttgttgggctcactcttacctgttgaattaagaggtacataatcaccatgatttggggccctcttacattatagtttacaagattttcatgcatttttcaccagtggaccactaaaacgggaaataaaacaagtgttgtgaagtggtttccatgctgcatgctgactctgattttcggaatgatctgatgatgtttaagggatttgcatcaagacctttttacatgcccatggttatgctacttttatatttatggggacagtactgatattttgattcgaggctgtttacaaatccgcgttagactttcttgaatagtgcttggttggatattaggcttaaccgattttgaagacaatacattgatcttattcgtaataactctctgctggaagtgtattcttcctttggcacgtcgttcccgcacactatcactggcttcactattacgttcgacgtcttcgcagacaggacatagtaacaatgaaaaatactttgcacctcatttgttcttatttct

SEQ ID NO: 15889 - DNA, 784 bp, Homo sapiens
agccgaaaaaatggtcctcctgcttcatgtttaacaagatatgggcttttagttgttctactggctgctgtgatgaaaatttttagattcatggatatgctcattctttgtcccctgtgaaatgttcgctagcctcaaaattctgtaaagaatccacattttgtttggagaaaagttattggaacataaatcaattccattcaataatctgttaatgaatccctgctacaagccaagcaccagtgatttaagtgtgtatgaaacaaaatctttgttttctggagcacacagataaacaagaagaccaatacacagacacataaacaaataattaccatgtaatgttatccatacaacaagagtgttaacagaaaactggggaagagacatctagctttgtccaaggttatggtggatgacatcacaaaagaggaggggtttacagaaaatttcaaagatacagagttgttgaaaaggtggataaaggaagtgagaaagaaccacgaagaatagcatctcctgtaggggaagaatataaagaggagaggaggaggatgaattgttgacccagctgaagaaccatgggacagaatggctgacaagaagcttagaacagcagccaaacaccaagaccttggatgggagactgaaatgcacatttcctgtgctttgccctccagggtagacaaccttattatttgctacagaaacccaggtctggggttccaactttgctcctagatcttttatttggtgttccctggtttaccttgcatcaggtact

SEQ ID NO: 15890 - DNA, 875 bp, Homo sapiens
ctgaggctgggtctagtagtaagtttgatagtggcagtcaattttactgcatcgcaagtccagggtatcacagccttgacaacatgtgtatgaattcagatgctacaaggtttctgagcttgtactcttcacctttaccttgcctggacccagctttcaagtattctgcctcaagtcttctccacaacaagatgagagaaatccaacctaagataactaaaaatgactagacagggaaataactttatattggggactaatccatattttcagaaaagcgtggagaaatatcattcatgaactttaaataccgcttcatgccagagttcccaaatatcagtcagaattgggtcgtacctttgtatgcccatacatggatggtaatgattcacgtcttagcttaacttgttaatatgcacattccagggactcaatatgattctgtcttactcaggactagcgaagttagtaagtactatccagctctgagcccaccatgcttacgttgatgattagtttcagtgtcagtgatacggtagtatgtcagaataggtctacgcgtaggtctaggaactagccggattatggattattccatgctatacgttaccctgtcaacttgtggtatacattatcagaaattactacatttgttagcaaacgtgcaatggttctctatttaagatctgtcaatttagtcgacgtcgtgcatcgcatggacgacgtcaggttcttccatctataatagataataattatgtcagttcactcgctcggtgcaagttaaaacaatagagaataatggagtaggcaggttagaatttaatgatcatagctagaagccaaggaggcccattgatctattcaggcctgtt

SEQ ID NO: 15891 - DNA, 849 bp, Homo sapiens
aagattcttttctcacatataaagtttatataggtgatgtttttttattttctagaaaccaaccagcaagcctctgtagaagtatcaaggaattgaaacttaccagataactgcatctggacaataagacaccagatcccttgcctgtcataatggactatgttgcaggaagtcagggaacccgaacatagggaccaactgaagccatggcagaagaacataaattgtgaagatttgatggacatttattagttccccaaattaatacttttgtaatttcttacgtgtgtctttactgcaatctctgaacataagttgtgaagatttcatggacacttatcacttccccaatcaatacccttgtgatttcctatgcctgtctttaatctcttaattccttcatcttcttaaactgaggaggatgtatgttgccttgggaccctgtgatgattgcgtaaactgaacaaaatgattgtagagcgtgtgtgtttgaacaataataaatctgggcaccttagaaaaaagaacaggttaacagtattgttcagggataaagagagataaccttaaactttgactgccggagagtctggcagaacataacctttttttctatttcttcatatgcaaattgtaataaaaatttgcatgattctttctccccgatagcgaacatatcttattaaagagacttgtttctctttatggttagccctcatgaatagaactgtttctaatggagctggattccctatataggaaataacagcattgtacgtattaatctctgatgttattattagtactatatgtttattatgaatatgataatcccctaatatcagattg

SEQ ID NO: 15892 - DNA, 842 bp, Homo sapiens
acatatggtgatatctctctcgttggttgatataagtgatactcctaggcgtggacagcctagttctgaaattgctgcagtctggagtctagtatttgcgaacccaagagagccattgaaagggtcctttactcaaagctgcagaagaaggaaaataaaaaccccaaagttaagtatcaccatccagctggcacatgtgcttaggccacaactggctttggcaagtccccatcctcgaggcctccagtggctctgaaattctcaccacaagaaaatcatgggttttaagacacaagaattaaagaacacattaatgtaattttggtgcaggagcatttagagaaatgtgtgtttgtctttgaaggttggctaactttggaaattcttcagacctgtaatggggctatctgcctgggagttggttctactgttctctgagagaccgtaatttaaccatccccaaatggcatcatatatcctccccccttcccacttccccatacttagaaggagcaatctgtgcccaaatgtctttttttaaatttagaagatctctctgtttttaaactgatcacctttaagtcttaatcggtaaatcaaaccatgttcttaagaattcttggaggaaaaattaatattttgctacttgagactcatcggggggcctttttgggccgtattcctttaagtagggcatatgtttggaaatctgagttagttacgtactgaggtatatgtgatagatggtggaacgtgttttaatcacttattgttggttaagttgggtttccaagtactgggtgttttcctgatattaccgctgatcgaagtgcgagcttggg

SEQ ID NO: 15893 - DNA, 776 bp, Homo sapiens
tgttcctgctggcaaaaacgtggtaggtgatggagagagctagggaaaatatcttggaccaagacatggcaccataaggacgctgaaggcacaagaaaggaggctgagggtgtgattattctggagcctggacaacctacttacagtgggagtggaagggaagtaaatgtctgtcattgcagaattactgacatttggggttttctgttacaggcagcccaacataatcctaactgatacaccctaacagattataaactttaaaaagctgggagagaatttattttgttcaccattatagccctagtatctagaacagatcttggcacgtagtaggaactcaatacatacttcttgagttaacactgaatagatgtttaggtctggtacaattagaattgatgatgccagcttcacataaatagttgttataaatccttaatcttttgggaacttcatttgctaaattctagggctcaaatgtctcaaaggtaatttctcatgtgtgtgctcctcatgttgtttattttcaagcctaatgaacttcatattttctttgcaaaatgtcctgcttgtcattggcattttagtgttgggtggctcttatatttatctcaccatttgcaaactctgtcctttcaaaatgggtctaggttacgttttttggaagacagatctgtttcctaaaatttacattgttttgatgacccttgcaattaaaaaatgaacgggtatttaatgatgagaggagatttatttttccagttatggaaaca

SEQ ID NO: 15894 - DNA, 382 bp, Homo sapiens
tttgttgcctatgctggtctggaactcctggcctcaagcaatcctcccacctcggcctcccaaagtgctgggattacagatagttctgaagaaataagcagccaggataggaagccaatctatcaagaagctaaagacacctctaagagctgaaagccaccaagaagccaggactctaagtcccacaaccacaaggaaatgagttctatcaccaacctgagtgagcttgaaagcaccttcttccccagttgagcctccagattagaacacagtcaagctaatcccttgatggcagccctgtgagaccctaagaagaggacccagttaatctgtgcccagactcttgtgagataataaatgcatgttttcttttaagtcaaaa

SEQ ID NO: 15895 - DNA, 206 bp, Homo sapiens
cgcccgactcctcaattatatctgtagtttgttttttgttctttctagtgctatccaactggtacgtctaatctttatgtaatttcttggagaagaaacacctatcagttggagagtgtgtaaccactgcagaggaactcctacgctggaatacaagcataggccaaaacctttcttgctcagtaaaactcaatgtagttagaaaa

SEQ ID NO: 15896 - DNA, 814 bp, Homo sapiens
  misc_feature (1)...(814): n = A,T,C or G
cccccgcccttagcctgttctcttcgagattttttatgataaaaaaaggattttctggtntgtacctcagtcgtgatctcacaactgatctcgcccctttctggaaacttctaacttcttctgttcgtaagtctgcatgtttctcccttcaagatcacatccagtggatgcccagtggtggaaagaaaaccacatctacgtactggctgaccagccatatccttccaaacagagactctggaatgtgtcttgcctgtgattccacatatatgcatccaacatttttgttgttttcagctttcctgccaggataagagagaagaaataaccagagggaaaggcagcaaagagaaataaggaaaggtttacatccattctagctgaactgcagaactctctcagggaaatcacatgtaaacatataaggaatcacttaaaagtgacaaatctgtttactttgaaatatgctaatggtgtattttcagtgacaataaataaacttggaaattaaaaatggaaattagttaccagtgacaaatttttagatcaatgacttgattttgggatcacaaaattcgaaagtctcaggtttagctttaaccacacgcattcggatttttgtttttttttgttctcgtccaaattgagggtgactctatttggccaagctggatctacataggccaattatcatgttcagtagaagaataaataagcgaggattcagagtgattgtggggcttttacctgccgaggaggttggtattcaggggtcctgccattttcccacttctctgagcctaactaccggcat

SEQ ID NO: 15897 - DNA, 792 bp, Homo sapiens
atgttatcatttggagctagaattttcttcacactgtgatgatcaactgtgaaggtcagagatggctgaggcagggaagtcatgcattttttccgtcttatgtcttaaagaatttgtttttttcttcctgggatagaaggagtaattaattgtttgggctttccttcagggttctcatctgaatggaggagctagcagcatttaagatgtgaattcaccatcagttatgaagagttgggcttaaatgtctcagtccgcactttaggggagtagttaagaagccctgagacgtgttcagtgtgtacaaggtgaccatacagtgtagttgtatatgcctgttgtccttgtgttattattaacagcattctctttccttcccacaagcgtctcaattaggacagtaagttatatggttaccctaaataggatctgtgtaagcccatcctcgggtgagaagtcttagactagaaacaaggcaaatatccattagtgggagaatgggtaaataaatagtggtatattcctaaatcgaatactattacataacaatgaaaatgaatgaagtataattatgtgtgtaaacatggataaaactaaacaaatgctgaatgaaaaagcaagttacagaagaatacctgctctatttttttatggacattagatttaatatagcacaattagatgggttaattgcttagggatacatatatatgggacgaggagagattaaagagaagccaaggagggcgggcacagtggctcattcctattatctcagcctttgagaggcgg

SEQ ID NO: 15898 - DNA, 841 bp, Homo sapiens
  misc_feature (1)...(841): n = A,T,C or G
gatgctgtctgaacagacaatttgtcctttttttcattaantnctccagctctgtcacttggtaggatgcaccggtgaagctatctggtcctgcgcttttctttgtggtcataaggctccgatccctgctgagaggaccctgctccacacccagaaggaaagaaagcatgctcacagagaccacaaaaaacctaaacagacactgggtttccccactcttttttcttttttcttttttttttttgaagtggagtttcattcttgtctcccaggctggagtgcagtggcgcaatctcagctcactgcaacctccacttccctggttccagtgattcttgtgcctcagctacccaagtagctgggattacaggcgtgtatcaccacacctggctaatttttgtgttagtagagacaggttttgctgtgttggccaggctggtcttgaacttttggcctcaagtgatccacctgtctcaacctcccaaagtgctggaattataggcatgaaccactgcgcctggccttctatatttaaaaacattaatattttaatgttgcttttgggattaaaattaataacattttatttctaatttttatttacatcaccttgtattttaaggcgtctaaaaacttggtgctatatgttttggtctttccctggtccttagacctggtaaaggcaaacgcctaatttttgcacatagagtatgcctttcacatcgtgtaaatgattgcacgattttgttatattgctggtttttatcacataataatacattattgctacaatgtataaaatagacggttccttttggtcttctggtgaactatacatcat

SEQ ID NO: 15899 - DNA, 764 bp, Homo sapiens
ttccccagtcacttcctatcccaggactcttctagtgatgaagattatgaaaattcagactctccctgccataagtaaaactggctggtattttatcttcaaagagaaagccttaaaagaggcattcaagaaaatcctctttaggaaaaggagatggggatgtttttggtgaaagcaaggtacttctccagcagcaaaaatgggagctgcccgaccaccttattctgctgttgagatgtcagcatcatctctgttatctgccagcaccactcatccaggttacgggcagagtggactgcacctgagaacaatgcacacctaaagaggcggggcctgccttctgcttacaatggctccctgggcaggtagttgggattgtggccaccctcatccctttcccgctagaacacagaaagcatggataaaaaagacaatgaaggcacgtcccagaaaacacagagtagctagccggctgctggaggctcagcttagggaggcggtcagagaaaacagtggaagcccaagtgaaaccaggatttccatgcaaggctgtctgggtaaaaccacctggccagcattataaccgaaccaaacaagaacacagctaacgtgaacctgggctccactccagaccatttaaaaagattttccgaagtaggacctggcctaggagtttttgccgataattcctaactcgatttctgttggctgaactgctcggtgatcccattaaaatgctgggagcccacacccggttgcgtttt

SEQ ID NO: 15900 - DNA, 246 bp, Homo sapiens
tgctccagctcagctcaaagtggaagagtcaggattcaaacccaagactgtctgactcatgaaggggagtgtcagggttgtgccacagcctttgggcaagtccaggattcccagccgacttggacatagtgccttgggaaggctctggttgcctctgaatttgggagaaggacacagtctgggttactgccctgcataaaaccttcatgacaccagaataaagcctagtggtttttcatgatctca

SEQ ID NO: 15901 - DNA, 814 bp, Homo sapiens
  misc_feature (1)...(814): n = A,T,C or G
tactttttttcatattcgtagttttatatttcttaagnaaaattattactagggttgcgctgttcctcccgcctcagtctccctaagtgctgagatgttgcaggaagtcagggaccccgaacagagagatcggctggagccgtggcagaggaacataaattttgaagatttcattttaatatggacacttatcagttcccaaataatacttttataattttttatgcctgtctttgctttaatctcttaatcctgttatcttcataagctaaggatgtacgtcacctcaggaccactgtgataattgtgttaactgtacagattgattgcaaaacatgtgtgtttggacaatatgaaatcagtgcaccttgaaaaagagctgaataacagtaatttttagggaacaagggaagacatctataaggtttgactgcctgcggtgtcaggcaaagggagccatattttttttttttgcagagagcctattaatagacctgcgagtaggagagatattgctaatttcttttgctagcatggaatattactattaagcccttgagaaaggaatgcatttatggggggagggtcataattggctcgttttgggattgtttatccttcgcaacggaaataaggactgagatacgctctagtatcttgtaatacccttagggtgtctagggtgggaaaaacttcgttctggtgaaatattagaaataagaattattggtattggagactgggtctcagtggtattattttttaatgaagctggttgcttggttattatgctttctctcgattctcctccggc

SEQ ID NO: 15902 - DNA, 850 bp, Homo sapiens
attcccttcttacagcgtgaggccaccaggtgactggtaaattaattctactttagtctgttaagtgcaacttgcccagcaaagtaaaaaaagaggaaaggagacaaatgaaaagctcaaatttggtcaagatccctatttgccatttaaacacaacattagaaaactcttgctaggactacattttgaaataaacctcatgttggaggtcagttctgctaagaaataccactgaaagctgccacttgacccggaattcctctacaagaaaaactagccataactacatgagaggcctatatgagaaactgccagaatgtcaacttcatttgcagtggccccatatggcctgatcactctccctggcatgataaatcactggcagaattcttaccttcctacgttggatctctgctcaacaagaagtggttttgatgtgaagaactccaaatctttttaggtcatagacaaatagcagaggcactgacctgcaaagagctaaggctctattatactcaggtgaaaagttgaaagcttgtgacaagttccctttccaccacccttcctaacccttcatgaattaatgaactaaacttgcctggaaaacttgttaatttgttctgaagcagatttgaccacaatatatagtctgcctagtactaatatcacgcgattaaatttatattttatactatacttcgaagagtgaattgtattaggatgctactattttaatttttaattattgttatgtagttaaccaatgtagaaatatgttaaattcccgctgactattttccgagtcggataggctctaatttattaactcgcaccattgacacaggttagt

SEQ ID NO: 15903 - DNA, 834 bp, Homo sapiens
gtatgatttgtttttattgtaatatgtaagggttacaagcctagtggtgtttctcccttgttacctgggctagagtgcaatggcacaatttcggctcactgaaatactccgcctccgcggtgtccaagcggattactcctgacctcaggcctccttgagtagactgggattacaggcacccaccaccactccaggctaatttttttgcattattagtagagatggggtttcactcttgtggccatgctggtcttgaacccctgacctaaagtgatctgaccgccttggctgcccaaaatgctgtgattacaggtgagagccaccatgccaggcctttatagatgttaagacagaataattgcctttcatctatatgactaatatggttgatttactccatcgattatcaatcgcaaccttcccattttaaaagatcatattatgttaattgcataacaattagacagttaagctatgggagcttaaagattcatgggccttacttacattgtctcatttcaaagatcctgggaagtaccctatcgggatgttcacaatctgaatataattgtataatatttggagactgtgtgcttaatttggttaatatgtgtgcacacctgatgcattcctctttaaatgcttgccgtgtagacgcgccattgtcttgtcgaaatatgagaggaaattttccgatttatgatgttttgtttgataggggtaattataatataacttgtggttccctttgtagtatcatagatatgtgtattatatatattcaatttcggtgtaaggatttcattcaccctccccggtagatactccagtgct

SEQ ID NO: 15904 - DNA, 798 bp, Homo sapiens
acctttgtctaatctttgattgtttgatgttgtatgtttatttgtatttcagttgcagtccatggcgggttcttggctcactgcaacctccgcttcctgggttcaagcgattcttctgcctcagcctccggagtagctgagactacaggaatgtgccaccacacccggctaattctgtatttttagtagagatgggggtttctccatgttgatttggctggtctcaatctcccgacctcaggtgatccacccacctcggcctcccaaagtgccaggattacaggcgtgagccaccacgcccggctgttcactcatttttaatgcctataaactctattacataaacatgccacatattatttattcagaaaccttcagtaaacaccagccttacactgaaacatgaaccatttaaatcagaaatgagaaaaaaaaaatttggtctttgttggcctcaatggaggatctatttaggacgttttcctttattgagggttaatatatgatcctcgctcaatgacttgttttacttagtcgttttagatagcagtgaagttattagcttactcaaaggttgtaatactgttatccactgcaattcgggattacagcttatatatcatgtgtgctaatggtcttctaacgtccattaactgtctagtggccctgtatgttgttgttttatgatatgtttcagactttttatatgtgtttcaattttttcttttatgttttggatgctagaccgtaagacttttttgtattctgatttaacactgtaaattaatagtggctgac

SEQ ID NO: 15905 - DNA, 1212 bp, Homo sapiens
  misc_feature (1)...(1212): n = A,T,C or G
actccctgaccctctcctcaataaaacatcgtaatcacctaatcaccaccatcgactacacanatacaacatgttaagagtngtgatcgcgcancatatngcgacacatatctccatctgatcatgtctaggtcaatagtagtaaccgtgtgctagtaatcatactacagtatggtagtctagtacagtacaacgtacgatctagcatgatagatagccatcacgcattgaccacgctggaggcacacttcagcttgcgcactacgccaggtgatgcatattgtgatcaacctcgttgtcgagtcaacacacaaangcagagtattctcgcctcaagcacctgaggcatcttgacatctcgaatacataacacatcttgatatctactaatacactaacatgaatacgggtgctcgacttagtaaccacatcttttactctagacgcacttcgatgacatatactgtatctgatgttaatttgacacataatatttgagttggattccgtacgtccaccgtccctctcacctggcgatcgctgagtgcgctcgagttcgagcatcttcctcgtcatatcaccccaggtactttttctcccctcgcttgtgcatacgacgccctccaccacctacatttatagttttccacggcatgtcatatcccatcaattcgtccttgcgattcccctactccctattacttaactcccacatcactagtgcgtgtatcatctacacatatttattcactcgccactacttgataatcgaatcaccgcatataccgctactctacgtgcacagtccgcaccaccacaccccctcccgctctattaccatcacaattcagcgataatgtaatagttataatgtcatatatcgctacactcgaactgcatagaataataaatagtctatagctaatacatcctctgtatgctatgttaaagttacacatcataataacccatcatccacacgctctatcatacctcgaaagtcttccctctgtgccgcgacaacactaaataatttaaactctagctaacaatcaaatgtcttcttcttctccattaatataacttaccagttatctatcatcattagaccccacataccttatatgctgtgtctattctaccgatcgccttattaacacttatactagatcatcaaccagctatattgtgtatagatccgaaccgccagcg

SEQ ID NO: 15906 - DNA, 738 bp, Homo sapiens
agccgggggttaacccccccagagggaagggccccgtgaggcccaagcaagaaggtggccgttttcaaacccaaagaggcccccaaagaagcccaacccgctgataccttgggctttccagcccccagatttgtgagaaataaacaactgttgttttaagtccccccgtctatgatattttgttataacagccccagccaactaaaactaggaaattcacccttctaaggttttgggcattgaaaagcataaaaatttcagcccccatattttcccagaagcggccttttttgttttcattcagaggagcttttttcaacaaatatttcataagaacaacttcataaaataaaatgtctctatttatgattccccaaaattatggggttccccaatttcgtttttttcccggccagaacataaatttttttaattaaaaatagggggttcagcaaaagacttatcctgcaagttgaaatattttaaaatgccattccagaatttcccccttaatattgtatactatttgaggggttattgtttaatttgttcaggaccccctggggttatgaaaggataaatttcaagtttttttgttgcaaaagatttttcccaaaaccgccttttgggatttcatttgccaaaaactttgattaaaacttttttttagcctaaaaaaaaaaaaaaaaaaaaaaaaaaaaagaaaaaaaaaaaaaaaaaaaaaaaaaaaaaaaaaaa

SEQ ID NO: 15907 - DNA, 841 bp, Homo sapiens
  misc_feature (1)...(841): n = A,T,C or G
accgtaagatctcgtgtcacaaatcaaaaaacaggcgccnncggttatcaccaacannatgaagagtgactgattgcatgctgttgctgatgacggtcgcttcaccaggactggctcaggatgttgtcgcctactgtggcagagcatgcgtcttcatccacatcacaaatacataggtgctgctacagatcttgctttcagaaggacattccttgtgatagaagcttgaggtggggaaattagaccgtgatgaagaggctgtaagtttgtccttgaaatgagttttacaaagcaacatgtttctcccagcatatttcggccaatgtcgtttcatgaataccgtgtgcattagttcctacccaggcaattgctctttgaacactgtcccatcttggttactaatgactttctcaaggaaaactagtacagtcagatgctatttacattttttaaatcacacaatgtaactatcggatgtggttgttaatacttttaaatcgcctgaatgttcataatcggacatatccgccccttaatttacattccagacaatgcttccacctttatacacataaatcatcgcctacacatttagctgacttgcgactgaaatccctcgaatcatccactcttgatagaaggtaaaacgttccttcccgaatacatttcgtaagattatactacgggaatatagtgattaagagttccaacattttaaaattcctctatttcctggcccaatcttcaagcatgctaccgtgaagatcgtagcagatatcctcctatcgtaaacctctaaaccattagattcccgcgcggtactctttatctcctactcgag

SEQ ID NO: 15908 - DNA, 735 bp, Homo sapiens
ctaaacagttcttgcaaataaggtcttgaatgttttaacttctaggaatgctttaaacacttggggccttaagccacattatgccaggctttttaaatagtttgtatgaggaaatgtgatttatgaacaaactcatttcctttggggacctggatcttcagcaactgtagtcagtcctacggatactatatccctatgtaaccaacccacaatgaaaattgtgaacttataggcttagacaagtctctgtaatagacaaaactttacatgcaccttcacaatttattcttggaagaattaagtgcatcttatgtgtattaagtgtattttctagtgactccactagaagaatatccttagaagcttgtgcctgattttctccaaacgttacccatacaccttttctcttcactgatttttcttgggaccctttactataataaaccacaatcatgagtataatgacttctaagtcctaaaagctcgtctaataaaatcaccaaaacaggagtggtcttggggacctccaaaacactttgcttctagagtaagtttttactgctataaatttccctctcaggactgctttagatgcatcccatatgttttgacacattattgtttcaatttaatttggttttgtatatgtattaaatgtcctttgagatttcctttttgaccaataaagtatttagaagtatgttgcttaattcccacaaaaaaaaaaaaaaaaaa

SEQ ID NO: 15909 - DNA, 739 bp, Homo sapiens
cacaaatacagttcacctcagccttgactttcccagactcaagcgatcctccctgctcagcccctgcaagtagctgggactacaggcacatgcaactacaccccgctaattttcgtattttttatacagacagggttttgccataatccaagctggaacactataatccattttaatgcaacaattaacctggtaatatagtgcctacttttgcctatcagtaaccatcaaaatctggattcaattgatatttatgtaggatatattgaatcatattataatattattttggtttatcctgtgagtttgttgttttcattccaatttacagattttaaaactgaggctcaaagggataacgtaatgtgtaattcagtattaacatttgtgccaactccattagtagaatatgagagcttaatgcgttgtactactgattcttaatttgatattcagttatattcctgcgtacatttttttgtgtgtattcatctacaatataataagtatatgtgttcatacacttgcacacacacatatactacatttttctaaagcttgatatcttggagctaccaataaatatttgtgagtggtcacatttataaatcaaaaccctggtagaagttttatgccgatttgtcaaatgactataaaaataagacttggtttaagatctcaagtctggttacttgtcaattgatctgaatgacaattttatagcatttcacccctcatg

SEQ ID NO: 15910 - DNA, 746 bp, Homo sapiens
atcgcacatagaatggcccctccaccatggttatcttgcttatccaaacaattttgcagctgtttaaggctgtatagctacaaaagcacttttaaatgttatgttttttcatcctcacagtagacatttgaggtagaaaaggcagggattagatctccatttcacagttgagaaaccaagggtaagggatttgcacatggttatgaggctggtgtactgtggagctggaacagagcccaagccttttcaaatcaatttatcccataaagatcttactacctatagtgctgtgtattaaactggaactaggctcagaggaaatttaccatctattcctgagcattgtattcacccaattttatgaccagccttaaagatgccccgtaaagtgctttcgcttaatgcttatgagcttaggtactgcagtcagcctgccccagcttcgccacttaatctctgtaagcttcagtttgctcagctctaaaacggagatgataagtatacttaccttctaggctctttgttaagattgggccagactatatagcaaggatttagcatagtgcctccataaatactagcgattatcccattactcctttgtaatctttggacctttttatccctgccttgtaaatcatagccattgttttgaaacttcattggtttaactcttacatttttaagttacttttattctactctacatataataaaatgtacccaccagaaaaaaaaaaaaaaaa

SEQ ID NO: 15911 - DNA, 834 bp, Homo sapiens
caactaatgcaattaacagtaactcttccaaccccaaccaatgttgagtgggaatgaatacataatctatcctgaaacctgggggatctctggacggatggacatgctccacatttcttgaaacgtgagccagaccaaaaagcgttcctactgagtataggcctgcatgctccgagaactggggatctttggttgcacagccatgcatggaggacaagtcccacatcaccatgtgttactaacctgaaaactgaatggagttttacacgtgaaaacctcaatttctatagacctcctcttgtcctttcatatcaaatattttaaagatcgccacagcccccaccgaacacttgcgacctaggccctagaccccctttacaatgccccgccaccgtaaactcatctccaatgttgcattagcctttattcttaccgcattgcagcacacaacctgtcaccgtgcattctcactatcatgcatatacacactttttcttcgccacgatttaaacatataaatccagattcctccatattatttccctctgctccttattagtgactttcgggcaccatataatagaatatacgcgacgtgggcaggcataaatatctactatatgtctcatccataaaataacatgaccacaacctcctcccccagtaaatatccttccactcactgtcccaactaaattaatactccttccttctacacaataattccacacataagcatttaaacattctattttccccgccttcacattcatcaaagcatcgtccatccattaatatacactaaatcatcacctacgcaaaactcagagcgga

SEQ ID NO: 15912 - DNA, 739 bp, Homo sapiens
acccacatgttggcaaaatatattttatttgttcatacaaagaaatagtatgaatttccagaatttcactttgcctagaaacatctttctctgtgtaaaaataatttgtgttatacataggacgaaatacttgatttaattttttgtacatattggctatcctaacatccaagttatcgaagacatactgctagaatttgcacagtattttagattacttggttgaatgagactcagtgataaattaatgtcacaaaagtgagaaaacatctaaccacacctttaagttttattggccatcctcttgataagctgaaaagtcacattagcttctgtgtcagcatcttagatacgtactgtttctagtttattggaatcttccatcttccttttttacaaaaatatcctggcaggatctgaaactgtttctccaaatgtctaaaatatatctgtcacacaaaatgacccccaaagagaatcctgggaagaaaacaatttctcctcctccatcatccaattaagtatttattaaacagtcactatacttaaaatacctttccaggtaccacctactaagttaacagactactgttcaaacaccgcaaagaaagcatgaactagatagaaacaagaaaaacctcaattttttttgttgacctttttgtttgtttttacatgagaaaagaaacaaaactgaggaaaaaaaataaagtactccaatgaaaaaaaaaaaaaaaaa

SEQ ID NO: 15913 - DNA, 833 bp, Homo sapiens
gacgctataacattatctggctcgcatccaccccctcaaaccacactttacagcaactgctgtgttgtttgcttccctgtgcgagaggacatgtaacaaggaaactgaaggcagcctccagccaacatctagtaaaaaactgagaatcttagtctgtcatcctagaaagcactgaatactgccaaaaaccatagaacagagatgaccacatgaccaggaatgttagtaaacattttctcctctacgtggatgaaaacctgccttcagtagaagagattgagacaggccgctgtgagagagagcatgaggacatcgcctgagctactggattcatctgtccctgaaggtggcctgtgccccatacttccatgcccgcaaatcccggtatatccctcagcttccattcgcccacacccattctcgttgcgccagtgtctcttacagagccccgcctcccgtaggactttctcggaccaggctttcgtatgtctccatgcgtgcggggtctgatcgccgttaccctcaaatgtctctgacaaatgcatccctctttcccttctccgcagatctggtctcgattattcaagtattctatctgcgcttggttatatatcccgcttaatacgcgccggcatatatggaccaatttccgccatggcgccgtaatcattattgtaaatgccgcgcgggctgcggcccggcgtatgcgcatcacttccttcgccccgtgaaatctgtcgttctccaccctattccctataaatgactgcaccactacagtgctcggacatgcaatttgaaacgccgactgcattactaatagacaaatcact

SEQ ID NO: 15914 - DNA, 795 bp, Homo sapiens
caggatactttgtgtgtttcttttcctgttatatccgacgcatcaacgacgttgactctgatctcaccattgtgtaagtgaacgcctccctatactcatgactcccctctaagtagatgtgttacactctttatatacatgtggaaagcagactactctgttttgctgcttactactttagactacacaagtcgttacgtctcactttgtatgttacaactcgctagaccagtttgcaccctgtaatctctcttattaacgttctttaaaatacagaaaaaacaagtgttggcaccgatcacagaggttatttcatgtacacagatagatagaaatctgcaggtgctagctaatggtaatttttcgacgtgacatacaagatatgagcagccgtccgtatacatcgccttaaagcctcaatcgttgttacagcagttgttcccaaaccaccttttcttttcatgtatttctggtggtctccttccatgtggtaaacttgaatcataagtataatcgattgtgagtcttaaaaggtggtcgtggtgggtctccaagtcacgattggtcttgggagcctccagcatcactaatgaatgataaagataagttatttaataattatgtaatttgcctctcaaggcggctttagatgcatcccatgtgttttgacaacattattgtttcaaattaatttggttttgtataggtagtatatgtcctttgaaatttcctttgtgtccagataaagtatttagaagaaaattgcttaactcccacaataaaaaaaaaaaaaaa

SEQ ID NO: 15915 - DNA, 217 bp, Homo sapiens
ataggctcgatgtaataagagctctgttataggtccgacacggaaagtaaaaataattcatatgtcttcaggcacctatgaagggattcccagaaggtttgtcaccagaggaatttctcgcctctagaattgatggaaaccacgtgccctcccggttggagtgtcatgttgatgtcccctatgttccttttgagtaaagggaaacatcttttcacac

SEQ ID NO: 15916 - DNA, 819 bp, Homo sapiens
ctaggaaaggcaacaaatgatcaggtagattgggggcttacccagtgagcgaagctttggcaaaaaggtaatgccgtgcagcacaatgcaagaggaggccatggactccctgcaaaacctcaacttcaagcctaaaacagcctgaaggttgaaaaactggactgctggctccagatgaagtccaccctttcccaactgattctttctgaataatgcccacctgcacacacagaggatggggtggggccatgcaagctccctgctgggaacccagcctcttgagctcctatgtggaggggcaggagccagctcacacgcttccctctcactctgctgagagcttttctcttttccttttccttgccccacacattccatttttctccacccaccccagcccctactaccctcctgccgtctgtctactactctcccccccgttccctcctctcacatttccgtgtctcgccctattcgttcctacacttcgccgactctataatcatcattccggcctcctcccctcaacgcctctccccgacacattttgataaatcgttacgttcaaattctataatcttcgctcacctacagcagccaatgtttactcgataaattatcctgtccccccacatataaacacaaagacagtaaacctcgcctcatttaaatactgcaggcatttctcatatctgttacgcctctacttctcgctctcacacgtataatcaatcacgatatcctatatcttctccacactgagccttaaccagcctttaatattatattcccaccctctatattattccgcccttcagt

SEQ ID NO: 15917 - DNA, 569 bp, Homo sapiens
tgagaatctctgcctcaggcctttaaataggctcaggcttaaagacacctctgtgttatattttgtaaacttcatataatagtggttggcatttttcaaattttttgctcaagcatcctcaagagaatttcgaaaaattatatatctctcttatacatagcggacattaagtacatactaagttgacatctataatttttcatcatgagtctaactatttctaaacaaaagaatacagttttgtgtttgcgaataatgatagtttaaaccattaccacaccctttcaaatgtgtctacttaggaatatatacagatttgtgattaaaattacttccatacggaatttaataataactcaagtgagcttgtcaagaaagttaagaaatttatctttggaactcctattggcattttattacccacataggaagtcgtatgctaaagaagtactattgactgcttgagcatccattgcggcttcatttattggatgtgcagcaaaaaaaaaagcaaggactgggcggaccagcggaggatttttgagccctttcctttaaggggggaaagt

SEQ ID NO: 15918 - DNA, 724 bp, Homo sapiens
atagtgaatttcaggatttataattgactttttaaatggtcggatgtgggagaaataaatctggttagatctttataggaaccgtaggatgtaaggagtgtcatcctaataggaatgttttgttgggtggtataaatgttaattttaaaacatgatcctgcccaaggaaaggaaagaatggtatagatgcaggcagactgaagcaacagagcaacacatttccataagtaataatctatcatagatatattggttctgataggagtccagatagacgcctgaaaagattgaatcaaattgggccagtttaaagtggggagtgggtatcactgcaagttggactagatcattatggttgatgacaagttactgttattttgactgagaatatcattatgtaatatattacttaaattgttgagccttttatttaactttcatcagttgcaaacttggggggtagttatgcttgtttttggtcattgctaaaactcttactgtttctctgggaaccacattctctgtgctttttcgccttccctgttctgcctccccttttcttgaagtgtttcttttgtttgtctccattacaccagcacgcagggacacagtgtttctgcacagtgggagttggcaatctccgaagagcctttcagcattgctttttagaatgaaatcattacaatctacaatagctacttggatttaaaaaaaaaaaaaaaaa

SEQ ID NO: 15919 - DNA, 901 bp, Homo sapiens
acgtcactcccgctcaatatatctcgtgctgaacaccccccaaaacacactttatgggtcctcggttgtgtcttcaggacatcgttgcctgccccatcaccatcaaaggagcctctcagctgcagtggtggatccagcccatccagtggtccacctgggaggtctcagccaagctatctcaacacactcctctgcttggaatcggtactatgtattgtctttgctttaggttgcagggccggaactgagcctattaatgttatatcaacactgtattcccaaccctaataaagctaatacgcgcactaataacctgtagttacagcaattaagatgtcctactgctgcctccacttgccgctagctcctatccccaactccccattggtatctcccatacaatcgcccccccccctttgcctattcacctcctttcccccactagactcggtccgccctgtgcacaataattctacccaacctctcgaatgacccccattatatccacgcctcccagcaatcatttaccgtacgcccgtcagcatcaaacttatgtcttccaccgcccttaactctccaaccccgcagtacgataataacacatacatcataaactccttcccactacatataatctcgctctccatccgcctctacctcgcaaactactaatataatacatcgacctaccgccccgatttaaatcatctaattttcgcgtcgcggcactcccatctcacttccttactctccccttctctccttctccgcgctccttcactttgcactctacacaccgctccacgcccgcacactaattgagtcctactcttaccgaccgcaactactcatgatgctacaacacacgctgtcaccaaccgtatcactctactacccatta

SEQ ID NO: 15920 - DNA, 749 bp, Homo sapiens
ctgatagtgagtattggtggtgaatatatttcatttatgacgccaacagcatatcgaatctgggctggtgttgacgacgtggagtgtgatcttttctctagatgtgagcaccggagaaggaagataaagaatgagtaaaagggatggggaggaatggaacagagcaacgggagtagtgagagaggaggcagtaaggaatgtggcgagagagggggtgaaggtgggaggtaaaaagaaaaaaactgagagtgggggaacggagatggatgttatgcgtaatcaggaaatgacggataaggacggtaaaccaggataaaaggtgtggtagggcacaacgttataagaagaaatcggtgcttcattgagagtggtgtgggacggtttatcggggtacgggttcatgaatggaggtataatccagcaacaaatcgacaacagggtaatggcagactgaaagaggtcagcgttgtaaaatctgtaaaatgtcccagatattttcaatgtgtttcaaatatttctttaataatatcgaataatataggtataatttgggagataatgtgttaacaaggatgacaattattaattcataatatatactaatccatatcacttatcattcttcattaacatgtgctactttcttctcggttataaaaacaatcttccctatgtaaatgtagtacacatatggcaatgttaataaatgaacaattgcagagtgctaaaccaaaaaaaaaaaaaaaaaa

SEQ ID NO: 15921 - DNA, 784 bp, Homo sapiens
tggcgtagtggccagagctccagcaaccatcttggacaatgaaaaaaccttcacaatgatagccatggcgaaacacagtggagtaggaagataaaagagactgagaaccggataaccacggagttccataccagctctcctgatacctttcataaaagagtgaaatgagcatttacctttttgttttgcttcattattatttggctgggttttcttttaagttaccaatagtctatttttacttgtactttagcagcttttatgtattaatataccattgaatgcatgtaaatcttcatataagtcataaactatgtaagattagataacacagtagaccccaccccaatttacaggagctattttacaagaccctctatggatgcctgaaactgtacatagtaccaaaccctatatatactatgtctcttcctatacatacatacttatgataaagtttaatttataaattaggcacagtactcttgtgctttagggccattattaagtaaaggaagagttacttgagcacagggatacaatactgcaacaattgatctgataaccaagatagctactaagtgataatggacaatgccagacagagggaagttaagcctcaggagggacagcatgggccattgcaagatttcatcatgctgcttagaatgatgcacaatttaagatggatgcattggttacttctagaattttcatttaatattgccagaccacagtttactttgggtaacttgaactgtggataaaaaactgtggctaaggg

SEQ ID NO: 15922 - DNA, 714 bp, Homo sapiens
cacaaggaagccataattaagagttaagtatttaagacccacaacttacctttacacccaagtcacgtgttgtgttctctggccaaaatatttgattggaagggaagaagcctagagcaaaaaatgttctgatggaaaaggcaaattaatccgcagaagaaatataatggaatatgattgatcaatggagataaccattattttagaagataagggaatctaaggaatatccctctccggcctcattctatcatgcttcctaaataccaattagataaaacataaatgatccaggacttcccctacttacatccttggtcggatggcctagggaagactgtttagagttgaatgatacttttatcctacttcagccagagtttggccttaatgaaaaagcttatataatccctaggatttattatgtacttagtaggcctagttatgtgatgctgaacaaattctttaacactgatactttaaattgcccctctattaaaactagtagcaacgtctgttctactatgacatggagttattttgatgtggaaatgagatggtctaatttttgataagtctgaagtatgaaaataagtagtattaattgctagctattctttaaataatatctttcttaaaagtcaactttctctgaagtttacaagcatgacaagcagaagacacaaattctgtgagaaaaaaaaaaaaaaaaaa

SEQ ID NO: 15923 - DNA, 867 bp, Homo sapiens
ccatttctattcataacacgcactttcccccacccccgcccacctttgagctgaacaacagcatgcgctccagtgatctgattctggtgagggcttcagactgcttctgctcatggatggaagtgccttaatatgtatgcctcatctctccgaagtggtggaccctgtttacctgctctggagaatggctgcctgtggcagacacaggagttgctctcacactgtgcttcctgtattccatagtaactgagttgtaactgcgatgcacctactattccaggaatacgcatctcagccccacaccttgcacctacaactaagcgtggtcatgttctcatcaacaaagtgcgaacatcttcaatgtgcaccaccttcccgttgatgcttccaataaccacgggctcccctcacattgctttattataccttttgatgtggggacatctttaatcataagcgccccgcgcgacaatatcttaccctatgcaaaaccccgcaagcctgactaaccatcaccgaaaagacaaaagactctgtcctgccaccacataggcctggttctctcatattaacacgcaactaaaacttcttgtttatcgacgagcaaatcaagcaaactcaataacaacttgcctctcatttcccactaaatatataccaccttccgaccctagttacatttaataattatgactctccgttcatcatattttgtccatctaacataattaccataaacccacccataaggttgatgcgaagacgtcataattactcacacactcagatgttctacgcttttctcgccccgctctatgcgcgtttactactactcgccaccgttttgcattatcggctcccgcgcgg

SEQ ID NO: 15924 - DNA, 735 bp, Homo sapiens
ctctttttctatttctcttactgcacctaaatttaccctgtcttgctttataaccagcatttctagtgttgacaaagaaagcatttagttttcatttcttaacaaaaaccccaacaggcaagataaacattaagttcattattgaaggaaatgagtttgacaacaaaaaagataatttagaatgaaatgaattctcaaaataggacaaggagagtacaggttgccataaagctagataatcaaaagtgttgaaaaatatgtaaagctgtaatatggttaggctttgtgttcctacccatttctcatcttaaattataattcccataatctctatatattgagggcgggacctggtgggaggtgactggatcatgggggtgattttccctatgctgttctcttgatagtgagtgagttatcatgagatctgatggttttataagcatttgacagttcctcctacacacattcactctccgtctcacttgtcaccatgtaagatgtacctgtttcctcttccaccatagttgtaagtttcctgaggcctttccagctatatgcaactgtgagtcaattaaacctctttcctttataaattatccagtctcaggaaactctttatagtgtgaaaacgaactaatacaagctgtaattagaatccactattcactatgcattgtgtaagctacagagaaaatacaaataaaagataagagacaaaaaaaaaaaaaaaaa

SEQ ID NO: 15925 - DNA, 781 bp, Homo sapiens
  misc_feature (1)...(781): n = A,T,C or G
cctgntcactcaaagttctggggganacagaaatggctcacaaaaagacaaagaaatgtgatagatcaaagccatgaatgaagatgacacatgggagctcctctgccctcctccaggggctgcagtgggccccatagcacaggccagctgaagaagaaagaagtggtctttcccagccaggactccaggggatccaaagcacccaggaactcataaaaacagcacggagcctcatgacaatactgagggtggatgagaggaggagcgaaaggaggaacatgccggcttggaagggctgtgaatattcggctatgagtcagctttccaaaggcaaaaacaggcttaatccccaagcccccacttctgcactcccgtgctctttggctgcgtcttccttctccaggaccagtggttgccctgcgtcaggagcagctcttaccctgtggatctcctttctcctctttcttcttcggaggccagaattcctgcatgccccaccctaccctctccacccttgcctgttcaatgcacccatttcagcctccagcaacggcccctgcaccaggctctcctgggtgtgccctttccttctactgggactcaggactgtgccatccccaggaagcccaggatgctttttacaagggatgttcaatgcccctcatgggttctcagacacacaagaacaagctgtagaacataaagtgattgcaaaccttcaggctacactgagccctcctcctgctttttgataaccagacccttagctcaggatggggat

SEQ ID NO: 15926 - DNA, 730 bp, Homo sapiens
tctcataagagtctccatgggaagggtaattgagtttaaccccgttccccaaaatgcctaacttcaaggccccttcttcctggctggacaacatcaagcctccagagagaataatctgccaaatggaggcactggtaagcaagacccagcatcccgtgtgaaagggtagacacaagcccagagaaacaagggttttagaagaaaagtagctagttatcctaaaatttatcatcattcaatggcctcaaacagtgacattaataagcatgtcaatgagcctctccttcccttgcaaatttgtcaaatgccaattaaaaacccaggacttcattctgagtggttgtattaatatgaataccatgactgtttcagaacctcccagatgtttaagggagcacctcccctccattgagaacaataccagttattactaaaaactcctgaatgtggttaagaagggcagaaagaacagacaagagccagtggagactgaggatgtctcactgaagaccacttggtgagacccatcagctagtcatagctaacacatgtaacttactatatgttcccacacttttacacatattaactgactttatctacctcacctctatgaaggaatttctattagcaatattattggtatattttgtactgactaatatattatgattcattttcactctgctttaaataaaccaacattgatttcaaaaaaaaaaaaaaaaaa

SEQ ID NO: 15927 - DNA, 1141 bp, Homo sapiens
  misc_feature (1)...(1141): n = A,T,C or G
tcacccagagtcctactcagccagaacacattcctcctgagaataaacacaagaacttttagggggaagcaggcaaaaaactggactgctttcgaggacatcatcagagcccagagttcaacagatcatgaacactttcgagacaaatgaagacaggtgcaatctgccttgaagaaataaaatctaagtaccaacagtcccttctagagtcaagaatctctctctcttcaaaaatgtaaacgctatctgatccagggagggtaagtcgtattaagcaatagcattctttgattcacatggcatgtatacgttatctaactgttctaagctatccaaaactgccagtacactaactggccagctacactagctagcagattcattgatcgcgagcagcgcagtagcatgattcacttcggtaggtagcatcgtattctatcgacgcgactctgatcttatcggcccactcctcgcctgtctctatagtccacaactattcgcacccgcccagttaaatccaaactttcgtcactcatactgaaccagatcctcgcccacctctacaccgattacctcatcgtataatgactcccccgggtcgattagatacatttcacaaaccctcatggttaccaatgaagtatgtatatcaccgggccccccgacctctgttcttgcttcacgtctttctccatatgcgtacaagaagaaaacagaaacacgcgctcgggcgccgctacgtctcttccgcattatacatactcgaaccacgtcactcatatgttcatacagacgagagcatacatttcatacttacatcgatttacactcgaccaccagactcgcgccgctcgatatgcatacaatccgaatctcaactatactctcgctgtgctctgctagtctgatgagatacctatggcataagtcactcacactctcctccgctatcagtgtcgctctactcntatccactgacctgtctagtatacacctcaagtatgtacactctcagataatctataatgtacaatatacgttacttcgtcacagcccgcacgcacacatacacgtattctacaattctaatctacgcaacgcagctactcatacgctgcttctacacnagacatatcnantc

SEQ ID NO: 15928 - DNA, 284 bp, Homo sapiens
  misc_feature (1)...(284): n = A,T,C or G
ggggnnnnnnnnnnnnnnnnnnnnnagaaaggggggnaagtgaggagnnnnnnnaaaagcctagttagtaccttgctttgttctctaggctggagcatgctggcgtgatcacggctcactgcagactcaagcaaccctccaacctcagtcttctgagtagttgggaccacagatataccttttgctttcacagatattatctttgcttaaaacaagaacatgtgtttgaaataggaattgtattccatantnnaagattttcccaaggcttaaaaaaaaaaaaa

SEQ ID NO: 15929 - DNA, 354 bp, Homo sapiens
ctgaaatgaatgtaaatatgaagagttcctcttaatccagaagagaacacattacataaagcctgacttggaaagaatacttcaagttagccttctacccttgttccatgttccatatttctatacttaatggtggaaccccacatataattgtcatatgtgccctactactgaagcttatgaggtaaaatgctgaaattgggcatttaattatcttcccacgtacgcttctgttaaactcattgcaattctttacatctacattgctttttaaaaaactgtattattagacccaagagaataacctaacattatcatattaaatttgtgcttttaagattaaaaaaaaaaaaa

SEQ ID NO: 15930 - DNA, 232 bp, Homo sapiens
  misc_feature (1)...(232): n = A,T,C or G
ggggnnggnnnnnnnnnnnnnnnnnnngggaggggagaaggaggaaggggngnnnnnnnnnagggccaggtgttattcccaacagcagggaccgactacatgactacataatttgcgggaccagtatgagatgaaaacgcacactgattcttcaaaaagtaggaaatgaaacgtatccgaatagctgtttgtaagtgacattaaaggtactaaaacagtaaaaaaaaaaaaa

SEQ ID NO: 15931 - DNA, 785 bp, Homo sapiens
gctctaatggaaaacttactttgccctcaaataagactttggactttaagttaatgctggaatgatttaagacatttggagactgttgggaaggcatgattgcattttgctttgtaagaaagatgtgagatttcgagggccaaggatggaatgatgtagtttggatggttgtcccctataaatctcatgttgaaatgtaatctccagttttgtatgttgggcctggtaggaagtgtttggatcattgaggcagatccctcatgaatggcttggtgccctccttgttaaagtgagtacattcttgcactgaattaacatgagatctggttatataaaggagtgtgtcacttactctcccacttctatcactcctgctctcactacgtgatgtgcctgctcccctttgtcttctgccatcattgccagcttcctgcacccctcacaaggaacacatactggcgccatacttactgtgcaacctgaacaactgtgagttaaaataactcttactctcttttcaattaaacataattcaccttttgccctcttgcgactcaaccctggaacctatttagaccctttccttttcccacgcactacctctcatcctcactccctcacttccccgatccacaataacctgcccaccatctcgttctctctacccaccttatcgtattaatctcccattttgctcttttctcctggcatttccccccttttatacgctgcacggcccccaggatagtgttttgtttaataacaccatcacacgcccctatcat

SEQ ID NO: 15932 - DNA, 365 bp, Homo sapiens
cctgaattggacattttggattcctatacctcatgtaatggtattaggaagtagaaactttgggaggtgattgtgtcatgaaggtggagcctgcatggataaaattaatgcccttataagagagacaccctagagagttttagctctctttctacgacgtgaggatacaacaagaaggcagcagtctgcaatccagaagaagaacatcaccaaagcacaactatgctggctggcagcacaactatgctggctgcaatccagaagaagagcatcaccaaagcacaactatactggctggcatgactcagatgtgatgcctacagaactgtgagaaataaacttctgttatctgaaaaaaaaaaaaa

SEQ ID NO: 15933 - DNA, 230 bp, Homo sapiens
ggcgacggccatgtggtgaagaggccgagattggagagatgtgtccagaaaaccaggaataccaaccactacggggagccaccggaggctggagtgacgccacgaagcatcttcccctagagccatcggagaaagcacgtccctgccaacaccttgacttctgacttctggcctccagaaaagtgagagaataaatttcggttgttttctgccatggaaaaaaaaaaaaa

SEQ ID NO: 15934 - DNA, 724 bp, Homo sapiens
  misc_feature (1)...(724): n = A,T,C or G
tttgtgtccctttgtctgataacttaccttcgaacatgaaattaattactgatgattcagttatgaagtcagctgggagaccacatcctaggaatattgactgctccgaacaaggaaccattataagggagcgctcatgatgcatncaccnnnataccgactcaccacatcaccccactctgacaaactgcctcaacacctgatgaacaggacattgtgtcacttgaccaccttcaactttgacaatgaacactgaacatgacactctctgcccaccttttccccacaggcaccaccctcccttactctgcgccttaggagagatctacttacccccaggcatcacccctcaccctcccctgcctccccccaattctttccacaccacaagggtncctattcccccccccccccccccccacccccccacctccatccccccccccccctacccacccttaatttcgaaccaccactacttcccacccctttagtcctccacaaccttccatcggcccctcancccttcttttctctgcccacccgcaactcctgccgcgtcccccccccccatgccaatcctccggcctacacccgccccgatagcccactctccctttctcacttcactatataccttcacccccccgccttctgcaatctcctacctgcnatctatcccctcaccccccctcttatctaattcattctcccacccactccg

SEQ ID NO: 15935 - DNA, 288 bp, Homo sapiens
cttagaatatacgctcctttcttacctccatgctgagactattcaagagacaagtggcataacacaagagccacaggattcgactagagacttaatatgtttcgtctgaaacaaggaaatctccgaaagagagaagaacatgcactctgattataaaataccatcaaggaacaaaatgtatggaggaaggaaattattctaaatctccacgtagacatggaaatggcctatagataaggaagataacatttgaagtagatattaataaaaaagttcttacacatcaaa

SEQ ID NO: 15936 - DNA, 777 bp, Homo sapiens
tctgttttctccttatgtgacccctccagtacccaccagaggccaggatgcatgagaggggtgcaccaccaagctcctacccagaacagcctggctgccaccaacgtcaaaggcaatccaggagttccacagaagggccctgctgggatgtgatgcaaacacccctcatcccagccccatcaccagccactaacacagcacatggactctcacccctgctgggaggagaggtccatgatctccagaacagttctccatggtcccgggacaagaaaatggagatccaggagcaaatatcatccttacacagtcatgttcccatctgtacacaaggagcaatatgctgtatgccacacacgggggatgggaataataacaaccataaacaaccccaaaaaaaaacagacacccacacccccccccccacaagttaaactccatcccacacattcctccttaaaacatcacattaataccatattccctttttttctaccctcacagcgggtggtcgtgccttcacacagacgattaatcccgaaccacccctcacttctccggggagaagtcccgactccccggcaacaaccacccctcactaccgattttccgctatcgcgcaccccccacccacccccataaacttcctatcaacccctcccccacccgctatgttcgctccccaccacacacactcctctactctcctcttctcactactctctcgatctcccacaggctgattgggtgtggattttccacgggccgacccccgcg

SEQ ID NO: 15937 - DNA, 765 bp, Homo sapiens
ctggtcatgctgagattggtcctcagttctgggaccggtcctcaggctggagatgcaaatactggcagttggaagaggctcaagcacattgaaagccagaaagtaaagccctgtagagagatcttcctcgtggcacttgccacttgtccagaaataatatgttacgtgttggtggctcccgaaagatggcggccttcaccagtttctggagttacaaatgcacttcaataatgatcaagtcatgctgcaacaggcacagagaacaaagaaacaactgcaacacgaaactgctgaacttgggtctgaaatcccagcattaacaaaaaaggttcttactctattgtccagcctggagtgcagtggtgccatttcagcctcactgcaaccttcgacttccggcttcaagagattcctatgcttcaacctctccagtagttgggattacaagtgcgtgccacgaacaacgactcacccttgcattcttcgccagagatggacccccaccccactgcacaccctggccttttaacttcctgagctcaactgactccttgccatcgaatccaccagtgcctgcactccaggcctcacccctcacattctctgtccttttctcgcccattccacctcgtcttttccaatacgcccacctccctcccgcctcttattgcctgccctctttaacagtgttcgttactttgccacccttcctcccgttggatcccccataaatatacatattttatttttctctcccgccccgct

SEQ ID NO: 15938 - DNA, 867 bp, Homo sapiens
  misc_feature (1)...(867): n = A,T,C or G
ggagaagaaaaangcnnnnnnnnnnnnnaaaaaaanaaaaaaaaacaagnnaacctagcaaatcgtccagccatttttgcccagctgtcagatgattattcatcccggcccacagccatgcaacacccaaggctcctctggaaggcatcaaccctgccatgcctttgacatcggactccgccatgcgactttgtgggccactggnntaggaattggacttatatgacctgaatggaagctggcccttcaagggctatcacatgtatttgtccttggtctgcttcctcatgaaaatcacaatatttgccacatagagaccatttattcagttagatttctggctcgcacacatagaacaaacctggagtcaactcaggggtgacaatgnctcctacattaaccccccccacccaccaccacatcaatggcctggcgtggcctcaccgcgaggaacattcccccccccttccctgggcagaggacaccaccactaccgccggttaactaacacaccccgcgtcggccccgcaaccgtcgagctatctcacctaatctcgctcctatcccgccccccaccgcccaaccagcggcctctaccgccccatcagcatcaaaacagccccccgcccccctcgccagcctgcgaccccacacgccccacccncccccgtgccattcgcccccgcttcgcgtcgcgcccgcgccccacgccgcaatacgcactgctgagccgacccccgactactcgccgacccagtccacctagcgggacttccgctgctcgcgctgttcccgcacgcccagccccgccatcgccccccccccgaggacaagtccagtagttccagccagcgccccccacccccg

SEQ ID NO: 15939 - DNA, 775 bp, Homo sapiens
ccttaggtgaggacacaaaacgaagactgctatctgcatatcaggaagcaggccctaaccagataccggatctgccagcaccttgagcttggattttccaacccccagaactgtgagaaataaatatctgttgtttataacccatctctcacattttgtgacagcagcccagatggactatgacacttccccacactacttggccatcctcttttctcctctgtacagatgagtgaactgtgatttcagagatacctagtgccttgctcaagctgcagcatctgtatctgatggggctggttctcaaacctagttcttctgcctggacatccagatacagggtacaacatgaactggcctgttgagaactgagagatgaatcattgcaaaaacaagttactaacatttaaataatgtgtaccccaagatttccacatgcaaaatcacgcaaagccagcaacacacaagctgaagggtattgaaaattcataggaggggagagcccccagggaaatgctagaaatggccagtggctgacaccactgcctttgagaatatccctgacccttccctcctccaccttgggcctcgcactcttttggcttgcctatgagagaccactttctgcaaccgaaatgacccctcgctcgcccccccagccatccgtcgaactcgtagcccccctcactgcctatttgaaccattaccatgcaattctcccgctccaccccccgcccgcgttatcctattatgctctctccacgcctcgttccgt

SEQ ID NO: 15940 - DNA, 359 bp, Homo sapiens
  misc_feature (1)...(359): n = A,T,C or G
ctggttggcctagaaatacaggttataactctgaggagagctggagcccgatggatggagtctatacctgcatatccatctgaaatggaaacgcccttccatgccgtgcacatgctttctgtggatatcgacatcgactaaactatagatcttactantatcgtggactcatagaagagaaaataacaaaacaaactcggaccgtacgatctggcgcgctcacgctggttggtacgcctcatagccgtgcccgaatctcccattatacctcgatgggcctacatctctattgatctctacgtctcacgtagacatcatcgtgccgcgtcaggtacgtgtacggcgtgatcgcgatgccc

SEQ ID NO: 15941 - DNA, 431 bp, Homo sapiens
ttaggtctttcagttgctggcggattaatagttattcctcttgaattgctgagcagaatcccagaagacaaaagaaacgtgtctgtgatcgcacccagcagaacaaccgaggacctactccctcaccctctgcgctatctcaaatctctacatacaacaatagcaaaacagactgcaaatatgacccactgcttttacaatgttaaaatcaactgaaacgatattctgacaacagcttttctcacagattactagacatctctgccaaaggaaattaaaacatgcctccagaaaaaaatcaggactaattccgatcttcttgaaagaaactattatatattaatagagtcatatcatgggcacatggataagtaattatcataattttgagaaatataaagcctcttttaaaaaaggaaaaaaaaagaaaa

SEQ ID NO: 15942 - DNA, 792 bp, Homo sapiens
cctggctcatcatggaagaaacttactttgcacctcaaataagactttggactttaagttaatgctggaatgatttaagacatttggagactgttgggaaggcatgattgcattttgctttgtaagaaagatgtgagatttcgagggccaaggatggaatgatgtagtttggatgtttgtcccctataaatctcatgttgaaatgtaatctccagttttgtatgttgggcctggtaggaagtgtttggatcattggggcagatccctcatgaatggcttggtgccctccttgttaaagtgagtacattcttgcactgaattaacatgagatctggttatataaaggagtgtgtcacttcctctcccacttctctcactcctgctctcactacgtgatgtgcctgctccccttcgtcttctgccataattcgaagcttcctgtaccctcacaaggaacagatcctggtgccatacttcctgtccagccctgctcaactgtaagtcaaaacaactctctctccctttcttcacttaacaacaaaatatacacttttccctccttggcctcaaacgccgcgctcttccccccctttcctttctcgaggcttactccacgacccccgctccctgactcctctccccccggccactccctccccctccacccacctcccccccctcactgcttaatctaccgccctccccacgacgccgggtcctcccaccgacatcaacatacaaatacctacccctcaaacgcgccccaacctctcactctcgccacgcttctag

SEQ ID NO: 15943 - DNA, 1004 bp, Homo sapiens
ccttcgtaccccacacccacatcaaaaacttactccaacacacatttggtgacacccaccagcagttttcattgaccctgcccaacacccaaaagtggatgaagtcttgacttgtttatttgtagtttctttctttgaacgtggagtgtctgaagagattttttttccagtatggcgtgttcgtccaaatggatatacttatactttatcttgacatacggacaattcccatgaccgacagcgtcgccctctttatgccatgacacagcatatacccggactcatccctcaatttcatgtcattttttcttaacgctaactaacaataagctcactatctcacactgcgtgtctagctacctcttcttcctatctagagacttataattcgccctccatcactgacacctactttcacactcgctattcatccattctctatgcagcacatacttcttcctccactgcgactatcaacagtctctatcctcccctgtacaaaccacccgcacttgatcccatttcctggccaccgcacgtatatacgcttcattatccattggactcccttccgcgcgaatcacccgcatccttctcactcctcatcgcgaccgatgtgtcttcgccctagtatcccgcccactcaccgtgagtccatcatcgccgatcgcgatcttacccctaatgacttacagtctacaccgtcgccttattcgcaccaaatttctctcatactcgtcatgatcatcgataactctatcacatctcactcttcgtgcctccgcgtacgcaggcgttatgttcgtttctcacgccactctcccaacccggccgcctgtctcctctctccaccaaccctccctcgccacctcctacctcctcccatatgtttatgattgttaacgccattctttccccatctcttcgctattgactttatttcttatcagtcctcctctccctgccacactacacacatcaacgtcgcatcctctctctcccct

SEQ ID NO: 15944 - DNA, 961 bp, Homo sapiens
  misc_feature (1)...(961): n = A,T,C or G
cttcaacccccatcaccccttcacccattctcaaaagctattacacttaggaccagccctacagcccttaatgccaggacgaggaccactggatgactgaggaaggcatgaagaaagatgcatacttaaactagaccttcacgatggaatagagcctttaagaccaaacactatacgatgaatccgcttctattatataagcggaaccatgcgaacatgtcgacataatcgcgcatcaccaaccatcgatctcaaagaccgatccgcgacaaacaatgactcggcctctatatggtctaaacccatcagaaattgatagcggcacctcctcctagtgatagaggtccgcattgtctggagaggtaaaaagtactgcaagtcttagccgcctcaccccctcccctgctccacatacttctagctctcttcttatttaccaacgcgacggttgacacgcgtcatacacccgggagccaacacgaatccacggcgctgacttacacctatgacgtgtgctagccgaacatctacgtctgtagtacacggatagttaccgccattacctgcgaccgacatcatacccaagcaatttcataccatccaattttctcaggcgcatacacggcgccgccctcgtgtacacggtctgattggctgtggtcgccggtcgcataccctgacacgtcaaaatacccgcgcgatttggtctcattcaacgtcaatcagcatcgaatctatctacctancagagtacacgacacatattggttcgccgtaacccacgctgcgaaagacacgactacgcgtctgtttccaacctggctgacgtcatgcagatcatacacagcatggtgggctagaagaagtgtagntgttccagatgatataaatgtagattgttgagttagcgagtgaacactgcatactgactgatatgaatcgccctctcctcacgattccg

SEQ ID NO: 15945 - DNA, 264 bp, Homo sapiens
actcgtttcgagcgttcccctctatcaattatctcaaaccacacacaaaattttaggactatgcctactgtgtgtctgttaacttccaatgttccgaagatctgcttctttgccctctgaactctgagcaaggaacctttccaaacagtatgaactcattggcttccccataactctacagagctcgcgctgccatatagctgggaatcagagaggacctttattaaattagctcaactcagttaaaaataacttcataaacaa

SEQ ID NO: 15946 - DNA, 474 bp, Homo sapiens
  misc_feature (1)...(474): n = A,T,C or G
atgagctgctcaactccaccgctagttaagaatatcaaaaaaaagcttaacgtgaatcaagtaggtcgtgnaggaattcacaatttacagaagaggaagcaaagatccaataaggataagtttcatacaccctgttggaaccataacaaacacttttgctccagcatgatttccgaaggaccttctaatggagtgcctcctttaaccggcatgcctcccctaccagacctgactccatgaagcagacactgaccttggcatcaaggcgacctgacccgagctcagctccatcactgaagaaactcctcccctcttcgagtttcagttgtcatctgtaagatgggagtaagaatagtgcttacagatagggctgttggaatgataaatatgaaaaaatgcataaccattaaataatatacaacatatgctcaaaaaaaagacaaaaaatggcctccttggcctcaacggcggacg

SEQ ID NO: 15947 - DNA, 947 bp, Homo sapiens
  misc_feature (1)...(947): n = A,T,C or G
cttcttccccccaacaaacaatacttataaaacaactataaactacttggaacacanagtgatgtctctggatctcaagtagctatttggggctgtgaggtgatccactgaggttggtggaggagcaaaattataccagaggcctgagtctctgttgacctacacaacttccaaaacagcacctgaattaactacctcgccagactgtttattgacccaaaccacacacatacatctcttcctgttctctccctctacctattaataccaaaatggcctacccctcgcccgacatcggcggaccctctgcggtacacttctccttacaaataaaggacaccaaactagacatcccgcaagccgcgactcccagcagttccctcaatcacttcatgctccggtaccgtctatcagactcacaccacactgtctcctcacacaactaatcccccatataccgctggactaacagaaataataaactagctcagagcattcagcagtaatctctactctaatcaaaccccccaaacgtcatgcacaacatgttttgattcgctgcatcctaccctcttctcaccttagaccatctccattcttccaacaacaattagattagtatgcaaccgcctccacaccactctcgtcatctaatgatcatcatccctctctccgctctccctttcttactctactgctctcactctctcttgttccattcacctgcacgcaccgactcacaccccacctccctcttatacctccaccaccagtacgcataccgtcctcatccacacactactctatacatagccagactcctaacaccttccctaccggcgtatccagagaggccttcgagtcgtgaccatgtccaatatattatattagagtacaccactatcattcaatacagtcacactactccaccaacaccatccccccgc

SEQ ID NO: 15948 - DNA, 846 bp, Homo sapiens
cggggcgatagccgagtgatcgatatcgcaaaaaatactcagtcccacgtgtgtgatggcggttgcactctgcttgagggtattaatgcaatcttcagtggtggctactgttctatagatgttctacacaactggagcatgctggcttgaaacacccttgcccagttttcgatacccttgaagacttgtggacagcctgtatgagacatgatggttttatgtgccgagagcacctcactcataaaaccgctatactgttgtgacactgtcgcacaagaatttgcgcacgcgcaagaacgtcatgaacacatgatcatggacgaggtcgacccacccaaaaaagataaacgtcacatagtataggagagagcgtatgtgccggccgggcctcgtccgcaatctaatccacccaccccccccctttctattcgcacgacgccccgtctcctcctgtgtctggcgccctcggactcacagtcaggttacgactctgcttggttactccatcgctgcgcccgactccaacttaacggtaaccgcagtttaccccccactctccccaccccctcctgactgactctttgctatctgcccttacctcccctaccgcccacacccacctggctctcgaggctcctaaaatctgaccaggcacccgccttcaccacctgttgtccgccaccctctcacgctacgctcaccttactacgccgacagctttccggggagacctgaaaacacagctgtgtataaggttgacacccctaggcacgccacgcgaacactgtgagtggtcgaactacgctacacgtagaactcgtgtatgcatttctatgacactgcatc

SEQ ID NO: 15949 - DNA, 888 bp, Homo sapiens
caccccactgacgcttctacgacgctgtaggcctcctctcagagtagtatctggcaccatccttttaagggaagatgggagtagattgaagaagcagctgtggagatgcaacgctggacatgaaatgggtgtggaagacaacggaaagccagctggtcaagacccttgggaagaaaagaatctttaaaaggtctctgttagcgtgggactaaattgtcatgaaacattgtgactccgatgaactacttatgaaagaaagacagtacaatatcgggcacttgcaccactgttcaagaagggattatcacgagacaatctctcgtctacccatttgcatcgtgacctttttattcacccatacaatgatttgaggtcgtcaccgatccggaaccctctaatcgtacctgtttccgagtggccggctctcccctcccaacctccactttcaccgtttgtgtctccgcctaatgatgcttttcccacactcgcttccgggtcgaagctcgtaaatgtcgcgtgtcacagtccggccccctcacttttctcctctctctacctagtaatgatatcagcactatccgtccagcggctctgagagactacgtgggaaactatcctcgttgtcgttagccccgtccgtccatgtctcctctgatcgagatgttatcgtattgtattctcttcacgtactggcctgcctctcccgctcaatataggtactctcacaaaaaacgagaacaccgtgcccaacgactccgctctcctcctggctcgctcaattacgtcctactgactcattaagtcgcccacgcttccttcgcgtcctcctcatacaatctcttctcccggcacgtggtgtcaacgtcccctcccgctatcccactcctg

SEQ ID NO: 15950 - DNA, 237 bp, Homo sapiens
atccatccccctctaccaataaataatattaccacatcattaaaatcctctaattggctctagaaaccattagaaactctgacgagagcatggagcccgatggaaggagtctagacctgcatatccatctgagctggaaaccccttccagcctgcactgttttgtgaaatgactgaaaaataaatctatattgcgttaagccaataaaacaaaaaaaaatggtctctttggcctcaa

SEQ ID NO: 15951 - DNA, 915 bp, Homo sapiens
ggtcccacacgccctcccccactgtcataacctcactttcctcccacacctaagatacagcgcaatatgtgccttggcagaggaagcacgtcttaaatctggaaatgatatgaagagggatgttagcaacacttcatcctgcgccagtaatagggagagctccttttctctcgccacaccgctgaaaggatactagccccgctcggggcggacactcacactcgaatccctacccctctatgtgatctacaccacgctgactactgtccagcgtgaccccactgtacacactaacacacttccgtccttctcaaatataaaaaaaacacacggccctcattacgccccaccctgcgcccgtcaccggtacgcctcccccacacgcagcgcctaacaccctagacccccgcgccctcgaccacatcggtaaagaccaccctacacgctcctccccaccgcaccactacactcttaccttacgcctgaccttcaccaccaacctctatcccgccccccaccccctaccacctttacactacacccccccccccacccgtcacgaagatatccctacgccccctcactggtgagtctcacttatatcttgtcgcatccccactcaccgaggtaggacagactcaacaaaaccccccctccacacatcccaacccccacctccgatcattcgttctcataatgcagtacactacaggacacatgccactatagtttgatctccctcctcaatccactctctatcctcccacctcctctcccctcctccttactctcccctctttcctggttcatctacttctacacccaccacaccttcacaccacccgtccagacataagtcaccccctcccccgcttcacccttcaccccgccacactctccctaccctcactcccg

SEQ ID NO: 15952 - DNA, 782 bp, Homo sapiens
tggtggcctctgatcttggaggaagatgctcaccagtgtcctgctgctagaagaagggtctcgtctgggggctgtgtctgtccacgccagattccctgttgatggatgctccagtctggcccccaggagaggctcacaccacacctgcttcactggagggatctccactgctctctccctacctcccaggtctcctgagcctcccttctagctactgcagcggtccttttattcacaacagcagaggcgtgcgaggttggctctccctcaagctctcctctaggaccatgggacacccagtggcactgcctcaggtcctctctggccctggcagaccttgcggctggctctatagtttccacaccatggagaccgagagctcctcaatggcagccacttcccagccagggacccaggggcacagttccactgtgccggtggactcccagacatttacaaggaaggagtcttctgccaccttatgcctcttgccacttgttggcagtgagagccctccccgcccccggatattggtcagggctcacattctccaacccctgtctgttcgcgtcctgctatgctcgtgtatagacccaccccgcaaccagacatgcgcgaacacgctgtcgtacaccgtgcccaattctccccccctcccaccccgatacccactcccgcacgagcggacttcatatacaacccagcccccgtagtaaccactgcgtcacacctaccactcgcctcaacgttatttaccgaaaccgcctgagcatgttcccgtg

SEQ ID NO: 15953 - DNA, 874 bp, Homo sapiens
  misc_feature (1)...(874): n = A,T,C or G
cccggcactgcagtgactcgtcacccaggcggcgaaaagcgacaacctgnaaggcaactggagccagacttagcaactgcagacgagaaaactgtgaataaaagggaacaactgtacccttacaaccaccactgtaatcaagaggtataacagcttcatcagttcaacacttgaaactggtcattgtagaatatgaattatgagagtgatttatgaaagaaagacaggggagaattgcaaccgatggagacattcaaagaaaagactttggcactacatcaacagagagtacaatacatgaccacactaccgcacacagagaataaagaacttatccaaagctatgcaactgtgtaaagaagcggatttcggcgattgtgaatatcacagcccgcccacactacattccaccgacaggccgagctacgtaaacactctgacaagaagagcgaggcttggatgacgaccaaccattaccccgcgcgtcctcgtgcgggacacacgctcgacctctgacggcctctcaccgcctgctatacgaacacgacctaatgctaccgttactcactttccgtcgcctcggaatctccccgctccgcggcaattccggtccgcccactgcgctgcctgcggccccatgtcttcccctccatcgccgcctctcacaccgtgtgcggcccgaccgcatgcaccaggtctccgccatgctcgcatctccccgaattgctgctgatccctccaccgtccccagtatggcgttccccgctccggcgttcgtgtgctactttcgcccgccagtccgctcgacccatactccccggaggccgagtacgctcccgcatccgcgcggccactgtagcgctgcccgcgtgtg

SEQ ID NO: 15954 - DNA, 870 bp, Homo sapiens
  misc_feature (1)...(870): n = A,T,C or G
cgcgggagacgtgaacaacaagttaccacatcgaaggtgggcagcccggctgntagctgactttaatactctttatgcttacagaccccggctggcctctgtccctcaccattctgtgtctagaaaaagcagttgagaacccatattcttcaagaacccttccccattaccaaacaccatattatatttaatctacccttcagttcttttgtagccaaattaaaatgtattactctgaagaaaaaaaaaaacacaaaaaccacgaaaacaaaaaaataaaccagaccacacactcaacacctaaccaacggatcacggaaaagggtaacactaacctacgccccctccccatccaagacagaagagaataccgccggccagaccggcagggcacgcgagggtgcgacggtcgcacgctcgggccagtgcgggatcgccatagtgcgcgcaggctccgcaccgagggttcgttaagcggactccaccatagtgcatgggctgcggtaccgttagggggagcgcgtacgtaggttaggtcttcaaatgcgggaatgcctcgcgcgcaatgcgccgacaccttctctctcgtgtgctcacccctccacatccacaccccgactagaattcggggaacagtgtcggctaaccgacgcagggaccccgcccatccacaggcagtaaggttcacccccacggaatacacgtcgcaaagtgttaatccatcgagaagggggagaatccgcggccaggcatacccagttgcctgatgcgcggccgtgggactgcgaccgacataaccttccggtgtctcgggtgggcggagcgattccacgcgtgcaattgcacccaccgacggggataggagggggg

SEQ ID NO: 15955 - DNA, 164 bp, Homo sapiens
ctaggctccatgacatttgctccagttaacctgatacagccatctgcctgaaggaggaggagaatttattataaagaatgacgaaggaaagaagcagagatatgtaacatctgacataaaaaaacaggattaaagcaaaataaaacattataaaaaaaaaaaaa

SEQ ID NO: 15956 - DNA, 940 bp, Homo sapiens
  misc_feature (1)...(940): n = A,T,C or G
caccacaacccaacattctaacccccacgacagagaaacgccacaccgcactagccacaaactgacttctgtggatatgaggacagtggaactggctcctgaatgagatcttatttgccactgctcgatctggagcgcaaatggatgaagtctgctgcgactcacgctgacgccactgtatcggagtcgcccatgcggaagagccactgcgtgcaacatcagcggctggaatttaagccgcccttccctcacacgcacagatggccgcatgaaacccatgctccccgggaatcgcacaccttccctcagctaatgtcccacaaagcgtgctcccactacttccttctgtcctcctaccaaaccctacctcccccatgaacatgcgctcccgaggtgaccactccacgcagcactcctgcactaatgagctcttacggcacacacccccaccccttgatcacccaccgccaccaccctcaaacacacctattcccatacaccaccacctccaccccgaaacccacctcactctcacaggttggttgtcccgccacaccccccggacatacctacctacaccaatcatgtaccactgcgacactacgaccccacacctctccagaccaccaaactcgccccataacacacagcgccaccgcagaacccaaaccgcaccacccccgtgctctaccccaccccccccacccaccattacccaacataccatccctctacaacctcaaacctccgacactctctcatgcagcggacccacaccaaccacgcccctaccacagcctcgccgcgcgccgcacgacgtcgtgtacccttcaccccctccactctgttatcaccgatactgaaccctaccaangtctacacctgctcccccgtctaccaccacacttctccctcactctcgatccacttctctccctgt

SEQ ID NO: 15957 - DNA, 843 bp, Homo sapiens
cccacatccaaactccccaaccacacacgcacacacaacccttacaggacacactgaagagcttgacagctcggcgtctgcgcagatcacggctttcgtgggacaccctcacacacagctgatcaccaaaaagtgtgaagctcacaacactcttagaacaaccctacagtgatcagaaaatttgaattgccaacttataatgagcctaaacaatattggcatgtgaaacacaacatagcgcaagaactcgattgcgattcacggttattttaacaaactactatatctacctgtcctggtttcttacataccaaatcattgaatcccccctatgcccgtttcacgtaccctcacacaacgaccacttttaaaattgacctaccccaacctataatctatatcgcatgacttaggtttccagcctacccaaccagtgacagaatctgtcccctccccccctgcccgtctctccccatagcactatgcctcactttacacccacaactctactacactaccggctgtatttcacacaccccccccactaccgtaccctctgcactcacatgaacatcttcgaccccaccctatccacataactaaacaaacttatacgtcactattactaacatactcccactcactaaatctcctcccacccctccttcaacactccaacaatcaaactcttcataacaatctgacattcttcccaccacacccacttccaatataacgcaatcgctccgcgttttatagtcacttacccgacatgtaatctctcccctaccaaactcatccgtgctcacggatctgactcgcccactcgttctatcatatcgg

SEQ ID NO: 15958 - DNA, 1100 bp, Homo sapiens
  misc_feature (1)...(1100): n = A,T,C or G
ccgcctcacctctcccataactaatcgactatcgacgccgagacccgcacgaggcggctagcttgttactcatgattagnaaagnatcnggagagcaattgtcttctatcggaagctggtcgaacataggcgacagcaagtactctctcttcttcgataacgaccatgcatcgtgcaataccacggaagtaaaaagtacaactctccacataactagagcagatacaatcagaacagtgtaaaaaataaaagtactgcggtctcgtaaaaacgacgtcgcgattcactgtcagcgagagatttactgcgcagacacctttctattctctttcattccttctttcagccgatcgacgcccacctcatcacctcaccactggcctctcgccggcgatatgcacgtgaattcgatggctatccactgcacagcggaaatggaaaagcatctctcactgctgtcacgacgcctgggtgttgttccaagcagtatctcacgagttcgtgctagcaatctacataccaacaccacgctcgcgatatcgactcgaagtcctctacaccaaccgagaagtcgatcacagacagtaacaattacgaacaccaataccaacgccatcaccgcggacaccggcaaacattctcaaccaggcaacattctgctcacgactcgagtctactccatcgaacgataccgttacgggagaatcgagtcgacatagtaccacacacaccgtcaatggcactctccgacccgcgcagatttgccttctacccatcacataaacgttcgcagttctacgctatgttaaaccgtgttattatcgtcttcgcctcactccgatgtgattcagctcagtctctcccctatctcaccatcacagtattcacctgcgtgcggcgcgtctgttgcaccataccgatacgtacgaacacgccacgagtacaaccgccaaagtctcgtagttcttctctaacgagcatattcgagtactaccttgatcaccacacaacgcgaatgctgacccccacagctctccgtctctacctcacgatccgccatatctcgcacgcacaccactctcagcccagctacctatcgt

SEQ ID NO: 15959 - DNA, 747 bp, Homo sapiens
tcgggacaaagaccgaccaaactttatcttgtggtttgggtcctccaatcctcataaaagtgtggtttcacctgttacctcataaaggtgccattgctgtatgcacatctgaatctgtttacaatttgagaatagaggatcaagttcagatggcttacggctgagatacatgctgctctggcagcacgaataaactgatggacaagaccaaaacacaaggcgagaaattctcgagatttcttaggacaaccttctccccggatgaacagagcttcttctactgcttattcttcgtagatcccgataatcactatgtgtccttctcgcgctcacgcctcacccgcactaacatctctctgctccgccctctttcccatactcccccccgcttcccgctttcccacgtcccattgccccagccctccactcgctgcatactccaccaatcccccccaccttccgcttctcgatttccgcacatctctcgccccactaccccccctccgcactatcccaacccgttgtatcaccactcctatctgcccttttctcccacgtttctgccatccatcctacttcccgtccacaccccccaccactctaacttccttgtttccccgccagccttgcccccaccccacctcctctcggcctgtcatctcaccccttcccctcccttttttatccacccactcccctactgttccttctcggcacgtctcccctcaccctccatcttcctgttct

SEQ ID NO: 15960 - DNA, 869 bp, Homo sapiens
  misc_feature (1)...(869): n = A,T,C or G
gcagcgctagcaacaacctacacgaattcaggccgacgcgcggcctgagggcaccaagcccatattaattttctaaacccccatgaagctagaaaacatggtttagtatgagatcaccccaataaggaatgaaagtactatgtgtctctctattttaccgatgagaaaaccaacactaaaagaggacaggaatatctcttctctacacaaagccacttgagcccatttgaaatgtaactattgccatggaagaattctaccaacactttttgtgcgtatttaaactacccactaaatacccttttctatctaaatactatgctttgctaccgcctcaccaaccgcacccacatacttctcttacaccgccggaccttgcaaccggtagtcgcctctagggccgcgctcccgtacgtgtccatctttaggtcacactactgcggctcacccgggagaggcggccccccccccattagacacggtggtgactcccccgttcctcccacccaacccactccgcgcgcgcaaccaccctacccaaccaaccccacgagtacaccacttctcattcgaagtctcaagaatgtgcgttacccacaccaggacattacccccatgccaccctcctctcccccccaatctcgccgcagactgcggcgagggataacattagccctaacaaacaggaccacgtcccagacccacaatgtggggccgtccggcgacacccgcctccgacaccccgcctacatagtccacgccgcagccaggcgcgtgacaancacacccactctatgtgcatatccaaatcgcttgaagagatcatcggatgactgcccgtcaaaaaggcagcaggagtgaggcgctgg

SEQ ID NO: 15961 - DNA, 796 bp, Homo sapiens
acgatgagttcactgtagtcttcgttaatattctgcaagacttgctagcaccgcgccagtgactatgggtacaaagacggataaagcatgaatttgcctggacataactcacagcttaccagagcaggaaaaccttggtaccatcggaaagcagtgctgattcagaccccaagtgagcattcttggatttcatgcaagaaataattcaggatcagaaacaagtctcacgattctggagacaagaaagcccacaatcaaggtgctggcagatccggtgacagaaactgttatcaacagaccaaacagacaacctatagaatgggagaaaatatttgccagatatagcacctgacaaagcttctgacatgcaacatttatacggagctggaacaaatccatctggaaaaaaccgtctcgcgcattggttctttgtgatgacctatagcgccgaacacatttctctgtatgcctactttgagcctgccaagccgtattggggtcacccgcgatattagcctcgcacgccagcaccctacgccctcatgtatcttacgttcttcacgcatagcatctttttgaccccccgtaggcctatcaattatctttccgacgtgggacggtattctccttgccccacctgttccgtttttctccctccgcactgctttcgttcgtcccacgcccactcacccgcccagctccaccacctacctatcgtgttccaacgccagcgtgtgttcttgcccttgcccacttgtaaggggacggaattcacctactatgtgggtaccggggt

SEQ ID NO: 15962 - DNA, 921 bp, Homo sapiens
acggcgcgcgctggtcgcgggcaattggctcgtgcagggggaacgagagaggctttggggcaacacgaaaagtgtttgttgacaactggcaccatagagacagagaaaacacacgggcatatgctttggactacaaaatccctaaagtgtacttccaaatgttaaatgaggattctatataagaagcgacaaacgctgataatttaattactagtatacgaaagacggcgccaaagcgagtaaaccctgcctctcacacaccacgtacattgaatactcccaccatgcttttatgcctccacattacattgtttatgctgctaatacctcaataacacagtgatccaagaagcgatcgcatatgagtaacgcataaccactctagtcgtagcatagcgctcaagacatcaccctacagacccaagacctatagagatgtagaccatcttatccccagcacagtgccaatcaagcactacactcacccacttctatcatcagcggttgctccttatcagcagcaactcgaccactacgctaacacaaagccaggataggagcacgtctgccgatacttcgtgagtcagatctctgctgctcactcagagtatccgacccccacagccgcagagtatctcgcagccgccccatgtaccccgtacatgaaatatgatgcgatacttcacccggctataatttcatccccccaccactcatccttctctccgtacctactaccaacggacgtgggcctcattgactgttacacggaaacgcgtactaaacggcagttaacaactcgcaagagcagccgtttgtgttatatcaccaacctacacacgcggtagaagtgccactcaggcggcacagaaaaagactaacacataacacgctaaacgccgcacggtacatgctatgatg

SEQ ID NO: 15963 - DNA, 275 bp, Homo sapiens
ctagggaaatcgccagagccctgctctccaggcctgcccttattcatggggatctgagaagaagagattaggacccagacatgcacagaggagaccctgtaaggacacaaagagaagacagccatctgcaagccaagaagaaaggccttgggggaaaccagccctgcccacaccttggtctggacttccagctgattcttggatgagctggcccttaggcacggaggcaggactgtgagaaataaatctctgcttttaattcaaaaaaaaaaaaa

SEQ ID NO: 15964 - DNA, 781 bp, Homo sapiens
cctaggtgcaactattactaagaagtaggccatctatacaaccaggaagaaggccttcaccaaaaccccaaccatgttaacatcctgatctcagactccaagcctccagagctatggagtctcgctgtgtcgcccaggctggagtgcagtggcatgatctcggctcactgcaagccccgcctcccgggttcacaccactctcctgcctcagcatgccgagtagctgggactacagacgcccgccaccaggcccagctaattttttgtattttcagtagagacgaggtttcaccgtgttagccaggatggtctcgatctcctgacctcgtgatctgcccgtctcggcctcccaaagtcctgggattataggcgtgagccaccgcgcccagccactgccaaactatttctactactcaaaggctgatgacttgataattttttttattgaaaggatttattccccttgctaaaatctaccatcacaagtcgtgaataacattccaacttgagaaatctgacttaaaaaataaacaacattgtgaatgacaaaacaacaaaaagaaatcggcctagatggcctcagcgggggagccctgtgcccacttgcctttaccggggccagataatgagccccgctagttggacatatgtggtttgaggttcggcagacgcggtcgctacctctcctcaccggccgacatcacgcctcccccaccggggggtaacccaggacagacttggcagcgagcccgcccacaaggccacgacggtgatagcgcgg

SEQ ID NO: 15965 - DNA, 862 bp, Homo sapiens
cacaacgatatacaaaccaacccgccgaccacgcccccaaaaaaacacctgaggtatacacatccatgctcctttgctatgcgcctcccagaggcctccctgcagaagagatgatacccacctccccgcctgatgctcttggatcactttgtcattatcaatataaccgtaaacccaattggtcatcttgtagaaggggtagtttacaaagccataccgattcagaattagcaaggagcattagaaaccagcactcgctaccaaccctatatcctaccatatgacctagcaaaaatgctcaacagatactattctggattaagcgaaatgaacacatcgagcaacccaacactaatacagtacaacagaacacacctaactatacataggcaccgccatggcgacacacaccgcattcacacacgctgccaatccccattacgcaaaccaacccaaacacaacaaaacacccaccagaaccagcaacaaaagtaaacgttacaaccccccccaccccgccgtactacacctccatgacgcccacctacatcgcgcaaccgaacacgcccaacgcgaaaataacgaaacccacaaacagaacagtaataaaatcacccaaaattcctcccaaccgcaaaacaaagcccccacgaccacccgtctccacgtcgcccccatccccctcacccttcttaccacaccataaagaaacacatcgcctctctcacccaaccggaatactcaacaatgacactcaacccaccaccatacgataccaagatcacacccactaaaacagctccacacatcaccctcaacctaacaacccagcgcaaccacactcaaaaatacaaagaggagg

SEQ ID NO: 15966 - DNA, 895 bp, Homo sapiens
cgccccgtacatgatatagagacaagtgaactaagaaaaacatgaagaataacataacactttgagttttaccggcactacaccattttttccctctccgtcatggcactgaaaaaggacttttgctatactcctacttctacgtcattaaaaaagcgttgacttttcgacgtaagtgaaagttatgaatttgacaagtattatttgagaatgatacaatgaaactcctataatacctattcaaaagaaaaatgaacgtaaacaaacccacgccccacaggcacgagataggttgtgaaagaatgatcacagccgatagcgatcaatcgcataattcactcttaaataaacacatcatccacacagccttaacgtgtccgacgttttactaggctcactctcatcactagtgtcttactttctttacatgctccgcattactctgcgtcctggttcttcttccctccgaatctcgcccgtccgctcgcacgcgctccctatcctaatacaggccctccgttatagtattaccattcaccggatcgaggtcgtacaatcactcctctatctcactgccctcgttgtgccagctccttttaagtctcttcgagagatattacgccactcgagctgtattttttagctaatacgctgagccactagcagccactttccctccctagccccagtgctttttgtaccacgcacttgttcgctcgcgtattcatgacatggtagtatcacgagtgcagctacctggacatgcagtcctccggtctcatcagactcgcgtctcgttcaatgagtgaagtaccgtcgcgcctgttatttgcgcagccgttcagttatcgcggaagatagatctagtgagtaatacagttgagactatgtgctg

SEQ ID NO: 15967 - DNA, 192 bp, Homo sapiens
cctagatgtcatggcaaaggggatcagtaagtccaaaacctaccctccaaatgtctatcagaagtcagatcccttcgactctatcagagcacacatcccatatggatcaaagaacccagacaagactccagtacatggtggacagcatttatcaaaataaaacgtgaaaccactcagtgaaaaaaaaaaaaa

SEQ ID NO: 15968 - DNA, 819 bp, Homo sapiens
ccacctcacttctcacttcaccattcaccctactccctctcaccaccaggacgacgtgagtgtagctactcctgcttttttttgatttccatcttgcatggaatatttttctccatccgttcgttttcagtctgtgcattcacctacagccttcctatgatggatgtaaatggttcatgttccacgattgtcttgttagaatattctgaatttgctttatatcttcagatgttattgtgctaaacattagcatttttaggcttcagcgtgaagaacttcatttagtatttcttataaggcaggcctggttgcaataaatttactcggcttttttgatggggaattccttatatttctctcacttttccgaaatatacttttgctttgcacagttatcactacacctctatatctttaaaacactattatcataatctctctacttctttttctctcttactccccccctccccccttttcgtcttctctcacctgtctgttctttccgcctcatttactttttctcgtgacaaatcatctatctcctccctcttccttcatctccttgagataatacgtcccctcaatggtattaattcacctccagcgcttctatcccttctactccatttcctaccccgttaattacactacactcttttccatcccattctctcgctcctaacatctcaaaacactttttggcgctaccttccctatcatcactcccgctaacatctggacacatatcctcacattcattttcctttgttccttcttttcttttgttctcctttatcctccttgttttttactttt

SEQ ID NO: 15969 - DNA, 911 bp, Homo sapiens
cctccaaccccgggaacccctatggggacctgcagaacaaactagttcataccaatgaacagtttcctgtagtcaacctgggacctcagagtacggcaaagaaaaccactgcttaggtccagtctacatgctgaccttatgaaacaaaccagctatagatgccagagacctaaacagatagactgtgaattcaatttgaggaaaacactgcagaacggttcttttgataatttacaatctttcctatctgatggcaaaaattgaaaagtgttataatattcattgttgataagacataaatgggaaaatggacactgtcatatctcgtccagcggaaacataaatagcacacattcttggaaagacaccaaaatacacccaattatgtcgagacacagttgccagcgtccgaagaagacccgattaagtacacccgactcacgacacaagtacgatcgtccaccccgaccgactccaagcctgcgcaccttccgacctcctcacccccgcacaccgactcacctcacctcatctccgccagcgcacacaccacaacctcccgacgaacgcggccgaaggagcaggacgaaggacgcgccccgcgacgcagcaacttcaaaaacaaagccacaaccgaccacgatcgacctgttatcttcactaaaacggcgcccctgcggttaccgctcgcacccctcagagtgtgccgcgcgctacaacgacacccggcgtattcgtaactacttcgtatgtcgcagcgcctagccctcgccgcgcttctcatcctaaccgacccgcccttcttatggtgcaagatatcccaaacgcctacgttgagtaaccgaatagctgcattgagcagctggtggatctcggctcacctacgcttccgaaatgaacgcaacactgtg

SEQ ID NO: 15970 - DNA, 606 bp, Homo sapiens
atggaggagaattgatggcccaaagtgactgtcctgccctgtgatctgccctttagtggaagaaacagcaaaaccggcatcaactaaagcaactgggaacatcaagtttttattcatttgttgatttgaacagtatttcattctgattttaactgacttcttttgcattagattaaaaacaacaacaaaagactgaaatcattcaagaacaaagaggagctggcctataaatcctaaataagatgtagtgattgaacccatctaggtagcttatgaatataaatctcacccaaagtttcatccacacttaagagataaccactgttaatattttggcaactactcttggaagtatttgtgtctaaatacaaatacctatgcgtatgcaattttacttaactgtgatcatagtaggcctgctgttctgtaacctgtgtttttttaatcttgataatagatgatagaaatcttttcatttaaaaagcaatgttatatatgaagcaaagtttgcttaaccaattttttacttatgctttcgatttttcactattacatgcaatgctgtaatgaaaaaaataaaaaaatggccttgttggcctcagctgg

SEQ ID NO: 15971 - DNA, 1149 bp, Homo sapiens
  misc_feature (1)...(1149): n = A,T,C or G
actatatatttgtatactgtgtctatnattcagatataatattaaacgtaactgaacacctaatgctctgtacacaccttccagangactttttaggcagcgcnaaganctccagtatgtagttactgtactctatcaagtaactatgcagattctagctaggaggagagcgtggtaccagaatgctccattggaaatcataggttgttgtccagtttgagtctccacacaatataagcggcgcatgtgtctgtcttgcntctctaggtatactactttattaaaataagctacgaattttaagtatctattgcacttgtctcgtcggttgatagtatgacctaccatctatccgtcatgtagtaactcactatagaaaacaaacaattttcgattaccttcctccctcacaacggtcgccttatatttctccttgcaccaaatagtaacattctangtaatattgtagtgaggttgttatatgttattagatatttattatcataattgcaagtttaagtcataatcaaatttgtagtgtatgtctctgcgtagattcgttggagcccagataataatttcttcctcgtcctatattccattatcattgtatttacatattattatattgtcctcagtaaatcgtatataatctctaagttctccatattttctttcgagaaacatcaatattatagcacacattttattttcaataataaaangttattattatgatcgtaatgcatcactataatggctctagtcttacttttaatctagtatctataaagactgttctattgctctatacacttcggtgattacaagttccacgagcaagattgtgtgttatgtgatattcactagtccaaaatcccccttacatttctgtactaatctatactctattctccatgctatttgatactgattgtacattactactgtgtctactgtgatttaacataccacgtctcgacatatgcgcgtacgatttacattaagtaactatatatacgtgtaactccatcatcgtcaatcctctcgcagatgataagttatancgtttctcactttctaacacatactattagtgtactcttagattccgatatatcaatattgattgattctagactacttatt

SEQ ID NO: 15972 - DNA, 846 bp, Homo sapiens
cgacgggagacacagaaggttagtaatattacgacacccaaaatacacaactgtgttgactggtttgttgaactttatggatggagccagccaacaggatgacattgtggcagagaaagaagcttgcagcttcttgcatcagaaaatcagatagagcctctctggcaagaagctgcagacacaaaagaagcttgcattgaaggtgactcagctctggcttttcagcaatgccctaacattggctatttaaaaagaggcaaagtagcttcagtgagacctcaaaccaattgcacagctagacactgcccataaagaagctactggtcagaaatgctggctccttcatagacaaaacggcaaagtacattgataggggctgctggtccaggaggatctttatatcctggccaagtatggcatttgtctctgtcacctggaaaatggccctggagcacgcatgtgacctgactcgttctgcaaggcctccatacagcttaatgaagaaggcttctagctaagaaacagatgggcatatacacatgccaagataacttccccacttgtctctgatggaaacctcagggccatgttgtatatggcgtggatttcgggacctaccatatggaactttggaggcccatcccatgcccattcagcagtttgtgtcataacttgtctggacctcgattgattataaactggggaagggtaatagtgatgacactccttgtatctcggtccttttttattaaccattctctcatgtattcctatccacgtttaccttgggatgggcaccttcacacgggacttagattactagataattacttgtgtccagatctt

SEQ ID NO: 15973 - DNA, 266 bp, Homo sapiens
  misc_feature (1)...(266): n = A,T,C or G
attgtgatgtgcaccatggatcaagaacaggctgtaccgctctccaaatgtatttgattgctgaacccatcaagaaggtgcatggctgacactagcattccccataaatgctcctcttagaagaaagacactttcaagataagactttgggagtccattgaagaaaaacatgaatgtacatcaggtggtaattgtcagncggaagatttttcttaaagaaaaagggctgaaagtaaaactctattttaatattaaaaaaaaaaaaa

SEQ ID NO: 15974 - DNA, 965 bp, Homo sapiens
  misc_feature (1)...(965): n = A,T,C or G
aaatcaatattcataatgcgaacgcattaccaacgaaaaaaaaaaccttatgggacactcaaggccggctctctngganagaaccaagnanaaacaggagacctacaggagaacacaggcttgaagagcataaacaaaaagcataggggctcgaacactacatggagaccttagagctagagtgaatctagggtctagagtccacatgatatgagactacatgcaagtccctatgcctactcactcccttggcctttagtctatatgagtactattcactctattactattttgcgaactctttttttaactaggacaaagcatgatctcgagaacgtgtaccagagcaaaacactagggatcaaatgggatgaagatagttgcgtccgtctccctgatttcacgtcatggtgattgacctgttatatcacccttgatgcgctatatcgatacaaagaacataatttcttaaacatatattaataaaatttcgtgattaatatatgccatgagttgagaaggagacttatatacgtgaaataaacacaggagataagtgtttcaatatattttatcctaatgttaaataaacaatttctcgcgcgatacagattatccataacaatcaagtataatcttcaccacgtatttagtaataaggaaaagaataacgggtccatcctaccccattccacggacactaatttccgtaattgaacgcttattaatttcatcatgtatttgtatatacgtttatggaccacgtacaacaattacctcaacatacctaaacgtagatatcctttagacgaaaggttaacgacacgttgagatgtgataattcaattcacataatcgttatctgtatacacagtgcgcacaattattaagataaggaaatatgaatatagcagatagatacaacctaataccaatattaagcaatataaacgtactcaatgtag

SEQ ID NO: 15975 - DNA, 778 bp, Homo sapiens
atggaagatcaagaaatgtcacttttctgacaaaaaaaaaatgtctaatgcaaggagtgaagagagctttttatatcttacactggccacaacacacagttcagaaaacttaaataaccctaactaaaatttgaaaggtgcttcaaagcatagaaagtaccttgacatgtattttctcattggattcttataaacctataaaacggtgcttactccatttcagaaatgagaaaatggcgacccagaaaataaagcagcatgcacaagactacatgctacacaggggactgatccgacaccaaaacttgactgcagattgtctgctttcaactctcaccagcaaaacagacagaagtgctttggacatgcaggtgtttattatgttgcattttggaactccagacctaaaaccaaacataggcaaatataaaccaaaacaaaaaaacactaaagatcaaacccattctcgaacccaaacacccagaaaataaaaggaaattattattatttttttctcgggggaagcaagtggttgatttcatgtggaattaactctcaactctgatgaacctcatggtctcctggatcttcccaaaccaaggctctgggacaggaattaatcagatggaaagtctggggattatctttccaccatcactgctttctgctgaatgctgacttaaagatgtgaatccacttaattatctcacagataggaagaagcgaatttataggttcaccgacacaaaaatgagagcccaggacagtccctaagatt

SEQ ID NO: 15976 - DNA, 810 bp, Homo sapiens
tcatataggtgtacttatgtagctcggctatatcacaacgattgcgctatctttagtagtcatctataaagtaagtagagcaagagatttgatattgtccttaagaagttggaagaacttaaggatgagaaaaaggtgtgaatacccccaaaatggacagcaaataacaccccccatcacccaaaaaaatctctacaaaaagactgtgcccggccatgggaagttgacaacaatcaattgagagcaatcatggaatccgatcctcctataactgcccatttctccattgggttgagatgtaccacaaatagtggattttatacaacaaccagcgatggccagctcagtggttggacatagaaaaaacttcatagttcttccctaagccaaagcttcacttaaaaatgttgatggacactgttagatgtactgctgtcacttatgatcactacaattttataaacccctaaaaaacccttacatgtgagaagattagtcattttgttattgtatagcaatgataacttgattgccttcacatcaattcgatccactagatggtcctactgtttttacccataacgcactatcgtactctgctggcgcaattgctttcacacaggttttcctgggcaatagaattttagctcgatgtccctatgtctccgtgatcccttgttaaacagattacactttttataaactagtgaatacttatatatttggattatccttgtcactttctcaaagtacaattcaacttttttttcggcttatagttattggggtaacgtagttaggcgttaaaat

SEQ ID NO: 15977 - DNA, 788 bp, Homo sapiens
  misc_feature (1)...(788): n = A,T,C or G
tcgttaggaattaacaccggtttgtctaagctgcacgtagctctcctccaacccagactccattcaaactttggctccaccatcttaacttttgatcttccaagatcgccctgctgccctgcttcaagcctgcaaaagaggatagggggtcaggccactcatatttcattgtcccaaattcagtcacatggccacactcactgcaagggaagctgggaaatggatgcggtcgnctgngccctttaagcaaagaaaaacagatttgttgaagacttagtcaatctctgcaacaatgaaacagataagatttgtttaagaaaaagaattttacaacctgaggagggagagaaaattcagttaacaaaaagatagactacatgccaaggtagtctgcataattctacctacccaaattatgtgttaaattgtgaaagaagttatgataaaaataggatgagggtgaaatttgaaaaatgctctggggacacatagcacactcctttcctgatgacacaatatgcataaccaagcccactataaaaggaagctcactgtgtataatctgctgctcggataaaaccatactggaaaaacttttcatttcacatcctaactgatcatctatattcgcagtataccaaatactcctagctggatgaaatacctgccagctcccacttacttcgaaaagtaacttttgtattaaagggaaacgcgtacaaatgggactttaacccaataaatctatcgttttataatctgtgtaagccatctgatgaaccatgaca

SEQ ID NO: 15978 - DNA, 851 bp, Homo sapiens
gttacttgggtcttattatttatttatattgcacctgggtagttactaggcacatcagactttacttgttcttcgactgggatttacaccattggtttaccagattcttggattttcaaacttagactaaattacaccatcagctcttctgggtctccaacttgcagatcatgagacttctcatcttccataattatggtcatgctctgttgcccaggctggagtgcagtgacacaaacatggttcacaacagccttgacgacctgggctcaagtgattctcctacctcagccgcctgagtagctgggcccacaggtgcacgccatcatgtatagctaatattttatttgtcggtagagatggggtttcactcctgttgcccattcttaagtaacttgtcttataacatgcctgactaagataccctcaatggtattgttgttattttccattcttcttcactcgcaattattatttaacccatcttgcttaaataaaagataaaaaaaaatggccttttttgatctcattgttaggttttctattgttcttatatcttttatatgggtttatttatgatcctgtcactcttgcatcatgatctgtggtctttctgtttcttcacgcttttttattttatctccaatttatgatacacttcttttcctacatcattacttggataactttatgatttatactgtgagcaataagccatatatatgcctcttacatttgtatatggatctggttatttttctattctatgtatcctcgcacttgtttagtatgttatccatttatctcgactatactatttttttatttactaaaattattatttctattat

SEQ ID NO: 15979 - DNA, 540 bp, Homo sapiens
ctggacaatgacttatcttccctattccatgaatctcaaatactgtaatggattttctatgaactcactcaaggcaaaaaattttgagagacacattcaacaaagtgaaaaggcaacctataaaatgggagaaaatatttgcaaatcattacatctaataaggggttaatatccaggatatataaaggatccctgcagctcaacaacaaaataacacaattaaaaaatggccaaagggtctcaacagatatttcaacaaagatatgcaaatggccaagaagcatatgaaaagatgttcaatatcactaattattaggaaaatgcatatcaaaaccataatgagatatcatcttacctatcaggatggccactgtcagaaaagcataaaataacaagtgttggtgagtatgtagaaaaaccagaactctgttctgttgctggaaatgtgaaatggtgcaatcattatggaaaatagtatgatgcttcctcaaaaaaattaaaaataaaattaccatctgatgtttgggaaaaaaaaaaaaa

SEQ ID NO: 15980 - DNA, 1100 bp, Homo sapiens
  misc_feature (1)...(1100): n = A,T,C or G
gtaggcaggaggaagactgcgatcatgtaatataccgagcgcagaagaagaagagagggaggngaagagaacgcttaaagaaagctaacgacaccactgctgcgcttgttctgcataaatcgcctcctcgtaacacgcaagcacgacacgtgctctcaacacgaggcgtcctcttatttacctgggcatacagtgaagtatacgcagctctagctttgagaaagctcacagggaggcatgagcgcttcgtacgccctagaatatacaataactgcaaatgcacacggtacctgtatccgctgtgttggtgtacatcgcactgtgcaatccacacaatagctttgtggagtagaccatgagcgcaggcgcgccaatcaccagcaacgtgcgcgagtacctacctcttggtcgcaacgatcggtaaattactccacactcgtggtagatacgaaattcacaacacaatgtagtgatatgggtggcgcacatagccgtcgtatatcatagtatagcgccccggaatgccgaagagtgcgaaaaattacttggaaccctggtgaggtttgagctcggcaccccacttagaaaacggcacgcaaccgaactgcacccctgcggcagaactacgtgcgtactcgtgcctcggacgaggatttgaaccagtcgagttacacgcccgtccattcacaaatctgtctccctctcgacccccgcatgtgatagggcgcaaaccgcggaccaatactactccgaatccactccctctccacgccgcaccgctaaaggtagtgatagtaatgcccaatgatcatcttgcgttgtccaataatatctaacagtacgcgcaaagcgatgtccagctctcactgtatatgctcgcgcaacggtgatatcaaaagactagacgcatcggtgtgcggtacagtagcgcgaacgtcagggacgattatgtttgttaagaaggtatgtcaaatcccccccccaccagtctgattacccagtattatatctacttagctgcctcacccagtaatacggatatacaagtataatcattctctaatactcacgatgagcatacgtcgccgcagaactgacag

SEQ ID NO: 15981 - DNA, 1409 bp, Homo sapiens
  misc_feature (1)...(1409): n = A,T,C or G
gagagcgagatacagtctacgagcgaccacgcagcagctcgtatatcngcagattagcggctgcnacttgactctgataagcacgtgcagancaagcgaaggccagtgatgtaattgactgcttgatacctgtctactacgttgtcgagtgtcgtattcgnctgctgcgcaatctcgatactagtgacggtatatacatgcagctactagtgtgccatcaccgacacaagttgtgatcgtcatccgctgcatgatattgaacgtttntactnctacagcactactnctacgatcgatcagaatagncatctgagtatactgacatgaagcttnttatatatnactcgattatatagagatactcgntcctgatactgtgatatcactgcagatgtaacttctaaactgattccatacacaccacacacacgtcacgactacgacgcgtgngtggtcaccgttgtgattaatcatgggatgtccctctcacgtatacatgtaagagagcgatcctgcatgtgtggtcgtacttgagcatagatgtcacgcgggtcccaagcgcatagacagatctagagtatcgtctcgtcgcgncgcgagtgcaggtatgtctncctcgcgctacgcgtttggcacgantgtgggttgcacatgcaaagtactagacgaacaatcgattatccgatgtgccactggtcngtgctctccaacaggctgcgccgcgatcctacgtcttcatccgcgagctctggtagaccacgtcattcgcgatccttgcgcacattcactactagttccactcnganatcccctcggcgaagtgtactagcacacacacgatgctcacgtgtactcatgtagtagagagattcttcacctattgaagttacgctctatagacacatctaggaccgaagacacacatggtcacaaagagactgatagcatcgcgtgattcgtgcccgataccacgtatctttggtctatatctagacattatatacgctctatattcgctctacatcgattatagttatgcggttctgactctgtctatatataggngcgtccgagagtgcacatgctggttngcgagcaaagtatgcgtgaggcgggtatagagtggagngacgctgttagtgctcttacgacgtattctatagtcacgtccttcttcgttaccgccgatcgtctgatcgtgtgcacctgagataacaccatatcactcaaagtagctacatcaccatacatagcacatatcctcatgtattgctgtatttctactctatacaatcgtccgttagactctatcgtcgtgctgggacagcgtngactgtagtcagcagctccctctctgcgatctcgtgccatcagtggcggtttatgatgaggacggacgcgatagtaag

SEQ ID NO: 15982 - DNA, 2481 bp, Homo sapiens
  misc_feature (1)...(2481): n = A,T,C or G
ccccccccnnggcccccggcnnnnaagggggnngngnacnncggcaggnncgcgcagngngngnngcgcnngcagcacangcnatgggcgggcngcngagngnnnagantgatgngattactgtnactagngtngagttagcannccgcaacgcgatgtanntctancacacncatcacanagcagctgcgncgcangatgattgatcggggggtantgntntatctncncgctacgcataantntncatactanacagcgatnatctgcgtcagccagcagntcacactacgcgatnatgtagtattctattatcatctcttagtagnaggatgtatnacgtactatctagtgcagacagtcgagcgtcgatgtgtcnctcagcatgacggtancaatcagtagttgcagtgtagcncganacacgtcagacgccaactcaggatgacacgagtaatatgtgatctgttacntggnagtgagggcntgtcagntagacgactaggcncntatatatctcttcnatnttgcacgacacataccagtgatcgttagtagatgccctgtcgtgatgtgtgattatcagacgcnantcatgcncngacacgcgcacgcatttgagcagcataggagcgagttatacgagagttgtantgagngacgnatagtatgcacgcagatcganagacacacagacganacgcacagtgatcgacagcntgtagtgtactgaagcncaaacgnacncancatatgtcgaagtagacgagtaggacgaagatgcngcatcgacgtgtananncagatnatacatacggatgngtangcagacagacgcatagtcgtagcaggcncgtacngacgcgcacgcatgagttatcgtacgtacgccgacgtctgcgcgcnctagctgtggctngcagggatctgcnagcgcacagagcgtagcgagcgacgagacatgcanatntgtgtgacaagncgaaacnacgagancacgatnagataggagacgcagtagtaanagcgacgacacnatnggagatnatanttacgnaagncgagtctanantatgtgtgntgtagagagttngtgnttgtaggtggagcgatgctcagatgtgaagncagacgtaaacgcgcancggtatagtacancaacacacacaatattaacntntagtagtaccgcagcaccacgaggactcaacaacaaagtagagagagctacgcgcagacagtaagtatatgcacgagagttcaacgagcagtanacgacagtnatatacacgctgtagtggtgcagcagcagcgtcgacctctcagcgggcntaattcgacagacgacatgaatgtnatatntgtatcacactcgcacgaaacgaggtnattatgcagatcgcgcacagaccgtcatattagcagcgcgcgcgcaggtaacnacgcacgacgtacacgctattatcacgccnantntcggtcgcgtataacgcagcatcgtcgcgcacgccanatattagcgtgtagtagcagcctacgttagtccacagtatatncgcgtgtattcgtcgtgtctcacagcatgcgagatgcggcatgtactcgcggatagtaatcaaatcgatatacgcaaagatatatgatggcgataacgtgtttattgcgggtgttcggagtcgtgctgcgaattagtcatgttgtgagcaagcgtagtactagcatcattccagatatatcagcggatgtaactgtagtgaaatgcntgtgtttnatatacccgtgtatatatatagtccgtaagcctgatagcagcgcgtgataagaggatcagtatacacagctgaatagtaccaggtcgccacgcgcctatgacaagagagcgtaattatgcagtgggaataacgagcgccanaatagtataaccacgccagtacatgcagacgcgtgtataatcgactncgacacgcctataaatcntgcgcggcgacatcatatcgatcacacatactcagtaatatacgcgtgctatacaaggtacaatntaacacacgctcgttatancacgcggcgcagggtagnagtataganaggtncggcgntgcgactctgcgcggtactgatcgcagcactgctaatgtgcgacgtgctatcaccgcgtgtgagatatatgtgcgctncttcagcntcgtacacacaacgcgcgcgatgcagcgaggcgacgcanatagactctgcgntgttcantatcagtaggcgatcgtgatnatacagtcagnctggcggcgcgatcagactgcgcgcggttatagttagagtacagntntgcgcgtgatacaagacgagtggattagaaaagagatgatagttctagtactgcagcgcgcgcatatatacacaantcgcganataagagcgtgtgatatagacatatcggctgnagtgacanaggcgtggtggatagagancttagtttgcgcgtag

SEQ ID NO: 15983 - DNA, 199 bp, Homo sapiens
ttatcccaggagaggaaaacctgtcagaagctgtcaacatgtcatgcacatactgctaaagttttgctgaagtgtcatcattctgtggtatccctgaccagcctcctctgccagagccatgcaaaaacaaaaagctaagagctttatacatagctctcccaagaaaaaactcaagtaaacacaattgtttgagttagaa

SEQ ID NO: 15984 - DNA, 806 bp, Homo sapiens
caaactatagctatatattataacaaaacgccgcccccactacattctctaggagaagcgagtagaagaatcgagggtgttgcaaatcaaaagcacatagagatatcatcttacaccagtcagaatggctattcttaaaatgtcagacaacaacagatattgagacaagatttcacttgattggtctcaaactcctgacctcaagtaaacctaccgccttggccttccaaagtgctggggttacaggcgtgagccactgcccccggcctaatcatcgtgttctagtctgccctccaatgggagaaacaagtaaaattatgccatgtgaggattattcaccaatttattctaattacttttttctttataacatttaacaagatcacaaattatataacacagttatcagctttttgggaagttacttttgctggtttcttataaaactgatggaagacacaaacactattaaagaactgtttgcatgttgcacatgatgtccaaagtccaaatattggtaatcatttatactctaatcaacatcccgtccgacacaaaaaagatcggcctcactggacctccagcgtgtgagtattacagacgatatccttatttgcgggcgcattcttaaccctccgttaatgcctccccgccactccgctattacagttccacgcaccataataagttactttttgggtattcttcccgctttcccttgacgtccgagattattccggaaaagcacgcgggccaataatcacatagcggcctcaattgtaaataatgatatacaggggcaaacg

SEQ ID NO: 15985 - DNA, 763 bp, Homo sapiens
atgtgccttggcaaatgccagttatcagaaggtttgaagaaaactcataaaattgactcaggtgccacaaactcaaggcaagcctaattttaagggggaaagactgagataggaagccctgcagacttagccactctggcatagtattagaaggacaatgacctgaatagaacatctggtagaccaaccaggaaccattgcagtgctggcaggaatccagaccatccatagcgttttctcaaccgcaagctgagcagaacaagctttaccatagcaataagacacaaaaagcagtagcgccagtggattgactcaaactgccagtcctcagtctccacctggcttggaagtaagaccgacacccgctaaactgagtacacctctgcattcatggaaaattaattgaaaatcaagacacttgtcaacctttttgtttccagctgctggagcagaccacatggctaacaatgactaagtacctgttacaaatcaggcatcatagaagaaacttttaaaatgttcccaataatcaatgagaagttgtgattattctaggcaaacagagtctcagagaaagataaaaaaataaaaaagctgttggtcacagacataaagttattaagcggtagattgaatatttaagcccaggacaccttgcttgaaagtcatgtctttctactaaataatttggccgcacttgaaaaacaaaaaatttcttggggagacttaccgataagtactcagagacatcacgatcttaacg

SEQ ID NO: 15986 - DNA, 713 bp, Homo sapiens
attggagttgtcctggtgtcagcctcagaagctgtcattgtctatcagtgactacacgccaggtttcttgagctgccattaatgagataaaattattctttgatggcagtggccatatgacaaggattgagaagacaaggatccctggattccagaggattgtcacttagttatttcaacaaatagcgtgtttcaataaattttccacatagaaaaaaaaaacaaaaaaatcttaaagtcacacaatagagacactacggaagtaatatattacgattttgaaaagcccggcagcatttatttaattgcgatttgcgattttggatatcactgtgtatttctaacgttattgaaataatacactattttgaaaaaattaaaggaggcctaatagtccaattggaggatcttcacagcctttagcatccgaagagggttaaattctttttctgtacaacttatacgattctcttaatttttctacataaaagagtagataaaacataacatcatgattgctttcctgtgcttcatattattgccggctcatggataaatgacttttactccagaatgtccttgtaggttgagaaacattatattatgctgttaatattctaaagcacatgattactaaatttagtatggacacgtaacagagactacagatatcattgaatctatagttatgtgtctataatgattgtggttat

SEQ ID NO: 15987 - DNA, 821 bp, Homo sapiens
gacaagtatgcgatatgtattcgttctacgacgacgccaggatcccctagggggaaaacaacatgaaccctgtgggctaacactccaggacaaaggagtgagggaagctgaaatgttatgattcatccggtcattaccacaatggccacacgcatgtggaagagaagctcatgattctaatctgcactgatgctggcggctagatatagcctaaagaggatgtgaaacagcagcttcacttgcaatggagatccggacagtaataaaacagtttttttttgtcttcactaaatacatcttagtttgcatggtctatgtatattgccctggggcacgcgcccgaaaatattaaatattattcatcaacaacctataaacaacaacctgcctctctggtctcaccgttggacctctgcacccaccaccctctaatgaggtttcattcatcatcccccctcactcgatatctgcgcctcgttaactaatctcgcgttcatcgctctcaagtcactaactggcacgcactactgcaaatcaccccatcctggtgattccccctcgactcacattacttactataggggttttgcgaggccaagatactctgtacatcggttgcactctgtcaatccatcattattattccccccccttcttacctcacccctctccacactacagagatatcccctgttacacaactaacaacgtaaccgcatcttaacccacacccctggaaacttgatcgattcacggtcccccaatcattcccctcttcagttactccccttgtttactatttcgtttaactctcgagataa

SEQ ID NO: 15988 - DNA, 840 bp, Homo sapiens
  misc_feature (1)...(840): n = A,T,C or G
aaagagtaagaaaggtcgtatgtgaggagacgccgcccaaccaatacatcctgagtgagcagctagaacagnatgattctggataccagcatagcgcacacaagctctttgtgagctgatcgttcagagagagggattcggccaaacagcccccatctctacaggaggccaccaggatgctgctctcacctctcaccaggaaccagagactacagaaaaagcaatgcaatgtctcattgagtttgcctcccatcagctccccctccctttttttactttctgattccttggatgagctaatccatcatgagaaagccagaagttatgaaacgacagtgtgtaaagagacctttacaataatggtcactggactggaacacacggactccgaacacccgcgcgctgtagataaacaagacgatgcgttcaattcaagagaaaaaacagcaggagcctagtcgaggccagaggcgcaaccctgctacccaccgccttcacggcgggcggactgatgatcctgcctcactgaaatcgcgggccgggcactccctgctgcgctagggaggaccccacagccccaagtaggcgcaacgtcgacgcacacttcaacacgatatatctcatcacaaaaccaagatcccaccgccccatagtgtatcgccccccattatgacgccccggcacagcctaatattaaggtccgcccgccccaactaactgcgcacgaccgcagcgcaaacgcccgcggtaccgacacccggctctactaggacaccaaaactctacagccacgagacgcctcgagaaaataccccaaacaaactccgcagacacggaagg

SEQ ID NO: 15989 - DNA, 782 bp, Homo sapiens
ctgctagatggagtttcgttctcgttgcccaggctggagtgtaatggcatgatcttggctcacagcaatctccgcctcccgtgttcaagcgaatctcctgcctcagcctcctgactacctgggattacagatcagtctccaaccattttcaccctctcttctctaggctgacctgtatgcacaccatcaacaaattattttctgccctggcttccagctgggttcagtcagtgaaaggcactggcagaagactgagttgggatagggccttgcataatttagttcatgttctgggctaccagtaacgggcatacgtcttctaagaatgggaacatgaggactttcaaattttgcacgcaagacttgaaacatatggtaaaaagacaagcaattaacatttaatcaacaaatatcacttactatgtgaaaagaaggaacagccagactttgtgactacaaggtattcctaatattatgcatcatttctgcctcacaaaactaatgctatttctatagaagcttctttatttagtttctgtaccaacatccttaattccaaagatattgccaccatttcagtgttcgaaattctatatggtttataaacaatatagccataaataagttgaaaagcattaggaattttgagaagcagacaactccattagctacatattcgaatcctgaattgtcataaattcttccaagaaaaaaagtctaattttggaagagccagaaaaaaaataaaagaataaaggaataaaaccccaaaaaaaataaaa

SEQ ID NO: 15990 - DNA, 799 bp, Homo sapiens
catgacagttatgatattaatgctatatattatttataagctactaattcacattttaataaatttaggcactttgtgagggtctttatacatcatagaaagtggcccatttttataatttctgtagtatttattgaaataatggcaactaccattaatatgaggatatgattccagtaggctctagcttattttaaagagaacatcttcacaaagaattataaaaatcaatatgaaagtttgtataataaggataatataaatcagtatttgtgtggtatattacactttctgcttcagtcccaatgtaaacctaaccataatcttaacaaacatctttcaagaaaagtagcagacataatcagaaatgaaaaacaagaggctgacaatgtgactgtctttaacttggctttagaaaatcaatctttttgttttgagccctaagcatgtgttgatctaccccacctaattattaattataaaaggcttttcaaaaatgtttagaaaatgggacactcttataaaaaggtcttttttttaggtgaaggtttaggggggtaaaaaaaaacccaaaaagttccccctttttgtttggcgtggaaaaaaacataacggcgaaaataccgcccccggtaaacccttcctatagggtccgagggagggaggatgtaaatgtttatcttttatatccgtgggtggaaacttagatgaatttaatatggcgataaaatctaatagcacggtaatgtcgctcatcaaccaatatagacccacaaaaacggcctacgaaagcggggtg

SEQ ID NO: 15991 - DNA, 901 bp, Homo sapiens
ccacaaaaaagtccgagtatgtactttacttatcaccaccgcagacttcaccctgttataggacatgcatgctcggtacattgaattccatgtggaggcttaaatgcttgtatgtggccactctctcagcatatgattgcactgatgatgcaacaaaaaagatgaaaaagatcttgtgatatgattgacttaggatacaacatagcattgatcaagcttacgaagctctgatatctctcaccttacctttgagactaacattcttctcggtattcacctaagatttgctctacggaaccgatacactcgtcattagcatgctcctcagccatttcgtttgcctattgtacacccactcctgtgtggccccacatatactcatccccctagttactccccccacccgcacccattgtcaacatcccccgctacaccgagtccgtcgtgttccatccctgtcttatccaagtatgatactcacactatcaattacttcataaatccccacacttgtagttcacctgacgaatcactcatcaccattctacaagctacaataatcagtcaagacgtaccttataccctatacctgtcgctcacactcctacccctaccatcaaattactccacccacccctatctcgtcgaatgtgtgcgatcacatgtgtcgcttcatcacctttccacccatctttatatgcgtgccccattcagtattcatcctcacacccagtctcgagcgatgtgacgagcactgcctaataacgctcctctacgctttgtatgtcgccccgcccccgtatcatatcctctttattctcatcgtataggctatctcgccgctcctttaagacgatcccatgcatctatgccccctcgcctcccagccccaggtcaatgt

SEQ ID NO: 15992 - DNA, 472 bp, Homo sapiens
tctttttgtcaggctggagtgctatggcacgatcttggctcactgcagcctccacctcccgggttcaagcaattctcctgcctcagacccccaagtagctgggattacaggtaaaagaccctgattgactgaacatgccagggtccagtgaccatgactgatcaaaacaattcttccatatggcagagtcatttggaagaaaagcaacagcaactgcagtggccacattagtgtaagcaggagcagttcttagaggaagaggttgtttggcagactaaataaaaaataaaacttgtttaatacaaacctatttgaacattaggaatgtagagaaattccctgtggacctcagacataagagtgtaaagaaaaaaaaagatagtttgcaaacatcggtatgtgagtaactaaataatacacccgtacaatacaatgggaacgaaaaactaatcgtgctttttggcctactcgt

SEQ ID NO: 15993 - DNA, 991 bp, Homo sapiens
  misc_feature (1)...(991): n = A,T,C or G
acccaattccatatttaacacccaccccacaccagagaaacattttagggctacctgngtccctagtctggagtgcagaggtgcagtctcaattatgccacatggctctgaggtccaagtaaaagataatattctgcaaccaactacactggagttcgaccatacaaatactctttctacaggtggcgataacgcaccctcgaatgccagccttctctgcgtatggaatagaatgactccgagcattggcgattggtagagaaacaagatctctccgagcatccacgctaggcgactgcggcattgtaaccaatattgtgctttcgcaaacaccctctgcccctactcactacaccagcgcgaatccctcttgcagcacccacccacgatttatgccacctcaatcagttcacgggccgagtgtgacaggtacgctccccacctgcgccgtgtcaccgcccgcaactctacaccctcgcatatccgcgacacccacattcgggatccaagcgcgcgtccgccagtcaccccagcggcggactatccaccacccactactagtcggccatcctgtacaactagtcatcatcactaacaaaccccatcatacgagtcccctgatcgcgcctgttctggtgtaacacacacacaccacgaccacgacaacacgaacctctatgtataaggtctcaaaacatgacacatatcacaccatagtcactctaactaccagcgcgacgtcgcgctcggtattgatgactcccccccccacgcatctacctacctcaacacgcccatgcggctactgttctacaaaccgacaccatcccctaactcttcagtccagatcgcagaatcactccccaccctataaggacccttcaaatccaaacataccgctcgcaccccaccacatcactttcacactctgtaacgacgatccggcgttgttgaccaccgagacacataccgtcgatcccactcagctacg

SEQ ID NO: 15994 - DNA, 784 bp, Homo sapiens
ctttgattgttacattgcaagtatatttaaaatatatgtgtcttttgtgggaacacggatggagttgaaggccattatgcttaacaaactaacacaggaacagaaaaccaaataccgcatgttctcacttataaacgagagataaacgatgagaacacatggatacaaagaagaaaacagcagacactggggcctacttgatgaagggcgggagaagagacagcagcagaaaaaataactattgggtactaggcttagtacctggatgacaaaataatctgtacaaaaaactccataacatgagtttacctgtataacaaacctgcacatgtgaccctgaatctaaaataaaaatctgagaaaagtgcaaaaaaaagaagtacacatagcctaaaacataattagtaaattcaatcaccacatggcgatttatttgaatggaatacttccagcgaagaaaactatatagttttgagacaataatgagtattaggttttggattggttatcttataaagtgcgtggctcccacccatttttttatgtagcagggataagattgcaagtataaaacatctcatcttctggcgttagaggggggcggtgtagacgcttccatgtaagaagtgtttttactggatcttaccctggctggtctttctggaacattgcttggaaagagcggatacaatagttatgggtcgtggacgggtgtctacgcaatattttgcgtctgtctgacgggcctcgaaaaagaactataagatggccgtgatgtggaaat

SEQ ID NO: 15995 - DNA, 841 bp, Homo sapiens
attcaatataattatatatttaatattatataattcgaaaaaaactctactacctgcaaaaattatgtggtttttcttccaaagatggattgatcaaatgcataatcgagagaaaggcgccatacgatctcggcgggaggaggatggatcaaggcaaaaaacacacaagaagatttgtaaaaataaaaagcaccctaaaactgtgtggagatgtgattcctctctctctaaccgctcctgtctgggatatcgtctgatgagatttttggaggataggaggggtagctagctccactgtgcatatgacaggacctgcttgtatatgtataatataaagaacattttctgcatagattccggggcactgcttctctttctaatgcttcatatactatttgctgttattacacattaatatctcatttataatttaattatactatctaaacttgtcatgtataccaaaactaatctgtacaattaccctttgattcctatcttctttgtacgggaataattattttatatgtatttaaacatataaatattaaagacttgggatctataaatcatatattatctcatatactataaattttgatgatatgtgtttataacagaattatttaatatcacacatgattttatctttatgtactactgacttctactcaatatttgtccttattcatattccacattcttttctttttataccaatacttctcagtctctctctacatataaacactaatattaatgtgttattaatcgttactcattcagtgaataatattaaaatatcttatttccgcggtttttctccatcaaacttcaatac

SEQ ID NO: 15996 - DNA, 833 bp, Homo sapiens
tcacatattatttctttataatataatgttactggcacactagagaaaaagctgtaccagcccatccttcacctttcacaaatggagcacagttctcttgtatctgctggagtctgaacttccctgcctaactctcgagccttgctctgatgactcctgtggaccacttttaccaagaggaatattcagctcatgtctgacttatcacctgatttctcgcccatgtatcattcctttttatatcctccatgacgtttttacctctgagtgaaaggcccatttttcctttgctgcgaatcctccccatgacctgctcctcccctactatggaaattcttcctgtcttaatggtggcactgtgttaatatcacgtactattgactcatggataccatcgttctctccctggctctgacacatttactcttttctgacttttccttttaactactctgggcccaaactgcctttaagatccagttcatttcaattcgttgttaactcttatacactctcctatagtgactccttacaattgtacaattattgactaccccagcctccctactaatctttgttaataatattgtaccacagttagaatataaattccatttacacatgcctccccccggctttttgcgcgcctaccatgatttcttcccattcccacgtcttagcatataccagattcgacatcattgttactttacacttatctatcttctccctacctactttcgttattccattcaccccgttaccactacccttccctctctatccactctcctccacctatttatcctacatattcactcccccaatatcat

SEQ ID NO: 15997 - DNA, 819 bp, Homo sapiens
  misc_feature (1)...(819): n = A,T,C or G
acgcgacttataccatcgtgttcactacaccacacagcccggcnaacgcttantaggagacagttgggatgatttcattactacaacagctaaagttggaagagaagctgaggttctgtttgagagcaacaacaacaaattgaaataggtctttgaagagcaaagtccagatattatctaggatccatgaccaactacagaaacaccaagtgtaatagcttgtgtgtttccctactgcttgttatattcacgcatttattttatgtactaatcaatcttttattccttctctttgttgccctcgttcttgtgtattttatatactagttattggaagttaatttgcatttcagtattaagtaaaagaatattcaatgcatcagaccatacatttaaaccacctgcgaattttgagaagtgagaaatgcagttttttatagatacaataactgtcggaaatgtgtgtcttctcattttggagaagagtgagagcttttccatttgtgaggagagatgtgcgccgtttaggtatacgcgtagagcttaacttattatcgtgaggagttcaaatctatgtcagagggatgcttatttaggagtaacacactactaacctaccctgtcctcacacaaaaacagcacgcctctatttggcctcatccgctggacctctgcagactgtttcctttcataatggattattgatgaatctagctaactgtactcggtagtttagcatattgttgatgaaagcggtatagctacccaaaaggcagcaactaggtattgccagaactagtggacacccacgaaagacac

SEQ ID NO: 15998 - DNA, 814 bp, Homo sapiens
  misc_feature (1)...(814): n = A,T,C or G
gacagggatgaatagataaactagataacgctctccaacacccagaacaaaaaancttgagaaggaaccctatgggagtacctgagctggcagaaagctgatagtactccaaatgactaagaggtcttaaacatctttgccatcatttataatgcagacttgatgactgagaagagcactcgacactgccaccagaagttatgattgtggagtggattggacaattatgctgatgccacgggaccatggaacagtgccactattgccaagagcaccagcaaaccgaaaaatcttcatgcaatggctgacatacaaaagactatcacattggggcatgctttaaatatacttaccaccagagttggaatcatgcaatctatcctttaaaaggtcaagtgtattcttgcattttataaggagcaaaagaatgatgtacacattatacttaaacataggttataaaagcatctactcactggggattcatgcgaggagatcacttacatggacaagatgacttgtatattgctgaatagagtagnttaaaactggaagcagagttcttcaaaaatgcgttctttataccattgagatagaacaaccaagtgttaaaccaaataaaaacaaatcgacctactgtggcctcatttgttggatcccctgcagccgattacctttattgaggatagaataatagatcctgaataactgacatactggctacctgagtgaagctgaggaaagcagactagcccacttaaaaggggtatacttggatccacccatagcgggttaaccgcgaaataactggcat

SEQ ID NO: 15999 - DNA, 831 bp, Homo sapiens
catccaataaacctttattatttagcttgctccccaaccaaagtaagctagatcctgacttgacatctctcaagactgcactttgcttgaggacccttctctgatccacaatcatgatagtacctctgagcagaaaaccagggctactggaggcctcacctcatctgattccattctctgaggagacacaatcttgagctttccgttatcaaatgtcatgtctacttacctagtttttttatgaagggagggcaaatctggagctgatcaccctgttatagacagaagcagaagtctaatttggtccttggaatgttgcttttccgcaccagagtgcaataggtttttttttttttttaattaaaaaagaagaaacccatctaaataaaatctaaaaacaatctcaacaaaattcctgtctctcaaaaaagactaggcatcacttaatttatcattaagacccatttcgggcttagctcatacaggaagatatcaagggcccagagtggcccatgaacagtaaacagataacaattgtgcaaatctcaaagagataaattcgatcaaatctccttaaaaactatgtagccgaatattgtgactgtgtttgagtgattgagagattagttgttcccaatctccttatgcatagccgtcttacatatacacgaatgttctttccatgttagaatttatagccggcgacattatgtatacgcctttatcaaaaaccttccccaataggctccatttttattcagcaaaacactcatacattgaatcaatccagtacgcctgtcttgcgagccctatattaaattctgaattatt

SEQ ID NO: 16000 - DNA, 741 bp, Homo sapiens
tatggactgttcgtgttcctctgcccactcatatgtttaaatcttaactccgagtgtgatgatattaaaaggtggggcctttgggaggtgattaggtcatgaagagggaaccctcattaattggattaatgctcttataaaaggagccccagagagcttactttctttctaccacatgaagatacaacaaaaatatggaagtctgcaacctggaagagggcctacaccagaagcgactattcttatcttggacttctagcctcccaaactgtgagaaataaattcttgctgtttataagccacctaatctatcgtactttgttatggcagccccaaatgactaagatagaagtaatgtatagatagcaaaagtattttttaaactgtgtggattgatttaaaaaaaaatccaggagagtgaagatggagaaaaaagactagaaatggaatcgagaaagggtattcaagggagatgtcaaatgtgtctatcttgcagtccaacaactatctccaggcagaaagtacaggtgattctagtattcacctgctttgtttgccttttctaaagaatcacagtactaaccatcttagtccaatgtcagagaatgattgtttcccataatttaacattttttaagctaagaaaggatgactaattctcttactaccttatgaagtgcaaatcttactgtactctttgaattttgaaaaataaccaatgaaaaaggaaaaaaaaaaatt

SEQ ID NO: 16001 - DNA, 777 bp, Homo sapiens
ctgcatggcactatctcagctcaccgtgacctccacttcccaagttcaagcgattctcctgcctcagcctctggagtagctgggattatagtcatgacccactgcgcctggctaattttttgtatttttagtaaagacggggtttctccacgttggtcaggctagtctcaaactcacgacctcaggtgatccgcccacctcagcctcccaaagtgctgggattacaggcgtgagccacttcgcccggcctagacaatgcgtttgactccaagagagcctcaagccactacaagaatgccaagtaaccactgaattctgtcagccttagagctagggtcttcttgcttctatagatggcacatcaacagcaaacacaaatctacctgcagaggaggaatcctgcgttttgctattgtatatacagagatctctataaaaacccccatggagctggtaaccgtgggtccctttggggaggcaacccttctactggtcaaaggggtgtgaaaaatacttaaattcagcttatatgctggtgcttataaatcataaaccattgtttaatgcttttccatctcacatacatatcaatttatataagaactaatatttgatacctgtgctctattgtgtatatttccagcgctcctcttctttatgttgtgcacgtttctttaccccgccccattcctgcttagtctcatcctacaggcagaaggagctgcttcatgtacgtaaagcgaacttcgtttttctcttattatgtatttttctttg

SEQ ID NO: 16002 - DNA, 532 bp, Homo sapiens
tctatatatgttgatttttttttggttatttatttagaatacatctgagggcagttgttttccatattacctcaaaggaaagcacaacagtcagacgtgaaatggaaacagaaaaatcttctgaagcagaatagtaacgctgtgaatttaaaagtaatggttcaaagataataaatgtaatctgatgacagaagcaaagagagaggagcaagacacgagaaaatgctatgctgcaatatttaaaggtcccagcagaagaaaaaagcatccctcctacctcatttctcctttcggaggctagcaggaaattaaaaaaggaaaggagtttcatgcagtatttcttacagcaaatttctcagaatccagagatacttcttttctctgtaataagttgctgcagatacaaaggaacacttatgattgatgactatctgtgtttgcatgagcaataatttctgaacacacagttcttgattaaaaatcaaatgcatttatcaaaaaaaaaaattagccttaattaggctcttatttt

SEQ ID NO: 16003 - DNA, 350 bp, Homo sapiens
acgaacctgctatatagtgagtcgtatatccccagctcagtacatctggatcactcaaggaatcatcaaaggactcgtgtgtcgcttcagttttcaagtcgaagatgagaaaaaacaacaacaacacttgtgccagttggaattcactgcttcctgatagtttcaacacctgattctgttctggactgcgttcccttccagtcgcactgtatctgcctcactccaacttctcacccctagcctgacctgcaccttgtcaagttcttgtttctcagttacatagtagtgtaagtttgtgtgtatgcataatatgcacaatactcctaaaataaattacttcatatgcaaaa

SEQ ID NO: 16004 - DNA, 1052 bp, Homo sapiens
  misc_feature (1)...(1052): n = A,T,C or G
ggggnnnnnnnnnnnnnnnnnnnnnnnnnnnnnnnnnnnnnnnnaagggnnggnnnnngggnngnnnnggnnnggggaggtttgggaggagggngtgtgggggaaacattactatatntaaatatactattatgatattactatatagaaattataataagtgaatgtttgtgttttttttatgtatttaatagtaggtaagaatccatgagagcaacgccctacacatcacatctttgtggcacactgttagagacattctacgtgtcgtttgcgcgatgagtctntcaatttgtcgtggattnnctcgttattggcgatctgttgtcttctctgttgtcnccaatgatgaattgattattttgctgttcatatgtttaattcgattcctctntcatgtcctcacctcccgagctctagtgatggtaccttcaatatctatggctacttctagtagtaagacacttgtgttgcgcctaccacacatacagttcattctcttcccttcattcctaccctgcgttccatacatgcccgctccagttcgctttctgcactccgttcatccgcccctcattttactatcgactttccgccgtcccctccatttcacaactagatgcttacttacatgcatcgcttcgctctcacttcttttgagtcctccccaccgcctcatgttctgccctgccgcgcagcgtggatagtcncccccnagtagctgccaaggtcccgatccggatcacccaacgacccccacccgcccgcacgctctcgaccgcctctgtcctccacggagctngcccgtctcntctctctgccctctctactttgttctgcttataaagacaactgcactacgctcgcnagtaatcgatccgcatgccgagctcacattttctgttccttgatgtccagtgcccctggtacagttcaccgcgcgctcctcctcatgtttatagtccatgtgcgtgccggacagttccacggctttgctgtaaccccccatctccccacccctgatcactctactccgtctcctcaacggcccc

SEQ ID NO: 16005 - DNA, 362 bp, Homo sapiens
cctcgctattttatgcccttcatgattttaatttctctatgaagcatcagttcctgaaggaaaacacacaacctcaagcagaagaagagtttcttctttatatcccaaaataccctgtgcaaatctctaccgtggctcttgaaactacatatagccgtgggctcaactttttcgtttttgagcatagaattctcagcagaacatttgaaggcattaactcatatttatcgatgtcactttgttcactgggtagacctttagccttgtgtttctgtttgagaggggacacttcacaccctgatttatacattcaggaggcatacatctgaagcttttcaaaaaatgcacactctctcaacaaa

SEQ ID NO: 16006 - DNA, 1644 bp, Homo sapiens
  misc_feature (1)...(1644): n = A,T,C or G
aaaaaaannnnggggnnnnnnnnnnnnnnnnnnnnnnnnnnnnnnnnnaaaggnnnnnnnnnnnnaaaatannnnananannnnnnnnnnaagnnanannaaannnaannnnnnnnanagnnaaagtnntttagangatgtagnataaaacnaatgaggnannnntntagnaattgttatnnnnagtatgatnnnnnagtanactggtgtgngagagtagngtgagaggngntgagatggggatgaggagagananaagagacgagcaannnatcgagtngagaagtggaggataataggagagagatatnnnnnnatgtgtgtgtgttattanttnacacaatataagtgacgcgacgttgactgagcgagtactgaccgcgccacnnnngcacgcgcacgcggctgatgaacagagcntnnncnagtgagtcacgtagangnggagngngggaagcagaggatgttgttnnaagtnncnatgtggtatcgtatacacaatntgttgtatctctcttgananataggngnnaagacggtagaccgaaagtggagttatgtctaatatatatgtagagatggagtnangattngttttgttctnnnnnnatgattgngggtntatcgcgtcagacagcacgagncaacgagaancacaganctcccatgggnaggacgagtctggcgncnncatcaataggcaagtgtcgngcacgcagcgccntccacgcgaacccagctacacnacncancacaagaagaatatcacagttctccgagtgtccgaaggcgtcgccgagtgatgccatcatcagagatgccacggctgagcgcactgcgtntcatcgccacacaacgatatgaccaccaactccngcggccctcatcagtcctcgtgacccntacctttacagcttcgtgtcagtgtcactctgtgcgtccatctcgctctcgcgtcgtctcgcagtctncgtactccccgctcgctcgttctacnacacgtcgaatcatgaggataacaantacaccaacacacactctctcaatanaccccnacgtcaacngccctggccnncctcgtcccgcgcgcagtcgctgtcgtccgctgcatcgccnnngagtaccgcatgacgcantgcgccgtcgtccgatacgaccaccgccgagcagctcacatctaancngctgagcgcgaggagcacccaggcgcacgagccgtagagcccacgccacccacgcggccgacgcgancaccgcgagcgatgcgacanccccacgcgcaaagagacgcggggcagagaagcgganccagcggntnnntctcggatgtaatagagcatgtctgctcaccacgcgcgcgcnacgcgggatgtagcacggtgaagcgaggacgacgacgccnctctggcccgtgctcctnnntcaggcggagangactagtcactgagagcagntacaccgcgcccgcagatgcccacgcgagtgntcacgagaagacgagagagccgctcagatgatncnaataacacggttagtanncccatactaacacagactagatctcgatataccacgcggcntcacagatctgcagcgtgccccgcgccgtgccgcgtacgatcaccaacgagcagcgtgcgcgac

SEQ ID NO: 16007 - DNA, 760 bp, Homo sapiens
ctcctgcaactctaagccatgtaggtgtaatggagagtggaggaatagcagaaaaaaggggaagaaaataggaggaggtggtgaagaaatggagagtgaagaaaactgccatcaaatgaaaactaaaactgtattctcgtgttcattaaagaatatacgtgagactgaaaaaaaaaaggacataaatattcacgtacaacggtccatatagggtcatcttattttactaggacagtaatttcttgccataattttgtttgttttctaagaaaaccttaattttctaattttcttggtcaaaacttgttgtttgcttaacttaaaacatacttcaatgttttgtgggtataacattcctaaaataaaaaaggattcatgttgcattatttcttgcatgtgctggacaagtaaaaatgcatctctaaattttcattccagtaatgctccacactatagggaaaataccgatgtgtaatatcatatgcttacatgactctcatgatcctattctaattaacatgcacctccttataatctgaacttagaagaagtgctgtccctaattaaacatcttgaacagtctcctgtgataaaatcctctagcacgaagcatatgtgcaattatattcctggaaaaaacgaatttacttaatgtgtgcggccctaaacactttaaaagcttgcacgcgctaaaaaaaaaaacaaatggccctctgccctccacgcggactatgggaccttacctttttagaggtaatag

SEQ ID NO: 16008 - DNA, 786 bp, Homo sapiens
  misc_feature (1)...(786): n = A,T,C or G
agagatagggtcctgatctggcacccanactggagagcaatgacacgagcacagctccctgcaacctcaatatccctgactcaagctatccccccacctcagcctcccgattacaggtaaccggaataaccaggtggcactcagggaatcagaggcacttgtggtgtgtctctaccattgcttcttcacagacagacttcacttctaaatgaaggatgtaggaagtgaaatttataggtggaacctcaaacaagtaactgtagcttcagaggcaacagaaaccttctctctgaagatacaatggggtaagatgcaatctatggaggacaatttggcatatcttcaaagatagcttgaggaaaaaaaaggagagacagagaatcttggaaaaattggcatgtgttgtctgtttctgaactcatgggtgaaatgtctaaaaataacagtctcacagagggccttcaagaatatgacccatgggaaaaaaataaaatcccgaatagcctacaactaaggcttctgtgaggtatgagcattctgaaatatatacacagacgaagaggtcatgggccattcaagaatagacttggacttttggccacaaaggacttgtaaggtatagtagctaaaacaaattctctatttctgtacacacatactcctatcaccaagcacttactctaatgatttcctcatgcacagcccacacacattntctccctgctctcttccctgtggncagttggctttgtgctttaagagaaaacagggccaggtcgtgggcac

SEQ ID NO: 16009 - DNA, 830 bp, Homo sapiens
  misc_feature (1)...(830): n = A,T,C or G
aaagaatccccctcaaacacattcgccaacacgcaacacctttatcccacttgggctgggctccagagaccatggtctgaaattcaccacccccagtgccagtgatgtttgcatccatttcttcttttccagtcacttgtgggattttctttttatcctggcatctgtaaaggcagaatctctacacagagcctgaggacagctcattcactgcatttccccagtgtcaaacccagagtgacacactgcaggtgtccagaaaatggcagccaaaggaatgtgtgaaagaagctcctgcaccagcaatgtgctgcatactttctatccacctatccagatccagtctccatccccctactctaaggatgacgtcacccggcaccctgccttccaacgtctgttagattcgggtgataggaagcactaactggagatcagaggatggcaggagagtgaagacccggctttatttattccctctgccagggtcacttgagattggctgcccccctcagccgcagacgtcacctcaattcctgtcggaccccctgtcctgccttgtctactccttcttactccaagcttaaggctagccaccgctcccgacggcacgaccgacccccccgcgaggcacaatccctgaacccctctacacaactctagagtgtaaactgctattcaatcaccactgatcggacggcgctccnctcgccacctgctagagcctcccctcgtcgcatcaccccctagcctcatagacccccctaactggcaacagacccccactggcacaaccccagctctactacacacacgtgagcagcacaacc

SEQ ID NO: 16010 - DNA, 834 bp, Homo sapiens
gcttaccttcgccttccactacacatctccccctgccctctctcaccactttaggcaaacagttaaaagctgaagtctgggaatctgaagcaagaatcagtctgatcaaatcgtaccatcatgggttactgatgtgatagggtattttctgaactgaaatatcactttcctttgaccaaacatcatgcactgaagactgacatttgtgatgtataacggctggtttaaacatgaaggcagggaaaaaggcagactgtggaaaagtagactgaggagtggcgagggatcaaggaagcagaagaaaagactggaacgcctacttaattttttgtagggtgtatttgtctgttttcacgctgctgacaaagacatacctgagactgagtaatttataaagaaaaagaggtctaatggactcacagtcccatgtggctggggaggccttacaatcatggcgaaagacaaacggcatgccttacatggaggcagacaagagagaaccacagcccaatgaagggaactcccttataaaacccatcacatctcatgatacctattcacctactcctacaacaccattggggaaaccatccccatgattcaattatttcccactcggtcccctcccacaacatgtgggaattgtgggaactataattccacaacaccacttgagtgggcacacaaccaaacaaatctcctaggatcttcctcctacaatcaaccctatctccaccttttccgaattcgcctattctatattaagcatgtttcatcataccttccctccaaccctatctcacatatcacctatgaaccaccttcatcccaccc

SEQ ID NO: 16011 - DNA, 815 bp, Homo sapiens
tgcatttccgcgtatcatacccgccccccaccacccccctggttttacacatgccacttctcaggtttgtgaccctccttctatcttccaagccagaagccttaagttgcattctcacattgcatcattctaatccctttatctgccttccttttccacatttaagagactttgtgattatgttgggctcactagagaattcagaactgaataattgtgccctccaattttcacatgtcaaagccttaccctgcatggctggaagatggagcctctgaggaagtacttaaagctacatgaggtaataggggcggtgcctgatctgataagattggcgccatataacgagagatatcgaagatctcacttttgctgtctctttgccaacatgcatgcacctaggaaaggccatgtgaggacccaccgaggaggtggctatctttaaacccacaatagagcccaccaaatactgaatctgcggacactgccatcctcgacttataaattccagcactgcgagaaaacgcacacctcgtgacttagccacttagtccacctaacctgtggcatttctcgaaatccaacaaggacttatatccgaccaacctcttctacctatagcatccaaaacgatcgtattgagacttggcccctacgtactcttctcagcaatcctggcccatccctggtacacatggcccccttccacgggaaatattacctcaaagcggtctcccggggtaagtaatacccaatagctggcacccttcggcattgggctttaatttcaaactctccccgcacaagacccacct

SEQ ID NO: 16012 - DNA, 865 bp, Homo sapiens
tcatccctactgcaaacctcaaaaaccacccccacaccaccaccaaccccaacctaagtagaacacactctgcttttgaagttgaggctaagaagatggtgctcccttttgcccaagctcactttgaaaggctaaagtaacttcatgagcattctggtaaatcgcattgcactgaacaggaaagcacagatcaaaatcggggattagtgatctttactaacctgaagaaaaggcttgaaagcatggaactgggctgaacgtgttccacttctaaaaatgactgtactcatcaaaacaaatgacttttttttcactacctctctataaatgcgcaaactggcttagcaggatccagtcccacaaaacgactacacaggcctattttttgaccttgtactcccccactcagcaaccactcacacatgacaatatttgctctatatctaaaattctcacacccaacttccatgaacaccatctgcctctccctaaagaaaacactgatcccttttgaacctcacctcactgtttactcacccgacactacgcaccgttggccccaactttcccttacccccatctttccatatcccagacaggctcagcacctaccccgctaatctgttacacatcccactccacctgacgccggaacccggacaaaaccccacatttacccccatttcaacgacatcagatcagccccattatccctgctacttcacacataactctgaccagctggtacctcacaccaatacatctcctacaccctatcttcccatattaatctccacaccaagaacgccccatcggcccaccccaccacaacatccttctacacaaacatactcaacccccgccc

SEQ ID NO: 16013 - DNA, 791 bp, Homo sapiens
tgacatgtcatcaggattcagttacttctatgtcaacatggaattatgtaatctgctctcaaaattcaaaagactaccaacatgtattaaaatgtcgatcaagaattcatatatacatttcaagaatatgttgaattaacagatgaaaaaaactccttagaaaaagtggtcaaatatttcaagtgaagtttggtggggaagtaaaatctttaagaaactactatgcatcattgtcagttaagtgcaatataaaatggacatacataaatgaaaaagccagaataaataaagttgacagagaaatttaaaagaagcaagtagccgttttcctcacccataccctggttgcacattgaccacacacttcaaaatagggaggaaaaccgagacgacaccctgaaagaaaacaaaaccagaaacagcactttacaagaaattctccagaatcttataatacaaagacattttctacaactcagatctcctttccagattagcctaatttctttttatttcaagaaatgtacttctgaattatcaaataaactctctcaatctctgcttgtgcctgaagttgaatggatgaaacaactaaaaatctgaagattttataagatttccatatgctgcacaccccagcgacgaaggccgttgtgttctaactggaagcaggcagtgccttgactcatttgctccaaaccctgtatctggcatgcttggtaaacattctccccaaatgagaccttcctggaaactcgatttgagtggattctccgcgtcctgtcatcctt

SEQ ID NO: 16014 - DNA, 804 bp, Homo sapiens
gtcctaccaatggcgttttttcatagagagtcgagaacacctactacagcatcagttcagcattactggggaggcctcagaaaatttgctatcatggcagaaggtgaagttttaagcaaatcaccttcttcagaaggcagcaggcagaagctgtatgctatggatttttctgatcatttcatgctgagctcaggggagggactctaaacttggatgggaacaatgatgatgactttggaaactgcatcttgaacaaggcaaacgtccttcagctggtccctggtcccctgaggtctccttcacctgaatcctgcttctctgccttttcatgaaagaatattatatgagcaagaaataaacttctattgaattagcttctaatttgaggcccataaatctccaaggggtctgtagattgaattcaaggggtcctgtgaacttggaatgggaaaaatacgatgtttactactgtctttcttacctcacttcaacattttcttttgttatgagtacaaacaacaaccagtcccatttcgagcacctatagaaagtatatttgtatacattacaactgcccacatatctccaaattaacttctactactcaaaactctaacattctgcccaatgaccccgcaggcatacttttttagatgatttactgaacaaaccccctgtcctttatacttcccatattatactgctccagcctacatcccattgacgcatttccctcgaaccattcaagtccccttcattttccacagcacctccccgcgaacattccccctgcgcataacataa

SEQ ID NO: 16015 - DNA, 787 bp, Homo sapiens
agagatatacattcaactcatcttcaataagagtgtcaaggacatctgatgggaaaatgatagtctcttctcaaatggtgttgggaaaactgaacatccacatggaaaaaaaatgaaacttaatcactaccttacaccataacatataattcaactcaagatggatcagagatttaaatagtatgaaaatgatgttagacaaaaagcaaattcaagcaattttcttattcaagttcaaaatgggtcgtaaagcagccaagacaactcggagcatcaataacgcatttgacacaggaactgctaatgaacgtacagtgcagtggcgatttaagaacttttgcaaaggacagaagagccttgaagatgaggagcgtagtggctggtcatcggaagttgacaacaacaaattgagaacaatcatcgatactgatcctcttacaactacatgagaagttgccaaagaactcagtgtcaaccattctgcggttgttcggcatttggagcaaattggaaaggtgagaaagctcaataagtgggtgtctcatgagctgaacaaaaattttataaatcgtcgtttttgaagcgttttcttcttttatcctacgcaacaagaaggaactatttctcaattggatcgcaatatgtgatgaaaagtggattttatacaacgggtgatgtccagctcagtggttggaccaagaagaagtccaaagcacttcctaaagcccaacttgcacctaaaaaataggtcatggtgactatttagtggtctgctgccagtctgatc

SEQ ID NO: 16016 - DNA, 451 bp, Homo sapiens
tatataatacatgtatatcccaaacttcatcatatgaaatgtaacatctttctatttcagactgctctttattatatcaactgcaaataaccattttttaatgtgacttaatatccacaagctgccctgactcacttagaacctacaatgaaatatgaattatactttcagtaaatacagcgcggccgatccatcccttgcagtctttcttcaactcactccggtcctctcatttataaatccttatcttattgaatggcaggtttcatccatagcaacacttgcaactgaataactccttgcttttcaaaagacactttgctttcaatcccatccactaatgtatccccttcttcgcccttttaacaccttaaacactcaactactggccttacacatgtgaggacggacatttcaaacccccatctataaccactttcctttcatgcag

SEQ ID NO: 16017 - DNA, 887 bp, Homo sapiens
  misc_feature (1)...(887): n = A,T,C or G
cgacgcacccatcgacaaaaagaanaaaaaaaaaaaaaaaaaccacccccacctcgcgtcttagctgagtcgtattataagaaaaagcacagcgcagttcattcatacaacggaagactatttagtcataaaaatgcaggcacttctggctggtgcggtggctcacgcctgtaatcccagcatcttggaagcccgaggtgggcggatcacccgaggtcaggaattcaagaccagcctgccatcttggtgaaaccctgtctctactgaatatgcacaattttatacgagcgtggtggcccgtgcctatactcccagatactccggaggctgacgcacacgaatcccctcgaaccctggaggcggaggatgtagagagcccacattgtgccactgcactccagcctgcgagacacagcgagattccctgtgttctcctatctttcccctaccctatgcacatgccccagactatacatccaccccatccggtttgggcgctgctgacacatagctgcataacgtaagaacccttgacaacactactctatcgatgtaacggcatatgttccatgcggcatcaatcttgatgcccatacaatggctacccctctgctatttcagctaccttcgtaagagcctatctccgttcctcacatcaaccgtcccgaccgccccactccaccttacatgtcttgtcataccttcgttagtccataattcccgctatcgaagatatgttccgctggcacgcaacgattaccgtattctcccacccatgaacgagcaatttaataccaccaatcacatagcgcacctcacccccgcgtgatttcaatccatgaccacgacctaccgcactgatctctcacggttgcgggacatgactt

SEQ ID NO: 16018 - DNA, 764 bp, Homo sapiens
aggaaagtttatagttggttgagagacgtgctgactttcctggaggctactcaggaagacagggacaacaccagagccatggcccagatctgagaccccacagtccagcacccccgctccccacactgcatccctgtggcggccactgtctaaggaaaaaggcaggagcagcatcctccagaaagctcggtctgcacacacaccccttctcacagtggctaaggaaagaaactgcaaccttcaaagtccacaataaggggctgctcagatctcctgagtgttgaggcccttttatttctttcaatcgcctcaaacaaatgggaagacaaccagcatgctataaaaatataaactacactataaactccaaaagggcagaggccacatcattcttaaataccagtatccgcagcaccttacacaaagcacaataacgtattaaatacacaagtgaaatatctaagtatcttaatcagggttggtatagaaaagtcctcaactgggacccaaactaggatacatttcttagtaagtcaactagcaagagatgaaattatatgattacaaagaagagggttagagtatctgtaatgttctggtccagccactggaaccagtcaaaacttaacttcaagccaggatttacctcctcctgggataagaagcagaaatatccatttctctttggcaagtcccacctttttattcaatggtgcaatctccccctttgtctacccaaaccatatcactgcctctttcttatg

SEQ ID NO: 16019 - DNA, 772 bp, Homo sapiens
cttttctcctgtggaaggcagaatccctcctccttctctcaaggatatccatatcctaatctctggaacctgttaccttacacgatgaaaagaactttgcagatgtaattaagtttatgacctcatctctacaaaaatacaaaaattagcctggcacagtggcgggtgccagtaatcccagccacccaggaggctgaggcaggagaattgcgtgaactggggaggcagaggttgcagtgagccaggatcgcgccactgcactccagcctgtgtgacagaaccaggctccatctcaataatataaaataaaaacagaggaaggactcaatgaaagactcgatgcagtgttgctggtttcaagatgtgggaggagggctctctgacaaggaaggcaggtgtccttgaagagctgagagagggccagtttaggtggcttctgactgtaatccgagcgcctttgggaggctgtggtaggaggattgcttgagaccaagagtttgagaccagcctgggcaacatagcgagaagcccatctctacaaaaataaaaaataaaaaattacctggcctgtggtggcacgtgtctgtagtcccagctaatcgggaggttgaggtaggaggagcacatgagctcaagagttccagcctgtgtaaacatcttttgggaccaatcttctccccatatactaggcttttttataaaagttgactacatcctcttcagaattttttttcattttatcatagccatacctgcgagaactggtcacacc

SEQ ID NO: 16020 - DNA, 765 bp, Homo sapiens
  misc_feature (1)...(765): n = A,T,C or G
cagagagaacccctgtccttacacttgatagactaaatgaagatttttaaggaagaaaagcacaagctgaaacaagggaaaaccttcaatgtgtttcatgggaatacctgtacacaaagccacattcaaagttcctgaactggaagaacttggactttagagttgcataaagtaagctatgaaggctttggacatcataaaccacacatatggaagaatgcatgcttcctcattcaagatggcataccaccatgggctgtgaacttcctcccatgagccagcaaaactaaaggaaagagggatttggggactctcagagctcagcaactaacattaaactttgcagaaactcttggaaagcctgacaatggtggcctcctggtgtgggagagagaggagtgagtaacatttttctgtgaccctttagtcgggtatgtgtatgagctctttccatatgttttaaggctctctgaagtttatcctttatttttccctaaggggggggtctggactgaaaccttttttgaaaggggcgtttaaggggtagattacccctgagctcgaaaaagttttttgttcattgagaaccccatgattctcccacgattctccagaatgaaaacttacccttcttcacttcctaccccccacattaaaaaccggcncttcttcctcatgaaaaattaacacattgcctttgtggtccaaccttttttcttttactttcaaaatgggggccctcacccacgtgaacctcgcgatagt

SEQ ID NO: 16021 - DNA, 815 bp, Homo sapiens
  misc_feature (1)...(815): n = A,T,C or G
ccccccaaccacgacgacgcgacacannnnnanaaaanaaaagcccgccacgtccactcttagtgagtcgtcttaagnatggncttacaaatggaaccccaatgagctcaactaacaacttctactgaggacccctgcaccaacccgctggccctttgactggcataaagagttcccctctgggggacactacaactgcagggctccttcttcaacccatccagcaggaagtagctacagaggtcattgcccaattcccaacagctcttggggtgtcctctttagaggggggattgagaggtgaagccagctagacttcctgggttgagtagggacttggggaacttttctgtctagctagaggattgcaaatgcaccaatcagtgctctgtgtctaagctgaaggactgtaaatgcaccaatcagcactctgtaaaaacacaccaatcagtgctctgcgtctagctagaagattgtaaatgcaccaatcagcactctgtaaaaatgcaccaatcaacactccgtgtctagctaacggattgtaaacgcaccaatcagcattctttacaacggacacaccaccactatgtacaatgcaccaagcagcatgatcagggcagcgaccaataaatacacaaaaagctgtacaccctacccagcagcaccaacccactccggttccctgccacgctacggaagccttgcactttcaattcacttatacaactcgcagccgacaactctcggatcggccccttgaaaacctgacactcaaccaaagcgtccccgttattttttaactcgcaagccataag

SEQ ID NO: 16022 - DNA, 808 bp, Homo sapiens
  misc_feature (1)...(808): n = A,T,C or G
actacaccacacaccctacatatttcattcttaaaaccaaccccgcaatctggcaagtgaagcctactgagttaccgtctctttccatcaaaagctcaatgagaatttggaaggattatatctggagatgaagatgaaaaaggtagcagagaaggttgccagctggccaatgtcaccaaaaggatgaaccttccagatcctttcatcctatcactaatcattccaaattctttttagtttgctctccctacctgactgcaccagttctggaaccagaccatctgggtcagaattccagctttcccattcttgggtgggtcattttatcctctctgtgactcagtttccacatctgtaagatgggttaataccaaccttatgggatcatggtaattattaactgagttaattctcatagaaaaatggctagcaaacccttgctgctgtttgtggtctcactggaagggaccagatcttctgtctataccctcaattgctcatttactaactaacccatagaacatccttagagagcctgcaggccgggcggcctctggccaaggcatttaaactctctaagctgctgacaacacaacatactctggcggtcgccgcccttggtgaacaccacctaaccatcatggttacatattaccaaattttcacatccgatacccaggcgaaattcacacttctcccactgtttcctacactctccccatctctccggtcacccccgacccacaaaacacccccccgcgctctagccctttccccaagcataactacaaccctgtacaatanaaca

SEQ ID NO: 16023 - DNA, 822 bp, Homo sapiens
  misc_feature (1)...(822): n = A,T,C or G
cacaaccaccccactgaaacagaaaaanaaaaacccgccatcgcctctagtgagtcgtattatagagaaggaaacaacttaacccaagtaaaatggggataattcccacccctgccagtttcacaaagcttgaaatgagaatgtggacatgctaaaagcattggcacatttaaattgaaaaaaaaaatcttagtggtgtatatcttcgcagtttacggcctttttccccattatggtaaggttgccatgacaatccaagacaattgagtctccccaggacagaatgattcattaagttctagaacaggggccacacagagaagatgctcaacaaatattgatgagatgtccaattaaggaatatataagcaaatcaacttttgaaaaatttaagcagatcaggtgcagtggctcacgcctataatccaagcacttttggaggccaaggatccacaccagacaaggaatgaattctaatgaatgggcacacatttcacgctgatcttcactgcctaccagatgcaaaaaatgcgtctttaacaagccaattcgtttagtgccattattactatctgtccagaggaagactcacgtttattaacaaatggactcttgcgtacatgatacttttcccttccttctccctgatatccttcttcataaaaattctccccgaatagacaggtctatcattgtacgatattcccatcctgaacccattttccactcatacagtatatgtttcacccaaccgctttcatatcgcacgttttgttatactgttcagtcatccctttaatttttccgtgtacaatcattcgt

SEQ ID NO: 16024 - DNA, 775 bp, Homo sapiens
agtagaatgagggtctaccatgttggccaagcaagctcgtctcgaactcctgacctcaaatgatccatccacctcagcctcccaaagtgctgggattacagatatgagccactgtgcctggctgctatgtggattctgactgcaccactccaatgccatgtgacttggtgacacgggacaacagcagttcccagagcccaggaactcacggcataatgcaaagctgctggcatacagtaggggttctacagagcccaggtgtcattcctacaacgttccaccctccagggctccagactgggcagtgctggtgagggtaaagtaaaaggaaaccctggttcctcccaattttcagaggtctggggacagccacccaggtcagtgagcaggagacagctgcacccaccagctcaccacagccagtctcaggatgccgctcctctgaccttctgaagcagagactcttccttgcagtgggtcagatggcacgtttccagagggccacaaataacaaagtggtaaggtcccactgatctccgggtctgcaggctttctactaagctgcatcaaggtatgggttttttgggtgcaagaccaccacaataatttccttttttttatacaaaaaggcgggtcacttattatgctcccccacaattacggactgtgttgaatcctcctaggtctgggggtaaacggaacacacacaagacaaccaccgggggcacgggcgatgacaacctccctaaccgctgcctccggtcctttcactcag

SEQ ID NO: 16025 - DNA, 787 bp, Homo sapiens
cctggaggaacgcccttgccagattctagctcgtcaatctaggactttccagcctcagaactaaggagaattttaggagaaggagaaggagaaagagagcaagagaagaagaagaaggagaaggaggagaaggaggagaaggaggaaagcaggagaaggaggagaaggaggagaagaaaaagaagaagaaaaaaagaagaagaagaagaagagaagaagaagaagaaaagaagaagaagaaaagaagaagaataagaagaaaagaagaagattttttgaagaagaagaagaagaggaagaagaagaagaagaagaagaagaataaaagagcttggagagagatttattgcccatttatgtttggaaagagcccaaggatagtttttgctctctgtcttgaagaaaggagcataactgtaattttcttaattatatgaggtgtcacaagtaaaaaggtagcagtactagctcagttctctgtgggaacactggcatctgtgagaatttgcacaatccttgaattagtaagcttctcaacaggggagagctaatacttgttattctattttggatttgagagaatgtctattctacccatggcattctgaaaatgccttaccaattatctaagcattgttgtgtaattttaagatgtgctgaaagaacattgacaagatggatgttagacaagtagatttgacagtggtactcaaattagaggaaatcaaacctcttttgctattgttcacctgtccacaatttggttagaagttcttgaaaggagatt

SEQ ID NO: 16026 - DNA, 833 bp, Homo sapiens
gaacgccgttcatgaacctgtacttccaacgaacaaaacacctcacgcctctttggagcagaattggaactttattttgcatccaagccttgggaaagaagagaatattataatcatggatgataataagcaggtgaggacagaacagagaagactgataacaaacttaatacaactgcaaagcagtagatgagaaccatgtctcagagtacgtgaacatgggaaaaatgctccagttcagaaacaccttcaacagcgagataatacaagagaaaccttaaactaaccaaccaaaacctatctgcgaggatgatgtggagttacttttacttacctgttggaactgagcatgaatgggttctgcataaggacctctatactgatgaacttttttccgggacttttgcttcatttcctgcagtttccaatataaacctggaatggctattcccattccattttgctcactttttcactgtacactgaatagaacagtgtcttttccttttaaatcttagtagttgtcccatttggtcaacgaccccaacttttgttatgcttagtatcgtgcacccttcgtaatttcaatatattcctatgtacactttttcaatctaaattataatgggtcgtcgaaaagtattcatacattacccttgatctgccttaacttacgcctcattcgctataaagatgtcaacgccacattgtatcatatctcacattctctctccccgtcttctcattttatcccgctttccgtactatgatacccaactactatcctcaccgttcgtacctgcctgggactaaaccagcataatagctagctt

SEQ ID NO: 16027 - DNA, 296 bp, Homo sapiens
agatatattattgtttaatttttaatttttatacttaaaatagatattattacagcacctctccctttccaggctcgcagtgggaaagacgaggcactggaatgtcaccagggtagggatagcagctgactcttcatctttctttctctcagggttcacataaccctgactccgattgcgttgcaccacactgtatagattgcatttatttgtttcacttgtaaatacccaacatactcgacctcaaatgtcttttagatgcagcatatatttcaaatacaatctctggtgataaa

SEQ ID NO: 16028 - DNA, 822 bp, Homo sapiens
  misc_feature (1)...(822): n = A,T,C or G
aaatattaattgagcatcatattattatatcataatattacaatgaattttctagattttagtacangacctagtacactcaaggttcctgccaattgctaacgaagctgaagtctccctatcagtaaaagaaataaatattggataccaagagcctcagagacttatactgagttgaagatggaagcaatgaaaaaagagactcactgtattagcaagtggatacttggtgctgctggactgcaaaatttgtctagagattaagaaaatattagggaaaatcccctatagatagggcaggtataaagtaaacacagtgtactagtccattctcataccactaatactgctatgaagaaatacccgggactgggtaatttataaagaaaaagaggctttacggattcacagttccacgtggctggggaggcctcacaatcatggtggaaggtgaaggatgagcataggcacttatttcatggtcgcatgaaagagaccgattgcaagggaattgtcctttatcataccatctcattcactaccacaataacaataatgggaaaaactctgccttatgattcaagtacatcttaaagggtgcataacataacatgtggaggaaatggaagtgactattaaatatgaaattttggaaggggacacagtgcaaccattatacaactaatattgtttggaaatactaaaaatgaatgacgtatttgtaaaggcaattatataatatgaacaggtcgatattgttttgtctcgtgaaaagggtattattcgtacattttatacagagatggtccatttataattaat

SEQ ID NO: 16029 - DNA, 866 bp, Homo sapiens
agaagaatttatctgcacgtcctattaattttttttctctcaccagaaaacactgtgaacagagaaacgcatcgacacttttctgggaaagatctctggatgagtcagaaacaaccagcctcaattttctcaagttaccatgcctccttccgttctctctgtactggtgaaaagtggagttagcccgtggtacactggctactcctctggtgccctcatatgagatataaataccccacctatactgaggtcgcccataaagactagatatctaactacatcgtatttatatcattaaatcaaaattatattttctataacataaaataccaatattaaccttatatttaaaccactcaaataatatattccccttccttctccatcaatctaccacaatctttttgttacattctctaatatatcaagaaatacacaccataccatatactactacacgcttcaccgtttccaaataatcaaaccacctaaaagtacaacatacacccaaatacattacaatctctaattccatactattcatatccctaacatgtcgacctcactttcatattcttactatatttttttgagcctcccatcagtataaccattacattctatacttatgttaattgacaactacgcctctatatcataaataattcacgagagcataatgtatatatatttaatgcgtctctcatcaaaaccaattgaaataaattggtgatcatgatataatataccattgcgccggatcccactcacttaatatttatttctatatcatatatgcacaaaacgacacgaactttaatatattcaaaaacatctgccatagtaatattaattttcactttact

SEQ ID NO: 16030 - DNA, 751 bp, Homo sapiens
gcatctccagattaaatgtggagactttgactctaaaaacagagattcttgttgaaactaagcaattgtggggatgtttaaatatcatggccaagcttgatgatataggccaagttggatattaaatggaggaggcaggcactgtagagtctatctgctacccccatgaaattggctgatctcccatcctggcacaatttgaggatcctctctgcgggaggaaaagaatcaggaaacaagtctgacttcctgaccaacatggtcaaggaatagatgtttcatgctgaaaggaaggacataggaagctctcctcaatcctctggacttgcacttgcttttcctgaagtatcgacaatttatactctcagaaataataaagcttgatcttacaaaaaaaaaatacatacaaactccgtaaaccacacactgccagccagaacatccccacccgctccactgcttccttccacctcctcccctgcgcccctcccggtcggacctctcgagtagcccccctttattaaggggttaaatttctttaccttgctaaatggactacttccgtttgaccatacggccccagcgaaatgacaaacccatacccagcgggcacgacccggtctctcccataatatggcgcacactcctgagtaaactttgaccccacgctaccacaacgcctcaaacttataaacgcccactatgttgcttaccccctcatccgcacccctcataccgtaggctgttttag

SEQ ID NO: 16031 - DNA, 560 bp, Homo sapiens
  misc_feature (1)...(560): n = A,T,C or G
acaagagcttctggttcctgggccttcanacttggactagaacttcactaccagctttcctgggtctccagcttgcagagagcagatcgcagaacttcttagcctccataatcacaagaacgtgtttgcttccccttccaccatgattgtaagtttcctgaggcctccccagtcctgcagaactgctttgaagaagaccactgcgtcggtatttgtgaaatgttttgagcctctggatttaaataagatggaaaaccaaagctcagggagttttacatgggcaggcagctggtgagggctgagactggagccaggccagtggtcttcaaaggctttagtcaaactttttgacagatataagaaaaccgaactaaggaaaatactttcctgggatcatccctatatgaagtggcagacctggaattgctccctgtttcaaaacatgtaagctcctcaagaacaggaacttttgtctgtttgttcattgttgtatctccaatccttagaactatgcctggctcaaagtaggtgctcaataaaatatctgctgaatgaacaaa

SEQ ID NO: 16032 - DNA, 314 bp, Homo sapiens
ctttgggaacctcggattagaagcatttgctgctctcagacctggcctacagagaagaactgacacagacttccttagatgtgttgtcttcctgtcactggtgcattccttatcaatgtgggcatgttcatgggaggacaaactgtcataatgagcagcatccctaatggcatctctacaagcagtacatgatgacatctgtgggactctttcttttaactccctgattagtgataccacatatgttccattgctattaagttttccaagcacctgtgttattaaaaaaaattagaataagaaaaaaaaaaaaa

SEQ ID NO: 16033 - DNA, 834 bp, Homo sapiens
agaacagaactcagcgacagcacatactaccgggacacggagggcaaagtggtatggatcaagaattctacttcggctgcctaaagctgaattcaattcacaactctcagaggttcaccatagacagctttggaaactacgcttcctgtggacaaattgacttcgtcgtgaggtggatgttggaaagcactagaaactaggcatgttcagcacgtgatagaagaaaagcgcccgcattccaatcggcccaagcagggcatccggacatgtgggagcgacgactttcctccctcggttctccatggactcacgtctggagcggtaacggcgcagtagtcctgcgaggctagcagctggggagggtcccgcgacctcacaccccatattggccagccgcgcgcgccgatgacacagaggaaggcaagccgggcgcgagcgccaaggaaacgcggtccgaccgcgtccacgagtcgcaccgaacggacacggccgataaaacgatacgacacacaccaaaccagaagcacgcccaccgatgtcctagccccggcggcaaccgtggttggtgcggtttggccgtggtttgtaccgctcagcgacgagccaacagatggtgcaagggataacatgcggaaggccccgagaagaggaacacaccggcggcgcagggggggccgagaggcccctcctcagggtgaaggcgatcaaatagtgagagacgcggagatcgagagagagggctcgagggccacaaagatcggcgcgcagtgagcagacgcacggccatggcagttcgcctcagacatggtcgcgcggcgcgcaggagagtgactg

SEQ ID NO: 16034 - DNA, 761 bp, Homo sapiens
tgagcctgcggtcctttcgtcagcaactgaaaccgcctttgcaaaattatgactgagatagtgaaagaggtccagcttaaacgactccatcttgcctctaacctccaagctgtccttgttcatttctgggcgcaggctgaaaaaactttgggaggaacctagtttatagttttaaaaaatgacaataacagccctttcccagaacaaactccctttttgcctggagactagactactaaagttagccacagtattagaagttacggtttaggagtcaagtagttggaggccacaagattctgaccttccctaaactgctcccaagatcagtgcctgagatgttttgcagactctactcttgatggatcaactggcaccacccatatcgagaaaccggcccatctgatcttgtgactcacacccaggaactgactcaacgcatgaagacagggacgcgccgtaatttcacctccgacccaaccaatcagcactatccaactcactgatgctgcactcccaccaaattgtctttaaaactttgatccccaaatctttggggagactgattctagtaaaaatagaactgcggtctccaactaaaaaaaacaaaaaaatatcgacccgttggcctcatacctggagctcttccggacgctttcctttaaagaggggaaattcatgaacctcccttctctgaatcgtctcctcgggcattccgctcgcgtgaagtcgaaccagctcactcaacggcagtcttacgg

SEQ ID NO: 16035 - DNA, 827 bp, Homo sapiens
  misc_feature (1)...(827): n = A,T,C or G
ataatatgtacgcgttgtagatcttttcatatgatataaatactaataaattctatagggatctccctctgtcactcacgctggagtgcagcagcctgattctggctcactacaacctccgcctcccaggttcaagtgattctcctgcctcagcctccggagtagccaggactacagatgtgcgccaccacatccagctaatttttgtatttttagtagatacaaggtttcaccatgttggccaggcggtcatgaactcctgacctcaagcagtccacccacctcggcctcccaaagtgctgggattacaggcgtgagccaccgtgcccagcctgatctttgttatggttatgtaagatgttatcattgggggaaattgaatgaaggctacactggacctctctgtactaatttttttgcaacttcctgtgcatctacaatcatttcaaaataaaacaacatcgaccaaaatataaagataatgaaagagccgacagtattaactgcaggtgcagtatttgacttcgcgtgaggagcgcctcgatgttagggtgtgaacattattttattcctcgcaagctgctttcaatcaaaaggatagtgataattttatgattggttgacgtgtattctctaatacctccgggtgggcgggtatagactatgggcactcaataatagcaagaataaaagatcacatttctacgcgttctaaaagaaaaggaattttcgatattattattgtngggtgacgtcattattgtataataggtaagagtattaattttctaatatttttgtaactgtttcgtcatcgaattttatgt

SEQ ID NO: 16036 - DNA, 835 bp, Homo sapiens
  misc_feature (1)...(835): n = A,T,C or G
atagtatagtacacactagaaatatttaataaaatatattatatagtnanntttctatctgagaactcctttagcgcggcaccttgcactgtccttgcgcgctgcctcgcattgctactggctttcagctctatcatacacttgtgtagacgtgaccacgaccagccccattttcaaggcctcatgaaaggttatggatagggtcactctggagacccacgcccgggtgcaagtctgagatctcaatacactgctctcttgaactccaggtctttcaagggatccatctgctctgacctcctgagtaggtgggactacgctcacaggccatcatgcctatattgacttattgttttaagagacgagaacaacggggtctaggctcatttgtcactgcgggattaaagtgatgctcttaggtgggcctcctaaagtggtctgataatgggctacgcatccacaccttgcactaatcgcattaccattgtatgcctcatatttatttctggtagagctaagcaatatactacggtgtctgctgtatcatatatctgatgctcaccgccttacattttcaacgtgctttatataagtgggaggattttatattgtttatctctactattttaaataaacagctgcgtataataatgcatgtttatcgtgtccctttaatgggttatgccctctacaaaaagtaaataattgggtctctataatcaattaaatatgctctgctatcaagtagctttaaaatggttttatacataaccctcgccccttacctcattctgattcgaaaatattatccgcgctctgtaccttgttcctagag

SEQ ID NO: 16037 - DNA, 239 bp, Homo sapiens
atgaaatgaaatcatcgtcacttctctggctaagttatctggatgagtcagaaatcaaccagcctcaagtccatcaagttaccatgcctccttccgttctctctgtactggtgaaaagtggagttagcccgtggatcactggctactcctctggtgccctcatatgtgatataaatatcctaccaagaatgaggttgttcataaagacttggtataaactgaagtgaaaaaaaaaaaaa

SEQ ID NO: 16038 - DNA, 816 bp, Homo sapiens
aaaaattcgtaaataatatttattttttataaattaaaaaaaattctataacacttcatcttgttgtccaggctgcagtacaatggtgcgatctcagttcaccacaacctccgtctcccgggttcaagtgattctcctgcttcagcctcctgagtagctgggattacaggcatgcgccaccacacctggctaattttgtatttttagtagagatggggtttctgcacattgttcaggctggtctcgaactcccaacctcaggcgatccacccgccttggtctcccaaagtgctggaattgcaggtgtcagccaccatggctggctgactttgttcttttttatggctgagtagtattccatggtgtatatgtaccacattttctttatttaatcttgcgttgatgggcacctgggttgatttcatctatgctattgtgaatcatgctgtgaagaacttacaattgcaggtgactttacggtagaatgattctgcttcctttgtgtatatacccataaatgggattgctgggttaaataggttctccattattctgttgcttgataatatttttaacgactttctacatggatgaactgatttgacttatcaccaacataattctaatattcccttttatctgacatctttacaaaatatgttatatctcgactctataatttcactcactttagcagttctgattacaaacataatattttactgaccacgcaaacaataaattattcttatttatcttcataaacataattcatgtcttcttaatcacgaactatgtctaccctatctattatct

SEQ ID NO: 16039 - DNA, 822 bp, Homo sapiens
  misc_feature (1)...(822): n = A,T,C or G
cattacatcctcaataaaatccatctctttgtattaataaacacaaaataactttagntacncancctgggnaaatctaactaagacacaaacaaagaagcccatggatcttaaggcagacagtttgcctgcatctactcctagactggagaaaccaggaatgcttcaagatctgaacgtttcatatgatataggtgcagaagcagcttacaccctgtttcttggaaaaaaccaacagtgttatggcaagattctcaggaagaaatggtgtcatggtgtgcctaggcaaccaagaccatagacaaatcacaaaatatccatgtccaaagtttggcataaaaggtatagaaggttgaaaggcatgaagaagtgatcttaatctgatggtctcagccacatcccatataaacaaaaaaaaaaatgagatccatatgctagcagacactttgacctagtgaagattagggatgtaatctagatttgagtagaaatgggaagaaccctgataaaagaaaaaaactgataaaggcctatctgttcatagctggggacctaaaaatccatattaattttattatagaaggtcaaaaattttgaatttgtacatttgaacttgaaaaataagagtattaccttctataatactagcggtatattggaaaatatattgctgttatttgatctatctttataaaacctctactggattcctattggaaaaataaaaaatagtctttttgtctttaaaattgtatctttctagctcttacctcttagcgaggtcacataataatctccactttacacctccttatcttatct

SEQ ID NO: 16040 - DNA, 362 bp, Homo sapiens
taattattactcgtcagctaatcaaatactttacttatcatttctcagcccctgcagagggttcatctgttaccaggagcctctaggacccagaaatttaactgtcaatcaagaggcatgtgagggaaagtccagcccagcctgggtgccagaaggtctggattcctggtctgcacattccctacaacgctgggcagagatctcatatgtacttctggctcagctactaacttagctgtgtggctttaggtgacccacttaacttctctgaatctgtttctccatttgtaaaataaaaggtttggactagggaacccccaaatttcctttcagtataaaagttccatgattaccagagaaaa

SEQ ID NO: 16041 - DNA, 821 bp, Homo sapiens
aattatttatctttaattttactttaaattataattttatatttttattcccataacattctacattatggagtaaaaatgactaatgaaccttccacgggtcttcggctatttctccttcaatcatatctcactgatccagtttctgatcctgagtttttcaagggatgccgtggaaaggaactggaaatatacatcttttggaactcttaaaatgtgttttatagtgatcaaatatggaagtgtaaaattatgattatttatgcttttgtaacactattatttaatgtttctaaaactttacagcattttctaacatgacaaatatttcacttttttagttcaccattatatacaatatattttgtgttccactctctacacagtatacctttaaataaatatattatgactgaagataaataaaaaactattctcttctggctcttatttgaattactatattagtcttttctctgtattccagcaatcattacttaaccctctctcaatttttcatattctctcgttcacacaggatcattaatattgctatatatttttttatgggtcaactattcgtatttctctctaaccattttttaattacatatttagcatttttgtttatatcccatgcatattcttctttactaataaatctgttccttattataattattatttatattgttacatttacttatttcatttattcattttatcttgcataacaaatttgtctttgaattcttctattcttttctttcttcctattcttctccataatcacaaatatgtttatacctttctattttcta

SEQ ID NO: 16042 - DNA, 417 bp, Homo sapiens
  misc_feature (1)...(417): n = A,T,C or G
attttcgctgtcaatccctccaacgtctatntttccgcactctaagtccccttctaggttagctcatggcaaccagatctactgccagcttccaccagtttcccacaagtgcaatctgacttcacctcaagcctccagttcccaggctcctatcccagaggaaatccacttgcacacatgcaactcagagcatggaagagctaataccctaggaggagccactgcataaatgcttacttctttttgaagtcagccggccgaaggtagtgagttatctcaattgattgttcgctttcagttacagattaagctcctttttctactctttctccccttctcacactgcatttgactagtcttacaataaataaataaaattcataaattatattaaaactacggtgaaaaaaaaaaaaa

SEQ ID NO: 16043 - DNA, 847 bp, Homo sapiens
ttgttttcgtttacctcggcgatcgatatttgtcctcttcgtcagttttttttagcagggcagcagaacgaccttgtgaacttttcttgttaggaaagactcggggactgaggtgactgtcagtctcagaacagccatatctgagacgaggaccaaggaccaaagaccaagtagctctgtctgagacaaggacaacctccagaacagatttccacattgctttctttctgtttccatgacttaagcaacaatggcatctgtgtgtaccttatttctgtgtggaactgccaattcttctacatggatcaatcccaaggagtggccgctatgcacattatccaccatacagtggctgttgattaggaggccttgatactctgatgtggcgccaccacatccttcaaaagcaagtcttttcccttctggcaagtatacaaccaaacttactccttaccctgttctgattagccaatgactttgggtagaagaacatggttggcatctgtccttcctccaatactttacaggcgaccgcttgctttaactctggggtatttctcaccgtgcctatatataggtcgatatgtgattctattaactattctactatctttggcgtcgaagagacctgcttatgttgtcctatagtgcctttagtcatgcgcgtccggacataataatgtgctccgagatccctaccgtaattggttttcttttctcctcgtttgtcacgactttgcccaccacctgcttagtgacgcaatagctctcgtttgttactgcacaccgcccgaacagccgccttcccaggcgatggattttgatacacccacttgcgacgcgcgat

SEQ ID NO: 16044 - DNA, 832 bp, Homo sapiens
  misc_feature (1)...(832): n = A,T,C or G
ttattaaatcatctcaccacacttttagacaacaacaccncacgaggttatgtgtgaaacaacttcananctaagacttcatcttctcatcagagtgtgatatttaagaatgtgggctctgccaacagactacctgatttgaatcctggcttcaccattttttagctgtgtgcccctgggcaaggtgttttcctgctcatcgatggagcaataatgagcacagacacatttcacactgtcaacttgctttagcatcctccagccttctgacacaactcgtctccagctacaatgagtgccagctccatttatgtatcctccttcccaaatctcctctatatctgatttcacatggaaataatcacagtcagagtgtttatgtaagattcgactggatgctctggatttgtacatcaaagaaaaaatggttacaaagtgatgacttattacacagatttggatgaagctcaggaaattccacctctatcttgatgtaacagggctgatcaagaaaattagaatccgaggggtcagaaagctaacttccttaaatgcaacaaacagaaaagtttttccaactacccctgcgcaataagaaatacttctttcaagtaccaactccttcaactgtacaatgaatcataatttcgaagatttctgaaaactttctagtcacttcacgatcttgacaaccctaaagctatatcacaaatagactccctggaattatcatttcacatcctgactattattaaaacgacaattatcatgtggtacagaaccaaccaccaacatcttcctcttatgtgcacatcacttgatccgtctctcg

SEQ ID NO: 16045 - DNA, 905 bp, Homo sapiens
cttgttttcctcaacttcagtaacctaattactgtcatcgacttctatacattttagagagtacctggtagcatgtgtgttgaaagaggaaagcaatctggaatgcagcgtgaacacatcagtttacagctgctataaagagtgactgtggagactgcagtagacttgcctgattgaaaatttaactttttttgtgttaaatcatccgagattttagggctgcttattaccacggtacaacctagccttatatgactggtgcgtgaatgtggctttatatatctatatgctgtgcgctgtgcataatgttttttgttcatactttactcatcaaattatcttctcatcgtatatttctccggcctatcttctattactatctggtttactacgcaaatattatatccaattaactctatctttctactgtcaatctctccccctctaattaaattatactatctacaaccgctattttcgatacacttaccacatatttctctctttattattaacttttctcctcctctactgtacacagtttctcatgtatattttcccatccgacacccttctactcccctcattacatatcttgcacactggtcaccctacatcgtccattttaatccttcactctactttcctccttttcttttggctcgtcaatctcacgttcagactgtatagcatattcctcattacacccacttctcttcccactttacttctttcgtctatatttcccaccgctcctcaatattactacgttgtccctagccttatttctatcatttcctactctccttcccctctttactccgccacgatctatattatatcctcctagatatcacgctcatccgcgtgttacctttttcttaactcctcttttcctacgtttc

SEQ ID NO: 16046 - DNA, 845 bp, Homo sapiens
  misc_feature (1)...(845): n = A,T,C or G
atatattttagtgacttgtctctccctagattaatttgctccaataaaatcntaagttatagctatgcaagaatacctgattatgggtaatataaagcagaagagatttaattgactcatagctccacttggctggggaggcctcaggaaacttacaatcatggaagaaggggaaccgaacacattcttcttcccatggaggcagaaaagagaagtgctgagcaaaggacaaaaagcaccttataaaaccatcatatctcatgggaactcactcactatcatgagaacagcatgagggaaactgccctcattattcaattgtctcccaccaggtcactcccataatacatgggggttatggagattacaattcaagtgagatttgggtggggacacagccaaacataccatggcggatcatttatattgaaagaagcaatacaattcaaggtgagaattggtagggtacacggcgaaaccatatcagtggggattatgtctctcataccacgtgtgtattataaatcgatatgacactcactcatccctacacacgtcatacgttaatattgttccgctacatttctgcaaagcctaaatctccatggattgacatatcctcattgtctcataaagaagagtcgaacgtgtggtatcctctgctaaatgaatcatgtcctttatagaacgtactattatctcctcttccgatctaggttaacaagtctgtgaaagataagagctttcacgccagtgtgctatagaaacatttcttatgcttctactctcaggtcttaaacacctaccccttcttagagtctcactcactggctgagttactctct

SEQ ID NO: 16047 - DNA, 257 bp, Homo sapiens
gctaatggctcactgagcctcaacctcctgggctcagatgatgcttccacctcagcctcccgagtagctggactacagggacataccgccacactcgtctcatttttgtattctttgtagagatgggcatttgctttgttggccaggctggtctcaaattcctgagctcaagtggtctgcctgcctagacctcccaaagtgctgagattacaggcataagccaccatgcctagccaataaattcttatactcccaaa

SEQ ID NO: 16048 - DNA, 814 bp, Homo sapiens
tacttatatcactcacctcgagtggtaacacaaaaacaaaacctaggtgacattgatttgggtctgtcaagctattgaggatacagatctctatagaaattgcacaaaagttgctacaaataaaagataaatcaataactttctcaaatctgagagagagaagaaaaattccaatgtactttaacagtaacacacgctttggagcatgaaatctgccacagatcttacaagtgactgaataattttgatctttggttttcttgtcattgaaatcattttggtaacatgtactcacaagggtaattgtaaagattaagtcagctggtataggtaaagccatcagcacactgcttagcatgtatgaactgatctgttaatggtaagtgtaactgctggtcttatcattattatcatgagcaacactgtcattactaatattaagattaattatagccttcgctgtaatgttgctattcttttctctggaattatattccctcttaataaaacaggattagctaatctagtacagctatacccacagatgcctcgctgtgctttggtaagacctgaaggtggaaggctatgatgctggtaatgattgaggagagaacaatgacccatctcactgcgcgatattttataaccacaaactaagataggatattttcccccccccgcaagtttattaattaccgcttaaatgtcaacagagtgaaacactcccaaccctcataagaattgtctttattaggcatagtgtgatgactggcgttccgcgtagcagtcattgagataccaatgtaatactctt

SEQ ID NO: 16049 - DNA, 182 bp, Homo sapiens
tgaggaagttgatggagaagaggaagaaagtaagaatgatttctgagaactgtattcaactcattgtgtgagaactagctcgcgaagaggagaacaaacctgactccaccgttttatcacagctgaatcactctatcaggacatctggagaataaattaatctgaatggaaaaaaaaaaaaa

SEQ ID NO: 16050 - DNA, 820 bp, Homo sapiens
gtgttaatcgttacataatccaacacaattttctctccctctacgccgatctagacattgccctaagcatactttagaagagagaaaaacagcatgcagcttgaacaacagattggattttttcatcatgcacagggaagacaataatataggggtgaataaaagtgcagcaaagtgatttcaatgaaacccgatgctggctaattgcttctttatagatggtcacgatcagtttactgagcatctgtgcatgacagaatgtgggacactgcgggcggtacaattccaatatgtctacacattctgaaaagcaaaatattttaactacaagtatcattttatgtggtaaaattaactatgtctacaaaaatctcattttttaattaatcgcatatgtcacactgataagccccaaaaaccacacctgtttgggataaaagaaaacaaacttaccatggaatatgtacctttttggactgttacttaaaactaaatggcactaaattcgatcctttttgcatattacaaaagatctatacgcttgcacattatctacgtgatgttgtttttagtcattacactgtcttatgtccgaaaacaacactacatcaatctctttgtgtcttacattttgattttccttttactgttctttctttatattactatccttattctccttcttacccctctctctctcgttaaatgtttcagaggttgatgccttatcccgagcatactctacattatcccggattcttgtcacctcccacaatctcctgttccttgtttcattttcgtctaccactttaatgctttt

SEQ ID NO: 16051 - DNA, 829 bp, Homo sapiens
ttatttactctgtcattccatactacatttaaccacatatatacactctgagcccaagcagtgcaatgaattccaaaaggaatgatttccaggaggaagagaaacttttgatggttgtgcctgataaaatagaactacacattagtgaaactgaattcaaaggcgcttccaacgctgctgcacacagatgagccctctcgctggatcccgtccaaccccaacggctgcgcgcactgtaaccaccatgtgtcatctgcaaaccagatagtttctgtgcgggaaagaccagccagctttcttggccaagctgctgccataaaacacactagtgatttggtttttcatgttttttttttaagttatgctttgatgcacaggatacgtttggtctcacattgtccagagcactatcagaaatgactagttgatgaatgttgtaccagaatcaggtcacattttgacaggtcgtattgtgtcactgcaaatcattgctttacaatatggacttttttccccccttaacttttaaatcttaagcgtaagaatataaagagcggataaacactctcaaacattaggagtactctgcctttaacaactatattcatcacctgcctttcgatatcctatgcaaaagcaaaggctttttgggatctttttaaagaactgcaaaactaaattggaaaactgctttaccccctctaaatagagaaattactggcgaaaataaaaaatcaaagtataacaccttatgagtgttccgatacttacataacgtaataaccactcctcgcattattaattgtataaagcccctttctaaagtata

SEQ ID NO: 16052 - DNA, 301 bp, Homo sapiens
cctggctcataccacagagagacttcttgccttgtcccagatgacactctcggacttggactttcggcttaatgtggcaatgacctaacactttgcaagactgctgggaaggcatcgattgtgttttgaaatgtgagaaaatcgagatttcgcagggattggggttgactaatacggtttggctcccacccacaccccctctctcgagtcctatttcccataatacccaccatgctgcagtaccatccgtgcaaccatgccgtcaccctcccctagtttatcccacctcatctgctctcta

SEQ ID NO: 16053 - DNA, 497 bp, Homo sapiens
gttggctcatagacagaagagacttcttgccttgtcccagatgacactttggacttggacttttgggttttgtgggaatgagttaagactttgcaagactgttgggaaggcatgattgtgttttgaaatgtgagaaaatgagatttgggagggattggggttgaataatatggtttggctgtgtccccatccaatctcatcttgaattttagtttccataattcccacatttctgagggacctcatgggagataattgaatcacggggttttttatgcccatgcagctgttcttgtgatagtcagtgaattctcaagagatctgattgttttataaggggtttttccctctttgcttggcatttctttctcctgctgccttgtgaagaaggatgtgtttacttccccttttgtcatgattgtaagtttcctgaggccttccaagccatgtggaactgtaaatcaattaaacctcttttcattttaaaaaaaaaaaaa

SEQ ID NO: 16054 - DNA, 797 bp, Homo sapiens
  misc_feature (1)...(797): n = A,T,C or G
atacagtgtgtcactcatgttaattgaatgattanaataaagcttatttcttgggccaaagatctctacatgactacatcacctgtaagagaactcttcaagagctagatctgaattactacttgaattctttgaattgaagagatgagaatgaaaccccaaaagatggtggaaccataagatagaagccgcctgcctgcctgaatcacttgttgaaaaaacttctcatggaccagaatcatccaagttgggtcatttatgaagccatatttcaaaagtaattttgtttcagtcaatatgcatttctggttttttttgttactatactcaacctaattaatacaataaattgaatgacattgtggctagcatatttactttttgacaaacctactaatgaatctagattaaggtgacaaatacaagtattaaagttctccttgatcattttatgagaaaaattgtgtttttgctcttcttaaacttattaaaatctcattgcacattaactataaaatacaaatgcccctcatggcataccacgtacgaccttctctgtcgcttacctttcaatgatagccttattcctattattattttactcgatttactcttattatcctcttctcttcacgtaatctttttcccccgattttagaatgtgtatcctgtttaatacttcatcttggttatccccggtacaactccttgctcttctgctatactaagctcattacgttagaacgctatcaatatattaatcaatctttataatacatcaatttcatactcctact

SEQ ID NO: 16055 - DNA, 692 bp, Homo sapiens
tagagtggttaaacctacgtccccctgaatgtcacgagcgatccaggaagtagaatgacgagataactgagcatgccagaggactttccagcctcccatttccttccaccagtcacccaccaatcctagaattctttccctaaacctttcctaacaaaactgctgccctaaagctgtttctgggagacagatacgagctggactcctgtctccttgatggtccactggcaataaaaaggttctcttttctcagagaaaagtggacagatcgtaaaaaaagttgttgtgcagtcaataaacactcactggacgacaaacacacaacgactgagcaaaaccaacagccgccgcaccattcagctcagtgccgggaccccacgggcgattcgcgttcaccgaggccagtccaagatactaagatgacagactccctcccctcacgcaaaccggagaccgcgacgagagaaggtaaaagaaaggccgccatcccggacatcgctgtaaggtcggcggctccgcccgctaaatgtcaggcgcaaaagtggaccgccgcgcccgaggagacctgatggacccaggagatcgcgcctcccgcacgcgaccgcccattagcacctgtccactactagaacagaaagcatgcaacgggagccccggacgcggagaacacaacaccacgccgtcgacttcgt

SEQ ID NO: 16056 - DNA, 790 bp, Homo sapiens
cctggctcatagcgtggaaggaaggtgccttgtctcacacagactttggagttggacttttcagttaatgctggaatgagttaagactttgggggactgttgagaaggcatgattgtgttttgaaatgtgagaagaacatgaaatttggaagaggccggggtggaattgacatggcttggctctgtgtctccacccgaatcttatgttgaattataattcccaatgttgttggagggacctggtggaaggtgactggatcatagggacggatttttcccttgctgttctgctgttctcatgatagggagtgagttctcacaagatctagtcgctcaaacagagtgtggcatttctaccttcactctcttactctcttagtcccttgtgaagatgtgattgcttccccttaaccttctgccaacgtgtctgaggtctatcagccatgccttctgtccgtcctgtgaaactgcgaccctgtccaacccctctcccctataagtccaaggccacacccgcgatacccctcccccgtgagtcgctatcccaggccccagattccgctattgattttatctctcctccctccagcgtagccgtctttccttccactccctacctcccccccccccccccctcttcctattgacaccccagcgctaacctcatagtgcccgcgtccccgcgccccccctcttccgccctcgagatccactcctttcagatcgccgagcccacctactcatacttgaatctgacactcgtgaagctccacgttgctatccgtgtacg

SEQ ID NO: 16057 - DNA, 804 bp, Homo sapiens
  misc_feature (1)...(804): n = A,T,C or G
caaaacaaccaatgtacgaacagataattatttataaaaagaaggaaacttgagtgcactcanaaattggactggtaccatggcaacttcataatagattctctgggagcagacgagagtttcatcttaaaaccacagctcttgccagtacacttttctttataactgtttttggtacaactgcactgaagtgttatttttgatgttgagctttctgcttttagaagcatattgcatggctacattttcttaaaaaaaaaaactgtgaccttatgctatttcattgcgactggaagactgctggagaaccagaaagttttttgtatttctgagctaaagcaagctggctttgtacgagatttcccaaaagtgcgagaattaaataatgcccacagatggtactggaggtataacctcacaaattaccaccttcaacattggaggaaagggctgaatactgtctcgtcttaagtctgactccacgcgcctgttcgacctctcaaaacacattactaaatcattattctcataatgcctgcgacccgcagtgttcccgccgaccattttgcgacattactcgtactaattacttacatcatcctacgtgctgccttcctggacacaaaaatcactcttcatactcaatcttccgtcccattttcttaactcacaaaacacatttttaatctataccactaatatcgtcgtcatcaccaaaaaattataaacattacattctcagaaacgtccatgaatcattaatggcaatccgactttaaagacattgactacattacataatca

SEQ ID NO: 16058 - DNA, 810 bp, Homo sapiens
acaaatataccattagaaaacctcatctaccgaatctatacccacacatcagcgcagcaaatgttaaaattgtgatgatgcacccggaagtgttttaagccttcagacaattcagacttgagaatcacgtgatggaggaagagctaaaaaaaaatacattctcgtttattaggaggagaaagaaagtgccatctcaaaaagatcgaggctcgttaatgctggattataaagatagacactttctgttctcgacaggcaaacttcacccacaaatgtgggcgccaggccctcaagagtggttggggccggacggctacaaagagaatgcgattgctcccgacttgaaccccatcgtgcccgacgagtcatgctcagacttcatgaccgccacacaccacgcgacctgctgcggggaggggcagaaccctcgcaccctactacgacaagcgcacggctcacacctacatcgggattaggattcatactttttagtaatgcttcaggcgttggatacatcgtgaatccctagcctcccccaaaagtaacttatatatttactcccgtcgcgtatcgcaaatagctagacaactagatgagcaaaccgatcacatataatacacttcaccagagcactccagaaaaacactttccaaacttcttcagagtacaaaacacccaacacatttattcccccaaaaagtgattacaactgcactctacgattaacccatcaaaaacagaatcagtacctaaccagcacggcccctgacaatactcgcaataacacacgtagctcatcacccacaaaag

SEQ ID NO: 16059 - DNA, 850 bp, Homo sapiens
  misc_feature (1)...(850): n = A,T,C or G
acggtctaattcacaattatcccatcgatttgataaacataaataaatgattttagtgtatagcacagcgttatttcaacaggctaacgaaaacagacaaaattcaattggaatagcaagttttggcaccttcctcccataagaaaaacttaatgactcttcgtgatgaacaaattggacagttgctggagctgatgcatgaagccacaaaacccaataggcaatctagtatttactgagtctatgaaaccaagattttagcctatacatcataacttaatcagacctgcaaatatgtaaaacccctactttaactgtcattggctttcgaaactcactaagcttctaaaacacatgttattatttaaatcctctcttgttacaggatgttatagattgtagttatttaagataagattaatacatgatacttatcttaatctatttgaatattatatactactttgaaacttcttttcggtacactttcactaatctttttaaaacatctttctctatagtttatcaattataattctctattcgccatattcatttcttttgttttgtttttattttattcatattaatttttgtgtgtttcgtatagtttgtttttttgatatgtcgtttaggtagttccgggcgttgtattgtttcatatctaattaaaaaccctccttatagtagttcttgtatcctcttttagaaattctcctgagtcgtagttaatcntatatcaaccgatgcttatcgcgcacccaaattcatgtctatattccgttcccgctctctctcctctgtcttccttatctatacatgtaatcaatgttcagcattgcgcttctct

SEQ ID NO: 16060 - DNA, 1374 bp, Homo sapiens
  misc_feature (1)...(1374): n = A,T,C or G
tactatatatttaaaatatatatttatatcacataattctcgtttaatattttattagctcattaactatcgtcccaagtataggttcgtactttactccagttttcatggtaaaattgagcaatcttcagtggcaagttcttatcttcggtagcttactaggagtaaagactatctttcttcccttagttaagcagcagtagtacatctcctcctttctctctgacttagattgtgaattcatatagatgtgacgcacgtgattcctagtatcagacattcacatatgagcacatttacattactttctctatcccagctcgcttngcacgtcatgtggattgcgttatcatatcaacatctattcactagcattccctcgaagctactaatagcatcaatctcatttaccacgtagctagagacttgaagtactacagatcataaagaactgtagtgcgtcgtttccttactagatttatcactaatcaactaaagatacttagcaaaagattatatcttaacttctcacatggcctctgttgtatgttgctagcatgtaaacctgatgtctaaaatcaaatctatctttcgtcagactattgatcctattcatcctattgtcataatgacattcttttaccctctgcgtcttctcgcttatctctcacccacctattagatcttatactactaatagttttcnagacttgaagtgtctatgcatgtctgcacaccacatttatataacatacaacaattataccaatatatacgtcagaccatnatccatactacaatctcactacantgttctagacatatgtgtgtcattgctgatgtctctcgcgtctagatgctgtgtgatttgtattgtgtttaatgtaatattcatcttatacactttatattgtgcaatacagtantcatgatcttctcatnacttactntacgatcacacagactactgtatcacacgtcactatacattttcgtgatatacacatgatatttatctatntntngttatacacgctactangtgcgtgatcagatctcacatgctatgtataaatgttcaagtgantcgtgtacaacgcagcgagcgctcgactatacatgttgtnagacacacgccgtcctctgtatgcatnctatctcgcacctgtcataacgcgcntcatctctagttgtcattatctcacactatctctccacgcatccttacatctatattccgtctcatgcgtgtattacactgacgtatcacactatcgctcacccactgttngagtctcgtctcantatcgtcacatcgtgctgacgtcgcactatctacttattcttctgtacgcatagagcactacgcttctc

SEQ ID NO: 16061 - DNA, 848 bp, Homo sapiens
aatattctaattataaaatatatatctttatatctaagataaacattagtagccatattttggtgttagccatgcaataggcgccttgtgaccagccttcaacataaaaccttgggagtctccagaactccctgggcagaacatcgcacacatgttgctgcattttcattgatgggttaagagtgagctctatgagacccctcgtatgagggagagagaatcaggaaatccggatgagatttctctagaatatgcatggtggatttcttcagggctatctcttttaccttttcaaatgtacgtgtacccttatctcaatatttatatatatcttttttttacactgtaaaaaatataaatttattggactacttttgccttattttttaagcttctcaaacttttcactctaatgacgtgttacttattatccttcctcaatataatttatcgcttgagtctttatctcttacttctatttaaatcttcattctattcatcttatttccttttattacctgcattcagtgcattatggtctcattctaactcttgatcattcagtatatatattgatcctcatttcataaaagagtagcgtatcgtctaacctcctcattgacttttacactcttactcagacatcttattatttatatgtttatgtattaagtattgagtcacacttattgtttatatatagtcttttatttgtctcacccaaaaagaacttatcttctttcgctaatttaatattttaattatttaatttatattatttatgtatctcaattattagtatatttatatagatatattatttcctcataaatactcgtatcctctca

SEQ ID NO: 16062 - DNA, 924 bp, Homo sapiens
  misc_feature (1)...(924): n = A,T,C or G
gttaatctgtctaagtatccatactatactctttccatgtatttcgctttcttgtggaccttagcaagtaaaaactgccaggagggacctgtaggtctgctttctacactcatgtttaggagaacacgtctccaaagaaattcattctgtactttgttgctagagactctctggactacgattctctgagaaattctaattgtcatctacatgaaatgaccctaatctgatggaattactttcattgaatcacgagcctctaaagccaaatgcactatgtatctcacctatgccctaagtatgtagtggcttgaccatgcacttattagtcatctaataattctaaccattctaatgactatataaataaattaagctgcgtaactacttcactatactgtgtcatatcggttaaactcgtccttcttcatataggtcaacgactcaattattgttttctttatgtttaactcagttactcattcgtcgccatcatatcactaatatcgtaatataaagataattataatatcctcttgatagtatcttgtaatacctctataaatatgctatctacaataccaataatcattaccattgaccattatcctcatatcaataaatttttatgtttattttcatattttattgtcgacaacattttatactataatacttcagccttcgtgcgagtcacataccatttcgtattttagttgatttccctctatctgaatatgtcattcctttgttctttacttataagaattgtatatgttngatacgttcaatgatatttatccattccgtctcgatctttaactctctaactgacccttttctctaccagtaaattctctatctccctcatttcatataatcctaccagatcactgatctaataatacatactttacatatgtt

SEQ ID NO: 16063 - DNA, 810 bp, Homo sapiens
  misc_feature (1)...(810): n = A,T,C or G
gtatttatactatataccatgttatgagaagagnaatcacttataggcacaccaggacgtctgcgccgcgagctgccacccgaccaggctgattactgcatcgcgcggatggccccctacaccggcctcgactccgcgccaggtgctctggactacatgtccttctccacagagctgtacggtgagagtgacctctaattcaccccgcccgggcgacctcgacttgtgcgccttgccctgacttgcacctaacacgtagccattttctgcctgggatcggattcaactcctaaactcccacccggtgagagttggggcccacgtgggatatatcctccctgctcgagaagcgacaattcactatattattagctgacaaggacaaaaaatatgtacgtaaaaaaccaacaaactacacaatatcattgtagaaaatgtgacacctctccaccgtacacatgcgtaaaacgtaggatagtaaatctttgtactgcgaaagggcatgaacgttagtaaatgaagaaatatccctaacaaagataaaaagatattcctttcaaattatataaatatcagaaatgagcacaaataaactgacaaataattccaaatcccaggtcgattatagagtattaaatagtatcacttctaatctcttgaatattgacctattttatgctcttccgtcatacttcttttactcgtgataaaatgatattacccgacccgaaataagactgatgacaaaacacccgtatattctcacccatatcacgtacaaaaacctattattacactacacgaaaaacg

SEQ ID NO: 16064 - DNA, 874 bp, Homo sapiens
  misc_feature (1)...(874): n = A,T,C or G
taatttattattattttattatccatattattaaaatattnatttttcttagctcaaagcacaaagactatccttgtctctgatgagactttggactttggacttttgagctaatgctggaatgagttaagactttggaggactattagaaaggcatgactatattttgcaatgtgagaagaacgtggagtttggaagagccaagggtggaatgttatgatttggatctatgtccccaccagatctcatgtcaaattgtaatccccagtgttgtaggtgggtcctggtgggaggtgattagatcatgaaggcagagctcttacgaatggattagcaccaaccctttggtgctgttcttatgatattgtttgagttataatttacatttgattaaaactattttatatttttttgctatttataggtacttgtatcttcaaataatatattcttttattttaccttccctatgttttaaatatctctgttaatattttatccaaaacttattttatatatgattatctgtactatattattagatccataaacccattaaatcctatatatattttttaaattaaattatattatattttttattatcaaaatgtatgtttactctagctatattagttaagcgttatttatagaactcgacaataaagttagtttgatcagtaaattgtaatcctttctatttatttactcgataataattaacaatattatattattacaattatattattttaccctctccactttttcatatccacttaataatattacttatattaatatttatcaatttcttttcaccttacttttattcttcaacttaacttgttttctggtatcactgtccatgaag

SEQ ID NO: 16065 - DNA, 846 bp, Homo sapiens
ttattatatggtatatatcttactctactattatatatataattatttattctattagccatggtccccccggcttaaatgtcagataacctgagcatgcccagatcaaccaagtgtgctaacatgctggcacctgttctcagactgagagcaaagactgaattaagaagtggacactgggaagatgcaatggctcactactggaatcccaacactttgggaggttggggcaggagaatcactggagcctgggaatttgagaccagcctgggcaacagagcaagacctagtctgtacaaaataaaaaataaaaacttaactgggtgtggtaggcacacaactatggtcctagctactcaagaggatgaagcaagaagcatttatttatccccattatgtcaaggctgatgtgagccatggtcatgctcatgtgcttcaacttgagcatcagatcaccaccctgttataaaagaaaaattgtagaaaaggagttgaagatgaagaaacagcgtatccaatcaatactttacctggccttatcctatgacatgtccaaattatgattatctagtttactgttacaatcactatcatcattcctctatatctttttgcttatataatcgtatacttatttataaacttaataaatacttcatctggacatttgccccacggttatggtaattgggtagaatcaaaatatattcttacctcatcgtaattaataaataacaaacattccattactatatccagccagcattaacttttcttccatatcttatattaaactggctatcttatcttcccacactattgctttaatattctttaaataaagcg

SEQ ID NO: 16066 - DNA, 338 bp, Homo sapiens
cgagaaggactatggcctggtagctactgcaccttcagcttccgcacacataaatacatatggaacacaccggacctagtctccagcctggagccatgcctacagcatggctgaagcatgaagcagggctaactggccacattcaacctccatcagctgaagcacaatacacctgcaaacctatgagtctgagaataaaggcttgttagtgaaagccactaagatttggggtggtttgttatccaacattctgatggcaacagcagtaatagatcaccaggtctttgtgattttgcttttaaataaattcactaattctaaatggaaaaaaaaaaaaa

SEQ ID NO: 16067 - DNA, 812 bp, Homo sapiens
tataatattataaataataaatattagttaatttttttagatatttattatggaactccaaaacacctgagtgccctgaaaactgcttttgctgataaagaaacacaggcaatctaccttctgaccgatgggagacctgatcaggtacttaccagagctgggaacaaagagggccttactgatgctctgaaagcaaatgttggaaatgggtctgtgggaccttttcagctgtcaccaaaaatctgtggacatatactttcttggcttagggactcatatctgttgttaaaaaatacaaagacagattcttttgtctatggataacttaaaggagaatatatgagatcataaatgttgactggtgagtaaaacacacacgatttctctgtatacctatccttcttaatgatacgaatgttattcactaaaaaacgatatatcattcaatattcaattagaagtgaataaatttttatattattttatttaatttatatactttttatcaagtattatataatttatattctcattaattttatatatttagatataattatctcataatttgttctagagtttattgtcatatcttttatcatttcaatttttatataattaaacaatttgtaggttgttatgctcagctatatatgctactaaatgaatttgtgaatatattctctttttattaatatatgaaatatataatgtactgacacacaatacaacacaattactgctttatgacggagcgatatcattaatgaagaaacgtcgttatgttaggatatagaatatatatgttgtat

SEQ ID NO: 16068 - DNA, 567 bp, Homo sapiens
gtgaacatgatgctcagatgtagagcagccttcttaaggccatgaggaagaaagctgtacgttaaggatggaagataatgacaacagaagaagcctggtttcctaatgacacccttgagcagctttgatagccctgaccacctaccttccagatttttgactgaagaaatttaatcaacttattatgatgatgaagcaaaaacattatagaagtgtgatagttagaaatagtagcaatgtttgaaaaagggtttttaatataaggcagattctttccctttcttcctatcatagaaaatgtgattaactaaagggtgttattattactttacttttagaatgtctttacttttagagtgacagaatttttctatagtataaccaacataagtttcgcttagttaaatatgtattaaaatgaatcagaggtatcgtctgaaagttaggctgtaagttatgacagattgatgataaaaatatagttcccattgtttttactcatgcataagagtttcaatactctcacataaatatggtttcttcttgaacttcagaaaaaaaaaaaaa

SEQ ID NO: 16069 - DNA, 961 bp, Homo sapiens
ttatttaatataattttcaattacctattaaatatataacaatttagcaggaaaagctgaagaaattctttatcaggtggaacagaacctcttatatgaaaactctctgttcccatcattcaaagactaccaggaacacattctgtgatcaacaaaggatgccttgctgatgtttggctttagagtgacgttgacctgtcaacgcttctcttaaacatagggcatgaaaaaggatacagctatccagcagtattatagtgaagttcaagaaaacttaccaagataaaaaaataatataaggtcagtttaactcttgaaaaaaagaaaaaaatatggtctcagttggcctatagtagttggaactctttctgtcattttacctgtagttatcggttaattacatgattcctggattcactaactcgactgcgttatggatgattaggactgatgtattatgtatatataatttacttttatatgacgtccatatttgcttaattcattaaaattaaggaggttatactcttagattagaaacaactttgagtcaaaattgcatttcgaattaggcgctaatataccatcacaatatgtataatctaattatttaagtaatattttcttaacgatatcgattactgtttcaaagtattataacaatattgtcctacaccttaaactacagtacgtatggagtaatcaccgctcacacacttatcacatagcaactgttatgcttgtactctatcgccactgttaatatagtatactattatgtatataattcatatcgactcggcgtgtagttctatatctgcaacgttacatttctttatccattcatgccgagaccgatatccgcttttacttactgcttacctcgagtttctatcccgctcagatttaagactttgtataaaatcgaactcactatattctacgactaataaagtacaac

SEQ ID NO: 16070 - DNA, 252 bp, Homo sapiens
  misc_feature (1)...(252): n = A,T,C or G
ccccccgcctcntggatggggtttcttcgttttttgtcaagagaaaaaaaaaggcgcttgggacacaggntgccccttaccatcaggaccctcttcctcccttctgaagccagtaaaaatccttgactcagccagacatgggcagatgttgggatgacctgcctgtggagaggaggtcctcacttcgggtctcctgaaacctgtcctgctgctcaataaagcccctttctgccttgctcaaaaaaaaaaaaa

SEQ ID NO: 16071 - DNA, 893 bp, Homo sapiens
  misc_feature (1)...(893): n = A,T,C or G
gtccggccctnacataaatagaaaattttagggagagtaggagaggatgaggagatgggcagggttgacagaacacaaaaaccgcggctcccnctgcaggttcgctggcacctccaactcatacggtgataacactggacgtaccggtacctcagtcacatctttgacatgttccaagctgctaggaaaggctagcacaagactcaccacaaaggctctgaagatacaaacaaagagcctgaaatggaggaaactttacgagccaaccattgctattagagccttggaaagataatagagccgccacacactacacataaaactgaaaactataaaaaacagcacaaacgcaatgcacagaaaaccgccgacagcacatgcaacactaacagcgatcgaaaaggacgacacgctaactccccctccttgcccaacgccccacgaacaccttacaaaactaccgaccgggccctcccggacacacctcctcagttactctcacaagcaaccgagacacgcccgcgtagaccgtaactcgcacatacctatcacctcccgacagaatagatctccaccttacattccacgcctcacccccacaaccatacccgcgcacccatccacctcgacgccaggctaacaagaacacacacttctcatggactgaagagaacgagagcggagacaacgaacacaccatacccaacaccactcataccccttacccgaaaaccccgtaaagcccccacatacacacgcgcccacaagcaattcataataacgtacaacgcgtagacccgcaaagcgtgacgttcaagtcgcagttctctaatagatctccccacccccgccccccaaacagactaccgagcaaccataaccagactatacca

SEQ ID NO: 16072 - DNA, 324 bp, Homo sapiens
  misc_feature (1)...(324): n = A,T,C or G
cttgccctcagcctgctcttgccccgcgccccgcgcacggacagaaacaaaaaaactanaaganacaaaaaaaaaggctantaggctctacgatcctgctntcatctgatatggcgaagcattgtttctgagtgggacacatcctctctaatgcaccctgccttttccgctgctccaaatttcacacacgcgtgagagaaattcaagacaatctacataatctaagtacaaatacaaaaaggaaagcggtttctttcacagctgtgaatcatataaagtgatttttctcaatagacgtttgcagaaatgggaaaaaaaaaaaaa

SEQ ID NO: 16073 - DNA, 1285 bp, Homo sapiens
  misc_feature (1)...(1285): n = A,T,C or G
gaataaggagagaatggaggtgggaagaaatagaggttagttttttatttaataatggaaaaacaaaaaaaaagcttaagagaggaacacaaaaaacaaagctcgaanaggaacaatactgagcacnagagaccaagacagggaaaaagagaagcaaagtatcaanngccnnncntaaacacaaaagccncaaagaaaccccagagcgagacatacgggacgcaccgtggagcagnacaagacagcgctggaagaaggacgagggtctgtgacactgtagttgccgcagcgaggtgccctcactcactgcggactttccacgtcttctgtaggnagagcacaagttagtaggnagagtacgccgttcgcacgagtgtattgtatctgtgtggagtagtatgaacattcttagtggtctcgcgtcgcagcggacagacgcaccatagagagatcacatctntgggcgagaanatcagaggagccgttgatgtgtatngagnatatgtataagagatggctgctccacgcagtgtttacattgtgatgtgnagcaactcgtgtacttnttatgaaaggcgngtattatgatcgcgccgcaactcctctgaacgcntctagtcctgtccgctactgcatacacgtcaacaacatagcctcgcactttcggcgagtctcattgtgcatccccattctctcctctctataccttccttcagatgacttgtgtgtagtggtacattcacgtagtgcgccgtagctagtcatcttggtacaccaatactctgtcattgtatagctattatgtgctctagattcgacactgtctcgcgcgttgttgtgtactagatggtagtatgtcgttccccctcgtgtgtgttcactcgtgcctttgccgtgcctttgttttacgcctattagataatagcaatttcaggtgcatgtataccactgcagttctctcttcttcctatctcttatcaattaatagtgtgatttttagtgtgttggtagtnncaacagtcactcgaatccataacaactacgcctcccgtatgcatcgtctactagttatataccacgtgaaattaacacnctacatcnctctcaggatgtattccgtcgctatagttcatttattatatcgcttgttcgctgtattatatactatncaatntcatgtcacaatctntgattttctatacttatgtgttgctcactctcatcgcntcaccacccgacataatacatctcncgacgtatatcagagtgcacacagaacacacac

SEQ ID NO: 16074 - DNA, 876 bp, Homo sapiens
  misc_feature (1)...(876): n = A,T,C or G
tcctagaggcttaaattgtgtatgtacccaaaaaaagaaagaaacaaaaagctaaaaggcacaaangcggngctcngagggagaaccagaggcaggaggcctggcgctacagggattccttactcacagcagagaatgttgctgccactcaaagtcaccaggggctgcagagctcctgtggagacccacatcatctaacaacacacatactcaaaacagggaaatgtgccttttcgggagaggaagagacaaaccttttgcttagctaactggctattttcttactgcgacatacatgtgctcctgcaagaacggtgctgggtgtctgccctcaagatcttgatcataggcaacaggatgaagggctctgtgtgacttgatttaaattgtgtaggcagtgaatatttacattcatacaataaacaacacaatcgagattatcgctgaacctgaaaaacaaaaagaaaaaatggccctagaggcgactcaaaggggggtagctatgcggggctatttgcctttaatagaggggaagaataaattgataactcacggtacatgaactagattgagcgacgggacgtgctgtatccgagactaacgttataaccgtcaccaaaaagggtccgaagatgctgtggtttccccccacaacgccgcgcgatacaccctccgaaatacacattaacaacagatcgcgccccgtctggccatcgaattccactataggcaacacacgcaagggaatacccgcaaagacgtcccgcctacatgtctagcctcactcacttcacacgagttggttatccgcgcgcgcgatctgtgtcagtcttctcccgccccagcaaattaatcccgcaagcaaaacacagcccg

SEQ ID NO: 16075 - DNA, 852 bp, Homo sapiens
  misc_feature (1)...(852): n = A,T,C or G
ctgatataactatgttccggcgcgcgcggccggggacgagacgagggaaagcgtgngtnattaccatgccgatctctaaagaagtattcgcgtgctgatgattggagctgcgaatgtaatcatgtcagtcccacgctattacaggatgactataagaagatgtagtgacatttctttggacacataattgagcctccattagtgtggagagcgggcagaatactgaaggcagtgcttgaatgatggcacattcaaataaaaagcaggtcctccttttgggagataaaggaggatgaggaccaaaaagttaccgcccaatgaaaaaaacaataaggacgcagacttgtacacagaacggagtgatgatcagcaaacaaggccctttggagcctgctcttctctttctgatggaggaattcatgaattacctacaggctgaggaaatgtccatgatggtgcgcagccactctgaccctgcccagcgaggggagctgagcttgggtgacactattatgcgcgcgggaaacgggcgggggacagcaatactgcaatggacgacgtcagggcgatcggacacaagactttgaagaacgctcctggaagtggagggcgactgaaggagtacgactatcaagaccaagtggaatgccacggggaaccacaacgagcggttgcagcgtcagaccccataatggattgtgaactcgcggggcgcgcactgtcccatagggaaatacggcagcccttccattggtaggccgagaaaaacccgctggcgagtattaccggaccgcacaggcttggggatgcgcctggagcattagcaacggacaatactggatttagtctctg

SEQ ID NO: 16076 - DNA, 251 bp, Homo sapiens
cctggagcgtgcccacaatgcctgtccagtgaggagatgctctgtggacaggctggtcagtcatagaaactgttactgggacctgagacatgaaggctctcaaaatctgaacacaggacctaggaactcttggagcaagaagaaattattcagacctgtggacttcacactgtttaaaaatagcagcacagccctgtttatgaaataagcaattgctagacactcccttgattaaaacaaaaaaaaaaaaa

SEQ ID NO: 16077 - DNA, 299 bp, Homo sapiens
atggttaattatgtatggttttgtgaaggctatgatacatgctggccagctgaaaaatggagactttcatttcactgactgtttattttttggttcactgatgtctgctacagatccagtgacagtgctggccattttccatgaactgcacgtcgaccctgacctgtacacactcttgtttggagagagtgtgttgaatgatgcagtggccatagtccctacatattactccttgtggacattcttcaacatctctctacaatatcaataaaatacagggcttaggaaaaaaaaaaaaa

SEQ ID NO: 16078 - DNA, 907 bp, Homo sapiens
agtgcagtagaaataaaccgagcacgagcggaccaaaagagcaggcaagaaaacctttagtgttcacatatgccgctacacttcaaaaagtaatattgcgtgcctgtgtattaggagcatgcgaatgtaatcattgtcagtccgcaccgctatgtacagagactgactataacgaagactgtatgtgacattgtctttcggacacatgaagttgagcctccattagtgtgttagagcgggcatagtactcgaaggcagttgcttgaatgatggcacatccaaataaaaagcaggtcctccttttgggaaatcatgaaggaagaggaccaaaaagttcccgaccaatagaaaaaaacaatacggacgcaaacttgtacacgtacagggtgacgactgatagtcaaaggcctctcaagcctactcttcactgtctgctggaagaactcgtaaattacctacatgctgaacacctgtcccatatgcgtaccggcccactatggaccctgcccgccccagggaagccgagccgagagtgacacgattagtgtgctgtattacggcggctggactgatagactgccctgcacctcatccccgcgagcggtcacggcccgtgtgcagtgacacctgtgtcagaaggcacactggacgcggtgccttctgacgagaccacactcgcattccgaatgcaggatagggagcaagtggctccgaggaggaatcgtcagtccagacgatcgaaattacacacgggggaacggaccgtgcacgtaagggcttagtgcctcggccgagtgcatgcgaaagtcagatgtgatgcccagggcctgtagttcatcgcccgcttcagagtatagaggttgagacttggaactagacgcttgagggcgactggcgaagcgacgcg

SEQ ID NO: 16079 - DNA, 1201 bp, Homo sapiens
  misc_feature (1)...(1201): n = A,T,C or G
tcccctatgacttttccttcctctaccgcagcatgcaactgaatcatagcaagccgcttctttatgcaccaaacgtgctcgtctcagtactatgcatacgctngtactctcgcatcctcggnagcttctccatngcagtcatacataggagctactctatgaaagaggattattactagacgtcctacatcttacatagtactagcctaccctacatctcgctagcagatgttagagatcgacaggctacccatagcacacaaatggcggtacaagcgccctactaattgcataggtgataggaccttagtatccctggtaatcttgctaacacctccatcttgtcactatttatcgccttccttaactgtatcttggctgtagtctgtatacgaccgacgcatcgctctttcatgtatctacattggccataatttggaactactaccttcatggttgtactgattatcccccgtaacatcacatgctatggcaccagagggctcttcttgctaggccacggattgtctcgctgggctcgcgcctcggtatcccttcttgtttatcgatttcttttcatatctcgaccgctcaactatcctgacttactcattgtgtagtacatacgctcgcccgcactatcatgatcttcattctctcatgtacatcgactccgctattccatanaccgcgaatcgaatgaagtgatgcgcccgngcttcgacgtgaccgatcacgttatctgagacagtgcacccgcacctcccacttccgacctctcgtttattactattcataccaccagacatcccacatcacacacatgtcacactagccgctacgcctgtccgaccgtagctctcaccccgactcacgacatttgctcacaatgccaacgacatggtctacgcaactcacaacgccgtctanancgagttgagacgagacnatcgcgtatatccctatgtacttcgtctctcgtgactcctacgtccgtcngctctntggtcgtgcttactctagaccagactccaatgcgccacctacgacagtctccagcacgcgagcacggacacgcgctgcgcggacacggatgaaactcctatactacgctgcgcgtaatatgtatagttaatctttgatgctcctgctcgcactttctcgacagccactntgtgccgctacatcaacgagccgacag

SEQ ID NO: 16080 - DNA, 853 bp, Homo sapiens
acaacattatacaatctcacacaaacatcaatccacacaagccggcccttatcaagcactttaggaggcatttactgctgccaagacttgctcacctcagtagtattcaatcccatgatcggctgacaagccctgacaactgttagcctctttactacttccactattcaccaaaaaaaggaaacacatctagttcaaaccaaaggctagtccctaattctttgccgcatttgccccaaaactacttacattagtttttaaaagattttccaaagaagaaaacagaatttcttagtctttaaccaattgttctctaaacccaagaaaacattataaaacttgcttctgtatctagtaagtaagcacttaccactactttctaattataaagcctactctacccaccatagactatgagtaaaatacctactaaagacagcctaaaacgatcgaaaagactcctcggatccccattctttcctgttcacgaccatgccaatacggcccacaagcagtggtataacgatatgaatacttaacctttgggaggcccaatcaatttcaccgcccgcagaacgcattctacacacataccagaaccgcatgtggatcgcctgctctcaataaaataaaacaattaagtctcagttgctttagaacgagctactccgctgatcgcccctccatatgatactaattacacacttccttctgcactcccctcttttcctttttcaatacacttgcttctcagatttcacggaaatcacgacttaccctaagatctacacccgatcgatgtctacgatgtcatgaactccagaaggcctcacacataaacccgtacaccctc

SEQ ID NO: 16081 - DNA, 851 bp, Homo sapiens
cccgcatatgtatggccggtctatcataaacaatacaacgagaagcgggagagctgaataccaacccctttgcaggctttcaggacactactttcctgggtcactcctccttccaagcatcccatttaaacaaccaaaccctgcggctttttgtcttgagactgaagagggaagccgggagataagatgagacagccatcctgttctgtccactccatcatgaaccacaccccaggaagtctcgggtggacaacctactgactcatcccatccctcgtcaggtggcttaacgaccagcctcgtccaactttgatccttgtgtatattcacaatgtaacattcctacgcgctctctcctctgaatgccatcgccggcgtcgatcgctcctcaccgtcgtacccctctcctattatattctctactaagtggagtgctccgcacacctcgtattcgaaaccaccaccagcgccacagtattcttatctccaccgcagccccccgactaccacttaggaggggcgaactccatcgtaaaaaagtctaacccaccccctcatcccgtgtcctctcgcgatatacgccgccagagccgagatgaactcgtataagtctctcgtaccaactatttggtcccgccattacctgaacctcgggtaatcgtcctcctccccccaataacgcccctcgcttatccataataaagcgcacttccagcgccccctctgactctatacgtgcgagtctttcatgcgcggactccaacaggcgccctggccctaaacccccgtccgctccggactattcatacattatgtgcagtactcgttagctgcggcccgcgtcgatccat

SEQ ID NO: 16082 - DNA, 263 bp, Homo sapiens
tcctttttcaacaccactacttttccctgtttacaaatttacgatgactgttgaagatgtgtaggaagagatcaagagagaagcagagagtcttctggaaattactaccctacctctgtcatcctaaagatttcagaatcttagtatgagatcctggtagaatgaactctggattaaaattcaaaaacttgatctctggcaaacccattgacttaaacttctcggtgcctcaagctctactaaataatgcaaaaaaaaaaaaa

SEQ ID NO: 16083 - DNA, 867 bp, Homo sapiens
tcacaatactataatccctcgctgcgagtgttatcttcaattaatatttctgggaacaggctgaagctgaaatcatcattctcagcaaactaacacaggaacagaaaccaaacaccacatgttctcactcataagtggaagctgaacaatgagaacacatggacacaagctctccaaaaccatgagggagaagaagtcagagaataatgaagttcttccttacgtgatgtgcttcttattcccaagctatctttgtactctggacctggctgatgttgaaagcagagcattcacatgagcattttctgggttctttagaggctcccctgctggaatccctcaattgaatcaccggagcccgggtggacagatcatgacagttgtgctaaggagctctaatgggctgagcatggtggttaggacctggaattgcaaccctttggaagatctagatggaaggatgccttgaggccagcacttttcagacctccaagtcattatagacaagtctcatctctttacataactatacaatgcagggctctaaagcaagaggatcactaatagattgacatttgggtgccactgtatccttatatggaatgggaatacgaaggtaactacaaagtagtatagcacgattcgttctattgggctccttgtgttatagacatgcgtgctatcaaccacgcatcacgctattttattgtcttccaatctgcacgatcgcgcgccccggggcaacatcaccagcttggtaacatatacgaactgcgtatgttccgcgcggcccaaacattctagcaggtgttcagctatcgaataaatatcgtcggtatctgtctgaaatggtgaatataaacacag

SEQ ID NO: 16084 - DNA, 238 bp, Homo sapiens
tcggaatataagcaagcttcttaacctaatgtatggcaccttcaaaaagcctacagcaaacatcttacttagtgatgaaaacctgattgccttccccataagatttgagaaccaggcaaggatgtttactctcatcatcactcctatccaacatggtactggaagtcctagccaatacaataagggaagaaaatgacacaaaataaaggtagtaagattagaaagaaaaaaaaaaaaa

SEQ ID NO: 16085 - DNA, 764 bp, Homo sapiens
  misc_feature (1)...(764): n = A,T,C or G
tcttgggatccacagcaggcagcaaacttatggaacgtggtttccatggaggcggaaggaagataaggttggagaagcagctgcataaatggcctgtgggcctgaacatgaggggtgcccggccctcagggacccccacttcttgcgttctttcaaagagttttcaaggtggaagaaaacagagttgactggggttgcagactaagctgacacaggtagggtggggacagtgtggcaggctccagcaagcaccggatcagtacctccagccctagtacttctcagctaactagtggtaaaggtgggcctgggcctcaggaccttatggaaatagacatgaaggtccattcggatagatggactgtgttttaaaagcctctgcttttgctaatggatggtgaagcccgtatgctgttgcaccctttcccaaactctcttcacagggacccacagactcctccattagaaccctccccagcaggacagcaacttcccttcactcggtctgtgggcacttcaagttgcctgcatccaggccaaatgaagttggtgaggctatcgacgatggtcttgacaattacaatgcccagcacttttcggatacangaatactgacccacaacttcctctcgctggaacggaattggataagtgcactagataacgtacacttcttatggattagctatctcgtttcctgcctatcccacaacctttattcgggttctcgccgtgctgcattatcttctatcagcacacccctg

SEQ ID NO: 16086 - DNA, 516 bp, Homo sapiens
aagtagttaaaaagagaagctaaatagtcagttccccgaggctgctgctttccttttagtcacctgtgagaactcccaagagaccatccctctggcttctacttttagcagaaccctgctttggtttttgctcatctagaactttcttgccttgctctgcagcctgttcattggataactgttgttcgtttatttttccctcaaaaggagacgctgagtttttctcaccctcatttgtggccctctgaggctttccctggacttattatgctcgtgctactgccattcttccaaaatgataaataaactggtcctctccggcctctccatttgatgccctgctgccactttctctttactggagggtgattgctatatgatttggttatcggactcacgtgtcgattagatctatgcggctcctgtaagcgcgctccgctccccttgatggcgagtacggcgtcgttactttgagtctccggatactgtatgtaccgttttgttcggccgttgcct

SEQ ID NO: 16087 - DNA, 306 bp, Homo sapiens
ctacttcaaagaaaaacttatgacccaggcagaccgcttcagtgaggaggaggtcaagcagatgtttgcagcatttcccccagatgtgtgcggcaacctggactacagaaacctgtgctacgtcatcactcacggtgaagagaaggattaggggatcacaagtctccccgacattcaggggcagcaaacactgttgtggggtgtgacagggagctattgcagccagaggctgcaggaaaaaggcttcccttgtcctacggttggggacaaagcaagaataaataatgctaatgaaaaaaaaaaaaa

SEQ ID NO: 16088 - DNA, 760 bp, Homo sapiens
ttaggtgtaaggacccagagccttgaggtcatcgtatctgtcagcaaatcctgtagtttctatcttcaaaatttatctagaatacaactgctcctcaccaccttccaccactccactccagtgccagccaccgtcatctccgtctggattactacaggaacttcctaattggcctcctctgtatacctggaccctctatggctgagcctcaacacggcagtcagagtgacctttttatagctccagctggatcatgccattcctctgtgcagatgtctgcagagtctacacattctggcctcccacccattacctctttgatctcttctcttaccatcccgcctgtctaggctctggccgcccagcctcctgcctcagggcctttgcacttgttctctccgcctggccaactcccccatgtcccccaccaggtccacgtggtttactccctcactaatttttctttgctaaaatgtcatcttctcagtgaggcttactcaaaccactctaaaactgtaaaccgaccacccccatccttctctcctgctctattattacccacagtacaccgctttctaaatactgtttgatcattacactcaaaacaaaacaaaaaattggctcgtcttactcattagggaatccctgcagcccctccatttagagaggggatacggatgttacaccctccacgactaagcggggctcggcctcacgaagcgctgaccggcaataattctctcaagggcggcatcggacg

SEQ ID NO: 16089 - DNA, 814 bp, Homo sapiens
  misc_feature (1)...(814): n = A,T,C or G
catctcccctcttatcattctgtagttattaatataaaatttgggggggcacccnccgatttagtgtctgtggctggtcctggaggctgtttagggattcaagacaggtaccactttccacctcttctggaagtgatcagctcggcttggcaaaatctctctctgctgcccagcctggagtgcagtgggatgatctcggctcattgaaacctccacctccaggttcaagcgatactcctgcctcaggctcccgagtagctgggacttctagtgtgcaccacgatgcccagtcgctctggctgttaattccagcatatgctgaacagatgcgacaagagctggcctctttaccttgcttctgatctcttcggaaaagcttttatttcctaaccatttgcatctgacagcagcccggcctttatcaccctgaggtacacccctcctctacctaatccagctgccccttcccacctctacataactgttatctccccggcccacagaacaaattggcaccactcgccctcacctgtgagctctatacacttcatcctatttcacgtggccccctcaccgcctcccccatctccccttcacccatatttacctcgaaagccctaaccacacatcccacttctcccatctctcgcggttttctcaaattttcgggcccttcccgttgatcattccatgcccgaactccggcgatcggtgcttgtgctcgattctatgttctaactagacccactattatacgctacccactctctgactctaacctcttctatattatccccatctcgaaccgaccgcg

SEQ ID NO: 16090 - DNA, 832 bp, Homo sapiens
  misc_feature (1)...(832): n = A,T,C or G
acaccgaatcactaccccccacaattataatgtattttaatagaatatttataggccaacanaggggaggtatgtaccccaggaggctgtgcagctgacccttgaacaacacagatttgaactgtacgagtccacttctatgtggattttcctccatctctggcacctgagacagccaaaccaacttcccactcactcctgggcccactcaacctgaagacaaccaggatgaagatccacctccacttgatgaatagtaaatgtattttctctgccttaagactttctcagtaacattatatattctctagcttactttgtcataagactctaccatgtgatacacataacctacagaatatgcgtcaaatcgccggtttaggctatcagtaacgatcacgcccaataccaagccattaccaacttcctggggagcaccatcttaatactggaactcgtcaactgcanccaccacaccctcctcattggccaagggtccactatagccccatcgccacaccatctacaactaaaacaactcccaaaaccccacgcccccaccctagagaaactctttatacaacaaaacaaatctccccacgctcatcccacgtacataccctgaaaaaactcacacccgccgagcaatcacgaactccatccaccggtcgcgcatccaccccggggaccgcacctcgcgcaagacttaccggctccccgccacccggttaactgtataactattatccagtacctcgtcccgcatgctctaaaccattccgaaccctcctcacctgccactctacatatttcccattgtcatccaccacac

SEQ ID NO: 16091 - DNA, 212 bp, Homo sapiens
acgttggatggccccttcacaacgtgttaatataacagttgttcctcttattaagaactttaggaggcatacactgctgccaagacttgctcacctcagtagtattcaatcctatgatcggctgacaagccctgacaactgttagcctctttactacttccactattcaccaaaaaaagaaaaaaaaatggcctgcgctggcctcaacaggc

SEQ ID NO: 16092 - DNA, 475 bp, Homo sapiens
ctaggttttacggatcttttacatatgaagaaagaagcacagccagagccacagtttgtacaactccagggagagctgtgaaaatattccacgtgaacagcagcccctgaatactggacttcaacgtaacgacgtcctgggtctgcgcagtgtggcagcactgaagatgtctagatgataatgctttattcgactggggactttaatgaaaaatggtttacataagtgcacacataaacatagtgctctgtagtctgaaatattttacaaatatttcaagaactacagataaaattatactaagttgatcctaattgatattataatatacgatattaaatatttcttccttggtgtttttgcctgataccagattctgatgtaaattccaaatcggatattatctatgtctactctagcttatgttcaagcacaaataaaagggcaacagaaaattctaataaaaaaaaaaaaa

SEQ ID NO: 16093 - DNA, 656 bp, Homo sapiens
tacattattgatatatgcaggtctaagcttacagtgttactcagtgatttgtatttttctggctaattccatgttcctattggtctgtttttatttatcctgtcagattactaattttattatttcttccccttcacatgtttgcaatggtcaataattttagtgtttacataaattataaattattaatttacgaagtgcaatgctaatcagtgcattatctttttaaatttcttattaatatataatatttgtacatatttataggatatatgtcatatcttgttacaaacatagaatgatgatcatgatcaagtcagtgtgtttatttatttatttatttttattcttttattcatttttcttttttttttttttttagatggaatctcgctctgtcgcccaggctggagtgcagtggcctgatctcggatcgctgcaaccttcgcctcctgggttcaagcaattctactggctcatcatcctgagtagctgggactacagcttatgttggcatacctggctaactgctggttttttagaagaaacggggtgtaatcgtattagacaggcttggctccaactcctggaactcggtgatcctcccacttcaacccccacattgttggtattcaggcggatagccctgcgcctcc

SEQ ID NO: 16094 - DNA, 1421 bp, Homo sapiens
  misc_feature (1)...(1421): n = A,T,C or G
tcctacctgacgttctcgatccgtcctctcttccgattattgtnagctcatttatagntgctngcttgttgtgtgcttaaggtaaacaccatttgtaaagtagcttcctagggtatgagtcagcgagtagaatagatcatactaagataattttatacgatagtcgtntatactgcacatccaatcatcgcggcgaacatagaacttgacttntngtcatacaagtctacatatagtatacataacgatatacgtcacactngngatcgagtcacttctctaacaatatatatccacgaacnttcacgagtcatcgctagacaactagcgtatctcagctatattgtgtgcttcatgagcttatgtatacaatagatagcaancatactcacatatagtgcacaatgtagcctactcgaatagatcactcatacnttgtaatgctatagcggctcacctttgcacnggcatattctcgtggaacttacgtctagtaaacattaccacagatctcggcaccagtcattgtccgagcaaaagtagctatcatatttctatatagcaacaaacacacatagctaattcatctatgtagcgtctcttctgtagtgcgcctcaactantcngtctctgagaacactttattgatatgagcactgctttcttctctttttcataagcgagtgagtatatatccgcattagattatcctccntacctccaccttgtacatacaatcttgcctccntcacagatcctttctctagacctgatcggcaattgcccgtgttctcctcagtttcatcttctatattgcgacgagttatataccccggtctctacgcccatacgatatacgctctgtcagttcaatctcttatatatacaacttaatctatttgctttcagtcgctactactgccacacatctacagctacacgctacacaatantaccgtgcgtctatcacactagatgcgcactgtataacatcgtgctagattaccttctcttattccagactcgatcatcacttttattcacatacatagctatattctacacttaancgcgtcgccctctatactctcgtctcgctatactaccgtgtcgaatcgtacattacatatatcactcacatcatcgtcagtcaccctatcaccacacttctcatcgatcctattacgccataccttcgctcgctgatcacctgtccaccactcttcacctatctctaatcatctcaatcgtctatcctcctcatgtatattctatttaccacatcagctatcacgtantagttgttagtccgtataccgtgcacactntctcatacgtctactctcacnctctacacacctagcnacacagatgtcgtttcgcaacccacgttgatatcaatacatncatcactcggcgcg

SEQ ID NO: 16095 - DNA, 854 bp, Homo sapiens
actaatctaatatcgctttagcaacacgtataacttccaataccattttgcggatccgtgctgccgaggcttacggcagcccagcagcagggggcctgaccatacatggattccttactcgcagcagagaatgttgctgccactcaaagacaccaggggctgaagagctcctgtggagacccacatcatctaacaccacacatactcataactgggaaatgtgcattttcggggagaggacgagacccaccttttgtttacctaactggcatgacagagtgagacatacatgtgctcctggaaaaacgccgctgggagtatgcactcaaaaccttcaccattagtcactggctgaagggcaatgtggcgttagttctcattgcccgacgtgagcttatcgacctccgtcattgcagtactaatctacagcattgtggagaacaaaatcaaacaggcctcgcttggcctaagacaaagtaacacatgccgatagatccgttcagtttgggtcccgaaacgatctcttaataattataacactagtcctcacatccatggccgaacatgaacgcgatcgttcacattatacgcgaaaattcacggttctcgaatccgagttggcatccagacatatttagatgaaataactcaaatacgcgaaaactatggctctaatccttcaaaagagactactaatttaaataagtacaaatatatctatgcctttatcggtgatgtagcgccaacgcgtttataatgtaattccattatcctgccccagtcctgacatacccactccccaacccacagtagaggtccttcgctgtatttacccataaccactccctaccccg

SEQ ID NO: 16096 - DNA, 868 bp, Homo sapiens
ccgtctctactatttcatctgttcattttcttgtttattttatatgataaactgtgccatgaccgtagacacaacagaaacgtgttgcatcaggcctcgctggctgacgcaggccatgggcgggacctctgctggcacagaagccagcgccataggccgcatatataacaaatctgtcccaactgccaccaggtcctacagacgattattagttacccaaccagagtggagcttggatcactgctaatactgcgttgcgtacatgaatctttatttctatggagttaaaagctcaagaaaatgtctcttggaaatgcagcttggcatgaatcctattaactacaccatctggctctgacatataaaaaacaaatggcctccttcagcctactcagaggagctatagcggctgatcccctttattgaggtgtaattcatgacccttcctttctctctcgattctttcggccccacgaacgtgtcaaacagttcccatatttttgaaatgcagtccttctcgtacccccccgcatcgctaggaattcgtctgtttcactttttagtgcactcccctcctaaatggcctgcaacccgtgctcgggcccactcgatgtatattttcttttaggctatctcccgcctgtatacctttaaatcacccgttagccttgccctcactttatcacttaacctcgacgtgatctttctacatacactacctttcccgcctatgtctgaactcgtaacagctatctttgttaatacctttccttttacccctaacccctgtctcttccaaaccgcgataccctgatccctcccctatttttcccctaaccgcgcttatttccgattgagtctcctacac

SEQ ID NO: 16097 - DNA, 326 bp, Homo sapiens
atggtggcatgagcagaacaaggaggcgtcacactgcaggcaaaactgcaaagaaaggggccactttcattctgtacccatggtgtgaagagttaaaacccatctaaggagactttccaagactctctctggacgaccactgtgttcataagtgcccctgtacagcaggaagatggggtgatttgctagggtcttttctagccttggagattctgggattctagaattactcttttatagtaagacatgatctctgcaatgtcattgagatttatatgacaaaaaatgttctttaggggctatcaattaacactttataccacaaa

SEQ ID NO: 16098 - DNA, 857 bp, Homo sapiens
  misc_feature (1)...(857): n = A,T,C or G
gaaagagagaaaacggaaaaaagaaagaagaagaggggaagangcttaagagtcaaccagcagaagcnctgcaagggcgaaccaaagcccacggggcggcctcgccacccgagactattgacgcaggagacgaactcacccgtcgtcgccagtgtggcaccggacatgaccccaaccgcagctgcgcaaacacgtaggatcactggaccagacacatcgaacgcgaggccacacgagactgtagggaactctgacctgacagcaggtccagactcgacaacagcaaggagaggatcagttttttataggacggagcggcaggcaggaccacgccagagagcttagaaagagggacgatgtcagccgaaaacggaccggcatgacctactgcgagcagctccacgcaggtcgaacagtacgaagggactgccctgtggggcgggacagcacgaaagagcacgcgcggagcaaggacacacgggagaagtcagcacaaccaccaaagctagggtcaggaaaacgccaaagggcatctcggaacggagggaagcgcaagcgccaagggacgcaaccaactggagaaaagcgaacccgagcccgtcggtcaaacgagaggagcggcgcaagccgcaccggcagggggaaggggaacaaaggacccggcaccaggggctcgacgcgcaagggcggaaggtgacgacaagcccacaaagatcagggacaggcgggaggaagggcaggaacagaaggcagggaaggacccgggaaggagagagtgagccaggaggacgaccagagccaggaaacggagcagggccgggtgacggccgtaaggcatacggccatggacacagagg

SEQ ID NO: 16099 - DNA, 1168 bp, Homo sapiens
  misc_feature (1)...(1168): n = A,T,C or G
cttaagatagtatagaatactgtggttttaagtgtttgttattatagtccacctattgccgtgtattctgagtactcctgagctagcaaaggagagatttgtagtacaatgcgcttatctgcagacacagactaggagtatcactgtaccgtggcagcattgctacctcatgtatggtgaccgatgtgatagagagaccacaggaacagaagaacatgcggacatactactgctacttgcacatctacattcccgtcgtggtgcactcgtcgttgtatgttgatcacatctctagaggtacgttgatattgtcttagcgctacttatcgttggctcatagaaatagtgtgtataggactaatctgctgacaagtggcaagtatagctgtctcatctgccagtataagcataatattaaagagtattctggtagtcttgcaaaatctacgtataggcgtatactattactctactacgactggacgccagtccagtattagtaattcaagtgcccatagcattaagtcgttctcgggtatctcgcaatacaataaagggttcaacatttatcaaatgggtgaactgagatattgtaataataataccataccacacttcatctaccatntgtacttatcctcatgaccctgattggaaagtagtggtgatagattgcatgattaaacacatcgcggttacaagtgaatatatagatagaatataacaatcgggacgatcttaagagcactaacgttcctcggaaatcactctatatcatagatagtgggtgtgattaatgtctgttgatattcggtgtatgcgactcatttgtatctatagacgtagtcgcnctagtctagctctgtattccaaaatcatttacaggttttcgttttatattctcgatttaaaacaattgtgccttatagaattaaatctcacccgacatgtttacctattagccatatcatggcgtattgcgatgaacttgtagtgtgtatatgtattatttgatattacagatggtctgtttttttaattggnatgttacatgatcagtttcgtaacgtagtcagtacgtaatcggtctatatgtgattattataacattatttctatgtcgatcagcgcacgacatattgtcactctcgtcatgctgcacgacatt

SEQ ID NO: 16100 - DNA, 181 bp, Homo sapiens
aagaattatccaaagaatgagaacagatcgacaccctcgatcccagatgtcgtccgtttggtcgttcaaatccttgcataatgggaaggaaaggctattcttgaggagcaactcccggcaccacagtaataagatggtgaaagggttcttccacctcaattatcgaggttatgagtgacat

SEQ ID NO: 16101 - DNA, 786 bp, Homo sapiens
atccagaggtcttgaggtgctggggagtgagcagtgctgagaagccagcagaaagggggctccagttggcagcattgtctttctttcttccctgtgagccccatgcagcagccagtgggtccctgtccctggttccccagggtgaggccagctggaggaccacacctgccacttatgtggaatcttcctctgtggagggtcggagatctttgcttggcagagctgagttcgccagggtccctgtctgcaccatctctgtcagctagtctcaacgctgggaccatggttgtggggggacagtgaccacacttgctgtctactatggtaattgagagacagactctcactctgttgcccagattgaagagcagtggtatgattatagcttatgcagcctcgaactcctggactcaagtgatcctcctgcctcagcctccagagtagctgggactacaaggacccgttactacacccgtctacctttaaaaattttttttgtagtgaaggggtcttgctatgttgctgaagctggtctcgaactcctggcctcaaacaatctacccaccttgaaatcgggttttttattttctgatgctattacatctccggacattgctaaccctggagggactgcccctcccagggccaaccaatttgtagagttagtaaacaactcccccgtggataggctttctgtttgcaaacccaccaatgaagagccctttgcccaatcacaggccctaatcaccctatgggccctgtaccagattaattaaagacatttgc

SEQ ID NO: 16102 - DNA, 817 bp, Homo sapiens
atgaccttcctgtacgcctccttagaggctgctgggctgatccacctacagtcaacgaccagttaccactctctccgacacctcacctggatgattcacgtcctagaatcgctccgggcatcctccctgccactcccacaggatggagtacacgtgtggtccacatcttttccgcctctgtcaccctcataagttgtccctcaactaccagcttcagtgcgctctcctctccaagaccttccttccaccccagatcgcttatgcaccatacgtgacctttggtcttctggaacttctatggcgctgtggctgctgccaacactcaagactgcacggctcctgtggagaccagcatcatgtgtttcacagacgagggagatgtcatgactcactacttggactttaccctctctctgagcatgtggggtcagccgtggggcctgtcaaaccgaggacgggagttgctacatacgggctcaagtggatgagagccaagttaccccaagtgaccactggctaacgcctatggagttccaccatcttctatccttggctcctcgggagaaatattcgactggagggcgtgaaggaagactacgagagcgcgcttcgaaacaggcagggaacgtaaaccgaaaggctttcaacgaggaggaagtcacgaatctgctggatcaaaaacgcaaaccgggggcgctgaggggcagtcatattattaggagatcgtacccagaactagcgacagagagcggcctttgatccttggatctcggggactccaagacgatttgccttaataaccagtattggtacactt

SEQ ID NO: 16103 - DNA, 563 bp, Homo sapiens
cgttgtaacattcaaaaccaacccatggacaccactaatgggcatccagtcaactccaggaccaacaccctttgtgatcttctccactgaccactcctttcttctccctctgtctttcagcaactggtgtttgctgtatattgttattttggagttagaattcatatataacaattcacctctctgaagaggccatttatttctggccatttatctaaaacagcagaccacactctgccccatcacatactttagttttctcctcaacagttatttgtacttgaaattatgccatttgtttgttggctgtcttctttactaggatatgagctcacagagaacaggaacttcacagtgcccccagagcctgggaccaggcctggctcactgtgatctccaatgaatgagtgaaggaatgaaggaatgaatgaacacctcctcacatagactatgctgtattttatctctttacctttgtgttttgttattgttggttccttgctttgcatttgttcaaatcattaccctctgccgaaaaaataaaaaaagtttattcgtcaaaa

SEQ ID NO: 16104 - DNA, 273 bp, Homo sapiens
  misc_feature (1)...(273): n = A,T,C or G
cctgngtgagacctcgctaccttattagaggcctatggcttagttggttaaagcgcctgtctcgtaaaaaatgtcagcctgagcaacatttctacaaattattatttttttaattagctgggaatggtggcccactcctgtagtcccagctactcaggagactgaagcaggaggatcgcttgagcccaggagtttgaggttcggtaagctataatagcaccactgcaccttcagcctagacagcagagcaagaccctgtcaaaaaaaaaaaaa

SEQ ID NO: 16105 - DNA, 702 bp, Homo sapiens
  misc_feature (1)...(702): n = A,T,C or G
gnncttcagtggaactcaatttcttttatttaagctgcacctcctcagtgatgtggcccccctaatagtcctctacatagtgacccctccccctttagaatcgttattgtcatttggaaccatagtagcttgtctccaaagatggccttccagtaactcatgcttcctgatgatcaggccctaaataggttgtccttgtgacttccatcttgacccatagaatgtggtggaagtagcattggttgacgtccaaggttagttcataaaaagccttgtggattcttcctcagcctctagaaacacttgctcttggagcgtatgctctgaggaaatccaaatgtcatatgagatgcctgagaccacctatctcagactatagtgggagagactactgtgctgtgaagaagtacaaagtagccatgtgaagataccatacggagaaagacagatgcctaggtagcccctagctgtgccagccatcccatcagaatcaccacacataagagtaaaggaatcattgtggatgtccagcctagtcaagcctgtagatgattccagttccagttgccatctgtcagtaactgcctgagacccaagacaagaaccacccagcttagctcagtaaatccacagaatcacgtgttatcatgataataaattgtttttttaagcaataaaaaaaatcggtcttgttggccttaa

SEQ ID NO: 16106 - DNA, 635 bp, Homo sapiens
cctaggtggggaatgaagaaggatgaacactagcagaggaagaaaaagcaatactggagcacttaaaacaaatttgcaccccacagaactcttctgcctcagataacatagaggaacagtaatctgcagaaaacagcaacagctttattttaggaaacaatcccatgtaatggagtaggattttttaccatagtcagaatgaacctcatatgtgctgtgaagcatgaaaccaatgactgagtaatctctgtactgaaaaggaatacagcacataaaggataaggtgctacatatttttttattttaaaaataatttcaaatgtttttctttccccaatctttctctttatatgatataactgctgccatctcgtgttccctttgaattatttttttctcctttcagtcttgaagtatctatgacaacaggaagaaatgttcagaaattttttaaaggattttttaaatacaacatttggatgttaagttgagtggagtcacatagccccaggaggtcatctgaaatttttaatttaattttgttgtagctgtagcccaagtcccaattttaattgcctttactatccacaattgtgtcaactttcctcattcaatttatctaattatagtcaaaa

SEQ ID NO: 16107 - DNA, 823 bp, Homo sapiens
  misc_feature (1)...(823): n = A,T,C or G
aaaaaaannngggaannnnnnnngggnnaaannaaaaaaaaaaaaaaaannnnncttgngggaaaacaacatggtattttgaaaccagaggtatgaatctcccccgtttggcatcccactgggcctggacctgtttcgctgctaatgttctgctgccaaaactatactagctgcctggactattgcagaagagctgaagaagtccacaacctggaaacaccaagacaaccagacaaaaaaagccctgaaacaaaagtttgctgtttctagccaaagaatcattataggagcagcctagcatgaaacaaacttgtaagcaatggaaaagaaagttgccaaaaacagagaaggatattacatgataataaaagtgtcaatccaacaaagagagaacattcctaaacgtgcatgcgacaaacaatgatgctgcaaaaaaatgagaatcaaaaactgacagaagtgaaagaagaagtcaacaaatcagcacttatagtctgatacttcaacaaccttctcacaacaatggatagaaaagctagataaaaaattaacaagcatacagaattcaacagtgctattaaccaacaagaaacaagatctgaaaacttttttagagtactacaccccagaacaggagattacatatcatttcaggtactaacagaccatataccaagatagagtacaacttgggtcataaagctaattaacctcaacaaatgtaaaatacttaaaacatacaaagtgtgttctttgatcacatataaatcaaacctagaatctttaaaaaaaaaagtcggcctcgttgccttagcggtggagt

SEQ ID NO: 16108 - DNA, 604 bp, Homo sapiens
cctggttggagttgaatggtgtgatttaggctcactacaacctccacctgctgggttcaagcaattcttctgcctcagcttcccgagtagctgggattacaggtgctcgccaccatgcctggttgatttttgtatttttagtagagatggggtttcaccatgttggccaggctggtcttgaactcctgccctcaagtgatccacccgccttggcctcccgaagtgctgggattacaggggtgagccaccacgcccagccctggttatcactttttgagaatgtactacttattaaaaaataaataaataaactgaacaatagagcaacttcaggcacgtccctcaggaggtgtccagaaagaaggattgttatcataggagatgacagcttcatgcgtgttgttgctccaaagagcttccagcgggacaggatatgaaggtggaagacaatgatgttgatgatcctgatcctgtataggcccaaactaatatgtgtttgtgttagttttttataaaagagttaaaaagtaacacaaaaattaaaaatagcaaaaagcttgtagactgggatataaagaaaaaaaaattttcttatagctgtaaa

SEQ ID NO: 16109 - DNA, 742 bp, Homo sapiens
gctctgttgccaggctggagtgcagtggcacgatgttggctcactgcaacttctgcctcccaggttcaagcgattctaccacctcagcttcccgagtagctgagactacagggaaacttgactgagaggaagagaaagctaaagaagtatcaaattcctctctaagacatcttcactagtcttccagaacatctccgccttgggaagcagaactctgaggtccgggaagaccttccgaccaatccactgagacattgctacggctgcctcctcttcactttctggcctcttgagccaacatccaacatgatcttcatgagaggttgccggttacctttctaaaaacgtatttgaccagatttcttcatgatatttcaaaatgtaaaggcagaaaacaagttaaactttaaacaaatttaaatttaaacaatctaaaagggaatttaagtaagcgtatgactttgttgcagaggttctaggcttccttttttacaaaaggatgggaaattttaaagcaactgctctgactaacccagaaaaatctttctttgtttatctcctttgtatttagccccaatatctgagaaaattttaaacatagtttttttttctaggattggtgcctaagggtcattcccttacgaaaaccctaactttttttacccctttgttgaatgaaggagctggtggaagttcaaatttgtgtgttaacatgtgacttcaattagagtctgaagatggg

SEQ ID NO: 16110 - DNA, 778 bp, Homo sapiens
ctggggggacatactctgtgcctgcgactcatatgaatctgtccggaaactcatgagtactacctgcatatggatggggaggccccttgagttctgcatatgacagatgatacagcaggtgcttggctcttaaagaaatatgcagaactataccagctcaagggaactacttacacactatactgagaaaggcacaggacattcgtataataaagtggagcttagttgttcttaaaagaactgacctggcagcatattatctagatacataatattggagaacacgccgttaaaacattgaatattatacaggatattgctatttgcagttatgtgggaccaatcattgatatgtactaataatgtccttagacttgcggttaaaaaccggcctaaaataactggcgctatcattcactgtgacctgatacatgctgagatgtaaaccatgcgaagtcaactaattggactttgatggctctatcttttccttcagcgaagatcgctatttagaactggcagatcatttgtcctagcctagcacgatgtttctaagttcaatctacataagccctgtgggagtgggacacatagcataccgtgttattaaacatgactaacttggttgcataaaagcgcttattataccgtggcctatctgtttagcgtgactcaatacacctattacctggggggttgctaggagtgcaatcacgctacaaaaaaagccatttagagagccctaactaagagaaaatggaccctccgaggtgaaaga

SEQ ID NO: 16111 - DNA, 742 bp, Homo sapiens
  misc_feature (1)...(742): n = A,T,C or G
aaaattaaaacatcagataaaaacctagtcaacaacaatacactggagagaaagaaggacaggaataacttcaggcgtggctcatctgcgaagtttaacataaaaagccgctgacgaacgcaccaggcgaaaatgagaacagtaagatgaaaaagcagaggctgcctgggaaagtgggtggtctctgggaactagaactgctggttttctctacaattgacaaatcgatattgaacctggagacactcacgggccagcctttcacagcctcggtgttcggtgtgtgccatgtggaggtgtatttgatcctcatccttcttggaagaatgaattctttgcacaaacaggcagggttcctgacacagccactacactagctcagcctcaagagaatgaaatactgagacagatggctggctatggctcgtgcggtggggtggccacacgaggcatcgaaagacaaggaggccggcagccctgctctctgagtttcctcctcttgttcaccaagcaagcgtcccgaggtacttaggggcttgtgtctccttccagctcattcctggtgagcctctctgggcaaaaacaatggaatgggcactagcccaaaaacacttaagaatcacgatagattgcatctactgtcagataaagcaaaagaaaggaacaaatcgttacttgttcctgntaggctgtgtttgggttggttttcgcatctatgtggattggctgtaataacctccca

SEQ ID NO: 16112 - DNA, 767 bp, Homo sapiens
  misc_feature (1)...(767): n = A,T,C or G
ctttggtcataccngtctaataacagtaatcagagagaagtaccaggatcataattacagagagaagtttgaccaaatccctttctgaagaaaaaaagattcttgaaggtagagaagtagaaaagatcaataataacaaaaaaaaggtacttttgatataatggaagaatggcgactgtggaaataaatatgagaagaggaaacatggaaaggagtgaaagttaatatagagactcaatttatatattgggatgaacatgggccctggatgggtgtagacatactgtataaagatcgaggccatcaagctacagatggtctcacaaacagaaccccaaatgagctcaactaacaacttctactgaggacccctggactgacccgctgacgctttggctggcctagagagttcccctctgaaggacaatacaactgcagggccccttcttcacccttatccagcaggaagtagctagagtggtcatcacccaattcccaacagcagttggggtgtcctgtttagaggggggattgagaggtgaagccagctggacttcctgtgtcaagtggcgacttggagaacttttttgtctagctagaggattgtaaacacaccagtcatcactctgttaaaatgcaccaatatgtgcccggtgtctatcttaaggattgtaaatgcaccaatcagcattctgtataaatgccaccaatcagggctctgggtctacctaaggattgtaaatgccccattatgactcttgtaaaag

SEQ ID NO: 16113 - DNA, 678 bp, Homo sapiens
ctagtgtcacggaagttctgcctgctggaactgaaccatagcaaatgcatctccatttccatgattcagtagctttgagtgacaaagtaactaatctccagccctggttattgagaaactcctgaattgtttgcactgagctgccggtttcatccagaattcctggcaaaggtgttagaacggctccatgattggtcagtgaaatcatcaccatcttcccagaactcaggtgcaagctgttgggatgggaagccagtcacccactttattttcatttcctgaaagtgatctggtaccgtttgtcatgggtctttgtcttaagaagcctcaaccgtaagcgtatagactggggacaccacagtggacactgatgctccagggatgaggcgtgcccagccattgcagttttaaaccggaaaagtaattgccttggtcaccattgcacccgggcctttttggttactctgcaaagccatttcatgggatttcctcctaactgggcctgccctggagaacattttgaaaggccctcccccctgttggggctccaaaaggtaaaccttcctcctcttattttttggcgaaccaacttttttttttacccttccgaatatttttgttctgcgcgggaaaccccacccacccgtgtaaaaaaaaataaaacgggggggggcgctg

SEQ ID NO: 16114 - DNA, 555 bp, Homo sapiens
  misc_feature (1)...(555): n = A,T,C or G
aaaannnnnnnaagggnnnaaggnnnnnnnnnnnnnnnnnnnnnntttcagaaagnaaaaaacaacctgaaaaagaatagatcctgacaaggcttagagagagaagccagcatggttcccccatgagaatgatggagaggacagcaaagtcactgactggacctgccaaccaggggtcacttggcagaagtctttgttcccaatccctggtgccagatgctacagcaggaggtcagaatgaaccagagggctgggagtgctggactctcaattgcaggactaattctgaaactgactagccatgtgccttaagaaaagccacctaaccctctctgagcgtccctgtgttagtgtgtatgtaagtggagaaaatggtaatgcctacctcacatgaaggtggttaaaaaagaatgagaaagtggatatgaaaattcttgtacaaaataagtctctttcacctccccgtacatttctttgcaccttcctgtggatcttcaattatatcaaaattaaaacttttaataaataaatatttttcactcaaaaaaaaaaaaa

SEQ ID NO: 16115 - DNA, 217 bp, Homo sapiens
cctggtcatgaggatagagcccgttgtatgggattagtgctctaaaaagacctcagaacgttccatttctccttctgccatgtgagctgatagcaagaagacagctgtctatgaaccaggaaatgaatcctcaccagacagcaaatctgccagcctcttgatcttggacctcccaggcttcagaagttaaaaaaataaatttctcttgtttataaaa

SEQ ID NO: 16116 - DNA, 343 bp, Homo sapiens
cttggatagtgaagtaatttgtccatgatcacacagctaaattgtggtggagctgcgctttgaatgcctcagaaactgttccataactccactactccactgcttctcctgaatgcagaactgatgtaatgaacaaatggtcactcatgcattacctttgaaatttaacatgctcatataatcatagagtctgaagttagaagatcatctactttaatgatctatccaacccttaaacctcctttatcatatgcctaagtcacaatctgccttttgcttcagtaacacccatgaggtatctgtaccatgtccaaagaaaaaaggaacgccttcatcttcaaaa

SEQ ID NO: 16117 - DNA, 818 bp, Homo sapiens
  misc_feature (1)...(818): n = A,T,C or G
attatgtagatatgtgtgattttttatataagtaattttttataaataattattttattcggtgaatactcaccacccctgtattctttatgtttttaagggtggcactcatttctgccagaccctctgtgatgcaatattgtttttgctttactattttgcgtgtgtgtgtgtgtgtgtgtaagagggtaccaatttcagagctttacgcttggctgtattcaccctgatagctcttaccccactggccaaactatatgatatctatctttttgttgaatttctcatacagattatgaattgatttcctgctttcgttgaattgtctgtattcttatatttcactgagtttccttaagatcatcattttgaatttttttttagggatttcatgtatatcatttttgggaggatctgctaatggacacttatttgtgcattgtgggaggcgtcatcttttcttgcttttttcttattgagtgcctacattctctacacgatagaaactggtttaaagtatttagctaaggtacaactgggatttcttaaagaatctaatttggatgaggacaacttagagagactgctttaagcttgactttattgaggtaactcctgcacacggctgcgttctagcgagaacttatgccgtatgtgtacatagatcacactgtggcggttgactatctaacattgaacatgatctcccatcgtattaaagtaaagtgaatagtgtgcgtgtataatacttcatgncccaggcggggtaatgaggtggcggagtggaatttgtgccggtaaaggggggaaatatcgat

SEQ ID NO: 16118 - DNA, 563 bp, Homo sapiens
  misc_feature (1)...(563): n = A,T,C or G
tttttttttttttttgctaatgacttattacttgtttatgtttagactatgaaaacgatgctagacaaaaagccaattcaagtgattttcttattcaaattcaaaatgggtcgtaaagcagtggagacaactcacaacatcaacaacgcatttggcccaggaactgccaatgaatgtacagtgcagtggtggggcaagaagttttgcaaaggagacaagagccttgaagatgagcatcgtggccagccatcagtcactggacaatgacaaattgagagcaatcatggaagctgatcctcttacaactacttgagaaggggccaaagaactcagaatcgaccattctacagtcattcagcatttgaagcaaactggaaaggtgagaaagctcggtaagtgggtgcctcttgagctgagcgggaatcaaaaaatcattattttgaagagccgtcttctcttactctacgcaacancaatgaaccatttctcgatcagattgtgatatgtgatgaaagtggattttacatgacacctgcgacaccagctcagggttagaccagaag

SEQ ID NO: 16119 - DNA, 773 bp, Homo sapiens
tagtgcatcagtgataaaagttcgggcaccacctctggccccaggcctcattctggagcagttattcacacacaattgacttccaagatgttcccagggagctccttcctgctgagggctactaatgattcaaagaactcacgcaagttgacagagccgcctccccctggagcagttggaactatggctgcaggatggatgcatttctgacccccacaactctaaccacacacacacacacacacacacacacacacacacacacattttctgacccccacaactctaaccacacacacactcacacacacacacacacacccctgccccagcccacacgctgcgttcccagcaatatttatttcctgccacgtgaaggacagagtttgggtatttccaaacacaccttgcctggccgctgctggagaaaggccattcaaggccctctggagaggaggagaggtcaggcagcgacagaggaggcagcctgaggcctttatttcctcgtctgcctgctccacctgccacaggccccgggtgccttcctttgaggactggggacctccccaccttcctgcccaacccttgtcctaggtccagcatcctctcatctggcagtgaccctccaggggtccccggcaactttcggtatcctgaaaaggctcaagaatccttcagctccccaaggaaagatggcactagccacctagacctcggaacttgtttctgatttgggcagccatgacatcctaagatggaaatcctggcctctc

SEQ ID NO: 16120 - DNA, 764 bp, Homo sapiens
  misc_feature (1)...(764): n = A,T,C or G
ctgggtgaagcacaaaggagattcttgcaagatttggaagacctagggaaggaagtgacattttatggctgacctatgctgttgctgatctgctgcatcatttcaatggcataaagcagcatctagatctgcggttgtttagtcttttctggattcatcttcagttttttgacccctgagccagactcagagttcacctcctccaggaagccttccttgagacgccattgctcacctggctctacttgcttgaccagaaattggttgatgaagaccttggacttttggccaagattgaacatctacagtggagattatttagtgctgttttctattcacaggcctagccactccaacctgtctgttgtctttacatcataggactttacccaaggtgcactctataatacatgccagtccaaatatacattctgacagacaatctagctgcccacatctgtcagatggctctttctgtgacaactgaggataagaattttttctttaagaattagagctaaatattatgaaatataatctagacttcaagaaactttgacagttacctgtatcaccgtctgtggatgaataaaaatctctttgacatctaagacaaaatggccattcaccatctatctgaaaattctagtgaggacagccatactttctgaggcatgttgaatggctaacattntagaattcttccttacattggctgaaatatgactgaagtttcacagatntacccttattcctcatgataa

SEQ ID NO: 16121 - DNA, 790 bp, Homo sapiens
  misc_feature (1)...(790): n = A,T,C or G
ctagatggagtcttgctctgtcactcanactaaggcacagtggcatgatctcagctcactgcaacctcagtctcctgggttcaagccattctcctgcctcagcctcccagatgcaggttcagaataagatgaatatatttgctgcaattacagactttgttgaataactgtgaatcagccaactctccacaaaccatcttctacctatgtctgccagaaatcttctcactgctttagaggctaacgactaatatacagcagtcatctgttgtactgcaaagccctataaacagattcaacgtcattgttctttaatgaaaaagaaatatggtctctatatgctgctttcattctcttggggtaaaaagattttgttctcaatttaaaacaaaatgctatcatcaatatcccctggaaattccacttaattaaaatgctctagtcatacaatctgccaaataaaaacttggttaatttttcaattaactgcatttaattagaattttataatacggaggagatctgcttgtgtagcttatcctcatcaaagaggttgtactttggtcaaaatgaagagaacatttaaaacataatggatatcagtaggataaaatgttcttctttcaaactaattcctcatctggctgcacaacaagataaaaaaactcgcacactcagttgaatctggatgtccctggatgcaattctcatgactccagccctgctgcggccaaatgcctgcatgcctgcagctacatgggtattggctcagatcacaagggctggcttg

SEQ ID NO: 16122 - DNA, 1090 bp, Homo sapiens
  misc_feature (1)...(1090): n = A,T,C or G
tttttttttttctccgnnnncccccnnnnnncccccccgcgnttttntctggggctcnccttccgccntccatntgnttnncncccnccttttttnnctttatnatttttggtattgngctatnattcagttctacccgctaaatatatttctatatatgaaatcacgaatacccaaaaaccacgctcactaatattgatgttttgttctccgccaccgaatgcgtggaggaggcgtggctaacggtgagcgcgaggcgccgcgtctgcgtttgttccgttatttgaggcggttgcaggtccccccggctatccagcggacaacaggtaggtggtgtgtttttcgtgtctgcccactcatatgtttanatattctctcttcttatccgagtccatgaatcacgtcctattcccgatgatgcggagcggcatggcctgacggcgtgttacagtacttacacccccttaccccccgacgccgggttcgccgcgctgtgtcattcgttctgggtgagggggcggtttaattaacccggaggcgaggaggggggcgggttggagccggacgcggcggggtttgcgagaggcggggggcggggccggttgggttgtccgctgtcatataatagtaaccgatagtcgtcttgtttattatatatccacgtctttcttcccttttccgcttccatcgcccgtcttccatccgtcatttcccgagtgcttgccggggatacccatagtgagattatcgttatcactacccaccgcgatcctagtatcggtgcgaccccatctcttgtcccccccccgcgcgcccgcccgcggattatgcgctatcgcccaccatcccgggtagccgtattcgctgtgttttttcgcgccgtgatgacggtagcagtatgctgacgcgtccggatacgctgcgccattaccgccccgcttccacatcggtttatgctcgacgagccgattgttatcctaattgtatcccgagatgcgatacggattgacttcccgatctcgtcctcgcctgttactcgttattccgctctgcatttaaaatcgtgcgcgatagttctctccgccccacg

SEQ ID NO: 16123 - DNA, 686 bp, Homo sapiens
  misc_feature (1)...(686): n = A,T,C or G
atgatgggagtttcctggtctttccccagaattatcagacctgtgcttgcagaatgcagagtcctgagccccagatgatttctcacttctccttcaggcacaagagatagggagatgtggacagaaaattgatgacaaatttgaaattctatattgggagaggcgtacagagggaagagaacgtctgcagaaacgagatggaaaaccataaagggaaaaaaagaagtcagatatatttaaaagtgtgtccaagtgccttgtctctggaactacttctcttcgggcctccatctggcttcagtttgactacttcaacagccttttaaatggactcactattctcagctgaaatcttcttctttgttcatgtccagtggttaatccagcctaaaacattttaatggcttcccttcagtaagtgaatacctgctaacttttcacaatgaaactcagacataatatatttatggagccttgcataaaacttctagaaagtaaaaatccaaaaggaacagaccactctctctgtacaaagccacaaacttagaggtgtttgtttttttgtttacatggctttctccctctgttatactgtaagttcctcaagaacaaaaactgtatcttacttaaactntgtttaaataagtgtttaattaagttttttaaaaataaataaatatttcctt

SEQ ID NO: 16124 - DNA, 818 bp, Homo sapiens
  misc_feature (1)...(818): n = A,T,C or G
ttaatggttaagatgggtaaggtagtggataaaaagttatattttaatttttnagtctattctagaaaataggaagtgacaatgaacattaaagctgaactcctgcattctctctcaatggagcatgaaataaggcatgtcatcatgtcagcgtatgctaggaaggatttgcttacaccccggtccttttagtatgatgcagctatgacattcagtcttcaactcactttgtgctgatggtgtccaactcaagcccacacatgatacttttccttattatcgcagaagtctctacactgctgaagtatggggttaaaatagaagattgttgacagatagcatactggatgtaaaggggcacatcttgggacaaaaagaagagctctgaagaataatatttgttgacagataaaaattatctgaaatgcacgtttctgtgtccacaaatgtttgattgaaacacagtcatgcctcttcatgtctatattgtttgtggatccctgtggactgggacatgaaagtcagcagttgcaatggagatatttggcctgcaaagttcaaagtattcactattttggcatgtaagaaaaagtgcaatgaatccttacctacaatgctgcccacgaaagcacttggtatatctgggttgcccatataaaaacaaccatttcttattttcgccatatataccattatggtcactcattctctgccgctgttaagaatcggaccggctatggcgcccgcgcatgacccctataaacagcatgggttagcagagggcaacatttaagacgaggcaaagcgaatagaacgtg

SEQ ID NO: 16125 - DNA, 772 bp, Homo sapiens
  misc_feature (1)...(772): n = A,T,C or G
agatagggtcttgctgtgctgcccaggctggagtgcagtagtgcaaccatgagtcaccgcagcctcgacttcccaaggtcaggtaatcttcccactaagtctcccaaatagctgaggctacacacacaggccaccaggcctggctaatttttgtaatttttgtagagacagggttttgctatgttgttcaggctggtctcaaactcagggctgaaggaatccactggcttcagactcccgaagtgctcagatttcaggcataaaccactggtcctggcctctataatgcactctttaaggaaatgctttattttacattctacctccctatggaaatattaaatatgaatgacatcagatattttcatatataatggttataaaagggtatgtcaaagagggaatttacaatattctttattgacttgcatgtttgttttagaacacattagtactatgttgaacaatgtggccctataaaactagatagtccagacctaaattatctagctgagattgttgtccaaataaatgatctgttcatcattaagttaccacaagttgggagacacttctctggggaagtggaacattcctgcacgtctggcaagcagcaacactgacagccctctgttctaganttaatttttgaagatgtttgtataaccaacagacttggaagaacagaataatggctcactctggagcaaagggcagtttagcttcctgtccattagagtgtctccctcaaggcaacaggggagtttgcctg

SEQ ID NO: 16126 - DNA, 753 bp, Homo sapiens
  misc_feature (1)...(753): n = A,T,C or G
cctgtgggaacaagaaatgactcttngatggataacgattgaactgtgtcctacaaggtgaagacctgattgctcatgaactgagaaggaaagcaaattcctaaacaggaagacctccctctagcaataacagcacctgccagaatatgtcagctctgaagccaagacaccactggccacaacctccatcaggttggggaggaataattttatcttggctgagcctcttctcattttaatcttgggttctctgggaggtgaaagaggaaaattcagggagctgggaatgtagagaagggaagcgaaaggacattccaggacacttaacaaactattagaaaagggaagctgagtaaaactactctcagatatctagaacactgtttgttccactcctcttcctgcttgtgtcaccctcccctgcacagccacctcgtgtcacagtcatgtcttgacacaggcaactgtactgtaatccttgtgaaaatgtttagcatgttcagaggtgaacccaggacccctggatatggcatttattaagtcagcacttgggtagtgactgctgtgattctaggactcttagaaacggaaatccatagaaatggatcatggagaaataccctagaatcccagctgatccaagtgtccactccccctgtcaagtcagaaggcttccatggaactcagactagctaatcaacaactgcttttgagtacagctagaaaaaaacaagtttaaagaaataaaaaagg

SEQ ID NO: 16127 - DNA, 227 bp, Homo sapiens
ggcttagttggttaaagcgcctgtctcgtaaaaaatgtcagcctgagcaacatttctacaaattattatttttttaattagctgggaatggtggcacactcctgtagtcccagctactcaggagactgaagcaggaggatcgcttgagcccaggagtttgaggttcggtaagctatgatagcaccactgcaccttcagcctagacaacagagcaagaccctgtcaaa

SEQ ID NO: 16128 - DNA, 822 bp, Homo sapiens
cagaatcattctatccacgcgattctcgaaccacgactcccccatctctagtttctcgaggcaggagggaggcggtctatcttcactgcggatggcgaggtgccttttggaggaggaggatggagagaaagggtctccaacagcgaacctttgtcctgcaatgcaaatgaacctctgcaaaacagggcgcagacaatgccagcctagtcctctgcgcgaagcgatccatctgcagctatttcgttaacctgatgtttcttacattctttctctcatacaaaatacttgattttgacagctgtgaattttaaacaaccattctgtgtatgtttttctaattttgtgtattcagattgcttctccatattgggggggttggaagccaagtactttacattccttcgtttagagatttcatgctttcctaaagtcgaggcggttctgatcgctcaacaaaagtagaaatgaagtgtgctcaccagcaacattggaatgaccggggagtgcataagcactcttaaaataaaaaaggttgcacaagcggaccgtacgcagggatcaagagtgacacatccctcattcacactctgccgcccccaccaagctgcgcctgccctcacttacctgaaaaacggggctggaacaacattatcacaaggcagaaaataagatatactatttgcagactaaaaaaaaaaactcgaactactcgtcctcaacggagagactttagcgccggttccctttcatgaggtctaataacgaaccccgctaattgaatgatacctcagccattagggcgtaaaaacgcgcacgcgtccc

SEQ ID NO: 16129 - DNA, 352 bp, Homo sapiens
aagagaacagctgcaagagagagaaagaaaatgtacacggtggctaggtggagacggcacctgaagaatctcacttgccaaacgccacaggatgcaagccaacagacgggcccagagagctctcgtgagccggaactgtcacataagaagcaaaaccacgagagagagaacaccacccacatccaacacagcatagccaccctgaaagcctcagcatgtaaactttcgtggcaccaccctttcttttagaaatgtgtttagattttatagacttttgctagactttgttatgtaagctttatgtactgagaggtcttaattaaagatttttaaatgttgaaaaaaaaaaaaa

SEQ ID NO: 16130 - DNA, 825 bp, Homo sapiens
gcccagtacccaccgaccgcacaatccacaacaccaacacgcccgtctagggacacactatcgctcttatacttctcccttcctgaggcttcttcaggctctggagggtggttcaccctggagaatgtctcgctctcctctcgagaggaacgcggctgcggctctgcgcggaccgtttggcaaaggctcatatgctggatccactggttggctcacggggttcattcctgactgctgatcttatacctagtggctccatcactcattcaaggcccgaccagtgcactcaccaacgatcactgtcagatcgaatatttctacctgccagccgccgaccctcattccattccgtatcctggggctgtggagataagccacgcgagcccatatcgtcatacctataatccacgaagcaccgactctccatcactacgttctctctaccccggcgattcgttcccattcctcgacacagcagggtagaaaccgaccctccccgtaccaacacaacaatcatccgcacacctcaacccccagacctaggcgtcacgacactccccctgcggcacacatcccacccatctattcgcttatttccccccgcccaccgcatactccaccctccctatagacatgtatcccccccttaccctattgacgcctaacgagccgttttcctactctccggctcgtgcgatcctccacggcctcagtgatagtaaaccccaacataatcgcaaataggaccaacgaacacttctctccccatattgcctgatatatcaagtgcgaacacactccacctagcactcaccgccccacccg

SEQ ID NO: 16131 - DNA, 377 bp, Homo sapiens
tcggctacagcaacctccacctcccgggttcaagtgattctcctgcctcagcctcccgagttagctgggattacaggcgtgtgccaccacgcccagctaattttgtatttttagtagagatggggtttttccatgttggtcaggctggtcttgaactcccgacctcaggtgatccgcccaccttggcctctcaaagtgctgggattaccagtgtgagctacctaccgtgcccagctggattgtcttcctttctaaggctgaatagtattccattgtatgcatagaccacattttgtttctccagtcatcctttggtagacgcttggattgctttcacctcttgggtaccatgaataaatgctgctgtgaacatgaaa

SEQ ID NO: 16132 - DNA, 424 bp, Homo sapiens
atagagaaatgccggtttctctatgcaaaccggcaccggcggcgcatcgctggcggtaacccgtttcctggaagacaaaatgcgtagccgcgatattcgcgccgacttcgcccttggcggtattaccgcgacgatggttgacctgcacgaaaaaggtctgatccgcaaactgctggatgtgcagagctttgacagccatgctgcgcaatcgctggcccgtaacccccatcacatcgaaatcagcgccaaccagtacgctaactgtggttcgaaaggcgcattggctgatcgtctcgacgtggtggtactgagcgcgctggaaattgacaccccagtcaacgttaacgtgctgaccggttctgacggggtactgcctggtgcttccggtggtccctgcgataccgcgattgcctctccgctttct

SEQ ID NO: 16133 - DNA, 781 bp, Homo sapiens
agtgtgaaaatactttgacttcaaccccatgaagattacatagaagaaaatgccggatgaagttccttattgtttctcattcacagaatttatttccactaagttattaaaaaaatgggcaaaagaaagtggaacttcaactgttccttaggacaatacggacttgtgtttttgaagaagcaaagtggaaatgattaggcagcagggactctttgcagaaaaacgtaaggagcaaagaaaaatttctcagaaaaggagatttgaagcgcaattgtcatcagttcacagaagaattttgaagttctgtttccagaggcctctctctgcctgcccagagactgtacatcttcagagatgagcaaaactctgcactctgcaaaatcagcaccctctgtctaatcaaaagttaacttggcccaggttttagtttctctgtaagttttgttggaaagtaatataataaatcttattacaagatacagctgattatgtatacattatgtctttggagaaatttgcattttaagaggaaggtcaaggatgccttaattacaaacattgcatttttggttacttaaatagtatctgggaaaacggtgaagatatataggaagttaagaaagatacctgtatctaccacgtgtgaaagattatctcagtaaatagatttggctacttattcatctattataataatacccaaaaggaagatctttatccttaaaagcgtcccaattcttggaggtcagcaaaatgaatgggcaaaaataacgagagaata

SEQ ID NO: 16134 - DNA, 448 bp, Homo sapiens
tgttcgccagccgggtccaatggagtgaggcagcagagacgaggggcctgggcaggagctatcctgcaagagcctggagtctgcaggaggcagtggctgctccagctggcttgacatttggggctaaggatttgccgaggaccgtttcacagatacattttgtagaggctgcactgagcctcctggactgaaatgcagtacaatactctgtgttgctttgatttcacctctggtgcaggctgcgtgggcatgattgtaaggagcctgtgttttcccttgaagacaaaaggaaagatgagccactgccttatccacacatatcctcatttaaaacctgctgctaccttttgaaaatgtattgagatgtatgttaatgattttcacaatcatctgtatttgttactcttcagtaaaatattgacaaataaacatagcatcacattttaca

SEQ ID NO: 16135 - DNA, 743 bp, Homo sapiens
ctttggttcatcgatgaaagggacttgccttgtctccaatgtgactttggatttggacttttgagttaatgctgaaatgagttaagatgttgggggactgttgggagggcacgattggttttgaaatgcaaagaggacatgagatttgggaggggttggggtggcgtgatctggtttggctgtgggtctctacccaaatgacaccattcctcagggtgatcagcgagctacctgatggcaggttggattatattggacctcttccatcctggaaagggcagaggtttgtcctcactgaaatagacacttactgcagatatgcatgcaatgcttctgccaagactaccatctgtggagtcatggaatgccttatccactgtcacagtattccatatagcattgcctctgaccaaggcactccctttaccgctaaagaagtgtggcagtgggctcatgctcatgggattcacttgtcttaccatgttccccatcatcctgaatcagctggattgatagaagaatggaatggtctttcaaaatcacaattacaatgccaactacgctccaatactttgcacagctggggcaaagctatccataaggccatgtatgctccatattcacatcccacatatggcactgtttctcccatacccctcattcatggatccagggatcaaggggtgccactggaactgacccctctcccatcacccctatacaccccaaccacagtctctcct

SEQ ID NO: 16136 - DNA, 761 bp, Homo sapiens
gttggccccagcttataaatctatgtaagtgtccaggtcctgccagactccgctgcatcttttgctttcactccagcagggtagcagcatgctgcctgtgccaaggcaatcactaaaaggaaaggatttaatgctgtcaaaaaagcttatgccagcttaggctgcaggaagaggaacagtgtcaagtatgttgaaagtggacatattggtcagacctccatgagagcctagggggcattgctcagcagcacgcttttaaaggaatctgaacaaaccagcatgtggaaagaagagagtaaccactgcaatcaggaaacaactgtacaatctagggccatttcattggaaaaacagaagtctccagggagctgcagtcatcaaacaggcttattctgtgtacccagtgggcaagtacagtcaatggatgaaaattcaaccaatggacaaacacaggaagtttttccttaacatgagttgtcagaaactgtccaaaattccaaagagctgcctcaagttagtggaaattttttttttttttaatcaggaaggtgctgaatgaagccagcaaggattctgtgtcagagggtggtagatacccaggacataaggttgaaccacgtgacctctgagaccacagttctaagctgttgaaacctcagtccctgctgaatactgaaatggtattagcaccctttagtctacatcaagattttgctctacccagttttggtggtaccaagactgatctctttctcatagat

SEQ ID NO: 16137 - DNA, 790 bp, Homo sapiens
tcctggtgccacgcgatgccacaactaattgccacaaactcatggttcaatctcacgcagtgctggatgccagaagtctggaatcaaggagttgacaggcctcgcttctttcaaaagctcaaaggaggatccttcctgcctctcccagctcctcctggctccaggtgatccttggcctgtggccacatccctccaatctctgtcttcaagggcacgtggccttctcctctgtgtgtttgagtattccctgttctcttataaaaatttgtcatccacgctgggtgcggtggctcacactgtaattccagcactttgagaggccaaggtgggcagatcatgaggtcaggagatcgagaccagcctggccaacatggtgaaacccatctctactaaaaatacaaaaattacccgggcgtggtagtctgcaccctggatgcagtcccagccacctcaagaggctgaggcaagagaattaattgaacccaggaggcggaggttgcaccgagctgagatcgcgccactgcactccagactggtgacagaccaagactccatctcaaattaatgaactcccactcactcaactccccacctccatcccccccgactccaaacccactaccatactccccccaccctacacgcgggcctccatggccccacacgcggcactctccccggcccttcccttcagtgaggctcactccatcaccctccctcacctccctccgtaccccagagcctacgacccaacacagcggactctccccaaccaaacgcctaaacaccg

SEQ ID NO: 16138 - DNA, 694 bp, Homo sapiens
ctgcctggaatatagggagatgcccaaaagaccctggttggtattgggagcagcatcaggagcatgagtggatctctcctgagagccagctgacccttcctgagtagggaatggccatccctctcatgggctccaggtccaagtattccttctccactcctggagtttcccttcctgaagatggagtgcccttggcacaccctctgccttccatcaccccggcattcgctgtgcctcagaacaggccctgtaataatcggtggtggttttggagtaaggagctgttctgttgttgctcctgttccttctcccgggagtgcccagacaacatgagttctcttctatcccagttctccatgagtgattggtgtaaaagtctgcctaattctcaagttcagaattaggaagtcaacttacttcagatacaagccacattcaccaaaatcatctcattactaaaagcagtgatatactggcttccatatgccatcttactttttgtcttatcactccgaggattgaaaagccaggttggaaaccagaaattatttattggggtgcctcaaacactgcaagagactaaacttacgtccatttgattccagaggccatgccctttccactcattacgctggatccattttgcgtatccccatagcgttagacccataccttcacggataagcattgcgaa

SEQ ID NO: 16139 - DNA, 466 bp, Homo sapiens
gaagccattttctgggcatgttgaatgtatggaccacactttctttgcaataattcctattgagaggtagaatggaactccttttcctccatgactggcttcatgaatagaatatgttcaaattccaaagctggattataagaaggcttccagactctgcctttgtctcttgggacacttggctttggcgacttaagctgccaagtgaagaaactcaggtacccttgggcagccaagctaagagaagctccttacatgaagaggctctgaaggatgcgacaccttgtggagagagagaggggatgaacagcacgaatgctctagacaagagagtgaagatgccatcttggagtggatcatccagcctcagctattccagaggatgccatgggcatcagctgagcccttcccatattcctgacccaaaaaatcatgaacaataaaaaatgtttgttttaagccaaaa

SEQ ID NO: 16140 - DNA, 771 bp, Homo sapiens
  misc_feature (1)...(771): n = A,T,C or G
cttgnggtacgtgattggaccatttgatgacaggacctgtgccgttatcacaggaaactgggtgtattctgaagactgtagttccacatttaagggcatttgccagagagatgcgatcttgacgcacaatggaaccagtggtgtgtaaatgtacaaccaaacatagaaatactttgcatgttaaagcagagctagattttaaagacttaagatttttagataaagtttctaacagaaagtttctgctaacagacatcatctaaataggagaaaagtattttatcctgaattgactataaagacaaatttctgaacagaacttttactctatacttggatttctggtttgtcttttccatggcattgacaagaaaagctaaataaaaaattagtaattattttaatagttatttaatagtttgatttttttgcgtttaaaatagcatagaataaaacaactttaaaggaatgttatttagctatatgtgctatgtggtagattggaaggaaagaagcagtatatgtacaaatataatatttgaagcatggaattctgaatttttcatctgtgtattatagcctgaagtgtttggtggggagtgggtagtgagaaattacctactgggtataatgtacaatatttacgtgatggataaactaaaagctcagacttcttcactttgtgatatatccatgtaacaaaattatgcttggacccctttaatggattcaaataaaataaaataagtgctggggtcaaatattcaaaaa

SEQ ID NO: 16141 - DNA, 258 bp, Homo sapiens
acgaccggctactgactactcctaggcaggatgatctcttgaccccaggatgctgaggatggaacttggccccccatccactcttgaaaataaccgactgacgttcatctctgagcgacaaagtctaaaccaccatactataataccctaaatacagcacaggcaataaacactttaactacatactgtgggactaattgacaccacatgtgtgatatctgaagacagtacactttaaagagggttaataacatgata

SEQ ID NO: 16142 - DNA, 318 bp, Homo sapiens
taggagatttttacagtttaaaaggttctgctgcttacaatttctcagctcaacaatgactttgcaatccaggcaggacagcccacttggaacattagtgcctgtaccaaagagtgaacagcgggccagtggaatccagtgttcctacgtccttctgctctgactcctcctgacttgtccagtcttattaactgccacgctcatgcggccatgtacactccccggattcagcactacttgtatcatcttaagccaagagattgataaactccagaaataatctcagaaataaatgttgaatatttctaaatctgaaaa

SEQ ID NO: 16143 - DNA, 779 bp, Homo sapiens
tcgcgctatagtgacgtctctttaatgagaagttccaaaccactcattttacaggtgaaaatattgaggcccataaagaaactgatttgccctgctcacaaagaactcttcgctgaggaaaagagctggactcagaactcaagtcctctgaatcacagccatcctgtgcctcaaaccatgtctcctttatcacagaaaatttgttgcgaacattgttatgtttttatttatttatattaatagaaaataaaccatgttaaggacaaataataaaaatataatactaaaaaaacaaagactaactcaaacaataaatcaattgaataattaaataaaagactgcgccctttggtcccaatagggggagcttttcgcgccctccctttttgggggggtaaatctatgaagccctttcattgactacctgggccaagcagttaggctgcggaaggtgcattcaccttattgaaggggggatacccctttttcccctaatctggggtgaaacccaaaaaaaaacttttagcaaaaaggccctaaaaggcccagaaaccacgaaaaggggcaacatgttggccttttccaaatggccccccctcccttacaaaataaaaaaaaacaaacgtcaccatttaaggggggatacccccgcaggactttattatatccccgtgggttccccttaaaaaatccataaggggctcatcttctacgcgctttggcaatagccgtgaaccagtccgcttttttcctttagaaaacgagggattttttataga

SEQ ID NO: 16144 - DNA, 759 bp, Homo sapiens
tgacctgtgggctaacatcattaccccatcccaggaatgagaaaactgaggcttgggcactcaggtataaaagataggaaagaccacgcgcagagctaagggaccacgtgactttggatggagtcttgctctgttgcccaggctggagtgcaatggcgtgatctcagctcacttcaacctctgtctcccctgttcaagcaactctcctgcctcagcctcttgagtagctgggattacagtacttcctactacaggtggagtgcatttccctacccactagggagcttgacctctcccttctgctgccatgaaaagaatgtgccccagctctcctgtgggtccaaggaggatgagagactcatggagcagacccggatccacctgctgattggagttaaaccccccagagcccagtttagatcagctgaccccagctcactcccagacagacgaattttagaattctgagatagacattgttacctccattttacggtgaagaaaagacaaaggctcctagaaggaatgcaacttacccagtgtcacacgaaagtaaactcaacacctaaggcttattctgtctgtgaagccccaacttttaacttctgtaccacattgcttctcagcaaatgcttgttggattaatggatgaaccgacataggaataacagcccatccactggggccaagaccataaactgccttcacttcaacccacacttagggcctgtccactgtaagggctgagctactcatcat

SEQ ID NO: 16145 - DNA, 821 bp, Homo sapiens
tatcaccccccaccctacgactaataaaagaaaacaaccacgattggctttttcactcctcaaaataaaagtggacactatatgccccaatgcagccgcattcctgctggtccccaaaagtatagtcacaaaattaaacagggtttgccccgtggacttgtggttccctctgctgctcttccctgactacctgctaatcctacttatcagttaagtatcaacttcctccacggtgtggagatgcttctctggcctccccaccaccccatactgggttaggtaacccaatactataccctgcacaatccctgttcacagtccttattatgctctaccctaatgtcacatcatcatccatcaacttctctaagcaagaaaactgaatttctgcaatgtcgtaacccagcatggtgccctgcacatagcaagtttttcataaatagtagttgggcagatgagtgaatatatgaactccagaaaagcctgtattgcctgaggcctacaatacaacggcaagaaaaacctgattccctacaggaacaagcttatatgaattaaaagctccacttttaactcacaactgggtcacaccgtatcatttatcccattaatacatctttccagaaattttgaaacccttcaaatagggattgttttctttgcaaactgtaccactgactctaatcccaattgacatcttaccctgcactccaatctggcagctaatgcgaactcctctttataataaaaatctctgtctcattgctctcatcctagaatttctctctccttccatttttatccagttattcttcaacctt

SEQ ID NO: 16146 - DNA, 780 bp, Homo sapiens
ctgagcctaccagtgggattcttgctgggagagatgccaggccatttctggcagactacattggaagacaccaagtttggacaagaattctgagagttgcttgaatctttgcagcaattccatgtcaatagctagacacgagaagcattttattttaggaagatgggactgaataaatgtgtgtttcaataaattccaaagagaaagaactgttcattttttttcccacttatcccctgaagattatctgcatcatccctacagcatgtgtagtccttcagaatttcagaattgatggactgcagatggaatcacaatttgaacttactggccatattcagtctgcccttgacctcacacatttctctagccctatgctcaccaacaagaatccgtggaataatgaggctatcaaccaagttcatggaccggaaaagatcctttaaacattaacttcaaagactagaccataatttgaaaaacacaatgtaaacaggaaaaaaaggggagggggacaattgtaagctgctagcaattaggcactaattagcttccttcagttgtgtagctgctgccgcccagcataccatttgtatctctcacatgtatagattccccaagctgttggcttcttagtggaactaagccacaatttgcagactaacttacaggaaagattttcataaatatattcacatctaactggctaactgaacttctcaattgtatttatagctaaaacccaattaattggaaaggagacagcatgcctgttaggtt

SEQ ID NO: 16147 - DNA, 785 bp, Homo sapiens
  misc_feature (1)...(785): n = A,T,C or G
aggactgtgctggtgctgcgtgacggcacatttctgctgacggccctgaactttcagacagatgctctgtgaatcaggcgagagggaatctttaattaacgccttaagactgggaatggaaacaaagaacaggaaggttgtaagatggatctggctgtcaaaacaaaatgaaacaaatatcccaacatgctctgccccagcaagcatcactctgtcctacactgggctctcgcccgctctcatgcagaaataagggcctggaactggagaccacagaggacaatttaatatggaagaaagcaatgaagcaactttccacagaaattctctacccagagcaccctagtgcctcattcctgcctctatcattagagctgccttcaaatcccccatgatcttaaagtcccttggaagggcttgaaagcttctcaggtaattatggccttgtgagaaacaatcaagctggaaaaaaggtatttctaaaagaatccctaaagtaaacccccgccattgtatctgttctttagagctataagagaaattcatgttacactttagggaaacctctttggtaaaatagcttgaatgtcacagcccaaggatagaattctttctttaggaaataatatatttcagaatcagaatatgactttgaacacagcctggtaaatcgttttgtacaacagagaaatgttagcacctgagttcaaggacagccgagactttagtgctttttttgtacatncttccttgttcggattgcttgctgcccttctttctgatac

SEQ ID NO: 16148 - DNA, 823 bp, Homo sapiens
tttaacccaccccaatatttcaaatagaaacaacacacacaacactttagaaacacagcgtgcgatattgttgagtgatgcgaccagacaggacctggtggggacagtgcacactaagaactctgatgctgcgctcgtaggctggactagcattcaaccttaaacgttctagcctgattattcattcaaaaaccccagcactgtatagtgtcctgcacatactataaagactgtgaattcatgattgtatgatcacgtgacacctaattaaaagatgatgcctgatccacgttcccttgaacacaataaaagctctgcatgctccctaaacctgcaccaatatcccatattcctaacccttacactgtgaggcctgaaatatggagcccaatatcacctaaacttaagtgagggtaaatcttagaacaatgtctactgactaacttaaaaaagaaaatcggcctcggggagactgaatgtaggaactctgaggccgtatccctgtaatgagggaaaattgatgatactcgctgactgactcggtgaacataaggccataagatggccagaaagttatcaaatgactcatggctggcattttgcctatccctccaccctctgataacgatgcaaagaacctgcgatcaataggcaggttgcaagacaccaccgggatataagccgtctcagccggcgccccttataagctccctcccccctagccagtgttcacaaacatgaagcttaaaggaaacaggtgcgaattcctactggactaaaaagaaaccaacgctctgccctctcacgtagctatttcactttg

SEQ ID NO: 16149 - DNA, 482 bp, Homo sapiens
aaaaggaaagaggtctaattgaattacagttctacattgctggggaggcctcaggaaacttacaatcatggcagaaggcaaaggagaagcatgcaccttctttgcagggttgcaggatggagttagtgcaagcaggcaaattgcctgatacttgtcaaaccatcagagctcctgagactcactcactatcacaagaacagcatgagggaaattgatcccatgatctgattacctccacctggtcctacccttgcacatggggattacgattcaagatcgagagtttgtgtgaggacacagccgaaacatatcactcttaatcatttttccctgcttcacctgtttatgctgtaactatggtcttactttacaatgacatttctgcaactcgtgtccattggtaattccctacaaaacataggcccagtcttttcattttttgacaaagaaagattcaaagcattggcctcattggactcata

SEQ ID NO: 16150 - DNA, 778 bp, Homo sapiens
ctggggtcactagctccgtctgtagaggtctatcttgttcctttcaagcgtgggagcggtgataacggttagactcggcatgcatctgaggcctacatggattaatctctgcacagatcatgggatttttgctcatcatcaactagcaatggaccccggctcacctaatccgtaagcgaagggagaggaagaaatgcaatgctatggctccttccacaccatcttgaggatctaatctaccgacgtgctattaaccaaaaacatacacttatgactatatctcctgcgcgggctaagactggatggccacttgataattgcactggtatattagagctggcgacagaggctgcccattacggcttgctctgccgctctcgctctctttgtctttaggactatcaggcactttgcttactgaacccagtgcacatcacagagacgtctcatgcgacattcaacttgggtgtccaagaatgccatagtgtgctcttatcctgacccaggccaaaatacatacatatctgatgggtccttggagggctgactctagacgaagctttggaactgatcgcctgtggactatctggccaggttcatttcttatgaaacctgtacacttaccattccttttgcgcactggttggcataaaatggcggctgtgctgcgcctgtctatattgtacaacatggattgacctactggtatgattccggttccctcggggcactccttcttaatgctaaactacgattgagagtctggccctaagtcaaa

SEQ ID NO: 16151 - DNA, 761 bp, Homo sapiens
taatgtgtcctcaggctcctctgtggcagtttctcagtcttttcttatttttgatgaccttgacaattttgaggagttctggtcaggtcttctttgctcctctccatggacatttttggaggaaggcaaaccagctctacttgtcaactgcaaaggccgaatatgggagtaaagaaggttggacgagcaagccatgccacagcttcaaatcttgcagaatattccctctgacagctaatgcctctgaacagagctgtctgggaacatcaagagaagtcttaagccactggcttgtgaactcttttcatgcctttaatcctcaagcctacagagacaggacaatactaaagggagggagtgggtctgcagttcggaagagctgctgtgcccagactctagtgcagcccagctacccacaggtctcccggggtggtcctggaagctgcccacttgacccacacctctctgctctgtccctcactcacgggccctggaatgccgacatttatgctagagcaagtgacacactgtgggtcagtggtagcagatgaggtactttgggactggcgctacctacacgaccaggaacatgcatacgagactactaccaccggaaaaggaatatcggaaggggtcccaaagactcacacatggatgttcctggtgcggatccatcatgcaatgtttcttcgcagcccccacacatcctcccatggagtggcctggcccacacctaacgatctcttcctagaggacaagtc

SEQ ID NO: 16152 - DNA, 813 bp, Homo sapiens
atggggagcatcaactttcgcatctcagtccttctccatttcctgaggcttcttcaggctctggtgtgtggtccaccctggagaatgtctcgctctcctctcgagaggaacgtggctgcggctctgcgtggaccgtttggcagaggctcatatgctggatccactggttggttcacagggttcattcctgtctgttgatcttctacctagtggctccatcactcattcaagccacccgatgtcccttttgattattgtttacacggttcgtctttttccacctttccccgttggactctgacgcgtctctgctgtgggaagcgcatcgccgccccggcgtctctctccgctgcggggagcccatcgcggccccggtgtctctctccgctgcggggagcgcatcgcggccccggcgtctctctccgctgcggggagcccatcgccgccccggcgtctctctccgctgcgggaagcccatctctgggctgcgctgcttcctgttctgccgccctttgctttctggctgcgattccactgaatgtgatcactgaaaaggtgggatttgcgcccactgttttaccagttgttttctctatggcttgtatctggtctggcccctcactcttcttttactgccctacttttatgctcacccaatttttcatttataccatgttaattattcttgatggctcctttaactctctttaaacttacttggttagcggtatgttctcgagaatgccacttaacatcgcagcgcaaagcgacaccctacaaccaactgtatggcctgttcgcaattctcctact

SEQ ID NO: 16153 - DNA, 1023 bp, Homo sapiens
  misc_feature (1)...(1023): n = A,T,C or G
tgttcgacaccccgccggaggggggaggaaagtaacccccganatctggctatgcatgacctttacctgaacttggaaagcctgggcgtgatgggatctccagacctatggccaaaccgcatgcttttcgccctggtaccctttcaggaaacttctgcaaccccggaactcttgggaaggaatccccnaagcctgcccgtttcgccgttgttttttgggaacatgcccacattgtttgggcttgggtgcctgggatctacccctcaaacgcacaaccgccgatgtcctgcgggtggggggaattacctggctagctcctctggctgggaactgtaatggccaacttacttgataatgcgccagacgtacgacaatctcgatgtggcacgcaagatggctcgagcagactgactaacctgatttcttaaagggcagtaggcagacttgtagccaaccgcgccgcggacagactacgcgcccggggatcaggtcggtttataacaagacgtctgttcccgccgcactgaccaagcggttgcgtagagataaagcatgccgatcaccctcttttcagtgacgacgtccgcgatactagttcgggcccgcaactaacttagtgcncttgctccccacgattacgccgtgatgttagtcctaccagtgatagaggataaggccccaagacatgtgaggcgggccggccttaaactgagaagggcactgatcacatcgcgagtgatgagggacgcagctcctcgagatgtcgttgaccgcacctctcgcagagagagtaggggctgccgccgaccacgcccatccagaagcatggaatagtacttagaagtgcgggagagaccccacgtagtctagcatgccgcagtgtctattaacagagcggaagcacacgaacaagtgcactcaggggttgtctgatcaggagcgccggcaggcgctcgagtcgaggctgggggggtggtgcaccgacagatccggctgatgaacagacttgtataaagcacgtgg

SEQ ID NO: 16154 - DNA, 943 bp, Homo sapiens
  misc_feature (1)...(943): n = A,T,C or G
ttttcttacccccccctacgtttagtcggaatacccctcgccnagcccgcccgtagcatgctctggcatactatatgctactccacatgactgtggtcttacaagacgaggtaagactctctctccaccgtgagaagacactatagagataggctgccatgtagtaagcgcataatgagagccactcgctgggaggtcagcccgtgctgacacccctgatctcaaagcttccggcctgcatgagctggaagagaatcctcgtttgcgtggtcatcaaaaaaaatcatcctcctgctttggtctgaggtcgagcgaactgtggcggacgtttaccttctagtgggggataatttgccgatcctcagctcattgatttgttccgcgctaacacatcccggctgcggcaactctactacccctcgtcactctcaaggcgaaccttacccgtttatcctccccaatctctgggtaacgtccagcgaccgactagatggtactatcgcgcgcctctccacaagctttgtacccgtccccttaccctctatccttatcttcccgtcatatcctttaagagtctcgcgccctcctccggactcagcgactcttaacaatatctttcacctctaattatcaccgctgtccatcgcccgcgcttgcctgctccccacacccaccatcctccaccaccctcctcacaccatccttgcctctttgtgttggcaagcccgcccttcgttgctgtatgttcatatgtctcatcagtccccctcgctctctcctcactgtgcccatccatcactattcgtagcttccccgnacgccgtcccccttcccttggagcgtttaacaaagtgatcgcgaaccactgccgagttcttattatcgtccttcttttgctggcgtccaatactgcagactttccccgtaactccttcccgtccct

SEQ ID NO: 16155 - DNA, 793 bp, Homo sapiens
cctgacagaaacccgggacgaaggtacctttccctattatacctgcaatgtttaagcccttttaattccacgcctttagatgagagggttgagtatactagattatcaataacgttccatattgaaagagccgtgattcattttgcaattcacgcatggtgccggctataacgggcgagttggcatgaggagaggcaaagatggattaattatgcacataacatggaatttttgctttttatcgtatagcattaggagctccggctcacataatcacttatcgaagggggaggagaacatgccaaggctgtggcaccttccagcccatgatctggattttttctacccccttgtaattaatgaatatcatacactgatatccctatctcctgtgcttgccctgagtggatgtccacaacttaattgctctggcatattagagctggagacacgggctgtgcatttcggattgctgtcctgctcaccctctctttgtcttttggcctctaacgcactttgcttacgaacccagtccaaatcaaagagaaggctctagtgacattgaagctcgggtaccagaaatcccaaggaggttccttatcatgatcctagcaagcatccatacctatttgacttttatttgcagggctgactctataagaagctttgtaactgatcacctgcgactatcgggacagttcactttctctcaacatttgctttaatcctccttgcccaagtgttttgataaaggtggctgtgcactgttgagcctctatcaatactttcgctc

SEQ ID NO: 16156 - DNA, 285 bp, Homo sapiens
ctagctttaagccctcctcctccattttaccctcttgacccatatctggacaagccaataagacagcctgcatgctctctcctttggcactggcaagaagttcaaaccacgtaagccctggccaatgtgcacttactccagctccaccctctatcgacaataaaagctaaagccagtctctcctccttgctttctcaagccactttgggggtctgctttgcaacctgccctgttaccccccaaaaaacctcattatgtgaataatatatctttttatgcccaaaa

SEQ ID NO: 16157 - DNA, 822 bp, Homo sapiens
  misc_feature (1)...(822): n = A,T,C or G
attttctcaccgccgcatcttgtctctattaacagaacaacaaaaaaagncttatgggtgaacataatttcttgtttatgacatcaaaagcacaaacaacaaaagtgaaactagacatgtgggactacatcaaactaaaatgcaaccaggatgcgaaggaaacaacacagtgaaaaggcaacccatggaataggagaaagtatctgcaaaccatacatctgataaaagtttggtatccaaaatatattcggaacccgaacaactcagtatcaagaaaacacttaaccctattaaaatatggacaaaggatttgaatagacatttctcataagaggacatgcaaatggctaacatgtatataaaaaatgttcaacatccctcatcatcagggaaatgcaaataaaaaccacaatatcacctaacatctattagaatagctgttatcacaaacacaaaagagaagaggtgttagtgaggatgtaaaagaaagacaacacttgtacactgctggtggaaacgaaaattaggacagtccttatggataactgtatgacgccttctcataaattataaatacaactaccatataatctgaaatttcttctttaacaaatatatcccaaggaaatgaattttcgctgctcgcatagaaataataaaatttagcctctgcggcctccacagcggaactatgaccacctttccttttatgaggttgaaacgagtatccttaatcactgacttcatgccttaactaccctcgattcaagacagcggtattactccactcatcacgcggaataccgcttttcatagaatgta

SEQ ID NO: 16158 - DNA, 716 bp, Homo sapiens
aagtgttactttctacaattctggagactgggaagtccatgatcaaggaactggcagatttgggtcaggtttttctggtgggtttctggagaaatcaactgtcaacattctgcaaaacaatcactgactcaaaaaaactcaagaagggagtaaagataattaataaactttgcaaactttggagaaggtaaaaatattccactgcaaggaaataggactgagttgcttaatagatataataaaagtcataaaggtcctacagcattaaaacagataaaggctgacaaaaaataaaattaaagaaaaatgatagaaagaaatacgttattttgtgtgagatgggtttctgaatgactactggatacataacgaaatgaaggcagaaatgaagatgttctttgaaaccaacgagaacaaagacacaacataccagaatctctgggacgcattcgaagtagtgtgtagagggaaagttatagcactcaatgcccacaagagaaagcacgaaatgatcccaaattgacactctaacatcacaattaaaagaactataagagcaagagcaaccacattcaaaagctagcagaaggcaagaaataactaaaatcagagcagaactgaaggaaactcgataccgtaaatacccttcacaatttcattgaatacaacgagttggttttttgaatcgcccaccaaatgtgatataccgccgcatg

SEQ ID NO: 16159 - DNA, 651 bp, Homo sapiens
ctggtcctgcctgtatataacccttgtattcaactctatcaacccaaacctggaaaatggtatgaacaataaagtaatgaaaagtgcccaagtctttcaacagacgaatgctgcaaaatacaacattcaatgagtatctattatattattacatcctggattaataagaatgtgtgccctctgcaagaagatgagatgtaaaagagattttgaaaatcttccattttattcagcgatcccctcatattatttgtgttcttattcatgtttcttctctcctttcactcaatcaagcttcctattttaatgacatgataatttttaaatgacatatcataaattcctaaggatgcaacacttctccaagaatgcaggtggattattctgttgtcactttagtctggatgaatatctagaggatccatatatcattgaccataattgcaagctaaattgttgatacaaagctaaaacttctttgaaacattaggctgaatttaatctagttcttcctactcagctccttgacccctactgggagatatgtctgctttgtaaaatgagcctaaatttatgaatcatccacttgacaatcatgtaaattaacggcacttgataaatatgccttttgcaattgcaaaaaaaaaaaag

SEQ ID NO: 16160 - DNA, 726 bp, Homo sapiens
  misc_feature (1)...(726): n = A,T,C or G
agcactgttcctccctgacccatctttgtcgttcggcaatgcggaccagtctaaagtcacaccggctaccggtctgacagttatattactcagctgccacttcccagaagcctacatacttatttgctctatgaagaccttctgaggatgtatgaagtgccagagctggcagctcttcaggatggataaatcactgaaactacttaacccagccaatttttttctctgaaagatcatcgagacaaaagagccacagagtgcaagcttttatgattttatagtcaaaagatgattattgatgtgcgagataggttaagttttggggggccaggacttcagcgagaatgtgtatgtttacaactagccttcccagtgaaaaaaccacaacgctgtttaaatggtttacatctctgatattacttgattgcggctgcctcgccatgacattatgtgttggactatgcattgacctgatcgttctgaccatgatcggctttattgtgctaataaactgagatagctcttgtagcgctatacatggcatattaccacctatgatgcaaggtcacctgtgattgggagctcagaacggaatgcataaagctgtgctggaagtgtaatccactgaggtgaangaatctgaattaatatcatactattatagttgaacctggctatctcttatgcatatttgggaacatgttttcctattcaaaaaaaaaaaaa

SEQ ID NO: 16161 - DNA, 763 bp, Homo sapiens
  misc_feature (1)...(763): n = A,T,C or G
caggagcctaaaatgtaaacatatttggaaataggctcttcactgatgtcataagttaagataatgcctactggatgagagaggaccttattccatgactggtatcttataacaagaggagagaatacacagagacacggagagaagaaggtcatgtgaagacagagactgagattggagttgatgctactgcaagccaaacaacaacaaggattgctttgagccaccgcaagctaaggagaggcaaggaaggattcttccctagagtccttagtaaaacactgttctactcacaccttgattttggacttctggcatccagatccatgagagaatacattggtttaagccaccagtttgtggtaatttgttatggcagccctaagacactaataaaatgaccagcctatttaatgctgcaacaaaaccacctaacccagattccactttcccctacttttttattttcttataactgatgacctaatgattttctactatagttcattgatcccaagatgcaatgctgttttttcacatggtatcgactctgaaattggaatgaattttgcaatcaatggactgtcatatgtatttatcaatgccctttttttttgattgtttttagtggtacataaaaccctggagttgtttacatttataccatcttagaggaatcacttatgggatacttattgtatggctaagnaacatgttttctgagagctttacctagaagtccgaatacaaataaggaaatggt

SEQ ID NO: 16162 - DNA, 738 bp, Homo sapiens
  misc_feature (1)...(738): n = A,T,C or G
tttcagcnctgcaaagctgactttttattgatcgcataaacggggatgctttgagctctaacttctggttggctgaagcaatgacagccgacagcaggacatcaaaaaggggatgaagaatggagcttgaagggtattcctgtagccccttcctggctggatcacaacaggctgggtaggttgccttatcaaactgaaaccgtctttgcaaaattatgactgagacaggtgatagagttttaacttaaccgactccatcttgcttctaacctccttgaacgttcagcataggctgaactatctttgagagaaacttatagtttataacaaaaatgataacagcccttttccaatactcacctacctcttgcctggggactagaatgcgctatgtaggactaacattatctacaagattagagattatggtttatgatttatgctacgtgaggcttnaagatttggtttaagtatattagtgcttgaaataattttaaacattgagattcatgattaggtggttcatataaatggataattcgctacccgcaaccctgcgagtcccccccagcaaaagccccccccaccgacacacccttaacaccatgacccccctcagccagacctccaagcctttaggagtactgcccaccaccacccctccccacgaattaccaattcaacgccctccccacccttttccaccccccccaacccccattccgcctcatcccttgc

SEQ ID NO: 16163 - DNA, 725 bp, Homo sapiens
cacctatttgatgacagactccctcctcgagtgccagccacatgcctgtgaattgctgagtatcaccatctccagggccccaatagtgtcctccactaagtgggtcaccacgatgtatcccttcgatgaggatcacccctgcaaactccagctttctctgatgtctatactcaatgaacactgatggaaggttactatgtgctagactccgagctgggcactgaagacacagtggaagtaagacacagtccctgacatcagagggattacagctacctccagtttctcattttgcccttgtgtgttctcccaaggccagcaacagagtccattcccagccctgcctcactgggctcccagtcggcccagtcctgttgcaaccaactgtcctggctatgcctggctgtgcctgaagacaccagagtgtgcagctcaatttggagtgaaatgctttcaatcactgtccataggcaggttgatgctgcctttattcaataggagaatagaacccgagtgctgagtatttacccggtcactgtctgttgggttctacgtggacaggtgcccctagtatccggtttagtatgggagcaaacctaagaaacctgcctgactcggagcgtgaaacttgggaccactcaaccccaacctggataacttgcctgtagagacatgtgagtccggggagaaaatgaccttgccttcacttcgatcatgtcatacag

SEQ ID NO: 16164 - DNA, 934 bp, Homo sapiens
aagaacgcaaggacgctaggcggggacgggccgggccagtttgaagggcggacggggcgccggggcgggggacgcgtggccgtacgctgcccccagacaccggcgatcccccgggaggaggcgtctctaatatatatgagaaatattatgtagctgattttgtcgcaagcagaagggaacgaagggggagggggggggggggtggcgggggcctgcgctcctcccccgccgatcccaacggcggggcgcgcccggcgaccatcagggcggctttccagggcattgctgcgacgccgcaggcgcggcgcgttatacgcgcgccggaaccataggcgagctagacctcctaggcgccgaggtacgcaataggccacgagacaggggcgggaagggagcagagagggtagtgatgagagggtattcgcgacactgtcagtataagtcggagcgctcgccgagagtggagtcgcgaggcatcggctgtgcaccccactcccccgaccgtgccggaggttcgatgcgcctgtacactgcctcgtgccgtcgttccggtgattgagaatcccgtcgcgtccgggccagcagtaaatgagtgtccggtcctgcaggtcgagagaataggaagattgtatagtgaagagcggggtacaacactatactatatcttgttacccgaccgctctcacacgccagggtagtggatgggaggagagggaagacgggcgacggttgagtatgcgagatcgaggagggcgctccagggtacagcggagatggattaaagactggacatcagagacagccccgccggctaggactctcgggccggggtaaaacgggaggcgctcgagcggcgataactccggcacgtgaaaccacctatgaatgggcacagccatgcccagctaccgcttagcgcagactgacgcgcccg

SEQ ID NO: 16165 - DNA, 1179 bp, Homo sapiens
  misc_feature (1)...(1179): n = A,T,C or G
ttttnttttttttaaaaaaaaaaaaaaaaaaaaaanaaaaaaagatgagataaaaaagagaaaaataaaaaaaatttttaaaaagaaaaaccaaaagnaaaaaangttttaagagagaggagaaccanngganagnnagggggggggggagggacagnggggggggggagggtggaggggaaagggaggagggagagaggaagagcgaggaggggacgacgccgacgcacggagagacgcgcgcgcggaacgggcagacggggnacgcgacanaagcaaaagaacgggaagacgaacagcggcggagagacgggcccgggaggagcagcaagagggccgacggggcccnggcgcgacgcacacccgcaccgccggccgcgcggcgggagaagaagaaggacgagacagcgcccgggcagccagaagacacgacgaacgccgccacgggcgaggcaccccaagagagagaagaanaaagaaagggcgggaggcgcggcagagcgcgggagcgcgggagggcggagacgacgaggcgtgggcgccgagcagccaggagagcgcaagagagagacgggagagcgaagagcacgcacaaccaccaacacaaaaaacacacaagcacaaccaacccagcgaccacccacacaaacagacacgcaccaccgcccaaacggaggcaccgaccggggaaagcaggcagagcgcgagaggcccgcgcaaacaggcacgcagccgacccagcccgcccaaacggacgcgaccaccagcgacgcgcggccccccgaacacgcggacgcacccccagcacgccgacgaagaagaacgcgggccgagaaggccacgggacaaccagaggagcagcccgacggggncgcgggacggcgcgcccgcaccgccaggacaaacgggagcgaggacagagagcacgacggacaccaacgccgcacggaccgggaagagcagaacccacccagcaaagggcagaggcgaaagagagggaagcaaaccggaatcaccgaaggcaagagaccacgaggcacagcaaaagagcgcgcgccaaccgcacacggccaggcgccccgagaggggcacccacacagcgacaggcaagacgaacgaagccgcgaaacaacacaccccacaaccaagacgacggagggcaccacgagaacgagagag

SEQ ID NO: 16166 - DNA, 1095 bp, Homo sapiens
  misc_feature (1)...(1095): n = A,T,C or G
tataataatgaaattataaagaaatatatagaatnnntaatgtttcnanngaacacaaccaanctacaggaactgnaattgcaaagtcaagtaaatgacacagaaaatgtactacgagtgttatggaaccaagacattaagtaactaggagagtatcaaagaaaagaactaaactaatacactcttgctctagggattaagtgacnagtataaaaagaaaaataaaaataacttcgcacagaagatatactataactagcacaatctnaatctgtggatcctatattacccacaacacatatcacttttgaggtatatatttaaagataggagggatgatgtcnattaaaatggatatagacacactaaccgtaggacnatataactaaacaacaacaccaacgccaccaagcatagaagcgaacgaccaaaaccgcacagcacaccagcacacacacaaagactgacacgcaccgacatgcccgagacaagtacgccagagtacccacacggtatcctccctcacaaaacaataccacacagcctccaccacacaccacaacatacacccgcacacgacacacacacaatcaagcaagacactatctaccaccntcgatcaggcatccactttctacctnacgataagcgtgttcgatactataattatagtacttagcaggaattcaacactaatatgaacaatcatgaacaggacactactaaatattctatcaatatgagctgtcaacacattcaccactacacacctcgcacactccatcactcgctaatcctctattgctctccacacagccccgtgcccacacccccgcaaccgcgccccacacgcacaccccacccacaccgcccacacactcccccacaccccaaagaacaccctaaacatacactcaccacccccaacccactcccacccactgcctacccgcagcatacacgcctctacaaacgaccacctaacgagtatncaaagagcaaactcgctacccacgcactcacccaccccatcaccaccgccaccaactcgcccctccgggaccgccaccccacacacacacacagatacgagag

SEQ ID NO: 16167 - DNA, 544 bp, Homo sapiens
aggtgaagaacagctgaggcctagataagttatgtgcccaatgccacacagctagaaagctacaaagctgaagtttgaacccaactcatcttggtccagagtctgtgcacagaagtcctcatacatccagcactcagcctgctcttgagcaaaagagtgtagcagttggaggtgtgtgtccaagaggcgacgtggcacatgccctccagccagttttgttggaccccagtggaaagctttctgaatgccagttcctacccagatttcccagctcaccagtcccagccagctggccatggaccagatttggcctgaagcaatccaacttctctgccatccagtaggtccagccacaatgaatttagactccaatgaagtctgaatcttagtgctggagaggaacccccttctccaagtgtatttcttcatttgggactttcagagaattcaagggaattccctgaattctcttttataccctctgagtggctactcacctgctaccagttagtatttctttctattaaatattccctgatcaatt

SEQ ID NO: 16168 - DNA, 767 bp, Homo sapiens
ctagactacaaaggtgatgtcagataaaaagcaaataaaacaaattcaaaagattttgttatttgagtgcataatgggtgatatagcagcagagacaacctgcaacatcaacaatgcatttggcccaggaactgctaacgaacatacagtgcggtggtgtttcaagaagtttgcaaaggagatgacagccttcaagatgagaagagtagtggctggccatctgaagttgacaacgaccaactaagaccaatcatggaagctgatcctcttacaactacacaagaagttgccgaagaactcaatgtcgaccattctacagttgtttgggatttgaagcaaattggaaaggtgaaaaaactcaattaagtggatgcctcatgagctgagtgaaaattttaaaaatcgcaaggtttgaagtgtcatcttctgttattctacacaacaataaagaaccatttcttgatcggattgtgacatgtgacgaaaagtggattttatacagcaactggtgacgaccagctcagtggctggaccaagaagaagttccaaagcacttgccatagccgaacttgcaccaaaaagaggtcatggtcactgtttggtggtctgctgccggtctgaaccactactgctgtctgaatcccggtgataccattacatctgaaaagtatgttcagcaaatagatgccatgcaatgcctacaggcagccctagttaacagaaggggccaattcttattcacaatggcttgactgaacattgcacac

SEQ ID NO: 16169 - DNA, 495 bp, Homo sapiens
  misc_feature (1)...(495): n = A,T,C or G
cttggaggactggttgagcagcttaggcagctgtcattctcgcattgaccgcacgaacttttataatgatttaaccatctttaaacttcgagtactctaattttatgattaggatactagtacaagagaaaaattgtaacacaactgaacaatagtagtactgtatagtctcttgaagacgtatgcgtatacnttagcaaataatgagtatgcgagaggtagaggttgaaaagggaacatttcgtgcttcttgtatagcatagaccgacgtgtacgttgctactaaaaatgtctgacactgaaatattctcactcatctatgtttgcaacatgcgaatttatagtattctaagattaaaatgtcattaccaaatatgtagtgggaacatttaatttaaacttggctcatggaatctttaatttcaatgaacattacagcatatatatgttatttggcgagacatcgaatagagttaaccatttaaaaattaaaaa

SEQ ID NO: 16170 - DNA, 121 bp, Homo sapiens
  misc_feature (1)...(121): n = A,T,C or G
cttanggaagactatgaagtcaagttaacacatccacagaaaagatgcttgccaaactcccaggttcctggcagaatgaataatgtgaataaaatgcatgtttagtccaaaaaaaaaaaaa

SEQ ID NO: 16171 - DNA, 768 bp, Homo sapiens
  misc_feature (1)...(768): n = A,T,C or G
cctagagattggagttctactggtgatgctgatgagaagagcgaaggacaaagactctctggaattcctctgttccttctttttacagactccagaggacctgaacaagcacacgtgttttaaagatgctaggcttatgatggaatcttgctctgtcgcccagtccggagtgcagtggcgcaatcttggctcactgcgacctacgcctccccacctcaagcgattctcctgcctcactctcccaagtagctaggactacaggcgtgtgctaccacgcccagctaatttttgtatttttagtagagacaaggtttcaccatgttggccaggctggtctcaaacttctgacctcaggcgatgagcctgcctcggcctcccaaagtgctggaattacaggtgtgagccaccgtgcccagcctaatgtaggatattgataataagggaaattgagtatagggtatgtgaaactttctttacaacttttctgtaaatctaaatctactttcaaataaggtttattgaaaaagtaaaaattagaattaggagaaactttaaatgttaataaaggcaaaccatttagaagactatatggcctatagtagacactcattaaaaggtaagaagcacctgttaggagtactactaggtatggtactgtgaagccaacaaaagcttttaagcanaattgctgatttcttattcccttaggctttctcctttgggttttgctgctgcttttgaagttttattctttgtacaacatttaac

SEQ ID NO: 16172 - DNA, 162 bp, Homo sapiens
agcctgagaaagaagaatgcctctcagctacttcaatgcccaacgaattctgcaagttaaaataaactagtaaaattgaagaaatctattttatatccactgaagttattattgtaaacagattcttaaataaattccattaactacttaaaaaaaaaaaaa

SEQ ID NO: 16173 - DNA, 923 bp, Homo sapiens
  misc_feature (1)...(923): n = A,T,C or G
agtttgtattttnaaatgtagtanaaaaccaactaagataagaaaaaaaaaaaaataaaaaaaantcctagaggttccatacataagatgtagagatttaagaatgctcctagaagaggaccaggagaacttcgtggatgtggaaagggcctacaagggagccaccaagcacccatgagcatctttcttcacgtaagacctttgcgaataaaagaggataaaaaaaaaatataataaaagcaagaaataagtgggcctgtaggcctgttgattcgtgcagacgttgagtagtaaaagtggtagaaataaagacaacaatacacaccacaacaccccccctatacaattcgctaacaaggtgtgataagcataaaacacccaacatagatcataaagtatatttttctcaatttttattttccattgagacatgacaaagggataagagataatagagattaaaattggggtcaggtagcaagcgaaagaagagcagagcccagctccgcgacaaagcaaacacgaaccaccaaaatccctctctcacccatccctacacgcccccacagcaaccacccccaaccacatcaccaaccacaaccaccccaaccattaacccaccctatatccctccatacattctccagagtcacactcgcactctgaccacctacgatctaaccacgtccgccataatatagaccgaaacctcccgcacactcctaatcccacgttctccagaatacagattgataccccgcgcaaactcgcacacgaacgatccgcccgccccatccaaaacgcaacccacccgcaatcccaaacaatccgataaacgtaacgcgacagatacgagcccgccaaacatattaagacaccacacccctactcactaccccccctccccacctcctacggtcgct

SEQ ID NO: 16174 - DNA, 843 bp, Homo sapiens
taaccactcgacggcaagggcacccccactctccacccccaacctaaaaaaaatttcagtctctgtgttgtcacctgttaaaatggaactttccacctcctcgggatgttatgatgatagatgtaacaagctcagcacagtgccctgccaggcggaggcaatgcccatagcctcgcgccccaccttgcaccccccaaacaccaacgagaatgatcctaaaaaaaaccaccaatatacctcccgcttccacccaccccggcgcccctctgcctcagtagcgaagcggggcgtgaacccgatttattgtctctggtctgaacaccgaagacgaggcatcgttgctccctcgcggattcccgccgccccctcacgcctccccaccagactcccccccctcttcccttaccccccccccctctactagctcgtccacacccattacaaacaacaaccgacaaaggcaacaacgatactacgcaataaatcccgttctctcccccatcgcatcccgccgtctgcgccacgcccctctgatatgtgcatcgcctcgccatccaacctcccccagcccgacgttacccccttcccccggctcggcgcatgattctgccagccttgacacacacccaattttcacctcccccccgttactacccataatccacgagcaccaataccaacctccataaatagggtgacctccccgcgtcgccgtctgacgaaccctaactcattgacgaccattaaaccctccctcccgctcgcacgttcttttacaccctgcggccccccccttatgtcccccctatcacccccaccccactgtgccacttctcacgccgc

SEQ ID NO: 16175 - DNA, 968 bp, Homo sapiens
  misc_feature (1)...(968): n = A,T,C or G
atatagtgtaataaaagaatataaataagcaaataacatgattagagtgttgaaaaagatagaaatcatagaacactgnagagaagacttatgaaccaggatattttgtactcgatgtggcagacgtgacaaatgcacacattttctatgcacccagataaacaaaataaacatgcaaaaaaatgccctaatgccattgcacacccaaaaaacactccacacaaacttcacaattcttctttcaattatattattatcacgcgcgcacggcgggcacccgatcagcacgcgcagtggatcaggcatttcgctgtatcggtccttcttcacttcccccccatctactctatagtcaccctctacctcccccagcggatggacaaactccaacaaccacatataacaaaatctgcagataagagtccgcccacgaacgacccatcccccacttcctcatttgtccgatttgcttaataatttaatccctcctcgttctgacatccacacctcctagccaacaaacgctcccccacacctctccagtaataacacaaatctactaccctcccattcccgtccagtccgctccttcacaaccgccgccaaacgagcacaaacaacaacgtaaccatacgatttatctacctcctagccgctcctctcccctccatatcaataataaacacgactacagtctccattcttatctgagcaccccctacgtttattaaactccttcgcaaccacatcccaatacacctcacagttccatatatcccattattaccccaccgcattacgctcgtcctcatcgtacccgcccacggcgcatctccgcgtgcgcattccacgtaagctgattcacacctagtctactaatcgaatcagatacaatgagtacctcgattcaccttatgcacatgactcacaacgaacagatcccactccccccatatctactagtctcg

SEQ ID NO: 16176 - DNA, 890 bp, Homo sapiens
  misc_feature (1)...(890): n = A,T,C or G
cccacctccccccgccggagctgacccgcccccgaaacctaccccaccaccacaacacacccccaatccccaantttgatttttaggcaccaaaaatggttatttccactgtcaagattataagaccaggtgggagagtgcttacttgtggtgcatttctggaacgaacaaggttcatttcaaacaactctgctgcccatgcctaaagagccccaacccttatggactacaaacagtccaatgtcagacctgctaaaagcctcattgcccgctgacctaaaaacaagacacacactggcctaatgatgcataatacacaggaactgtgccgacccgtgcacgccccgctgattcatgctggcacggcattggctgagtgggcacgacaacacagtaaatagatcagcgcatagaccgcccagaaaccacccccgcaaccctcggaagccacgtaggcaagcgctcgtgcggcccacaagacgcccaacccccacacaaccggcccccccacccaccactcgaaacccaccatacccatccagccccagtccaaaccctccaagccgaactccatcccccatacacccccacaaaacccccgccccccgcttaccttcgcgcgacgccctgcaggccgcggctcttggcaccgccgtccccagccccctatcaatcacccgcccgactcgcccacccacggcggctagcacaaccccgcccctccccagctaccacacacacgccccgaacgcccgcggtaagcacacgctcacgccccagtcgagtcctgccttgctgcccagcactaacaacccacaaagcttacacacccccccaccattcacccgccgtacaaccatcgaaccacagcgcgccgctcccgaccccag

SEQ ID NO: 16177 - DNA, 186 bp, Homo sapiens
gaaaactaaagaacaaaaataatatgaacaagagaaaaaaaggaaaaagagaaaaaaaagtaaagtttgaggggtacttcaaaaaaggtataagggaagccttctctccatctctacgctacaaaatatgttattgagaattctgtcgtacttcatgcttattaataaagccttaagtcattattt

SEQ ID NO: 16178 - DNA, 813 bp, Homo sapiens
ccttagggcactgcacgatgcgtagctgcttatagaatcgagtatgagcagcacctctgatcagaacatgacttcactcactagactacttagctccattacaccaatggtgaacgacacacgaaagaacggcatcatactatgaacttaaggacaacacgctccgttgatacttgggacgttcccatgtatccacaactgcgagaactaagtcgtgctttggttgatcagcctacgcaagctccacctaaacaaaactaacaagaaatggaatacaatattcaaaaagctataaacaagcaaaaatggacctaaacaacctcaacagggcctgggaggccgtcagggccaacttcccaggccccttcccttgactggggtggaaagcctgaacaactgcctgttcatccgtcacatcagtaccaggcgagcaattatcctgcacaaacttacacatggccgaacttctgagcctcctaattatacgggggctccagcctatcaacctggaatggatacggcccaacctggggcctaaccaccaaaaccaggttgtacttggctttctggatgtaccatgacccctcctccaagtgggcctaatccttatgcccgtaaccgggcgcccttccgccaggggtatatccaaactggacgtggttcctcgtgaggaggcctccggtcgccattctaatgaacctgctagctgttgcggtaccaaaagactcctttactatttgagaaagtatggaattaattcataacttcagctggcagactcttatttatgaattaagtggtagtgtacaataa

SEQ ID NO: 16179 - DNA, 243 bp, Homo sapiens
  misc_feature (1)...(243): n = A,T,C or G
ctgctnggccacagtgcaagacttcatctcaaaaaaaaaaaagagagagcaagttcatccctcctgctctgtgaggaagcagcattcatcccctccagaagatgcagcaacagagcaccatcttggaagcagagagcagccctcaccagacaccaaacctgccagcaccttggtctaggacttctcagcctccagaactgtgagaaataaatttctattgtttataaattaaaaaaaaaaaaa

SEQ ID NO: 16180 - DNA, 863 bp, Homo sapiens
  misc_feature (1)...(863): n = A,T,C or G
ttaatattttatggttatgttnnatgttattnagtgagtgtggttttgtggggaagggaanaaatatagtcaggtgcatgatggacgttccgtttatcagacaccaccctgtctcctagtgatacgactcgctatcggccgacaggaacaaggggtgggtgcaccatggagtcaggccaagactcctgtgctcactcagggattcttcattacttcttcctattgcctccacttaatgttattttcttcccttcccatttacaagtcaaactgaccacagccccaggaataaatggttctcttggtttcctccttgctcctatctggacccagttccctgttccctgttggccattcgcaaaccaggaggaccacattacacaaagctctcttctgtcatcaaacatcaaagcatgcactctgttaacaaaancaagacgaccacaataaacaaaagtgtattggttttttgtaaaaataatcatggcatcaacaaagaatgataaaagaaagttacaagggctctttcccgtcccacgccggagaatttcttgggcctttgcccgttaattgtggggttattaaggaatcccggcctcccttgcctgtttcgtcttggatgcttttgggtctccgtccccgcgtcccgcgcccagccccacggtcgatggacgttaccgcccacaattcggcgttgagtggttgtaggantgaagggttgatacacatataattataagaggggtataactcctatacaatatgatttgcttgctctcgttctgttccttcatccgatagccacgctcgcccaaagacatgtattgaatccggttaatttgaggggttgtgtgtatgtacag

SEQ ID NO: 16181 - DNA, 189 bp, Homo sapiens
ccttagactaaccaaccgaagaaaaattaaagagaaatcaaagagttgatttatgatatttggaggaaggaaagtagaactgcttctaaacatctctttgtgagattcaatatggaaattattgacaaccaaattcaatgtttacatgccattaaagattcttactctttgatctgaaaaaaaaaaaaa

SEQ ID NO: 16182 - DNA, 360 bp, Homo sapiens
ctaccctccactggaagctgagtctccagaaagacaaccctttgttagaagtttggaactttcagctgcaccccctcaacctcagagaagggagaaaggctggattgaattcaagcaccagtggccaatgatttaatcaatcatgtctacatagtggaagctcataaaaatccctaaatgatggggattggagactttccaggtgggtgaacacactgaggtactgggaaggcagcatggaaactcggcacctcttcacctcccactacctcgccctacacatttcttccatttggctgttcctgagttgtatcccttataataaaccattaatagtaagtaaaatcaaaaaaaaaaaaa

SEQ ID NO: 16183 - DNA, 898 bp, Homo sapiens
gagtggggatgagggagaaaaaattatattaatttataatcgagaaaaaaaaacactcaaaattatcgctgatccacatttaaagtgagaaaccagtgttcctagccaatgcattcttcaagagatgttgttgacaactcacttattttgtatggggtaacttcattaaacaagcttgtaaggggttccttgcctctcactcttggcgtaaaatggatgtatgaaaccagattttgcagcgagactcacatgtccatctttattacaagttaagctatgatgcttttctgtttgtcttttaaaagtactatatggttgacaatctaaaacaacaaacacgccacttatttttatctacctttcactcaagaacacgacccacacagcccccctccaccccaatagatcaccccacatcatcccccactcttcccaacccccaatcaataacaccattccccctaccaaccccctaccccagtccccctgactacttctccacctccccaaatatacaacaagctcctacatcatcacacacaccaatagaccactcttccgcccttcctacacccctgcctaaacgagtcatttcaatcgctctcctcccccacctgccaacagtacaacacccacatacaccctacacctatatcacacctttatctcacctttcaattccctcattaacaaaacactatatatctccacccttccctaccgcaaaccaacccctcaacacaaatcttattctccaccccgaccttatcaccatctcaacacaagatcccctcgtccctctacttatcctcttccttccctcttccaacacccccctacctctcgacctcccatcctactacgactcttaacttataacaatattacataccctaaa

SEQ ID NO: 16184 - DNA, 841 bp, Homo sapiens
  misc_feature (1)...(841): n = A,T,C or G
tttttttgttttttatgtnattaaaattttttgggtagtttataagtaaaaaaaagacctcgtgtctaccanattggcattcgattttgggttcttttaacgagttagcctgccacggtttcatggatgctaatagaagatacaagacttctgagtcagagacaaaggacattttactcacagcatagcaagcaacatgatttgcgtgggatcctcttgctctcaagtcccatggggatgatgtgcgggccgcattatgggaactggatacacagtggatttgcatctatgggtgaagaacttattggttggtgggagaataagccaacctggtgtttggtgtggaaggtagtgaggtgatctgttaaaattgcttgagtatgcagcggctgtgcaatcgggctggataaaaaagcggaatagggcgcttcagcactggccccccagtcctcttgctttggtttcagccaccccttctccgattgttctcccctaccatagctttacccctccttcgtgatggtcttggggccgcaaggctaactgatcaccaattcattcctcggtttcgtctgtggagcccggcccgttccctctcctagtttaccattatgggcctcttctctttccccgatttgctctccccctacgcaatttacaagaatgaacacccgtcgtaccctctaccttgcggaatacaatgttttgaacgaggcggcatatggtgtattcgtgaaatgacgggtcacgattgcctaaccccctctcaccgctccgccgcacctccaaccccccagagttctgtggattatgatagtgattgtttttggcgccattgtat

SEQ ID NO: 16185 - DNA, 769 bp, Homo sapiens
cctagagacatcttcttttaaaagtgcttacacctatattgacctctagaagttagaaaagatgaagaaatggattctcccctacagcctccaaagaagccagccctgttgacataaatgttggaattctgatctccagaaatgaatgtatgacaccgagaaggtttagacctgtaaatatttagtgtcaacaatacttaaaacaaagatggaaaacgtgaccagaatgaagtcatcggcccatcaactatgttttttttggttacggtaaacaaggtctttgtctctacattattaatttggcctagcaagtatattttgtattacagtagaacatcatggttaattttaatttggccagctataataaaaatcgaatattggatttgttttgtatactaaaattaattttttccataaaatgttaaattatgaggtgtcatttttcacatatagcagaaaaaaaggataaaattatcataatttttatttattatttgtaagattgaggaaaatagtcactcttccatactatgtgaatgtacattggtaagaccatgggaaaaacaatgtagctgtaccacgtatatgaaaagttaaaacattgaccttgatcttaaaattttatttgttagaaactagcttacagaagtacttagatacctgcccaaaagaggggtggaaatcaattggtttgatcactgcttgaaaaaaaatacgaaagtggagaattgggctaacatatgaccctggggaggttcgctcttat

SEQ ID NO: 16186 - DNA, 714 bp, Homo sapiens
  misc_feature (1)...(714): n = A,T,C or G
ggtggtgtgaaacagaggcagagattggaatgacatggccataagccaaggaagcaggggacatcaacagccacccaatgccggaggaggcaagcaaaagttcctcccgagaatctccagatagcaagccccggctgacaccttgattttggacgtatgatcttcaaaactgtgagagaacaatttttgttgtttttagccatccagtttatagaaatttattacagcaattgtaggacactaatgcattttccaacatatatatatatacatctctctccctcaaaatcctctgtatgaattgttaagagatacatatatatatatgtatgtgtatatatatgtgtgtgtgtgtatatatatatatatatatatatggagaccttttatagactgaaataagcataccattttatagtgtatttataagtctttgtctcttagctcatttgatgtctcatcatttcacttatatgccatatgtaagttttattcaaggtctattagcgattttcattgtcttgaggtttttatctaattgaataatcaagtgtgtgagttaccgtagtatgttctcttgataatgttcttgtgttttatagctgaatttgtttatctaatcagtatgatagatttatgcntttgacatgtgcggctaccactacggcatcttgattttcttgtacctatttctatgtcatggtgttctcttat

SEQ ID NO: 16187 - DNA, 347 bp, Homo sapiens
taggacattcacttggccagaagattgtacgacatgggctgctcaaacgagtccagatgcccacatacctgtgctctttgccgtcatgaaactggaaactacgcatttgctccgggatatcctgtttttaatcagttcacaacgagatggaactggctgaaactggacaacaccattggaccacactgggacttatttgtgattggcctcattgttcctgggctgattttgttgcttagaaatcaccatgggtaggatgcggatcacaggaaaacctgctcacgagaatcagttcactccaaggtatccccactaaataaacagtttcccatccaaaaaaaaaaaaa

SEQ ID NO: 16188 - DNA, 774 bp, Homo sapiens
tagattaccttggggagagaagatgatcaaaatggaatggaaaggatcaaataaagaagagagatatttaatctatatatttaattatatatacttatttatgatattgttcattgttttattttaccacttcactattctgcaaaaaaaaccataaatgcaaaatttttaataatatgttgccaacctataagacaagtgaaataaatgagaaaaaacttaaagtataatggtagaaatctatgtttgtaaatttcaacaatcaataagaagtagaattattcaagcaacagaactccttgtgattacatgtttcaaaaataaaaagatgattttgttccaataaatattctaaattactacatatatttgtcaatatattgatgagttaatattaagattagtatagattttaaatttctacattttttctcttaactataaacaaagttcattatctaatgatgaatctttgtatttactttcattcaacactgaaaattctaaaataaaaaaagatgagaaaatcttattgaagcatttggacatccatgttgttattattaacatatatttatatgtgtgtatataaatcatatgtaatatatatcaaattattacacacattgggttactttttcaacactattttaaattaactacatttttactggatctctttgttattgctttttccccattgctacctcttattagaatatttggattgtgactgaaaaaatgctttaagaattgccttaataaatgcctatt

SEQ ID NO: 16189 - DNA, 762 bp, Homo sapiens
ttaggtaaagaaagcttttcatgtttcactgagaatagtcaaccccttccaatgtagaacccgaagattggatcttctgagaacatcagagaaagactgtccttgccatccacactgcaagaaaacttcaggatcttgaaccttgcgttcataatctcgcaaatgaaaagggtccctccaccctcttggaactgtacacccattggaacctttaaggtaaagctaaccaaggaagtctccccagaagaagatggtatccttgatgtgaacagctttcctaagatcgtggatcaagacttctaccatcttgagactttcatgaatattttttccttgttaatgtctctatggtttttttttttttgttttttttatttttttaggcggagtctcgctctgctgcccaggctagagtgcaatggcgcaatcttggctcactgcaatctccacctccctggttcaagtgattctcctgcctcagcctccctagtagctgagactacaggcacatgccaccatgcccagctaatttttttgtatttttagtagagacggggcttcactatgttggccaggctggtctcgaactcctgacctcaggatatccatctgcctcagcctcccaaagtgctgggattacaggtgtgagccatctcaccaggcctagttttagacttttgaaccatgtggatatacacccatgaaaagttaaataataaggatgtaagataattgtatactaccttataaatattcttttaa

SEQ ID NO: 16190 - DNA, 505 bp, Homo sapiens
ctcaggtctttaccgtggtctatttccaactcccaatagtttgacaactgcttatggatgaagttcctcagttctgaccatcagctcactgaatgtgctccagtaaagttgcaaagcgagtcattaagctttgtccaccacagtgagaacaactttccctcagtccatttcccatcaacccctggggaaatttctgagttgcccaccttgtctgttaggcttctttccctggttttatcaggtatgaccaggggaccatgactacattgtagacgcatggttgttgggagtctgcaataatagatcggggcaaatttaggggttaatgtgtgctggaataacatcccagtcataggttgggtctctccaaagcagagcctgagacaaagacttatgtaccggaagtttacttagaaatatgattctggaaagcagaagtgcagaaccaagaggaaaggaaagacaaaataaagatgcattattaacttctacaaaaaaaaaaaaa

SEQ ID NO: 16191 - DNA, 780 bp, Homo sapiens
ctagggcgtgtctcgtgaattcggatctcggggcctgtaggactaaagattggattcctcaataattgaattgaacatggatcgggctttgtgaggacaagcatggagtgcatggcaccctgctgaccttgactggcacctcctgggcttgaaccaacctctaacctgaacctgccactgagagagactgaacgcgtgctccagcatgctaaaatgatttttgtcttcattgccatacgggatgatgccgtggtgcgctggcttgtatctaacgtcctgagcttaatcactccatcacatcattggcctgccatagggctgggattacaggaaaactacctacatttactcatacgcaagtactccgagatctgcagagtgccctgaggaactcagagacaccatgagaccgcactgcctgtatggaggctttagctgccactaggccgtgattctgcatttgctccaagtggtccatgtcggtaactgagcaaacagacagctgactgtatgtattgagtggagctcccctactggactatcgtgagtacctccgacccccgctgaaagggtcatcgagctgtgcattgttacaaccctgtctttgacccgatacctggaaaactatctctcttagtggagcgtgcatcttactatgatatactctgactggatgtcatatgggagaaagacagacgcaacaaaccaggcggcgggccaaaaccccgcgtacagcccgaccccggtatcttgctcagtaacttaagaatctatgtcaag

SEQ ID NO: 16192 - DNA, 127 bp, Homo sapiens
ctagcttctgcctgggatgatgcatcaagaagacccttaccagatgccagtcttggacttcccagcctctgttactgtgacaaataaatttttgtttattagaaaaaaaaaaataaaaaaaaaaaaa

SEQ ID NO: 16193 - DNA, 562 bp, Homo sapiens
  misc_feature (1)...(562): n = A,T,C or G
ggtgtgtcctggaggtgagaaagagtgaaacggatccttgatgaccacaggcaagccggtgacaaataattcactagctgggccccagacctgtttctgcttcctcctcagggcacagcaaggccatacctcacagccttccttaaagctaggctgggccccatgactgagctccaggcaacagaatgtgggcaggagcctgcacgcctctcccacggttggcccataaaatcttccacttcacaactccatgccgggtccccttccactacaactcaggaagtcacctgttgaagatggtgcagtcacaagatggagagggtccaagccttgagtcatcacttggagaagagtggcccaccaatcatgaacacttgattataacttacatgaatgagaaatacatttgtatgtggtaaaccaaaaaaaaaatattggttctttttggtctaattggattgaactttggaggcggtttcctttagtgggggtgattagatgatcgtctctcacttactactntcccttcgatttctttgtttgtgtgacgtgttttatctat

SEQ ID NO: 16194 - DNA, 339 bp, Homo sapiens
tagaaattgacaagctgatcatggctattcacatggaatacaacccaaaatagccaaaacaatcttgaagaggaagaacaaagttggaagaggcatagttcttgatttcaaaacctaccagaaaactacagtaatcacgacataaggcataaggatacacatatagatgaatggaatagacttgagagactaaaaataaaccctcacattggtattgaattgaatttctgaagagtgccaagacaattcgatagggaaagaaccgttttttcaacaaatgttgctgggacaactggatacctgtaaaaaaatgaagttgaactctcaacactatacaaa

SEQ ID NO: 16195 - DNA, 336 bp, Homo sapiens
atggagatgagctttttcatatgctgcaaaggaagtcccgtgatgttcacagatcatcttacattgctcctgtttttgtaatttgctcaagaaatctgcaactcccagcatccctcctcacctggacactcacccctgtgtggccgtggactcttttcattgtatggcatctaatctgatgtctgatctttctcaactctccaaatccttctcctgagtcctctcaaactcaacatttgcattagcatgtcctctagtctcaaatgtgtattgaatacttctgtatctccttggggtcttcaagagggtctctaataaatgactgcatcagcaaaa

SEQ ID NO: 16196 - DNA, 782 bp, Homo sapiens
ctagattacctgaggagagaagatgatcaaaatggaatggaaaggatcaaataaagaagagagatatttaatctatatatttaattatatatacttatttatgatattgttcattgttttattttaccacttcactattctgcaaaaaaaaccataaatgcaaaatttttaataatatgttgccaacctataagacaagtgaaataaatgagaaaaaacttaaagtataatggtagaaatctatgtttgtaaatttcaacaatcaataagaagtagaattattcaagcaacagaactccttgagattacatgtttcaaaaataaaaagatgatttggttgcgataaaaaaaaaaatcgggctttctggcctgaacggtggagctatccgtgcgatgtcctttttgaggcgaaaatgatgaaaactaataaatgtcacatgtaccttccaatatcatcccactggtccacattatattttggctcgaggtaatcttgattgcattctcctacctctctctccctctcttcccaaatttttccatcttatcgctccctcctctcccggtctctactgtatttcgtgcgtgccccactctctctgtttttacaacataacatatacatctacttgtgttagccctaatccatcgcgcgacgtagtgtttgaacatagttgtctaatattcgaaaagcgctctgtgtcgcttagtgctacatttatagtcctttacaaagcgtatgcaaaacaggccctgatgggtgggggaagcgacaacaatct

SEQ ID NO: 16197 - DNA, 780 bp, Homo sapiens
ctaggtgtctttctgcatttctgtaacggtccctgtaagactacaatttgtattcctcaataattgaattgaacttggcatgacctgtggggtcttccccatagcacatctccctggcaggaagaataccaacatttgtgcatactcaagtcctgcaagtcctgcggtgtgccctgtggaactcaaggacacgaaaagtcagcactccatgtaaggaggttttgtatcccactaatcctgtattttccatttgctttgagttgtggatgtggaacctgctgataaagacggctgactgcatttattgaaaaaaactccacatataagcagacgtgtgagtttcaaacacatgttgacaagggtcaaacaactgtacatatatacaacaccatattgataagtaactctggaaaactaacactataggtgcatctgccatccgtcattgcctatgctaggctttcaagaacaatgatgggattgtctcgttttatacattccttttacttccttatttgttctaacttctaatggttttcttacacgtggcccttaacctgctctctacccttcgtattagaaaacgcgtaattaatggacctctaacagatatcaactatggacgtcatcatttcgctcactataatgtgtgactagattccgtctccgggcagatacctcatgggtacattctacagcccatcattgatctgttaataagttacccatttaattccttttttttttatttatcattaacacagacactatttcattcat

SEQ ID NO: 16198 - DNA, 750 bp, Homo sapiens
agattacctgaggagagaaggtgatcaaaatggaatggaaaggatcaaataaagaagagagatatttaatctatatatttaattatatatacttatttatgatattgttcattgttttattttaccacttcactattctgcaaaaaaaaccataaatgcaaaatttttaataatatgttgccaacctataagactagtgaaataaatgagaaaaaacttaaagtataatggtagaaatctatgtttgtaaatttcaacaatcaataagaagtagaattattcaaacaacagaactccttgtgattacatgtttcaaaaataaaaagatgattttgttcgaataaatattctaaattactacatatatttgtcaatatattgatgagttaatattaagattagtatagattttaaatttctacattttttctcttaactatagacaaagttcattatctaatgatgaatctttgtatttactttcattcaacactgaaaattctaaaataaaaaagatgagaaaatcttattgaagcatttggacatccatgtcgttattattaacatatatttatatgtgtgtatataaatcatatgtagtatatatgaaattattacacacattggtttacttttttaacactatgttaaattaactacattgttactgtggatcttttttattgcatttagctaattgcctacctctgatagatataggtgatatgggcgaaacatgacttattttgg

SEQ ID NO: 16199 - DNA, 458 bp, Homo sapiens
agatgctctaagctgggccagtggccaactgcagaacggagagtggccgagcagggaaggtcatagaaggcacaggatggggaaggacactggagaccaggttcctgtagggaaagagatgccatgctagtttgaatctactgggacagctctgtatctgaggcctgggtgcaaggcaacttggctgctgaattagggaagagataaaagaagaataagaatggtctgtcttatttttttaagttgtaagaacatatttaatgaaataatgaataatgatattttggctctaatattatgaaaatttaaactttgattatgcatagcaaatacttttatttatccattttgtaagaacaattttttacaggtaaaaattattttaatttttaactgtaacagaacattaaaaattatcaataaacttgaaaccttggtgaaatggaaaaaaaaaaaaa

SEQ ID NO: 16200 - DNA, 215 bp, Homo sapiens
aggcagcatctgacttccctcagaaatgaaaagaagccattaaatcagaagccggaggcaacatgatttatggtgatggaagaatcattgtttttaacatctcaaaataggattctctttataacagcaagatcatgtttcatttctgaatgcctagtgcctagctcagcatctgctacacagtaggcactcaataaacgtgtcttgaatgaaaa

SEQ ID NO: 16201 - DNA, 157 bp, Homo sapiens
tcagtgataaaccagagacataagaatacttctggacctaaggatgaaagaatgatgggagaaacatttcttgagccagtccctttctgcgttcttattttgtggaatccgcacacatccccgagaagcttaataaaaagggctactatcatgaaaa

SEQ ID NO: 16202 - DNA, 277 bp, Homo sapiens
ctagatatatgacatcaacatgcatagcagtttggatgaagagagcaagcatttggtggagagaaatgggtatcacaggtatgttagaagagaaaaagaatctccaagctgccgtctacagctttccctgagcagtttctgcaacacatcaaaaaccttcacatgacaagaggaatggtccctggagtgggccgccaagacagagggtcacgcctgcatgttggcatcaaggatggtccagttagcactcgcaggattaaaactgggaatgaccaaa

SEQ ID NO: 16203 - DNA, 743 bp, Homo sapiens
cagagagaagaagaagtgcctgtgaggttgcgctgatgaagaggattgactgatacagtaatgcaaaaccccagctccgttgcttctcacaaagatacattttagatgcaatgtattcatggagcaacccaccacgatcaagctgaggatttaatgaagttaaggatcttggcatgcgatcaccctggagtatttgggtgggttccaaatctgatgagaagtatctttgtaggagatggaagagaagacaaagagaagacggagagaaaaaaagatgagaaggtcatgtgaagacaaaggcagagactggagttaggcagctacaagctaaagaatgcctggagctaccagaacccagaagagacaaggaaaatattctccccataggttttagagagagcacagctttgctgacaccttgattctgcacttctggtcttaaaaagtgtaatagaataaatttctgttgttttaagacaccaagtttgtagcaattgttacagcagccctaggaaactaatacagtggaagatctggtaattctacccttcagtatacaagggcatatgacactttgtcctctgtttccttgccctcagtaaaagtgatgactggcaacagctaacattccatttcacagactggtagctgaatctgctaagcgtttttgattaaactgctatgtgtggctatctttggacccaatttaaaaactagaacttgggatatttgttttgcctaca

SEQ ID NO: 16204 - DNA, 645 bp, Homo sapiens
  misc_feature (1)...(645): n = A,T,C or G
tcccagaatgtatgagggatttgtgaccttcacagcaagatggcttcatcaaccgaggggcattctacagagaagaaaccaactagatgcaacagtaacagtatcttgggaccagtgttctggcttaataaaggacatctatgtgggcacaaatttgcttactccattaagtaagttgcccctggtctcctacatcaggaatgcaacagttgggattttaacctggatcttccttgactgtaaagcctggtttggttttgttttgttcctagaatattacattcccttcctagaacattcttactttttatttttatttttctgttttaatgttttattttcttttttcttttattatactttaagttctattgtgcacgtgcactatgggcgggtttgttacacatgtatactgtaatagcaacagaactaatgaaaatatagagaaacagatactttattgctttcccactgtgtacttttaagataacttccagtgcatnccttaccctcacctcaccattttaggttttcttttatcatttcttttaagtcatttatatatacaatcttagtccgttttctgttattatagaataccacagactgagagatttattaatgaaatcagcttaattagctcaa

SEQ ID NO: 16205 - DNA, 740 bp, Homo sapiens
caggaacacagacattgtccaattcaaccacagagaagacttgtccagctgaggctttcaaattcaataattatttggagatatgctactagaaactttcagagaggacaaagaaaaggtatcattacagtgtaagaaggctggagtggattagcattgctcacagttgtagagagaaatacttggctgatatcaaaatacatcgttggatgatgccgcccgcctctccgggcctgcgagtgggctggcggataccggagtccctgaggtcactggcggagatgataatttgatgtgatagaagatgtgcgaaaatgaaatcatcatttagtttggaaacaacctcagtgtccatcaataagaaaaagaactatggaaagccatcctataaaaccctctgcaatttagaaaagttctccaagacaatttgttacatgaaaaaagcacactgtgactgggcacagtggctcacgcctgaaatcccagcacttagcgaggctgaagcgggcagatcgcttgaggtcaggagtttgagaccaacctggccaacatggtgaaaccctgtctctactaaaattacaaaaatcagctgggcctagtggtgggcacttgtagtcccagctacttgggaggctgaggcaaggagaatcacttgaagccaggaggcagaagttgcagtgagcctagattgtgccacagcactccagcctgggcgacagagcgagagtccgtttaaaaat

SEQ ID NO: 16206 - DNA, 766 bp, Homo sapiens
tgggtggagaaatgagacaacaagaggagaagtggtggcttgcctaaaggaatcaaaaaagagcctgaatagccgaggcattcctaagcaaaaagaacaaaactggaagcattatgttacctgacttcaaactatacaacagggctacagaaaccaaaacagcatggtactgctacaaaaacaggcatatagaccaatggaacagaacagaaagcgcagaaataaggccacatacctatgcccctctgatcttcaacaaagtgacaaaaacaagcaatggagaaaagactccctattcaataaatggtgctgggataactggctggccatatgtagaaaattgaagctagcctccttccttataccatatactaaaatcaactgaaggtgggttaaagacttagatgtagaacccctaggtataaaaaccctggaagacaacctaggcaataccatcttggacaaaggaatgggcaaaaatttcatgacaaagacaccaaaagcaattgcaatgaaagcaaaaatggacaaatgggatctaattaaacttaagagctcctgcacagcaaaagaaactattaacatagtaaacagacaacctacaaagtgggagaaaatatttgcaaactatacatttgacgaaggtctaatatccagcctgggcaatagagtcagactccatctcaaagaaacaaacaaataaaaagagattatcgggctcgttggcctcaacggaggagctttgcggacgtttacctttaagagg

SEQ ID NO: 16207 - DNA, 441 bp, Homo sapiens
tagatcaccagcacctgaggcttacctgaccgataccgaacacacagtgctcactacaccacccggcaagatcatctcagggcaccacccaccctaggacacgattcctgcctttatcacgtcactcaccatacagctcttcaggaccgacacattgagcgagccagcaagctggaagaacatattcctgacccactgtgctcgtccagatctgcaaggtctctgccgcggaagacagaggctgggtgcacggtcctgactatccaggacatcagggcagcaggatgactgacagacacgctgggacctacgatgggcttcctgatggggcggccagtaccctctccacgtgcaaaccccatgcgtcccacagcctgccgtgtgggcgagcgccaccagcctgtgttcctcaccttgtgaaataacaacttctaccgtaga

SEQ ID NO: 16208 - DNA, 548 bp, Homo sapiens
ctggctggagtacaaatggcatgatgatcttggctcactgcaacctccgcctcttggattcaagcgattctcctgcctcggcctcccaagtaggtgggactacaggcatgcaccaccacacctggctaattttgtatttttagtagagatggggtttcaccatgtcggtcaggctggtctcgtactcctgacttcaagtgatccactccccttggtctcccaaagtgctgggattacaggtgtgagccactgcacccagccagaaatgctagattttccagtgaattaaacattcctcttaaattatcaaggacctaatttccaaagcaattaattttctgctgtcttcacttgccaaaaaaaaaagtgcaaaataaattctctatgctttctaaacattaccatattatttcgaattagtacagtccgaactaggatttatgagtgataaataagtttcttgtttcacaatatggtttcataatttctccaaaaagaaactgttccctaaagcctaacatttttattaataaagcctttaatcataa

SEQ ID NO: 16209 - DNA, 653 bp, Homo sapiens
ctagagatcataagcttcagaccatcatgcagcaagggctctagccagttccaggtgaagaccccaccccgggccatcaaggagcttccctgcctccactagacagagcagagtgagagttccaagatccccaatagacgccaagaacctggacaccctccaccggtgacaatggcagaaggtgaaggggaagcaagcacatcttaccatggcggatcaggagagagaaaagaaggagagtgaggggagaagtgccgcacactttcaaacaaccagatctcctgagaactcacccactattacgaaaacagcaagggggaagtccgcccccatggttcagtgacctcccaccagacctctcctccaatacatgaggattacaattcgagatgagatttgggtgggaacacagagacaaactgtatcatacagtaatctcaacaaaagcttccaaaagttacttttgaacatcagagatgtaggatataggattctctctctgtcttggtaaatttaataaaagtagattaactataagatattgttaatgaaagtaattgactgtaagattcactgtaagcatacaactatgcagaaagacaagcttttgaataaagttcagttatagattaaaaaaaagaaaaaaaaaaaaa

SEQ ID NO: 16210 - DNA, 733 bp, Homo sapiens
tgtaatgacctgaagtacaaagaaaagaggaacttacagaaagatggaagaagagtatgccatgcagatgaagctgggaattaaagacccagatagaggaataaggcaaaaagagtatgactactaggaagagaatggattcaggaatcttctgtgtaggtggaaggtgaccagccttcccaaatgaaaaataaaaccacccacagaaactagattttaaagccagatctgccaacattagccaatttacatcagagggagaggctgaagagtactggagagaattgttttggagcagttatgagaaaattacgaataatgggattttggtacaagatggctgactagagatgtgagacacctgctctctccagaaagaagaaccacaattatgaatagataatcatactataaatagaacatctaggaaagaacactagagtacaatggagaacacacagggaacatttgaggcacagaaggaaaaggaagcaagtggcccgcttggtcaagattgggtgggagcctacaagggctccctattacagggacagcataagtgacagaactttagcagttcacaactctaccggggactgctgtgaactaaacctcagtagaactcctttaccaaccaggaatgctgaaactagcatgggatgatgacttggacaattgtgcgaaagcattgcctcacaccaggaatgcatgctggcgtaataactacacctag

SEQ ID NO: 16211 - DNA, 340 bp, Homo sapiens
tcagatgaacaatgatgagaagttttctgtgtgggatccttgggtgttgatggaggagaccagccatcaggcaggtggtgacaggccttcaacatcttgttggagtggtgtggcatgttacctcctcatcatcctggaggatcccacatgggcttttttatgctttttcccattaaaattttaaatgtacatacctttgacttaataatgttacttctataaatcaacctgtaaataaatatgcattgtacttttcaacatttatttcagaaattttttagtaacaaaaatgggaaacaactgaaaagcccatcaataagttaaagtatatacatccaaa

SEQ ID NO: 16212 - DNA, 690 bp, Homo sapiens
ctaactcctgcttaattccttcctgcattcacttgcacacaaatactcttcccccaagctgtcagaaagcatcagactgcctgatctgcaaagtgaatttcaaaatcttttgagaaacacaaggacatttgcttcaggcgcagatttcatcatcaccgtcataaacagcaagtataaagcaagtcaatctctggtattcaaaccaaagctagaagatgatggtactttgaagatggtaaaatgaagaatccaggaagaaattctctctacacggcagtcccatgtttctagggcaataaaagactaaaatatgaaaagtatattttgtgagactttaagaggccatgaaaacccacccacaattctggcaagctacgtttagcaaagaaagaagcatgaagcaaaggctccattttctcaggacctgtggaatttaccgaggttttctcatccttcctgcgattcctagtaacaagcttgaattaaacatttttgaagagacacatgatgattaattttatctattaattttgcttcagtgacacttgcatagaaagttatttaggatagacatgcctctggtgattgttttgttttgtttttaatcagctaaggattttgcagagagaaagaacagcaagctcattgcaaagcttcctcaagtaataaaagggacacactttcagaaaa

SEQ ID NO: 16213 - DNA, 2951 bp, Homo sapiens
  misc_feature (1)...(2951): n = A,T,C or G
gggaaaccccccctggggggtnnnnnnnccccccncaccncccccccccncnnnntnttcccccccaccccccccccccccccaacccnccccccaacaattctcttaggggcctctacctcgctagggcgcactcagttgtgggcccttttcgcnangcaagnaaatacccagctcgggccttcacctggangnncactntcggccctccccctcgctnccaaatcgcnaaagctatttttttatacagtgcccctaggtgcaactctatataccccctncctccacatccatccgcaaacacatcggtcngcggccacacacaagnaatatccgccgacacgccagcccccagcccccaggctcgaccacaccagccaccacattcactaccctcacagntttgcgatcacatacaccaccccgccggccacacgaccccgccataatcctcggccacacagcccctccttggcgcccaccctccacgcccacatctttctcccctctcccctggtcggncggttcattcttcacaacaggccagcctacccaccacgnctctcttctatctcccaccccacgccaccatcccctactattcttattttcccacctttgccccttagacgaccgccctttattcttaggaccctcgattcnaaccccccacaacttgccactcggctgctcgggaagccttcgtcgccccaattacaccatcgccgtgttttctcgtcaagcgttttactctcctcccaacgttttcagatcacaattgagctaatttttccccccaactccatccccctcaaccctaaaccctctaattctacatcccacccccccccccacacaacaacaccggtcggaaactcttcaactgtccttctgctctcgcacccaaagacccccccccctttccctcttcacaccacaacactcctcctcttccccccccggggagcacgcacaactgcgcaacgcacacttttgctctcccctcgggcaacccctaccttccccccacagccaacacgattatcttcatacaccccacacaatcccagcccacaacttctccgccacccacctcaaaaagcggccaccacacggtcctaacatccctcccccccccgctctctaaaaccacacccacctaacggttaacgaccaaaacaccctcccacccctttgcggcggcccatcccacaacggccctcgttcacgtgaacattttcctcctagagctccctctcgtctactctttcacccccacccctcgacacactctcggtngtcgcctcccggctccctctctctgattatcccctacaccaccacttattcttcttcggaaaacagcgtccgctcccacatctcccctacaccgtccgcgcggctctcggcagcttccgcgccatactacacacgcggcgncgcttagcaagaccgtaacatctcctctcgtcaccttcgtcgcgcccgccccctcaccgccggcaacatgccctcaaccttccctgcctcccgaaacctgtgcgggcccgtcacaccagcaccccgcacgatccccctttcggggccctgcgtacacctttttccacctcaccctcagggacccacctagcaccccccgggcccgtatcccgtccaactaccgcccacccatattcgtagcgctccctacctatctcgcgcgnacccatcaccccctcccctctgtgtggccgtcccttgcncccccccacactcaaccgccaaacacagagacctcttacgtcttcctcacagcgttgtttttgagcccccccccctcctcaaccccgagatgcacacctatgtgcacgcgcannctcttttcacaaccaccacctcaactccgccctaaacaaccacagtcctactacccccaccgcgcccttaaccaacatccgatgtacgcccccgtcccaccccctactcaacaccgaagtttgcttantaccggaaccacaatcacaatcacccactcntcgtaaccnattcctataaaggagacgaaggtacgacgcgcgtacccactccatatangaagataagttatccaacccccctgcgctcattacgtcgcagcggcatcacaaaaactcaccccgccatcatatactctcccctggttgacgcgctcacagctggtccgtcccccccccccccgggacgcgactccttctaactaaaaacaccaccacaaccgcacctgaccactcgtcaccataccaaccccatcagcctcgttgtgtttangccgtctcaccgtgacaggggagcctccntattccggcgaaggctacactcctctgcttccctccantactactttttggagagccataagcgtcaacatcctccccacctccatttcccgatccgatcccgttcttcgccccccaaccaataacgtcctcttaaaacaagaacaacacttgcgtactatcgcacgcggacattattancctgaatgactgcgcgttaacctccccatganaagggggtagcggtgctggagcnaccctaacggctcgatttnaccttcactcgacacccagcgacctctcccctaccgncctacccctccccagcgcctcatcctaacgtatactacaatcaccacccgctgggatgccgcttcgacccttcccccccccacgcgcacgcgccccagcttttcncctctcaccacccttccttcttctttcccccnaccacccaccaacaacaggccgcgtcgcctctcatcacgctcttccccaactatctcaccactccccacgagtccctgattgtcngaccgtcatacacgcgcacgcccccacccactcacttaccctgcattcacatcatcgccgcccccacctgcgtccgcggcgtgcgcctcnaactctagcagtacaacaccgccccacccgcgc

SEQ ID NO: 16214 - DNA, 779 bp, Homo sapiens
gtaggcatctatcctttctctggtgacaaaaataaacatgtgattgataatctgattatggctccagggacatttgaagtgcaaattgaagaagttcgacaggtgggatcctataaaaaggggacaatgactacaggacacaatgtggctgacctggtggtgatactcaagattctgccaacgttggaagctgttgctgccctggggagcaaagtcgtggaaagcctaagagcacaggatccttctgaagttttaaccatgctgaccaacgaaactggctttgaaatcagttcttctgatgctacagtgaagattctcattacaacagtgccacccaatcttcgaaaactggatccagaactccatttggatatcaaagtattgcagagtgccttagcagccatccgacatgcccgctgattcgaggaaaatgcttctcagtccacagttaaagttctcatcagactactgaaggacttgaggattcgttttcctggctttgagcccctcacaccctggatccttgacctactaggccattatgctgtgatgaacaaccccaccagacagcctttggccctaaacgttgcatacaggcgctgcttgcagattctggctgcaggactgttcctgccaggttcagtgggtatcactgacccctgtgagagtggcaactttagagtacacacagtcatgaccctagaccagcaggacatggtctgctatacagctcagactctcgtccgaatcttccacatggtggctttaggagatccttg

SEQ ID NO: 16215 - DNA, 1452 bp, Homo sapiens
  misc_feature (1)...(1452): n = A,T,C or G
gagatagggaaggataagangaaagttctaaaaataccacggacgccttctaaactctttcncgtaactgtatgcagtgttctcgtgncacacttgtcgtcggttattagtaaagtatagtgctaactatataatctagaagagtatggacgtcgtgatgtgatgtagtgagtagtggtaaatgatagacgaggngttcattacttagaacgccaaacacctggcatcggcaatacactgctattgcttcagagctcgctggtcagattaactaacacaccactctacagtagtccgtgcttcaccatttatatntattacaaaatactttcgttnaaaacgggaagacagtaacaaaacagggcccaggttatttcacctcaaccaccagagccngtggatgttgtgggatcggtagtatataaggccgaatagtcgtgtgattcattgtatttttntttttttatactatcgatgtacatccatantatcacgacgtcgggtatgagtgactattgggtacaccatagtgatactgtatgcagtatagatgcggntcgcgagatggttaantcaatattatttttgatagaccggagatctctttcgcatacgtcctagatctggttttcacatgctagttgcgatgacacacaaccancccgtcagtgcgacgatcatagagtgtgcntgcatgtctaagctgctagcgtcgcntcacgtccgcgtgactgtcatgatcgtgaatagttaagagatgaacaggaggaggtgagcattagaggatactgatgagntatatatgtacatgtatctgtatatctcacgtccctcttcgtagagcacatgtnatcgttatgagtatagacgaagagatagatgcctgagtagaatgggcgcgcgtgtagcagaagcagatcgcgaccgtctcgtnccttcacagctcattatcatccctcgttactatagagtngatgatatactagactgagtccgaagtctattctgatagtatcagtaataatcctatatcgctatgttagtaggtctctcgtcgacgttcttacagcacgaggtcatatcgtatgtcncgttataacaactaagtcgttcgacagagctagtgcgacactatatgtcagcgattctgtatgtaggtctgatagcagaatgggacgctggatagataggtgatgagcagtcagtcgaccgtatgtggatgaatagtgcgcgcacatggataggactagcgcagcgcgttgagtgangtcgtctctcgaggantctgagtctcatgcatatcacattatcncacacnatccantgtatacncacatactattagagangcactgagtgacagtgtgtatgctcntgctacanagctcgactgtctnacgaacgtngttggctatacncatctctcgcgatgatantcgttantnacgntaa

SEQ ID NO: 16216 - DNA, 1187 bp, Homo sapiens
  misc_feature (1)...(1187): n = A,T,C or G
aaagtgacagcaaacacgcaaccaaacatggngatgcggtctaggtcgcagcnccgctattgaggaaccggctcgtgagggacgactacacttcagtgtcagcgaggaacgggggaggcggaagtgtangccagcgtgtttgcggtgtatagaagaaaagatagagacgacacgtgtggtgtcgcggttggtctcagtgngggccgttgcgcagaggggggagggagtagagatagaagtactagggctcttcgaaatggancctcaagaatacacaacgaaanagctaggcatggacagcaataaagagaacaggagattcccgctaaaacgaccgtnaggcgggcggtggngcactcgtgtcgtttgagagcttgtcagcgctggtgggagtgggtggcgttgggcgatgagggatgtctgcgtaagcgtcgacgaagcttcgatctcgtgcagtggtgatgagacgcgnacgccttgtgntgtgcgctgcaaacgaaacatcaataacatacgtatgatgtgtagcggggtggttgcgtaggtaagcaccagaggaagaacaggtggagagaggagttgtgggagaggagtgattatgagagagaaggagcgganatgtggtggagaggccgaggtggggagggctatcttggttcggcttaaactatatgtctgccgtgagtgctccctacgccgtgcgggatagtggtgtggctgggggtagaatgctatnggcggagagcgtcagctaatctcctctccgtcgagtggaagcgaangggggaacgtcgtnttatctctggtttatttgtaggtattgagcatatggagtcggtagagtgaattataaaagcgactagtcgcgtgtgatatctcttnaccgcctacagtgtggtctgtgcggttccagtacgatgngcacatagaacaagttaagatgatgcggcagactgtatcgtcaagtcccacgggcactgnaccacactaggtatacggacgcgtcgagcaccgagacgagagcanaaagcacaataacatatcaactcttgaggctctctgtctgcttcacaacaagtctggggagatggtccggtagccgatgtagtcaacctgtgcacgatagagcctgcaggtaacctatgtgatggggcgctgcgggagtgatgagtgacagcagtagcaat

SEQ ID NO: 16217 - DNA, 707 bp, Homo sapiens
aaaaaaatttgcatctatgttttaaaaaattcttagaatagtgagcaagcctatttaaatcgtggtcatttcttcgtaattttgcagatgcattattctaaatagtgtgcatgggaaaaaataataggtattaaaagttcattaagttcaatatccggtgattctaagggactaatagcactctatgtccacaaaagattgtaagaaattagagctatgggatagacagagacaggaaagcgcaacctagtcatgtccggaacgaacatcccaatgtgagttcatcccgtaatgtcgttagtctcaacgaaaggttaagaatccaccctcatccaaaatccaatcaaaattaatcagaataaaaaaagttgggctaattgatttccattaacttcaagtgcaaagtgttttgcacactcctgggatttacatgatggagaagaacagattcgaatgaactttgcctaacacaaattagataaatatccttttccttgaggacattaacatttagtaaacattaataaaaaaaacaagtaatgcatgcctaatcatgtgctacatatgcctaatctgaattcatctttaaacggggaacggtttgaatggaaaattcatgttttgggttcctacttgtgacatgtaatgataataatttgtgtattccagtaaaattccatgccttttgaaaaaaaaaaaaaaaaaaa

SEQ ID NO: 16218 - DNA, 1479 bp, Homo sapiens
  misc_feature (1)...(1479): n = A,T,C or G
gcggacgtggtggtagacacggaagatcgagaaagcacacaaacacgagcgacgcaggcggagaacatcaacataatcacacgactgcccgatctatttaatgcgacggtgtggaaagtgggcacgaagcgatcgttatttctcgctgtagcagatgcgtgcagctcaacgtaagcgcggcgatatcgcatcgtaccacgctatacacccgacacgtaagaggaacgccactcagcgcgtgcacgcgtacgaccgccaaccggcgacaagtagacgccacggctganggtcgcgcgcggaagcgactgatccggcaccgcgcgcgggcagagaaggatcatggcgacggccagaacaagactgatcgaggcgagatgtagggtgggatgcggtcantcgtaccagcaggatcctctgcacagatgcggactgagtccgcccacacactatacaagtgagcaacgataggggttggaacattgttgtgcantcacacaggtgacataaagcgngccactactgcggcaatgggacacacaagngggtacagtagacaagcgactgcggctggcgagatcagaacatgacatgtgacacatatacgacgcacggccatgagatttgggagcacgcgacancgcatcattgcggtagatcgcgagcgggagggngaggctgaactcacaggcgcgccgatcgccacgcctactcgataattacgcgcagtgaacgctncatcgacgcgtgcgcgtactgggcacatacacactccacacgccaacacgngccgacccacaatacgctctactctatgtctgcagcagtgagagctcggacatcactcatatcgtagttacgcgtcgtaagtacaagtacanncctgagagacttgagaagacaagtagaacatgcgcacaggtctactacgtggagctagagctaacaggcggcacgttacgacaggccgacaactctacatcagagngccgagtgtgtagcgcgacgcgctcgcgtagtgaccgcgctgtaccgcataaanaganaccacgcacagaaaatgagantccaactggaggancgatggagcggacaccgcagatggnagcacacacaagacaaganatgagtacacggcacatgtggtcatanagccacnatagtggacgaacaatgcangcgcacctgctgtagttgtctangacagtgtgatatgctccgcgacaaggcgagcagagcctctgtgcactatgtgacncaccgtgatgncaatgcgcngagagttagtacgtggctgagcacgtcgtggagtgggncagcgcgcgcacncgaacagngcaccaggtgtgccgacgtntcctcgagagtcgtgaaggaacacgcgaagggacgacgctcacgactcatacgtcaccgatggganagacntgtgcagtctgtgagagtgagagcgatacaggtagacacggactncatgctgcg

SEQ ID NO: 16219 - DNA, 1554 bp, Homo sapiens
  misc_feature (1)...(1554): n = A,T,C or G
gcgccgggctagtatgctgggtnggtgcagcaggctgtcggtnctgtacatattctgcagcagaagctagtgttatcgtatcgcgattgtgttcactgcatcgttcgctctgttcgactctgtcgtcggccgcatccgatcncattctcggtacgcacagtgcgtcgctcntctggcgcantcgtcctgntcggcgtatgtgtcgctgtgtatcngtcacatcgcgagactccacgccgcgctccgctcgcgaacagttttctcctcacagatttcgtatataaaataatgacgaccgcgtagcgacaccgcacagatcgataacgcgagtntacgtccgttagtactagcgtacgtcgcagtgtctttattacttacgtcgtatgtatgcgaggctacgactccgcgtgccgctgcggtcacacgcgcgcaatgatgtgtatatgcggcatgccacatatagtgggnggacgtgcgcgactgctccggtttccgcgttgactaaaaaaggaccttaacgaaaggtgtgtagtttgatcgagagtgtaaggnaggctccgattcaccgagtgaaaaataggtggcataacagagtgtggaacttggggatgctaggaggacgtgatcaaccaggagtacagaaatcttggagaggggcagcaggctaacgagatgaatgtggacgattatggttattgtcataggattgtgtggcagtggtagatcaatgtgtggagcagtcggtgctatcagcgtggatgagagtaatattataggcacgcatgttcgcgccgatacgtattgagatacggtgaccgagagtgcgcgtatgtgagctggacgtantatccgcgagctcctcatgtcttcgtctaatcgcgcncgccggtgcacattatcnacagtatgccggcgtagcagtgacggatcgtatataanatactatactatcagtggagcgtgttgcatctgtattcgtcaggcagtcatcggtcaagaaatgtacgcgcgcgagcgatgcagctaaaggtgttaagcggacatacgacctcatcgtcaaattagcggctctcatacacaccatgcatgtgagtggtcggcagganccgtgtgatggnatcgagctgccatgaacggatccgnctacgtactcacgatcgacnagacatggagctctctcggtactccgcactacggtgcaggttctaccacactataaggcgtaccggtgagtggcatcgngggcacacatgcggtgatccaagtatcgntcangacgagntgtgcacaagccgtgatgcatatcactgtgncatgcagtgccactacagtcgctaagaggtcacaccaagcgcnagacggcgatcgagtgacatggtctcacatatgtatcgtgcccactactatatacatctatcancatgtgttgctcattgcaccgtaagtcntgtgtgcgcacagcgagagacnanaccacacgcgacacgcgtatgtgtttgtccggncggntagcgcgtgtgtggcggtaccgatcgacgngtgatctgtctgacg

SEQ ID NO: 16220 - DNA, 1705 bp, Homo sapiens
  misc_feature (1)...(1705): n = A,T,C or G
tgtgtattatatgctgagtgatctgtatgaacgttattgtgagtggtagatagatagtgtatgactcacttagtttgcgagcgtctatctattaatctcacatcgatagacgcagagtagtgctttacgttgaccgagcggtggcacanaatccgatatacaagacatagatgtttagagaccaccaccagaancttacagaatccacacagaatcaatatatancacctcatantactaccacatctcgccgcacctcatcgtctgtctttccaccgnatagatctctcnatgttcgatgntccgatctctgcgtcggntacagcgcctcagcacgcgccgacgcncatagataatagtaanatacattccgatcgtggcatgttacagtatgtgtctaatcggcttatctgttggtaagtctggtgtaatgtgatttcgcgtcgtccatgacgctgngtcaccgacaggtcgctatctttgttgatcgccggtgcggttaacgtgtgctctctcagatgttagtatgattgaagtactcgcgtcgatatgtattcgacgcctcacgcacacgacgtcgaccgctataactctatcatgatcatgtatataatcatagtatgactcgctcgcgcgcatgtagcattttttagatccaccgtttagttaatccgcattgtcgcgtgtgccgcgtgtgtatatatctccgcgatgcgctgtgacacatacgacgtctctgatgtcgcggcgtcggacgngtagattataancgttanctntctgcgtattccatattatcntattccncagcctgtgacattgtcgtgtacgcgcgtgatgaatgcgatatctaatcgcgtgttatatataatatttgcagcancgacagacaacgtcttcttaatgatgatacgtgtcgatnatgacctgcgtgactaccgcgagtgttcgagagcgcgtctgtgtgtcgggcgtgattagtgtcgtgcgacggtataataagtatgtgttctgcggctgtaagtgtgtatagngtgtgagtgatggtgnaggantatactggcggtcgtcatctttatancaacantgacggtcgctcgtgctggcggttattgagatatatcgatatcacatggacgtcgtggtgtgcggagcgtgatagtatatggcgacgcgtatcgcgcgggcgcggtggtaataatatatctcgctagcctgtgtcgacgtatcgtgcgtatcgggctacgcgtacgcgcgtatagtacaatctcacttgcgtgatattagatacgtcgtagccgagttcactccttcactctgcggcgcagcgntagtattctgtggtgcagcggagcgatacggggttggatatggagtttgacaagantattagcgcgtggcgagaaatcggtgcggtctactacaccgcgtgtgtagacaagcgagtgcgnggcgggcaatcgagatatattacacagagtaacgcgcggtattattgaggatgcgcgtcatctatattacntctgatactgttgtatagtcgacgtgcgcggtgagtcgtctgttacatagtatggtgcgtgtgcgttactcaaggtcccatggtatagnatatagcgtgtgcgatgtggantcgagcgcacggtantncagaggtctcgagcgaagagtgctaaacggagagcacgacgcgacggatgaatnt

SEQ ID NO: 16221 - DNA, 1347 bp, Homo sapiens
  misc_feature (1)...(1347): n = A,T,C or G
gcccgcctctgcctcaccacgccccccgctgtcttgctaacccctccgtcttctcgatcggtgtggctacctgaantcgtgattttctcggattgcaagcaccgacagcaaggttcactagctctctcatgaatcgggcgaagccgggctctctcacccacgacccatngtcatcctcgcataggtcactcctcttgatgctgcggtggacgctgcgcccgagactctagtcacatacataggacttattgcgtgcatggtcntnagtggagcgagtatatgcgcacgctgatcattgctcaactattcgatcgacncaacaacctcgctcctgcgacgacgcacaccctaccgagtttcagccacgcgtngggtccgcgacgcatagatcgctgcgaaccttcgacctacagcgatagtgtgtagcgtgactcgcatcacatgcagggcagcgtagatggaatgtctgttacacagagataaggctcgacaccactacggcggcctcccagcatctgcattcattcgattttggtgcgtcgcacccgtcctgggcctctcgctagctcagaccacgtctccctcttgtatctatgatgggtctgtatgacactggtcgcgcgcactccacgacactggttagtgcctcgccgccgacgtacgcgtcgtgcactttcgcgattactgggacatagttccattgattgcgcgactcgtacccggtcacgtctcattgagctcgcgcggatgggtggatatgtaatgcctgttaactctggtggataaacttgagcatgtataaaccagtcttcgtagtcttctatcttgtggacacttggagtgccggtggcgcctcgagacggctcccgcacgagtcgcgcagagacggcttgtcaagtgcctgcagctgagcctctgcgtgcgtgtgcggcgngctacacttgcgtcggctccacatgcttctcgcacgctgcacgcacgcagagacgcgcagtgtcacgcgtcgcgagaacggcgtcacgtcgtcgcgcgtagcgattcgttgcagtgtcacgatcagcgcgcgcgcgtctcgtggatcgtagggagcgtgacgtacgtataacatctattgcgcgctctacgttcacttgcgtgtgacgcgattgcgtgtacgagccgcgagtgtccatctctnacncgctcgtctgcacgctcgcgcgctcgcagacatgtagctgtatntgacatatacagaatgtatatcatagctctcctcagcatgacagccactcatacgacagtgtgtgtcaggacagtgagcgncgcgcgccgtgtctggntcgcgcccgtgtagncgtgatggcg

SEQ ID NO: 16222 - DNA, 809 bp, Homo sapiens
tgtatttcaatactttcgacttttttagaattgttggcgtttcggtagtcaacatgagccctattacttggagtaaaacaaccccttccccagcaggagtcaagaatgagcttcaggcctcttcatctcaagctgaaaaggacagagggagccatagacaatacaactaacaacctccaaaaacgcacagcctcaccaccactatcttgagtcagccaggactaatcacaccctgcccttcattatgtctgtccccataaagccccaaactcaaaggttatgcttcattacccatacactgatccccataatgctctgcatgctccccaacctgcaccaatctcgcatattcctaacccttacactgggatttctggaatatggagcccaatatcaggcaaacttaagttatataaaagtttattaaaatgtaaggtttaaaaactataactttaagtgttttaaaaacttatggtgttaatttcctaataaaacttaacctttagacaaagggaaaatgtttttttacgtacgatcgtccccacattatattgtcatgacaatataataaaaacctgtacgcttcatagttattaagtagggatttcgtgcggctttttttttatgtgggggtaattcaagtggacagttggaagagaagtagctagccagaaaataactctgagaaaaacggttttattgataaaaaagaggagtagtctgttgatatagaaatagtgggggtagccctggcgaaataaattgggagaagggggacgatagaggctataaagaattcaggatctttt

SEQ ID NO: 16223 - DNA, 534 bp, Homo sapiens
cagatcctttgtatggcaaccctgtaggctcctcaccggcccaagttggccttggggagacccagtccatcccagacgctccaaggaccccattggcagagctgcaaccagagaccactgctctgcaagccacgattgctgtccgggcagtctcacccacggggcagactgaatccttagcttgttggtttgtgtcatcatccggcatcaggctcagttcaaatcccagctcctccacttccaagttgttggccttgagcaagtcacttaatgtcgctgcgttccatgccccatctgtgaaatgaatgtggtaataatggcatctctgtctctctctgtgggcacaaatggttaatagatgggaagtaatacgtggcctgacacacagaaagtattagttaataccgttattattagagccagtaaagcaaagagagagagaggagtttagtggtgatcaacttttccatcatgttgcaatctcagaatctaatttccaaaaaataacatttgaatttgagaaaaaaaaaaaaa

SEQ ID NO: 16224 - DNA, 804 bp, Homo sapiens
actgatggtagcaactctatggacggaaagcggtatgaccacagcctgaccagagactgattcgttgacgtacacgctgctatacaacgcatacaaactccgtactcgtagaggtgataatctactaccagctaaggatcaccgtccaccgatcgtaacctgtacacccattcgtatccctggacgctggccgctcactacactatagcacctataaagatatagctacacctaatgtgagcagcctgtctccagaactgaacacactagtttagtatatctgagaacccctattctactaaaatacaccattgctcatgcctatgagagcacttaatgctaaatgacagacgagtcagttgctcacacttatgaggtatacaccattgcattggattatcatcactgactaatacgcgccttaacatctatctagatagagcaaagaagattatcccttgttcaaaatatatttaagaggatgccactatgactcacgtgagaagagaaacacctctcagcatgatcatatgactccacataaattgtaaaacgatacttttcacagtaggcctaaactatactgcttggcccgcattgcgtagggcctcacactcgcggcttgtgatttcttaaacagtccccgcaaatgcttactggataaatgcctgcttaacaaacctaactgttaagaagaaggttacccaggaccttagaaatttgttaagccaggaacatgacattaggtaaacctgtcttaaatgactctttaggcgcagcaagaagtaattattcaaatgggga

SEQ ID NO: 16225 - DNA, 169 bp, Homo sapiens
gtaatactgcagtggtgagagtaaaggagaaagcgatgaggagctgagtgacgagagctctgacgaaggtgaagatggatcatgagtgttgctgcaatacttgaagcttcatgtattttcattaatgtataccatgcaaatataaagacaagtgacaaaaaaaaaaaaa

SEQ ID NO: 16226 - DNA, 1334 bp, Homo sapiens
  misc_feature (1)...(1334): n = A,T,C or G
atcggacagacaatccagacatagcccacaaaactgtannnntttgcacaaaaacaacagtgcgaaaaagttgaacgagaggaatctcttcgtcaggccaatnctggagnatgggnattatgaatgagcatttgtagacacaggaacagagtactcgaaacatcactagttagcataaacgttagtagccacaccagccataagcgcaatacacaagaggcgaggtgagcctctgagctatggaaacacatctaagctgtgctaggattgactacgtgcataatagggttgcgcgttagtctggtcgtagactcgtcccctactaggtatgacgtaaatcactattgcgtgaatctttatagtatggctcctnctagcgtatcagacatgatacatggacatttagcttgtaacacgctctcgctcaaaacgttccaatcgtagtaaagcaaaggcatcgtgagacgatgtgacttactcctcaaacagaagcacctcgaccgagaacagtgggtctaacacggctctccacacccacgcagccttagcgaacatgtcacgtcccctaacagagtagttatgcctccgccccgatccagttgcgcgcgaaccccaataagtgaattaacgctaataacaatagcatgtcgatcacacccactcaataacaccaactcgagggacacatatacaacactagagaagaagttgatcaatcgcggtacatcacacccgcaagaactcctgatagagatgtaggcgcatgattctccgcccagccaacacgatctacgcagcgccgtcaaaaatacctagagacatacgcacgacccgccacttaatactcacaactacgagccatgagatcacaatagncaacagatacnccgatacacccacgcacacgctaccaccacacctcagctgctcctccgcctacgaagactgcgactcgcgaagcgcaaactgcatcagagtgtagaaacagtngacgttactcagctatggaccgacgccacactctctagccgaccgcagatatcgacacatactaccgataagtactcgagagcgtagaagactaatgaaacgcacagacacgctacccacaacgactgcacgnatccgccgagtatacatccgactctccataccctctgcagcggcgcggcncgcacatccgatagcacacctnaatatatcaatatacggctgtagtggntagacccgcgatcgtgccgcaccgcggaaagaacagagaatagatagagacaaacacccaccgagcgaggcatcaacaagcagtcgagccacgtcgtcgtggcgtacagcac

SEQ ID NO: 16227 - DNA, 757 bp, Homo sapiens
agagatgcggtcttgctgtgctgcccaggctggtcccgaacgtctggtctcaagtgagctgagcttgaatgaggtttgaattcgatgtggttggcaggaggagccgctagagattcttaaccaacagagcgacaggacgggactttaggagtagtgtgcaatactgggccataataacaagacacaagagagagacgcagaggctactaaaattacccaagcccgggaagatggatatggaggactattaatagaagaaccatctttttttaccctccattgtctgctgtcaccaattctcactcacacattcaaactctggtcttcttgtttacttaattgttccacttaggctgtgccccttcttcctctgtgcctctgccaggaatggccttacatcacatcggtctattcatattctatacatcttttaagtccagctcacgtcaccctctctacaaagctttccctgattgtttattttaatccacagtaatctatcctctgcgtgaattgtagaacttcgttaaggcagatctcttttattgacactcatatgtcctttaaaatacctatagttcattttcgttttgacagtccactcatttggccctttcccagcagggttcggaaaatgaatcagtctagtagaactttctttgattacgaaacaaaaagccatctcgtggcagaaaggaacaatgcatgctttgttagcagcaaacttattggccctaacaactacaattgagcttta

SEQ ID NO: 16228 - DNA, 968 bp, Homo sapiens
ttctcactctctatatatgacatcacactacccaccaccattagtatttcgaaagtacctactaaagcaactcaatttaatatgcgaatatttattcaactataattcgagaaaatgttttggcgctacaagatgactacttagctctaatatcactcggaaaaacttgtatgtaactgcagcgcagagttgggccttcgaagactcgacttcagcctgacaaaagaacttctaagaaaaatggagtggatccatccacaaaatgatacacccttatctcccttactagaccctgcccccatcgtcatagccccaaccccctaacaacctcgtcacttctttgcgacatctctgcccagacacgtgaagcccaacacacgcctccctccgcacacatccacgcccaccgggcgtccccgcgcccacccgccccccgacctatctgtctttcttttaacacctcacacacctccctcaacacacatcatcgcattacctattctaacccatcaacacaaccgccgcctaacctcagtgcgacggacgcgacgcacactcatctccacacaactcgccctcctaatcgtttcacctccgcccacagtactgtcgcacaccctctccctcacccccgcccccactcgccccccctatctgcgaacaccgcgcctacgcatcgtatgtcgtctcccaagcaaccaaccataacactcccactctggcctagcctaccgccccgcgctctctacacacgcaacgtgtcatacttcgtccatctatacctcatactgatgtccagtaccctatcctccgtcgcaagacatccctcgttgccaccctccgcatcactcgacgttccctaccctctcctacataaattctccctgtccgtatcccacataagtgcaatactaccgggcatgcgccgaaccagcaccgacacacccgctacactctcatctcctccc

SEQ ID NO: 16229 - DNA, 829 bp, Homo sapiens
  misc_feature (1)...(829): n = A,T,C or G
caaatattctcgatccccccgcatatcattatacccccatacccattatacagtggcctgtgcagatccagtanatctgcccacagtgccagcaccatcttcaccatggacctctggaatcacctccggccacattttctgcgtgagctgcgccatctttatctggggctattttgcttagcgtggggagaacccatgggtacaaactatgaccctcttcaccgcgccatttttttaacgaacgacaaaatatcaaatcttctgttcacccaaaataataaataccggctatttggcctcagacgaattagctccccaacacattatcactcctccgaggaatcatctattgatctcaagtcaatcattcaaccccataagttctccacatttgtttcaaacctgactgtctatacacctccgcgtcttcgagcagtgcctatatgactccgcgtttgattgctctaacagaatacgctcattattcacgagtttccaatatcctctgtatctttcatcatccctaccccgtatgttcttccctcgtttcttaatcgttatctcacgctatatttttctatatttcataccacagctctccttttcgcactcacagcccctattaacgattttatctagtctcccccccatcccagctccgactcccacaggtacccgtctctccccatgatacccctatatgattgccccatcaccacaaatttaatataagtcgccatctttccattcgcttgtaagttatcacccccacgcacctccgtactcgtttaaagacctctcaatcatagttattcttattcctcccttt

SEQ ID NO: 16230 - DNA, 720 bp, Homo sapiens
cctagagaactcttctaaattggattaaagcaggtgtattgaagagcaggaatgattcactaaggaatatgagtccttgtggttgtaaaggacagacttttaatatggaaactctcaaaatatattctcactttctttccactgtattttttctgccagacatgtgccttttgactggctattggtcagttcctagtctttcccaatctgaacaatgggtctataatggaggagggacacacttaggcactctgatatagtgtctgttgctaatatcttttaactctgtctgaccacctcaatcttagtgacattacattggcaatccacctagctttagcattttatcctcccataacacccttcatatatctcgaaatccgccactaccaacacccctttgcaactttaactgctatatccccagctactcctgtctaaaaatttcctcccgacgttatgtctccctcctctctcttcgccccctcccccctccccttataccacgaaaccgcctcctctccccccacacccactctcacactttccaccacaccaacttccaaccacctcgccaacatctccccctacacctccgcatccaccactttccctcaccaaacgtgctggtactacactcccttttccaacacatcacatctcacactctattatatcgccctcccgccatcctatctctccatcactcttcccacttat

SEQ ID NO: 16231 - DNA, 782 bp, Homo sapiens
ccacacctaaatggatgacgccgcctgtgcttttatcacaacagaaatctaccttaggcggtggcgcctgtgtcataaaaccaccgctaaaagaagaaaaaagttctctttccatagatataaaaaaagcccccagggggtcatccccccaaagggcccatgctggttcaacaattagcatctccataaaagggtttttcttggagacccaacatttgattttgagaccccggcaatgattactgttcccctgacccccggtgcgcaaacaatttttccacctaaaattttcttaaggggggagggattacattaaaaacagcaacgttgcccggggagagaaagggaatgttttgtgaaaaacaagggcttcgccatccccgccagggctgcgcaaatatgctcgggaaaaataatattttcacaggcctccgaccaaggtgcccctttttaaaaggggatttcccgtactacaaacacacggtcgggttacagaggaggggagggcgacattgggttacactgaggatgaccacttaaacatgttatgggaccacagaggatggctaatatgtaatccatcgatgaaacaagagtgcatcgtccgattgtggatgaaacacccattttatagtgaacaacctgcttctaaaaaagggcaccaatatcgtgcccgggaacattttttttacctctttaccctcctagccccctgtgacgacgacaccaccacttctggaatcgctgtgatcgcgcgcgttacctgctttggaccccccccc

SEQ ID NO: 16232 - DNA, 786 bp, Homo sapiens
cctccgccctcgctcgcttcttctgtcctgtttttgcttgggttttgtcccttttcacctcggcccactttttttccttctccgtggggctttgggtgacccttgccttctgtggttataccggagggggtagagggggttggtggtacactgttgtctctgctgatgggttaaccaccacatactttatacagtgtgggacacagaacattggggttgaaatggaaggggggggcggcacgtgaacaaacaatatgggtggggacaatgactgtcaactgacaaggggggggagggagggggaatacattccttacagggggggggggacaaatcgcctcatgcttgggatgggtgtgtgtggtaaggcaacgtggtggtatcttctaaaaatggtgtcaacttatagaaaatgggaagaagggggaaaagcgggggttgggaagccaccaggtggcgaacgcgggtccagcagcaggtgaactgccgaacaaaacggggagggataaaaaagggagggacaaaggataacaaatggacaaaagggtggtggcgaaaacgggaaaagaataaaaaaacatgggcaggagggaaaagggacaaatggggtgaaaaagaaacggatggctggaaacgaaggaggcgggaaaaaggaggacggggaaggggagaacgaaaataaaacgggggaagaaagggggaatgaaggaaaaaaaaggaaaaaagagggaaagaggaaaaggggaaactggggaagggagggggaggggggggggaagaaaaaaa

SEQ ID NO: 16233 - DNA, 1149 bp, Homo sapiens
  misc_feature (1)...(1149): n = A,T,C or G
gcttagaaagaaaaccaataaaaacgaatgtgggagaagagaggagcanatgantttattgttttgaaagtatggaggatgagaggaatgagtgatgggatgggagtataattgtagtatttgaatattnatcagtcgcgtgtcgtggtgtgtatgaggacgcgagcgacgcgcagaggaacgagggccgnggcngttggggggcnaagaagaggnaggcagcaacacaaggcaccgagaatcaaaaggccgccgccagcgcgcgcccgtccacacaccccaccgccgccccccccggccgtgtgggcccggggcgacgcgaccctagcacccaccccagaagagacgcccatagagaaacatgcaatcgggctgagcgagcgagnactaaggaccacccaacgacaccgacgaccaccgccgactccccgnnnccagccacgaccaccgcgcgccccgcccccaaccacaagcagacgaacgccgatgacaacgaacgataagcaccacggctcacagccgaaaccgganaccaacagagcgtgcgacagggcncagccccagaacacaaggacaccgcacagagcacacgaccccgccaccgcaacaagcctcgaccgacgtgccaacgcgaccaacacncaactccgaggacgcgcacccatacacgcgcaacgcagcacccccaccgcgcgccccgagcccaagaagcctcgggtctgtgtcgacaagacaacgaaccacaacgtccgcgagaaccgagaaacggccgcgcgccccaacggaagagactctcccacacgacgcaccgcacccgaccacaagcngncacacgcgcgcgctgcactaccgaagcgaacactggaaaacatatngccagcagcccagccaccgagaccctaccagagnaacgccgcgagtcgcggcnccaccgaaacaacgaacacacacactgaagaggtaccggcacgccgcaagacgagcacgtggtccacagaccacggcatgctncaccaccaccactacccgaccgccacgcacgcaatcgcccgaggacgcacaggagcagcagccacacaccacgaccagaccgccgcacacacccacggaggagagcacggatccgcaacgagcgaaagcgggagcacg

SEQ ID NO: 16234 - DNA, 760 bp, Homo sapiens
cctctagatgaagaacactaagagaatttgtcaccagtagaccattcctaaaggaagtccctgaaacagaaaggaagtgattaaagaaagaatcttggaacatcaaaaagaaataacaggaagaacagaaatatgggtgtgtgtgtaatacacctaatgtgggatgaacctaggagtcagataaccggctatttcagtcctgggaaacaacatcattatcttgtgaaatgtactttcagcactcaatcctagcaagtaatgaatgatattgcgtaacacgtttgcggcaattaccttcggaattgaatactccctttggtgctattgatagaatgcacgctcaagttgaacctgccaagaaaagcactttggtacccaagctctggacattcacctgcccttaactcttggatgccactgatgtaacgttatctgctcctccactaagagtgttctacctttcaacgcttacaacaggtgcccagtcttaggtcagttattgtgcacgcatccttcgatcccacccctccacttgactggggctcgattactatagagctctcccctcccaatatactacacttcgcgctttttgtatttactcccgccactgcctgccataatagccagtgacgactttactgtcactccggtcgtgatagcaatcgctttagatcagattaccaacacaccatttagctagcttctgtatgccacgagtggtcatatctcttgattctatttctgctacgctaccaga

SEQ ID NO: 16235 - DNA, 767 bp, Homo sapiens
gccggaagtaaagagaagctctgagaaagcatgtgacctgctcaggatcccacagcatgtccgtggcagaaccctgctccacattcaggctgtctgcatgaggcctgttgggttctcagcacacccagtgcccgattcccccaagactgaagcacctgcctctcgacagaagtgtctcccactcgctctgcagctgtggatgccagggaccgcacgcacccggcctctgctctttgaaaaggtattcatctttccactcactgagagcaagcgagagccatataaggacatgcccaacctcaggtgcacaagcagcgcaccagacagatgccatctcatacgcagtcaccaggcccggacgcggactgccaaaaacacccagctccactcccccccacagcctgacggaaccaccactgagctacgagccccgccccttgccaccccgcgccgcgcgtcccccccccccagcctgggaaactccccaattctcaccctctacgttctgcatcccgacccgccacgcgcgcgcctagtacgacgccaccgtcccactcgagccgagctctcgcgaccgagctcgttcgccggcccacgctagcaggcgcctcctgtaaccaatgcatttactattcgccattcctaccccgcaccccattttcctctattcccctccccctgtctccgtctccactaaccccgccacaagaaagccaccgccacgcccgcgaaagagccgtccgcgaacttacgacccctccgcgccg

SEQ ID NO: 16236 - DNA, 782 bp, Homo sapiens
  misc_feature (1)...(782): n = A,T,C or G
gagaaacaggaaagaaaacatttaaaaactacgggaaggtttggngnnacgccacncgcttcgngancnacggncannaggaagaacagaagagccgcttggaggaangaaaacccgccaaaagaagcaggggcagaacnaacaaancgccaggaanagaggagcncccaaaancaaggccagcaaagaacaagaagagagaagcccaccaaccccacggacacaaagacaaaggcacccccgatttttttgancaaggcgcaacaccagcaagaagaaaagcacagagaccaccaaaaaccaacccaggcagaccaaagaccccgaagccgaagcgccccacaaaaaccccagaacacgaccaaccaccacagaaccccgaacaacgccaacaacccaacnaaccaaaccaaaaaaaaagcacaccgccggccgcaaacaaaaagcccccaccccagaaagacacccaaaaacaacaaaccacacgccagaccaccccaacgcagacacaccacacaccacaagcgcaggagcaaaaccagcccacaccccacacccgccaaccccaacacaaccaacgcacagcgccaaaaaagaacaccccccccaacacccacgcacaagccccccccgcccccaaagaccgcccagcaacaaaccaacccaaaacgaagccaaacgccaaacaaaccaaacagacaccaaaacaagcgaaaacccnccgcaaccgccacccagcaagcaacgcagccaacagacaacacagaacagcgaaaacgcaa

SEQ ID NO: 16237 - DNA, 1297 bp, Homo sapiens
  misc_feature (1)...(1297): n = A,T,C or G
taaagttatcatctacttgctaccactgtaccgtaacacacctctttgangtcgacgcagcgcgatanatatgtctcttctatcacatcccctatcatntactccacgttatcacgacgcactaatgagaagtggttcaaagtatagcgatccactgattcaggntgctgaaccgccgccgtccgcactccacagctaacgcgtgtatgccaagtgacacgtggtgantacggtagcgtagctgcgtgagaaacgcatccacagcgcttctgcgatctccctcggccactcacgtcgccactcgcaggcatcgagctccgccgcggagagaggagcactaccagcatcgagtgactacggttgacgtcacacttattttttctatactaaatcatgatctgcgctacaccgagatcggcaagtcaacatacacatcatagcgtcatagactaaaacatctttatctacttgccacattacgtctgtcgcccgtgcgtcgcgttagatgaggcaacgatatccactcggcagactccagacgtacgagcatactagagagggtctaagtgcacgtttcactacgacgtacgcgtcgcgcaggcgttgttgacgcgantcttaagtagctgtatacggcgactacccggaatgatctccttccactgcgtttctggacacgtatgtagtttatcggtgatagcgcagacgaagtaatgcgtacttacctcaacatgtagctgcgcgtcgctcgcctcgtgcacattctacacgcacgctgtgaccgcttagtctacttagtaacctgtctacaaccataacccgagcgcacgtctgagcactctatagccacacacgcgagtccatctgcctctgcatctgccgtctaatgggtaggtgctctttctagctgttccgtacataacgtgcnagacgactcgtataacaccagcaatagacgtaccgctccagtcaagagcgatatgctgtatatgtgaatacatggatatgataatatgagcagagaagaagaagcacganataatgagtgtgntgtgacgggcaccggcgagctcgggctggaggacagtgatggtgtgtatacgacgcactcagagtagcgtctcgaatcatgtctctcgcgaccttaaggagcatgatagtcntcgtgttcgcaccatttccacttnttgtagtgacgcccataatactcctttgtatgctactattacangctgtatatagttcgcacttcttgccgttggtcgagtatctacgtacatcatgttagagtccaaat

SEQ ID NO: 16238 - DNA, 215 bp, Homo sapiens
cgtcgagacgaaaaccaactcagaacaacactgaacaagccagcagagccatcaactcacccctacagtctccatacacagactctatgaaagcattggccatcagctctcactggtgtggatatgtcaccagtggggtagagttgttcctctctctgacactgtattagtccattctcacactgctattaaaaaacaaacaaacaatttttttt

SEQ ID NO: 16239 - DNA, 1308 bp, Homo sapiens
  misc_feature (1)...(1308): n = A,T,C or G
tgctcggtttgtctctcgcgcgcgtcccttgcacgcgtctgctccctcggngttgtgcgtcgacatccctgtctttgcctcctctgtcgccgtcggtgcgccgctcgcgcgcgcgtgcttcgcgcgccttctgcggnttggcttgcgtctcgtctctcgttcttttcttgtcgtgcgtccgcggctcgtgctgtcttcggttcgtttttgcttgccgtataggcgcgcggctcgtggtcttctctcattctctctctctccgtctcgctctgtgcctcctccgcggcgcgcgtttcgttgctctctttgcggctgtcgcttcctgctccggtcgcgctgattccgcttgtgttccggtctcgcgcttgtcgctctcgtgctcggtggcttctgcccggccttatatcatctctgcgggttcgctggcgcgggcgcgcgcgctgggctgggttctgtgctggtttgngcggtggtgcgatcgcgtctggcgccggcttgctcgcgcgtgcgctctcgcatgtctgcgtcgcttcctctttctgcgctctgtggggcgtcgagcgccgtctcgcnctcctttggttgcttgtgtgtcggtcgatttccggtcgctctttactccgtaccggctgtgtgtgcgcggctattgtcttctgcgcggcgtccgtcctctgtgtgttatgtgggtgcgcgcgtggtttgtggcctcgcttcattgcggcgcttatggggcgccgcccttgctggccgcctgcgcgctctcccggtcggggcgcgcgcagttcctcggtggccttggttgccgggcggcttctcgcgctcggcgccgcttgttgtctgttgcgtgtttttcgtgctgtgtgtttctccttgccgcgctcgcgtttcttttgccttgtcctatgggatgtcgtctcctgccgttcgcctggctccggtgtgtgtgtttggttggcttcccgttgcggtcggctacggtcccgccttgtctgggtgccttgttccgtcccggtgcgtggggttctcgtgcggctttccctgcgtgttcgtccttcgctttcttctctgttcgcgctgctgctctcggtctctcctttcgtgtctccgtttgctttcttggcgcctctcttcttgtgacagtcncttctcctggctctggtcgtgtttccgccgtcntcntnntttntggtctctncgcttgngctcaacgagtcgtgtggnggtcgtccntgcggccgaaaagccgcccttccttctctttttcctctcctccctcgtttttctcttctgtttctctctccttctcct

SEQ ID NO: 16240 - DNA, 782 bp, Homo sapiens
  misc_feature (1)...(782): n = A,T,C or G
tctggctttggacaagaggagccgttgatcccatcatggacatcttgggcactgggttcaggcaggtgcctcactgctcagcagctcgtggacaggccctctggcctgtggcttgtgggcctgttggactgtagtcccagctggctctcttcacgtgctccagcatccgtgggcagcgcgatgcctgccttctccgctttgatcagggcagggggctgcggaacagttagtttgggaccgtctctgtgatgcattttgacagacttggccaagcatatgctntaaatcctaatgagatagggtctttttaagtaaaggaagcccacagcagccttcaaagcgctctctggacaaactagggagtatgaagaaccctggctctgtatcatcctgcagcctagtgtgcaaatgcagtggaagagaggacctctagcttgtccttcagtccaaatggggtgacagcagaagttgatccatgggctgactcaaccacacctcccccagggtcaaccttccggagaccttttcccagggttccctggggctctgacggtgaaagcacctctgaactgggcccccttggtcttgtatggagactgccttaaaccgaccgcgcatcgtttcaaggggtttagaaggaggtaagaatttacaccgcgctccccggaaaaacttatgaggatgcaacccgcacttgtgaaaaaaaatgatttcgaacacaaagcctagccaagtaatggaccatccaaccaaagaatcacccctaatttaatgctttggcg

SEQ ID NO: 16241 - DNA, 545 bp, Homo sapiens
atgaagaatagaagaaaaataaagaaagatctgaatgagcacacaaaagcacacaggaagtatactcactatttactgaagagaaatttggaggcaattcaggaatgtggaacccaggagaccccatcctccagaattcaaagaagaaagttgaacccttctcacattaagcctatctgaaaagctgcttttagaaactccagtgcacactcacacaccattatatgttgtttcaggctggtgtaataataaaactgtcaatcctatgaataagaactgtttctttacttggattcttgctcatgttcgtgtatatttatgtattactagaaaagcagcattcttaagattcttagattgttttgataagatatgactctacttttcccagcctttcttattataagaatctttaacaagctctttaaacagttcacacatgctaccttacatttttatgtgatgtaacgtatagtgaaaattttttaaaaagattttcttaatataatgtttaaataataaaattatttcttgtctaatgaaaa

SEQ ID NO: 16242 - DNA, 882 bp, Homo sapiens
  misc_feature (1)...(882): n = A,T,C or G
ctccgagccacggagaggttattgtggaatgcaggccagggagatgtatgatatctatagcaggctagagactatacaggcacggctggcattcgcttacatgatgctggccaagactgtgctttactgcgctcctgccaccgtcttatgatgcgttgaagatacatggccaggaccgtgattgtgaaggattcagcgactcgctctcagtaaactatatagcgaatcacttcttagacagataccaaccaaagcagatcattggctagctactgacgttctaatatactatctttagttctgagagccgaccgaacccattatgaacactatccctttcttggaaacaaaagtgaaataccatattgttttgctgtcatagngctgctttcttgactgtcctgcttagttttcacttgctggaggataccataatgtattaaggagctgacatggatacaagataagatgtgtaccttagaacagtacagagctccggtatgacgtgaatcagattaccacaatagccgtgtacaatcaaagacactatggggtgttctatatgaatatgatgagcctatatcgcttcagaagatatataggagggaaatgtacataagctgcgaccctcggataagataatacaaatctgagcttatctgagaagttgagatctccttcaggctattgattaaccataggtccaccttggggcggccttctgtatctgcagttaaaacgatcccttctggatcggggccacaatcgcctttgaaaaaagagtgtatgatggtaaacggcacctttttcaatcagagcctttatatctccttctgagtacgggatacccccataatcctagcgttaggaaaaaaaaaaaaa

SEQ ID NO: 16243 - DNA, 1594 bp, Homo sapiens
  misc_feature (1)...(1594): n = A,T,C or G
aggcacgcgtgagcggacagtcganggacgaggcagaccaacacagtctatgtgcaggacntactagttctctaatcatgagtatgtgctcacgtagctgtgatagcgtccgtgaagtaganggcattgtggagatgactgacgtcgcacgacgggcactctgagaggcatctctcatggtggactcgacgctgttgcataatggtgtagttgtatttatgntgtcgcaacttgcgtgtgtgtgtgtaggtactgtgtagagtcnggacacncactagatacgagaaggcagtggancagggagactgtttgtantcggcatatagtgggaggactggagngaatangtcgtgatagcatngncatcgggtccgttatatgacgttactcgtngatccgcgtcacgtntatgatcgtagaagtcaatgatatantantgtngtagtcttnttaccagatctctcatatnnnanctatctagnaaganacatgtaaaacangacacgatgtcgtgtgttactgacaagagacacacataccgagaggaactttatgacatgacacactaaacatgatacagttaatcttatgatgcgtacgactgatgatgtcgagtgaaanagcactntgagatatagctactaactaatatatgttgtgcgtctcatatctacatcatcacgtcagtancacagttacagcgntaactacgtgatggaggagacgatgtatgtgaggaggcgattgggacggtgtatgtagaggcgtgaacggcgaggtgagcctatctattgctgcgacanctagtacatagtaggagcatagcgggtgtctctgttacatagaagttntactagtgtnggcngccactgctgtgctgtgacgtggcaccgcgtgcagaagcnagatctccgctgacgcacggcagnaacatagtaaggactaagagtagactattatgtccggtatgcgtgaggcctgtgagagtncaagacattatgttacatagaattgatgaggttgtggagtgtttaatagagatggatatctagtagagcgtcggcagtatgtcatagagcntgtagtaagcataaataaagaactatgataaacgtagataatgataatatattgttataagtctataagaagatataagagtgagtaagcacagaancaaatcataagcgactgcatatgatacatattatataacatactcagacgtntctctgtacagcactacaagaaggcctcattaaatgagctattgcgtgatcgtatatagtcgcacgatagctactaggatagtacacgatgacggcgagttcggtgagcattaataagnancgctatttacaactaatagcgtcaattaaatatgtgcacacaatgataacgatcagagtgaccaagtaaagtatgtgaagatatatatacattatcataaacattattcaagtactgtgtggagtaaatattgcaaatacgtaagcgagcagaacagagagaggatagcgagatcgagagtgagagagagagaaagctaatggagnagattgatagacagtagtatgtatgatatgtatgatta

SEQ ID NO: 16244 - DNA, 1560 bp, Homo sapiens
  misc_feature (1)...(1560): n = A,T,C or G
atagtncgtgcgtatagcagtataangagtgcgcttatctatatgaagagtctatactgtggatatggatcggtatttagcttcagtacgtatcctagtgcgtgtanctatagtgaacataagcgacagatgaggttagtatactgaaacggcgacgcggctagttcagactagagagtgctgtgtgcagacatcgcaatgacaacagaacaatgtctatatcgagcgtacagtgttacatgactacgcacattacgcggctctttgattctaacacgccgtgcacccatgctcgttatacgatcggtctctgctaatgccgtggcggtgagcgcggatccgcgtctgataggatacgatatttcgagtatacgcatatgtatgattggtgatactctgatcttccatcaacattgatagtgacactatgtcatagcgtagtgtgtagagagtgacgcgggtcgtgctgtactccgtggcatgttctcgtgtctatggctcactcgttgttgttcttatagatgatgcttggccgattcaggtcgagccgacgcctacgcacgcttatcgaataacgatcttcgggcaccagatagtagtatgtgtatatagatagaggagagtcgtcatagtattacatgatttcgtagccgcgcatcctcttatagtgacagatgtctatatatgtctcacgtcgtatcgttattcgcaagtatatgaagtgtgtcgtgcactcatcggtcatgtagtacatctactagagcgacggtgcgctggacagcggtgcacacacattggagtatgngaagtagacgactnaatagtgagcgagtgctaaaactctgtacactgtctgctcanaccggtgtcattcgtatggttcgtctctncatcgactgacatctagcacgcagacatgacgatagagtgatctgnctatgtgtgtgcgacntnagtggtgcgattagacaatatgtgagatcgtttagcatatagcactcagagatactactanaggtgggtgatgtattgcangggtgcncgtttnctgactgtttagtgatatgcgatgtatactgggtcgngtcgncatntcgacgatgcacactgcgtaatatagcctgcatgttgtctacagcggcgtatggcacagaagtaacgcatnggatattccaagcggatatgtgtgtgagatgatcagtagtaatacgctgtttagatcgtacgaggtgcttacacatgcagtgccatccctattttatattagtacattcacaggagtatctcggtgttatataactttaatattattatccgctataggacaatcaacggtattggatgtctgctgtgttcggaatcatacacattctgtatgtgctgtcttgagaggaagaatataataacatataatataanatgtgtctctnctgtctgtgncntaaaaaagacgtgtgcgcagtntgggtngtctgcgacctngacgctctnttttttcgtctcttctctatgtcctagtgtgccggtgtgtgctgctatcgtgtatacagtccgaacttg

SEQ ID NO: 16245 - DNA, 964 bp, Homo sapiens
  misc_feature (1)...(964): n = A,T,C or G
atgggttagtgganattnnctcaggcatcaaccgcactaggcaagccgcaaaagcatccacgncgcttagaggggagggacatcacctatttccagcccaaaccacaccaacacaaccgcgtagtaaagagttccnnaatcgatgtcaggtctngcccatcaaaaaagtaagaaaaccaactacccaanacaaccgaaagcggaagatatcaccgcccccccacccagcgcgcgttggcgcttgttgcccccccccgccccccccttcccgcccccccccccacccccccccctccccccccacttccccacgtcccacctcgatattttttttttttcttcccttcttactcaaatttcttcttccacatttataccgccccccgccgtatttcagtatgtgagtcnttagaaggaaaaaccgaggaaaactggatgaaacacaattctttcttgggctttcncgctgtgggggcttaggaccccgttttttgcccctattttatcttttcggtcgaaaccatcccaacggtcaatgtcaatttttttttctcccaaattagttttgttgggaaagtagaaaatttgtttcgcgctcgtgtgtctcttttacaccttttctttttttcaccgcatagctttggccagagatataggttccctctttttctcttccaccccaagtgaaattccctgggggaaatcttttttcttgtgaaatctattaaaagaggtgcgctacgggaggcggttccttttgaaaatacgattcccacgaatcgcgctataagcggtgataacacaaagggggccaacatgggagaggagatctcggagggcaaatgatgcctattttttaattttattgtccagaaaccacaaacctatccgaacaattcgaataataatgttaactagatacgacatcatccgatacactcatctccgctttttttctttacgt

SEQ ID NO: 16246 - DNA, 1288 bp, Homo sapiens
  misc_feature (1)...(1288): n = A,T,C or G
tgtggtgggggggnatntantaatangttnnaattaggncgaatcgttagggagtgtgtatgagcananaaaaaggggaaatggaaagaaagaagcgtgnttatggacgcgacgntactggttaaaccgatgcttgccgaagctactcctgcttgcgtcactgctggtggtggggtgcgaggggtatgacccttgctcgcgtcgtataatcactccacgtaattctacgccatacatccgcgttttgtgaaagtcggagtgtaccagtataacgatattgatcaaatagacggcagtgtaattcattgccggcaatgcagccctactcgtacggagtgctgtggcggcctccgccgtttacttacacacgcactccaaccaatggagaaacagctgcgncacgccccagaccggcggatgcatgcttattttgcagacagaagacgtacagtgttcaagcgcaccccgctgccggcccccgctgtccgcgcgccgccctcccgcccctctttttcctgcatccacccaccgcccccagccgccgcccgggtccctcacggatcccccgactcccctccaccctttcccacccccttcacctactgcataccttgccgatgatcccgtctgtccgcgccgatttcgcgcgcgagagagaccgcgacgacatgcaccgcatcgattcagaagatcgtccgcctgtcacgccgcgtccgctctgcactcccacggatatcgatcgcgccactcgcgtcggaacccgacgcgccgcgcgcccgccaccccagctcaacccatcccgaaatcctgccccccccccgttccttacaaccagccccgcccgcttctcccgactaaccttacaccagcccacattaaccaccgcgacacccccgaagtccctcccgtccccgccctcccccccccgtcccccattcccccacccccccgcaggggactttttccgccgttcccctcatcgcccgcccccaatccgattactatcactgcccgatcagcattacaaacctactcgcaccaccccctccccgcccctccccccctcgctttccgcccccatattaccccggtgtccgtcccctcgcgtgcccgatcgccatctccacgcggtcccccttgaacggcgcgcggtgtactctcgatccccgccccctttcatcccaccccccacattccccgatcacccccctaatcacgtgatcacctgcgactttcccaccctgtaccccgcgcttccgcgggctacgccctcgctccccaaagattt

SEQ ID NO: 16247 - DNA, 389 bp, Homo sapiens
gagcatgggatggccggcccagtggggaagcgccgcgagtccatccctaggcctgacgtaggaacaatcaaaatgtacttgcacttgcccatggaccagtcaccacacacttcttacatatctgagcccatgaaaaccctggactgaaccacgttatccgggctgcctgcctatggatagaatctactcacttctgctgacagctgttctgccattacaataaaactgctccaccttgctcactcaaataagaattacaaaattggctctcgttgcatcacgggtgtgttctttgtcgacgtttccctttattgaggatgaattcaggatccgtcctcactgactctctgcactccggcattcaaggtttgctaagtgggttggtcggg

SEQ ID NO: 16248 - DNA, 718 bp, Homo sapiens
tcaagaagagtcatttgatgggtttctcagctaaaatgggcatgtataacttgcccagagcctcattgttttcaattctgttttttttcccccattaggtctttaacccatatttgtgactttgtattttgagacattctggaacattctccggtagaataaaactataatactatgggaataaaaaatacaatactaagaaaacaaccatagggctgggcgcagtggctcacacctgtaatcccaacactttgggaggccgaggcaggcggatcacaagatcaagagattgagaccatcctggccaacagagtgaaaccccatctgtactaaaaatacaaaaattagctgggcatgatggcgcccacctgtagtcccagctactcgggaggctgaggcaagagaattgcttgaacctgctctttttttgacatgaccacaccctgcagcagctcgcccacttactccactatgtgacattggacaagtcatttagcatctcctggcacaatttccccacttgtacggtagaggtaataatcctaatgcctaccagaaggtaataaataaggattaaattagataatacaggtaaagtgcttagaatggtgtttagaatttagtaagtcatggctattgttatgattatcttctacccatataagtggttggagaacacacatgaataaataaagtttggttgaatctgcttcacaaa

SEQ ID NO: 16249 - DNA, 1429 bp, Homo sapiens
  misc_feature (1)...(1429): n = A,T,C or G
gcacgatatgaaaaaggtgctggngcgtggtngcgccactgccacacaccacaacaacaccgggcgagcgaccaacaacctaactgactacgccggccggcgcacgcgcgagagcattactgctaactatacccgtgacaatctatgnacagtgtatcgcgcaacatagaacaccatccgcgcacctcaacaactctcgctgacccattacatctcaactgcagtatagtgagactaatactacacacatngagaccaacacccgcctaccactcgtgccacacatcaccagtcgacacagcgcagacacgactcacactgccacgcgctccttctcagcacgcgatccctcgcgatcgcctctcgccctcgacgcttgggcaatcaaccacacgactgacacacaaaggccaccgacctgaccgaatcactaccacacagcctcatacttctcacacagcacacacaccacaagaccagaccacagcaacctcacacaacccacaccagcaatacaacaggccgcacacgaccgaggccacnacagagcaagggcggacangcagcaccanacgtcgacatgccgcccccaacgcgaacccatcgtacgcgcgcacaccaacgcaacaccaccattctagcaggacaggtacgtgccattacgacatgagaccggccgagacgcaagagccacaacacgtcacgcagcggcgaaacgacactactcccgcgccggatgaccccaacactacccacncactcacggacacaccgcaacatcccgcacggcacgcgcgagacacatctatctcgcgtagcgcccgcaacgcgcacccacacataacaatccgtagacacggcaggcatacacacccaatggtaaccgccccgtagactcgacagcaccgacgcgctancacaccaccaccgccacctagccacgctagacgacgataccgagatacacacgacccnactcacctctgagacgacccacacacagtagcacacgatgccagcgcaccgctccgctcgagcgcgcacaacgcacaggataacacacctacaccatcatcancacttggcgctcnggcacgacaatactgtgccacaacacccactcacccgacacngcgcaagacgaccgagaccacaagagcgactccaccacgccacatgctgtagtgcgcagtcccagccagccacctgcaacgcacacgctcanagtgacacgagtgacacccaagcagncacgaccctcatgatccctataccgacaataactgtactgccacgcccagcacaaccgacacactcggagtaccctctaccacanancggacggcccgtgcagctcacatccagcacagactacacatggaacacaagcagcggagcaggcgcgcccacgaagcccgccancgacanc

SEQ ID NO: 16250 - DNA, 828 bp, Homo sapiens
ccaccccagcatcggcaccgtaatagttttgtaggacgccaattccctcagtcctggcagctggcagtgcaaaaggaagtgccggcaagatcgtttttttctgagagctctctccttggcttgcagatggcagcctgctcctggcacagtcttttctctactcatgcccaaagttacggaggacccatcaaccatctcctgcagcccctggaaacctcttgactctcctgtgatgtccacagagatccagcagtcctggcctttttttgatggcttgaacatttggccttcattgaacaggttgaatattggaaactcgacagcctacatgcacattccaacctccggctgcatccctgggtacaaaatggctcaatctgtgtacctgtttttacattctaccaagatgttccaaggtccagggatccttagatcatcttacaccggacaagtcaactcaattgcaatcactttcactagaagattttaacgtgtctttgtcctgatataactctctacctgctaatcaattaacgttcttcatagttaagcttagatcaacataagagcagacaggggcccccttctccaaccctatataatcctattaaagtatgttcgatcctctatagttggttgtttcttacatttcatctcgggcaacgaccgtttttaagaacagaatcagaataaatctcatcccccaccccagctaaattctctcataatcacgtctttgaacgagggaccatccataattcctctcaatttagacgtcatacgcaagaattacacttgctcgtctcaagataagattaacttctaatg

SEQ ID NO: 16251 - DNA, 851 bp, Homo sapiens
agagtgtgcagtctttgccacaaaaaaaattaccaagaaacccattccagatgagcacctcattctaaagaccacatttgaggatcttattcagcgctgcctttcttcagcaacagaccctcaaaccaagaggaagctagatgatgccagcaaacgtttggagtttctgtatgataaacttagggaacagacactttcaccaacaatcaccagtggtttacacaacattgcaaggagcattgaaactcgaaactactcagaaggattgaccatgcatacccacatagttagcaccagcatcttcagtgagacctctgctttcatgccagttctcaaagttgttctcacccaggccaataagctgggtgtctaaaaggacagcttctcttccactcaatattgccatttttccaaagaaacatgttaaaaaaaaaaattataagacatggactagtcctcattagcatgtttgcatagcaaccagtcaagagcatttacactatttctgctgatatactcaccttagaactgctcagaaccctggtgctttatttttgttttaatcttttgttgccagtgatgattttactattctgcaaatagtgtatttcctgcattaccatactatggtttcctgaaagtttcttgataatcgtgtttttaaagcctcatatactttttacaaaggagcatttgttatgcttaaacataactaaactattttctttatgtcctccctactgctagtgtcatcacattaagcgtggtacctaacaaagataaaagaaggccctcttcggcaattgggaatcttagcgccgtctctttatgagggtaattatgacctctct

SEQ ID NO: 16252 - DNA, 390 bp, Homo sapiens
agttgcaggtctgttggagtttgctggagttccattccagaccctgtttgcctgggtaccaccaacggaggctgcagaacagcaaagattgcagaaaagcaaatattgctgcctgatctttcctctggaagctttgtcccagagaggcagctgcctatatgagagtcattgccctgcaggtttttacacaccactgctcttcattccatcaagacagcgagcgatgtagcatttctttagaaagtactctccgccatcatcctcaggattcactcccagccactggcacccatatgtggacagagacaaatatcctaactgacactctggacaacagtgattgtcacatgcatcccaatttcaataaaatataaaaaaagtgcacttaaa

SEQ ID NO: 16253 - DNA, 766 bp, Homo sapiens
aaagaggcactaggtgcatgcctacacagaggaaagccatgtgaggacacagcgataagattgctgactgcaagctcaggagaacttagaagaaaccaaccctaccagcaccttgatcttggacttccagcctccagaactgtgagaaagctccaggatgcttctgttgcatgggaaatcagagacacatagtgcctgctcttcccaagcattcagactagtgagaaagtaacagaggacaaaatcctggaacgtgtctccagcattcgccaagccagtgactttcacacactcttatctatttacatccagttcataaagatgacctcggtaatacagacccatgccagagctctgcaagcttcactaggacctacaaaagtaactgaaagtttaaaaaaaactctccaaaactcagaaagaaaatattaacaaaatctttttcaaggaccatcctgaccagagatgagaaacatgacaattaggaacataggttctcaagtcacgcatacttccattcaatccatgactctgaactctttcccccgtgacctcaggctttcaacagggccatccggtcctactttctccaatgatgagatcacatagcattagtagctaccatgtcgggcaatgcggattaagaagtatatgtgctgcccagaatgttcggcatgtgaaaaagttctggagaaggatcttccctgagtgaaattgaggcagatggaacacctgcaggggaattcaccctgggagaatatttcag

SEQ ID NO: 16254 - DNA, 358 bp, Homo sapiens
caggattgaacacttgcctgtggattgcatccttctgtctggattcatcctagaaattgctgtcaaagtcttccaatgccaattgtttctctgtcttttacaatgtcacccaccgtgaaaccaaatgttactgttctctgtttactcatagggaagccccctacaggacacctcaagttaaaggacttaacttaaacctacatttaaaaacaaaacataacttttatataataaaaatatttacaacaatgtccaaaatttgttttaaataacttcaataatatcagggatatgcatgcatattgaacatagaataaaaattttaagacaaaataaacttaatttgaacataacaaaa

SEQ ID NO: 16255 - DNA, 788 bp, Homo sapiens
  misc_feature (1)...(788): n = A,T,C or G
cctagggaatgcctaagattcttcagaatgggagtgcataacacccaggacttcccctttggatatactgtctgtcccaacatccgaggcctctccagaagcagagctcctgtcctttgccctataagcgggggcctctaaaggcaataagacctcccaaaccactggcccagccagggagaagaccctgtttccacaaggcagcaaagagaccatcttggggtcacccaggcatgagtttgaattcccgctgagacactcacccattgtgtgtctgcaaccatgtgaactgatctctctttgtcaatctacctacctatcatattggaataataacgccaacctcagagggtggttagaaaatatgtaactgctgtagcacagctcctggaacatggcatgtggtcaataaatcaacagtaaaagcagtcactgtagcaattgcactagggttagtcattcttttttttttcttccatagcttctagaccctacacttcactctctcttaattggtatcctagctgtctgtgaacaaactttttggggggggggtctacagtagtctccccttatctgccagagatatgttccaagacccctccctatggatgcctgaaactgcaaatagcactgaaccttatccaatatgttttctcctgaacatacatgtctatgctaaagnttaatttataaatcanggccagtaagagattaacaacaataacccatggtaaaatagaccaattataacaatgtcctataataaaagtatgtgaatgtcgcct

SEQ ID NO: 16256 - DNA, 776 bp, Homo sapiens
  misc_feature (1)...(776): n = A,T,C or G
cctagggaagccagctgccatgtctttgcatgtgacaaggaactaaggcatccagccaagagccagtgagaatgtgagaccagccaacagccacatgagtgagcttggaagttggaagtcaatcttcccgccttcagatggctggagtcctggccaacaacttgacttcaacctcgtgggagactcagaggaaaaacgcccagctaagcccctcctagattcccaacccttagaaactgagtgtgatatttgttatttttgagttgctgagttgtgttatgcagcaataaataacaccataggcagcaaacactgtagtattagcagtacctgtgattctatcactttatcactaaaatattttgtttattgattttaatatgactggtgtccgttatgtcctttataattctatgtatgtatttaaatttttgcatttaaagacattcttctgagaggggatccataggctttaccagacagccaaagggcacaaaaaaaggttaagaaccctgaatttgcaagtcatagtttcttcctggcgatgtgcagggggacaaaaaacacctcccaaaggtgtaattaaattctgcacagaccacagcgggtggatcttccaggggttggggccagctgtctgctgtggggacaggacgagcttggtgggctggcanggctgtcctcctcccaggagggaggagcagcttctgcatccagcctggactcctccacaccaacagggccttctgcccacactttggaccaaccttgctttc

SEQ ID NO: 16257 - DNA, 1142 bp, Homo sapiens
  misc_feature (1)...(1142): n = A,T,C or G
gaggagttggcgtagtgttttttgctccaatgtgcggcgggtgtattagcggcccctcctccaattactttatggtaattgcccagcatctgccctgtttccattttccctccaggttanaaaaaatggggggcggggggggaaaaaaaataaatactttagggaaggtgaaagggaagaaccatcgaaaattacaaaaacaggaggaagaaatggaatatatctacacgcaccggaggagaaagagaaatcatcttcttatactaccagttgtctctaaaaattatctttttgttttctaggggggggggggtgttacagggacacggccaaaacccacaactttgtactcacaattaatctgatttattaaaagccagagagggtattggggtcataagccttaaaagctgttgctgttggtcttccttttttttgggaaaacttgttagcccaacactttcggcgatgtttatgttattcttttgaggggatgggaccaattctttaaattctcgacttgcttttggtgcccttctcctgtccccctatagagtataaatccactttgtgactgcggttcactcctttccacaccacttggcttggaaagaattagtgcacggcgctgggccatgagcacctttacactcttgggtcgcggcaatgcatacaatctttcgtgctttatcataataaagaataacaataatttgcggcctccttattggccttttggagcgactgtagtgtctgttgtctggcctgctctttcacgtgtttaagcagtgaggcgtgtaacttgtattatgataccttccgcgtttcacagtcgaaccgcgccatacctcgtctgtgaagatcgttgcgcgcgctctgtctcttagtagacgcatatacatcatactctctatctcacanatgcggctctgacatatagactactacactgtcatcacatataccncaagcacgtcgcagacgtgcccgccagtagccaatacgctatatcgtgctatactcacgacatcgtgtcgctctcgtcgtagntgcgcgcagtgtagatatgtgtatnnacantaatctgcgcgtgcagatttcgtgtctagtcgctcgtagtcttnctctcgtcagctgcggct

SEQ ID NO: 16258 - DNA, 801 bp, Homo sapiens
ctaggcgccctgttcgattagttgatgtgagtcgcccagaatatgctctgtctccattttgcttccagtgtatgatagggtgccgagagccgacctagatgaaagtagtaagagggaaagcgaaaggctagagccaaagaatatcagaaaaaccggaggatgaactgctggaagactacattgactaattgagtaccttgttttatactacagtagatttataatattttctgcttctaaggacattattcaaaggacacacaaagcctagcttgctttacactccttgacttattaaagcagagaggtagtgtgtcataagctgacatactgagctacgatttcctttctcgacagagttgcacagaagattgttgcttcctttgttgatagggagggccaataccacatatgctctgtgagagcgattcttggcacaataatctagcattatgctgtttctcctggcaccctgttgacacatatcatggtgttttcgatctttacaggatatacaatttgatttgtctcctgaaacaaatgaataaaaaatggcctcgttgtgcgtctcggtggacttatggggggcgctttcgtggacggttgggttaatagagggcctcgtttactgactcgctgacttactgcctgcggttggacgttagggtgtcacatgactgataagcggactcacgggttgtcactacagtatgcgataacgcagggaataacctgtgacacaaacggcggaccaaaggcgccgaaccgggcaaggacccggtgatggcgcgttttcctgcg

SEQ ID NO: 16259 - DNA, 873 bp, Homo sapiens
cgcagactaaatgtaccggtccggccggaagggatcacccccgcactactccagcagtataagcatgatggaggggagtatgtgcaaagaaccatcatacttaattccacctcttcagactgctagagccacagacaatcctggaataccccaaaagagaggaggattccatgctactgctccgccatgcttcacaccaatcaataagaagtgtttacagctgtatctacgaaatgtctctgcagaatcactgacaattccgttcacatcatatggcaattaaataatctcctgatgacttttaactcacctcctctcttttgactgctccctacaccatattcggggtccgaagggtctggcaaaacctacttcgaaaatgcacatctgttctctcgcaactgccttgacgtaggcgcttgatatcaatgactctacaaagagaatgcaaatgataacttacagaccgcgtaaaagagatagtttcgagagctgggccaacacaggcgattagacattctggcattcctgcgcacctatgcaatacgcatacgctactttgtgtcagaaaccctccattattaatacgcggtctggtagggcgctgacgtagagcactcgtgtccagcccgtccccgagcgtttaggcccataacctccaccctcttgtcacaggcagcggtaggcaacggaacgacaaaaacccgaccagccaactataacacgccctctgcgaggtactgctgtatctcctcagcgattcgcctatcgcatcgcgtcctacctcgcgctctatgcccccgttcacggtttctaagcatacatcagtatcacaactcacgcttcgtaaagcagggtaataatccacaaagt

SEQ ID NO: 16260 - DNA, 773 bp, Homo sapiens
  misc_feature (1)...(773): n = A,T,C or G
cgggaaaccatcgtcagatctcccanatcatatcaagcaactgaaactcaccagatcactgcatctggataacgagatgccagacccctcgctcttcatgattgcctatccgaccacctgcttcttgttgaccagctcatcttccttactcctccctaatttctgttttcccacacatggttacatttcttccctgctatataaactcctgaatttagtcggtgaaagagatggatttgagactgatctcccatctcctcagctgtttttttcttttaaagccttcttccctggcaatactcattgtctcaggcattggctttgtgtggcaagcgacgggacctagactgaaaccctgccattttggtaacatcatgtgtctcatacaccccttgacccagcattaccaacctcgtagcctttccagaatggtctctgccctcttccagggcaaaatgacttctcattagctgtaagttatcagatccctttgtttaaaagtctgtttattcttcctcctaagtaatgactctgctttgaagaccaattatctttcaactcacaacatttgtgaaagctgaatattacacaagtgggaatgaaagaagaatcccccaagacaattttaatatactctataaccaatttattacggaaaaaaaatcttattgcgggaagaactattccaagatgaaagcttaattaaattgtgaccctgaaagccgaacttttaattaaaaaatgaaactgggataacactctctccaccctcc

SEQ ID NO: 16261 - DNA, 1005 bp, Homo sapiens
  misc_feature (1)...(1005): n = A,T,C or G
cacgcctacctcagactaaaactctgacaccacctcacaccaagacacaacacanaaacaagangtcnaagtggtnaacgtttgctacccaattgaccaggacagaagcagcaactctcaccaagacaagatcccacatgtgttttcttgctagaatctgactttaattaagaggcagacaatagctcccatcagctgttcggaactaggccccaggcaacattgctcttagcctgataggacatcgtcaccaaaccacaacctagatcacacggccttgacgagaacgactcaccctccctgtagcttcgcgcgaattaaccactgtatatataacatgcgagctgaccgcgcgctctgcatcctctcaagaaatgccatgaccaccctcctaaaaacagattggtacaccaaccatgagcccccccagcacacccaccccatgcgcattacggcttcacaaacaaacacccaaacctatgaccaacaaacaactctcaacaccctgctctccaaacgccgacatgcacagggacggcgacccacgcagtctataaccctccgcaactcgcccccaccatccgctctctcatgacacatcggtcccgggcactcacgacgcaccgtccccaggtattatataatacactcatccccattatcgtacccgatggcccagcagccaaaccaccgcagatgcgaccccacatataataatcccgaccacaccgttgtacacgccaaaagacaaattgtacaggattcgtactacgctccgaaacaccgcatccccacatcggtctgacgactcatgataccacaatgaccctgccccaccaccgccctatcacgcaacctcacaactaccttctacttcattttcttcgtcctctctcacccgcaaaccacgcactccaacctctcttacaaccaatgcagatcactcgggaccgtcgcgcaaacgaaacagagcaacatgatacgcggctcggagtcacatatatt

SEQ ID NO: 16262 - DNA, 734 bp, Homo sapiens
atacgcgacctttgagtgcaaaacttccatcttcaactatactaacaagatggcgaccaactgtgctcctgcaacactgcagcaatggcaatttggcggacttcttctttgggccagcgcggggcacaaactccacactcaccggcagccttacgatggacgataatagaaggattcaaatgctatcagacactggtggctactcttgtctctggggactaaagcagcttgctttgaccttttttttttctttaagggacttttcctggtctaaaagaaagggggggggcgcccgagatttaggatagtgagacgtgttagaaaaaaaatttacatctactggccccaggatgatagtgcctgatcgtgagcgctgatctctcttgtctgttccacatcgggggatagtcgaagtcactggggttgtgtgcgcaaccatggacgtcagttaaattggagtcgtctagcgtccactatttacctaatagcgccctttctatcagttttcgaataggagaacgtggcttttcctgcgtttgagttttgtgtttggaaactcttcacaactgagcattaccacacgtcggttggtgtcctattatgtatctatagggagtgagcgggttggcgtgaaaattgggcgaacatgcgtttcctgtacgcgtgtgacgcacgtctcacatattgagccagcaattgtagtgtatgctgtgttgctttgacgtttatattcg

SEQ ID NO: 16263 - DNA, 489 bp, Homo sapiens
aggtatgctctgctcataccggccttgctgggagaggatccttgatgactgggacctacatggatgccaggatgccaaggagtcaacgccttgttccctgggtagctggctcaggctggttctaacagagtctattgatgcaaaccagaattttgaagcttggttcacaaagttgagacaactccagctttctttgttttggtcagtagagtactggaagccatctgtatgttcagccaaactgaagggaagattcgaaacaattttttctggtgactcatattcaaatttggtggctggatgcaaacgaaagttagctctccatgagactaagcatctaatattcctaaggccactgtgaagcagaaatcattgtacctatttaattattattttgttgattcaaagcaacacaatgagagatagcattcagatcttcatcttgtaaaaataaaccattcaagtgtgtgttactcaaaaaaaaaaaaa

SEQ ID NO: 16264 - DNA, 751 bp, Homo sapiens
ataccttctctctactgccgcctgtgaagaagatgtgtttgctgccctttctgccatgattgaaagtttcctgagacctccccagccatgctgaactatgaaagtgcattgaagatgaagagttgtcagtttaagcactggataccaacatggtttgagccagtactggccttaaccccgctaatgctgatgcatctcatcgtgttcctggcatttggaagagtgaggaatgactttggactgagatagataacgatgactaaagatctaagctcaaactatccaaaaagtataacctgagccacataggtaatttaaaatgttctagtggaggcattaaataaggtaaaaatagacaggtaaaattaattttaatttttatttaaacaaatatatccaaaatattattacttcaacatttatgaaaacaaaattataaggtgagatgctaacattgttttggtttttatactaagtatgcaaaattcagagtgtattttatacctacagctcatcttgatttgccctagacacatttcaagtgcttgatagacacatgtgttggtcagtgcagatctaaataaggaaatcaattgtagatttagagaaaggtaatgaatagtgagcgcaacaagtgatggaagacattgagtggcctgtgtcatttactgttactgagtctgaggcgggtggcatgaaaggactgatgtgtatggatattagtgtgacggggagggacgggagttttata

SEQ ID NO: 16265 - DNA, 769 bp, Homo sapiens
cttaggtgaagatctggaaaagtagatagaccaaacaacacaaccaaaaaataatcaccaaacaaaagcaacgtaaaaggagctgtcaatttaagtcttttggaagcttcttcagctcaagagggatgaaccaatacatgtgggggattaaacaatagcagcctgcctctgtgtctgcaccaatgtgatcagaagcagcaaccatctattagagcacagattcctgatatttgcaggataaagcccatattgctgactctgtctgtctgcaaaaccctttccagaataaggacatggctgcctatcatgaggctgagatggggaatgggtagttgatactgcacatactgcattaacggctgaaattgattgaaactgattacaatttatcatccagcttttcccttgatgctgaaattgtttggatagaatccagagttccaaaatagacacttcataagtcttgatcctacagctcttgtctaggcggagagacagatttctgatgcttcttaatctgcattcttgcattatttcctgatgccacgtgtatttctttgctttcaaccaagtcaatattctacattgtacaggcacaaccataccctgcctattcatccttgaatcgatggaaacgccgaccgtgatcacttctttgactctataactcgtgctgccctcaattcggtccccaccccaaaaacaaaactccccgctccttggccccagcggtcgacctatggccatgattactgttagagaaggtaat

SEQ ID NO: 16266 - DNA, 710 bp, Homo sapiens
ttcgtgcgctctcctgtttccagtgtctcccatgtaggtgaggccacatggtgcataagccaaactcttgctggccaacagtatatagcacaattctgtctcttcctggctcacgtggcaaagaatccgatgttacttattcacattctatacctttcatggccccacactggacgccctatgtgacacgcgccagcatcgttgtcaccgtgaaaaccctcttgcatcactacctacagcgacacctcacgcactcctttcacctcgtcccccaaaccttccttctataacagatatacccgaccccccctcctttcatccctccactacacttagttgaaataatctccttcacttccattgcaccatcgtgcttcagtcctccatgacttcgtagacgcacgccccagataccaccctcgcaagatatctaaccccccctaagtaccacccactataaccccgccgcagtccacgtcccctacgacttttataccacaacttcatacaatctacatccgaccaccccactccacactccatacgccattttcatgcccccgttacccctcaacatgtctattaccccttcactccccatttccttcctttttttctccccactccccagctccatagtcaattcccccgagcatatgaagccgacctcgccgatgctcgcattgtcttatctaattcgtaatccctct

SEQ ID NO: 16267 - DNA, 804 bp, Homo sapiens
tctgcgtccattatcttcccacgctgtccacgcccaccccccgacgacggtagccctggacctattataggatttttggaagataatcatctacactaataacctgaaatcattcgaaccccaatggacaagagagattctgcgaggaaaattctccagaaggaagaggaggctgaggaagagtctctgatgaacaaagaagaaagctaaggaggcagggaccagcacgatagacctttggtggaggcagaaagcacattcccccacaaccggcatacacacgaaggggatattccccaggacagctgttttcactgtcaagggtcgtccagtgccacctgctctctgagccacggcactcaagctcccgatgctggacaactgatccaaggagtcctatcgggccctgacgcgccctccctgctaagagaatggtccacagtcccgcgctgatctgccacccctcatcacccgccttctgcatggatactggcacggtcacctttcttacgccatccgtcatcatctcaccccttgtgcttccacccatccttccggcggggacgacgcttctgttctccctctccccctcgctaacgagctccccattctcttcattttctgtccctccacctcctaactcctaccggcgctttctgcccagtttttatcaacgcactaatattcctacatcccctgcagcgccgtaccaaagacgccccccccccattctctcccatcccccttcgtcttatacagcccaacgactgtgtttccctatctcattgagtcctctagccgcct

SEQ ID NO: 16268 - DNA, 820 bp, Homo sapiens
  misc_feature (1)...(820): n = A,T,C or G
ggtgnggagcaaaactcatagcaccagnccttaccagagcaaccaccacacccagaactattcatatggcatcgtacattctatcccctcacaaagnacgccgtggcacacgcgcactacggtcgctccacacatgcctatgagtggcatcaactctaaatccgcagatcagattttcagactactgaccctaggaagcctaatcatgaacactgatcatcaaccatgcctaattacctgtgcataagctataaaccaaaatgtttattgagcctagtatacaggaagtatcttccgaatggggacaaatgatacactcataaggacataactgtgaagctgggccactgcgctcatgcacagaaggaaaagtgagagtctccatcctacatgactggaagggatgtggccatcacctaccatgatggccttacccttactctaaccgcccatagaccgtcctgcacatacaatggagaacccactggaaagatcacgacagctaccaggctccttatagacctgaacccaaagaggacccactggaggatacagaccgtgggtcacctctccccccagagaagccccacaacacattggacgtcatgacttagttaacaggaccaagcgctccatagaagacataataaccgactgtgatcacatgaaaccgcgggcgggaccgggacaggactaaccctcgacgaataaccggaggcataaacccactcctgtcggaaaagaaatgactaggaatggtaatttgggagacggaaaaagaaaggttcagtgtaaggcgagctatcaaggcaggaaaaaa

SEQ ID NO: 16269 - DNA, 469 bp, Homo sapiens
  misc_feature (1)...(469): n = A,T,C or G
gagagcgttccagtgaccagacttcaagcaccacggaagaggactcgcctccggcgatgtangatctacatgccagtactcaccatagccgccgagtgggacctctaccccgccactccccacactgtttactcggaccttaacattgtgcgaacacacgactggatgaactatgcctcacgcacatgtagtcatgggatgtgtaaggtgtgtgtcagagaccaacagaaccgaggcggaagcatagaacacgccagaatttttttttacgccggctgtgatcaacgaaaacggacctagcatggacgaaaagatcggatactggccggcctggcctcaacagaggaactgtctcctgcgctcccatctagtcgagggagaactcatgattcttggtcactgactgggtgtgctccgaccaccagggtgagggagtgggctgagcccactcgctggccggagtgcaggc

SEQ ID NO: 16270 - DNA, 400 bp, Homo sapiens
  misc_feature (1)...(400): n = A,T,C or G
tttaaaaatggcnnnnnnnnnnnnnnccnnnnnnttccccaaaaaannnntttttccagacaagcttaccttgnaaaacaaacaccatcggacccaaagagcctgagttggagatgaactttggccaactttcctcatcaccatacttaaaatcctgtccaaggaggagcttattcaccatttctattcctgggacctatgtagcagcataaccgacaactgggactgggctggcttgacttcacctttacatacaatgacttaacttaccagacttataaaaggcatgtttgcaccattggttaaggagggattggtttggggaattattcccaagggccttcttacttattgcaaggaataaaatccccctgggaaatccttggtaaaaaaaaaaaaa

SEQ ID NO: 16271 - DNA, 1622 bp, Homo sapiens
  misc_feature (1)...(1622): n = A,T,C or G
tcgcttccactgaggtnngtggngttggtananagaggngnntttttgttgaggnnntanntgtgtannntaaanataaagtaaagaaaaagaggcttagagaaaagaaaaaacaaaaatgagaagagggggtttttggggangggtgtcgcatacntanaccnatatatttttacagaattggggtcttgtttaatagtgtattgggttttatatatatttgtttatgttnnttttnttatataatgtgatgtganatttggattgtggggntgggngtaaaattatatanctattgtaccaataggtagatagagttgngtgacggngtgtgattgtagtgttttgtttgntgnnngtnncgggggagggatgttanttaatgaatangagaacaaagatagttaggatatcngtatctcatgtcgatctattgttggttgtgttattgattagttaattatctttaatgattgtttattatttntggtatcgtgtgtnctgcattgattnattaaataatnnntannntnnnntgtatatagagagatagaagtatagtgnggagttgaaagggagntcgcgggagnggntgctgngatggatacgatatanatacttgatatatnatagatatagagaagtanagaggnnctgagtgcgangtnctgtctcatantatttatngtgtatagtgggtaagnaggataagacgtcgatgcacgcgtgggagangnangagagannagannaantaatgtgatanatcatgntatctgttntatagatacaatanatntantntnttctcgaggttatcatcatcgntcaatcgagagatatgtacgagtaagtgaggtatgttntgantgnagtgnatagaagtagggagtgataattgtgctntagatgatggaatgctgatatagtgtatactactgttgtgtgtgagtgtgttatagagtgatacgatatgtatatgtgatcattgaccatataanagacgataaataacagtttcgtcatatcgactagactgcnattacattacgtagtgagtgtgtgatantatgatagtaagngtgtagaggaagntaactagagacgcgattatatctacatgaataagtgtggtggacnttgngttcatgtaatcctcgaatnatattangtcacataggaggagatagtggagggggtaagagtgtataacggtgtnttntagtagttgtctgcgagacgacgcnnggtcgcataagangagacgatagacacntctatctgatagtacgacattatanctcatcgtgctnttcatataagtagatataatgagagacgcnaagacctntgtagatacacagatgattgcacgtgnnagtaatccggaattggtganacgantantggtcaataantagtgataggaagagtcgccatccgacactaggattntagatgcgagaatagtgagaatatatataatagagancggaagtctcccataaatatgtatttgtgttgttgtgtnntgttcgcggtactatctcctcttttgccattctatccgagcataaanatcatatnntatgttttgtnctttgtgaatntgcggngtgtgt

SEQ ID NO: 16272 - DNA, 1165 bp, Homo sapiens
  misc_feature (1)...(1165): n = A,T,C or G
ttaaaaaagannnnnnnnncnccccncccnnatnccccccnncnnnnnnncctagcttctgctccagacactgccctgggnacccaanaagagctgggtctcctccagggaccagggttgcttggatgctgggagccgacctgcattcgctgaaggaagtggagcccagacctcatgacagataatcccagcaaaaccagtacctcgcctactgaaaaattaccttcactcatcatctaccttgcttaaactcatcagacatttctcagttttctactccccggtgtgctttaagctttgctataaagcatcaacatctatcatcaccctaacttcttaaatcaattttagtgcctattaaaagttgccatcaaaaaagactatagttaataacaatgtgttgcatattttgaaaattcgctaccaagggcagatttttgagtggttttcaccaccaaaagccttattgtgagaatgataccatattgtttaattaagctttgattttaaagcccattttcccttcatgggggccacataatttttcccagaaacatccatggtttgtaatttacccattacaattacccaggggaatcattaccaatttttgggatttttgggacccaatttttaaaaacccccaaaattaaaaatctaaccctcccctcaaaaatcatactcttcctctttgggggaccccttccgtttttcggggggccctttaaaaacacggggttggggggaaaacctttttttggccgggggaccccggccttttatccccctttttttaaatttggaagaggggactttcaaaattcttgtcaattgggaaatcccccttcccggagttctcaacttgggaaatttttccacctttgggcgcccttccggggttccaaactactcggggaacttgccccgggtccaaaggcccgcgctaatttcccaacttttcccaaacttctaaaaaaagggcccgcgataaaaattaaccgggggctttatttccccccccccccaatatattcaaggggtgggaattaaaacctgtcctcggggtacaagccgtaaccatttgggggaacggcccaaaaaagaggggccccccgacccaaaaaaaggggccccccgtatcaaccccccccagacactaaggggg

SEQ ID NO: 16273 - DNA, 777 bp, Homo sapiens
ctaggagtttatggggaaggaaacataagcacttacaagtctttctggttatggaaaagaggcctgcaattcaggagctggtaatccgtacagccaacgcttgaaggtactgggtcctggggtgagtcctagcagagaaagttcactagctcagtctgcaaccgtgttttgacgtaaatgtcattatcatccccactctacataagacgaaagcaaagcactgcaaggcaaagttacacattcacatttgcacagccagggagtagcaaagccaggagctgaatacgtgcaggttggttcctgtgatggtgaatattgagtatcaacttgactggatcgaaggaggcaaaacactgttcttggtgtgtctgtgagggcgttgccaaaggagattaacgtttgagtcggtggactgggagaggcagacccgcccttaatctgagtgggcaccatgtaatcacctgccagctcggctagaataaagcaggcaggagaagatggaaaagcagacttgctgagtcttctggccttcatctttctcccgcgctggatgcttcctgcccttgaacatcagattccgagttctgcagctttttgacctttggactgataccagttgtttaacaggggctctcgggcctttgcccgagactgagggctgcattgtcggcttccctggttctgagattttgggactggggctgatccatcactggcttcgttgctcgttaacttgcggacgggcctttgtggactttaacgtgggataaggggagt

SEQ ID NO: 16274 - DNA, 3751 bp, Homo sapiens
  misc_feature (1)...(3751): n = A,T,C or G
ggggnnnnnaaaaaannnccnnnnggaaacnnnnnnnnnnnnnnnnnnnnnnnnnnnnnnnnnnnnnnnnnnncnnncnnnnnnnnnnnnnnnnnnncnnnnnntcnnntcaacgggnnnnngnnnnncnnnnnnnnnagacnncnnnnnannaanancncnnnnnacnntacgtagagggnnnnnnncnncnnnnacannnnaaaacaaccaacacaaacaacnnacagaatatncctccctgaanangcncgcncnnataactcnncgcgggcgccccccggnnnncnnnnnnnaagggggggccgaacnaacaaccttttctngtngagcgcaggncgtcgatggcggcgcgcagcgacgaacggcccacacgaggacagcgcatcccgcagccctccctccntcaccatcctcacncnctcacgactcacgggcaaaagcagcgcagtagcgcgcagcgcnccnctccgcggggaaaccgtagtcgagtgcatntcncnccagacactcgctaagcgacaaaccatatctaacgcgcacatataacgcgctccacncaacacacgaactctcaattccgggcgtcttcgcccncaaccncncaacgnncnaaacgacacacacacttcgcccctcacagantcccaacacgcactcacntctcacactacacgagacnnacacaccagtcacacacntcctgcgactcaatacatncctggcncncgcgcnncctctccctccgcacacacaccacggccaaagnnncacctatatcagcggcgaacggaggcngntgaaccacncagcnatactccncacttacacactctcgagtccctcccaacgcccgaacccaccngcactccgcaacgcaccaanccacccgcgcaagcacagccaccaacgccttgctcnccgctctactctcagcacccccgtgcaagcaacggagacaccaccacacgcacacaaacaccgtncnctcnancccacacacccagcagcaccacagcgcgtagggcgcgtgtctacccaagcacgacagacgcgcnnaacaaacnaaccccaacacaancacacaaggagccaaatgcgcgcgcgatacaaggaccaatactacaccgtcaccacagacacgcgggcgcccntcagctgacatgccggccgggccacaatccaggtcggacgacacacacacaacggcaacacagagacgacagacagtnntncgcgcactnacgcaagccgcacacagacgacgcgcnangatntgcaagntcacagcatggcagagacancancacccacctcnaccgccgacccatnggggcacacaacacaagcaagcggatctcacactcgctcccnccntntccagctagcacgagacggcaaacttctggccggggcgaagagaaggacagaatctccgcagaacagaaaacagaacgcgctgcacacaagcgacgagcggctggtcacaaacacatacaccgcgcggcgaccgccgttccaaaccccgcgcgccgagacagagcggcagacaancgcctnctnctanacacagaccccgcgcgcacacctacacacagacacccnaaanagcggagggcaccatgagtcgaagacacctcgcctcggcncaaccaaccgccccgacaagatcgggacncccacaaaggccagcccgcgaacacaccgcaccacaaagcctcgcgcaagcgtcgggcgggcgacaccctgaccagcagaacgcacaaccagcgcgggagcgggcggacacacagcggaagaaatcccagagaatgtgcgcaaggaagagaagagataaagccaccgagaaccgcgaaaatacgccaactatccaaagtgccaacggcgacgccggcgaaagacagatcaggggaaatgtgatggacaccaaagaggagagagagaaagttganacccggaagacaaaacaaccgggagccctgcgacagagggggacgcacgcccccgcgtcgagaggtcgagggaggnttagtgcgcagacgagtgcggtcacaganccgacgagcgaccagatccgactgagagaggaatagaaaggatgatacatgggacggagtgagtaggggtgcgacagtgagcgcaagacagccgaggaaacaantatacacgagaagcccccgaccgagccggcaccgcacgcggggacagaggaacgcgcgctcaaacagtgcgcacaaacggtgagagaccaagaggacggagagagcacaacgagaataaactcgaccgaacgcgcggagcgaggtaacatgnatgtagcgagcaacgaccctcaaagacgaagcgagagagagcagcgcccgcgngcacaancgtagtaacagcagagcagagacccgcgtagagccgactctacncctcgcgcccggcagagggcgacgaatcacgctaccgccgtaggaagacgtacaactacactcnacccccagaagtagagctttgcatacgcgtgacagtgacagcgtagactaccccataagcagcggatactgnnccataaccgtagngaacgtcatcttcnccgattcccgngtctgacaccgcacgagccaggagacagcggcaacggaatcggaatcnaccgcaaccgtacagcgcgaacgcggncnacgttcaccgaccaacagccgacgaaaaattggcagcaagaaaggcaacgaacggagggcaacctggtcgcgaaagggagagagattgcacgtaagcgcgagcgccaacactcactgatacaccaccgacgacgatcacgcggangcaaccaatgaacgtncacgcccgaagcaggagcgagcaataaaccggcatcgcgcgatagtgangagcaggagccggcaaacctnccncgatgncgctgcagaagaatgctgcgagcgcaaccggacagcagcgggaacaacggcccacaacaggagtcacaaccggggagcacgggtaaacggccatgcaccagcgtaaaccctgccgggtctcggcacccgtaacccaaggcgtagtgcagcggatcaaggcccccaaaaccacaacaatccccatacacatgatacgaggcgcagcgccaangtagttgcgccggtggagtagtgagggnctcagaagcgcagaggggaaaagacgaaaacgccgcgcaggaacgaaagaagacatcgacaagcctaccccgacgtcacgaacctgacagcacgcaacccgctccgcccgccggnngaaccagacatcgagaggacggcacgagtcgctaacacacgacgcggacacggcgacagcacgccagaggntcgtggaccaaaccgccgcatgctgcagcgagcggcgccgntaacgcgtcgaaaaaaggggtaatacgatgaggtgccggaaggagaacctaccaagcacgacctagctcgcacccgcacatgacattgcagcgaacgtngaaagccggacgaccaacatcgccaatcagcacangcgcgacaacagacgacgaccnccagccgtccgagaagggaaaaaccgccacacacgaagcnacgcaagcgaggggaaagggcgaactatggtcaccgcaaacaaccccccagagcgtagaaggtagtcgagagagaactgccgactcggcacacggggccgacgaccacggctagaaccgcgaggccgagaactagcctaactacaagcaaccgaagaagccagcacacaagaacgcgaa

SEQ ID NO: 16275 - DNA, 765 bp, Homo sapiens
tgtttccagcgtccttcatcctgaagattacaggacaataccagagaccctggcagaagggcacagatctggcttcccggagactgctaaaggctccaggtgaggcaacccagcggtgcgggggagttaccgccacagggagcagaccttcaaccaaagaagtcctcaaaaagaggcagaaagctacaacgactctctctccattcctcccctcaagggactggtcacccaacagactaattttcctcacgaagcagtgaccccatgtgcagaatttcctggtaccccacccctccttcctgccttacttttctttgacttcaactacacatctctgggactgcactccccaatcaaacaacagcatccaagtcttaccctagtcttctttcctaggatcccagaccaagagaggtcacactcagttatgcaagcttaacaaaatgatactcatgttatccataaactacaaaagagttctgagtatgagcaattgtttttctcaacttttgacattttcttttttttcacagaattagcaattttatttattcgtagtgtatttaaacctagattgtaggtaaagttgaacatgtgcgtaattgggtaatcaaattataaattgaacattacctgcctaaattattattctgtattcttcaaccccatcatgcttcacaccttaggcgaaatgggatggaatcctatttatccatgcgcgcgcctgtacctgacctttcttggaccaaaaggttataaaacaaa

SEQ ID NO: 16276 - DNA, 761 bp, Homo sapiens
  misc_feature (1)...(761): n = A,T,C or G
cttgnagcaacaagaaaataaccttatgaagagatacgaatgaggaatgcctgttggatttggaacctccaaaggacccaaaagcaagagaatataagaggcctcctcatcataaataaaagagctgagcgaaaatgtttcaagatgcttcactggaaaaactcaccaggtgcctgtaactaatttctctaattggcattctcactctcacattcaaaactttcactatgaacatacaacacaatcaatgattaccagccagtagggaagtgggtcttaagtaatcaaataagaaactgagaacatgctttaaatagagaagaaagagagaaaacacaaaaataactcgtagtatttccaaagaaacaagaggtgatcaaatatccacaaaacaagaaccttagccaaagcaaataagcagaataagaaaaatttcttagaaattaaaacatggcatgtcagaatcacttaagcgcctaagtgacaatatatgttaaggcccaaaatacagctaaacaatatattattcatctgtggaaagatttatgagtaaagaatatataaagaactaatattgttgagttacagattagcatcccgagtgcaattaactatctgtttaatttagaaacataattacaacgcaaaaagtatattttagttcttagaaatgtcataggcaaaagatgaaaaagattcctacacatgcattacgctatgtagatgctttaacatttcccctttactaataaaattaagaa

SEQ ID NO: 16277 - DNA, 2532 bp, Homo sapiens
  misc_feature (1)...(2532): n = A,T,C or G
gggggnnaaannccccnccgccgggggtttgtttgnnnnnnnnnnnnnnnnnnnnnnnnnnnnncntcncnccccggcgcgcccnnnnnnnncnnnnnnnnnnnnnnnnnnnncnnnnccnccggngcccaccccaccccccnaacacacgaaaaaaaaaaannnnncctcctctcccccacccngncacgnngcggaaacagccncnnacaaacaccccaccagcacataaatactaagaaagagagaaagagggaagcgacagaccacaccccagcaccagagaggggntgggntngcgncccccccacngnnnngacgcgccgcgcgcagacagccccacacccacggacacgacaacaacaccaccaacaacacccacacccgggcaaatacacccaacacacccccacacggaaactccaacacaacaccaacaacccccacaccccacacaccccaaaccgcacgacaaaacccccacccacacgaccgaagaacaccacccacccccacaaaacccaccagcacccaacaccccgagcccaccgctccaaaagagcaccaagcagacatcaaaacaccacataaccccacataccagaggagccaaccacaaaagaagacctacgaacacccaaacaaaagcaacacacaaccacacaaaaaaagaacacacgagccccgaagaaaagacagaagaggaaccaacccaacaacacaaaaaccgagaaaagaggaaaacccccacaagagcgaaacttccccgacaagacgacgccccccgcacagggcgacccccaaagaaaacacacgaggcagcgccgcaccaccccaagagaagccccataaaacagagcagacccgccgaaaacagacacccccacgaagaagaggaccccagaaaaacagcctaaccgcagaaaaacacacacacacacccacaaacccaaacccacaccaaaaacaccaaaaaacgaccgcgggccgccacccaaaacccaacccgcgcgaacacgcaccgcacagcggcacaccccgcccagacaacacgcgacaaagagcacaacacaagaaaaaagagagaacacccacgcgcacggccccagcacccaccaaaagcgggagcacagagacagaagccaccgacacgaacagccaacaacccacaaaacccccaaagacacagaccggacaacagaacaggagacgacagcccccccaacggagcgagaccccaaccacaaccgaaaacgcacaaggccagcagaggggagaagagaggaaagagagaacagcaaacagactaggaagagggacccccccgccacacgaagaagcacgaaacgaaacgaggaaacacacgccagaacacagcccccacgcgacaacgcaaacaacgcgagagacggccccacccccagaagacacacgcgcgaagagggtaaaagccggacaaacagaaccacacacaacacaacatacaccccaaggacgaaacggaaacccaaggccaggaagcgaaggcaccgaagcggaccataccgccgcccaccagaagcaccagggacaaggcgaccgccggcgccctacaccacaacaacgcgnagcgagaacacaagaaaagacaccgacagaccccaaacgaaccacgggcctcgagacaaaacggaagcaaagcaatgacgaaccccagcgacacgcagcgcacgagcgcgaaaccacacgccagaccagacgggcgngacggcagcaacacccacctgcagccacccggactaacggacgcgacgaacngcgcacggcatgcanaaagccagagccagcccacgcgcgacagcgccgaaaatcacggcagccacgcacagaccagcngaacggacgcagcaccggcaggcagcaacacagaaacacaggcacgccggccgcgcgacaacgccgagatgcaaagaaanaggggcacggaaccccagacccaacccaagaaaaccgcggcgccacacgaggacacccctacagcaacgaccggagaacaanacacggccgaccagacgcggacatcacacagaacacgaacccccactacgacagcagcggcgggagcagcccagcacgagcacccgaagcaaccgcgacgcacggccgagacgacgaagagggcagcccgacacgaacaccacggctcacgagaggcgcacgacaacgaagacgcgagcgcacnccgcagacaccgcgcaaccacgcaccncacacacgacagccacgtgaccgacaagcaccagccaccacgaggacaatcccctcgcgccacaagcagcgntagagtaggcacagaggcgcccgacacgagtcagcacggcgccaacacacgccaagcaccgagaccgcatncgtggacgacgcgacggccgacggcaccttcacgagaccaccaccccaacccgatgcactacccgacggctacgacggccgggagcgagacgccccgaacccacaacaggtcagctcacgtgacatgaagagcgtacggaa

SEQ ID NO: 16278 - DNA, 467 bp, Homo sapiens
ctgggacacaatgaactgaattcagaacagaagggccaaggaaagaagtccatttgaatgtatcaacatgcaggtttattaattattccctgaataatcaacaactaaaccattctgcattgcttggctaatgaatatgatcaaacctatatttatcatttggaactgaagttcaatgtcttatacaagctttgtttgctcatgactattccgtcaccatttatagaaagtatagtttttcaaaagtgtgaagaatccaccagctttctgatctttgtgactcctctttaagaataaataacaaccagacacaggaccccttctatctggatgggatcaagtttaatgtcatcccgggggtcagaagaaaccaacctaggaaaccccccccccaacaagttcctttttttttccctgaacggaccactaaaaaatttcccaaattccttcccttaaaaaaaaaaaaa

SEQ ID NO: 16279 - DNA, 1210 bp, Homo sapiens
  misc_feature (1)...(1210): n = A,T,C or G
tttaaacaagannnnnnnnnnncaccnnnnnccncccccccctcacaaaaaaaaannntcttgtnacangatgccaggnatctttnatgcagctgtgtnaacaacagnanagccctgtgtggnaaataacaaccttgttagaaacaggaagccctccaaaactcagcctctggtattggccgattcttccaactaattcaatcagattgctcagtcttctccaagcctacttcttattaagttactgcaagcaaatgaaggaaacaagtctcaaggctattgcatttgtctctcttaagatacaatattcgtgggtttggcaaacaaattgtactgttctaatcttatgcataaaccaagcaagactgtgtaaacttataaaaactatttattaactacttaatatatgccagtgcataaattggtatcctaaaagcctaaagaggtacaaccaattaaaccaagacagtaccaaaaaaacaaaaaaacaaataaatgggcccctcccgtttgggcccttcaagcgggtgggaaagcttcttggccggcccggcttttcccctttataaatttggaagggggtttaaatcttccattggatttcccctccggcttccacctttgaacttccggcttgacggctttcgggggtaccggttcttccggggttttgcccggggctgaaaggaccggggttcatttccaagggccttacaaaccttccaaaaaaagggggcccggggtttaaaattcacccggcgggttttatttcccccaccccaaggaaaatttcccagggggggggggaattaaaacccggcccaaggggggaacaaagggaaaaaccacttgggttgggaaagccccaaaaaaagaggggccccccagccccaaaaaaaaagcgcccccctaggggaaaaaacccccggtttaaaaaaaaaaatggggccccccccaggtttttgggctttgggggccccctttttttttttttcccccatataaggggggcttcccccgggcccccccccccccttgggaaccgggaaggcctatttcttaccccacaaaaaatctactcagaaaccggccttccaaaaggtccccaccaaaagggtttgggggcctaaaaaaaccccccccggaccccaggggaaaacctttattttaaagcgtgaattgacccccaactgccccggctttttaccac

SEQ ID NO: 16280 - DNA, 605 bp, Homo sapiens
ctaggaaggtggccctctcagctcccatcagtctgagaagatggtgcatgtataaaaagttggcagccaacatctgtggctgggggcgaaaaaagggatctgggaggatcttcaacagctgcctcaatgattcatatgctaccagtctgtgaaaaattcatttaaatttatttaatggaagttacagcagaagctcctacttttttctttggatactgacatttctgtgctaaattttcaagtgttacagaagagttttatgttggatgaataactattgcacagaattcattggagaaataaggatctgattttgaaatatctggaagacataagaaccatcctatttttcatttgtgataattcttaaaacttagttaacttcattccagcaaaaataaataaataaataaaatagaagattcaaaccatagttgtctaaacatgcatgacgtgatcaagtaaaatcattactagttagtttctgggaaatatttagataaagtattttcagggcatgtgcagatggttatatttgtaattcacatttaaataacttcagaaaaaataaaaatatttttaaagacccaggaaaaaaaaaaaaa

SEQ ID NO: 16281 - DNA, 3009 bp, Homo sapiens
  misc_feature (1)...(3009): n = A,T,C or G
ttttnaaaaaaaannnnccctcccctctgtgtccccnnnnnnnnnnnnnnnnnnncnncnctnncccccctccccccccantcnccctccctctcccccccccccccccactcacctntccntctcctcnnnnccccccnnnnnncnnnnnnnnnnnnnnnntttttctgaccctgctttccttaatctacaacccccaatcactattctacccggtnnttttttgttgngggtgntnggagaggctaaccccctcttcaggagnggncacacagccaagcnnaanatnggcctaccncacctcccncccaggcccttaaccgtgtgctttgttaccttatgntcacctatcttctgttgctccttatctaacagatggttatttattcttttcagctgcaccactcctttggccatctattttcctccgtcaattcttcattctcngcccacaacaaatgtatattacctactgcgcgcacgaaagattattctcctctttcttctgaggcgagcttcttctcgactttaataaagggntacacaacgtcaatttgttgttctgcgccacatttaaccaaagcactaggtggacaaaataagccccatacacaacctttncccccaaataaccccactacgcaaacattgaccaaaaaggccccttttatggtgttccacctgagccatatcttaaaaattctaagcaccacacaggtcttcttccccctttttgagatngggcaaagatgagcctaacaaaaggatgctattgtgtcccacacccgtccgcgccgcaaactataacggtcatcaccacattattttgagcctatttacctgttgtttaaattataccaccatcccctctctgcacgccccctatttttaaattnttctccggaatttcccattcgggttgtttgtcaatatattttccttacaaaagcctttttcttcgctacttccttttttcaagaaaaataaagattgggttcaacctccaaacgccagctaacctttcctttgcttcaaactccgggccaaccttccttttatcccccccaatacaaatggggctaacatttattcggatatttttacgctcaactccccctaatgttaaacgaagaaggccttctctcctcacataccgatggctacggccgcacctacagtctctttgctctctctctgaccactccttttattatcttctcttctctgtatcttcctcctcttttattaattgtcctaaccactctttctctcacacaaccacactcctactcacaatccttcgcccgcgcccncaaaactgcgggtncatcatattctacttccctcgtaatcaggatggcatcncattctcacatatttcgcgcgcctncgactacgcatagtcttggtgttcccattctccacaggtgtttgtacacgcatctatcatatccccgatcattcgaaaaatatccagcacagcntctcgtgcgtcgattgttcactacgctctgagttctgtactacagagtcggtgttacttntacctccttctctcatgattattatctttgcactccatactttcacatggtattctcaatttgtcgcggcctgtttcttaccccatccgagagctccctttttcacctcttccatgacacnanactacttcactacatagtgtcacgaccaagggtatacattctccttcttctgtgtgtattgtcactcctctctttctcttgacgngttcgttgctagatgaatttatatactcttacataccaaacgtcggtcctatttcttacatactcgcccaaaaagtttctctcttcccattcgcttattcctctctctccctgcaatgtcttccctggtgggaggggggaggtagcgagggtcgcgtctagggttcaccagcttctgcacttttcttctctctcatcaatacaacatgtaagattttcgtcctcattttacaatacaagtggtaggcacggnntgttacgatatgatctgattcagtacgacgtttgccacgtccgccagattttcatgtcttgantgagagtaatgatcagtatgggatcttgttccacttcacacccgtcatccactgctgcttttttagcgaagtggaggtcggcggtgcttaaccaactcacttaataacaacaagactgcaacatgagtagcgataccgtcgcccccaccgttncgcgaagtgctaactgctatcctnttacgcttaggagacatcgtcgatttcctacccacccattgaaccaaatctagtttttatatatcaacacgtgttgcntaaaaagtatctaatataatagtgtcctttttacatcttggtgtataccancttattatgttacatcccgaatctgtcgacgcatcaaggtggctcttgtcgatagcatatgacacgggtcgtcctcttcttgtgatcgttgacctgtgtcgccgtcttcagcaatcgccgctgcgctctacagtagaagtatccactagtcacttccgcgtcgccaaacgngccacctagcagcaataagcgagtgcgtgtgcataggccctgtcttcacctcgacccgtaggctgnntagtagcagtgtcgaaatttnnnaanatctcacctcagaccctccacacatttcaacttggtcagtaattggtcttatctatttcattcccctccacctcctctgctcttccgccgcactcacgctactcgcgtacgccgcgccctactattcgccccgttatcgttctctcggcacgcacaaccatctctggcgtaacgactcgcttctccttccatttcattcatgatcccgtagtcatgatgatagaatangagtgtcgtcccccttccttcttgtactcgctcattattgatcaggactcagcgcaagagcctcgtttcaccacacaccgtacctcacagctccgcatnccgaacatccctgtttctcacgtgtctgtcacgtctgccatatg

SEQ ID NO: 16282 - DNA, 858 bp, Homo sapiens
  misc_feature (1)...(858): n = A,T,C or G
aagtaatanaaatnnaaaanannnnananaaataaaaatganananaaaattaaatatnnntttgnngttgcctnnggtagaggtattggttattaggaaagattaaaaaacagtattaatggatttgtaagggtgaatattaaccaatggtgagaaatttgggatccactttccatttgatcttgatgctataattaagcattgatgcttggagcatctttcgtgattgaacacatgcattttgaactgtggccatgtgaattaccttgaaagattatgagagatactactggcttttattgttgccacccctcaacattaattatgaacctctcactgccaccctctaaatccaggcccataagcactaaactcacttctatacaccccctatgcctaaagacaccataccccaccccctcacccttaatctatctctatctgccttgttcccctctcataggcatttattcctccgctgtactttgatctggggtcatctctgatgttcgcagactccctctcctccttcggttgtctgtgctctggctatcggtcccagctaaccgacaggttgaattatccgcaagaccctcagttcgcggcctcacatcctcaaccactctcctgcccgagacgccgcactggttctcgcgtatacgatacacccggccgtgccctgtcgaggcctcagtctcctctgcccccccagccgacacccatccatcccattcatggtcctctcgagccgctctcgtttgtctaccctcccctgttcgcgattcccgctcgcctcccactctgctcttttttattatatatgatgcgtctcatttcctagttgctttccgacgact

SEQ ID NO: 16283 - DNA, 1194 bp, Homo sapiens
  misc_feature (1)...(1194): n = A,T,C or G
ggaaaaaagannnnncccccnccccncccnnccccccccnnaaaaaacnncctgaggttgactgtacacactcnaccaccgctcctgttcagctggccctgtggngagagacttgttccactggcaagccactattatggggcctcctgatagcgcatatcaaggtggagtcttctttctcactgtacattttccgacagattatccttttaaaccaccaaagattgctttcacaataaaaatttaccatccaaacataaacagtaatggaagtatttgtctcgatattctgaggtcacaatggtcaccagctctgactgtatcaaaagttttattgtccatatgttctctactttgtgaatcctaatccagatgaccccttagctaccagatattgcacaaatcctattaaatccagacaaaggaaaagatacaaccaagacatggcaagaaggaatggggaccttcaggaaattatggccaatggttaaaaaaatcccaacaaaccattttttccattattataacccaagaagttaccttggcaaaaaaattcttaaggggttttttctttttcaaaccaatttaagaccaaggtaaaaaaattttgggaagcccaccttgggttttttaacctgggttttcccattttggggtcaaaccccaattgggaaaaaccccccatcttttggcgattttttcttctcaacccccccaaatctttttttaaaaaatcgggtggggttttattacctggggaaaagcccccataggcaaccacaaaatatccccaataatccttttttcccccaaaaaaaaaatttaaccccccccttttaaaaaggaacccttggttgcaatttgcatacgaaggcccatttcctcaatccccaattgtcattcggtgtaatggcccccattcctggcacccaaaaaaggaacacccttttgtaaatttttaatcggcgggccttttatctccaaacgcaattttcccttttggcgaaacccctttccttggcccattttctttttcccgtgcctttttcaccccaaaggaaaaccctttcccccaaactggcccatctccctggcgaaaaaagagcgcccataaccccgaaaaacctcaaacctccgaccttggcgccttcggaaaaacacctacggaattgggctttccccttaaaacccttg

SEQ ID NO: 16284 - DNA, 853 bp, Homo sapiens
  misc_feature (1)...(853): n = A,T,C or G
ttgaatctgacagcaatatcaccctttccatgaacctaggaccaacatgacgggcgcgacctcctcgcccgcacatgacacactccagagcgactggacgcgcgcatcaccgcctcccgtcacagactatcccatccatacttcctcacacgatgatgctgtatcgaactgatagaacagggataccaagatatacaaaatgttgatgacagcacgacctgctacacattggggttgctcggtacgagactgactgctccggcaggggggcctacatgaatactgacagtgctgaaaagccatcggcgttggccgatatcgcgccccacatggtcaatgaacctttgttcctgtgtggcctgcaacatctgagtgatggcactctgtggcaccccggccacatggaaccactaggcacctgaactccccttttgaatcaaccgaactgcacccagggagaggattcctccacttccttatcgaaattacatgatacccggcgcccttgtttttcgagcttggtggaaaaaaattgacgcgaattattttttctttggataaaagggtttggcttaaattacacaaacccctttaaagggcccagaacaccccccggccccntgnnntttaacggaaagggtattttttagagggggnnnnnnnnnattntntantaattcttttatactatctataaaatataatacatactaatattcataccataattntttctatttcccagagtgttatatttctagtcttataccctcatgaaccaacaacatcctggtgtgacaaaacctgactgcgcgaaattatttccaattgccagatcagatccccccgcccg

SEQ ID NO: 16285 - DNA, 2356 bp, Homo sapiens
  misc_feature (1)...(2356): n = A,T,C or G
ggggaaaaaaaacaacnnnnnnnnnnnnnnnncnnnnncccccncnntctgggggggggnnnnnnannancccccccccntctccccaacacaaaaaaaaacacttctgnannaaacttngaactnctngtnncacncangttctggcgnnaaaagncnagntagcgcacgtagacacccctncagcgaccttacaacctngnccnagaacacttcccaacactancctcttggntntaccaagnccgaatnttctnacctaggcactnccagaccctcgctcgcagttagcggttctctggcagtttcaagcaatttcggcgctgcctcaatnctccatcaaacaacagcaaacctnagnaagcaactnaatttgcaacctcgatatttctaccaacctctccccctcggaaacagccacatctcngcaatccgatccccttgccatctctaaatcgctattcactctcctccctctcaatatactagaccatctactcatactactctctctctcatagtctctcgcccaccaggcataggcgacttcaaatagaaatttccttaatccctagcaaggttcctttaggggaatttttctcccaatcaaaatcttcggctcgcgaagccaacaggnggctcttctctcttcacaaattcaaaacccgctcggttttcaccacaactttgtgtttttaagccacccttaattttcaacaaaggcaaattgggacccatcttcttacattccccccttttaatacacacaaacaaacacagatacacaaatcattggggcccccccttcccgatcttagggccccacctacccaaaaccggcgcttagaagaaagtaccttcccttaggacaggggactccccggcctttttcctccccctctttttcttcaaagccttctgcaaaaggagagggtctcttttaaaaatcatctcccaattgtggaaactatcccaccttttccacgttccttcaacccaaccttttagagaaaccacttttccgagtcctttaaggaaaaggaccccttctctcggaggtattaacccgcagtatattaccccgtgtcgtatcacttagtgtcctcagcggatccaacaacaataggaccccgcgcgtggcgctttaacttcacccaaaagagttctctctttgcctacaactccctttgcnccaaaaaaacaagagtgggcatccacggcggtcttacataaacatatacaacccacgcgcgcacgaccctaaatatctntctcccgcacccacaacccacagagtgtgcaacaaaataatatcgcacgaaaccgcgcgggccgcggtgtggagaatataatatagaaacacaccccgccccctcncaagaggtggcgtgngacaaaacgaacgtacaatgcggcgaaatacncanaactaccccacaatatcttgtaggggnctttcnacgggctgataataataccgaccgcncccctccataacacaaaaataaataacagntacgcgntttgcnttcgcctcaccacccccatcagatgcncnacccgcagatgaagaaacacaaacaaagaggcggcgccctcgctctcacaactacctggtgagaaaaaaaaaagctatcccgctgctacactaaatacatacacacacaaaaggaggcggggtccctcccccacgctctccacagggacatttatttnagggagcatcttctttggggaggagcgagcaccctcagctctctcttcttcgtcctatatctcattccccgagcgcacatatatttacaaacgtgggggacgcttccttcccactccccggggaaattaaaccatccccacactccaccctcttgtgggcgcaacaccctccacaaaggccgccccttttctccaacccccataagaatacaagatactctctctgataaaaccgacgacctctctacaaaataatagtttgccttacatccaccaaaacgggctgcgggggccacccaaaaaaagaaaacaccccactcttcggaaacccctaagagtagtccgagtaccttctcgatcgtacataaaccagcccgcaataattttcaccccacacataaccgtgacacacgcggtgtttatttttctgtccccacaccccccccctccttcgaggagaatcactaaaaacccctttactaaccccctcttacacgcgttaggagcgcgacacacccacatctatattttaccatcctctgagcgtacgtttcaccctcccacaaacaccctccnctcctcgcgtacacccccgccatatttttaaacaccaccacacgggcataaaataaaacctcca

SEQ ID NO: 16286 - DNA, 848 bp, Homo sapiens
  misc_feature (1)...(848): n = A,T,C or G
tttttgagnaatgngaaaaaannaaagaanagaaaagataaaaaaggaaagagatttagtgtgaccctatactctattatacagctggcagtatttggtgtcaattataaaatgtaagtttattaatgaaaaattaaatttttaaaaaatcttatgcctaccaccatgggcttcaacattgcccagttcttacagaatatttgtatgctatagctggtgaaattgattaatgtgacctttgcaattgcaagtttcagcatatgtatttgcaaaacttagggaaacaaagttttccaaatagtggttatatgatgctatacaatcatgcataaatagtaaaaacccactcaaaatgaaaaataggaccaatacacttttgtatgcatatgctccaaaaaattatctatggacattgacactgcgatagctcatacccaggcgccaccaacattacttctatttctaaacttgcgtagagtccacatgatcaccatatacccccctaccgatatgcctctattatcaccaccctcgaattattttgggcttggtagctccacagaagtaatcaatcattaggccacggattaggttatcccaatcgtcacttattagtgatatgaatgaccctgcccccgccaataagacgcccaccaggtctataaatagaaaacaccgagcgacagctttctgactgacttctaactttagaacactccccatccttcttcaactgcatataaatagtacttaagaaagggatgattaatttgtcatttcatctttgttaacagaattcgattttatagtttttagactatgtaacctatctgaccagaaacaccaat

SEQ ID NO: 16287 - DNA, 235 bp, Homo sapiens
  misc_feature (1)...(235): n = A,T,C or G
actatagcattgcttcaaaggagcactaaaggctggnacacaaatgaaanaactgagcacatgatttgttcttaagaaaattattctccattctttgagaagtcaactgaataggatgaagaaactgctctatgttatcaggtttttaaattttgtatttacttatttacttttgttgttacttaaatcaactttaaaataaaataaaatttatactttgagctacaaaagaaaa

SEQ ID NO: 16288 - DNA, 510 bp, Homo sapiens
tgagaatctctgcctcaggcctttaaataggctctggcttaaagacacctctgtgttatattttgtaaacttcatataatagtggttggcatttttcaaattttttgctcgagcatcctcaaaagaattttgaaaaattatatatctctcttattcatagtggacattaagtacatactaagttgacatctataatttttcaccatgagtttaactattttcaaacaaaagaatacagtttgtgtattgtaaataatgatagtttaaaccattaccacaccctttcaaatgtatctacttaggaatatatacatatttgtgatttaatttactccatcatgaatttaaaaatacataagtaagtttttcaagaaagtcaggaaatttctctttgaacttctatttccatttcactacccccatggaattttattctaatgtagtactcttgtatgcttgagtcatctattgttcatcccattatatgtatctgctgcaaaaaaaaaaaaa

SEQ ID NO: 16289 - DNA, 782 bp, Homo sapiens
  misc_feature (1)...(782): n = A,T,C or G
cctagggtcccataagaatgtccagacaagcttatgtgaatatccctcttgcaggaacaatggtcaaaaactggagccaggatctgtctactgtattcgtgataagttggaatctggcgatgctactcgaaagtctttcttctaaaaggcagccccttgctcttgatcttggcttctgtctttgcagtgctctccatatcacaccttgttatatactcataaaaggcagagaaagctacatctccagttgccttccaggtcccctcagaggattgcttggtgctagggactttacagttgtcatgactgactaatgttttcttcctctacctttgatttggtctctagttctcatcttttctcattctgctcattcttcatggatgggtgcacctgtgcccaaggtttcagttactactgatgtgatggatgggtcgtctgattccaaaatgtgtgctaaactctgaggctttcttaagctatatggtcatattttcaaattcccactgggaacccatactgggatttctaacatatatctcaaattcaatatgcctaaaaacagctcatccattctatctccaatacagcccactccttcctattcttggctntggttaaaggcaaacagttcttagctcagtgcttcttaaagataaagtgtgcataggaataaactggtttttatcntttanaaanaaaaaaaaaaannnaannnaaannnnnnnnnnnttggccttnttggccctcacngngaactgccccccccgccccctttgggg

SEQ ID NO: 16290 - DNA, 390 bp, Homo sapiens
  misc_feature (1)...(390): n = A,T,C or G
gttggtggtggttgttaggnattgtggtgggtnnnngggnaaaaaannagnnaannnnaattcaggggagtcagctaccatgtcatgagcacccctatggggagacccatgtggccagaaactgaagtctcctgctggctgccatgtgagtgaagttgggagtggatcctccagccccagtgaagccctcagatgagactgcagccccaggcaacagcttgactgcaacctcatgagagacctaatgagcagctaagccactcttggattcctgacccccagaaactgcatgagatagtaaatgtttattgctttaagatgctatgttttgggataatttgttacattgcaataaataaccaatacgtggtgctatcaaaaaaaaaaaaa

SEQ ID NO: 16291 - DNA, 758 bp, Homo sapiens
  misc_feature (1)...(758): n = A,T,C or G
tagtttatgagttggtgaatgccttgaggtgaaatttcatgcaatctgttcttctgggatggagcccttcaagttcaggctgacttactagccattaactccaatcctgtagactcatcccaagggggcctcaatctgtcacccaggccgggttggtgtggtggcatgatctcagctcagtgcaacctccacctccagggctcaagcgatcctgcgatcctcccacctcagcctcccgagtagctgaaaccacggacacggaccaccacgtccagataattttttgtaattttggtagagacaggattttgccatggtgcccaggctgatctcaaactcctgagctaggcaatccacccgcttcagcctcccaaggtgctgagattacaggcgtgagccactgcacccagcctatagtcctttgttatagaagcttagttttatacaaattactccactatatccagtcgatgtctaaggaaattattttccaaacaagactccaaggtttaataaaagccccccaaaatcagtggatataattatatcaatattacgaatttctggccaggcatggtggctcacgactgtaatcccagcactttgggaggccaaggtgggcggatcacctgaggtcaagagctcaaaaccagcctggccaacatggtgaagacccatctctactaaaaaaataccaaaattagctgggtgtggtggcaggtgcctgtgatcccagctacttgngaggcggaggttgc

SEQ ID NO: 16292 - DNA, 2027 bp, Homo sapiens
  misc_feature (1)...(2027): n = A,T,C or G
aaaannnnaaaaaaaaaatatntaannanannaananatnnnnnnnnnnnnnntnnnnnnnaggtagtgtggtatgagggagntagagatagtnnataangtagataggnggtngangtagnnanaggaggaggnnnnnnnnagggngccgtcnnnaannggnaganganannaacannganannaagnagacnnagatgntncgctttganantangngngatgtngngngagagnaccccganangnanacaggaagangnagnagnnanngnnanagcgagagtgaaagaagtgnagagatgtanatgnanntttgtatnangtggtatatatgttngataggtattatgananaacagggagatgtangnnnnnnnggggtggtgatggngntgcaatactagacgantgaagctgantctcacacagaantatagagtatcgangagnagagtanatgaaaaggtgnagagagcagtgnatgagaagagagtggagnanagagtagacgctgnngatatgcaaaacgagagtgangtacggangagtagtgcgnggacgagcgacggcccaanacnatacgagngaccgantaacgactataatagtagaacgacatatacaatcnantcgtcanacggtnatttaccgagacaaaggagagtgtatngtatgggagtatgagnaggataagtatgtagatgtatagnnnaatgagacacgatgaagatcgagagagagctcacgagatgtnagtcgangcggaagacgagcgcactaganctagagtcgagagagagagggtnncaacagntcgctcgcctgcgcgngtacgtcgcgcactgaatgcagcgcgacgcncgcctgcancncgcacgcgcgacgacagtctgtagagatcacgacacgtgcncaaggcgctancgganncacagtatacngaganacgagcgacgagnaccaacatgacgcgcactgccncnncacgtcgtcacacgacaccacgacgcaagagacgagcagagccgcgcancaccancacaccagagacgaangacgagaccagaccacgngccgcacgcagagtntcactctncactccagagacgagacacgctcgcgcgactgcttcgcaccgctcacatcaacgcgtctcgacgacacccaacacactcacccgcgccagcgctgcgctccacacgagcncacaagactaacatcacgagggtgtncncacganactgacgacgcagtcncacgtatcacagcatncacnantaagagaattcactcgtgatgaagtcggntaacagcgtacgcagctacatcgatcgtacganagagagctncacagacgtgantaggcagccgacgagagngncntncnangtagaacacacgtagaacatgtagtcagcgtcgcgcgcgtgcncnacaatccacgttgctgccacgagagnctgccggngtgcgcgagcntntcgcgtgctnctgcnngctaggtgatgcgcganagactcgcatgacgtgcgnncntgcgntntgcgcgtgcntnnccagcgaagccngncatcgcacncgcgacacacacacntcgacacagcctacgtcgacacgcagaacatcgagagcnacgctcangtcaccgcccncacacgcactcacnacagngctaacctccagcgacagccagnagcagacaccgntancananagcaaacngccctaanncancagtcgacagcgtcaacatgagagagagcangtcnagncgataacgtagacgtcnacacgccccgctcnacgacgccnacgacgannntagacagacatggagtgtgtacancactagacagtagagtgcnaccncagcgctgcgactgangtcgagtagcgtcagtagcgacgncngacagatcacaacgagcagcgnacacacagcgncagcntcgcgaccccntacgacangatgagtcacganggcganagaagacgancncgatagaacganacggagcaanaga

SEQ ID NO: 16293 - DNA, 1202 bp, Homo sapiens
  misc_feature (1)...(1202): n = A,T,C or G
gaagagagagggagggggggggggagggggnggggggagagagaaaaatnnagaaaaggagaggagaaagaagagggaagaaagagttggaggaaaaaagaagaaaaaaaaaggggtagaganagagnaaagaagaaaaaaaagaaaagaaaggaaaggaaacgagggggtaggggtgtggagaggagagaaggaggagaagggagtaagagagnnnagaagggggggagggggagngaancgnagagggccagagcgcaaaaggagaaaatagcaacgacgaatagagagatgcagcacgagcgaaaagaagcaaagggataaaaaggtgtagggaagagcgcgaagtggaaagaggatgaggacagagtgctacagaaacaagagagaagaacgagaagatctgaggagtaacataagagaaagaaacggagaccagatcagccgatacacaccatcgacggacacagccagcacccgaacgatcctaagaaaacacaaaacataaccgcagataccggacagacgaagaggagacaacgaacagcaccccgtacgaggtaacacacagacgaggacgaagcacccacaaggcacagcacgcgagcaacaacacaccgaccaccgcactccccgaccctactcccccacaaccaaccgacacctcacacccatcgctcacccacaccgatccagacgccgctctcacgccgacgatagcgatacaagaacgcacgcacatcgccacaacaaccctagcccatcaaacactcaacgacccacactacagataaccaatacgagaacgcaacgccaaagatacaacaggagcgagcaaagcgaagacacctcgangcgcagcagatatagagcggagacagcacgaggagacgaagagaggcgacgaaggagacgacccaccaccgcacggtgggcaaactccacagacgctcagtcgagcaagaagatgcggacagaggccgaacggcacccacacaccaacacaccacccccaagagcgcgaacgacgaaacagcccggcagcacgaccgcgcgctcgcgagagagcggcaaaagagaggaaacggacagaggcgacacagagcaggacacaacaccagaacagactacagcccacaccacacaacatgcaccgcccagttgataacaatctacgaacagtgatcgcacgtaggcctcga

SEQ ID NO: 16294 - DNA, 409 bp, Homo sapiens
agtggggagcaccaaccccagactgctaagaatacttcagttcaagatattgctgcaaaaagtgaggttgtttccttatctctacattgcagactgttagtgttccagaaaggaatgtttaattggcctgtgtgttggaagaaagaagataaagagcaaagctgtatcaagctttctgttgtatggtgctattaactctgcctggaacatgagcaagtacaagccaaaaaatactatctgagagctcctggatttcaaaatgacttgttaagcctcactgagtgtaaagatggatcacaatgatatgccgctgggagaatactgttctccacttgtggatggtcagataaaattcagaaattgttgctctgatcactgaataaaaacattgccatcaaaaaaaaaaaaa

SEQ ID NO: 16295 - DNA, 860 bp, Homo sapiens
  misc_feature (1)...(860): n = A,T,C or G
agaagaaaggannnnnnagannnnnnaaaaaggaagnnnnnannnaaannaaagngnnnnnnnccaggctggnatgcagcagtgtgatcatagctcactgcccctcaacttctgggctcaagtgatcctcctgcctcagcctacggagtcactgggattacaggcaagagtacccgcatcaacaattggaagcagtctcgtggagtgctggggaaaggcggaggatgaagattgacttgggaactttatgtttattgttaatctgttttttttttaaattctgggtattattatttaactaatttgctaaaaggaaattacactttgttgtacggtgatgtgattgggatcttaagataagctataactaagtcagaaaatatactaaatggtttttttatcactcggtctagatcaggtctattggggtttctaagttttgtcacgaaattatatgtaagttattccgtagcttaattttccttatagagtgagtcgtgtatgtctcgtgctcagttgtttgtgggtgctgcgatgtattggtacagatgtagtattgctccatcgggtcgggtctttttgctcacaggggtttaattgatagctttcactgtattattctatcatttaaagtacgctcattttattggtcttaacaggtaacgaataccacgtctccacgccgcggattttcttagccagaagtcattggtatcccactctctccacgaaaccctctttcttcttatttatgagagaggaatgaggggggaaggattagaggcgtacttaaacctctctaaattcactcttctggactatggggagcgagtagatttctatcctatttgataggtagg

SEQ ID NO: 16296 - DNA, 703 bp, Homo sapiens
aagttttcttatttgggtgcgaactgggtcataaagcagtatagacaacctgcggcatcaacaatgcatctggtccaggagctgctaactaacatacggtgctggtggtgtttcaaagacttttgcaaaggagatgagagccattcaagatgagcatgagtttatggatggccatctgaagttgacaacgaccatctaagaccattcatggaagctgtatctcttacatctactcaagagggggccgaagaactcactgtcgaccattctacagttggttgggatttgaagcatattggaaaggtgaaaaaactcatttaagcggatgcctcatgagctgagtgaaaattgtataactcgcaggttatgaagtgagctcttctcttattctacgcaacaatcacgaaccatgtcttgatcggattgtgacatgttacgatccgtggatcttatacagctactggtgacgaccacttcagtggctgggccaaaaacaagttgcaacgcagttcccacagtcggacttgccccataaacacgttctggaccctgacttggtgggttcgtgccggactcaaccactgccgtctttgttaatacctgagaaaacctttcatttgtattgtttgttgtcgtttttggatactaatttatgtctacttacccttttgttcattttttttggatctttattttttttaat

SEQ ID NO: 16297 - DNA, 762 bp, Homo sapiens
agggggaagcttactgccatgaagaggccacatgatgaggaacagaggcctccaaccaacagccagtgaggaattgacatctgctaacaagaagaaacttgttttaagtggtacccgattctttttttttggtttttttttctccctgatatgggtttcactcttgttgcccaggctatagtggtgtgatctcggctcactgcaacctacacctcccggattcgagcgattctcctgcctcagcctcccgagtatctgggattacaggcatgcgccaccatgcttggctgtttttctgttttgttttgtttttatagtagagacagggtttcaccatgttggtcaggatggtttcgaactcctgacctcaggtgatccacccgcctcagcctctcaaagtgctgggattataggcgtgagcctccatacccggccagtgctacctaatttcttatggtcgcttatagtaaaatgtgggagaagataaatcagctagagagactatgcaacttgaagaaaccaggacttgatggttctgaaaattctcagacattccaaacagcaaacaattctaaaattaagaaatgggtcctcagcaaagagcatatgcaggatggtgccaggataactagcctaaagatgatggcaagaatgcgactaaactattcataacacctcagaaggatctatggtggcacctgagcattgctttgagtcagactagagatccactaggattcccattgggtggcctatagatac

SEQ ID NO: 16298 - DNA, 768 bp, Homo sapiens
  misc_feature (1)...(768): n = A,T,C or G
cagggccatgactgtgctttttttggaaaggtggcctctctggagccctcaccttcttctgtggccggaggcaaccaggacagctgtgagagccgtgtcctagctgagcctggacctggcaaggcccaaggacacccagttccctgctcctgggccacacgctcctgctggtctccacgatcctcagcccatctcctcctggaccccgcagcagggttggcagtgttggggagcagcgagggcagggaggccgaggagcctgtggccctgctgaacactggcctgcgcctgcataggcagatggtctaaatgggatggtctacacaggatggtctacacagacaatctacacaggacggtctacagagacagtctacacaggacagtctatacacgacggtctacagagacagtctacacaggacagtctatacacgacggtctacagagacagtctacacagacaatctacacaggacagtctacacaggacagtctacacagacaatctacacaggacagtttacatggacagtctacacaggacagtctacacagacaatctacacaggacagtctacacagacaatctacacaggacagtctacacaggacagtcgacacaggaggccggctgcccaganatcggctattctcaactattcccacagagtgaggagggcaggggagattgcaggcagttgnggagctgggggcagccgtccaggggtgcctgcaagtgggatgaacgtgggcactgggactcct

SEQ ID NO: 16299 - DNA, 905 bp, Homo sapiens
  misc_feature (1)...(905): n = A,T,C or G
agaaataaaaatanaannnnttgtttttgtgggtttgaatatattgtaaaatctttgggaaacaaaaaaaaaggttagagaaggacggggggnnnnaaagggngagnaggggaggggaggagaaggggggagaagggggagggaagggagagagnccccgaacacggaggcgaaggaaacgggcaaaagcgaacgagaaggcgcggcacggcnccggggggcggaacccaacggagcaaaggacacacccaccgccgacgccgaccaccaaataatgnaaatctagaacacccccccaggagggaggaggcgggggacgcgggcacacatgccgagnaagggagggcgcggagtggaggagaagngagagggcgggtggggtgggggccgcgggcggcgagggaggggacgaccggaaaggaacgggagccgcagcggaacccaggagattgtttttgtactagtctcttctttcttttgtaactttctctctcgtagtttatcttgctttctcatctcccttccattttattatgctcgggtctacgtttttttcttttttattatttttatgttttattttgttattatgttgtgtggtgtgttcattttattcctcttctctcgttgttgtttaggtttttctgttggcatttgtgtgatggaagtgtattgccgtggtcccctgtctttctcaatgtcaaggtcgcctatttttgagatgccttcttctctagacactctctttcttcttattctatgcccccccattatccctatcaattgttatctttatattgctttctctctttctttatttttccgcgtgaatcgccaggcatgtgtgtatgcagtgctacatgtgatgtaccgtctgattagttatttaccgccatttattattt

SEQ ID NO: 16300 - DNA, 1209 bp, Homo sapiens
  misc_feature (1)...(1209): n = A,T,C or G
agaagagggaggaggagaaagagganagagagaatggggggngggagggggtganaggagggggagangtgttgaggaanagaagaaaagaaagaaagctaagaaagggggnagggagaagnaaaaaanaaaggnnaaaaagaggaaagggaagtgtttgnnggtggngagagggaggaaggaggagagagaagagaggtgagtttagatgaaaatatctggtctatattgagaatgtttagtacgttagaatattgtaatgaggatatggcgtgggcgacatgatggctgtgtgtgtgggagtatgttaagggtagaggataagagggagccagacagagagagatatggatctcgtcgcggcagacggcagcgctctgcgcgtggttctcgcgagtgatctacgtatgcgtccgctcggctgcacggtgaccctatggctaccgtctcgggctaacatcaactgtcccctcccttcccccgtatctccacccccatttctccccctctctgtcctcttctcttactctctctcctccttccgccttcttccttttcctcccgtctcccttctcgccctgttcgcccgcctcctcgaacgtctacgcgccactctttctctcactccacacactcctccctcacatacctatctcatatttgtctacctcactttagtaatgcttatctatgcgatcgtttgtcgtcgattcgtctattatctcgtgatccgcgacgttatgctgagtggtgngttactgttctgcatgtaggactgatttcgtaaggtgtcgttntctacttatgcgtcntacgtatcctcctctgtcgtctcgctcatactcgcacngtgctcatcatcgtcgctcaccactcgctcgcggctctncntacgccgccgctcgcccttcgctctcgtgtctgtcggctcatgtatgtcgtacngttctgtcgtggntcccgactgcattcacagccacgccggaccgtctgtggtacactccgntactcagcaagactgtggcgngactctctcgtttgagtcgctcgtgtctacgctctatcgtcgttcgtgtcgcttntcgtgtnctatnctctactgcgctcntctgcatgttgtgcctccgagtacactgantatgcgtacgcactgtacgcgcgctccncacacagcactcctctacgtgtagcgtctatctctctcncttg

SEQ ID NO: 16301 - DNA, 1829 bp, Homo sapiens
  misc_feature (1)...(1829): n = A,T,C or G
gttggnnaangttttgaggagtntagtnnggannagtagnnattatatagntgnnnnnatagtaggtngatagggtgnnatngtgatgtgnnnnagttnnagnattgtnnatgatgnnnnnnggnnagagtgnnnnangaagtgtgaatggnnnnngagannnngaaattgnnnnntatattnnnnnnatagaggtnnnnnnnnnnnnaagnngntatattgtntnttntcaggnntantnnnantnagtgtagtgnannnatagagaggagtnnnnnttntnnnnagagagatggnntcagatgtngtagacgtatgatgtnnagatagnnagatataattagtattatatgtgatagaaagnnnaagatagtnnnaacatcaaatataatacgtgattgtangattntactgacntcacctatactagaacgtcgtagtatacgttnanacagcactcgcnancactgctagaacgcatacgtanacagaggcgaggnnnngcgcgctcgcgcgattttagtcacgacgtattagcgacactcggcccagtcagcccgacgacgtgatcatactgcgncaacgtctcatcaccacgagtatgatgcgcgccattgncttcaacatactatagctncactacatntgtactcttctctcatttggtccccctagatggctgtntcagttatatctnntatagtattnagttgtctctatcgtancncncgactgtctgatntagtctatgacntcngctctcngttgatgtctcgtcatgtctncgacgtgtctgcntngtgtcncccgcttacgttcactctcgtcatcttcactaacnntcatcnacatnncacctcccatatcacacncacgcatcattgatcgtnctatctaataaactgncgtctncttcgnccgcacatctgtgccgtgtgattgctatatactctnagtcgtgttnagcagctgtgcntctcnccacatgtatnttctacgcattgtcgctcgttgcgtgtagcnngtgtcgggctgatttcgtaatgttcgacactcggtgctatagtcactgtgggatattgactgtgtncnccatatatanagcnnnanatgagaagctaccacactcagcaaatcatgaanatacagaatnagataataactctatcatacaacatgtcgacgagaatagtacgcatacactcactatcatagtaatgtagcgtgcggtcnctccttctatcgccgtgctatgtgacctctgatcgttcctcatgtcnatccattcttttactcatccatctcctaccgaatctcaaccgctatgatcgatcccgagcaggtccacatatccgcacacgtgtcgtgaatgactatgtanatatacncngacagaatatatnacaatatgtgtctatcacgcaancactgtacatcgctcaagctatatgatttcacacacagacgtgatgactacagttatccaccacactgtcnaccacacaccgtcagctacatattacaattccatgccncctcacttctcntagtgatatgctcacggccagacgggacagctcagatgtgcnagcagtcagtacacagtagacatgaggnacncaatcatgttgattatgttagtcaacatatattgtgtggnncgtacatctacttgatacgtncacatatctgatgactctactatcatcccattatgctcacctaacaccaactaatcctaactcatctcagcatatatcntacacactcgcagctccatactgcccgtctcccattacgcccacacagcctccctcatccccccaccg

SEQ ID NO: 16302 - DNA, 754 bp, Homo sapiens
ctgatgatcacgttaaaatgagatcactggatagtcctaatccaatatggctggtatacttacataaaggataaatttggacatacagagagattgatgcagagggaagaaagtgtgagagcacagggagaacgccatctacaagccaaggaaaacctgagactaccagaaattagaagagatccatggaacagattcttcctcagagcttgcacgaagaaccaaagatgccaacaccttgacctcagactttcatcctccagaaccgcaagacaatcaatttctgttgctgaagccactcagtttgtggtactttgtatggcagctcagcaaactaatatagccattgaaattgaagggcagaaatgtattataacaaattctaagataaattatggggcttttgttttcttctccattgctcacccttctacacataatgtctttgtttcctcattacgcccttagtgaattttccttgggttaccatgaaggtccaggaggtaatttgatgtgataattgtcagaatgtggtccacttactgccttcattaaagtcacgaagaatgattgtttaaaatgcaggtttctgagtctgagagcacaagtacaaaattagattatttgggaaaggatagcccaggaatctgcatcttttaaagttctccaggtgattctgaagtaattaaagtttggaaatcactgaaggaatctttgactggttggctagtgccacaataggaaataatttaca

SEQ ID NO: 16303 - DNA, 784 bp, Homo sapiens
caggtatctcgcaaggtgtacagcgatcacaattatagatgtaagacgcgggtgccgggggagccttaaaggacttctggctctgcatacacgaactccacctataagtctccgagagcttaaatgtgacaacatctttataaccggccctacctggcctaggcatgattggtgacctcggaactaggaacacctgtaacgggcttattttgccaggagtgaggacagtaccccacagctcatggacccggagatgcctgaggtgaaatttgaggaagccggtgtcgtttatgctcatgggatgagcttgcttgacaagggtacatctgtatatccttacttagagagcctaaatgctgtgctacctatacccgacactgagcagtggggagaagccagacccatatgactctgtgacgaattgctgaagagaaggtatttaatgagagatgcatactacaagacaaagaggaaagactgttcttcacacaccttttgaaccatgccttcttccaggacgaaacaggagtactgtgagaactatcacattaagatgatggagataaaatgagcctagattcatggctacgtgttgtagatattacgactgtagcgggaggattcaactatactgaaggtattgagtcttctattcatttagagagagatgtcccagagaatgatcctctagaacatgggggcgtctgggggtctctagccagggtgaggccgcaccgtggctatagctatataagacccagccctcttaatagaaagaaaagag

SEQ ID NO: 16304 - DNA, 760 bp, Homo sapiens
  misc_feature (1)...(760): n = A,T,C or G
aggtattcttcgttagtgaaagcttcctatcggtccagcctgtggctctgcaagggccacctgaagaccaccctggcccgcagtgcttgtcaagttctccagttggctgggtctttgttcggatgtcggtggagctgttggctgggtactgtgatggcttctgcccaggccggtcacaggatgctggtcccctgctcaggcaattccactatttgggatctgctgttggacagcactgcaagctgggttccgaggttagatggagtcactgctctggccagatgggtccagaggcgacgtccttagaaatgtgcaactgaggactgactcctgtggagtgggctgttggctgagttgagtgggtatttgactgcctgggtcaagcaggtctagccccttcccttctccaagatgtgcagaaggggaagtctcccggccaggtcatgggcaggctctttggccgagtggagctgctgtttgactgaaagcctgccctattcagagaccatcgcaagttggtatcaccatgggaccaaacagaattctaagttttcactgctaccaaaactacagaaatttaactataatgttcacagaaatattctanactacagtaagagttatgctgnaatttttactcatgttttgaggctaggaagagtaaaatatcttaggccataaacacattataaaatatgcatgctaattaaaaaaaaaaaatggcctcttggcctagcgggggagctctggggcgtttcct

SEQ ID NO: 16305 - DNA, 212 bp, Homo sapiens
  misc_feature (1)...(212): n = A,T,C or G
agtgaggaaaaatagtatnnnatttattttggatttaattgtagtattgatttattcggtcgtgtcagctacagccaaaagtgaccatctgcaaaccacgaagaaaacccgcaacccaaactaaacccttctggaatcttgatcttggattttccatcctccagaattgtgagaaaataaattgctgttgctttaatccaaaaaaaaaaaaa

SEQ ID NO: 16306 - DNA, 195 bp, Homo sapiens
cctgtacttccttgagtctactcatcaggagaagaggttgctggatactgaattctggtcgataaacacgtttctgtagtttacaaacatcatgaagttagaatcttccagcagaaggctgaaatactgtaactgacagtaactgaccatctggaacactataaatgtcttctttacttcttaaaaaaaaaaaaa

SEQ ID NO: 16307 - DNA, 188 bp, Homo sapiens
ctagaaggaaaaccactttccccatggcccagctcatggcaccttctcagaaatttgtggattctcccacagagcctccagaggaaccagctcggcccacacccatgctggatcccagcatgacccatttggacttcttacctacaaactggaagataataaattgtgttattcgaaaaaaaaaaaaa

SEQ ID NO: 16308 - DNA, 1076 bp, Homo sapiens
  misc_feature (1)...(1076): n = A,T,C or G
ggagaaagagtnnggtgggggggggggggncgtttntttggtgaagagaggggagaagagaaaaagggggcctggnggggggaacaaagaangcgggcctcncggggggggaacangcgccacagaagaaaaaaaaaacaaagagaggccgtcgcgggggggaggaaaaccggagaacgagcgacancacaacgagggaaccagagagccgcaaagcggaacggacaaggaggagagagagggaggagggaaaaagagggcggaagaggccggaggagccacagaaggaaaaacagaaacgacgggcgaaaccgccaccaacaaacaaaaaaacaaaagcaccacaaggggagaggacaaggaggaaacacgcaaaaccgagagagacaaagaaacaacgggagaccgaggacggcggcgggacaccagagacaagagacgcagaagaaggaacagaaagaagcggggcggaaagggaaggaggcctgaaggacgcggcaggagaagggcaaaaaagaggaggagggcgagggacggagaagagcacggcgcaagacgagacaggaaaagaggaggagcccacgcgagccagcaccgctagagcagcgcgacacagaagagaccgcagaacgaaaaccgaaagagagagaagaaccccgggcaggcgggagcggagcagaaggagggggggaggagaggcgaggaaagggagaagaggagcgacagggaaagggagaagagacgagagaggaaagggaggggcgcgggacgaggcagaagaagaggagagaaagaaaaggggggcgggacaagacgagagcggagagggagaacggcggaggcgccgagcgcaacaggaggggaaggagaagggggaggagaagacgaagagaaagcaagcgcaaacggagcccancaaaagagagacaggagagaagcgaggacaacaacgaaccgtacggagagcagagagcaagaaagaaagaggcgggacgaaagaacagcaaagagaagagggagaggagaaggagcacagaagcagcagcaaaagggagaggaaaagaaagaaaggacaa

SEQ ID NO: 16309 - DNA, 235 bp, Homo sapiens
cagattagttataaattaacagtacaacggagggcggttccaagatggccaaataggaacagctccagtctacagctcccagcatgagcaatgcagaagacggatgatttctgcatttccaactgagatgctgtttcctctgctgaatataccatggtccccccatcacttggcgaacttcaattcattctacaattggcaagaaataaattattattttctaaaaaaaaaaaaa

SEQ ID NO: 16310 - DNA, 487 bp, Homo sapiens
gtggagtgaatggcatgatctcggctcactacaaactctgcctcccaggttcaagtgattctcctgcctcagccacctgagtagctggggttacaggtgcccgccaccacgctcagttaatttttgtatttttagtagagatggggtttaccatgttggccaggctagtctcgaactcctgacttcaaatgatccactcgcctcggcctcccaaagtgctgggattacaggcgtgagccactgcacccagcccaaactctctgtttcttcacctactagaggtgaggcagctttatctaattggggagaaaaaataaaagtggttccatggctatgcatcacatccaaaaactaaatgttaaatgttgtatatccaaattcttaaaatacattggtccttatctcctccaggggatattgcctttaaccatgttaatgggactattctacctcaataaattcttttcatctctgaaaaaaaaaaaaa

SEQ ID NO: 16311 - DNA, 750 bp, Homo sapiens
gatgttgccaactctaccccactctcccctgcccaccatctaaggaagcctcaacttccagatgatacttctacaagatgaaggattcattacgtttcaacataaagaacagttgccccaaagagttttccagatctgcagagaacgtcaacccaagaaaaaaaaaattgtactgagcctgtaaaatttagggattatttgttgcctcattataatctaacctatcgtcaatgatagcattgtctagaaggttagaacactgaaatgccaaaggagaatagcatgaccccccataagaatggagccatcacaaatcacccacaacactgcaaaggaaatgttccaacagcaagctctgatgttagtatgagcaaattacataatgagctcaaaatgctgtgtttgttagaccatccttgaatacttaaatacaattgtacagtttactgttttttgaaatgaaagcaagaataaaaaactcaaactcatataaaaaaaacctaaatccactaccacctcacccataaccccaccaccacatacccccccctctactcttcccgcctcactctctattttccttgcgatctcctcacatactcacccagctacttatacttatgttttgttaccaccgcgcctccgcgtatctccttattccctatatgttcacctcactacctcccccctcagctgtttcaccactcctccctcgcagtctcctcccgaaacgcaagctaatataactat

SEQ ID NO: 16312 - DNA, 756 bp, Homo sapiens
atgggtcatgggcctcgcatcaattgtgccacaggccagtaccagaggatgaacaagcctcttctagactgggaaagaaactttgctgcagtcctggatggagcaaaaggccacagtgatgatgactatgatgaccctgagcttcggatggaagagacatggcagtcgattaaaattttaccagcccggcctataaaggaatctgaatatgcagatactcactatttcaaggttgcaatggacactccccttccgttagacaccaggacctctatctccattggacagccgacctggaacacacagacgaggttggaaagagtggacaaacccatttccaaggacgtcagaagccaaaacattaaaggctcacagaggagactctgaactttggacttttgagttggtagtggaatgagttaagaatttggggctacaaggaagaatgaatatatttgtatgtgaggacatgcatttcggtgaaccaggggtggaatgctggtttgaatgtcccctccaaaactcatgctgaaacttcatccccagtgtggcagtattgagaggagatgcatccgtaagaaagaacaagattcctttaccacctcctcggtaaaacactataaaatagcattttttttcgctatacaatgaaataatttgtgccagcatctgagaaagagaaacacaaacatttgacattgaaaatctaatatgatttcagagtgagagacggatgtggaaaaaaaaaaactattt

SEQ ID NO: 16313 - DNA, 500 bp, Homo sapiens
agctaagtaaaaattggcaagatcctgtgacaagatcctgtgacaagatcctgtgatcaagacaaagttttgcccccaaaggacttgaggctatctgggaattccatgtttgacagaagcgctgacagcataaccaagcaaacaagaaggtattcagggacgctgaaacggatcttcaaagaagactcagtgggtgatttttaatttctgtgtagtattatagagcttaatgcagaacataccaaaaccttggagaggtaatgatagggtcatgcatttcataaggcagagtaatgccctgcaacaacaaaataaagtcaaagagttctacactgagccatgaaccactaaatggggaataccaacaaaataacaccacctgggtgaaatctgcttcctgcgtagataggttctttcaaccaccaaccctaggctttccagctgttaagcacttaatcatgaaatataataataaagatgtttcaggaaaaaaaaaaaaa

SEQ ID NO: 16314 - DNA, 152 bp, Homo sapiens
ggcgggtccgttgaaccaaaaggagtccttgaacctggatgaactgaatgaagaatgatccctcctatctcaaagtttttaaattaaagtttgcttaccatgaaaaataaaaaaaaaaaagaaaaaaaaaaaagaaaagaaaaaaaaaaaaa

SEQ ID NO: 16315 - DNA, 132 bp, Homo sapiens
tagggggatcttcaaagaaggtagaagggaagccttctctccatctctacgctacaaaatatgttattgagaattctgtcgtacttcatgcttattaataaagtcttaggtcattatttaaaaaaaaaaaaa

SEQ ID NO: 16316 - DNA, 481 bp, Homo sapiens
atgggacccaatgaaggattcctagagtgtgaagccaccagatggaaagaatctggatccctaaaacacaggaaagatcactcagtcgtccaacaactatgacatgagtgagaaaaaaaacatggattctgatactgaatgttccaggccttggcaccatttgtttctgctctgatcatggaggctggctcagctgaacttgcagcagttggacttttacctctctgtacatcgagggctagcaccatttcctgttgatgagtgtcttctttgcttttatttttgcttagccaaacttccatcttgccaaaatacctcctttagattttgcttttcagggtgaaagaagaaataaagaagttcagatgctgcctgatttaactctgatttgaaaaataaatgcacccaacaaaccaacatgtaatcctagtctggacttaagctgttattaaacaccacttcttacccaaaaaaaaaaaaa

SEQ ID NO: 16317 - DNA, 457 bp, Homo sapiens
acatccttgttctagtctttaagaatgaaagtccaggctcttcatcacactttgctgatatggatgagggctgcacctttcctggccatttggctagagacggctgattttcattgctattttactgtttttgtttctgcacattgatgtttccaggttaccggcttcttcagttctaagcctgagatatatgagtcaaaaagaaaactcagaaaactctctaccatgttgttcttcaggtgtcagatttcctatctggtatgccttcttctttctacctttcagcatctttatatgtttgttttatatataattcccaagatttctcattttgtttagttgaaggaatagagaaaagcacatctgttctatcttcctggaagtgaaaacctacaacacctaaaaaaacagtattatgtacaataaactgcgcatatttaaagcaaaaaaaaaaaaa

SEQ ID NO: 16318 - DNA, 764 bp, Homo sapiens
cctagatggaaatcagcttccagtgtgaaccactctatggacagactcaaatggaaaagaactgatggagaccctcagctcacgactggcaaggaattgacatcctcagttcaaaaacctgtgaagagctggatcctgccaacaaccacgtgactgagcttggaagaaaatccttcctcaaatgaaccttaagatacctgaaaccccagtggaatccttgattgcttaattgtaagagactatgagcaggaatatccaacctaagtgaaaacacaggaactgtaagataataaatgtgtgttttagtaagctgccaaattttcagataatttgttaagcagcaatagatatttaatacacactacttatgaacagatgctcctagacttacaataagcttgtccaacctgtggtctgcaggccgcatgtggcccaggacagctttgaatgctgtgcaacacaaattcataaactttcttagaacattatgagggttttctgtaattttttttttttttagctcatcagcctttgtgagtactagtgtattttatgtgttgccctaaacaattcttccagtgtggctcaggaaagccaaaagattggatgtacttgacttaaatgaggttacatccagattacccctttagaaattggatatagcacaaatccaaaatacatttaataccctgaaaaatctatctataagttgaaaaatcacaagttgaatcatggttaagtagtgggctgtctgtatactactg

SEQ ID NO: 16319 - DNA, 786 bp, Homo sapiens
  misc_feature (1)...(786): n = A,T,C or G
tttgagaaactcctggnatttattttcctccaaacaacagaccaaacaaaaaggaagccatggaatntagatcgagatacaaaacaaaagaaatgaaatgaatcctcaagatgatagtgagggaagatgccaagatgcttgatgctggtgtaaaggtcaaactggaagacatcagaaggcttgagaaaagactccgaaagcaagaaattgatctacatatagataattttaactgaaaatatatcaaacccttagaaatgctcaatttaaactttgtcctgacaaaaaaaaaaataaaaaatggctctctctgtcttcactctctggtactctgtttgtcgctccgctttagcgagggttcaggttttgagcctttctccctcactcctttccctcggtcctttccttgctgatatttgtttttttttaatctttcatttgcttattctttaatcctctatttatatgtttaactgttttgatttagcttctgttcaataatcgcccccctcccgtccaccaaccctccaatcgtcctccttgtttctctcttatttttccccctcccccccttcttctctcttttcacatatattatcgtatactctattttttttcccttttttcttttatttttccccatctcattctctttttctccttttatctctcctgttttcttgttctttcctcttggctctccccttgtgtcctgttcttgtcctcttttccttcctttttgcacgattgatttcttctttatttttccttattttgtatttccct

SEQ ID NO: 16320 - DNA, 350 bp, Homo sapiens
ttccagaaaaaacaggctggtagaaactctgtgacatgaaagaagtcattttactctcaattaatccaggacttactgacccagcactgtctgaggattaagagactcaaaggaagctgtgattaccccaactcgagttgcagagaaaagaataacgtgccggaaagtcagaaaccaggcaacatcgcaacatcaggatgtataaagaactagactgcttgagtccctaacctggtctgccacttacaggctgtgtggactaagctaggcaagttctttaacttctctgtgcctcagtttcctcatctagaacatggcaatataagtatctatcttgcataacaaacaaa

SEQ ID NO: 16321 - DNA, 264 bp, Homo sapiens
ggtggatcctcaaaagaatggcccgtgaagagacagacaagtgcacaagtagagaatgcacgtgaacatgaagaggtgggggtgatgcatccacaagccaaagcgtgctacagatagcccaaaaataccagaagctaggagagaggcctggaacaggtttttcctctcagccctcagaaagaaccaaccaacatcctgatctcagacctctaggcacaagaactgtggaacaataaatttctgtttaagccaaaaaaaaaaaaa

SEQ ID NO: 16322 - DNA, 217 bp, Homo sapiens
  misc_feature (1)...(217): n = A,T,C or G
ctagagnaagctcactctacagcagttgcagtgagtcacaaggacaagaaccaaatgatatggacgaccccattacaacaactcaagctggtgtaaacattctcacatggcatgagaatgaaacataatgcagtgctccctctccccagacctgggtcacattcctctatggattaaatgcaatagcagttaggttttaattgcaaaaaaaaaaaaa

SEQ ID NO: 16323 - DNA, 507 bp, Homo sapiens
atccttatgaataggctccaaaaaaggctaagttctaacggcttttattgtgccagaattggctttacgcatcttgcttacattttttggagggaaaaaaaaaacagtctctgtgagatataaagcttctcccactactcacttttgatttctgtacgcttgatatatggttgccaggctccctaggatgagagacatgaggaggaggcacagaattgctaggggtttccactaaaaagcccagcaccgtaggcagcactaatcctgcacctgtgatatgttattcagcagttaagaaatgcagcccagactgtggttgcctaatacagctcagctatttttctcagtagtccctttgattataagctggcaagagacattattccggtcaagcaatgagctatgttcaggacccatggcatatgacagtggaaaggtaaaaaagaaaggaaacctaggagtcaaaaacaaaacaaaacaaaacataacaaaagaaaaaaaaaaaaa

SEQ ID NO: 16324 - DNA, 179 bp, Homo sapiens
cctggtgaaacacaaatctgtcttgatgggatgcaccactaagtacatggtctgattgttccagttatcctgtgccaaaaagaagcaaaaaacgggctttccacggattattgaacacggtgtcagtgtgcctgagaaacaagcctctattaaaagctttctaggcaaaaaaaaaaaaa

SEQ ID NO: 16325 - DNA, 118 bp, Homo sapiens
aggtacaatcccaagaagaaccttgagaaggctcaacaggactttaagaagtcttggaatcgcgccactgcactccagcctggtggcagaacaagactccatctcaaaaaaaaaaaaa

SEQ ID NO: 16326 - DNA, 142 bp, Homo sapiens
cttgaaggagcagttggctggcttccagcgagcaggaccacaaaagaccctaggtccggcagcatcttgattttggacttcggatcctccagaactatgataaataaatgtttgttgtcttagtcactcaaaaaaaaaaaaa

SEQ ID NO: 16327 - DNA, 755 bp, Homo sapiens
  misc_feature (1)...(755): n = A,T,C or G
ttttangcgcaactggnacccggncttgccagggcncaccaaccccgacacggnggcnggaaggaagcaagctgaagccgccngcaaggccccagcaacacccaccagaagcaacnagggaacgaaggggcncaacngcgcgcggcaccaggcaagcccgccgacgaacccaccaaccnacgagaaccagaaggaaaaagacaaaagaaaagaaaacaaccgaggaagcatttttttgaataaaccaaactagggactaaaaaaaaaaaacaaaaaaggcctacggtggccccaggggtggagctctggagtcgattgcctccaccgacggttatttaatggatcctggctcacatgactccccgagaccagaagagccacctgccgcaacgggcaacacgctccctccagaggcgaacaaacggattcccgccacaatcacggcataatacccgcaagcaacatgctgtccccccgcccgtctaaggcctataccataaaaaagtcccgtacaatggcgtaatgacagaggaagcctcccacggacgggcgatagagaaatgcacactaaaggcaaaggggggatcatcggccagaactactacaaacccacaggccccagcgggggctcccacacgcgtgaaaatgtccaaacactccactaaacagatgcaaaacaaaaccctcactaggaaaggaggagagatctatagataacgtaaaggccctggagatgagaagcacgaaaggcaact

SEQ ID NO: 16328 - DNA, 412 bp, Homo sapiens
taggagctcatgacagaaaagtccccggttcaatggacctgcttttgtgctggaaggggcacggagctttgacttctcctcgctggggctgcctctgattcctccttcctccatactcccaaggcacctgaggtctggctcttcaggctgtgtgacgacagggactttaaagaggcaatgaaggtaaaatgagatcatcaggatggactccgatataaccggtgtccttacaagaagagaagacgggacacgcacacaaagcgagggtcagccatgtgaggacagtgagaaggcggccgtcgacacgccaaggagagaggcctgcgaagaaaccaaccttacaccttgacatcagacttctggtctccaaaactgtaggaaaataaatttctcttgtttaaaaaaaaaaaaa

SEQ ID NO: 16329 - DNA, 476 bp, Homo sapiens
  misc_feature (1)...(476): n = A,T,C or G
ccttgacagggacgggngtttcacctttgttggcccagacagtctccaactcctgccctcaagtgatccaccttccttggcctcccaaagtgctgagattacaaagttcagagttcaacttctgctcttaaatctcaacacggagttactttcttcaagttccaggctacaagactctgtttggaggatacctgtcatttatttatgatcccctgggcagctgagaaattgtgttgctgctaaggaaagagcgaagccaaagaggctgatgttgtcgctcgaccttgcttggttgtcctggaagcatctcctaaccagcagaagatgtgacccactggctctttgtgcataagtgtctagtccgaaaagaagtggcctggtcttttctatattgaaattccattgcttactttcctggcagctgcataattgggaatgccgtgaaataaaaatgaggaggaggaaaaaaaaaaaaa

SEQ ID NO: 16330 - DNA, 573 bp, Homo sapiens
ctagcttacctgagcctgcagctcctgagatcgcacacagcccttcggctgcaaccattctttccgtcagagtcatcatcagctgtcgggctttggagctggaacacttaaactggtccacaagaaagcgctggatatttgccatctgtttccagaaagcttccatctgtgaaatgagcacaagcagcaagaagtgaggtgaaaaacttacttaagaaagccaaacggtgcgtgctcgggaattacaattcaccccctatcacaaacaaagattctaaacaattctacagtttcagtgagtttatcttggcaacaatcacgttctacagtgaagttctttctggttccattgtctggttccagtgtcagtcagttttgcaatggtgtttcagcagacacgagagcactgctgctaaggaaagaaagcagtagcttgtccagcctacagactcttgcacaggtcattacagctacctaggggccgatgaaatgtgacaatgtgctcatggaagctttggcaattttaaatgggattaaatacttccaggaagtagaagcataaaaaaaaaaaaa

SEQ ID NO: 16331 - DNA, 763 bp, Homo sapiens
  misc_feature (1)...(763): n = A,T,C or G
tttcaaatttagttcttgctgccttnatggagtacaacggtgtgatatcggctcaccacaacctccaccttccgggttcaagccattctcctgcctcagcctcctgagtagctgggattacaggtgcctgccaccacacccagctaatttattttgtgtttttagtagagatggagtttcaccatgttggccaggctggtcttgtactcttgacctcaggtgacctgcctgtcttggcctccccaagtgctgggattacaggcatgagccaccacgcccagcctgactcatgcattcctattgaacagtactacactattacatgttggtgtgtatatccatttaaattgttcaataaatataattttaatggttaaaaaaagaaagcagagcgaacaaaaacaaaaaacacaggagaaggaagagtttaggaaaaaatatatatatcgtaacagtcaatctagttaaaataatgggctctaattgtcctaagtggggagccttttgccaccatttgcttttggggggggttttcgcaggacccaggatccactgcatcaaggatcaagaaaaggcggttcgctataccggtttaacttttctataaggtagtatttcgggtattattctaaatcctgggcaccccctagaaaaaaccatggnaaggctcgggcctctaagagggtctaatcccttaccagcggccacatctcccaatccttttgtcttagcgtctccctcctttattccctgttcaatacgt

SEQ ID NO: 16332 - DNA, 245 bp, Homo sapiens
  misc_feature (1)...(245): n = A,T,C or G
ctttggccctgatcngcaagtaagaggaagtagcaggactcaaacccagacagcctgtcaactggccaccaagcataattatcatgcctgcttggtttcacatcctcagaggtcaagatgttcatacccacagagaacgggagagaacaccaggtgcatccagataaatcaagacaatggggaacagaagatatttccagtgctctaggaaataaatattttcacctaacctaaaaaaaaaaaaa

SEQ ID NO: 16333 - DNA, 837 bp, Homo sapiens
  misc_feature (1)...(837): n = A,T,C or G
gaaaaagaaagaaaannnagnaatcanagtagaagnaataaaanaagaagaaattaagcaaacaaaaaactaatttgactgcctcttgcatataacaaaaatttgaatgcaatgactcctttgaactcaacaaaggagtgataattgaactattttaaaaaggctggctggatccattaataaaaaagcgtgtatctgcctatccatattagcagaaaaaacaaaaaaatggacccactgacctcacacgaagaaatatacagacactcaccttaattgagggttaatacatgatcctcactaactgactcgttgaaccaagcccccaacatgccacaaccgccaacacctaactccaaagccaacatcaccacaacacacagaccccagggataacgcccgaacaccatcccaccaaaccgccaacacacagacacaaccgcccctctcgtcccttacctgccctcagatcctaacacaccccaccccataaaaatctatacgtatatactaatctctaaccaacaagttcttcaaacaccctcccacccactatcactttccccccaattcaatacattatcacctacctcaactcactccaactgaaccacccccctcctactcacaacaatccacaaaacccatccctcaacaccacgtatctcatactccatatttattaacacccaactcccacacctatcttttcaattacaccgaaccaccaacccccacatcacccccacacccaaaaacccctccaccccactccctcctctctcactacacaatccaactcttccactttcaacactaatcactctcttattctat

SEQ ID NO: 16334 - DNA, 775 bp, Homo sapiens
  misc_feature (1)...(775): n = A,T,C or G
ctagggagaccagcaatcaatatttcggaagaagtacatnntggttcggagacacatcaattaacatatggactaagtacatgggttcggtctggaaaggcgggacaacttgaagcaaaggcaggaagactccaagcagggagggagcttcccggtttcagcttctactcctgccttgaaaaattcttgcctgcaaaccatttgggaggccaggatttgaagatgagctgtctggtccagcttgtttggcaccctgaaaataaatgacttcctttctgccactgcaacctcagtgtggatatctggttttactgtgttggcttctgccacttctcccaggatcacatctgcagctgtcagggcaagtggagtgtgccagaatctcttggctagatcaccaaaatcaagcagagaaaataaaaattttaactcaatcctcccaagttcacagttggaacagactcctgtaacacgagactgattgacaaaagaaaaataggtgacttattaacacatgcagtgcacatcacctgtgagataaggaactcaaagcagcgatctaggacttacataaacaaagaacaataagctttatacaagtgacacgacaaagaaaagcagtgcccgacttgcaaacaccacaaactgtgggaaggtacatatatgggaaataccctaacgaagcacaaaatgtggtgacagatttctgtgacccattactgacctgatgaccgctggagtggagaatttccctaccagtacatgggaaaaacct

SEQ ID NO: 16335 - DNA, 157 bp, Homo sapiens
  misc_feature (1)...(157): n = A,T,C or G
cttgnaggaacgccatgtgagggtcagtgagaaggcgaccatctgcaaaccaagaaaagaggcctcaccataaaccaaactggctggcaccttgatctgggacttctccagaactgtgagaaataaatgtctgttgtttaagccaaaaaaaaaaaaa

SEQ ID NO: 16336 - DNA, 775 bp, Homo sapiens
  misc_feature (1)...(775): n = A,T,C or G
ccttgnctgccatcgccctgaaggctttcaaagatggacaaggaagaaaggagagaagaaaatgtgatgtggttgcgggaggaaggaaaaacttcataaaaacacgacggcagaaatgtggtattttaagcaagacgtttgcccttcatatgaatgattcttggatttttggtgtatatttttggtggcagtatgcggtgaccttagaatttcatccactgaagagcctttttctattttcctttcctttgaatctgggctggccctgtaacttgttttgggcaatagaatgtggtggaagtgatggtgggccagttccaggtccaggtctcaaaaggccttgagtgttttcacttacttctgtgtttgccacgagaacatatccaggttatcctgttggaagatgggacatgaggagcagagttgagtcattctagccattgcagctgaggttatactagattagctgagctgcagatgactgtaagatccatgagtgagtccagttgaaatcagaagcactgtgcatctgagcccaccctaaattggcaacccacagacttgtgaacacaataaatggatattgcttgaacaacaaatatataacaaataatgtccttttttggcctcattggtggacctcttggcgaccatatcctttattgagggataattattgaacctcggtcactgactctatgtcccttgtactctccggtgacgccatgctgtattcactcccctcaaggtctattttcctgacattctaccacat

SEQ ID NO: 16337 - DNA, 395 bp, Homo sapiens
cttcagtgaattctacaaactaagctctggaagaatgtcgagatgttacagtgaaaaaggaagctaaatgaggccagattggagagcaaattgttattatttaaaacttatggaccacctcgaatatgccaagttctatttaagaaaatacagaaacatgattcctttcatttaacagctaacattttcaggaagtatacaccacatttttgtgtgtgttttactccacatactgccaatatttaaacttgcttagtttgaggaatttcctcttattagttttctttttctcaacattttttttagagtggttctctttcttttttaaattttgtttctgttctctttcctgtttttaaaaataaaaatagagactatgatcaaaaaaaaaaaaa

SEQ ID NO: 16338 - DNA, 420 bp, Homo sapiens
  misc_feature (1)...(420): n = A,T,C or G
ttaggcatgtttgtggccttagtagctgggnacaanngcttgtgaccatttgaaaagaacaggaagagatgaatatcagagatccacaagacagtctgactcaatatggagaatgaaaaatgaatccaataaatatgtatgtgggctggaggtccctgatgtagtgagtcaagatatggattattttagaaatggtataaatttgagaagtgtaaaaaataacagactatgttatatttagcttgaagctgcaatgaactgtctcatatatgttgagctaatgttcagttccctgctgacacctttcatactagtaggcctgttttgttttgttttgttttttggtagagaaataatcagttctttggcactgtgattattaaaccaaaacattcaatactctctcgaaaaaaaaaaaaa

SEQ ID NO: 16339 - DNA, 897 bp, Homo sapiens
  misc_feature (1)...(897): n = A,T,C or G
ctcagatggctactattaaaacaacacagaaataagtgttggtgaggatgtggataaacggtaaccctcgtacattgttggaacatcaagatgaagatcaaggagatcccttttcttcaaaacattgctgaaaaagatagtgtaacaacattgcagaaaaaatttaaaaaacacagaggacaccatcaaaactttgtccttgggggctgggcacggtggctcatgcctgtaatcccagcaccttgggaggccaaggcaggcggatcatttgaggtcaggagtttgagaccagcctggccaacatggtgaaactctgtctctactaaaaatacaaaaattagccaggcgtggtggcgcgtgcctgtaatctcagctactctgaggcaggagaattgcttgaactcaggaggttgaggttgcagtgagccaagattgcgccattgcattctagcctgtgcgacacagactccatctcaaaaaacaaaaacaaaaacaaaaacaaatacctttgtccttggagaacatctccaatgcccagccaggtcttagctcagaaggaacctgactattggagtcatttcctgtggctcacccagtgaagagatcttaccaccccacagccacttggagagccccgtgcattgaagacactggngtttgcccntgngtatatagcaattgaagatcatttgtgaaggactgatattgaagaaggcaggggctatgctggcttattcattcatccaacaactactatactgtgctattgaataccataatattttccttatttgtacagggtctactatttttcttttttatggctgagtagcagacacacccaaatctactaaacctattctttggggattgtagaccattaactatgcccattat

SEQ ID NO: 16340 - DNA, 623 bp, Homo sapiens
ctagaagctagaatattttaccttaatgaagagagccttgattaagagatataattaaggatcctgagatgtggaaattatcctgcactatcctgtgaagctcaatgtaatcacaacggtccttaaaagtggaaaagaagtcagaagagagaggcagagaaaaattttattacaaaagtggagatagataaagaaaaaatctaaattcaatggtttcaattgatgcttaaagactattttcatcaaaactaccagatttctatcacctactgtggatcagaacttcaattttgatggtactaaaatttgaaaggtaaattttatcaagtatggcataacagactattattcagtgtaatagaagtaaaataatttatatatcatcttttaatttgtataacaaatgttaaaaatcttaaatgaaaacgattaaatttaatctactctggcttttactttgggttacattcaaagaaactctgtaatggaaaaactgtaatgaaaactaaaactatgtcacagaaaataaaaagtcattttatcaaaaatatgtactttttaaacttataaataataaatgaagaacgggaatcaaaataatattcctttgaaaaaaaaaaaaa

SEQ ID NO: 16341 - DNA, 213 bp, Homo sapiens
aggacttgtaggacagatactcaaatcacagcatggtagaggataatcagagaagattccctaccaggatcaactcagcctgggaggacatccaggaatcctggacgaaacttcagaaaccttctcaaaatagccttgtaggtgactacctcctataaattggaattagcataagatattaaatctatttgccatacctgaaaaaaaaaaaaa

SEQ ID NO: 16342 - DNA, 786 bp, Homo sapiens
cctagaaagcacaagattcttgcaattcaaactgtgtccggaattggtgggttcttggtctcactgacttcaagaatgaagccacggaccctggcagtgagtgttacagctcctaaggtggcgtttctggagtctgtctcttctgatgttcagatgtgttcggagtttcttccttctggtgggctcgtggtctcgctggctcaggagtgaagctgcagatcttcacggttgctagtaacacaataataaagctgctttattttccagtgaagatgtatgtgatagggagtggaggaagaaaaaggccagaaaattccatagttagcaaatatacctttcttacttaaaattctttttccaatgtgagccttctaaagagttactgagaaattaggtgagctcacctcatttaatgcaatagatatgtttctgaaaaataagcaatacataggacattggccaattaagaattttgatgaagaagaattttcacatccgatagagtaaaaatgaaaaacggtacaaatgtagcggcttttaaatttcaaaacacattattttgataagatcaatattcctctcataaagcgaaaacggaagagactgctcgctgggtgttcgtcaaatggagttagatggcctgtcccacactcccctgttgttagttcttgaaacaggaagaatggtgcttcttcaggactggcccatgaaaccctgccgggttcaccccccacaattctctctcttctgctggctggaaccaatgaccacccaacctcacgtttg

SEQ ID NO: 16343 - DNA, 363 bp, Homo sapiens
cctgtgtatcatgtgaataatttttggccaataagacaagcaaaagaattgtgtgcaacttctgggaagagaagagatgtgacttccttcatcttgttcttcaccttgctgtctggaatatgaacttgatggctggaacttgagcagccttcttggatcagaaggcggcctgggaataggaatagagctgaagagaagccgctgcattcttgaaaattataaagatgccatgccgtttcagcttgctttcctgtggacttcatttatatgtatgaaataaaagtttatattgtttaaaaaaaaaaaacgaaaaaaacacccacactaccaccaccccacaccaacacaggaaaaaaaaaaaaa

SEQ ID NO: 16344 - DNA, 778 bp, Homo sapiens
agaaaagaaaactgcagtgcacgaaacaaaattcagagagcacaataagtcttccacagcctgttgctatcaggcaagccattgttcaggcctgggtgttcagggccacagcctggaaagagatgcagcttcctcacttcctgggcaattcactcggaatcgcattgcctctgtgaaaagaaaaacccagatcctggaaggggaaagccagctcctgccttctttggccgcccacttcgcttagggtgggcgtattctgatgagggggcaccatcaccctggcattgactcacgatcccagcaccaatgaatgcaggaaggcactgctctcctcctgtaactccatggtgcctgagatgacattcctttaataaataaacaaacaaacaaacaaacaaactccaaaatgtcatcctgatgctatcatatatttgatcttggtattctcttccaaaaaggatggggaaggcagggtgggatatatttcagcagccaccttggacttttagctttccttgctctgcctccaatgattagctgtgaggagccctcaaaatatattttaaaggacttcgtgtggctcacaggggcttctacccagatcacctcctgtctctcctaccttgaatgttatgatccaggaataagtaactacctacagttttatgggcacattttaaaatcccatgcccctgtgacatttcagttaaaaaccacctcttctaaaaagttttccatacctaaattaacactctggaaagcttaatattttctgctt

SEQ ID NO: 16345 - DNA, 230 bp, Homo sapiens
gccactggagggttcttttggaacccagaagaacagataaaggaggtgtttattcatgaaaccaacacttaaaagactgcatcaacagttccagctccatgattacaagctcctcgaagacatgaaccacatcacacctctcctgtgtggctaacgccaactgcacatgtagaacggtgttcctcctatgcttgggacaaataaatctcacaaaatcaaaaaaaaaaaaa

SEQ ID NO: 16346 - DNA, 822 bp, Homo sapiens
  misc_feature (1)...(822): n = A,T,C or G
ccggnnnnnnnnnnnnnnnnnnnnnnnnnnttccaggttcggctataaaaaagcagaaaaaactccacactggtatggaggagatcctaatgaatgaaaaagtcgaatactacatactacctaatgtcgattatttttatatacaaccaaaccttgttagtaaagagataagatgtggtactatctgtgtaactctgataaccactcatcaccatgggtctgagagatgcgccgtaattggtaaaggaaaactctttgtgagttctcatcttttccgcaataaacttttcaacctgatcactggatgccacgagatggatagagtcacattcattgaatgcattatggttaaatcttccaatagataaggctgtgactaatcataaccaccttatgagacgagaagtgtaacaaccacacccatattggttttcttgtgtttcgtcggtgctcctttcggcacctcccctttagctggcgtcatctgggggccctcccgcactgcctaggtgcaacgcgcgcgataagtacggggggaggttgttctgtgtgattcaaagcgatatacccgcctcccacggaatccccgtatatagtaagagcgaacggatggagaaatttgtcgcccacccttntaaaatctcttcaaaaacttcctgctcgcgttgtccccgtaatttccacgctgtttattaccgccttcaaatgatatagtcgtgtgtgatttctgtgtttagttcttcgattaccccttggatttcctgttgtgatccgttgtgtgttaaccgatttctttactagttagtccgtggttcgtattag

SEQ ID NO: 16347 - DNA, 465 bp, Homo sapiens
  misc_feature (1)...(465): n = A,T,C or G
gaagaaagggnngggnngnngnngnngnggnnggccccctccnntgagaaaaaaaagggnnggttgagttgctnacgnannccnacgccttctcngggggaaccattnngggactacgccaagggtgagctggctccttccacccctgctgagatccctagagctatccagagcctgaaaaaaatagtcaatagtgctcagactggtagcttcaaacagctcacagttaaggaagctgtgctgaatggtttggtggccactgaggtgttgatgtggctttatgtcggagagatttttttcaagcggggcatcattggctatgatgtttgaagaccaatctctaacatctgattatatttgatttattatttgagtgttgctggaccatgcgcgatcacactgctctctgaataaaataacgatccgtcccataaaagaaaacaaatggcctccgttggcctacaa

SEQ ID NO: 16348 - DNA, 459 bp, Homo sapiens
ttcacccttacagtatccggcctactgagaaaatcctttcctttgcaactgctaaatgcaactgcaacttttggatgggagtgaaacatgtggacagcaaagatgaaaagaacttcaccaaatagtgtttctcattactttgaaaaatgtcggccatgtacagcatgcaagaagaaacagtgaagaatgttaacatgctcagcatgggaaaccgagtcatagctttacatcttcacttgattatttccaacattattttacacccttctgatcaaagacttcagttatctcaatttttcagagcatttttggcactggaacatcattaaacaagttctttggaacagtactttgccctattattagtttgacctactacctttcttatattaagctcctcacacacggactatagaataagaaaataaaggttttctaccaatcctaaaaaaaaaaaaa

SEQ ID NO: 16349 - DNA, 733 bp, Homo sapiens
  misc_feature (1)...(733): n = A,T,C or G
gtcaaagtaangtgatcctcccaccttggcctcccaaagtgtgaggattataggtatgagcctccacacctaaccagcatcatactttagattcaaacttcagaaaatggttttgcttcagctttgtctattaagtagaaaataagtttcaaaaccaaagaacaggctaggaagagtttgttaaagggtacaaaattacagctagataggaagaatgagttctagtgttgtacaccactgtagattactatagttagcaataatgtatagctgcaaatagctagaaggagaatattgaacattttaaatatacagaaatgataaatgtttgagatattgaatatgctatttatcctgatccgatcactatgcattctgtgtatggaaacactatgtaccccatgaatatgtataattattttgaatgttaaaaaggagagttaatgctaaatgagtttctgaggggtctaattgtttttggattcataatctgtctttttaatgattagatttgcaggttgacatttgacatttgaggctagggaaacactggtctgttgagtgtaggtttgattcactgtaggtggtgacagcagtttcttatcgtttgggtgttgttttcactgtggttcccaaatggtaaaagcacatgtctgtgagaagtgttggttttttgaagtatataatgacactgacgcgctcgaggcattttgtttgtttcgctacgtattgg

SEQ ID NO: 16350 - DNA, 767 bp, Homo sapiens
cttgggtctacgcctggtgcccattctggagtgcaggggtatgatcacacatcactgcagcctcaacctcctgggttcaagcaatcctctcacctcagcccccggagtacaggattacatttttgaaggaatgactcccaggtccttgggaaacagcctgagagaagatttacatctcaaagagacagagaaataatttacaactacaagttttctaaagtaaatgctctacgaaaagggagatcaggccctatagtcaggaagaagtctgtctaaagcctagtcaaactgagaaaaacattaaggctgtgttggtcaaagacaacaaacaaggatagaaaataaattagtcaagattcattacaagaaacagaaatcactctagttatttaagcaagacggacctgaataatggaattagatgcttacaaaattatcagaaggaaggaaagctgtaggagtaacaccaagaaccacaggtatgactttctggaagatgtcccctcagtcaggatcaggaagatgagaaatataaaagcactcttaggatttttgagttcaagagcccattgtgctaatccaaggaaggttgaccaccaggcagctggcgtttcaatgcacctacgcactgaaatagtgactctacagtgagatctgctgcaaagatccacatagcttcatgacttttttttaccagaagaatttgctaagacacccagaaatggtcttcatcagagcctttcgattttaggtatgttgcttactgg

SEQ ID NO: 16351 - DNA, 772 bp, Homo sapiens
  misc_feature (1)...(772): n = A,T,C or G
cttgaaggcctcanaccaaaagaattcttatgcaaaacattctaagcctctcagttattttaaaagaagctgaaaaaaatgatgagcatttctcttaggcctgcgcacagagtctgcagtgccctgttttgtaccccacaaaagagaggtttggcaaagtcacagcatctggtgcagcatggaatctgaggcaaagaagagattactataaacatatctaggccaaaatgcatggagttcaagaagaggaaaaagcaaagaatcgtaagattcagaaagaagagcctctctctgttgcccaggctagagggaagtggcatgatctcggcttcttggctcactgcaatctccgtctcccagattcaagcaattctcttgcctcagcctcccaagtagctggaattacaggcacccaacaccacgcctggctaatttttgtatttttagtagagacggggtttcaccatactggtaaggctggtctcgaactgctgacctcaagtggtccgccccccaccttggcctcccaaagtgctggaactacaggcgtgagccaccactcctggctaaaataatttcttatcacaagaaaactccatagggttatacaagtgacatagaagcaaattcagccttggcctctgatctttggtggtcgaacaaagaaggaaatcactggagggctggaggtggatgaatgaaagccataaaataaaaatgagccccagcgtgcttgatgaccaccctgtttgaacaataccggttccaataa

SEQ ID NO: 16352 - DNA, 763 bp, Homo sapiens
cttatagttactggaccgaacgtcaaacggtgaactcttgtctgtgtaatccacagaatagactgagatctctgttgttactcaagatgactacttcaaggcttcttccctcatgattgcaaaatggctgcaacagctccaagcatgacattatctcccatcatcatccaaatgacagaaacagaaagactctgtgatttcttcttttttgagattaaggaaatcttttctagaattacctacagcagacttttcattgactacaattgtggcacatgccccatcctgaactcatcactaccatgggaaacataactacatttttggacacacactgatcaaggtttacaccttgaaactgtaacggggtccctataccaagaactatctgctgctcagtgtctgaccatacattataatgtattaacaaagaagaatgcgaggatcactgtatggttgggtgaccagcagctgaagtcacaatactcatatacttcatgtagtcactaaggtgaatgacaacaacattggggtctgatgatgaacaaatttaaaaaaactccagcgcctgtttattgacgataatacagacccctagaccacgcgtcctatatctcctttatatcagatttcttagttctaacaatttctcacacctactgtctttgctttttatctcaatcaatacataattggttacactacactactcataacactcaaattcatacgatgttccatcccgaccacacacaccaaccca

SEQ ID NO: 16353 - DNA, 792 bp, Homo sapiens
tttaacattgacacgcagtgtattaaaagtgtaatctctgacagaggagaagcaaatgaggtgagactcacaagtgccccagctgacaacctggagagagtttccacgccaccatacagaccctgtaggggacccactgtctccaggcctacgtttgctcatctgaaaagcgaggggtgggccagacaccccggcatgagctttgacattttaggatcccaaccttcccgctgtggatgcagaagttgctcttaagatcccaatcttaccgctgtggatgaaaaatgggatcctcttcagatcagaataaatggtgtttggatcttctttccattttcctaacggtgcatggagctattctgctaatgtatctttcgccttttgtccttatttctaatttggtttatttatatcaatgggtgaggattgtatgctttatttgatgtctgtttaggtgttattgtgttgtgcttttggagttgattttgtctattgatgttctgtagtagaatattaggaatctatgtcattgtgtgtgttacatttatgtgtagttttttttgattttttttcctcgcaatgttattatatgacttttttaacttaccacgtatagttattatttctatttttatttttttttatattgtcatttctatattttctgatcaactgtatatctatcatcgtgccctctctttccacttgtcttgttttagtatgtttctttctatccttgtttgttatagtctgattctgatacatacagcatacaatatgtaaccataagtg

SEQ ID NO: 16354 - DNA, 780 bp, Homo sapiens
ctaggtgcgaagtttaagaaatcttgttcacacaaatagcatacataaattttggaagcactgcattacagtaaagggtctctgaaataatcttccttcaagagcaaagaaagtttgtctcgtctacttaattaaattctccagaataactcctggtgctttccaaatatatgactatctgaacgaaatgggacccccatctcctgctacttctggagaacaaacaacccactcaaaaccatttacccatcatcactgtccagatcattgcacaggattttaaaggaaaaataaggtgatgttgctgattttcagaaatattttcagcttcagatatctgtgataaaaatgagaaaaaagaagtggatgttctgtcagaaggtattggtgagataggagacccagaattgggagaagcagcttagatggagagcaacttaaatgggagaagtgatgaacatgcgtgagaaaaaagtgactctgctccctttgtgatcggggcgaacatgactaactggtccaggaatttgtttcatttggtcacgaatgggctttgcaaatccttcctagtgacatgacagtgtcacctactgggcaagcaggaccctatgaggcatctaaagggagatttagccagatatgttgtttatcagaagccagggacctcctccactttgcatcctccctacttttcctttctacagaaatgattttttttaagaacgtattttaataaacatactactttgtgctcaccacttctctaaaggcttttatata

SEQ ID NO: 16355 - DNA, 562 bp, Homo sapiens
  misc_feature (1)...(562): n = A,T,C or G
ttgatcagatcttatttggagaaatcanaaatcccacaacccaaaggatgggattttacatcaagacatctcccaggctgacatttcatggcaacctacggaagctgttctgatgagcctctgtgttagtaaagaatacatctctataaatggactgcagtacagctgaccttggacaggcttatttgggcctaactgggttctaagctttctgctgggttcagctctttgtacttcaggcaacaacacctgagaggatttttctggcaggcgaaaaaatgtttgcaatgactttgatgatacggcgactgaggtgtatttatccttaggtgcataagcaatggcacacaaccaaagactggctgctaccttcacattccttctaaaggggctaaaaggaagaagtatggaaaaatgtatccactcaagtagaaattttatattgagtgtgcagttttgattttgaatgtctgattttgtttgtaggccaaaaaagactgtgattccaaatttgtaaattaatacaaataaaaattaaaattgcattataaaaaaaaaaaaa

SEQ ID NO: 16356 - DNA, 833 bp, Homo sapiens
  misc_feature (1)...(833): n = A,T,C or G
ggggnnnnnnnnnnnnnnnnnnnnnnnnnnnnngggnnnnnaaggnnnnnnnngggnnttttgagnacngaatgctggtggttgtgctggatgcaaagcagaagaagcacgccgaggcccttaagggcgtgcgcaagcntgagcgccggggaagggagctcgcataccaagcggaggaggacgggaagaacctggctggcatgcgtgaccggggggacaagctgagaagcaaggncaagagctagaagcgccaagtggangaggtgaaggtcgacggcaacacctacatggatcaaggaacacaaggaccaacaaaagctaggaagaagcggaggagtgtacacacatggcggaaccccatgcgcacaagttgacgtgcaccaacccagaacgccctgtgccacacgcacagagagtgaccttcctgacccctcttgttctcttagtatgtatttgtatgatgttttatatatgtctgaagccaanctgtccagattttgcttaatctaaatgaggttccagatgtcctgacagttgcctgggaggtgaggaaagaggcgaaccgagagggttatataatgcctatttattgtggacgttgagttttcttgtatntttgtggtcccatcctcgtctcccgatgcgctttgtcctatttcccccttgttcattcaggccctcctgttttatctcggccgttccccccagagcatctgcaaattccacacttgtccctttacgtcagtggcccctcagcgtaccccacatccccatttgatagtctagttctctagtgttgtctctaacgtctgaatcgttctgactacctgtat

SEQ ID NO: 16357 - DNA, 746 bp, Homo sapiens
tatcaaacacatgaaaggcaagaaaacactcgtgaaaagttgagaaaggctgcagaagaaaggaaagagctttatattttagtaccttcaatggaagtattctacttgaacaagtggactcatattttcattttgcactgggccccacagtgtatgtagttcttgtgtgggctccactgtctctgtcactgcagcctctacaatatgacttaggcattgtcctttttatgtcattgctaagtctgactctctgtccctcctacccctaggatttataagtcacctggttcctttgacaaattctttttctgcttaatctagctggggtgggttctattttttgcagttaagcacaccgattgataataaaaataactaaaatttatagatcattactgtatgatagtacatattcccataatggtgaagtatacactattatctataatttacagacaagaaaacctagggttaaagtcaattaaattgtctgagttgaatagccttttgccttcagggccaggattcaaacccatgaaatctatcttccaactacgtgtggagccgtgattatgttaatgattgtacttctatacattgaagatccctatggcaagatccttctttgttctatttatgcccattgtcaactaatcaaaatcccttgttacacactagacagtcattgtataagattagctgatgaatacctaaatagtagggtagatacaataaactgactttag

SEQ ID NO: 16358 - DNA, 390 bp, Homo sapiens
ctagaggaggaggaggtgcactatttagaccacactggtttagaacccttggcctgaaccgacccttcctcttcggcctcccaaggagcaggatttacagatgtgagccgccctgcccagacagcacaactctatttatactactaatcagagaatactttagcaagtgagtcctttccttacaatcaaaggatggagtacaatggaacaggaaagctgcactgaagacaagacttgttgggctaccattcttttggagggacatacaaagactgttatatatcattcggacagactgcgacaaaagccattgtaagttcagtgatatagagatacataacggttcactgattgctgcaaaaaacaaaaagtctggctcgatgagcctca

SEQ ID NO: 16359 - DNA, 823 bp, Homo sapiens
  misc_feature (1)...(823): n = A,T,C or G
aaaggggnnnnngnnanaagnnnnnnnnnnnnnaaaggaagnnagnnnnnnnaagnnntttanatacccacaggaacctttgactgtcccctctggcttctgcatcttgcttccagcatgaacagacagatggcccttgccttggtttacagttctagaagctgcttgaaagcaagagctattgccaggccagagataatgtctgaatcaggcacatagaagtgaaatgaggaattgtgagagacaaattggagagatacccaaggtcctcctgaattcgtgtgaccattgtggacttcgtagtctcacagtagagctttcctctcaaaatggaatctcaatttgcagagtttcttgggcaaccatccccatttaaagcttgctatttataagcatcttttccttagagcactatactggttagtctcctctgataaaatagtcaatgcttaaatacaataactttcttgactttttagcctcttcctaattagttctaacattctaacaagtgttcataggttattaattcccaaaaatgaattaaggaagcagagtctcgcagggccagaccaatagagctttcccagattgcacctccctttatttccatcaggtctctctacccaactacgatgtatgttntcttggtggattagtgaaagtgctaatgcaacttattcttttttatactgtactactcgctgtctgcgcctgcttactaatgttcactcaatctatatagcgtcgatccgcgcaaagatctgaggagggctacaaagtggatcagtggttggaagatataatgcaatggtgagaaaag

SEQ ID NO: 16360 - DNA, 587 bp, Homo sapiens
cgacagtaagaggctgctccttggaggaatttcagtttaatcaggggaagagcagaaaatacgtggaaaacataatcaataaaatcgacaacttaaaataggataaatgctgttggtgaagaagatacattagaataaatgttacaagactgtctgtggttgcttgggctagggtaatgaagctcctttgcccttctggcaagaagagacatttgagctaaatttcaaaaatggattttgtcaaccacttatgttattagaaggaagaggtaacacggccgggcgcggtggctcacgcctgtagtcccagcactttggtaggccgaggcaggcggatctcgaggtcaggggatggaaaccatcctggctaacacggtgaaaccccgtctctactaaaaatacaaaaaattagctgggcgtggtggcgggtgcctgtagtcccagctactcgggaggctaaggcaggagaatggcgtgaacccgggaggcggagcttgcattgaaccgagatggcaccactgcactccagcctgtgcgacaaagcaagaatccgcctcaaaaaaaaaaatcggcctccatggcctcaa

SEQ ID NO: 16361 - DNA, 1581 bp, Homo sapiens
  misc_feature (1)...(1581): n = A,T,C or G
attatgggtgtataggatagtnaanataaaataagagagaaataaaaagaagataagaagatactannngnnannaatatgtgatttatannctttaattgatataatgtggggcgacggacagagagacacgcgacgtgagcatgtgcagatacccacacanctcttctcagttgtgcancgtcgccgctgtnccnaaatgagtgtatgcgtgtntctgccatcgtgggtgcgtcgtctctgtctcgtgagtatttcttacgcgtcgtcactgatgcgacaacggaccgtgagtgcgcacggtagccacacccgcctacacacacacacaactcatggtggtatcacacaaacgacacagcccgggtacattcttgtctactcactggcgacagcggtgtcgtcttcattctctacatcatcgatgcaatgcgaagtcacacaccacaccacacaaantacgcgcagtagtccacttatttattatgtaagaggagattagtagccacaatttgtaatcacgttgcgactcccggcgccgcgcagcgcccgcgcgcacgagatatgctattacgtgcagaatccacttttaaaacacaaacgcaaaccaaatctcctctctccagacagaaagtagaacaagcacgccggcgacgcaacgatacgacgcgacccatggcgcncgccgccancacaagattactagacgaacgctacacgaattagttgcgaccaccgcacgaccncgtcgctccgcgaccacgcacgcaaagacgcacagcgcttcgatctaacactgcgctgaggtgtacgctctgagactgcgacatacgtgatactcagtagcgatcaggacgagtacgcgtaatcatcgattcgcagatttattacatatgttgccgatgtttcgcgtctgattgtgtacatttgtcttcgtacatcgatacattcacacacaattatcttactactagactcgtccggtacccgcgatgcgactcttctacatacataaatacagcatatgagatcaaccatatacacagccgcatcctgcaccgcatgatacctatatcctcactttacgctgacgtcgttcttgatacggaaccgactcacacacgacgaccacatattccagaacacnatcgccctacgctcgcgccacgaacgcacaactacagttcctactcgcacgacacagtatacgtcaccgtatacattactccgtacaccgcgcaccgccactctacactcacgccgacacgacgccatcaagcgaacgtcgacccgntcctccgccacattcgcaggatgtgtactcaattctagtganatacgttttgtcaaatcatacgtattttcgacggatatgngcgactgtctatgtcaatctanatattacatatctactgaacaaactacacaanagcaaccacctccatacctctgcgatcgcacatgacatgttgaactatatacagcgtacagagcgcgcgaaccancgcacgcgcaaccatacgcgacatcgtcattcacatacatatcgcacgactcaacgacagacgtgtacatagaaga

SEQ ID NO: 16362 - DNA, 1287 bp, Homo sapiens
  misc_feature (1)...(1287): n = A,T,C or G
gagctcacaatanatacgcanatctacatcccagtcgaancacnattgatnatcgcgtcatgacacgcacgcactcactcattcgcgattganacggctttctacgttctagtcgcatatcttatcgcgcacatctatatcggacactagccacnagtgctaaagtgagagacatcgcntccnctntagtgcgagcgcacatcttagatgtgcttagatccgagtggtgcagagtacgcacgcagaatatactattgcgtaagacacattgaattcagagtacacaatatagacgaacgatatatgaactatggtatatagaatgcgtcgatgtgggtagatagcagagcatcgcaatgtgatgaattacaagtatggtgattctaatgtacgtcgctcctcgaaggactagcatatcggagcttcagtgagctataccgtaacgagttacctatatgctcattttatatgcgtcananagtaatgtagcacnactgtntgtgagtcctgaaattatagtcgacgatacattgtgtcatacacttgatctaaactcggacgtatgataggttgattcaccgacaatgcaatacagtgcgtnacataagtgaatcgttcgctacagagttgtgttttctaccactctcggtcatatattacatcacttcagtatcgcgtttatgacgcatactgtatagtagcataatttttcattattgcttcacggtggttatagcctatnacattctattggtcgattgtatccatactattcgtacgcctacgcttcgttcgttatctacgttcgcctctatgtcgtctatatgacgactcgcgcgattatgtcgtgcattgtctgtcatctgtatggtatctgacgtcatttgattatgtacgtataatatgagaatagatcacgatgtctaattacgtcgcatcatattgatgcttaagaatgttaattgctacgatcattacgtatggcgcatactacaccggtagatattctagttggtatctgtcctccctgtggtttattgagtatctacatcatcgcgttagttgcgcattttcgtcgaattgtatcgcagcagtcgcgcacattattccatatagactaaatatattgtgaatgtacttcatcctcgtatatgttggaagtatcgctgcgggtagcgcggatgattcgactaatgaattcgcgtagacattgtatatggtgtaattagcatcggtgttgtcatgattggaacaacgagacataatgtatagttcgtcgatccatat

SEQ ID NO: 16363 - DNA, 596 bp, Homo sapiens
  misc_feature (1)...(596): n = A,T,C or G
ggataagacagcagtgtgtggtgaagcatgccctttggatcaagagcactccaagctgatttccttcccattccatgtaccacacagcttaggcctgtccacccccaaactaatcactgtcaaggggatggaactaccatgattggcttgcaataccagtgtgagacagcgtggatataggaaagtcatccacaatctccacaaccacatcctcgaagcttcatagaggagaggctggccaactgattcgtgtatcacaaaggaccatgattcaggtaccaagcatctatctgtcagatgccaggagctgtgccatttcctccaatagacaattcaattaaggagaaactaaaacctcgagcaattggaaagagcacatgaaaccccagtgttctttgacatgctgtagaatgacactgttgttcccaaatattctaaatcaattggggtcctgaacaagaacaacacagagcagcctgccgccgtgatgcccaaagagaatcattttagaccctgaanatgtgaagaggctgaaaactgaacttggattgtcatatgtgtaagatgtaataaaaggtgatgatgattaatgaaaa

SEQ ID NO: 16364 - DNA, 921 bp, Homo sapiens
  misc_feature (1)...(921): n = A,T,C or G
ttattaanttaaatganaaatttnaanaattatattttttaaattatatntttcaaaggtaagttcataaaacaaccataggaggatcaaccaccacagaaaagaatagactggtgagtcatcaccatgttcccaacagaattttaatctatacttctgaggacagcttcaagtgattacctagaggactgtgcttcataataagacaacctgcattcctgagcaggcccaccttttaccttgctaaatagtctgcctttcatatcctggaaccatatatctatctcaaatcatctgatgaccaatataaaaaattaccacgatcctcatctactcactcccctggaaaaaagaatacgttagctactattcccacctggatcaccggatattaaatcggaagaagagatcaataaagagaaaagaaaggactctcatattacctactactttcaatttctatatattctctccttgcctcttctttggttcctgtaatattagactcctccgttacagtacgaatcgttcttactcctttatcattagcaatacttaagaagatacgtttgatttaacaaaagaaacagctaaatgaagtccaagcacctactatattaaataatatgtcctaattatttatttttttaaacttgctcgagcatgatccatactgttaaataaatgctggagcaattacacataattccagtggataagcgaggtccccaagtagctacctatattctgtatttatagagcacactctaatgttaattctacctctcaaaagtcaattggtatagtaaattgcggtatgtactcctgtcgaagttctagtcttaaacattctcaccatcactactttattgttatctttctacctatgatgcgccacagctgatgtaaaaatatagttag

SEQ ID NO: 16365 - DNA, 932 bp, Homo sapiens
  misc_feature (1)...(932): n = A,T,C or G
aaaggggaanntttttttaatanagggtaagtagtggagtgaagagatttcanagtagaaaactgagctgattgaggaatagtcctgtctccacccaacagtcatctgcctcatataccttatgcaccttcttatccagtgacagaatggacacgaagaaagatgaatggggccacaccatggctaggatagctcagatggactttctgatattggttgcgctggacaaagcttacagttacctgtcatggcctgttgctgccttcttatcgcctctctttgatgccgtatattcttccctttgatgcgggagcacttcattccctccttgaatgctttacatagactatttgattatatgcgatcccacccgagcctacggcgtccgtgtcaatacttcgtgtattatacgtttccgctatttgctaaatatcccccctctttcttacttaactctttttcattcttcttgtcgtctatttctttcttttcggcctttctgctctcctctttgctgtagcagcgcgtccattctcgaaataacgggcggttggtcccagccgtactgcgtgataggtttagacaatggtatcgaaagttcactcccgcgcgagataaggacataacccagctaatgatcgttctgtctccctcgttaccccttcgcgtcgcggagtcgactaacatggtttctttcagtcgacacgttttctttctcttcgacttcattatcccctcgttgtcgcgaggtcgctacgttcgctggcgttcgtttcttgttccttctatcttatctatatataggttttgtttatcatttattgattaatgtgattgtacgtatgtcgtgatttcttgcaatggtctttatctacttccctgtcttgttctcgctgtgcttccctccgccccttttatgttgtgattcgcgt

SEQ ID NO: 16366 - DNA, 2102 bp, Homo sapiens
  misc_feature (1)...(2102): n = A,T,C or G
tattttttattttnnnnnnnnnnnttnntnnnnnatnnntnttnntnntntntgtnntnnnnnnnnntantnnattgntntanttntgatgaanttanattcgacagnatgatagtcgatatatnanagtttttatcgnntagtngtntnngtaggtactattntnatnattanctgatacagtganagtagnntatgatattaggtngtatagtngatgntggtngctcttgcggcttctnatctgctncncgtgatanaggntcgtacattacganaacgaaggacggccnacacgtanacatcgctgcagcgangccgatagaangttgtaagtgacnatngctgangatagcnctccatcccgtaaccaccntaaccgttgggtcnattatgttttnnggtgatgnaangctnggntcgaaagtaaccagntangatgtaggcagatcgcagacgaagctcgcntncgtgccgacgctgcgtctngacngcgccngtaagtactacagtncncagcngcngcttangcaggntcgtantagatccncgctcgatgntagtgctactanacatacgagcnangatcttcgtagnatgactgtcncnnacgacgatatggaggatgtagagaatnagcagcgntcagnatacaggaacgaatgtcagccgcatctcagtcatatnactgtatnacgtgactaacgccngtatgtcgttctgtgctnattttcatcanggtngatgaagtagtcgntgatactgtgngnnatctcgattgngtcagcagtatgcttgtgactacagctactcncatcgtanacacagtactgatngcagtncatntcagatcganntcnagtgacgacatgcatgtgtcatntcatcacatgtgtangatagtantagatngtctatgtgtntatatngtgagtntgtctgcttgtnnagtananatgncatgatagatactaatggaagttgcatcatactaanatntaaatatctatatagtaggantcgcgacatcgcganataccgactntgtcgctgctantgcgaagattatatatnatacagtcatctagcgcgtacgctggatcagnagggantatgctnatgagttcgacagtagatatgctatcncatctagctagtgctcactcactncgcccatcactagacgtacgnacttctgatactcgttgtccacgctctcggnatcggcatcgctcgacggcagtnatcgagttcgcttnctnctncntntcgtgctgatgattagtacagtgtcgtgctagactagtcatgtncgtaatgttgtgagtagatacgtgtgagaggtagaagagtgatagcgattcaactacatcgatactgactaagctctntgcgtgcatagctctagtgtgcantctcgactgtnancattagtgagnctgtatagatcatggagacgncgcgncacgagacagatcgatcntcgatcgtgacgctgtatcnaccacacatgctattggtcgtatnatgtatagtangtacnnnatcagacacgtcatgatgtcacactacgtgatgtgtgagctctacgactcgccgtctgactttagtcantcgagcagtncntactacgtcncncttngcatatatatcatggtatatgtacgcgcgtcgacgcgcgncacagtcgaagcatggcgtagctcagcgagtgcgtcatgacgtagcaatagtatcagcacgcgactacgtatgtgtgtagtcgagtatattagtgctcactactagtcgtatatagtgatagtatgagagtatagctgtgnatacaagtatntatgtagcnttgantcgctatagacagtcgatctatncattnactacatctcgtntgcgatcgctacacatattacgtgcnctactgtgtacgctctactgtagntatgtagcgtgangtaaatcagntctcgatgactagagngagtaatnagcaaatagatgcacacagcaccagtacatagatagnacgacacacgtagctatcggatgaatatacacacaaataggagacacagatatgtgtactgttgatatatagactgcga

SEQ ID NO: 16367 - DNA, 1009 bp, Homo sapiens
  misc_feature (1)...(1009): n = A,T,C or G
ctggttcgggtgctggtagctgagcttgatacagagcataatagcacgccgaggcccttaatggcgtgcgcaagcatgagcgcggtgtgaaggagctcgcgtaccaggccgaggaggacaggaagaacctggctcgccatgcaggacctggtggacaagctgtagagcacggtattatagctgacacactgtcatgtttgtaggaggcagtatctagtaggccaacggctcaacctgtcccaatttattggcaatggcgtcacctacggagcatgttaagatgcaggacagattactgcaacacataggagtgaaactccatgcctaactattcatggtgggcacgagaccgcgggacgtcgcccgcgcgcccaagcgacacctgtcgtgactggaccccgaccgcgcctgcgcctctagagcacgtagtgtgctgcttgtgcgcgcaatgccggactgagagccgccccgnaccccgatacatgccgatctgctgcatttgtaccgctctgattacgatataactctttcccatgtgtcacgttgaataggtcagtcgcatagcagagatgccgtatagccgatatcagtcagtatagagagcgtatgggacggggnagtcgtgagtgcgtgtattaggtaagatncgctgatggtctatcagcggagtgctccgtgtgcctaagatatgtatagtacacctactgcagcatcatgtaaatagaaatcaaatatgtggcaccccaagtatatgcactcntattacatacagatgtttcctacttgaggttctcctgtgtgatgcgtatcgatatacagacttggctgccaggttgcctatactagatactagggtgtccatgatggcagtagtccactggatcccttgcgacatcagacatcgctattacagttccggtggggacatcttctactatgcgnagcnatgacagtgtagaagatgtgcaaatgtgttgaccggagctaatatatgttntggagttcgaga

SEQ ID NO: 16368 - DNA, 921 bp, Homo sapiens
  misc_feature (1)...(921): n = A,T,C or G
aattattattaattttttttaanntttnacttaaaaaatcccttaatcttcaagttccattagagcacaccttccagtccgtctgccgccaacaccacctacaggggtcccacagtaaccattttcattgggctataaacagcataaagaggctattgttggagagcagatgcaggaaaagtttttgccaaatggcatattctaaggtgaacaggttttcacaaatggagcattaatcacaatcctctgatactaccaattatggaagcagaccaagaataaacctgcaaatgagaagagccctttcctcccttctcaaattaagaaggcaaacatattggaaatgcaaaaggaaaacagatttgctgaaagatagacttcttgagcagaagaagctttacctttttaaaaaaataataacaaacattttcttatttttttaactggatgaattgtcagcataaatgcctttgaaggcataactgccttaatattgtaccttatatatatttattttatggcattctgtacaaccttgctatctaaaatccacatttatcacccaagtatatcccaattattcatagctcgtcaaaattcataatcgctaaagtaataccttgtctattctgtttttcgggcgacctctacgacaccacacgatctctgttctatttctgaaccaacgttttctaaagttagatcagtatcccacaaagtaccaagcatgtgagcggaatagcgcgtgcacacatgtacttataacacttaccccagcccatgctttcgtttctatagatccctcctcttgntctttgcgttggcctatctcttcgtatatttatctcagccgcatctttcgcgcttctactcttctctcatagtagcgatctctgatgaaagtttttagtacttgtacag

SEQ ID NO: 16369 - DNA, 941 bp, Homo sapiens
  misc_feature (1)...(941): n = A,T,C or G
tattttnntattttttttttattctttattactaagatagttttcgagttgattctcgctacctttatataggcctatgatgatatgatcatagcagagaggcaaaccctattccttagctaccactgccttatatttagaaggacaatttcacagaacattttataacatgatctggaaaattatggccagtgagctattccttagttatcactgccttatatttagaagaatcgtttcatagaacattctataagataatttggaacactatggccagtgagccaaatcggacatgctgcctgttgctgtaaataaagttttattgggacatagtcaggttcatttcattttgtatttctatgattgctttcaccctacatgagcagaggttgagtggggacagaggaagctatgagggcccaaacattgactatctgtttctttaccaaaagcttcatgacccctttcttgaccattgtctttactcggttgcatttgagatctctccactgtcctataacggacatcttggtgcacgttgttaccctcccactcgtcgctcatccgcgagctgcttccaatatgaagcccatgctctaactaattattttaactcctttcgcactccttgctacttcttaattttcatatgtcagcattgtcgattcactatcgacatagaacagcgacatctgtgccattacagatattgagtttgactgtttatattagtctcctttttgatgagcgtgtagcacttatgacacctgcatagagcgtatattttattctttaaaaccactgtcttaatccaaccgtctcagaagctccgctcctatttgtgcttagtgacgtgcgttcaaacgtgttcccgtacttctcgtccgtcgtattgttttgtttggtttgtgctcgagttatatttttgtattcgtcat

SEQ ID NO: 16370 - DNA, 936 bp, Homo sapiens
  misc_feature (1)...(936): n = A,T,C or G
tttattttaantatttatattattttaacacataaagagagtgttatgtgttcagcttctggtagctaacaatataagaccaagatgtcagccggcttggttcctgagggccttgaggaagaatctgttcccggactttccctttggcttgccattggccatattctctctgtgtcttctcacgtcttccctctgtattagcttccaaatttactcttcttatatggacagtatgcatattggaaaaaggaacaccctactaacctaatgtccaactctatcacctccattgcgaccttttctcccactaccctcacattctgaactattaaggattagcgcttagttgtagtgagtttgtgcgaggggcaaggagacacaactacaaccagcctacaacgaccaaaatacaaaaggaaagagagaacataatgagccactgagagaaggtgcacgtccctctctcctccaattatcctcatccgttaacacttattattgctacaacccttcttcgcggtacgagagtactgcctgtataacacatatattgataactggcacttaggaagttgggatacagcacacgaagcaaggctcacacacttcccgcagatcgaatcttatcgtgtagaaaagaacttctcatatctccctaatagcttccattagcactcgcaatcgagagcgattattttcgatgccgctccaaagtaggtattgtggtccgcggataacgcctcgagatctctgtaacagtctgaaaagtgactatccccacgaagttattaaatgccatgatacctaaactgccataccgtcaatccatctcagtcctagcctacacgcacacccgtccttaaatagcgctcggagagccacggttcgccgtcaatctatacgacccccaaatctgtggtaactttgttgagctcc

SEQ ID NO: 16371 - DNA, 873 bp, Homo sapiens
cttagattcctcttaggactctattatgccggagagtggccagattaatacagactggcaaaagaagaacttggcaaagtgatttgatcacacacttctcaccctcacatctcctgacagttcccctaatccctgccccacttccccgccatgggcttccatcaggaaactccttgatatcatcttcgagaagaaaactgaggcatagaacatttgggaatgaatctaagactacacatctagaatagcagagtgcatatcatcgtcattcatctcacttttccttctaacatcaaggatctatacaaggccgttgatccccactgctgcatatttcttggatctatctgaggtcccagatcccattgcctcttcatcctcacagccactgctgggtctgggtcctcataagttctatctggaagtttcagtacagtctttctcgatgtgctccacactgttatgggaatgaattttcaaacacccctgctttgaagatagggtgcttccagggtaaggcataaagttctccagggaggcaacagtgcagtggtatacagacagcacagtctttcattcctgcgaggccacttacacctgagtgaggatgggaagaagagaagcccacgacgaatgtaggaaactgtcagttaaatgacattgtatggatgggcagagagaaagactagcagcgatggactaataatcaatacagctttggcttttgagtatgaaatggtgtgtagggtgagaaacaatagggaacttctataaagaagaacagtactcctactgtacatgaatggtatctggacatcatttgatcctaaaaattctcactacctgaataattaatgcactcgtaatgtccct

SEQ ID NO: 16372 - DNA, 516 bp, Homo sapiens
ttcaggggatgcagcgctggaggaaggcactgggtatggatgttgaagagagaaacccaaagagttccttccatactggaagaagacaggaaactggagtgtgtgggattttgtaaacggcttgaagttctttatgaatcaagatggcctgcaggaaccaagaagtctggggcagccaaaaaccacaaagaagtaaaacagccagtttctgccttaactaatgaaccaacattacaccattctactattgtggcttgaccctgccatactttgatcagtgacctggtgacatccttcttctggacaatgagtcttatgatctcccctccgcgcaccttgtgacctcctcctctgccaacaatagataaccgccttttactgtaattttccattacctacccaactcctataaagcaaccccttccccatctcccttcgctgactctctctttggactcagcctacttgcacccaagtgaaataaacagccttgttgctcacacaaaaaaaaaaaaa

SEQ ID NO: 16373 - DNA, 913 bp, Homo sapiens
  misc_feature (1)...(913): n = A,T,C or G
tggaagagnnnnaggnnnnnggaatgnnnanngtaaatnnaaatgggaatttttcaggctgtatttagtatttcattgcaaatagaaatgggatcaagaagcaaagattcaccagcctttcaaatggactcacacctatatccagtcttttgtcactgaaggttttccactcattcagtgctatcagtcaattaacatcattgttgaaagaatggagtgacagctctcaaaggcaatctttctggtaaataaagcaagatcacacattctacagtgagtgccattaatgcatcaaaaaaaatggaggtttaccgaaaataaacagccacgcaatataatgttgttgaggtctgttggtgactgttgtgaatgacatacacgtttgcaatacttttttcgccatacaacagacctactggtgaatcaactaatactgccaatatactaagcttttccacctcatgacaaataagcaaaagaggatgcaactcacaccaatccaagaggaaaagtgggaagataaaaaacccgacagtcccgcacttgatctctatcttcattgtttcaaacatgcagtattctgacacctaataccgccttatcagatgaccactccatacctcaaccttactttagaaatgataccagggaagacgagcaacacccacatcttattttacgtcttcttcgagcccatttttcactatttcactcttttcttgtatgacgatagtcatattctacacttagttccttccaacagatattctccatatgatatccggtggagcttaagatggtnttcccatacgcgttatcgctccatagccagaaagatttnccctcccccagttattgtgtttaattttgtgttttcagcgtcagagatttctccctattgttcatcgtactt

SEQ ID NO: 16374 - DNA, 923 bp, Homo sapiens
  misc_feature (1)...(923): n = A,T,C or G
gggaaggggnnagggnnnngagggnnnannnggcggnnaatgnaggttttcggaagaatatggatttctttcgtcatggagaacattgggatatcatcctaatctcatttgtgacataggctcttctacagaactcagtcctaaagcagcaatctgaaagcttgattttcccagcaatcgaagtatagtggtggggcggggaagaggaagaggactgagtctgcttcttctggcctagctcatcaaagaactagagctcgagggactattgtacttttccactgtgatacgtaggaaactgaccttaagcacaaagtatgacatgaaaaggcttaagcttaccaattttactttgagtatctttatatatggtctggaagagacactacttcaaccaaggaattttgattatcattatatattttgatggcttattgtgaatgatttcgtacatcagagccttactagtatctacataaagatgatcctgncactgacatatattttgtcatctatagggaaagtaaagcccacatatgtgtcgttcgctccaatgctcttcggcctattttgcttcgatctacccccagcgagctagtgttttatcaattataagtctccagatgagaaagactcccaaggtccaagagggttacagggttttttccttgtgtcttctttctctttgtttaccatacgcggagcattttgttgtactagtttcatgtcatcattaactgccccttctccatgtctcttcgcgcgcgtctttctgccccattgtccaagaatggtnaaggaattctcgtgtagatatagacgcctcatacactaacggattcacccccccaagccgccggaagttttataaaagcgtaggccagagtagtgaatctancgtccgtggtggtatttgtcgtctt

SEQ ID NO: 16375 - DNA, 965 bp, Homo sapiens
  misc_feature (1)...(965): n = A,T,C or G
gtaaatagaatatgggngtgtgttggtttttgtttnaagtgacgggcgcgcgggggaacatctcngcgactacctttggcatgagattttgagatgaaacaaggagagaagaggagaggagaggaatatgttcatagagaatacagcccagagcgctgcaaccccattcagtacttcttttttgaaatgagtagaaatcctagccctgcatagctatgcatttccagcaaaagataactagtccctgaataaacaagaactcattatcgtaggcaacaaaatagattcagtataagtttgtctcataaacagatttagattttaatgattcattctacttcttttagtaatgtgtaatttgaaagtttacattgttatttgcttgttggacatagacattggggttattatacttaaaataggtggtgtgcatgtatgctcggactcaagtgtgggggtgtactttgaatagagtcaacagatcaacctaatcagaaccgagactgcccctctccataaataagtctttaattaggaggtagggtgttatggattttattgttccctagtcattccccacattgaaatttataacattgtttctttatttatttaatatagaactgactggactgcctgtcgaccttagtctcgctacattataggctgattaagcgtatcattgaccgaattcttccgtcctaaccccgactaaatacataatgtccaacgagtttgacatatgcatatctatgaccgttcttcttctagctacggatgttcgacgaccccccatcctcggcatctctacttctggatgaacagtgtctcgttatccttatcatatatctcactagtggcatacgagcacccacccactctcgctttcctcccatatactcgccactctctatctcttccgcaagtaacccgcatcgccatatgctgttctcctcatcgcccgc

SEQ ID NO: 16376 - DNA, 1050 bp, Homo sapiens
  misc_feature (1)...(1050): n = A,T,C or G
aggggaagaggaggggaagaagnaaacaaaggagaaaaaaaacaaaaaaaaacctacaaggaaacagaaagacccnnagctcccggggcgacaaacgccgcgcggcacccccnnnaggacaagaacgggaaggccctgacgcgggggggaaaacgaccacacccaacagccgcccggcacgccacaccagacccacaccgggaagaggcacacaggccccacgaccagacgacccacagcacacgcaccagcgaccgagaagagggccaggcgaggggacccgacccgacgaacaggccacacgacccgcccacaccccaagccgcaccgcctcccaaccagcggaggacgacgcggcggcgcgagagccagcggcagcccgaacacgagcaccgcgcgggcgccaacaccgcagccgacaaacgagcaacgggaggggccggcggcgcggggggaggaccaaagagaacggaagaagggacgccccagcgagggagggcggccgacggccgcgcgcggcgcgccccccgcggcggacaaaccacgcacccgcagccccacaacagaccacaccccccccacgacgaggcacgcggaacaccaagccaccgaccatccgcgcaagacggggacgacgccggcgacagagaggagcagagaccgccccacgcgccggaaggaggggagagagaaaaagagtcaacgaccggacacacccccccaccgccggcccgggagaacaacgcgggagccccgcacgccgagcgacagccggcagtgcgaccagcccgacgcgaggagaggcggcgcgcaacggagcgagcacggagaggcagccaaccgcgcgcacccacgaccagacaccaccccgccgcccacagcagcagacgggcgcccccagcaacacccgccgagacgcagcggacacagagagaacacacgangccgagcaacaggagagaccgaaaacgacggccgaccgagcacgaaagagccaaggggaacaccgaggcagaccagaaccgaaggaaagaagacacaaccancacg

SEQ ID NO: 16377 - DNA, 887 bp, Homo sapiens
cctagcgacctgtgacatgacttttttggaagaaggatttttgcagatgtaattaaggacctcaagatgaagtcattgtggattatataggtggcctctaagtcaaatgatgagtgtccttataaaagacattgaggagaaccacagggagagaagaggaaaagaccatgtgatgaccaatgcagagatcagagtgatgcagccacaagccaaggagtacctggagccagcagaagttggaagaggcaaggaaagattctcccctagaatcttggaggaggcaaggccttgctgacaccttgatttgggacttctggcttccagaactatgaaagaaaacattttctgtagtttagaccacaccaagtttgtggtagtttgtaacagcagccacaggaaataaatacactaggtgtgcaatattgtctaatgcaagaatgaatgaatgaggcaagaatgagttggagaaagggtaggctcaagaatcaggagttcggtattgtctgagatgcctataacatgtgcaagagggatgtcgagtaggccgtggatatataagacaggagtgggctggagaggtcaagtctagagctccacatctggaagccatcagccacggggttggatgatatcaccattggagacattatagtggagaagagtgctgaaaagaactctgaggagcaagctacatttacagtgctgctcctattcagctgtgctctcaacatgaagttctgccaccccaccttacccctaaagcagacatttggcaatgtctgaagacatttttcgttgccacacacttgagcagcaggccagggatgatgctacacatttacagtgcatgggtggaataatttggatgatcttgctagatgtcatag

SEQ ID NO: 16378 - DNA, 886 bp, Homo sapiens
  misc_feature (1)...(886): n = A,T,C or G
ccaggtgactgccaacaagacagcttcctggaggcttcagtgttgggtccagatgtttatcgttgggattttcaaagtacctaagaggcactgcagaagctctgtgcactaggaatttcacacaaagaagagggacaatcaacagtcctgaaaagctggcctataccaagaactgaaattgaaggagccaggctataaaatccctgaggccgtttctgatgtcattgacctttcacatcataccagttctggctgtcatcaccctctgactgtttctcccctgtggttctcacccacttgtgactttctattgccatgtagagtgtagttgttccctacatgttatactctttaaaggacagatctacatttggtttatccttgtatctactttagcgtaatatgtggcccctactaggaactcagtgaatgctttttgaatgaataagtgatttctatgaattaagctctatgcagaaattgcttaagcatggaaagaaattttcttatgcagcagctatgtgttagactgagtatatactggatttcacatggcatctattgcagaactcaggagatgacaagcctacgataaaaaggctgcatactcatgcattcagggcaacagtggtcctggtctacagcacactttcatgggggctccgggaccaaaaggcgggctctgancaaaggctggtggaggcgagctttcttccttcccagctagctaatcactttgccaaataacttgctgaattcaagcagaaaccacacaacaaaataacaggaccatgtcaggcatattntcttgccatgggcatgtaatctagaactttctcctaatgtgctttgngttatattggggtcattctaaaagatatgctag

SEQ ID NO: 16379 - DNA, 944 bp, Homo sapiens
  misc_feature (1)...(944): n = A,T,C or G
atagaataataaaanngtagtttntaatgagggatttaatttctaaaagaagagaaaanncctcgagngctgactacctgnactgaccattacataaaagaatacaaaacaatctcgaaagtcaaccaaggaaatagtaatcaagaataattctgaatagacgtaatttctactttatgcatgactgtaaaccttaacttcactgaactagaccagggaattggctttcgcattgcttgttgggcttttaaaccagtgaatggaaagaataaaaagttttctccacacaacttctcggaagagatctgccctgtgatctgcaatgtcctgacgttcaaacttctaagtcatctgtggagaccgctcaactgattccaagtggaagtactaagactgtcatttcaggcatgacagctcctctcccaacagctctactttctacatctactctctaccaccacaaaacttctttcagttccatgaaagggccatgtttttctggtctcttggcctaggagcatgttgttcttctgccagcaaccttcttcaaccatctccacaggatgactcctctattggatacttccatgaaaagtccaggcctgggttatgtacccttccgaaagtgcaccccagacacccaacagtttttgcagcccagactcaccacactgtgtggtaatttcctgatcactcagttgtgctccccacagactataacctctatgatggcaggggccacagtttgcttgctacctctatatgccagtacctggtaaattacctgactgaaatgactatgggttatctattcattggcggcctcaaagaccatgcttctggaattaaatcttgcggggccctcattaatttggctttaccaaaaatggtgaaaacgacccctcgccttggctttggatctgcccaaaaaaccctggactact

SEQ ID NO: 16380 - DNA, 922 bp, Homo sapiens
  misc_feature (1)...(922): n = A,T,C or G
tgtagggggaaaaaaaaaaaatggaaaaaatagaaaagggcttctggtaacttcatacagtgtataggggaggagaccagatggttgaaggttcagggaagcctggtggcaatgacaaacctgggatcttgtaagaactcttttatttaaacatgatgatgacttccctgtcacgaagaccttccattacgtctcctccttgcctggatttttaaaaagtacaacaaaggaaaacgactccttggaaaagcataagtctgccatcctttttggagatgaaaggattccctgaggaacatcacttctaacaggatgccagtgcggtaagcggaaacacagacagaagtatttcttttagcagtacctttcatttgaacaaaatggtaacagaactccaatttctatatttgaacactcaagggcagttgttaaagaggttggctgcattctaaaatatcacccccacccgtctgtcaaggacatgggatttggggttctgcgtgccagatctggtccccacggccttcacacagacgacggggactgtatgactcacaagccttaccacatggactctttcatttnctttctaagtcagtctacaataaggcctcgaagtacctttaacattatattttaattaaaatactatgtagtgtacaaacataatggaacaaaccctaccccctgatttatcataaccgggaaccctctattggacactgaaaacgtcggactccatgaccgtagtaatccaacaaacccagctaggcccgggccattttatgccttgtaacaataacaaattcaatatcctctataaccaattctgtggagtatatcgcatacccagaaacaaagcgctgtaataacagctgctattatttgcgagcaccacaccctgtaataccacccttgaaag

SEQ ID NO: 16381 - DNA, 844 bp, Homo sapiens
gggaaactgaaggaagctccagtgctgcccccagctggactctgagaacgctggcagttggggtcctatcacacaagtaagagattagaagtctcctcgctatcaaggttgaaaagacccagagaaaagacccaaagacaccaacactgaaggtctcccagtgaaatggcccagttaggccacagcatcgtgaggctcacagttggctttcttcacctccagcagaatacaaaatcatctttttagtttccaattcttaaatataaacagattgcaaagaatcactggatatttgagaaaagcctgaaacacgatggacagaagaggaaccagcaccaaggaaaacagaagaaaaaataacttggaagaaacagagactatgcacagtataaaaacttgaaaaacgtcatcattaatcattagtaaaactctcagaccgttaagagaagacgtatcactggcctgtgctttgggatctggagataatacttagcatcagctgggtgtggtggctcatgcctgtaatcccagcactttgggaagccgaggcaggcagatcacctgaggtcaggggttcaagaccaccctgaccacatggtggaaaccctgtcttactacaaacagacaaacaacaaacaataaacctatacttaccggttgtgcggctcatgcctgtaatccagctacttggaggctgatacaggaaaattgttgaacccataagcataggttgccgtaagccagatcatgcattgactcagtctgcgaattacaccaaacctgtttgtaaagtaaagaatcaacaacacctatgtcacttgtttcgcccctaccaaaagctcag

SEQ ID NO: 16382 - DNA, 863 bp, Homo sapiens
  misc_feature (1)...(863): n = A,T,C or G
ctagtgaaacaaggggaaatanctcgctgtcaaacaagaaacctaagagaatttgtcaccagtagaccattcctaaaggaagtccctgaaacagaaaggaagtgattaaagaaagaatcttggaacatcaaaaagaaataacaggaagaacagaaatatggttcaagttgcacctccaaggaaaagtacattggtagcaagctatggacattcactggccctgaaattcctgatgtctttgacgtaatgaaaacggcacaggatgaagagtgagagtaccttgatactgggcccacctcatgcagctttccccagctgcacaaatctgtatgaacttaactgcttttaacctcccttccctacccataagggaatccacaaagatcatgcgcctgttgagtaatcctcactcaatgaaacataataaattttaaaagtattctatcaatcataaattacttcacaaatagtagtatgggagacagactggcataacagaatgagggtggccttggagttagataaacctggcttcaaatctgacactttttgtatttaatagtaatgtgatcctgggaaagtcacttaacctctatgagccttatcttactcttctatnaaaggggattgtttatattaccttacgagtttgttatgaagaatttatgtaaatggcttacacagagtttggtcatagaaacactcaaaaatatttggtcttatattaatacctctattataatattaattcctagtagaaagaggggttatactcagtagtatattctctgtccactttcggggacagttggtccaacattgcaaataaaaattaagtgaccttgtctgaacggccaagaaat

SEQ ID NO: 16383 - DNA, 930 bp, Homo sapiens
  misc_feature (1)...(930): n = A,T,C or G
aaaaaataaagagatannaagaagggagtagtgattataaataataagacttgaggggtacagcagctctcgctgtgagagtccttcacttcccttgtcagctgtattccaccacgatcaactcagcttcattcctgggattcaaggctggttcaacatactgaaaataaacgtaattcattacataaacagaactaaagacaaaaagtacatgattatctcaatagacgcggaaaaggcctttgataaaattcaacatctcttcatgttaaaaactctcaatataataggtattaaaggaacatacctcaaaataacaagagtcatttgtgacagactcacagccaatatcataccgaatgggcaaaagctggaagcaatccccttgagaactggcacaagacgataggagtgctctcatcactcctattcagcatagtatcggacattctgaccaaggcaatcaggcaagagaaagtaataagtgtattcaaataggaagagaggaagtcacattgtctttatttgcagatgacatgaccctatatgtagaaaatcccatcttttcagcccacaagtctcttaagctgataagcaacttcagcaatctcatgatacaaaatcaatatgcaaaaatcacaaacatttctatacacaaacaataggcatgcatagagccaaatcatggaatgaattcccattccaattgctatgatgaccggtagtaatagcaatgtattctatacttaaaattcggctgaccagagtatactttatatgctctcattccaaaaaaaaatacaaatgaggaaagaaagggctatgtgcaccacccaatctatcctgtactcccatatcccatgtgtttggaaggaacctaagcaaagatgaatataggcagggtttacatgcctctacaaagtaaagacc

SEQ ID NO: 16384 - DNA, 915 bp, Homo sapiens
  misc_feature (1)...(915): n = A,T,C or G
aaaaaaaataannnnnnnnnaaaaanaagaaaaaatcatattataaanaacctcagggtaacttcaccattcctctcagtttgagacatcgaaagaagaaaggatgacaatcagcagcaatgattgtagcagtaacaacagcagcagttactgtttgtggaggattttctatgggccaggactattttaaacactttacattcattatcctatttaattatcacaacactctgatgcagtatgaccttcaaatgggaaaaaaaaagatgaaaacaccacctggattccatgcccttcagttttatacctaatacttgaaaaccaagtgacagagtctaggcttttctagcttaaatattattctcaggtgtttcacgctaatggagtaaaaggttaatgagtctttgtttcctgtcctgggggaatgtctttcacatcttagtcttactctccaagaactcagctcattgcctggttagccatgacatcgctgttccctgcagggacatcaccagctcgttctcgtctttcctacaatcgttctctccatctcacccactttttcattatttattgttttgttaaaatcgactccgtcacatcagatttacttttggaaaacaaaacaaactaataaatccccctcaatggccatatagtatgtacttatgagcgcacttgctcctattgatgcttaacaaataaccatcgctaacttgctggatcgcctaacttcattagatgttgtgcaccgaatatgatcacctcatgtctttcaccgcaattcccattactgtggacaacaccggcaaaatcacatccccacagccttcctacgtccccccccccatacgcccagtacattgcactaattctctctcctcctgaaacttctcaactccgcataatataccg

SEQ ID NO: 16385 - DNA, 865 bp, Homo sapiens
  misc_feature (1)...(865): n = A,T,C or G
tccgctgccagtctgaagttcagtgctgtgatcacagctcactgcagcctcgaactgctgggctcaagtgatgctcccacctcaggctcccaagcagcttggactacacatatgaatcaccatgctctacagtttttgtagagatgggggtctcactatgttgcctcggctggtctcgaactcctggcctcaagtaatccttccaccttggccgtccacagtcctgagccaccgcacttggcctcaatcctttacataaaacctgttttcctcttaggaagcttgctgcattttctgtttgttatattcagtgttccgaaaatgtatgatgccatctctcggtatggctctatgtttcatccattatgctcagcaatcagtgatgcctttaaatctggaaacccacgtttcccaagtccaaccttattttttttaagtgttttactgacaattttctcctcttgttttctttgttctttcagtcatctttaattgagaatctgtaatctttgtattataataaaatgtttagactttttttgttaatacctttagaactgggtaatttattttaactaccgtatggtattataatatatgaacagatcttacttgaatactacattaatagacatctagattgcttcccttttgcgatctataataatattttaatgaatgtctttgcgagcgtatttgcgcgcctgtgcatagaacttatgttctataaagatggctaaaggaacatgtcctctaaaccttaccggaacattttctatgttatgccggagatcacattacacttctaactatgatcactgcaaacatcttcttgaatctaataatgctgatcaattttcctnta

SEQ ID NO: 16386 - DNA, 884 bp, Homo sapiens
caggtcctcctctggtgcagcatgagaatgggaggaggagacatcgtcagtgtttcctcctgagttcgcttgccaggggcgccagcttttcacgaattcaaacaacaatgacatggacaggtttacagtaaaatatgtctatcctgaaaaagaaaggaattgacagccaacccactggctgtgctcatcgcttgctgagccgcaccaagcaaggccatcttctgaggatctacaaatgtgtggcatggtaatgatctcaccttccaaggagctatgacgtatttaatgaggtgtggatccagggaaacaaaagtcacgcacgcagtatggaggggattggaacccatcaatatctgagacaaacagtaacatagcacggggacttttgttacaaatgtcctgctctcttcctcctccaccttcaatcttagcatagagcatgcagtgtgaacatcagtgaaaccgatctggtttcaaataaaagatttgttgcattttgactatgaggcattttgcaagttgcttaacctctctgaggcgcaatcccttgatttgtgaggcagagataacacctttttcaaaaggttgatttaagaccataataaaatcatgagcatgagaaacttagcatagagtctgggacatttcagctgttcaataaattttggtttctgtccattttctctacctttttcctctccactagaacaccggggcagagaaggtccagtgtgttagcctttagattctattagtcattggggttatttctctggagaatttacttttgggcctactcgttcgtctcccaaaaaggatgagacctaaaggtcttctactggttcttcccatttaaagaaggaaaacaaaacaaacagttttcc

SEQ ID NO: 16387 - DNA, 916 bp, Homo sapiens
  misc_feature (1)...(916): n = A,T,C or G
gggagaagtannnagaanaaaaagatanaaagaatgagaaagaaaaaaaaagcttctaggtttaatacgcagtcagggttggagactcactgaagtagagagtgaagagagccagaatgaaatcctgcagaccctgcagcaggcagcctgaaatgcaggaggcagtcttgggatgcacctgtaaggagcaagaatccaacactccccaatggcaaagacaactgaacatgtttaaaagcactcacttcctagcagtgtttgttttgactactacttttccagtaagttagagcagaaataacctggatgttggaatcaggatcaaattgttgagtgttttatatagagggtgatggctactgagaaacaacccagacatttgcgcttctgtacctgcccaaggggaaatgaagtctactgtctatcatacccctggaatgtaaccttcacatgcgcagggatttggttatgctatagtacaaacactaccacataccaggcttgtacctaatgaatgcactgaacgaacaaactgaacgataccagccacaaactgtacgacccccccacctgtggaataactatttatagatccagctgactcccactgctcacctttacccaaccgtcccctgttctcccgtcctcgtacgctaaaccgctggggcgctttgatctcacccccaatccgcaccactaccccccccttcagaacatagtgatacggatgcaagagtgcgtgcgtacttccctacagtgcattatatcgaccgagtgcgcgattagcgagtcaaatcgggcatacgacagccgccacaccgaccacgtcatcgctcatttcccccccacccacacccgctcctatctttataccgagatgaaatcatggacgcctaccccctgctaataatatcag

SEQ ID NO: 16388 - DNA, 925 bp, Homo sapiens
  misc_feature (1)...(925): n = A,T,C or G
ttaggattaaaannnnaaanatgnnntattatgaaangaggtattctccactataaaaaaagaaatgtgtttatgaaagcagagagtgagagtgaagaaggcataaacagaaggacattgggaacaagcagccgctaatcatcatcataacagactcaggctgggttaccaaagtgtcaacttcagcaaagcctcggcaagattggtaatgattaagcacccatctgctgcagtctttgagactttatgaagatctgagaaaaggaaaaaaagtggataaagagtgtgcacttctgttggggcatgactccggggcggaagaggctgaaagaaaggaccaatgcagggaggaaaagaaattaccaactccttccaggggatgtagatgaaaacatatagacacaattgggagaaaatttggggcaggtccttggctgagccttgggagaagatgaacacacacgtcatactatctcaactagccaccccatgatggtcgcctgcaataaagctggagagttgtaacctagctttacaccaggatgaagatgaaaactcgacctttgacatttctactgtggtaaaattgattggccgaccccctcctgatatggtgatgtttcttgatggaaaccaccttgatggcatcagggatctaagatcgtgtattttgttgcaccccaccacctccctctcctcacgatctctcgcctcaaaaattcatcacaacacctcatgttcgtaagtgactcgactccgcatgtgtatctcacacttggctttctcccgctggtataacttccttctacatcaataccccactaccgccaaccgcctccaatcatcttacacctcaacgtataacgaccccaatcatatccgcnagtcattatctcatattcctctctctgtcacatatctagtg

SEQ ID NO: 16389 - DNA, 871 bp, Homo sapiens
tgtaaatcttagtaaaagcagcatttggatgtgaacacaacatgacacacctttctccaaagtcttcctaaccaagtctccccccagaggactcttgtgcatgtcatggctattgatcataataagccagagtggtttcttctcctgcatttcccccttgacttcaaggataaagcagatcttcaatttcaagacttaatgtgggccttgtataatttcaccagaatgaccaccacgatccaattatgccatcttcaggccgaaaaacatgaatttggaccaaacatccacttatgcccgaattcttgttttcatgattgtacctgcgtagtagacattgagatctggaaagagtatgtttccataactatgggcaattactgacataatacttacgctaaattatttgtgcaccacaaaatcactcgcaaaattctcttaccggcatgcaacgatcacattacactttgatacagatatacggattgcataataatcacccactattaatgccccacccaatatttgtattgataatatgttttttattttatatccagccgaaacatagtatacaataacacacaacgccaccacttgacaataccccttatgttctaaaatatttattaccacaccctcacccctcctactactaaccactgctatacattatacaccttatccaatttctacaataagagcaatttcccgatccttacctcccctcgtaccccaccacatccgtcaagacgtcaaagcaccccaacatcatacccagccgctcactagtccctcctaccactaaccacatatcactcacccataccccccacacacactatacccacacactcaacattaacaacag

SEQ ID NO: 16390 - DNA, 914 bp, Homo sapiens
  misc_feature (1)...(914): n = A,T,C or G
cttttagagctacatcatttcagctcttttccaagggttatagcgaacgccaacagctgagacctttgactgctggaattgagcgttgccagactgattggaaccacctgtattccatttcaaagtcctcctggagaagattcattggcttaagtcagcagttcaattaattggagctataagtggaataacagagatgtacaatcaatgaaaactacctggaagtaaagtaaacaacctgtgatttctgtatttctgtataaaggagaacgttaccaaaagaatgtgtcctgggacaaagatccagaatggagaagagaaatgacaaaaataaggagggtcaacaaaacccacatcacttgaataattatctgctaagatcattaatcctagagtgacaccagggtattcagcaaagattcctcgatccatcaactctgaaagaggactactggatttggggtagaatagaggataaataaatggacaagaagagttggaagagttgacctgtggaggataaaacctagacccaaggtttctatgtatgtggaattaagaggcaggtgcacacagtcctgatattgattaaaggtcactcagagagacacctgaaatacaacagtgtgattaaccaccagatatccagtctgagaaaataatcttatttctcatgaaataacaggattggaagctattcatttccccttgtatggctagataatagaaattccttgagccaaacagtgggcgatcccagtgttggactccctggcaaacaagctcgctatcaccagagggacagaaactaagagtggcaantgtcactacactgctcgctctttatgcgaagccctggaggggctgtctttctcacctaagatcgccccctcacaatgctttctatttgattg

SEQ ID NO: 16391 - DNA, 896 bp, Homo sapiens
  misc_feature (1)...(896): n = A,T,C or G
cctanggtgacatgggattcatacttcacacctgcatgaaaacaaattccaaatggataagatctactgcttggcagataagaaaaataatggacaatgaaaacattcattcatttgatacttgctaatatctcctgcattcctgaatattcgaagctggagaggtagacctatgaacagagatttggaaacaataccaatccaaagagaaccctagacctacctttattcctacctttttgggcctgataacaattgactccatgatggctgatgctggtccaggccaatacttacccgactgtgagacaagatttgggacacagagtaggtaccttcagcaagacatcatgcgggtgatggaattaacaagctgagttacaatggcttcttctacacacagctgcaagcaaaagatcgtgttctcatagcgtagggaaaaggtttgtagagcagtatttttaggcatgttcacaaagtatatatgctggcaaggaatagccaaagataatgaaaacactatttcagaaagatatctgtactcccatgttcatttcagcattattcacagtagccaagataaagaaacaaccgaagtgtctgtcaacagatgaatagattaagagactatgatatatgtatatccacacacacatatgtatctcacactatatatatttatatctatatatagagagagatatatgtacacacacgcaatgggaatttattcagcccttaagaaaaaaacaacattcctgctacgtacggacagcaccgatgaaacttgttcactattttacttaagcgaattaacctcgacccgaatagacatatgctgcatacgtccactctaatgcgacactaaaatctatacttcataagatggcgaaata

SEQ ID NO: 16392 - DNA, 882 bp, Homo sapiens
ctcagcatctactgctgctgaggcttacacgtgaccaacggcgaacccacggaaggaccataccgcccaaggtgacaaaacccaaggcacgacacaccctcgccgtcgcgattgccgacatacccgacctagcgccacatcgagtatacagtgaccggacatcaaactgaatgacgaactgaaattaatctgttctaacgcgagtagaactatacattatctaagagacgggatgagtactaatagtcactaattatcataatagacctggcatctgattgcaatattattggtggcgaatccttaccaaacaggtttgaagctgcagtgggcgaaaaatagagtgatttgcttatcttatcttaccgaatatagcttgctcaaatgccagccataaaggcaaagaagatgctgagaaagagactagcagacatgaaatctacttttgaaactgccacctgggaaggctgaggccagcaaacagtagtgagacaggcaccatctctgtggagagaggaagattgttccacgccaatgtaagatatgtgcaaaggccctgatgcaggaaagaggacgccatgaatctacaaggtccacagcacggcagagcatgagacatgacgtcagatgcagattgcacgaggcattgtgatcacagtgaaaggtctgggatgactctgaaggcattctacagtgtaagcagcagattgacgttcgattatatgtttaagatcactcttactgttgcttaaacatagattgagagaaggattaaagttgatggctagtatagtgacacacttgtcttcttagaaatggctgaattattcttgagtggtggtctttctatatttcgctccaagtacgaagaaaacggaggcg

SEQ ID NO: 16393 - DNA, 799 bp, Homo sapiens
gatgttcacgtcttggaagctttcatctggtagcaccatgaaactgaagaataaatacaacctttaccttccggctcgtttttgatgagctcttccattttcctctgcttcaaggtgtcaacaacatcagctaaactgcccttgcgccgttcaggagttcccagggctgtactagacaaggactcgccactctgtcgcccaccttcttctgccttctgaggtgaggtagatgagttgtgtggggcaaatgaagacataactttattgccatcaacttcctgaaagagaaagcaaaataacaaataattgtttacctgaaagagagagcaaaaggacaaataattgtttacctgaaagagaaagcaaaaggacaaataattgtttaaatttcagtaactttaaaaaattggttatatggcttattcagctgaaagatcaaaaagtgaaatgtcactctgcaagaggcaaagacaccaagagatctcaaaaaagaataacttcatttctcatggtagtactagagcaagtcaaagatctattcacaggatatccaaacatggagattctctccttaaactgagtataaatgaccatttaggctatgcgaggctatttattagattggttatttccctgctttgcagagagcctcagatcttctaatagtattaatgctatgatctttgggcaaaccttctgcccttgcaatataaacaaatacattcccacaatcatcctcttcctagagttgcctttcctgatacacctcaaaagagtcagctgtcgccttctttcttct

SEQ ID NO: 16394 - DNA, 877 bp, Homo sapiens
gtaagaagcaacatggactacgcattacactagaaaaagtttttctcttgttgtccactctggagtgcaatggcgtgatctcggctcactgcaacctccgcctcctgggttcaagcgattatcctgtctcagcctcccaagtagctgggattacaggtgcatgccaccaagcctggaaactcaaaatctgtccagaagacaagaaaaggagagatggcacatcatgcctgcatggattttacagaatacttttcatgtttgcatcatgtttcttcctttatggtctagtgttggatatatacaacttaagcagtcatttatttgtgtctcaagaattattcagagctgcggacatacccaccttctgtttgcagatatgccacatatttaccttggaatagttatgattggaaaaggacccaggggaatgtgcttccacattggcagactccatagttgcgaacgtctacctactcaatttgagactggattttgttttaaggaagcctcaagaaatggcctctaggaaatactgaaggctcaaatgacctatgaatggaatgatagttaaatagaggaatagggtttgatgtgtccagcaggctacttttgtttctatgttattaaggagtcgcgcttaatcctgtttaaacgacaacgtggtatagtagcagtgcagtgggtagactatagcgctcacttttatcgcgctcttatactccctatcttcttaccaccgcatataatcggtacacttgacgttttattaagacaggcttccacgtatgagccatacatcgtatatattgtagcgatagcatctcgcgatgacagcaatgtccgttgctacccacagtcttctcctaatactatattc

SEQ ID NO: 16395 - DNA, 277 bp, Homo sapiens
tcatttgctctttcctgtcctctcagaaatcatatatcctcagtgcaatagaaatggaaaaatgcaaagatacaaagaaacttttgaaggtcgcaaggctgagaggtgcttgatctggatttgaactcagatctctctgattccaaagcccacgcactttctactatgtcaactcgcctctgtcatgtaacataggataatttttcttgctgtactcttattaataacactaatgatagtaataaataaaactgagtttattataaaaaaaagaaaa

SEQ ID NO: 16396 - DNA, 865 bp, Homo sapiens
ttagaaaagacagcagatgtccttgctttagcttttgtttaacatgcttatggatcaattaactagcaggttctggacaactcttgattttaaaggatgtcctagagtgggtccaggatttagacatgtgcaactagtgaacaagaacctggaactcgctaaactgagggatgaaaaagatgtaatgctcctgcccactgagctgcgggcagtgggagtaaaagagctgtcattctccctcccactcaccaaccaataggagagaagaagctgctggtggccactccctctagcccaccaaaaacaggagagaagaagccatgggatgccactccctcccacttgctgagctaccggagtgaagaagcgaagctcctggcactactttccctggctcactgaattaagggagcaaaaaagccgcaacatagggaggtttacgtgtatttaatgttttatatgagccactatgcagatactcaggacatggatggatgaaaaaaaaatcgggcattttgctgtgtgaagtattaagacaaccctcacgatttgcttaaataattgggagtaaatgtctatcctttccttcaagacaaaaacaacacacaacggacttccttcgtctcccaggctgcgaccttgccgccgcattccctttatcgagggtctaattcatgatccttactaactgtacttcctgccattgcttgtctcgttgttctcaccccatcccttctctcccagcggcattccatattcccccgtccgggaccaccccctacgaccttttaacacatgtctccgtagtcagcaattaacacgcccacccttgatttataccacacccgccactagagcaaaaaag

SEQ ID NO: 16397 - DNA, 429 bp, Homo sapiens
taggggtgacccttctacctctccacaaattctaccagtggtaaagtgatgtctgtgccttcgctgcaaagctgcagatggatcaggtcctacgtaccagtgaaactactgacatcagcttgcctgaaggatcccacgagaagctgactcaccaaagaatgcagtttccacatcctgatgatttcatcccccgtaacccaaccaatcaatgaccccaattcccatcctctttctcctcatggtccccttaaaaatcccaacccagatctcctcagggagatgaattttagggtctcctccatctcatcgctcagcacccactcaatcatggctgttaccgtgcagcgggcataccatcctgttgctcctataatatctagtcatatgaaacaatattaaagaaaaccagtacatttaaaaaaaaaaaaa

SEQ ID NO: 16398 - DNA, 859 bp, Homo sapiens
tctaatgctgggcatttagaaactatctgttgcatataaaacatctattgaagaaaataattattgacttgactaagagaaggtgactaagcctccaacagaagatgcctccgacagatccagcgcataatgagcagagcaggtgacctggagtctgatctccggagtcatcacttctcaccttggaggaaatccacgatggctctctcacttgtattcatcttccatccgcagccactctataaattactctctccatgtaatcattgtttgacatttctcttgttctagcatgattggagtcacacgttttgtgggtgtatatacaatgccgattcacaacacacaccacgcctcccgctccatccaccttcaccgtgcgcatgatctccctgtatttcctcctttccacccccagaggatccactcgcccccccccgcaacgcacgtctcccgtacttgtcgttttgatttttgttcttgttcctcacccctttcacttaatacactgctgtttgcgtgaaaccgttcgtgtcttcctgtttttatcttccatcttactaatgtcctattacattatccaacgatggccactggagacacgctcttgcctctatcgatctcttaccttcttcctgatcctctacatgcttcattctaactactgttcgccggcaattccctttcgttcacgccctctttccccctccccccgtccctcgcagctcccgtgccacccgcgacactccactcttacgacacataatcccgcatacacacccacacttactatccatacctccgtcacacttcacccaccctcacttccaccacacgctacaccgttactccaccctct

SEQ ID NO: 16399 - DNA, 942 bp, Homo sapiens
  misc_feature (1)...(942): n = A,T,C or G
ttttttttttatatttnaatgntattttgatatatttgttgtattccatattagggactcacatgttcctcaggctggtgtggaactcctgggctcagcgattcttctgcctcagccacccaaagtgctggaattacaggagcgaggaaacattttctaccaggaatctttatgaaatgtgtttgtaaataacaaaaaacattttcaaattgttggaaatttctcagcagttggtgcattaaaaaaaaaaaagtttcaaccagcctgtgtttactcatcttaaacaataagtagcattgtttggaaaatgtatgttatattatctctctaaatacaaattgatacttcccctccataaaaaaacaatactgggtctccatgttcctccctgtagacatattgatggtcgcttttcttacttaagggtgaaatatagaattactacataactccactctcatcactctagcaccacatctcactcgccaccgctctctctactctttttcgcgagtacagccgatatatatcttatcacagtaataccatctggattgacttttttatgatatagttatattgcatgtttatatctctctcattttctcgactctgcttacttagtacttgagctttttacatctagtggcacttttatttatacatatttcattttcattgttccttctctcccttttatctcattttctttcccgttcaccttcttagactccgtggcgcagcttcgttcagctgatctcagccaagtttacgtctgtcagtctatccacctcactcccctccaccttcttctatctataccttactgcttgctctacacacatctatatattatcattagaatacaaaccaatccctctcctcctcctacatctcttcgcacacgatctttcacctgctctaaacataaaattcttacat

SEQ ID NO: 16400 - DNA, 240 bp, Homo sapiens
agaatacatccttcctgagataatgagcaccaattgcctggatacctgaaggaatggagacagcggcagaaaacactgcagagaggtggaaacatccgttaatattttaaaatcccattaccgctaccaacaataataatggatgcatagaaatagatctggattagctgagcttgaaacagtccatctcacacacacacaaaagaatttcaggtaatgaagaaaagaaaaaaaaaaaaa

SEQ ID NO: 16401 - DNA, 1206 bp, Homo sapiens
  misc_feature (1)...(1206): n = A,T,C or G
gaaanttttaattttngatataagnnnntagacctctgcatatctttaatagtgcttccgagattcctctagggcacctttgctctgaagatggctgtcatgattttattatattcgttcctattactggtcatattttatccatgcagtattaatgggaaaaccatggtgagatatggtccacggctcagatgacctacggtctgactaaataggacttatcgacatgtgtaagtcgactaccgtgatagactatgtcggccacaagagaacgttaaaggagcatgggtagtacctctctctcttgcctcgctttactctcaacctctcgctagccactcgaaccccttgcgtctttgtcgatctcgcttcattgttccatcattgcgttctacagctctgtgtgctcctttgtagatagttgtcatgtcttaatggtagtatcttcgtcttggtgcgacctgtgactgttgagacattttgatggagagaggaagtaggtgtcgcgcgcggcggacgcttgtatgcatctagagcatggagtacagaagtatcgncgcgattacgtccatacctgtaacatcccagctctatctcctactattgctccgtcgattgatttgtgtccctcctcctttttgcttctccgtgtctttactcccgccgtcgattacaccaattcttaatctattgncctatctgtatttttacatttnctacatgtcctttattgactacgctgtcactatatanccgtacgctcgtgttctctcgctcacgtccttcctcatggctcttncccccaccctttatgatctatagttgcgatgcaatctcgctcgtgcctttccacgtcctgcttctcatgcttctttgtcttttctcagttgctcacactatttcattacacctctgatgtccactctcatctctcgtctcgcgccgtctcgtacctcgattccgatactcgtcacataccttctgtcactatttgccctctcatgantctcctactcttctgtttccgacttttcgtcgtttcgctaagtgtgtcttttgctcatcattcttactaccactagcagtccatcgtgtatgctcctctacctccaccctccactcctccgtctacccgcctacatcatctatgtaccacgatactgacggctncttcactctataatcttactattcgtagcaatgtgt

SEQ ID NO: 16402 - DNA, 903 bp, Homo sapiens
  misc_feature (1)...(903): n = A,T,C or G
aaaaaaaaaaaaaanngnnaaagagagaaacaaaagcttcaggtacccgatgcctgttttccattttattccacttggatctcctgtagaatggctgtttaccatggaagggctgattccaattctcacgttaatcacttacaaggcagaaaccagctagtctagactggtaaagggctttccggttcattcatcagcctcctctgattctctcagggctcattcagatgttcccaatcctttcacaagattacaattcaacacatatggaagcacaaaaaaaaaatgctgatttccccacataaataataattaatcactaatgaagataatggtgacagactatgggacttaagaaaaaacctacgaggatgtatcacaagacaaatccttctaaaaattaaactatttgcagacaatcagaaagtcaaaactaacaatctcttaaacatttatcacatatggctgccataacacagcattcctatcaaaacgaacttttaggttcactatatctttacacatacatgcactcgcccccacatgtacccgcattccattcgttggatctactgactaacgcatcattacttaaacgcgagccacagtaacaaaccaactgtgccctcactgcccccgcagcagagcctttgcgaccaatccctttcatgagcggttacccacgacccccctcactaactcaccccattccaccaccctaccgtcgcaacgtgatctacgttactccacgtcctcccactgctcgccccactaccacggtccatccgactgcagcgcccgtctgcctacgcgacctcacggccccaccacccaatcccaacccctcgcccatctcaccgcaccacgcccatccacctcaccgacaaccacaacaccaaccag

SEQ ID NO: 16403 - DNA, 381 bp, Homo sapiens
  misc_feature (1)...(381): n = A,T,C or G
tggaggaagttaattttttatgaaatgtgtattgtgttttgttaggattgggataagttaacaaaccaaccccaaggtgngatgcctccccccatgttcagttcttccccacattccaacatagagccactctaacagaatctcaggatgccacctttcacaaatggtcatcaaattaaaaattttcacagctcctttgctgcaagacttcagagaacaggtaaaatgaacttcatgccgcgtactgtatacagaccaatgatggcccttgatgactttatggaatgagccaccaccacctcgagggatcccgaacaaccgtccatgaaaacatgaatcatacgcgatgccctgtagcctcccgaccgtaaccgccctgat

SEQ ID NO: 16404 - DNA, 885 bp, Homo sapiens
  misc_feature (1)...(885): n = A,T,C or G
aataaaagaaatttaaaattntatgtggtggggtgaagggatgagtaatttcgttgtggtcatattactcttaggactgactttggaggagatgaaaagaaggctacaatacacaccctttgacaaatatggctaagtatacgatcccatgagctgaatgcattttcattcttgccgagataggaggatttgtgacgacggcaaatgagagcgttaagtgtgcgcctagggaaagctcctatttgtttcgtgtctttgaatacgcattgattcccggagcggggccgacacaaacaccccctcgccgcgggggggacgcgggtggctaccccacccccagtaccgtaaatgaatgaggccgtgaagagcctccggttctctcgacatgaggacgataattgagagtcaagaaacgagagaagttatcctcgccctcccccaaataatcgctactcgatggatatccccccgaacgacgcaagacaccacgatgcggcccgccataaacgcacgccgcacccacgacacgctccccccccgctgataacccgcccccgctccggccaccccccccacccagcggcgctcctctacacagcgtgagcggcgatgctgcgtgcgaaatacaccgcgaccgatgcgactactccgcccgcatctcaatgcctaccgtcacttcgccaacagtgaagatcgagtcaaaaaactcgactgcgcctagtcgctcctctacccttcctcccgtcgcgcactatcccatgatcgtaccatctagagaccccataagttccgacaaaacgacaccaaactcgtaatattacaacacacaattatcgggcgacccagtagcgcccggcctctcgaggtgaatttcaaaacttcagc

SEQ ID NO: 16405 - DNA, 933 bp, Homo sapiens
  misc_feature (1)...(933): n = A,T,C or G
ctagagagacttctgaggtagcttgagaacatgccggcagagaggttgaattctgaggtgaaccagacattccaatccaagggagacagatgcttggaagctataatctatgacagagctggatagtatgttgcaataaagggtctgcgggcatgaacacatgaaggatgaggggaggtactggcggtccacccacgagcacgaagactaaacgtagagggagagggataaacgtactatccttccgcaacatagtaatgtacctcccccccccacgacgcgcgttgcgagcgctagcatgtagatttataaaaggtcgctagaataataatttatgagtgacagacctggtccactaccggccccccgaataatgggacggngccggggcgagccgcgtgtctggtgtcggcccattatgtatttatatagaatactaaattaagatgtgtaccggtccgatccataattagcaccgcgaaaacaactctaatcataaagagtaactagacctgaagcgcacgggtctctccccccacgccttccgccgccactcagtagtcgaacacccactaccggccgttcccctccccgccctccattgtcgtctagttctgtcctcgccccgtcaattttacacccaatccccacccccccgctctccgctcgctccaccctacccgtgcctcgagttcgcccgcctgcacgcgacccgctccccggtctatcagcacccccgccgcgcgtatgactagccaacgatcatagcgcaccatcggtcgatgccctcagattcagcgccatgccaatcccccgtgatatcacaccataccacgaaccacaccnccataatatcatcgccccactatcaatatcaacctctacccactcaccaccccacctacctcattgtcgtcgcacgaggcatcatcc

SEQ ID NO: 16406 - DNA, 1086 bp, Homo sapiens
  misc_feature (1)...(1086): n = A,T,C or G
tangttatattaaaanaaataaatnaaaatttaanannntttttaaaatangaactaacctagataaaactcattcagacactngaggatcggtttggcgctacacgcgcaggaatgcgcacactcaaggggagagaggatactggtagcatgtggattgtacatgattattacgacctctgcgcattcctctcttcgaacgcatagacctccaccaactactctctcaacctcgccttcaagcatctttgtacttggacgtttgctgctgtaagcgtcgccgccacgcccacgtccacgttctttcactatattttcttcaatcattttggtgtgatcgatctcgtgtatccagtattctttccttttcactcgtcttccagctccgccattgctttcacttagtgtattcatagctcactatgtctcactcaccgtcatccctcttagtgacatgccgttgnnagtgttattattcagcatatattctacccccatacccgtacgtgctctcccgacgattggctcttgcggcaccgccgtgtatttgacccttccttacccgcccactcccagtatttctcaccctccgcgcgcaccctcgcacgtccctctctcccctctcccgctcttcccgtatgctcatcgcgcctctaattattcctctctgtctccccatgtctcgcagtctacctcgattatttctttgcaccccgcctccgtgcccgtgtccaccccactcactccagtacttcctaacgttcgtcccattccnctccttctatgtctctaccctaagtttcactctctctcccttctttaccatcttccccaccgggctttcgtctctgtcctgttccgccaccgtcctacactcctccttaccgccgtagcccccctccgccctatcgcgtccattctcatcttcctcccacatcagaacgcgccacattagtcagatagattatggtccaagcttcgtcacacgcgcctcagcccgcgcgccaacacggccgttcgcctcctgtgtgttccgcctccacgcatcccgcggctcgacttctcgtgtctaccacttcgtatcct

SEQ ID NO: 16407 - DNA, 806 bp, Homo sapiens
  misc_feature (1)...(806): n = A,T,C or G
gangttgttaaaaagaaaaaaggaatgtaaactagaggattgagaatgatgatgctactaataatgacatatttcaggcagaaataccctgcttatgattgatatggaaactagaaccaagaccggctcctaatatccctgaagatcaaaacatgaatgatgcctcctctaacgagaactaccgcttgggaagatactgtagtatggaaaattaatattgacggatgatgcattaacaaaatatgatgaatttcaaaaaacaacacaaaaacaaaaacgaagatatatcaacatagatcatacttatgatccacatgaaagaaaccacaagaaaacacaacaacacccacccacacccacccaccccaccacaccacctccaccaacatatactaaccccaccacccaccacaaattccaccctacaacaccacacccccaccactcaccaccaccccgagtacccaccctaaactcgatctcgccccctaccgcccgccccccctcttatatacaccagaaccccaacaacacccccccccccaataaacaacatacatctatccaaatattattgtccacaacaactacccacacaaaacaaccaactaaaatacaccaaccaccagaatcacacagaccccccacctcatccccccacccccccatcaatccaacactcaaacccaaatataattccatatagactccaacaaaccaaaaagattctacccgaacaacttgcaaacaccctcaccctcccgatcccacaaccggacccagcaaccccacaaccccaccccaat

SEQ ID NO: 16408 - DNA, 941 bp, Homo sapiens
  misc_feature (1)...(941): n = A,T,C or G
tattaaatataaaaaaaatannnnntttgtatagggagttnttgattntgtaaaaaaaatttgaaacctnaanctttatgcgttggtgtggtacttgaggatcctagtacttggccatctacacacaagtattgatccaaatcaggtttgatgatgaattatgtgatgaaaactttttactaacttggattctcaagcatcacaggagcgtccacgagttgaggattcgactatttcggcgaccacaaaccctgtcccccgcgttgccagcacacaccgcgcctcacttctctgcccggcgccactggtcacgagacactgatagactgggttgggggaccgacgttagagcgagaactcctgtaccaactgggggcggcgatgatatcgacggagcaagacaggccgaaaaatgccgcgcgcgccagcctccctccgccgcccactcccgcccacctctattatctccgcgccatacaccttacgccacccccttccccccctcccccaacattcatctattttcttataccatttcttctgctatgattcatatgctttttttttcttgttatttctacgttgcacccgctgcagcgtctgtagaactcagcggtacaacaaaaatatacataatcatattctacggtgtatatactacccaatgtgagactactccagtgcanatataagcatcctgccactcctcctctcactccactacaaactctcaccgctctccccacgtatacacgaacgccaacagcaccacacaatgccatgccacgcttcacctcaccactttcacgcctccccgcgtcctcatcatccaccctacctgtcccactctctcataacactaacactagcccagtnaacgcgactagatcggattatcgcgcatctgcaaggttatctgtcttttctgctcatattcttct

SEQ ID NO: 16409 - DNA, 841 bp, Homo sapiens
  misc_feature (1)...(841): n = A,T,C or G
tatattaaatttatntttatatttaaaataggaagttaaataattaaataaaantatattttcggtgccgaaatgaaaacaaagtgcagcaaggcagtagttgcctgatccatcagcagtcacagatgtgtccagaactgagagagcctgccctccactcagacttgtccctcaagacaacaaaaggctcaatatcagaaaatcgaaagagaagaacaggcatacctggtctctcaggcaccaagtgaaaacatcactgccaatttctttcaaaagaagttgttccattgccacatttctttcctatttaacagcaaagcaagcatgagtcaagaaagaagagtgcgagaagggaagaactgcagagacacctccaaatggccggtcctctgtgtcaggaatgctgggccttggtggcgtctcacaggtgattgtgtctggcccatggaaaacagagcacagaactacctgcctgggcagggccatcagatttctttccagggaatacccattggactgggagaaacctgcaagctgccaccacgcacgctggagctggagacctgatatgaaactgctgcggaggacatctgatggacgggaagaacctcagactcctgccatacttcaggactaaatgcttacgcgaaacatggacccttgtatgcgtcctgtgagatggaccaaacccaaggccgggacgggactcgtatcaaagagaccgattgccggactcgagtacaccagaagctgctggcacgagtactatcactggcctggctggctatcaggccctggagggagcgcggtgaccgatgtgggcgccggaggggggaggaga

SEQ ID NO: 16410 - DNA, 832 bp, Homo sapiens
  misc_feature (1)...(832): n = A,T,C or G
tttgggttttttnnnaanananaaaggnnnangggttgattgagttggaagatagaaagaaaaaaatgtnccttgtggtgacattggagggagtcaggtttgctgcaacatgtgaagagagctctcaccagaatccgatcatgctggcaccctaatttcaaatttccagccaccagaactgctccaagaaatggaattttattaaaagatggaagaggaggatatttgacagaaggggaactacctaatactgaacactaatacagcccaggatacatacaccatgatcactaacactcattcaatctaactcaccctatcagcccgcggacaactctctatcgggagtgctgccttcttctcctgccaccacctctgccatgctgaacgcaacgccatgaataaacagtgaccgaattcctggacaaagcccccgccctcccccgctccacctctcttctctcccccctccccctctccttcccccccccaccctctcttctctttttcctctcaccctattccacaccatacacctcctttccctactcaaccccctccctttatctctctcctttccttccctcttccacccctcgccaccctccccccccctctctctcctcaactgcatctccccctcccccctctcttctcctctcccttttcccccccccctctctccccccgccctccccccttcccccccccccctcctttcccccctcgcatcttcacttaaccacctcccctgtcgcagatttacattaattcttcaacccccgtcagcccacaaacccccgcactaaataacttatatccccataccact

SEQ ID NO: 16411 - DNA, 335 bp, Homo sapiens
  misc_feature (1)...(335): n = A,T,C or G
tcnttctcctcnagggaaaacacaggaagcacttagactgtcctacttcttgcctggaggcctcttggaccagacctgttaccgtccaccgccagcttgctgtcaatggctcacacatccccaaacccagggctaggcatggaacctcaagccaggcaccaagtgactccactgaacgagactccacagactgcgacaggctacagaagagggggcccaggagtagtgagacgaacttgtctgaaattcaagtgagcacccaccagggaaaaagcaaaagctactacaggctctcctcagctctaataaaattcgacttctgaaaaaaaaaaaaa

SEQ ID NO: 16412 - DNA, 798 bp, Homo sapiens
  misc_feature (1)...(798): n = A,T,C or G
ggagaaatgnnggnnnnnnggggggggggaggccgaaaaaaaaaaaancnnnncctgngganaagnncagcaggttcagcggaaaacagngccagangagagccatctccctaaaagacttgcgctatcccagagccgccgcgctgatcggnatctatcctgagtacgatgactgcatgttcagccgagttttgaccctagatctttctcagtatccagacactgaaggccaagaaagcacgccgagacacggagagccccactaggggcaaaccttttttcgccacctgatcactggtcagataccactgtaatactcacacagctgctgcacaggagactgctggagccagcaggaccagcccggcgcgccctctacgagaaaccttactcgctctaaccaaacaggctgcggctcacttccgtcccacgctccccaccttcccctcgctcggacagcctccccaccacagccggcgccgacagacgctcgctacccccccccccgggtaccattcgaccccgactcgtttcaaattgcatcttttagataagaaaattagtatcggaaagggaagacttacgccgcccgatcctctgtccacaggacttctaacccgccccgtccgccgacaccccccatagtacccccgcccccccgaccccgagcgcccacaccccgttcgacccagccgtctcccaaagggatgcaacctgccccgctgctccccgagcaccgaccctccgcccctccttacttcacgtcgtcaccgcaggcacaagctacacaaaagagat

SEQ ID NO: 16413 - DNA, 960 bp, Homo sapiens
  misc_feature (1)...(960): n = A,T,C or G
ggggnnnnnnnnnnnnaaagaggagggagnagagangnnagaagggggggggnaggtttcannaaaaaacagnagaaggnactgtanagaatcaaaacaatgaaatgtgcacactgagggttaatgctatctgatgttgggtgtggcaaccagtctcccagaggagctcccactccccgcattaatgncgaaagatcgaaccctatataggaaagggcancactcatggatagcctaggaagttgtggcctcgagatggtgcgtatctgacccctcgtcgactcttccgtcatcccctgtctccagagccgctgcgcgcatttaccacccccccacagtggcgcctactccactcgaactccccacacgatgacagtgntgaggaattcatgaaggggtcaagcagacactcttcctacatattatcaaccagcagntttatggtcagaattgcccccctaacatttcgtccccccttcccgctccgcncacgcggcccctcctgacgccccgagctcttccgtgtctctatcttactctttccccctctcttctccctttcctctccctactcgtccatcgctactttccccgcncgcccccactacttttcctgttcttctcttttcgtctatttntattacacgctaacggctataatcagtgggcatggtcaacgngggtctgaccgaagcanccgtccgtccacatgtcgtctattgttacctttccatcatgccccccccctcctctctattctttcattcctctccacattctattcggtcctccgcacacttccgccctcccntattcttcatctttatatcctcttcacctcactttttcgctcgtccccacttcctgtgttcaccctccggcctccttgcatctctcccagacgcgcctcatcactctgttcgcgcgccctccgccgactctgcgagctgctacgtctct

SEQ ID NO: 16414 - DNA, 810 bp, Homo sapiens
  misc_feature (1)...(810): n = A,T,C or G
ggcaanatcctagtacctcttctggcctcttacttcctgcacacacacattagcacgagcaccccacatgccaggcggctcctcaacaaattcggactgcaacctaatatttaaggaagattccctgaaggaggacactcctggtgcatacactgggaatgaagatggtctgtaggttctgcggtgtgtggcgcttaactcccgcaaactttcccacctttccccatcaatccccccacaacactccatccgttccgactttattaccatacacaagggacgatgtaaaagagtaccagtcgctgatatcagcaccacacacactaacaccgtccgaatatctaccttattctacacccctccacctctaattctcctatatttctccttcattcttaaacgcaaaaacgacgaccccaccatgaaatagcttagatgtgttcgtctccacgcattttttcttacttttccttttttcatctccttctcttcattctcttttccacatcccattccccgtacttcacttctatattaacattctcgtgttattacttatatattaatctttatttcttccccccccacacctcatccatatactactattccttatccctctctatcttctcatcagcatccaccccaccctacttttcacccatttgttcgtataaacctttgtcaatataatcacactctctatactcccttcatctctctatatcctcttaacatagacacttaatttattcttaacccacacaattccctcattcacactctcgattcgtatcagctttcttaccg

SEQ ID NO: 16415 - DNA, 745 bp, Homo sapiens
aacaagtgcgaatccatcattcttctcaggttctggaaaaatgctggttttcagctcctggaaaattctcacaggacatctgttttgttttatatcttcattgtttccattcatctttcctactgtagacactgtctatgatttttttgtgtgggggttttggcaaagtgcatacgattactttgaatttagagaattaaattgtatttatccactgaaagctgtttttaagatctagctgtgttgtcacttggatatctagtttattacttctacttgcaaagtagtacaatgagataccaaaccaccatattttttccatctattttctcaattatggacactttccaacttattactacagtagggaagttaaaggctatttgaattattggagaatagagatacctaggatcagaattaccaagtcataggccgaaactttggctaagtcctaaacttaatatgggtaaatattgttacattgctccctagaatattgatatggtttggatttgtgtccccacgcaaatctcatgttgaattgtaatcctcaatgttggaggtggggaatggtaagggatgattagatcctggggcagatttccccctttgctgcggatgtcctgatacgagttttgacaaatattgggtgttttaatatgcttggcacgtccctgtcctctctcctcctgctctcaacatggacattgatgcctcattgtctttctccctcactcgcagc

SEQ ID NO: 16416 - DNA, 111 bp, Homo sapiens
tgcgtgaggaagacagtcttaaatggggctgacattgagaagaagcccgagttaagagaaccacagagaaatggagattaaatctttgaacaaaccttaaaaaaaaaaaaa

SEQ ID NO: 16417 - DNA, 124 bp, Homo sapiens
tgggaaatctaactaatggagtttttctgagacgatcatatccaagaagatcgatctttattttacgtgcaacattttaaccccacttaaataaactaaaaattgaagatgaaaaaaaaaaaaa

SEQ ID NO: 16418 - DNA, 287 bp, Homo sapiens
gtttgagtggtgggctcagtgttcacttccgaaaaatgaaaaattgcccatttttgtgaaacagttctactgatatgtgaaggtaccacattattcattgaattctcttcctgagtgaatgacatagaaccccgacagataaattaatatgttaaaattaaaagattatctaataaacaacttttccgttttaataaaattgtattttgatatattagaaagatttttattgtagtgaaaaatatatataaaataaaaaataatgatgttggacaaaaaaaaaaaaa

SEQ ID NO: 16419 - DNA, 213 bp, Homo sapiens
  misc_feature (1)...(213): n = A,T,C or G
ttaatgaatatagngtnaanaantnnaanaatatttnnnttntnataatntttnnttattnnntttccaatagctctactttcacttcctaccatgaatggaagcagcttgaggccttcaccaggaacagatgctgctgtcaagctttctctccagcctacagaactgtgaatcaaataaaccctttttgtttataaattaaaaaaaaaaaaa

SEQ ID NO: 16420 - DNA, 120 bp, Homo sapiens
atgcttttcctgagcaatagggtgcttctggtgattgggttgcagaactcactgatattgcctcctcaaataactgttgaaatatgaggttatgctatgggtgtgacaaaaaaaaaaaaa

SEQ ID NO: 16421 - DNA, 468 bp, Homo sapiens
taggtttcctgtattctttgtaaactgggatgccttgatgcctgagggtagaagagaaatgcattgcaacaacaagcactagcattctgtctcctggtttttctgatgacctccagaaagtgctataactccagaggctactagaggcaaaggcttttgtctcattcatcttcatttcttgagttcctgagcacagcaagtggctggcacaaaatgaacatcccatgaatattagatggatgaatgactagatacacaggttacaggctgtggctatcatacattgctatacttttaaaaataggcacagtttgatagcaggaaagttaagaatgctataaatccgaacctctcatggtttacctattaaggaatcatttgacttttacaacagtattttgtgacaattttttttaagtatgaaagctaagttggaataaaacaaatgcaatagtaaaaaaaaaaaaa

SEQ ID NO: 16422 - DNA, 339 bp, Homo sapiens
  misc_feature (1)...(339): n = A,T,C or G
aaaanaagggggaanaattnntaaannaagnnnnnttcagaatttacagtgaaatgacatacctcaatagattgaagcagaagcaaatatgagcatacagctgacttctatcaagacaatcatcaaagagatttgaaaaaatataaacgacatgatcttctctttatctactttttttggaaatataattatttttcatgaaaacattttcataaaaaatgagcttactattattcttgttaaaggaaattaatatttttcttaattttaatttctaatgcagtaaatatcaatatatagaacccaaataaaagcactttaaaagcaaaaaaaaaaaaa

SEQ ID NO: 16423 - DNA, 296 bp, Homo sapiens
  misc_feature (1)...(296): n = A,T,C or G
aaggggnnnnnnnnnnnnaagannnnnnnnnnnannnannnnnnnnnattccacacactgcgaagtgactgagatgaaaaggacttctcataagaatggagacccaatgaatcagcttctggaactgaggatagccaaaaatttaatgtatttagggctcccttgtgatagcacaaaaacaaaaataaaaatgcctcccgctgcctcctaaaataacaaaataattaaaaatatgatgagaaaaacttggatatattaatctatatagtaaatataatatattaaaaaaaaaaaaa

SEQ ID NO: 16424 - DNA, 168 bp, Homo sapiens
aacccctgggaggagctggagggacaaagacttcacagaagaatggagtcccaaagaaacagcttcaggaactgaggagagccagaaatttaatgtatttagggctcccttgtgataacacaaaaacaaaaataaaaatgcctcccgctgcctcgaaaaaaaaaaaaa

SEQ ID NO: 16425 - DNA, 193 bp, Homo sapiens
agagatggggtctccttacgttgcccaggattatctcaaactccagggctaaagtgatcctccagccctggcttcccaaagtgcggagattccaggcaagaactactgcgcccggccttgctcaagtatttttataattaccatagattctcatatatgattaaaaattaagataactttaaaaaaaaaaaaa

SEQ ID NO: 16426 - DNA, 774 bp, Homo sapiens
agatggagttttgctcttattgcctaggctggagtgcaatggtgtcatctcggctcaccacaacctccacctcctgcgttcaagcgataatcctgcctcagccaccagagtagctgagattacgggtgcctgccaccacacccagctactttttttgtatttttagtagagacagggtttcaccatgttggccaggctggtcttgaactcctgaccttgtgatccacctgcctcaacctcccaaagtgctggaattacaggcgtgagccacagcgcctggccttattcatattaattttcaaaaaaatgcaaagttatagcgacaaaggagatctcttgcctgaggccagggctgggggtgtggattgactgcaaatggacacggggagatggatttgttctaaaatttcattgtggttatggctgcacatctgtatacatttactaaaattcatcaattgggtgaatcttatgttattaaaagtacatcagtaaagttgtttaaacaaggaagaagaagtatggaactggaagggctgtacaaaacctgtatcacaatgagaggccctcatttgtgccaacagaaagtagcatgggatttcagaggatagaagtggcaaggtcatggaatactgaggtgtgattagagtcaaagaccccttgaaccttgtgttttttcctaggatgggcccttcctgagcttatgcctttctttctatgctcctggccttgtttctggaaatggaagatgtgactaaccaggttccaagtcat

SEQ ID NO: 16427 - DNA, 753 bp, Homo sapiens
  misc_feature (1)...(753): n = A,T,C or G
ctaggaattctttggaccttctgtgaataagccccagtcgtctgtcggatatgttacagagaatatcctctcctcttccagtctctggctcgcctttccactaggttttttgtttttttttttctgagacagagtctcgctctctcacccaggctggagtgcatggcatgatctcggctcactataacctccacctcccgagttcaagtgattctcctgcctcagcgtcccgggtagctgagactacaggtgcccaccaccatgcccggctaatctttgtattttcagtagagacgggatttcaccatattggccaggctggtctcgaactcctgacttgtgatccgcccatctcagcctcccaaagtgccgggattacaggtgtgagccaccgcacccagacgcctttccactctttaatggcatttttgatgaacaaaagtacataaatgttcaatttacccatcttttnccaacaaaactccccaaaaaaaaacaagatccaaaagaaaaacacaataaacctctaaacaaatgaactttaagaaaaggggaataaaaaattccaaaaaggcccctttgggccccaagggggaagtttgggggccctttccctttggggggggttacttcgggaccccggctcaacgaacagtgcgcccgggccttccgggtgggccaaaccgttcaacttcttcaaggggggtatccgcgctccccacaaactcgggttccccccggaaaaaacccggg

SEQ ID NO: 16428 - DNA, 133 bp, Homo sapiens
ttggcttggaggcatttgctgggcctgctcattgaaagtcctggctgtggcttcagactatcacatcttgttcagtttacattataatcagtacccattatataaaagattattttatgcaaaaaaaaaaaaa

SEQ ID NO: 16429 - DNA, 764 bp, Homo sapiens
tttactatgtcctggaaaagacttgtttctttcctgcattcatcttccttgtggatacaaaaggggcagccaagatcagggaaggtttacagcaaagctctgcaacacctggaaaagcatccacccacatttggagctcctgtgtttaattaatcttacactaaaatcactgcatgcttctgaggccattggtggcaattcctgcgactcctgtgctttttgatgaatttccctgattttctctcctccaaccctcccagaagttgtagatgccagcctgtatcaagctgatggatataaaacagtgaaggtttaaaagtcaaggaattggagccctccataagtccttgcaggtgaatgaaggaggaaagaagaatcaactgtggaaaccgtattaacatgcatgtagtgactgtgttatctgacttctcatgggaactgatgcagtgaaactgggaattgtgtactgtgtggtgctgtgagatgaaaagtacaattcactacacaaattaagaattatgggttacacggcagttcataaatctattagataatgcttccttgacagatcgggaaggtagcagtttaaaatctagtacctctaaagctcttcatgtctactggagaatgggatgaaagcctctgtcttcctgtcttgttgcaaaaaatactttctgactcccaaaaaaaataaaaatgccctccttgcccctctcgccggaacacttccgacccatacctttatcgacggctattcattacct

SEQ ID NO: 16430 - DNA, 803 bp, Homo sapiens
  misc_feature (1)...(803): n = A,T,C or G
tgcannanacnaacanttcagttttggcatcaggcaggagctggcctcatgagttggggagcttctacacagcaaaagaaactatcaacagagtgaacagaaaacctacagaatgggagaaaatacttgcaaactatgcatctgacaaaggtctaatatccagcatccataaggctccctttctctcttctccctctcattccttggtttccagttctttcctatgcacagagatgccctgggatgtcagagattacacaagctgagcactgatccagttttctcagaagatgtcaagtcagcacccactcctactctgacgcaccatgggtagctgttgctcaggtcccataccttcccaaatattatggctgggactgcttgatgaccagtgcgcctcgatcccaactggactatatcccacattgaatacatgatccaaccctcggctactgatttcgagcgacactatctagtcctacaccctgactttctctcccccacaccctgcctcgaccctactaccccactccgcactgccactttcccgccaacgttcccgatgctatgctcttgaacaatacctcttaccccaacactctccccccgcacctcaccccttcacctcctcacttaattgcgcctcattggactaaacttcaggcctataaacacactaccctttccctactggcactccataccttctcgcatcccttcccacaccacaaaccgctaccaccccccactcactccgcttaaactttttcctaagactctacccagcctcatcacgttacacg

SEQ ID NO: 16431 - DNA, 210 bp, Homo sapiens
  misc_feature (1)...(210): n = A,T,C or G
aaaanggggaannnaagggnggnnnngaagnnnnnnggaggccctgggtggaacccatgatcatgtctgtaatnctagcactttgggagggtgaagcaggtggaccactggagctcaagagtttaagaacaggctgggaaacgtggtgaaataccgtctctacagaataaaataaaataaaataaaaataaaaagaaaataaaaaaaatg

SEQ ID NO: 16432 - DNA, 184 bp, Homo sapiens
tgttgtggatattttaaacaagtcaccttggagccggagaacctttgaggatggcatggtggaaagaacattgacttggaaatcacatgttgataataatggcaatgtggatgttggcaatttacttaatctctctgaaggtgtttcattaaaaatgaaaatgaggaacctaaaaaaaaaaaaa

SEQ ID NO: 16433 - DNA, 758 bp, Homo sapiens
atgatctatcacctttactcctgtcactgctgaagatgttttttgctggattcccttggaaacagaagagcatgaatgctacagctttattagagggtgggagttaaggattgggactgcaatctcaagacagagtaagtgacgaaaaaaggaaagggaaacaaggaaggattgcgagcaaataaagttggagcaattttgagcaagtcagaacttcaaaagaaaagccatgtcaggccgggcagggtggctcatccctgtaatctcagcactttgggaggccgaggcgggtggatcacgaggtaggagttcgagaccagcctggccaacatggtgaaactccgtctctactaaaaatacaaaagattagccgggcatggtggtgggtgcctgtaatcccagctactcgggagactgaggaagggaattgcttgaacccaggagtcggaggttgcagtgagccgaagtggtgctactgcactccagcctgggcaacagacaagacatcatcaaaaaaaaaaagaagaagaaagaaggaaggaaggaaggaaagagagagaaagacaggaaagagagaaagaaagacagaaagaaggaaagaacggaaggaaggaagtaacgaaaaagaaagacagagagagagatagagagaaagaaagacaagaaagaaagaggacagaaagaagaaagaaagaagaaagaagaaagacgaatgaatgaagaaaaaagaaagatgcacgaagaaaacataatcctct

SEQ ID NO: 16434 - DNA, 811 bp, Homo sapiens
  misc_feature (1)...(811): n = A,T,C or G
ganttttaaagaatttttaattttggggtttcatttgttgaacattctagttttgtgttcctgacctaaagccatccacctgcctcagccttcaaagtgctggtataacagattaagagtgcaggtgcaattttgttacatggacacctagtgtaatggtaattttgttacatggacatcttgtgtaatagtatacatcgtactcatcaggactctatgtcttggctgatgcacagcaagacttttcagaatctaccttagaagtgattgatatcaaggctgtgttcattttttttttcaccaaaccgggaatggagagaatgtccatcaggatcagtttgaactcttgagagactacagtttatcatggaaacagcatctctgcaaatctgctagaaactgactcttttcctgccatagttatttttgatctcacgaataccaaagtcgtaatttttatattcacttaatgcctgaaagttctgagacgtttcttcttataacgttttctgtccgcccgacccggggtgcgaagacattccttaaataccccaagcaaattgaagtggaactaatgaaaagaagatctgtttcctacccgcccctcacctcactcatccccccttgacacacaaagcataaatttcttcagactctcttgttttttatatacttttataacaagccaccatctgcctcccctttcctttaaattactattcagctttttttataagcccaggatcctcatttttaaaagtaaatttagtaatctctattttcattttttttttatatcgatacattatat

SEQ ID NO: 16435 - DNA, 185 bp, Homo sapiens
gctaggaagtactgcctggaaatgtagtagccatctacgggatgatatcaaaagccacatgctgagcattgtgaagggaagaggttgaaggagcagcaagcagttgcactagtcctggacttgtgagttacggatttcttgtgacgtgagaaaaataagcccctttttggtcaaaaaaaaaaaaa

SEQ ID NO: 16436 - DNA, 278 bp, Homo sapiens
ctgatgcttggagtgcttgctgtaaaccaagaagcatattttgtcaagaagttggtttggttgcacaggatctgaagatgttcaggcccctggaagccccaccactccccggaaaaacagtagaggcagcgattgaagaaagtaacagatacttccaatcaatgagcggagtcttatactgaagaaagaaaagtgcatacatcagcgggaaaatgctactaatgtattatttccttgaaaataaaccaattcttgaatgagtcccaaaaaaaaaaaaa

SEQ ID NO: 16437 - DNA, 779 bp, Homo sapiens
cctagatgtaccattcttctgcctagaaacgtgaatcgaacaagacagagctcatgttacagagtgttacctgagcacgggtttttaaacaagaatattgaagaggacctgagcaaagacttgaaggagagagtgacgacaagaagaaccaaggggcaacagaagcagagattgaagttgtgtatcaataagccaagaaacagcaaggattgccagcaacagcaatttctgattgaaagaaataggaaccaagtctcccccagacccttttttttttgtctggctcaactgatgcttagatctcatacttatttctgacctccccaatttgagagaataaatttctactgttttaaaaatcaaaaaacaatggcctcgctgggctgagcggcggtccctctcccgccccttcccttccccgccggccaatccccgatccctcccttgctcgctccgctcctctccctccttcccttctcaacccgccgccctcccatgccctccccccccacctcgccgccccaacactccccccatacccccccaccccccgcggccccgcgcccctcccccgccccccccccacccccgtccgccacccgtcccccctcccgccctcccacccccccgcttttttcacccctcgccgctctcttcctccactcgcgccccttctttcccctttctttactgtacgatttctccccgccttaggcgcacgccctctttcgccctcctcttctctcattacttcattacgaatatcaccaagaatctat

SEQ ID NO: 16438 - DNA, 177 bp, Homo sapiens
gacgtcaaagcattaactgccttctacctgtctcttctactttaataaacattgacaggatgccgctcatggagaaccagttcagaaattcatttgttgaattttagtaaataatgccactagactttagagctagtttacataaaaataaaaattaagaatttaaaaaaaaaaaaa

SEQ ID NO: 16439 - DNA, 162 bp, Homo sapiens
  misc_feature (1)...(162): n = A,T,C or G
gttttagtagcaccggnagttctggggtcagaattgatgtctcctcagcatcggatgaatctgcagacagaatgtacttggctctccagaattccagctgggaaaaaggtcctgaatgattcattgttatcaattaaatttactatagcaaaaaaaaaaaaa

SEQ ID NO: 16440 - DNA, 437 bp, Homo sapiens
aggaagagcgaaggcattccgattgctgagacttggaagatgcaggatgtgggttcagccgtgaggtctggagagaccagactggaattgtgggagagaaagtggaaaggcagctgaagcattgaaatgggcatcttggccgggcatggtggctcacacctggaatcccagcactttgggaggctgaggcgggcagatcacctgaggtcaggagtttgagaccagcctgcccaacatggtgaagccccgtctctactaaaaatacagaaaaattagtcgagcgtggtggcatacgcctgtaatcccagctactttggaggctgaggcagaagaactgcttgaacccaggagctggaggttgcagtgagccgagatcatgccattgcactccagcctgggcaacaagaatgaaactctatctcagaaaaaaaaaaaaa

SEQ ID NO: 16441 - DNA, 194 bp, Homo sapiens
gcgcagacattttttgaagtgcacacttaaagctctggcgaaaggtccaaaatgatgtcctaagaaggctacaggggaaaacagacaccagctatctctgctgtttgctgtcagttgtgtctgtcttcatccatttactcattaaagaataacttatctctggtctgtaaggaggaattcgaaaaaaaaaaaaa

SEQ ID NO: 16442 - DNA, 142 bp, Homo sapiens
catgtactgctttatttataccgttgactgaggtctgcagctatggttgcccaccactttagatagacaacgtatcttgtaaacagaagacatacacttacagtatgaataaatacagtagagtactttaaaaaaaaaaaaa

SEQ ID NO: 16443 - DNA, 566 bp, Homo sapiens
  misc_feature (1)...(566): n = A,T,C or G
attctagactttcaattctattccattcatctatctttgcgctagtaccacacaatcttgattaccatagctttgtagtatgttttgaaatgaagcagtgtgacttctgtaattttattctttctgtcaggattgttttggatattatggcgtccctctgcccttctgtatgatctccacccctcacctcgcccactagccgccaagatggtgaggcgaggtcccgacccatcttgactccgcggagcgcatacatgcatttgttgagccatcgtcatggtaccactacggtggctcgtcgcccagtccatgcgcaaccccggaccccgttggcgtaccacgggatggagagccgaaggtganccggcgcggtgcccggagcggccgccgcggtcacacctcccctttcctctggctttcactcgtttgacatccctgcagcgggtctccggcggtgcgaagtcgccggcaaccactactcgcttattatctccggcggttccgtcaatgtctctgttcttctcaggtcgggctacggcccgtccccgttcccatccccgccccag

SEQ ID NO: 16444 - DNA, 765 bp, Homo sapiens
agggagccttgtcttccagagtctctgatcatggggaccctcacaagaagggtcaaggagaaatcggttactcttgtgattaacccagacaaccactgttccagttgcttatctgctgagacagcagttcttgaccccagctatacattaagcttaaaaaaaaaattactgttgcttggaccctagcccaacttgtgaatcagaatttctgggggtgggtcccagccactggtgtttttgaaagtctccctgggtaattctaatgtatattcagtattgagccccactggcctgacactttcattcccactgaaacagaagtaatccactacagaggagagaaggttgttccactctaagccataggagtttttagttatcatagctccaaacccataggaactggcgtgagagcgttcttacgtgggtgatggatgtaggagctccaggatgccttggaacgtcttgtcccagtatgtttctgcttgtacaggtattcaaaatgagggccaaacccttctttggaatccaactctgctctaagctagttggctgcccccagaccaggatttagcaccaacaaattgagaatgtgatcagaggactggggccactaacataactggaaaagaaaaacagataagcattctcccaactcctgttcaattaattcaacaaatagctgtgggcatggcctgcaaaggtaccaagggggcatgactaataacttttgctttggggacaaaaagttctgcgttcttatgc

SEQ ID NO: 16445 - DNA, 819 bp, Homo sapiens
  misc_feature (1)...(819): n = A,T,C or G
ggggnnnnnnccggggggngnnnnngggggggcggagnccccggggccacagatagccaagactacagacatctaaacccccattggagattcgagtattacatatgcagctccagcagccatcttggtttagaatatgatggaatggagaatgtaagccatgtgcagaatgatacttacagacaagggactgtgtactttcattgaaccgcgaagctgccacaggcgccttggatactctccttgtggacacctttaatgggaaagaaaaatagactatcttgtttagggcaaaaaacacccaccacaacaaacacaaaaagcagagaaagtcaaacaacgaaaagaaaatccagcaaaataaagacacacccgctaatattatgcagtnaagtggtttccgcgccgcaccccggtcccccacccgcccctccctgctcactataagtttttgatacccataccattcctcctaccttcctccacccccatttccaaagcaccgcgacgtaatggacgatgctatactaagtcataacgacagtactcaaatatatcaggaggaagacaccatggatgtaaggccggcttgcggacgcgggacgtcgtntgaagcgacgtcccgtgactataggctactttccccggtcctacatgcccacccttatataaacacgacaaccccatacactctatattcgtttttgatagctatcgcgtcctaatgataagtgactcactagttgagataacggttaacggctcacggttcatatgaacctctcaaacacagacccagacaggtagcccgaagcagaa

SEQ ID NO: 16446 - DNA, 1778 bp, Homo sapiens
  misc_feature (1)...(1778): n = A,T,C or G
accacaancccaaanaacnaccaccaaacaacacgacacaannnnncnnnnncccnnccncncgcgcncncagcagcngcaccacaccgcanncacacacaccccagcgcgcgcaggggccccttgaaggtaagngannantcacncacatcgtcgacnagncngatttnanagcaatngntntcanctncaccccacgctctngctcgaccttcncgngaagaaagncatnagtcgacatctccntcgcacgagagagcaaacangacctactnatccatctatntacactcaaaactagcnactnatntcacccgctacacacaacgcgcgcaagtcgtaagcagcaggactaatgaacgtcatcggctggtatcacataggaataactcaagattctgangaggtgtcacacccaacacacactccgaacctcgccacacccgcatcataccacacacctcagtcntcacacacactcacctgtcgaccactcaantcacagcgagagagcccntactaaccagcaccnccacgcccagcacancacgccgtcgacnacgtnccgnnanacactgtcgnnnannnccganctcatcgacatcagatntatataaanntgatcttctgatgtcgtcccactaatacgtactagntncantantatngtgaattcgccaatngatagagtatatactcatagacacgcacgtgtataccgagtcgtgcacacacagacagtgcagtgatangtcccgcgcacgcgtctgngacnancncnagcncgttnatccgtcggcacantcgnngcnccctgcacgccgcagccacgcaacagangngccgccgcgtcaccatcgtccacgagacgaagcgcgcgacagacaccaccagtcaactntagtccactctacgcagcacgcacgcacacgaatcgttaatcatatacacgcgcncacagncgctctcacgacacgctctcgtacgtgcgaccctcacacgttacgtcgngcgngcgtgcctgcactacgtccctgcgcagcgtctcgacttcgtctcatctcatcagcacgatcacacgcnatctacctgctcnatcatctcgctactcacgcgctgacgtcgtcgctctatgttctactacntatcattccacgcgcaccaccnctcacnagtactatacatcantntntntatctntatctctaccgtagtcgcctctacgcacagcatcnctaccacgtacatccgacaacacattgnatagacagatctntatnctatcatctctcactcgcagctcntnacacgtgtcgacagtanagcatctacacgtctacatctcagcgacacgcatggccgacgcagctactgctagcactacagagacacgcnagagagntcattnattgagtctcgaccngtncgtcgcgacgctcccattgncgctagcatccgtacatcaccgcgcatgtcggcgctaccgcgaccgcncgtacacactccctctgcgactctcnactacatcgcgatcaagntcgacatcacgnctgctctccanctcacatacgtcgacaanagcacacgctccgcttcgcaatacgacaccgacctacccgcngcagncgacactcttgatcgancacncncgatacagtcacatactcagtagcatagatctcantcacacgtactctctagatacatactatcatacaacacacacactaacgacaccaacntacactacaacgagcatcccacaacgctatacagcc

SEQ ID NO: 16447 - DNA, 802 bp, Homo sapiens
aactgagaaagcagcctgtactggaaggatgaattttggacgggctatattcccagtgattcaacgagccctttttccactgtctgttctctaacaatccccgggcctgaccaaacgtttttatggatgaaaacatttcgccggaaaaaagatgggtgaacaactaatgaacaatgacacgaatgaacaaaacatttctgctgaatattgtttattcttgtccccatatactctctggatcacatacttcccctcctttccaatttgcgccgggcgccgccgccgtccccgccgccgcggggccccccccgcctctctttttgtaatgatcaattacactaacactctgctgcttccccccgcccccccccccgccgcgccccccctgtgctcccggcccccctcccccctcatttttttcatcaccactccctcttatcatcccttttctctttcttcccggcattatttgagtgggccattccctttgttcttttttacctcctcaccgccccgccctatcaaactcgctttcttccgatactccgcctgttcttttttcttgtctgtgttgttccccgcggcgagcgagccttatagagaaaattgataccatttcggtttgtaactatgttgatgtgtctttgttacgtgagtcgtgattggatgtagtgtttggtgaccaagacttccttacgccctcgttgtattactatctccttcacacttcgtctaccctccctccctagttgcgccctctcttcgatcccgtgtccctcgttcccgacccggcatgcctcct

SEQ ID NO: 16448 - DNA, 767 bp, Homo sapiens
ctgttatgtcaccttgtctctgcctcagcttcctggtgcaactgtagccagaagaggagagagaagaggacattggagtgcacgagaagaatatattataaaagaatattgcttgattaaaaagcattttttactggataatacttcttaatttagaaaaataccaaggagggctttaaaattgtatctacacattgtggatctctttcacagtctctgcactttccccacattccctgtgaattttttgtttcttcttccttttgacttatttttttttttacacacagggacttgctctgtcacccaagccaaactgcagaaacatgaccatagctcactttaacccccaactcctggactcaagtgatcctccagcctcaacctctggagtagctgggactataggtacacaccaccacactcagctcatcaaaaaacacaatgtacaaaccaggatctcccactgttgcccaccctgggctccattcttgacctaaagcactcctcctgccttgccctaccaagtgctgggattataattatggcccaccatgcgccaccctctccataccctttacaatagtttgatatcacaaatgcatgtatgactaagagaaatttgttcttacatgaagcttgttctacacagtctcacacctcacattcgctgctgtaatagcgtatggtaccacttaacagactctcattagacccacacatacgctctcgaccgccacgctctctttttgtaacacacaccccct

SEQ ID NO: 16449 - DNA, 351 bp, Homo sapiens
  misc_feature (1)...(351): n = A,T,C or G
ccgcaanacccccccccgccccgcccccccggcccccaaacccccaccgcacagaagaaaagganatgctaggtttctgacgcatggcttaactgaactgatgagaaaccagcgcactcaatgggttccagatgaattattgaaagcgcaattacagaagcctggccacctcaccttactggccaactctcatctcccataacgaagccctagacttacaatgagcattgatggaacaggttccaataacctgtctggtcggatgcataaccactgtgaagccctgatgctctccaaccagaggaggcagagagcatgaaacaccaacacaaactctcccaatataccaca

SEQ ID NO: 16450 - DNA, 887 bp, Homo sapiens
  misc_feature (1)...(887): n = A,T,C or G
ccaaaannaacaaanggaaaaacanacaaagccccagccnccccacaaccccacaacacacctaggtttctgtggtctattctgtcctatgtgtcttgagtgtgacatcgccaggcattatggagagtgtctttgctggccgttgaaacctgggaccaccttcgcactgagaattggcaccagggagagacataccatacacggaacactgtgagaagactggatggcggtgcactgcctgctgggattattccatctgccacgaggcaccagaactcaccacgacgaccttcccacactatgcacacgtaccgaccccccacgacaaacgccacgagtgcagtgtgagcaaggataactcatagtagttactgcacgacgtatattgtacccgcgcatcccaaataaaactctcactcaaccgacacacaccacacccccagcgccccaccccacccgctcccccccccccctatatcctacctccccacaaccccccaccgcgcacacatacccaacggccccgcccccaccccacaaacccccaacgccagcgccccttatcacactctccaccccaccactagcaagctaccgacagcccgccccccagtggccaccgcaaccctaagaagcacgcacagcccgccccagcatcctgtgccctatccccaccgcacaacgctcctaaaatcagcgagacgcatcgtcgtcggaacactgagtcacgcccccttcccgccgctttgagttccgcgaaaagggaccacgcccacacacttcccaatcacaacctcacctaactaagcccacatcgacgacggcctcacagatgcacttacactcgccaaccccccaaccccctccgcgcccaccccaatgcacca

SEQ ID NO: 16451 - DNA, 1670 bp, Homo sapiens
  misc_feature (1)...(1670): n = A,T,C or G
cccctctcccccccgctntgccccgggctcgggggagtagtggtggatgcagacataggacacagtgaaggagtggaataanctaataaaataaaacgtctcccgtctgtattgtatgtgtgttgtctttaccactcgtatagttgataattctaaagagatgttgtagatgagacttgcacagatttagtcgaacgtcaggcgagatgcacgaagattgcacacgagtggtgtaagcccggtgcacgtggcacgagagaggcgcgagcgcgcgcggtaggacagaacacgaggggcggacgaggtgcgcctgccgcgctagatcggcagtgcaagcgtgcgcggcgcggcaccttatatcgcgtatgggtgagattctgtttgagtgataaacataaaacgataatacaggtaaatgaaagtttagtacgcacgatatatacacacagagacgcagagcggggcggcccgctgtgtttttttggctccgggggcggctacgccggagaaantggcgaagaagagagtaaaataagaagcaggacgtcagtcagagaggaacgcgagagangtggcggagaagagaggaggaagatgtgtgttgtggcgtagcgaacggcgccgacgaatcactgatacgcgcgaacgagattataaaaccctattatcgaagtatttcgctcgatttactcnacagacagtatgctcaacatatcacattatctncnctatgtatatcagcgcataattctctcactgcaagtattcactactcttttcgtatatctatatagagtgtcatgttcgagtgtccctccgacgcgactttagtattgtgtgcgagtgagagaggacataagantatcaaatgatgcgaagcactcaagtcagtatacgacgaggtacgatcattctatcgtcacgagttgatcagacgtaatcgccacgcctgtacgcacgctgtgtttatgcgtattctcgacagccacacgaggcttcgtaaagtgattgaatagtgaatgctcgcagaccttcgcgtattcagaatacagatcagacatagtgtgtaacgcgcgtagtgaagtagcaacagagacgttcgtgtatgaagtggaatacgcacataacaaacgtgacgtatgatacgataacgcgacgttggacgagagaagacgagggagttagtatatatgcaggcgcacggaggggtgatgtataggtaatgtgaaatgaggacggatgacgagaaataattagcatagatacaatacttagatatgaacattaggtgatattcatatcattggtcgtcttagattagaggatacgtacgttagaccagcgcagtgtgttctaagtgaatgacagagtaatttgtgattaagtgttatcgaagcgtgaagaatcggaacatgatgatangaacntactattactaccacagacattatcgagactcgtactctaaaatttantgtgagcgactncgacagaggtagaaacaacgcaangantatgagtgaaggataagatataatagcaatcctcgtctcactacttcgcgacntcagagaggtgctgngtgattcgcactacacaataanaacgcgatatcgtcactcaagtgttagtgtgtgttagtggtatagtatacatgagctcaatagacg

SEQ ID NO: 16452 - DNA, 1479 bp, Homo sapiens
  misc_feature (1)...(1479): n = A,T,C or G
ccccccccccgcggnngnggnnngcggcgccgcgccggggcttcttgttggccggtggcgccgtccgccgcccgccttccgccggggcctgcgccctccgtccgctccccccccttatatagttgtttcttgtgctgccgtgtcaactattttccttttccccccttctggctctcctcgtccccctactccccccgtctggtggcggtcctccgcgttgtcgctggtgttggtggtcggcgcgttgtcgtggtgggcggcttgtgtggcgcccctggccgggcgtttgacgtggacgcgccgcggtgtgacttgcggtccgcggcacgctgtatccatcttctctcgacgcgtagcgcgtaacggatgttgcgctctatacttttattacttccaatgtatacaacagccgccgcgcccgcacggcggtgttttttatgcncgcggcggccgtaacactttctgttccgccaagttagtaatgagactgcgtgattatatgtggtggcaacgtgttaattattacccacaggaagcaataggtagcgcgtatgagcggtagtctaaccatgccactcgccactatcgcaatctacattcccaaccgatctgataacactcaataaaaacacacaatattcttgacgccaagatctatcgtcccattagtcgccgacaaattaccctcgccacgttcccattatttcctttttaagatacaacagtcggagggtccgggcgaatcatttctttgtcttggcgtcacatcatctgttagtatatgtcctcacgtacttatataattatttgtacagtggtccctacaacaccgcactaccaagtgtctccagtacatacagccaccgtaactatgaagtgcaacgaagttccagatcacatgtacactcacgttactactcgactggcgcggagggtgcagttacaagttcccagcgcaacgttgtaccttggtatgcttcaccctctcccgtcaactagactgaaagcggatgtgttcgcggtggcttacttattgtagtttttgaagcgcgtctacctcagacaaaacactactttcccaaattacttgttgcattaacgtataatgttgtataagatccgagagcgtatatgagttaggttatgtgtcatttttgatacaccacatcgctaagatgtatagtctggattgatcacagcacgcgagatagacaatatattctctctttctattctcctacagttaatagtatccgctgcgtatctacatagttatcgcgtggcacgaacggcatttcgtcgttagatattgtgttggcacacgtatagtcttanacatttaacatgcattaaccagaagtacgtactatatntgcagtctgtgtgctacgcgcgcgcctatatattcttcnagacanacgcctagntacggagtntattactgatacagtctatatntctccgcgttacatacacact

SEQ ID NO: 16453 - DNA, 760 bp, Homo sapiens
  misc_feature (1)...(760): n = A,T,C or G
aaatgaagtacacaaaaagcaaatttgagtgattttcatattcaagttcaaagtgggtcataaagcagncggagaccaacttgaaatatcaacaatgcatttagcccaggaacgctaatgaatatatagtgcagcgagggttcaagaagttttgcaaaggagaagagagccttaaggatgaggagtatagcggccagccgttggaagctgacagcgactaactgagaaaaatcactgaagctggtcctcttgcagtacacgagaaattgccaaaaaactcagtgtctacgattctatggttgttcagcttttgaagcagattggaaaggtgaaaaagcttgataagtaggtgtctcatgagctgagtgaaaatttaaaaatcatcgttttgaagtgtcgcgttctcttattctacacaacaacgacaaaccatttctagatcggattgagatgtgcgatgaaaagtggattgtatacggcaaccggcgatgaccaggtcagtggttggaccacagagaagctccaaagcacttcccagagccaaatttgcaccgagaaaacgtcatggtcactgtttggtggtctgctgccggtctgatccactacagcttcctgaatcctggcgaaatcgttacattcgacaagtattcgcagcaaatcgatgtgatgcacagaaaactgcagtgtcaactgaaagggcccaattcttcttcacgacagcacctgaccgcatgttgtacaaccaatgcttcaaaagttg

SEQ ID NO: 16454 - DNA, 746 bp, Homo sapiens
  misc_feature (1)...(746): n = A,T,C or G
ttagnaaacctggtcctactgnacttctgagatcctttggctcttgggaagaattacagatgcttcagcagtttacctcttccttgcacctgtgtctccaggaaaactgcgacgctatggtctgaatctcaaatataatgcctgctcacactggggacagcagcctactgagttcagcaatttaaatgcgaatctaatctggaaacatcctgctgtggactgaatgtttgtgtcctccccacccacaaattcatatgttgaaatctaacccacaaggagatggtatgaagagatggagtcttttgggagacttatttgcaataaaacatgtatgagaacttgaggtgggaggcaggtggaactcatctccaaaccacaatgaggactgactgaaacccgcaaccggtgctgaatgtacctcctgctgctgatcaccataagaccctcccatcagagccatgacagttaaccatcgccatggctccccaacgaagctactgactatttcctattccttgataacccaccccccaactagcatgcccttaaaagtggctcccaacgcgtctgcacactgcccctacgctgattctctcgacacaccacctacngaggtaaccctgctctgcacgagcacatccattactccacctctgctgccgccctgtaatgccgttttctttcaaaaacccccaaatggccccgatcccttctgcatcgacttacgcgcccctcacctccactag

SEQ ID NO: 16455 - DNA, 764 bp, Homo sapiens
cctggccgtactactacctagacgctacatattgaaactagaccaattaataaccctacaatggcctctaacttttcaagtgactaagtgtttttagtctagaaatgattaagcttagtgaggaaggcatgataagagctgagataggctgaaagctaggcctcttatgtcaagcagttagctaaactgtgactgtaaacaaaaagcttctgatggaagtcttttcctttgagtacacaaatgataagaaagcaaaacagccttattgctgatatggagaaagtttgagtggtcgtgaaagaaaaccaaaccagccacaatattcccttaaaccaaatcctaattcagcacaaggcactactcttttcaattctgcgaaggctgagagaggtgaagaagctgaagaagaaaggttgaaagctagcagaggatggttcatgcagtttaaggaaagacaccgtctccataacataaaagtgcaaagtgcagtagcagtgttgatggagaagccgcaaccaagttatccagaaggcctacctaagataattaatgaaggtggctacactaaacaacagattttcactggagacaaagcagccttctattggaagaaaatgccatctagaactttcacagcaagagcagtcaatgcctgttttcaaagcttcaaggacaagttgacctccttgttacgagccattacaacgaatgactatcactcgaacgcagtgctcgcgcaccattctgaaaacctaaggacctta

SEQ ID NO: 16456 - DNA, 377 bp, Homo sapiens
cttgatatcactcagccttggttaattgttttgattagagagagagaggtctctgagatggtttgcagtgagagcgtcatggtttgtgcaggcaggcagtattctttttgtctttttattgggccaaggacatctacagattttatcaataggtgcataaaaatttgtagatgggggtggaacaaagtttcattctctccatagacacagcaccaaaattatcaaattgaacacatttctacttgagtaggctcaagatttgtccttagcctgaattgtgcatgttcttccttttaatatgcatttttttaaatgccaggggaaatttaagcggtgtttattaaagcagaaatgtattgatgataaaaaaaaaaaaa

SEQ ID NO: 16457 - DNA, 194 bp, Homo sapiens
cttggtttattactgcagaggaggtatctgaagtcagattgctctttctttacttctaattaacctgtcggactcgtcacttgttcatctttctgccttcggctacgaggctagacatatttactccctctccttcactgtacatgaatacagcaataaataaaaatcatgttcttcccagaaaaaaaaaaaaa

SEQ ID NO: 16458 - DNA, 781 bp, Homo sapiens
  misc_feature (1)...(781): n = A,T,C or G
catgagacgtcaaagggaactatgaaagtttcaaagaacgttgtgttgacacagaggcattaggagatcgtggagtccttcaagtggaactgagagacctggtttctggtcccagtttactcggctcaagtgagagatttatggtttcttcgtcttcctcttgctgtttcctgcaaattgccatatcatcatacaagatgccagccctcgtctcaaatcaaaaactgaattctagaaatgttggagcagtcagttagccataactgtatgttcattttaactttatggatggtcataaagatcactgtttcagaggagttaaaggtgagcgcacttcaactgcttctcaagctactttccacatggctttttattccagtggacttgaaaaatataaaggaggaaaatcaaatacaaatactcctcaacttatgatggggctatgtcctggtaaacccatcatcagttgaatatgtctaagtcaaaaatgcatatatgtttttgacttacgatattttcaacttgttattttcaacttaagatggatttatccagatgtagctgtattgtaagttgaggagtggactgagtgtgaaccacttttgcaccattggaaagcccccaaaatcttaagtgaaaactgtcataagctgggggactgtctatatctatatctatgggctcttgcggcaaaacaatgaacaaacctgggaattattttggatgtngttattacactacacctgcctcaaccctaaactcactacccacatacacctcg

SEQ ID NO: 16459 - DNA, 1812 bp, Homo sapiens
  misc_feature (1)...(1812): n = A,T,C or G
aaaggggaaagaannnnnnngtnnnnnngnnnnnnnnngnaaannnnnnnnnngnnnaggnnnaagggngnngaantgnnnngaggaagaangncnnnnnnnnnnnnnnnnnnnnnnncnnntnnnnnagnnnnnnnnnnnnnnnnnnnnnnnatnnccnnaaatcnnnccnnccnnnnaaanngnncgannncgaccancannnnnnnnnngcgccgcgncccccnnnccagcaggtccnnncattcgacgnnnncnnccgcaagtacacaagctgccancgtcnnccncgnnnnncncnacgatcagacatggnnactcnncaagtgatagtacgagcaccntgactacggatgcgcgcgagtntnctgtggacgcgcgtgacggcgccggcggnagagcacagagcgagaatgtgatgtggtacgtggnagtgcttgtgcancaacnagtcagcctcncnactacngcattaatcataacacagaagntcgagcacatgctctcgncntcgtggagtatgtagtactgatgnggtatnattagatantattatntagtagntnatcangcnanatataatanaaatatataataattgtgcgatcaagtatatatactatnnatagacgatnaatagagagatgtatnnatnatattgccgactcncgtcatatagatntngtctatcntctatcgtatcactacgtcacacannagatgaattctanatatcgataagcgcgacacacatagagtaantntgttagtaaatctattatagatagtcagtgatcagcaagacacacgccacatctatatcgcaacnatcactacatacatgagagccgatagcacgcagctacncnacacgcacctcgttctagcgacatcangtacacgctcanacatgtagcgntctcncgactattacgtgngcaagtctcntcncncnctgtagatagcgcgatggccagagatgtcctgcgagctacgnnccacacgtcaccacacacacataagaccgtcgcgcatgctgcagcgcgcctcgcgcgctgccggntnagncgtccgtccgttctcnctcntgtatctacatctantgcatgctatgcgtcacagatgatgatancatgcagaacagtatntagcangncatcanctnagtcagataaagatattcatagttagtgtattattagtnangtgcagagtggtatataggttaagagttgtgctaagcntataggatgtagatatgaggagtaagtgaganactatagcgacggtagatgtatgngttagtcttcttaangtgtacacaggagcagactgtatagggtgtncctnataagaagatcgtcgntgctcgcntcacttaccactgtcaaacgagttgacgatgcagtgacactgatcnaagacgcgagtcgcgatgctacacgtacatcttctcgatgttatagnatgtngagatgcagcagtgagtgatntgtgtgtantggatatatgttctatgcagcagcaccacanagtatacatactcatcagtgagattgtnnacatgatagactacatatagcgctactcaagtctgangtacgtcatacagacagtactcactcggtntcctcaactatacgtactcntctccatccctactcagcgtctgcatcagagaacacggacncgatcagacacagtagagaanncacaattatatatcatacatatatgatttatcaagaatatgtacttactcactntatatacagtgaatatacggtgtcatcttaatcctgcagtctgcag

SEQ ID NO: 16460 - DNA, 424 bp, Homo sapiens
ctagataccccgcaatactgaaaactgtcagcatgtgacaatttatttcgtcggcttgtaatgatctccatttcagttgcatatcttaaaatcacaagctccagtttttttgtttgtttgttttttgtttttgtttctttgtttgttttgagatggagttttgctcttgtcatccaggctggagggcattggtgtgatcttggctcactgcaacctctgcctccccagtcctagtgattctcctgtctcagcctccccagtagctgggattacaggtgcctgccatttctaccagttaaattttgtatccccacttctgccctcacgccctccccccccctctcactcccctcactcaacctctccgtgctcactatatgccattttctactctagtcccagtgaccctctcaactgtgaatta

SEQ ID NO: 16461 - DNA, 756 bp, Homo sapiens
  misc_feature (1)...(756): n = A,T,C or G
ccttggaacccaccagccatggttgttaggacactcagacagccccctggagagcacatgtggtgaggaactgaggcctgctaccaaaagccaccagaatgatccatcttagaagcagatcctccaaccacagtcaagcctacatgtgaccgcacctcggccaggatcttcatcttcacgagagaccctcagctagaaccaccagctaatttgctcccaaattcctaagctgcagaaactcctggaattctactaataatgtcctgaaaactggggattggcatgtaagagtgctaaagttttcacagcagggacttcggagtgtctttatgcttgtgtgaaacaagtaaagaagtgcacacacacagcacaccacccacaaaacaacaaaaagctgaatttttggtggttattgtggtaaaagggaagtgtcaacccaaattcaacatggagcagaaatgagggtggcagtgtccaatctaattccaaagtttgagaaactgtgcagtgtgcaacaggtacacatatcctcttgacactcctattctctccaaccgccattgcatccgtgatactgacagtacagagaccaaccatggagcacgtggtcttccttcctcctgaaattattcctttgacaggaagttgcctatggactgggacctggagatnttgcttgggatgctctggcctcactcaggaagagctctagagcagggtcccaggccagacacttctggtttcagaaacagagat

SEQ ID NO: 16462 - DNA, 736 bp, Homo sapiens
aggctgatgactatgtgcctggataatgatctcttggtgaagagtttcccaggagttctataagattcttgtgattggatgtctagatctctagcaaggccaggcagcacagtgcatagaaactccttcagttacggaaaaaaagaggaaaggcgtgagacactttgcctggttactatgggaattctcacttatcttacccgagtccaccaaggtggcacccccaggagtcagtaagagctgcagcattactgggcttggtgtgcccccaatgccaatatggttgcagcgactacaggcttagagcataacactcaattccctttgaatacttagaaggctttctcaagaaggatggctacaaacaagtcaatactgaaatacctaactcttcgatgcctagacatcagcaaacatcctcaagtatcaagaacattcagaaaatcatgacatcgccgagaaaactaaatcagcaccagtcacaaatctcagagtgttggagatatgtgactattgggacagataattcaatatagctgtcttaagaaagctcagcaaacttgaagataacacagagaaggaatgcagagttctgtcagagacatttaacaaatagattgaaaaaatttttaaaaagtaagcacaaattccggagctaaatatccaattgaaaagctgaaaacgcatcagagtctcttaaagcagaactgaccaccagacaaaaaatgagccagct

SEQ ID NO: 16463 - DNA, 829 bp, Homo sapiens
  misc_feature (1)...(829): n = A,T,C or G
gaaaatgaaaaaaggagaaaagaganaaagaaaaagaaaagnnaaanganaaagannaagnnaatttganaacttgcagttccccatgtggcatcagttttgcatgctcagagatggttgtcccaagttnttggaggtacagagtatctgggacactggacacagggcaggcagagactttccccagtgccaacccaattctctgcatctaagattcctaggtaacttgatgtgatggaattctaacaagttttggctgatagatataggaagagaacaaagacagggttgaaaaaagacagaaggggcaaatgtcgaaggtggcggccactttaaatgacaggttcgcaccggacaaaaaccgcctcccctgattatgtttatggtacacccaaatatggtcaactgaggttctttcangaactcttacccttaggccaccccatatagcgtcggtaacgaccgcccccacccatcagtcgtgctaacacccccctctcccaccctctccgctcccccgccacccctcactccacccccctcccctctcttacgccccccccccctcctcccgcctccgaccctccacccgcttcacccgtccaacctagcttgtgaggtatcatccccgaggcctcaccacgttcgctcagattcgccccnccaccttttccgacgacgcccctactcaatgctatttttgcggtgcgcgccccccccagatcacaagaggtattcgtacatcggagggccaacgcctgcagcctaccctccccattctaactgtaancccgcatctgtaagtnccattcactcttttgtccacacg

SEQ ID NO: 16464 - DNA, 768 bp, Homo sapiens
  misc_feature (1)...(768): n = A,T,C or G
cctacnaggacacacgttggagacacttcttattttaccaaggctttgactgaaatgacatattttcagactgctttaagaaatcgaggctgacctacagagctgatgaaagccccttggaggaactggcctcctaccttgtcctgtacaggattcccaacatgtggcaaataaagaatgtcactttctgacaggcccaggaactccaagctttgttgggacctcaagaagaaaggaattcacccaattcatacaagtatctgcaggcacaaataaatccttggctgggctcaagagacttttaaagggtctaatctgagattccttatgaaaaaaattccagcaaagccagttagaaaaaaagagcctatatggccaataattattcttgctgctctttatgtaaataattaggcaaagtataataaggcaagcttattttgcaaataaattggtcttgtcattagtaaaaataaactggagagagaaaaattatgtttcaaaacagctacagcacacctgttattagattccagcctcatccattgttcttgagcttctgctgatgaccccatatttggttgatttttggggttattcacctggattccttgaggcttcaggccagttctacagggactcctgaagctaggacttttgaaactgccgctgcaaattacaactgagacagtgaaagagatctaacctaccaactgcatcttgcttctaacctccaagttgtccttggtcattcctgggcattagctg

SEQ ID NO: 16465 - DNA, 751 bp, Homo sapiens
  misc_feature (1)...(751): n = A,T,C or G
cctggatgctcatccttggaaccgttgngacccagctaccatgctgtgtggaagcccaggccacatgngagaatccacatatcatatccttgctggaagccccatctgaggtcccaggtagccagcatcaactggctatcaggagatcttcaagctgactccagcccagccaccaccagactgcagccatatgagagaccttgagcaagaatggcctagctgagtccaatcaatgctccctccccaagaaacaaaagaaatgaataataaatgattgttgtggccaggcctggtggctcatgcctgtaatcccaacacttcgggaggccaaggcaggtggatcgtgaggtcaggagttcaagaccagcctggccaagatggtgaaaccccatccctactaaaaatacaaaaatgaaccaggcaccagtaatctcagctacttgggaggctgaggcagagaatcacttaaacccgggaggcggaggttgcagtgacctgacattgcgccactgcactctagcttgggtgacagagcgagactccctctcagaaactaatacctgactcactcccaagtaaccaaaccgcaacactggcccccttggcctccccggcggacctctcgcgaccgccccctctcgcggggctcagtgctcgatcctcggtactgcctcactgcactacgcagttaccctccgcgaccggccacagcctgccgaaggccgccctgccgttctccccaaattcagga

SEQ ID NO: 16466 - DNA, 773 bp, Homo sapiens
  misc_feature (1)...(773): n = A,T,C or G
gctgatcggaacancaggcccgctgnagagagcgactgctgctcaacatgagatgccaaaatgcaacatgtggacaacctggcagccacagaggggcatgcaattcagatgggcggaagcctgcatacaccccccaggggtaccaggaactactccagtaggcctgagtccagtggccggaagaaggccacagccacaatgggcggggctggggaacttcttttcctggtgcaatttaccaaactcttcctcctacagattctggcgtggacaccctgcttccttgtgaaccaacagccctcttaacctctctgcaatttagaatcgtcctctacaaaatgggaatgctacttcctggcatacggttttatgccatccagaatttaatgagatgccgaatgtctgctgcatgtttttgtaatgtacatgtagtatacgttccgtgtgccatacagcactataaggactgcaaatacaatgacaggggaaggctacattcttaccatcttagctgaacagagtttttgctgtgtcgccagaggaacttgagaaaagatagaaaacactcatttgttttttagtagaaataatgattgtgctgaatgctgattcataatgaccctttggacagaagagagggaagctcagagaggttaggtgtcgtgctgagggtcactggctctgcttggtagtgacagagctcagatttagcccagatctgccgaggagcctccagaagactccactacaccccatgatcccacggagctatt

SEQ ID NO: 16467 - DNA, 863 bp, Homo sapiens
  misc_feature (1)...(863): n = A,T,C or G
caggaagttgacccttgagagtactcaccgattaaccttctatatactgaccttcatctcaggatctgcttcttggaaaaactgaactgcaacgccatggtttatgtttcacgtacaaactgagtccgcataaagctttatacagaagggtgacatctgatttgcaatttaggaggaggactctggttcctgattgaagaatggattataattgggcaagggtggaggccctcctataactttcaaaagctgtgatgggttcaaggggagatatgtttattccactttgagcagtttctcaggatattacgtgctgtgatggatatgctggctggaagaacatgcaaatccagccctaacactgcagaaaagattgttccaaagcagaagactatgcttttactgatcggtccgggcaggactatggatgtcttagatgaactgctctccaagactagataagtggatgttggagaatgttctaatattgggccaccgttttttgctttttgggtttctttttttttttttttagatggagtttcactgtttagcccaagctggagcgcaatgatgtgatcttggctcactgccacctccatctcctaggttcaagcaattctcctgcctcagcctcacaagtagctgggattacaaacatatgccactatgcccagctaattttgtatttttttagtagagacaggttttctgaccatgttggccaggctggtcttgactcctgactcaggtgatctatccacctangcctcccaaatgcctggatgacagcgtaagccgtcgccagactgtntagtgttatgttgatgggtctgcgggaacctanagtgttgatagggtgg

SEQ ID NO: 16468 - DNA, 883 bp, Homo sapiens
  misc_feature (1)...(883): n = A,T,C or G
agaaattataatcagcgtgtcttctgctctgcagtgtgtgaagtacaaagaactcaaacgttggaacataaaagatctgaattcacacactggctaaggtgttctggattcacttagcagttagtgctagtaaagtcttgtatccttggttatcctttccataatatggagctagcaacacctactttgcagagttttagaaaggatgattggtaaagtatgaaggtgcttagcatagtgaacagttcatagtaaacaaccattatattgtaagttatattgggattcttttctttttggtatgccttcatattatcatcaaaaatatgggtttgtctatgtttagaactactttgtaggtcctcaagcatagtgcttattgggtgaagtgctgacaagattgtaccttgaaaaacaggagtcatttggattgataaaaattatttaaaaattaaatagctcaaaattcttttcttttcagatagtgtagttggaaattctttagaaactcaagttctgtaagggacatagacattttaagtcatggttactgccttcaagaaacttacaccctggttggaggcattgntttcactaatatctgtgtccaacgaaatgatgtctctatatagtgactgggctgtgaggtagaaaaggataaatgctttcgagattcacagaagtctttaaatcattttctggcaatgaaaatgaccattgggatcaagtagcagggaggccgacggaatgaaactctgctacttttattttttggggcaagggcgactcctatgcacttccaatccttggtttagttaaccccaacataatcctcgaacaggatgtaaatcttcactttcggttaatatcgcgacctccgaaa

SEQ ID NO: 16469 - DNA, 894 bp, Homo sapiens
  misc_feature (1)...(894): n = A,T,C or G
cttcacgtggggcaccaaaatctactagcaactctaagccgtgtaggtgtaatgaagagtggaggaatagcataaaaaaggggaagaaaataggaggaggtggtgaagatatggagagtgaagaaaactgccatcaaatgaaaactaaaactgtattctcgtgttcattaaagaatatacgtgaaactgaaaaaaaaaaggacataaatattcacgtacaacggtccatatagggtcatcttattttactaggacagtaatttctcgccataattttgtttgttttctaagaaaaccttaattttctaattttcttggtcaaaacttgttgtttgcttaacttaaaacatacttcaatgttttgtgggtataacattcctaaaataaaaaaggattcatgttgtattatttcttgcatgtgctggagaagtaaaaatgcatctccaaattttcattccagtaatgttccagactataaggaaaataccgatgtgtaatatcatatgcttacatgagtctcatgatactatcctaattaaaatgctcctccttataatctgaacttagaagaaatgctgtcctanattanacaccttgaacatcttcctgtgataaaatctccatagcaggaagtcatatgtacaaattctatttctggataaaaatgaattttactttcatgtttgtggcttttaaacattattataaagcttgcagtgttatttcaantgcagtgagtctttttttacactattaagtgtattaatacactnatacatngcantngttgacagtgaatatgcatagaattgatttagaagccatagtattctctccctctaaatcttagaaggcatcctatttaactcagttaatcaaattgaccacagaggg

SEQ ID NO: 16470 - DNA, 924 bp, Homo sapiens
  misc_feature (1)...(924): n = A,T,C or G
aaaagaaagaaannaannnnagaaagaggaaaaaaaaaaagnngctcaggaaacatcttgttctgtttcctgcctgactatggtggtacggtcatagctcactgcatcttcttactcctggattcaagcactcttatcacctcaccctcatcagtagctaggactacaggcatgcatcaccatgcccagctaagttttaatttttgtaaagacaagttctccctatgttgcctaggtttatttagtctcatactaacagttcacaggttatttttaaggcatttatttaaatttaaataagtactactttagtcattctagccttggcacagttctaattgttacgatgatgaccatcatatgagattggtaggctgctaatcattttacttggcatgaactatgataatgaaagtcaagaaggcagtgataatcacaaacttggagtgcctggcattttaatggtctaaaatttaaactacatggagagtaaattaatagcctggaatgtactaatttttggttttgaaaaatgaaagagaatataagatataaagaagcatgaaatttgtctacctggtttaagagatgcnttgacctacaaaaatagcttgctttatattaaatcattatgtgacacaactggcgcatggaaaatactgacacatttttatacagagagaagagaaaatgttattctgggaaagcacttatggacactgaggatagctatcatatgagcaaataggcaattgatacatcaaaaaaaccttgacttgcgtaggataaaaatagagaaagaggcccgttgtggncctaacgtataagactatggcnnccgattgcatgtatagagggcnaagcaatgacnacgggtataggaccaataggcatggatgtttagatgcgtaaagcaatatgata

SEQ ID NO: 16471 - DNA, 470 bp, Homo sapiens
cagagattcattatgggatccatttcactgacatatgagttgacatcatttgtctgaaagagtgatgcagtttttgaaagattgaatatgaagtgtttcccatatcctttcagcaggtgctaagggatgccatcagcaggagaaaggaaaacaacttaacccaagtaaaatggggataattcccacccctgccagtttcacaaagcttgaaatgagaatgtggacatgctaaaagcattggcacatttaaattgaaaaaaaaaatcttgtggtgtatattttgcagtttaggcctttttccccattatggtaaggttgccatgacaatccaagacaatagagtctccccaggacagaatgattcattaaggcagagtgaaaagcaagtgcaacagtgctaagatagaagcaggctctgctggttgaagacatagcaagaaggcctgtgtggcaaagcaaaaaaaaaaaaa

SEQ ID NO: 16472 - DNA, 868 bp, Homo sapiens
  misc_feature (1)...(868): n = A,T,C or G
gaggttcacagaacttagccatctgtgtcatcttaaagcatcttgagtccaggaagaattggactgaaagtcctcggaaggcagagatttggtttcctcttaagcctctcttaagctatcaaggaaagacaggccccttgcattttcagaaacttatcggcactgcaatggcatccacaccgcttattctcacacatcaaagatctgagcgagctccaggactggatgccctgtggcatgctgctcgcagacagactggagaccagagatcagacaaacgccctgaaactcccagatgacaatctattcctgaagataaaggcatggccagcaagggggtaagaaaagggactggctattcagtctctcactagcaggctgaatcttgtctccctcagctggggaaggagaatgacgcangactgggaagcccaaccaccgagaaaaggataaactgagaagcaggctcaccaattctcctaactttggaccagccaaggacacctacaggaatcctgacttcaggtgacaaangaaacaagccaggaaggagagggacaacggctgggctctccctctaacttctcagaagaactccttaaagtgaccaagcatcaaagtacttcaccccaaaatataagtttttcccgaaggctcctactaccaatcaagcttctagcacacatctcctgccggacctttgtggtctgtaagcaaagggtcctgaagcttgcctctgggctaatgcatcattacctctacacanaaccccgtaataggtatgggggtagtaagaagtcaccctcngaaagtttcccgataagctttcccatggcagatcctatttttaataacagtgccgtaatat

SEQ ID NO: 16473 - DNA, 1452 bp, Homo sapiens
  misc_feature (1)...(1452): n = A,T,C or G
gagagtaagcaaagagggactcatcgcttgcgcagcgtccactagtacgcaacatccaacaagcgtctccgccccagtcttgaacactccgtcaacttctacaccgctacgcccgacgcttcaaccgattaccctgccctctcgcccgatcaacccgcgtctaacagatcatatgacactctgttattctcgtgnagagtcatagcaagaggtgctctgaactgtagatcgtcacgtatatctctcacattcncgttgtcatcatatctcaccgcgcacggtattatggtcctntcctattacggttcggtgttctatccaacagtcgcatattatatagngtgtcttcggcgttctatttcgaggcgcgtcactttagcatccacggcggccacgtccgcatatggcatagtagcagtactacagtacaacattgaatcgtcactattgtatcatggtcatgatcggaccatatttatccttcttgtccacctcgctacgtattggcagatgtgttccgcttaccttgtgaagtcgctcagcttcactcctcgcgcaatattcgtggtctcgcccgtcgatgtgagcaagagtgtcactatgatgatctgtgtcacacacagcggcatatacgactagcggtatcgcacgcgtgtccatcatgctatcatcatgcatgactagagtcaatgtatattcctatgctctgctccgctcatcaattatttgcgtctgttctcatatcgcatggtgtgagaattatttgtatcccgacgcgtgatccgcgacattatatctaagtgtgtcgctactctgaccttacggagttgatgtatatatggtcgaaatgatcttcagctacgccgccccctactagttgcgggcagatatcgagccgttgcgtcaagactctcctctcgactataattagtcattagtncgatatatatgagagagtcgcgctacactatggccctctcgtgcgtatcctcacaggacttaatagtgtgtcattcaanattacactcattcacatgtgacgaattgctcacactcgcactagtgctgcgatcgagtgtgatacatgtcaccccgctntgctccagcatcacttcgctggaaacacctagtcgatgaagcgacgctaccacggcgagacctaccaccatcactctcatgcccgtgtatcttagcatacagagacgctcagttcgcattagtcttgttcanaccgtgtcacgttacatatagtcacgcagtcccatgtacaagagcagctccgtccagcttcgcatagtttcgtgtgccatacaatgttttcgccccactctcgcgcatacnccgtgtgcagcttacatttattagtgtgcgctggtagcggacaatcgttctcgcgatgccgcagcgtacagtggtttcgcgttgggcagtcccgatgcctccatggtgacc

SEQ ID NO: 16474 - DNA, 1275 bp, Homo sapiens
  misc_feature (1)...(1275): n = A,T,C or G
tttataaaaatannnantntnaattaatttntanaaatnataagnagagacattttttcaganntnataagacaaacaatatnatataaatgttttatgtgatcatatatcatatatgatacatgatattgttcgtataacgcgatggatgcgagctctcgtagatgtgtacacctacgtccgaaatctcacgtgcacaattcgtccgatcaatagatcatctctattcatgtgtcgaccgatattaacaccagacatagtcttgtagaaacaacgtacgaaggacatataattagtattacgtacgccgcgtgtcgttgtgtatttggaccagacagtgctcgtcttctccgacgaccgcatttataatataaatttaaataaaagaaacacaactcacccaccatcaccatcaacacgtctaaccccagacactttacacattactccgtttcgttccactatatcacctcgttcttaacactatttatggcttgtcccgccggcggaggtagcgttctggggaacgccgcgtgcgcccggcgacgcacagcgacaccggcaaggtgcgcaagcatccatccccccctccccgtcagctataggggcagtcgccccagtacaaccaactctccagtctctccgtcactgtcttgcttcgcagtcccgcgtacctcttaaccggctcccattcgtctgccagtgtcgtcgtatacccacaccagcgatatccatccacacgcttagttcacatacacaacatccgcgccccaccacccatacttatgtcgcagtcgccacaccaccgtcccaccaaataaacactattcaaatccacttattacaccccgccctctcctttcgcgccacactgccccaccgtaccccgccccgctgctccttttcccaatcccccacgctcccttcctttttccccgttccctatttcgccccactttatctaatgttgtcacgcctatcgttcccatctcccaccgttcgcctagcccgcttctaccgcctttctcactacccgaattcgcgctcgtcttcgttacccacattacgcattcccgtccgcttcgctttcctcttccttttcttttacccacaattccgccatcccctttttcctcctattctccaccccgatagtaccccgcccattcatataccctttccacatacatatacttctgatgtaaccaccacgcttttctcctcgattccggcgcctntcacacaagttatccattcacttgttgcaacatttat

SEQ ID NO: 16475 - DNA, 886 bp, Homo sapiens
  misc_feature (1)...(886): n = A,T,C or G
cctcagcgctagcccggaactcatatttcagcaatgactgctcctcctcccgtgggtctggaagggaagtcatttgatcttgctctgattccatctgtcaacctccttcatcggccacctgtgaaactgcttcgagcctggctttcgtatcagcctccaaactttcccatcagctccttttgactccagactcttggctttgtgctggtatcctcctttccccttgtgaattttgtcccaccatggatttcctactttcttaaaagtaaatgtaagactctgtatttaaataaggatacatacatgacactaagctctattaaataagccagttgctctaaagtctggctgatcattacttggagacctttataaacattaatgcactttgattcaattggtttagagtagggcataggaacctacacatactaaaatctcttttggtgattggaattatcaggcttaaaagactattgtacatataataatttgcataaactctttaaaaaggtataattcagcacttttgttcctttttccatgcacctttaactaatatcattaagtgtaatcacttacttttacctggctctgtgcgttntaaaaatctgttgtcaaaatcttcctaaaacacanttttaggaagctctgcccccacccaggagtaggagcagaagctaatttaggtttaatgactgagcatgctcactgtagctcttcagggctagccacccacaagaaaccaagctacactcaactatgatccgaacanaaggcagatcccactgcagatgaagactggantatgacctncaacgagggaataagagctgcatgggtactggactcaacctgtgtgctgggaaattctggaccagccaga

SEQ ID NO: 16476 - DNA, 890 bp, Homo sapiens
  misc_feature (1)...(890): n = A,T,C or G
cagggtcatatccaaaaaagtccttgcccagaccaacatcacgaagcttttccccatgtgttcttcaataatcatggctgcctaagtgaatgaagatgattcttcagaaatggagatggagagagcctaagtgccccactctttgccaggtgcttcattagagaggccagggaaagtcacagcaaggaagagcatgtatagctataacaacaagcagcaggagggcagccttgaaagccaggccactcattgccttgagacaaagctattctaattcttctgtcttccccttggcctctcaacatctgaactttgcggactcagctcagagagaaagaattactgcagggcagaggagataggtacactcaccaccatagcttagctggaacgagaaagaaacaggtcataattttggggaaaccaaagaaatgccagctctttttcctgccttggagaaattggagaggggacagagaagtgaaagaaggcagaggggcaaacagtaagaccttttcctgactactccttcctgaggcttggcctgcaggaatggggatgacaggtacaaggaggagagcatganaggcaagggcatcttctttcagttcccacgtgggattccaggagtagaggtcanaacacatggtcacacagaaggaggcctgattggtactcangagctaacccagttcctgcatgggatgaatatggaattgaaggtcactggggtgggacagctgacctcatagcanaggatgagtgacccactagcccagggcactgctggagaagtcacagaaatnctangacctgccctctgtgagatctgaagggaggtgagtccttaagggggagtnggcccatccttcagggacatttggcagcaa

SEQ ID NO: 16477 - DNA, 748 bp, Homo sapiens
tgactaccgaagctgaacaaatttattgccagccatctacagcacaagaaatgctaaagaaactttgtctcactgaaataatataataccatatgtaaatgtgggtatgcaaaaaggaataaagtgcactggaaatggcaataatgtggctaaatagaaaataaattttgaattttgaatttctttaaatgataattctcaaaataaaaaagttataatgtataacgggatgcataatatatatagaagaaaatgtgtggcagcaataaagttactaaaaagtatcataaaatcaaagagtagttagctttgttagatgctgaggacaatgaaatatttatagtcatacaattataaaaaatgttgaagttctaaaaaattctacaataatcctaaaactgtcaagtctaataacaatctaatattgctgatatcttccataaaaacctgtgaatctgagaaaaaaagtactaaactataaaaaatttaaattttaatacaccttgcttatggaaattaatgaattacctttctactatctccattgaaaatgatactaaaactgttgttatacaaagaacctaacaaagttatacatccactagaaacatgagactggagtattataaaggtgtgttagattcaagcagttaatttataatatcctgtccctttgtgatgattgtacattaatattgccgattttaaaattactattacaacttataaactctgaaaaaaaaaaaaa

SEQ ID NO: 16478 - DNA, 551 bp, Homo sapiens
aagacatgtcttgcaacctaaacttatcagtcttgtgaccctgcagtcacgcaggaactcactgggcctgtaataaactctgaggaatgtggatttgggaagtatagataaggtccactgtccacagagagaagacaggctgttaatattcccttttaacttgagtgtatggtggggggtcacactttgcagcaactttaagaggattttaaaatttctattactactactactattaggttatagttgatttccttaattccttcttcaggtctacagggtaatggcatgagggtccaccatcttgtcttgccactgtccaggacacgcacatggctctgttcataagtccctacgaaatgtttctttctgagaaactagatatgtcagcctttttctttgacctctcagcttccttggactttaaggtttcctctttggtcctgagctggttaaaaggaacactggttgcctgaacagtcacacttgcaccatgatggctaaacattgcttttaggcttccttataagtttctttcttactggtgcaag

SEQ ID NO: 16479 - DNA, 767 bp, Homo sapiens
  misc_feature (1)...(767): n = A,T,C or G
cagaatagtcaaggagagcctctggagaagacatgcggtctggatttggaagcctcagtttgatttctggctttgtcacttaccttaggcattcaatataggtggcttccagacaatctttccatacttggtggttagagcagaagagattcatgaagagcactgccctttgaaacaaaatctcatattcagaaaactgatgccaaacaccaagtagcatgatttcactctgaagcagtgtttcagccattgccctggaatggttttaaagcaagtgatatactgccgaaagtgctgcctttgatattaaatgttcattaaaaatcttcactaagacataaagtttttcactactatctcttgatgattcttccccagaacggactgggagagcgaggtccgggtttccttctatttatttgcatcgatgtcgctccgagccttcagcactgggccgcgtatgacagcatcttagtggcttagggcctcctccgggaagagctaactgctcccaggtgaagccggtgcccgcgggcggttcgtacaccccgcagccggctcgcaccgctcgagagcctcggccgctgtgtcttccacgactgcagctcanccagggcgcgcagggcgagtggggtccactggcgggtaaaggggaccaggacggcgaggatggacgcacagacctgggccgtgggctttagctgactcttcctttggtcctggttggtaccccccaagcgagggcgaaaaaaccgaacagaaatctt

SEQ ID NO: 16480 - DNA, 760 bp, Homo sapiens
atgggcacatcatggccctcttgtgcttaggaataccatacagaacttcagcacaatacttggcagccactttaaactgcaaaatcaccaaaaaaaaacacaaacacatgaaaagcataacactaaatagaccattggaaagacatttgcatacagtctgagagctgcaacgaaaaagcagtgtcaccttgttcaacctcagctggaaacatgcacatcgggcaactcaacatttcactgctttgtgcatgactatgaatgactgagaaagtgtgtcatgaatattgatttgggggctacagattttagtgggcaggcaaatttgcaaacacagaatcagggaatactgaagatcaactatacgttacttgtcccatggctgacgcggagaaaagaaaatggaaaagcattaaacttcgaaaagttgaaactaaaaccctgaatgctctctcctaatgggagactgttgccaagtactttcttgatctgtagtaaagagaagcctgaaggaatgctaaagacagggtcatgacagttcttggagacaatgaaatgtgactctgaccatccgcagacatccatggaactgccgaaaatgttcaaagtcggagttaccgctaagaccacaatttgaaaaaaccaacactcaacttcctatcttcaacttaacctcagtaaattaaggcaaggattaaaacagtcagaattacaaacaagttctgtgttgcgggaatactatttcagaccccaaaaaaaaaat

SEQ ID NO: 16481 - DNA, 790 bp, Homo sapiens
  misc_feature (1)...(790): n = A,T,C or G
ggggnnnnnnnnnnaannnaagggnggnnngnnnnntgtgcacctccttggccctttttgacactagtaccactcctcacactctctggaccagaagtacttgtatcaaaaatgagaaaatccatcaatttcaaaggaaacaaaacaacataataacccatgatcaggactattctaatttctcttcatccatggaaagagagtctgaggatggtccaatttcctgggatcagacctgcttctctgctaggcagctggtggagatatttctacagaagggcctctcactcatttctaaggaggactttaagcaaatgagtccacggatcatccagcagctcctcagctgctcctgccacttacccaaggaccaacaagcaaagctgccacctaccactctggagaaatacggctacagcacggtggctgtcacccttctcacactgggctccatgctggggacaccgctgggacttttccatagctgtgaggacaactacagcctcatcttacaactgtacgccggcttccccatccgcacacctgtgctccgcgacactcctcctcacccctactcccaacgcccgcccgttcctgtagggcgcacccgcttaccccgtccaacccatgaccacgaccctcaatacgtagctcggcaagcccccgaagcacgccccgccccacacgcgtacacagtcccttcctcctcaaataatcccccacctcgcctacactcaccatagaggacccgttcaaccgcgtaccctaccacccactgcagcacacgtaa

SEQ ID NO: 16482 - DNA, 728 bp, Homo sapiens
agctgaagagccagcccacactctgcacctctgcagcaatcagttcaggaagtaaaacgtagactacagtaattaacccagagtgattggaacttgctgactgactgtaagctccctattttttgtcccaacttccaacttaggaccaaccagagaattcaaatatgtttatcaaatcaattaccttggatgaccaacttctacatgacctgccttcagcttctccatgtcagtcacctacaatcagggcatacctgaggccatttgattttttctaccgtaaatattttctaccttcctgcctgctttcaagtctctgaaaaatgtaagtgataatgattgattcctttgctatagcaaactctgaaaatacgttgttttcatttgggcgattatcctgtatttccacagtatgcctggagaatacaccaagatgcatcggtgttatattctaccatggaacctggttatcaactgggattgtggtacacatgcaggcaccctttgactggttcctcacagcttgatgagtcttgaatttcatgataaggccagaaccgaatctaacctcccctctgtttgcatagaatcccttggctacttattcttttttaactgctttaagggaatccccgaaactggggaatttataaagaaaaaaaatttaattgactccacagttccaactggtggggaggccccaggaaaccccccatcccggggaaggg

SEQ ID NO: 16483 - DNA, 752 bp, Homo sapiens
ctttgttggcaacacagttcaggcctgtcctgtgccaccagctggctgtccttccatgtggtgaggcatctttcacacctgggcacagatgcaccccatccttctctgcaacctgtggtcggggagccggaggcagagaagggccatgggtggcgatttgctttctacaacaactggaagggcagaaagtgattccaaacatgacttacagcaatgttgtgaacttaatttttaaagctccagaaaacttgttactagcatgacaaagtcatctctgagaaccaaccatccattgtcaatgagaaaaacgcacaaaatttgaggaaagacaaagaaagcacttgttagtgtttttctggaaaaaaaaatcccttcttgcccaagagtaatatatgttcattatagagctttttaaacttcgaggaagtaaaaaaattgaaatgaaaactgtccacatttcttttgcccagagatggccactgtcagcactgttgcaagccctgctctctctcctctccttttctgtacgtacgtgtacttttaaaaataaacataggcgttttcattcctcttaaaagatatgaaatttcctaatagaaaataaacttagtcttctctttaaaatgtttactcaaaaatttatcttacacatttgtatcggatatgcatgtgtcttaatattactgatggatttgccattacgaaaaatgatttttcagtaagacacattttaaccttcaaaaaaaaaaaaa

SEQ ID NO: 16484 - DNA, 632 bp, Homo sapiens
aaaaaaataaaacatcattagaaggaagatatttacatagaaagttccagactctttagaaacgagtccttttccggcttaatagatacaaccccacagcaatttggaactaggatctaaaattttctcggtgttagaatccacatcagaatacaatagcaatgctgctgtaggacagttttcacactgggtaccactggcactgccccttgaaagtgtatcttaagtgacattgctttccctcacgtaattttattaaagagaaacctgagaaatcatctaattcaacagcattctttaaccaggtcgctgaaggcccagaactgcgagctcatcaatgttcccatgacaggctaaggtcggaacaaaaacccagactctcctccagctcctctgcacccccaccgctccctcctgctcacagaaattcggcactgttcttcttttgccaaaactgcaaactggaaaagagtcaccagcgtaaaatgtgtctgagccctactaacacaattttttttacctgttggggacttttgagacttccatattcctcaaaaatcaaatgttttcatgggtaataaataatactttcaaatttaaaaaaaaaaagaaaatggtctcgttggcctcac

SEQ ID NO: 16485 - DNA, 773 bp, Homo sapiens
ctgatggttgtctgaagttcctgtagctacaaacttctatggtaaactccagcaagaaagaggaagagtgatagagaaagagaaagaaatagaatacgtcttaaattaaaaagttccgaagtacgatctcctttatttgaccgccctgaattgagccatgtgcctacttgtggagttgtactgttcaggaagagtctcgttctgtcacccaggctggagtgcagtggtgcgatctgggcttactgcaacctcggcctcccaggttccaaccattctcctgcctcaggctctcgagtagctgggactacaggcgtgcgccaccacgtccagctaattgtcttacttttagtagagatggggtttcaccatcttggacaagctggtctcatactcctgaacttgtgatccacccacctcggcctcgcaaagtgctaggattacaggcgtgagccaccgcagacggctgcacatcagtaagtttttaaagtaattgggcctggatcctaatcttgggtaagatactaactctttcaaagacccagatttctcctagataaaataaaatagttgaactagaaaataaaccttaatatgatccgccgccctcccccacgctaccataattaccgcgacccgcctgcttctccactcgtatctctccggattgctccttttcttccccactcttaccccccatttattatattgaggtacatctttcgctcccgatcctttcaaccttcctctcgttctcgcgctacatgactgcacaa

SEQ ID NO: 16486 - DNA, 773 bp, Homo sapiens
cctgacgtggccgtggtcttgcttgttccaggctggtccggaactgctggtctcaaacaattctcccttctcagccttccaaaatgctgggattgttgggtctctctctaatgtccaggctggagtgcagtggcacaatcatagctgactacaactttgaactccttggctcaagagatcctcctgtttcagcctcccaaagtgctgggagtacatgagagagccatcatgcttggcaccttttattttatttaatatgattaagtggttataattttgtaaatgtatctattcaaccttagacacaaggtcataggaacctgtatttagaggtaccttatattaattaaacttttgtctaaaattaatactgccagttataagaagatagctgattacttattattacatattgtataaaatatagccaattatgcaggaggtaatgtttgctgttttagaaatgtaatgacagtatcatcttatttcacgtcctttattatgttaatttgactcttattgcttcaactgacattattaagatttgttttatttataaaataagaaagaagatttgagacattgattgagagcacacagaaccacagcaggaaagtcgaagactcccgcccggcgtaactttcccctccctaccccctcccgctcccatggtgttgagcgaagcgcgcccccccgatttctctcttcttctcccctccctaatacatcaatttgccccgactccagcaccacacctccgaccacgcgcgtct

SEQ ID NO: 16487 - DNA, 785 bp, Homo sapiens
  misc_feature (1)...(785): n = A,T,C or G
ccctgnnaggaagctaacaacctggagatggaaggtgtgtgctcctggcaaccaaactagaccacttcactaatggtgccactccctctgtctccctgctggctaccaactgcatggatgaagctttcccatggccttcctctttgtacatggagtgttaagacagaagcacatcttctccagaacaaaccgattgctgacctgtatgtagctggactcttcagagttgaaacccggtcccctatggtttcaaaaggtgggaggggtataagaagagctgcctcttttctgaaggatgagagatttgatgccaacaaaggaatggtcacaggctgtgttctccgaccaagaaggatatagagttagaaactaggccatgcttgtgttattcccaagagtcagagcaggactcctgtatttttaatttgttttgaaaatcgacgttatatgtctacagagtttgaagattcgaatagttgagcaaggcttggtatgaaaaaagaactaccccttgagccttcctcctgtgatgcgtggattcttcaaggccatcacattcgactattttagccgggttgttttgatgttaatgttattatgactaatggtgtcgggtatgcccttactttttgattattcagtctgccggcatggttatcccctctctttcatcagaatgaggagaggtgtctttttcattgcctccagtgaatcaacacccataaatgcccccccttgtgctagtggtcgcttcttcgttgcgcgttacctcttattcaggatat

SEQ ID NO: 16488 - DNA, 782 bp, Homo sapiens
  misc_feature (1)...(782): n = A,T,C or G
gncctgnggggcaccaagtggctgttatggagctaacactgcagcaggctgcatttatggaagaacccttttcttggggtgttctccgcttgaatagtgagcaaaagcaagcctacccttcgcttcgctggaaatattacctaattcctcaaagcagcttgctgcaaatccaccctgagaaatgaccacagccaagaatgatcaggccgggatcttgtcctcttgtttttacaccacgaatatgcacagccacttagggctgacggcagatcacctattacaaaaggtatacatgaatgctgtagggtattatcgtcctcgtctcgcctggataaaaatgacttcaccgaatattcacgaagtaagcacaagcataatttcctttgagaatatattagttagaccggctccaagccgttctctctcccaccatgctcgcctccactatatatagacacactcatccttaaatacaactccaccctgatccacttcccatctcttacctttaaccaaaattatatccaatcccacccaacacacccccacccatcttacccaccgacgccgcccccccccacctgtctggcgaagtctcttcacctcgccaaccccacacacatacctcacccacacgcccccccattatcaactaactcctacctcaccttcccctttaattattgccggccccctcgtcctcattgcgcgttgctccctccgttaccctctctacacctttttcctcacactcaacaccctacccaccacacaacacaagc

SEQ ID NO: 16489 - DNA, 955 bp, Homo sapiens
  misc_feature (1)...(955): n = A,T,C or G
ggggggggnnngggaaataanggtattggnaaggtgatgggaggatgattngannnnntttcanttaaagttnttcaaacattatggantcagtttaataggattgactactatagcagnttatttagttaagcaagccaacaaagaatattngtgtggggagtactgtagaagaaaaagcaatcagttgtagcattggttacgaatactagggatgacttttgatagagtgggcacttcattaataaatgtacatccacactactagtaagaaggatcttaattgtatataattgaatgataacagtcgtaccctctacctggccataacctcgtactattagcaagcatatacgtatgtgtacctagtggcacgttgatgtgatattgataggtgtgcgtggcgtgtattattaaagatatttaaatgaagcataaggacgtagtcgcattgaaatagagtagttttagtattttatttttgacatatatacgactattctattcttactgtttntagttgattgatagtagagggagtgtatatgtagtggagaaaatgtaaataaacgagttggttgtgaattatannacaaatnaatgtatttgactctttaagtttcattagtatattgntgttagttgttataatttatgtactttcatatctcagtatcgcgacatgttcgtatcgtgtccgcacttcacactttcccccttccccttgtcccaccacactctggcccgcccccccttatcccccaccctgttattcttgtgtaccgcgcgccctccgcgatatttcctaacacctcgccgtctccctacgccccttctgtcttgttcctcacatccactcgtcccctgttacgttcgacttccccattctttcgctgcatcagtacaatgcgtcctcctcgtgtattgtcgcgtaggtgatgtagagcacgctgtt

SEQ ID NO: 16490 - DNA, 899 bp, Homo sapiens
tttttgagcagcaccatttgcgcccattaatggtgacaaatcgtggaggatagtctacagagactgcatatgaccttgatgctggcaagcattattattcgagaggcgcggaatgaacctaaagacgcagcacggaagacttatgaacacctcggtgcccatctccccagtggtggctgcattctaggaagctcgtcactgacacagaggggactacattatataacttgaacttatatcctacctgcaccgttctcatgttgacatagacaacaagactagagcactaccggatcttgacaaggatggatttagaccgtgaccttactcttgaattagtgataaaaataatggttatatagagggagtcagcttggaaatcgagatcacatttgaaagaattgagatccagctctacctaggccgagcagatttgtctgtcattgttggtatcttgtcaacgtactcatactgataaacgtgtatatggagactgagaaagacagtttcattggcgcttgtaggagaatcaagtggagggatggtgatgtaagtgagaaatagcctctcttttgtgcgatcattatatatatgactccatcgatgccatctcgctccgttctcatctattccccctctctggcttcacagttgccccctaactcaggctatactcacctcgcgccctacgcccccccgcccgcgcccctccacctacatcgccacgcccacatcgtattcctcctagtgtgcactcctacgcttacataaccgcgcggatccgccgcacatcaccccccccacatgtgcacgagttgcgacactatagatcgcgcccactccacacaatcgtcccacgcctacagcgcagtcgagcaggatcgccatatcggacccgt

SEQ ID NO: 16491 - DNA, 745 bp, Homo sapiens
  misc_feature (1)...(745): n = A,T,C or G
tgagatctataaggtgatgatgattcattaacaagatggcttgaattgtttcatccatcagcccttctcacttcttagttttggttcaatctgcttcttctgtctagaacgactctttcagctttatccatccttcaaatttcaatgcaagcaccaatctcttcaagaaccattccagacaccttctccctgcactgttgtgagtaatctcgtcttcccctggaatgatgcttgatatcctagtggatatgaactgtgtctcagccatctctactgctttcattatggcatagtcttctgaacatgatacaaactcatcccatgtttttgaaatggatatatttaagacaaaaatgttaatagcacctccaggatgctggtttccaggatgaataactgccaatgcaaaaattattaaagtcaagtataaattgcctacaagaaaaaaactgacaaataaaggttatagcatgcataataatctggaattgcatataatgaaataccaaataaactgccttcctgaaaaacattctgtttggctctcctaagccttgcgactggtaatgtcgttgcacgtccccgctcctgttttatattccgtcatcccccccagaagancactttcctgtcgcccgacttcacattatacactctcctctttccccctgattgatatatgataataccataccttttgtattgtggtacaagtgagcgagcttgcctgtctctcacccccatt

SEQ ID NO: 16492 - DNA, 918 bp, Homo sapiens
  misc_feature (1)...(918): n = A,T,C or G
ctgacaacctctgaacagacctaatttcttgctgcccacaggtccattggtggaagacagtgaaggaagaaatacttatttcaaagtaacagagacttcttttattactgcttccagcaaatttagaaacctgcggatttaagaacctaattactgtgacaaaggattcctatctcattagcaacctgcagagcccactgggagcttttctgggtgcccgggacttcctgcctcccgaactaccgatccgcccgatgcccatgctcctcctccagttctgtagcgagacctcgcctgcctggcaacgcagccccacctctgcacacctgctacactcctgacctctgcctcactcgcgtcccgactcatgctactgcctcaatgccaccttcgcccctgcccactagctcccactgcccgcccgactcccggcccctgcctcaacgttccccactcctcttactgtccgcctcaaatagtcctcacacttccacctaactgctacaatcgcccccctctcctcttgttcaatatcttcccacttcttctctatctctccccatgcctctctacaccactctctcccttcgctccacccgtcaccgccccgatcctgtgcctctccccccgtccgaccggccgccacttccgacctgtcctcctcgtccttacactctcctctcccgcccccgcctcccacgctcatgtctccgctgtgtcctccgcccctccgaaggggtaagtatctcctcaccttgcacatcctcatcgtgctcactcgctatcttgatcgctgcgtccgaanccatcaacctcacttccagttaccgaccgtacatcaatcccccgcgtccgctacacctcgtcctgagtagtataatcgagctcgcctgctgttgcgcgtgtcatacatgcatt

SEQ ID NO: 16493 - DNA, 790 bp, Homo sapiens
cctggtaataacgaggcctgaggttaggaagaaagacggggaagtcggtcggtggatcagtcagaacccatctagcattgatcagttaagtacaccatcatatataggtgtggtctatgctgcccaaaacaattaccacagaaacatcggagatcgttgatcacagatcactgtaacagatataataataatgaacaagtttgaaatatcgtgagaattgccaaaatcttttttatacatgaattgagtatatgttgttggaaaaatggtgccaatagacccgctctacgcatcgctgccacaaaactttaatttgtaaagaaatgcactatctgtgaattgcattatagtgaagcgtagtaaagcggatcactaattaaaaaaaaaataaatgatggcctcgacgctcccaatcggaggaatatctgcgagcagcttaaccttttttgagggtttaattctttatcttttattatctcacttaatttttcttttttttaattttttccattaattttttaaactaaattctttggctcgttccctgccctttctctcttttcggtgttttttgtgctaccgggtgaggttacttaatcgcgtctttatatccccccatccgtatttaatgttttatagccttccttctttcccatcactctcccttccccttcgattacctacttagctgtccctcttcccccgcccgaaaggcactcgtctcacatgcgttccccccttactaagtttttccaaccatactccctcctgtgctcacatcaaaagacct

SEQ ID NO: 16494 - DNA, 318 bp, Homo sapiens
  misc_feature (1)...(318): n = A,T,C or G
cctagtnggtaccgnggggaagccctttgccatgtctacatgacactcaagtagccctatggagaggtccactgggagaataactgaggcctcctgccgatagccagccctgaattgccagcatgagcgaccttggaagcagatccacccgcctcagtcaatccttcagacgactgcggccccagctctcatcttgctgcagcctcatgagaggccctgatccagaaccttccaggctagtctgctcccttattctgacctcagaaattgtgtgagataataaatgtttgttgttttaagttgctaaaaaaaaaaaaa

SEQ ID NO: 16495 - DNA, 739 bp, Homo sapiens
  misc_feature (1)...(739): n = A,T,C or G
acttantgtgacgacccaacgtgcacccgtttgatattggttgagaatctgaacacgtccatagcatggcttagtcacctggcagatacacatgtcacatgagaatctggtgcatcagagaagtcccgcaacacatggtcctggataatggaccacagtgcaactctagtggacacccccctgccagggttgtagaggtttcagatattgactgatgttctccctgtgaagcccatagtgatattccaggattgttctacaaaattctatttctttagttcattctaacacataacagtgaccaggtaatagaggacagggtgatatggcttgtctgtgtcctcacccaaacctcaacttgaattgtatgtctgagaattcccacatgttgtcagagggacccagagggaggcaattgaatcatgggggctgtgttttttctgtgctattcttgtgatagtgaattactcacccaatatcttataggttttatcatggatttgtgcctttcgctttttacctcttgtctcttggcatgttataagttcctcgtacccttcttatatgttcgtgccgctcccctcgcccttttataatacttattcacgtaagactatttttcttgacgaatatagagaaaaggctcttcctgcccccctcctcgtattttgaagttcgttccgcttttgctcgtgcatcttatgcgcctccctacctaactaccacacccacccctccg

SEQ ID NO: 16496 - DNA, 846 bp, Homo sapiens
  misc_feature (1)...(846): n = A,T,C or G
tttaaaaaaannnaaatttaatataaaaaaaagtagtaataagagaatataananttttagtccatgctgagaaaccataacanagccattcttgaccagttggatgctgccacccacccaccccacggggcccatcagctccactggcccatgtgtttccaggtctctgacaacagctgcatgtcctgccagcctgatcgttcttattcctgagttcccttccctccttttaagcactgaacgaatcccacagctgagcccctgcccacaacccaggggtctgtcctttgcagctctgagggccagaggggactgcacacagggaaacaaatccaagaccttctacatttctcaggtccttgagtgcttatctctgatcccatcctccctgccctacagaggccaaccccgggttaaacaggggacgcacaggccagagaccgcatcccggattccacacccccccggctggaacaggctgcgaacattctgcctaactttacgaagcattcttaggtccaagtttttctgacaaacgtgataatggagaggactaacgtcaagacagagagttttctcagtaagccccaagcccctgtcttccgcccaaactcatttcccgtcctcggcccgtccccgtggacgaccgcaaaactaagcggcccctccctgtaccgggacacttagttcgaccgccaccccgacattgtctggacgcctaaaggcaatacatccaaaagtaactagctacctgggacctgtcgggcgagtcttcgcttcccccgttatgggcccaatcgagcattgtaccacccctcgccaacgctacacaggccacaccacac

SEQ ID NO: 16497 - DNA, 800 bp, Homo sapiens
cccaccatctacaatatactagaaactccagtccctctccgcaagaatacactctgtacatacttgctagaacaagagtttggtctctaaagcattatgagaaatggaccaagcacaggatttgaagttagaagatattggtcataggaggagcaattaggtgtataattaagaatataggttgttgtggaggacatacgtgatgaggggaggtgatgacaggggagattaggagagagggaggatgtgagctgagataagaagggtgggggggaggaaccagagggtacggaaaataagaggaaagtgaatgtgggtaggggccagtcgccacatccatgttctacctacacacagcaggtcaacaagtgaccacgacccggcgtgcccagcgcccgggctctacggccagccattactgtcggcaccgtattccatagctctgcgctcgctttgattattcttgccatatagtctgttgcacaaatccccccccttgtcacggcataaccaggtatagatccggccgccgaggctactaccggtcggaattaacttctcgctccgcgcctccccgtcgctcctcgcagttgcgcgctggtgcatcctggatgcaacggctgaccggactccactttcgtgccgctccggcatgttattcgttcgcgcagtagttttcttcctcctctcatccgccccccccctcctcccctcccgcctctccccaccccctccccccctcaccctaacccaccctcccccccctaccccctacttcttctcttcttcaccctaccccg

SEQ ID NO: 16498 - DNA, 918 bp, Homo sapiens
  misc_feature (1)...(918): n = A,T,C or G
agaaaaaaaaannnnnnnnaagnnnaggaagagaggggagaagnaggaaaaaaaaacccattaattgcccagccactccttccttcagcaaccaccatcttgatgggttagcagccaccaacactgattcaagactctgcaccagcaaaaagattacaacacttctgaaggctaagatgattaaaattttttagtaatatttaaaaattaagatgtgtgcattatttaaacatggaggtgttcagatctttgtttggactataaagtggtgtgaagctgtttttttatgaaaaagatagtataatanataatatttatcactaaataaatataactgtctacgtcggacccggctcccccgactaacgtcggcggcggaccgcgacctcgcgatcagctgcagccgcaaaagcgaacacaaacgcaagacaccccaccactcagcttccatactactgcgcccctagcctaactagtccacacgtcactcgtacactaagatacttacgctcaggtcgaagtaggccaaataatactagtacgatttttcactttcttatataatctatctccctccgcaacctccactgccgtcgcttatacgattaagggcacaggacccgcataggcgtgacatctataccaaacacgtcacaacaaccgtccccgtcttcccccacctactcactcccgccccatcttctcaccactctcgactaccccctacctctccctcanccaaccctccccatccgccgccctcctctctcctcccaccgccctacctccgcccnccgccccctcgcccccgccctccccccctccccactcaccccccaccattcccacgcccccccccactcggccgatctatttacctttccccgacttaaccacgcagtcctgcccgcccgcccc

SEQ ID NO: 16499 - DNA, 1006 bp, Homo sapiens
  misc_feature (1)...(1006): n = A,T,C or G
gaaaaaaaggagagaannnagaagaaaagagagagagagagagaagggaaaagagaagaaagagaaaaatttgnaaccaccatgctctgaaatatccaaatgaactgcgagaaagagccatatgagaagagcaaagtnatgcttgacagactcaaaagaccaccaggctacagtgcaggacgaggggcgtggcatgggattcagatgtgtttgattggctaaaaggataaaacttaaagaaattttgggaggtgagagagcgagggtgggggaggtgagtggagtagggtgcgagtgccggtgtggagctgtgtgagaagaaaaataacaataacaggcggagaaagcccatcatggggtctgctggcgcgctgtggcgggcacgctagtgaggttgtgtccggagaggagaccgccggcccactcttctttaattattattatattaaattaacaacgccattaattatcatttccatttctctcaccgctctacttctactatctatatttctgtttctctatccctcttgttaggtgtttatgctatgcgtatagtaacggtaatagtattgatgatacgaagtagttacaatttgtatatgccaatgctcgcccgcgcggtgtggntgggaggagagatatgttatcgatgaatattcttctgtgcgtaatgatgtgttggtgtgatcgtatatcctgtcaacgaccaagccccagcccggcgccccggccgcgcggaccgccacccgactgtctatctaaacccgcctcacccggctcccggccgcgactgcaccgcccacgggccccaccggcgcacaactagcccgcggcgcgtctcgccgctcgacccgcgcctgagaccaagcccccctacgccgttgcacaccgtgcttcaccatcgactggagcaagtcagggctggcggcatctcacgacgctcgcacatcgttgcagacgatctgtacacgtcgggcgtacgccggccgcattcacgtgcccg

SEQ ID NO: 16500 - DNA, 976 bp, Homo sapiens
  misc_feature (1)...(976): n = A,T,C or G
gggggaggagagagaaggaaaagagggggggggggggggagggaagaaaggaaaaaaaaaaaggagncctaaagagaggacnaaggaanaacgcctttagaggggggaaaccggggcggagagaggggggaaaaaaagaaggaggggattgtacgcgagagcggacaccggggggggggnggncgaggcgggcggggggcgaaggggggggggggaggaggagggaggagagggaggaaggggggggggggggaggggggggagnagggagaagnaggaggggggggggaggggagagaggagaagaaaaattttttaaaaaaaagaagaggggaggggggggggcggggcagaagcgcgccgagccggcgcgaaaccggaggggcgcgggggggggggggctggcggacggcggggcgcggcggggagagcaacacggggaaggaaaacagaagaacggcgaggcgcgcccggcgaggcacagacagcgagggcggggcgcacggagcggaggcccgggaaaagcgcgccgaanaccgggaaacgctctagaagccgggaggcgcgagccaacagcgaacgtgtccaggacgccaaagcgaaggacagacgcgagcgcgcgcgaggggggggaagcggggagaggggtcgggcgcggcatacagaggaccccacagcgcgcgnacgcaagcagaaacacgccgcgccaaccgccccccccctcgccccacacgaccccccggccccaccgcccaccgcgccgccccggcccggcaccgcgccaccgcgcccgccgccgccacccgaggcaacgccgcgaccacccacagcagccccacacgcaaccaacgccgcccacccgggcccccccccgcggcacggcgcgcgggccaagacgcccggcgccaccccacggcaggaggacgacgggcaggatcagaagagacacgcgcacacccacacacaaccacacaac

SEQ ID NO: 16501 - DNA, 792 bp, Homo sapiens
  misc_feature (1)...(792): n = A,T,C or G
ctagncctataaaaaataaaatcaattgggagactacatcatctgttggaagagaagtggcattagacccgacagaagaaatctgctatcaactattccattgacctattccggaagctgaagtgatatttaatccctatgacttgaagcacatgtccaaaataagtaacagacacagatgttcaccatcttaccagacttttcattctaaatctcttgtgaagggaaggtatcacagtgtctttaaatccatgccatcacatggatccacactgaaaagaatccacaaagtctttagttacctttgattctataatatactacgagtcgaggtagcgcttgtaaagggagctaagaattgaaacggggggtatcatataaaaactacatacgctcgcgttcgcgatcaccaccccctcctccgccctatcccatctgtgtcctgtcccgtcccgcgcgcgctccggcctgcctcccctccggcccccaattttctcgaccgtcttctccccctcccccccgccccctccgtccttatttcactcaatccccccccaaccccccatcccctcctccacccctctccccccctcccccattcccacctactcaccctccctctttatcatcaactacccacgcccacttcctccccgttcgcactccccctatgcactggtttcatccgtaccacagacgccacaccacccccttctccctcagcaagacctacccttcccccccggccgcccgtcccccactccccccccctccacccgcccacccccaccc

SEQ ID NO: 16502 - DNA, 289 bp, Homo sapiens
cctgtaagtacatctgagggagtcagatgccatacaggacatccctatggagaggccctcacagtcattggactgtagtgcctgacaggagccacgtgagtgggcctcagaagcggactctccagccgcagacaatcctactatgactgctgccacaacgcaacaactgactaaccacgtgatgatagatactgtgccagaatcacccatctaatactggtatcaaatttctgatcacagaaagtgagagataataaatgtgtgccatctaaaacgaaaaaaaagaaaa

SEQ ID NO: 16503 - DNA, 1361 bp, Homo sapiens
  misc_feature (1)...(1361): n = A,T,C or G
gnnnnnnnncctcngangtatnntaaacaaacatctngacagcangctttacnctncnatgatactatgcgatnnacatgaaggaatntgctagcaagtaatngaatctacgaagngtgcanatggcgtagtagaggntagtacatacganaccatgttgtagtggagagctgtgcagacngtcgaactgtagagagggaccgtcatcgcgccgcgacagcgcacaccanatagataatggattctatcgtnactcgangnggtcaacagaagagagcaatagatactcgaatacgaacggtcgggtgcnctggtctatctttgctagtatactcttngtgatacgcaagctcgactcacgcnagntggtggtgtgagcacgacgtaactaccacgtctatactaggaggagaacatnctatgatctgtactgcaagcatagttctctcgtgtgcatccatgcncntcactngtcgatacctcgtcgtcgcatatcgncgctgcgatctcgctgtcgccataccgtacagtagctccgccgcnctctcctcctctctcatctagcctcacactaacttcacccactactcactagccacctcgtgtcgcgttgtnacgtctggatactcttcatnaccangtctgtgtancttcctcagcctngcgtcacgcagactactcatcatctatatgacacacgtattnagtgtctcaccttgcccnaatccggacttctctcgccgtctacaaacatagtaccatgcggatctagagaggccctcggagcatncgcnctcatgtgtaagtagtacgtaccagatncactgtgtgcactcatagtcnctagctcattccatatatgtgattggtagatnntggtctgttccctgatgccttaaccatagcatctcatatccgtctcaactacgcctcttccctctactagcttaacccatctgncacaacaccttcaaatagccctccatcttataaccgcgccacagccacatcacacaaatgcacgacaggccacctccacacttgcttctagcgtgctacgtcgatcgctcatagacggcatacagacacacactcgcgctcttccaatgccatgttacgaccacatactccggcngccctcgtccagtacgcagcatagcgcggcgaggtacaagcgtcgcatctcgtgcagatntnactggaaggactcttactccggcgttgtatgaaggactcgtccggaacacggctactcagtaggagtggntaaatactggatctcacatanacaactcgaggagaccaatcgacgccacgcgatcgtcttacgacacatcaatacataagaagcagagngcaca

SEQ ID NO: 16504 - DNA, 768 bp, Homo sapiens
  misc_feature (1)...(768): n = A,T,C or G
ttanagtnaacattgtgtgttattatcattttacactgtaagactgaggttgntgaagggggcaaacttttgtatgtgaagaaggcatgaagagatgaaaccagctaagtctattctttttactaggtaatcaatggttttccagaacccctataccagcagacttgtacttgtatgtcactactacattaacgatgtatcatggtcattcctcgctggaagctaatatggaagagctagtgaatgttatatgcggatggtaatgaggagaaggttcagaatggctgcttgatcccccccccttcagcagtgccataatctggcccctatccataaggaccctccctgctccttaggctgcccgcaacctctccaacgcctcctgcactttccatcaccccagcccatatcgcctcacgccgtggcagctcgcgcaatggttatctgtgtccaacgaacttttaccttatactctactctctgtccgcgtcctacactggccacacccatcggccctactgaccatatgtactgatgcgtgtcggccctaccccttccaccccaggacacctcctcatatttgcatacctgactcaatctcctcggtcctgtctcgccaactcacaccgccccacagccttcacttccgccggacgcgtagtgccgtcctctggcgccccctctaggagaaaagccctctcacataggcaaacacagcccgggcccccgccgaggcccggcggattacgtttgtgaatacacttgccg

SEQ ID NO: 16505 - DNA, 417 bp, Homo sapiens
ttcgacacaacctattggaagcgccaacctacctagggatactctaccgatctctcaaccggtacccccacccatgaccaccccccctggttggcaaagtatgacctaaaaaccctactctacacactgtgggtgaggttattttgagtagaaataaaactctagaccactctaccatgcctgacatacatgctggaaactgctctgtctattgctagtctctcttaacattgataacactgacctattactcatggccaggcagtgcatagacatgccacattgtgctggccacatctgacagtgtacagcatgcccacatcgaccatcgaatgcgcgcccaaataacatgattttggaaatgacaacctactgccttaaacatataggataatagatggacggggggggctaatg

SEQ ID NO: 16506 - DNA, 786 bp, Homo sapiens
  misc_feature (1)...(786): n = A,T,C or G
ctttgtggtaacattctatccgcctantnggctacacgtcacgacgagcagctgcggacgcacataagagtatgagcaggcctgtaaatgctcccttatgggatggccatgttcgaagattgccgtctttggggggtctcattatgatccgtgaatcctcttgtggatgtcttggcatcatatgcgaaaaacacataaatgaatcttactggtttttctacaccgattctccgaatgtattgcttcacttatgtgcatcaaaccctactcttacaaaaaatgctagaccacttctaactataccctctaaatggagactgtgacaccttctgagacaaagggaatttgaacattgttaatgaatgcggaattttgtgctgaccaacgaaacgaagggaaacataggccaacccgttccaaatcctgcaagctcaatttctaatatatgctcactcccatcctctttgttgagtagactccaactcttctccatcggaaatagatacttgtaatgtaaaacgatatctttagctgaggcagcgtttaagtgttcggaaatggttctcgtctttctcctgagatttgaatcgttctgcttccggcataaaaggagctccttcttcgttccgtgagagagagaatggaaggaggaattaacccgtttatgatgctgctcccaaatggcccacaaaaaccttgataccattttcctttggttactgcattctagatacaccccctatacccgcgacactgttgccaataaaaaaaaacttccctaaaaag

SEQ ID NO: 16507 - DNA, 287 bp, Homo sapiens
cttttgacggacgatgagcaacagctaagagtaccatgtactgagtgctcctgagtgttaggtggtatgctgagttatggattttactcggggcagtaatggcctcccccttgcctttcctgcttggaacttggagctctagcaagcatcttggaccatgaattgtggccctaaaggataaaagagcctggctgtctgccacaatggagctaccagacaagtccttaaaagacaacttgtttcatgtgaaagagaaataaacctctatcatcttaaaaaaaaaaaaa

SEQ ID NO: 16508 - DNA, 770 bp, Homo sapiens
  misc_feature (1)...(770): n = A,T,C or G
tttaggctttacagnatcagctttctgctgtgggatggcctatggagagagccatgtggtaaagaactgtgggcggcttctaggtgctgagtgttaccccagctgacagccagcaagaagtcagggacctccatcttacagctgcgaggagatgaattctgccaagaactgaaggaatgcagaaatggacccatcccaaattgggccttcagatgaggacagctctgtccaacaccttgattgtagcctcacagaggacccacctaacctatgcctggactnctaacccacagaaactgtgagatcgtcattgcctgtcgctttaacctgctccggttgtggtactctgttacacacaatacataatagctcacattctatttttactttctctgcccacacgcccgcgtaagacagacacgcttgtctgacatgccctcgccttcttaccacccccctgcgtcctctcttcgccagtccgccgatgggtccctttaccccgccccggtatgacgacgatagcatatcttggtcgtccctccgctccgtctgcccatcccttcacacgatactgtcctcgttctattacagagctccccctcgtattgatatttatcagatagctttgtgtttgtctcgtgggtgtcatcgttcactcgacccaacgtgcaatgccccccagcacagcatatattatccccgcgcggacccctgccagtcgttcccctccccgcccttcttcttctcctcattcactggcgcgaggtggg

SEQ ID NO: 16509 - DNA, 782 bp, Homo sapiens
  misc_feature (1)...(782): n = A,T,C or G
gcttggcngaatactnaaaaaacaatatttgacacactgtggcacaagttttaaggagcagggagtttaataggcatgagagaagggggaagacataaagaagaacctgcccaggaacagagagggaggaggactccaaggctgagagacagaagcccacctgctacggataccagccagatggagtttccctcttgttgcccagactggaatgcactggctcgatctgggctcactgcaacctcagcctcctgcacacaagcggttcacctgccttagcctcctgagtagctgggaggcatgtgctaccatgcccggctaattttgtattattagtagagacggggcgtcttcatgttggtcaggctggtctcgaactcccggcctcaggtgatccacctgcctcggtctcccaaaattctgggattataggcgtgagccactgtgcctggccacacattcttttttaattattttttccctttactaatactctcataaagcagaatggtaacgagaatgaaacaaaataaaactctgatttatataatgctattgcaattaacatgtttgtgcttttcctttctaaagtaatatttgggcatattattagaaatttacatacacctgttataaaacattcctaactttaaagtctctcaatgcacaacccactggaaaaaaattccttgggcgcatcatatcggggaatgcaaatttccccccttaaaaggggcaccaacgcaggtctctttatttaaacgtcctcccaaaaaaaaaaa

SEQ ID NO: 16510 - DNA, 799 bp, Homo sapiens
  misc_feature (1)...(799): n = A,T,C or G
cctgagggtgccttcattccttgtctcatggcccccttcctccatcttcaaagccagtaacatcacgtctctctgacccttctgtcacaacatctctgaccacagccgggaaagcctctccacatttaaggatttaggtggtttgactggacccaccttgataatccaggataatccctcttctccaggtctgtaacctaatcatctacaaagtccctacaccactcatccaagccggcatcatctctcacctgtatctcgcctggattatggcaatagccttctatctggtctcactctcctacttttgcccactgtagtaattatactcacagcaaaatcagaagttttgttctgaacatttcaagttttgagacctattagacaattaagaggatttcaagtagttgtcttgtatacagatggatcttcaattctgaagctcaaagaaagctttcaactggagatgtaaattttggagacattgccatacagatggcacttaaaactatggggctggaagacataaccaaaggagtaagtctacatacagaaagaagctgaggacctanatactggggccatttcaacatttagagattttcaccagggagggggttagcaaagaattcctagtctattctgggaaatgaaaaaaaaccaaacctgcgcttcaaccctgagacttctatccttaccagtcttacttccttaaccttatcactttcccaggatttacggcctgggtcaacgccctcatcgcctttcatccaatgtctactcacaccctgatcttatt

SEQ ID NO: 16511 - DNA, 810 bp, Homo sapiens
cctaccgtaacctgcctcggctaggttgtgcaaatcgagccacctggcacgtcacttgatggccatcagtacgagacaactggacgaaaccacgatgactatgaaacatgtgacgggggctacatgactctgaaccccatggcacctactgactatgataaaaacatgtgcctgactctttctcccatctaccatgtcaacatgctgttttgtttggggtgtgtattgaactatccggggtctgtttcttttgggtgatgacagtcttgataatcaaataaagcattcacgtttgggtttgcaacacatattagtctgcaaaggcttacctcaagtgaattgtgagaggagactgctgacttactggactgctattttcccgctgctgataccataaggatcagaccttctcatatactgcattccgtgcaccacacagacatgacccacattctccttgatggtgtgcggaattcccaacgtaaggagatctgaatggaatgttctggattgaagaaagtgggaaatgtccctacttacatagtccaacctgctgaaaaccatggggactctactgccccctagaacccctccttctcctcccgcctttcacggaggtttgtaggaactaggagacttccacctagtttccttcttcacctcgcatccttcttcttcttgctgggaacctcccttgagcgcatccgcaaaatccagctctgatgacccttccccccggtcttatcaaatagacagaatactttgtgtcatcctaaccagaatgttacaacatacactggtgtaccgtcg

SEQ ID NO: 16512 - DNA, 460 bp, Homo sapiens
  misc_feature (1)...(460): n = A,T,C or G
ctgtntctgaacgctgagaagtcctgnatccagaaggctcattgtccagtgaaggttgctctgcttccaagagggcgccttgttgctgccgcagcctcacatgtggaaagacaagagggcaagagctaactgaatgtggtgtgaagcctcttttataatggccttaatcccactttggaggaagaagctcgcaggacctaatcacctctcgaaggccccaccttttactattaccgcattggcaacacctgattttggaggcaactcattcaaaccatagcatgtgtctttactggtttctgagctgctggagagaagataatacagctttttttatatttgtagcttcagaactgaacacactatctggcacttagtttcatgctgtaagtattcgttggatgaatttcaagagttcatgtgtatgcactgaaaaataaaacaacaacaaaatcatcat

SEQ ID NO: 16513 - DNA, 760 bp, Homo sapiens
  misc_feature (1)...(760): n = A,T,C or G
ttatagaggcatttcaccgtgttagccaggatggtcttgatctcctgacctcatgatccacccgcctcggcctcccaaagtgctgggattacaggcgtgagccatcgagtccggcctatagtcttaatagattctttattttattattctatgatgtatccatttatctgtactgaatattgcaaactttaaaatatgtaacttatctctactgctccgttcaatcttttcaacacctactatgtatgtattggaacttctcagcctcttctgtatgtatgataattgttttttcatttgaacatgttattattttatttctgtactgcatgtggaacttcactcagcaccatgttcccatttttctaattcaccatgttacattacttgcttgcctttctactgcactcctgaaatattccattctatctgataactggcccgtttcagtttcatatgccactgtttcattatcgccgttgatgtctaataaacgcctttacttcttcgatgtgctccgtcacccgcctgcctctggccctataattacccacgcacggctctctacaccggcctagaccgcgggcccccacgcttcacccccctgtgaatataacgagcgccgagtttntggacagggcgaatgttagacgcgccgcgcagcgttcggcccttcggtgtaggtttncgttagcatagggcatgtgctggctcatccacggtcccctgtatcccttgcgcgacctcagcgctgcgtcct

SEQ ID NO: 16514 - DNA, 373 bp, Homo sapiens
cctggccttaacagaaagactgttctctcccaaagaagaggaaattctgccagaagactgccttcagactggaacttcaactcttctctgggtgtccagcctgccagcctaccctgcagattttggatttgccagcctcatgatcacatgagccagttccttaaaagaaatctctctctctctccacatatcctattagttcactttctctggagaaccgtgactaatgtactgtataaccaccagtggggattaaacctgctgagataattaccccattgttgagaaggaagaagccacatacttctctttctattctgatattttcaatgatattgctgaaaataaaactagcattttaaaaaaaaaaaaa

SEQ ID NO: 16515 - DNA, 750 bp, Homo sapiens
  misc_feature (1)...(750): n = A,T,C or G
gacaggaccaagcttgcncggctaaccctgacactagcaactgattcaagacgggagctctagaaccaagtagggcctgagggctttacctgaagcgaaatatgaacatccaatggcaaaaagaaatactctctccactggattgttatgcctgggcctgcagcaaccaagttctctaccacatggagagatatgagatatggttagacaaaatgtttttatcacacacaatcatatacatcagctgtggtggatccctgcacagactaacttacccgctgagcggacatgcaaagatctctcaccacccccccctcccagcgccctcaccactcttgcctgacaacccgcactctcccatgctcccccccgcacctcttatcactcatatcccctttcctcccagcccaacccccccgcgtgcctgtcaccctgctccccacgattctgtgccctctcatgtctccacccccgtcactttcttctcgttagagccttctacgtcttttcttctttctattactaccttacttcaacactagccctctcccccctgcctctcggccgccgtccctcccccgttccccctttactcaggcaccaaaaccaaccccccaccatctacctacttcctccatttccgatcaccgacccccccccccccccccaccacacgcctgacttcagcgcatccatgtacccgcgtcctccctctctgcacctctcaacgccagctcttactagagagac

SEQ ID NO: 16516 - DNA, 770 bp, Homo sapiens
  misc_feature (1)...(770): n = A,T,C or G
cctagtagccaccacaagtctccctgattgttgctactagaatcagaaaggatcatgggataaggagcactatgtaagactacctctcctcagcctctaaagactccatcaggagttaagaggaagtccagaagatctgtgttcttcaaataaggctactccttgctagtctcaacatcatcattgctcagcaaaagagatggcaccagaactctgcatgctccctcgtaagcctcattctttcctttcctgaatactattcacagtcccataaccactctgtgcctgagatgactggaaatcattttatgtcttaaatatgggactacttctgtcacaacaaggaagtgcagacacacaggccattactcctctcctgaagtcagttcccatgtggttttatgaacaatgaagcaactgttagacataacacatatttcatttgctttctgggccctgtcagcnctgtctactatacctgatggcagagatgattttctctgttcttgccccctgctgtctcctctcatccctttcgacccgcctcttcctgtttgcttactttgtccctttatcgactccctccctccccttcctcccgctcctctttgctcntctccctttgacacccgcacaaacccatggtccccttgccctcgacgcttgccccctcccgcactctccctttggtgccgcgccccctcttccccccccccctccgccccccccccttcccccgccccttctcccacacacaacaaaaacaaaca

SEQ ID NO: 16517 - DNA, 777 bp, Homo sapiens
cctgattgcaacctctcccaggtccttgcagggaaagctagctgcctttttaaagaactgtcagcaaagccagagtctgtctgagatgctcagcaagagctggaatttcatagcttcccacatgagaccagaccctcagagaaggtggagcaatgtcaggagcaagaagtagacaaagaaattttgactttggagagatcaagaaagctgttcatcagtgttggtgatggtaacttgggggttgacaagaggagtttagactatttcttttcttcatcctcatcattcctctggattttgttaaaaatggtgtgtgctttgagaaataaagcattccttgattcctcaagtgcataaatctatataatggcctcgttggcctccgcggtggcgctctcccgcccctccccttttttgagggttcgtttttgatcctctggttctgactttcctgccctcgttttcttccgttcccgccatctgttgtttcgttcttgtccggggtgtttttgtgctttctcctggctttgtggtttgccagctgcttgaccctcccttccacttcccccttctacggccggcacccttctcccccgtcctcttctccgcttctcttttcttgcttctccctccccctgctctttttgcctcgctcccccgctttcgcccctccgctcctctctccgccggccgtttctgttttcgtttccttgttctctctctcgtttcttccgccccgcctccgccctctcctttcgtacacatagaacacaaata

SEQ ID NO: 16518 - DNA, 767 bp, Homo sapiens
  misc_feature (1)...(767): n = A,T,C or G
cctggaggcacggatgagattgctttcaggacccaccaaagggcctcaagagctgggctgcttgagtaattgagtaaattggggaaatcagaactgtggacaactagaggaggagtacctagtctaagggggtagcctgaactccgcttcagctgagtcttctggatagagatggagtcttactacgttgcccaggctgtcctcgaactcctgagataaagggagcctcctgcctcagcctcctgagtngttgggaatagttcccaaactattggaaatngaggcctgagccacggtgctcagccttttcttacgtttatctctttcctttcaccgctgtggctgcctcccagttagctgtctgttggcttctatttccggttgcggtgtttggctctttgtgctttgtgcctcgcgcgggtcctgggttcttcgtgtcttccctgttgttttgtttggggcttgcgtggctctttttctgttccgtgtttgttgtgtgcgtcttcttctgttgctgcgttgcttcctttcgtttctctcctctcggcgccgcgggcttccggggcctcgcctccctcccctcctccgcccctcgcttttcggtggggtcgttttccgtctctctccccctcctcccccgcctgtcctgtgctcgtgtctcctgcccccccggtccccctcctccctcttcggggtctcccgcgtcctctcccgtcgcgcgctcgctcccgccctccgtcgggtcgccccgccacaaaaaaaaaaag

SEQ ID NO: 16519 - DNA, 1406 bp, Homo sapiens
  misc_feature (1)...(1406): n = A,T,C or G
tgannnanncttgaagtggaaanacaanaaacgangaacctttaagnactnngnaagcgcnngcttcatgtaactagggaacattagatgcttgtggtagcatgcagctttgggaacacctnnganaaccatgtatgatagaactaaactcgtagagcgtgagcctggttctaggagtgaaaggaacnactactaatagtgaagtaacgtagatagttgtcgcgccagacgcaacgaagcctttgttctcactctacataggatgattgcatgnaataatggaaagataagttagtatcgaggnntatgctgagcataaacgcggtgagttcttattgatgtacgttctgtacggttgcgcgcgagngaaggagtggcgatgacggagcgtcgcctgcgaggagctacctcgtgcgtgacgacggtcgtaggcgncacgcgaggtgcngctgctagtgcatcgccaactggacacctcgtactacccactgcgcccgtcccgacgcacccgccgcgccgccaccgacngagaagctgacgcgcnncgcacacctacaccgcagggancggcgcgcnaccctacttcgagcctaccgcgccagtgtcggcgttgcagcgngcggcgcagcgcttccngtgccgacttcacgctccgcaacgaccgcgccctctnnactcgcgcactgtagcncctctctcgnttgcgtgtcctcantacatgctgcnacctcactctcctactacgctctacgatctctactcatctactgcactcntcnctcacaatactcgcncggtcgctgtgcacgtctcgtncacgcgcatgnantactaggtgtcntncntgttcgtcntncantacgctngcactgcgtgctcgacacgcatcacatctcgcggtctctacncggntnagtgnnaccncgatnttgtcgactgaccgcncgtgctagagtcncactagtgatgcataggantagagtcgcnnccgcattgtcgcctacatagncacacgctctctcgatgctntctgcgcgcttactcgtcactgcgcgagaatgcatgtnnttatatcgtgaagtanntcagcntgctacacactcgttatctctntcgttccactcgncatgcggccatatctgntggcncgtgtcgctcctcctgctgcctcggcggtacgcgtgtcagtgctgctgtcatgataggtgccgctcatcgtcgtacgcgcacgcgaccnatcagtgagacgacgaggtgctgctantcgcgnncacgactggtgcatgacgcgcgtgacataggcgtcgctacgcntccnnacnagcagcgtcctcgccgtcgtcactactgatctattatntacgtgntgtctnnacanacgatactgtagacgagagctcgagggg

SEQ ID NO: 16520 - DNA, 374 bp, Homo sapiens
cctggcgttacagaaaaagactgttctctcccaaaacagaggaaattctgccagaagactgccttcagactggaacttcaactcttctctgggtgtccagcctgccagcctaccctgcagattttggatttgccagcctcatgatcacatgagccagttccttaaaagaaatctctctctctctccacatatcctattagttcactttctctggagaaccgtgactaatgtactgtataaccaccagtggggattaaacctgctgagataattaccccattgttgagaaggaagaagccacatacttctctttctattctgatattttcaatgatattgctgaaaataaaactagcattttaaaaaaaaaaaaa

SEQ ID NO: 16521 - DNA, 301 bp, Homo sapiens
cctggcgtacaactccgaatggctctgcgctgaacctccgacaatggcttcttctgctgggaccccttagataggcctctgagggagctctgactgccgtttccccaaaacaatgtcccctgtcagcaggaagcagttaaatcagtcttcatccttatccttaatataacggcagttagatgtacttctttagagggagtaaatttatcaattcagagcaatcctccctcctctttccatctttgattcacagttaataggctataagttttgataatgtagaataaactacagaaaactt

SEQ ID NO: 16522 - DNA, 295 bp, Homo sapiens
  misc_feature (1)...(295): n = A,T,C or G
ggnnnncctgaggggcaccattctttctgttanaaccgccaaacctggagaaacaaaccagatctttcaagaccttgagatatacggtactggagctgagcatcccttctaccatgtgaatacacagcattcttcccctccagagaacacagcaacaaggtaccatcttggaagcagagagcagccctcactgcttcacagacactgaacctaccagcaccttgatcttggattttccagcccccagaactgtgagtaataaatttctattatttataaattaaaaaaaaaaaaa

SEQ ID NO: 16523 - DNA, 406 bp, Homo sapiens
cctgatgctgctatatgtgtattgtgtctcttgaaatgtcctacaactcattgatgtgcctgcttctcctttctccatgactacatttcctgagacctccaagccatgtggaactgaatgctagctggagatgatggaatgaccagctgcagagagaagtaccttctcttctgagagctgcagagatgacctgctggcagagaggagctaccctatctgctaagagcttcagagacctgcagagacatcagaatgacttgcctgaggagagcagccacctcctccaggacctcctgtcagctaagagctaacacttgacaacctgcctacagagaggagctacccactcttctgagctgttctaacactaaataaaactctttttcttcaccgaaaaaaaaaaaaa

SEQ ID NO: 16524 - DNA, 144 bp, Homo sapiens
cctagaacctgcttttagctgaacttgagaaggaagccctgcaacaacatctggtgtgatagactgaaccatgcctccagagagaagatgactactcccagttgatgctgaccctcccaggaacatgaaacaaaaaaaaaaaaa

SEQ ID NO: 16525 - DNA, 748 bp, Homo sapiens
  misc_feature (1)...(748): n = A,T,C or G
ccttgatgttactagnnctttttctctccagggtcacctctcctgaagattacaggacaataccagagaccctggcagaagggcacagatctggcttcccggagactgctaaaggctccaggtgaggcaacccagcggtgcgggggagttaccgccacagggagcagactttcaaccaaagaagtcctcaaaaagaggcagaaagctacaacgactctctctccatttctctcctcaagggactggtcacccaacagactaattttcctcgcgaagcagtgaccccatgtgcagaatttcctggtgccccacccctccttcctgccttacttttctttgacttcaactacacatctctgggactgcactccccaatcaaacaacagcatccaagtcttaccctagtcttctttcctaggatcccagaccaagagaggtcatactcagttatgcaagcttaacaaaatgatactcatgttatccataaactacaaaagagttctgagtatgagcaattgtttttctcaacttttgacattttctttttttcacagaattagcaattttatttattcgtagcgtatttaaacctagattggaggtaaagttgaacattgtgcgttttgggtaatcaattataattcgaacattacctggctaatttattattctgcattctctcaaccccctcatggttcatcccttacgtgactcgggactgcaacccacatatcctgagaggggcagg

SEQ ID NO: 16526 - DNA, 509 bp, Homo sapiens
gatcatggatcagacactctgaacaacactgatcaacactggagtttctggaagtctgactttcatataaagggaaatattgtcatattggccaatagagatttaaagtcgcaaggtttaagaccaggtgaatgttgtcttgagaagattgggaagaaaatattgaaggaaaaaagcagatttctggagacatcaactaaagaaagaactgaagaaggccaggtgcggcggctcatgcctgtgatcccagcactttgagaggctgaggtgggtggatcgtctgaggttaggagttcttgaccagcctggccaacatggtgaaaccctgtgtctattaaaaaaaaaatacaaaaattagctgggtgtggtggtgggcacctataatcccagttactcaggaggctgagacaggagaattgcttgaacccgggaggtggagtttgcagtgagccagggttgcaccattgcacttcggcctggacacgagagtgaaaccccctataaaaaat

SEQ ID NO: 16527 - DNA, 775 bp, Homo sapiens
cctgggacatcgatgaagctggagtacatcattctcaccaaactatcgcaaggacaaaaaaacagacaccacatgttctcactcacagcaccagcaccacctggagtcatcttggactgtggtgtcgtcttcggatgctgagctagtttggatttctggactgcctaactctttacttctctaagaacagcatcctccacgggacaaatatcctcacagccaactggactttggatggatacatgatccaaagtaggccaattaaatgggtttttgggattagaactgagagtcagtctggtcaggctgatatggattcttcaaaacgagtagacgagcctcagaagctattaggaacaccaagagaaggcggaaatcttcaagtcagaaagagagctcgctgaaacctgaccatgttggcaccctgatcttagacttccaggctctgaaactatacttgttgcatggcttccattctgtgctgacttctcttctggacgatggggctaggatagcgaatgagaaggttctggcaaccagcaatctaatccttaccttcatgagaatcaccttttttttaacccccgtcttatagtgagaacctgtgccctaagaccccctcgccttggctcatttcactgatcccaatgaccatcaaggcttttcctgccggtactaaggacaaaaatccactgcttgggatgggcgaaaaaaaccccatcgcttaccaacaccattcccccctcccccaatcttgatgccggcacacaaactg

SEQ ID NO: 16528 - DNA, 354 bp, Homo sapiens
cctagacgtgactggggcacatggttgtatcaatcatcaactttcatttcggagagcagtaaaaaaggagaataagacacactggtactccaacaagtcatagtttctgccagatgttgcaaaaatcaaatgtccacagaaacccaatcagcaacactactttcaaagtgtcttttgacaagtaatatgtgcattttacaaatccaaaggcaatatttgaagtagcttttctaaacagctgcattactcaaagctatctctgtatcatcgccttgtttcctggaagaaaatgtggaaatgtgtactgaaaatgtgtaaatgattaaagcatcagtataaagaaaaaaaaaaaaa

SEQ ID NO: 16529 - DNA, 770 bp, Homo sapiens
  misc_feature (1)...(770): n = A,T,C or G
gannnnttttatttgtctacccaggnaaaaagttaattcagtattacaatgctagccaagattgagggcgagtacacagatgtcgtctgcacattcaaagaagcaagacaagcttttgaaaataacaaaaaaaatttcctggagaaattgagaattccttggccttgaggcaagatatacctataaggttgaaatatgagcttggcaggcaccttagcaaaaaaagatgtgaaggagtcctgtattctgaggagagcctgctgagccataaggatgtcaggtgatgctgtgcccttctctggatcctgttaggaagaggtgcagaaagactgcatcacactggcaatgcgacatgtgttaaattcttgcatcttgagactcctcgaccctttgatggcaaacaattttccatgtttccagacacaaccgcaccccctaagacctgacccaatatcagatatcccatctcgcagatggctctgagcggtctctcgcgcatggcaacctcccttcgtcaagctgtacgtctctcctctactgctcgttcattacaaacgtgcttcccttcaccctttctccccctcctccattcagttatactactcccctggtctcccatccccactactcgtacatatgtaactcctcccgtaccaggtggccatccccggtcttcccgtgttctcttggtgtcntggacttcttgagtccaagcgcggctggagtcactgttagtagttttccgtctttttatactcatactatcctcg

SEQ ID NO: 16530 - DNA, 256 bp, Homo sapiens
cctaggagccactattacagagggtttgtcgccaccgacaaccaatgcaggcttagctgcagggcctgctgtgatgtccatgctgaggcaactgagaaagcattcatcccctccagaggatgcagcattcaaggtgccatcttggaagtagagaccaggccctcaccagacactgaacctgctggcaccttgatcttgggcttccagctcccagaactgtgagaaattttttctgttcttgataaaaaaaaaaaaa

SEQ ID NO: 16531 - DNA, 567 bp, Homo sapiens
cctttttttcacggcgccaggagggggggacaggaccacgcctcatagcgaagcaccgcaggcggagaccaccctcaccggtccgcacaggggcaccgaggctgtgtccaggttggtcaggaaaacacagatggaaggccgggtggagagagatcgaggaaaggagtttacgaaggtcctgatactaaacggctgggtcaaagcgctccaaagcgacagcaccccccctactccgaactgaaccggccaaccgtatcggggccccagcgccattagcgtcggctgccacacatgatacctcatcaactgtctcagtaaccgagtaaacgaacgcgcttgcgccggcgcgcgccccagcagcgccggcaggcggcgtcccggcttctccacgcaatgaggaacgacccctagagacaataacgtgtcgctccaatcgtcctagaccttgagtcacaaaccccaacaagagcacaacacccggttactgtcgaccaaatccggacacgcgccttcgactaagaaagcggccgaacacgcactgccccgaatgcagccaaccagacagag

SEQ ID NO: 16532 - DNA, 787 bp, Homo sapiens
  misc_feature (1)...(787): n = A,T,C or G
ccatactgatactgagtgtctggctaagtcgtactcaccaacctgcccagggatgaaaagggccagaagcctcacaggctgttatgcttaacagccaggaaaccacaagcaataagacaaaggcaagaccgtcagctttgaaaggccctccatcccacaaatgtcaggtgcagcttctgagtggcatggggagagaggggttgtatattcaaggactggatgtgtttcctcntttctataggctaatcctaaaatgaggggctgctggggtggagtgaagagctgaaacaactcccgttccctccccatcctcctgcctttcctgggcatccactgagatgccatgatccctggtcccctccctgctgactgtgactgtcttgacaacttcctctcttctttgttattcgcgattgctctcccccctctcccttactcctatcaacgcccgcgcgcccctccctgtctctcctcgggtctctctggcttccttcggcttctctctgctcgctccttcccttttctgcggcgttattctttctccttcttctcttcctcccttgccctccgtcctttccccccgcggtttctgttttttttttttctgtcaggggggtcgttctctgttcctcttgttttgtgtgttcctcgttttgttctttcttcgtcccgtattgttccttccttttgttcttttccccttttccttggtcctcgtggctgttctgttcttctttctgttctctcccccctcccccgccccaacataaaaacacacacaaaataa

SEQ ID NO: 16533 - DNA, 816 bp, Homo sapiens
  misc_feature (1)...(816): n = A,T,C or G
aaaaaaaaaaaannnnnnnnnnnngnnnnnanttttaaaaaaaaagnnggnnnnccttgngaggnactnccacagcgacttgcangtgcataccaggcggcaccaaacctaaancngcttcngcctttagcggacaagacatgangacacagaaacaagagagggaagctgaatcccaaggccttgtgaagggtgagggtgggtaacatcacataactcacctcctttctcttcccaaccgcccattacttcacnatcacacacgatccttgacccatgacttttttttctccagacaccctcccattatgtcccttttttctccacggccctgggagacattggttttctaggcagaacttgaactccctcatagaaataggctncttatttttctgtcaatgagtttctaattttttttcctatccccttctttttctttattttttctttctanaccgttttttcctctacctgttcgttttgacctctctcttttttcctccttctctcttctttttttctctcttcttttttttcttttctctattcttttcctttttgttcttcatccgtcctctcgtatgtctgtgnctctttttgttattatttttttcttttttcttttcttnttcattttttcttttttctcttcttcctccttctttctccctctctattctttttttatttctatcttcacttccttcccctttcgtttattatttcttatgattttctatcttgacccttgcgcactcctccccttttttcctgttctctcctttcccccccttttttcctttctctacctct

SEQ ID NO: 16534 - DNA, 396 bp, Homo sapiens
  misc_feature (1)...(396): n = A,T,C or G
cttggtgtaactctcgctcctcttgacggatttactgagggaccagtatggggaatttacatctcgttggagagttttcctctccctttgccagcatgccaggtcctgtntaacagngaaactatgtgcatcagctggtctgacttaccccacaagaagctgattcacctgagaatgcggctttcatatcctgatgatttcatacccctatacacactaaatccctcccccaggttttcagtcccccatcctccaggacccccttgagaaccccagtccagacttcctcagggagatggatttgatggtctcctcccgcctctttcctcangacctggccgtcattaaactctttctctgatgcnncgccccccctcactggcctcgttggcctct

SEQ ID NO: 16535 - DNA, 1278 bp, Homo sapiens
  misc_feature (1)...(1278): n = A,T,C or G
gtcgttgttgttacttctccacnagcngccctgncgctgggnncnatcanagnaagcnacgctgggggtcnntccttcagggggnatccccggttgttgcnttgggnntgncctgggtctgccgtctctggcctctcgcttggcgggatggctggctngcccttgacccctcntgggacgtgatntntctcccccgccgggnnctcccggtgccgcgtcngcgcgtccgtggttttttntctccncccttcgccctcgctcngctcgtacgcctctgcctgtagaacntgcactcaagaacaataaaaacatcaagctacccgctcgcgccctccngcggnttgttgcnntttnnnngcggttgtgcgtggtgggtggtcnttcngcccgctcttnnttcgntgccccgcctggnccgttgctgtggggtgcattctctctcgctgtctctgttntgcacctggtgtgcgcgctcggcgcggggcgcaccttttttgctgttgctctgtcggcctggtggctntgcgtctggtctctggttcgcgctgtgcctcgccncgngggccngnagtnttttcggcgctgcttgttccgcgccgcctcccttctctcntggtggcgcgatgggctcgcggctctggctgnncgtctcngcgctctgcgttcttgggcgccgtcttcgcgtcngtgggcggcggcgcgtgtttcttctcccgcgcgntncggttggttngtctgtgncgcggttgcgtgttgcggtggggctngttnnccggcttgtgcggntcggttggccgcgctctgtccgttgcgcgctgttcgttgttttngtcgtgcgggggcggtgcttggggtggnntgtggttggcggtttctggtcggcgtgcgttccgctgtgcggccttnctttnctcggtngttgttgtgttgcttgttcgtggngcgcgtgtgttnnncgctgtgttgngngcggtgtgtgtgtttgtgcgtgcgncgcgtgtgcgngttcttcgngngtgcgtcntggtgncgcgccgcgcgctctggcgccgntgcgctgtgcggnntccgcgcngctgtcgtcngggncgctcggggctngnctgcgttgctcgtggtgtntgtngtgcgtgtgtgtgtgcggngntnggtnntccngcncgtttgttncntcgtcgcggctggtgntngntggggtgtgtctccgtgggtcgcgtgngcncgcgccgctcgtgctgtcaaacatataatagagaacacgaacatggtcgcgtccga

SEQ ID NO: 16536 - DNA, 139 bp, Homo sapiens
  misc_feature (1)...(139): n = A,T,C or G
tgggttttcggctttcggcctcttctgggtgttttcttggcgtgggggcttcctcctcccccggtcttttnctgttgctttgctttccctttcagcttggggcctcgcgctctcggtgggttttacaaaaaaaaaaaaa

SEQ ID NO: 16537 - DNA, 742 bp, Homo sapiens
  misc_feature (1)...(742): n = A,T,C or G
gctgtggggaccaccccctgcttttcgtctaaacngtncctcnntganngagangaagaagaggattttgcngagnnngangcagccgcttcttcngccgcagcagcggcngatgatgaagaaggagaggaaagaggaagatcttttacccttaatttgaaatattttataatattttccctcctttgttttgtcacaggcaagtcctgaaaaaaaaaaaatcccctccnttatcacactcttttgattattgtactagccagtcntgaacattngaaaaggctttaagaccttgatcgaatattatgttcctgaataagatgacctactataaaaatgttaatttcctataaggctccatacccatttaactttattcactttaaaactttgatgggaaaattgaaacttggcaaangtcttctgacctcattttngagaatccctgaggagagctgaggagttttttcctgancctccttcgaggaagttgatctgcttgacactgaaatgttttataggttcaaattccttancgccgtgtttttctggcccctntgtnttnnagccgactggtnggctcttgttccccgcccgacgtcggacttactatttcttctgtcccttgctcttgccctcctgngaaaatgcttcccttcccttgccccttacctgggtctttccgggatactcccttccccttggaccacgatgacatcccttatcctaaaacaaaaataga

SEQ ID NO: 16538 - DNA, 733 bp, Homo sapiens
gttgcccttatgatggtgtgtggatgatttaggataccttgacaccctgcctctctgatccacactgggcagactgttgatcccatgagtggaaagccccaaaaaggaatacccggtgaaatgaaagatctgatccttcgcctgggctgcatacgcaagaacagcacgattcagcctgaaccccagacctggatatgaagggtgatctctattagctgaataactcctgccctgaatataactctgtattggagtttcgcgcgtcatggacgacgacaatagccttctgtataacaactgacctctgtaaaggaatgccaatagcgatcactgccatcaatgatgacaagctgtgctactattagctgggattataatgaatgtctgacttggactatatcaatggtgtttgcaaggttgaccgaaggtaactaaaaacatggagtcggtggtctcatcgatggctcctcttacgccaattccctttggtgagggggcctttctgatgccccttccccttcttcgctgcactcgaaatttccgaaggcgttcagcggttttaattcactcacaggctgaataacgggtcctgatctaaaaactgggatatctttggttataccatattaattgaaagtctttttaattgccactttccttactaagggcactgttcttgcaatttacctacgcctccccccactggcagcttccgactaacttcacgtgtgtt

SEQ ID NO: 16539 - DNA, 788 bp, Homo sapiens
  misc_feature (1)...(788): n = A,T,C or G
tctcgangattctccnctaacatctctcgaccaaaacactcgctgaggtcacaactcccggtgtccaagatggctgtggatgcaaagtagcctgctgactagcagctcctcctggagggttttgtgatactcaacgtgacgtttgaggaaaacctcctcacggatttcgcattcttacctctccccagcacccctatctccccctgcccccccccccctcccccaccccccaccaccgacccttaatgactagtaatctacaacattgttgtaaggactgacactttcaacaacggatcacgtacgcacggtttgctgataaaacaacccacagcgattccactcgacacgccctgtcgcactagaacgacatatcctaccaccccagccactactctcacccctcctcttcttctctctcattctcctcctcccacccccccctcccgcccgacatacagtcccgccaccaggaccgcgccaccccagccgttccgtctccccgccccctctctccactccctcgctgtaccacccgcccccccaccccccccaactcaccttccccccgtactcccancacgtcgcccccctcccccaccccccgcccaccatcactccacagactttcactccccaaacccttcctcatcctccaccccccccctccccatactccccccacaccccttcttccccccctgcttgtatcgctactcaccggcgatacgggccaagcgcgattccacactccccaacatccgacccacccacccccatcccccccc

SEQ ID NO: 16540 - DNA, 775 bp, Homo sapiens
atgatagtgaatctcttttcaccaaagaaaataaattctactaggaatatacatgaagagatgagagacaaacattacatccttctccacatccacacttccccaatgctcagataaactccaaccaacccagaaccacactattggtaggcatctgtcatgtgtatggaactgtgctatgagccatacacaaagatgaataggcgtggaccttatattcaaattattatgactctcttaaggaagaaggacacataagataaataattgcaacacagcatacaatgtataatagtagaagtaatttattcagctgggagaggagaggaggtagacaacatctctcagagggtaatgacatatatcacataatacactctgactgaaagttaattaggaggtgactcagactgtgactgacaggggacagttctggttttagctttgatactattaccgaggtactgacagttatctcctaagctacccaagatcaactatgtcatctgaagaccctggactcaggccagcattctgctgaggatgatgactaaaggcaggcaaaccaaaccactgctggtggaacactgcacttaccctttcttcactgttatgacactatgaatactgctagagttttaagcaacactctcatgccactgtatacttgcctctgaaacatcttaatatcccgttcttatgtaatgtagattttgaacttatttctacctttaatgaaaaaagaacaagaaccctactcaataaacccaatggg

SEQ ID NO: 16541 - DNA, 783 bp, Homo sapiens
tgctttgtcaaaggacacaaagagagcatctggaccttgaaccagctccaccgaagattctaattgtttgccatccattgtctttccccatccccattacctgtggatctattacccctgtatggaagctataaaatcccatagaacatttaagaatggcctggcgaatcaaattattggctcctgtgccaataagaaatcctgttcaaaaggaatagtttagcaaagcttctgcacatctagctgctaaggaaaaatggatggaaactaagacatgtttgctgggaaatgggcatagtcatttcctgtattctcacttaaatttctacaacaccactttgaggtagatattctttctaccattctagatctgagaaaagcatcggcttatagcggctgaccgactcaccccccggggcacacctccgtcatcctaatgttctctctcacacatactcacgacccctcccctcgcgtccgcaccctgcgctccacgacccctctccagatcgtctatccatgaccgtcgtcctccacaccttcctagtctaccccgtcctggctctctcaaattgccttcgccccccccctctcgccccccctcttactccccgtcctcacactcccctccctcacctcttcccccattctcttcccctaccccacatctacctatacagtctccaccctcctatcacctttcatctactccactacttttacctttcccttcatttaccgccgtccacctcccccgacaatccacagcctatactcctacct

SEQ ID NO: 16542 - DNA, 743 bp, Homo sapiens
gtttcctctcgttttaatagaggggtggattctgaaaatttcttctgacattctgaagagcttcttctgtggtcacttttttatgaagtaattagaaactgagacacttctcctgaataaattgttggcttttgggatagtggaatggaagaatggaagaatccattacagcaagtgattcctgaggatgccagaacctcccttttatgaagcattcttcttcttcgcatctgactttatctctacaaggatagaacagatgagctaaactgatttggtccttgggttgagaaagaaaaatgggatcatatatgggagtggactacatcacttctgcccacatgccaatcaccagaaccttaagtcatatggccacatctaatctcaacaggatctgagagatacttatctatgtttccaagacgaggaggaaatgagggagcatgtatgattttttgccacttttcactagtttctgtgcttatatgagtgaatgaaggaacgaatgatgcgttacaaataattacgcacaggcggacccactcaggcacctccacacctacttttatcagggtcgacctttccttagcttatctgctcactggggactctggttcttccttcctcacttgccatccctctcactcctcaccccgccctcctccacttcacaataccccttcgccacccatcccctccacccccctcatccattcatcgccccactcccccctcccacacca

SEQ ID NO: 16543 - DNA, 777 bp, Homo sapiens
cttagtctgaacgcagacagaattcttgatttgaagatctgtgccaaaattatagtgtactgggtctcgctctgttgcccaggctggggtgcaatggcgcaattacagcacattgcaacctcgaactcccaggcttaagtgatcctcctgcctcagcctctcgagtagctgggaccacaggatgtagagagcagtcttcagcctgagacctatccctgggtgctcttgaatgaatgtttctgattggagattgtgacatcaaaatagaagaaaaacattcaggactcacagagagctggaacatccatgaatatcaaacagaacaggaattaactgcatggactgaattaacagaagactgaagttatctttttgactttttgcttaaaatgttgctgatcctttgtcttgtttttttcacagaaacttttcttttgcactattgacagcttccaacaattcagtagactgctatgaacaaaatttggagcatatgtgtttctgtctacctgatttctctagaatttggaaactatttgtgagtattccttaacttatggccaccagttttttgcgtacgggcgcgagaatttgtttttatttgggagatgattcgattggaaaacttgattttctacccaaggtcttgcctggattggagcgcttctctttattgagtcaacctctttttccgacctcaccgcacgctcctcgtgaaaactgccttttcacttgatctactcttagtctcctctcgcgcccggcgctcgctgttct

SEQ ID NO: 16544 - DNA, 519 bp, Homo sapiens
  misc_feature (1)...(519): n = A,T,C or G
tagatggagcacagagacaccagaatcctaggattcattatgagccagattgtcaaggctcagaaaagctgactggggctttggagtattgactgtgcataaccaaccttctgagggaccctaaaggcagtctgtccccggttatatactacaaggtcacatgagttactgggccaaagagttgagggacatactattcttgggatgcggatgaaggggttgagggggtacctanaacagagccttacctgctctagccagctcttccttatctcaagatgttgcattttcaggacattatgtagttatttttgagagccatgagcaagaaagggaggcaaactgggttagtgcaaagccgaccctgagaattgtgctgaaccattgactactcattctgattcaagaaatgttggtttctctgaccttttcttgagaagattttatatgtgttatctaaaatacaagactgaaatatcttgtatgactttgttcggtaaagaaagtggtgcgacggat

SEQ ID NO: 16545 - DNA, 760 bp, Homo sapiens
ctggttacatccgtggcggcagattaaaggccacagctactggaaaatgactttccctagcctccccttcctgattttcatcaatcacattatccccttgctccttccagcttagtggtggtaagaaatcatactcccttatacatctttcccactggtgctggcccttgtgctttatgtcgaggcacttttcctatacttgcctgaaagttttatgggctctgttaagtttgtccaagactgtttttactagcttttggatggtttctttataaaataataaaattgatttatgtgatctgttaattgaacaaaattgggcacacagaactgaaatgaagactaattcacggtgctgactacagttggataaaggaattttaaatattataaatctataatattaatgaactgtatgttgtctttttttatatatagttttgtgttatttttttatacaaaaatataatataaatttcactactcagatatatatatattgacgtttgtctgaacagtatataattctgtattgacttcactttaagcatcctccttcgctctattacttctgattgtccttcgtattttctattttattcattatctcttatataattatttttattttgttttctaaaacattgatcttctaattcattctcctttaacttctttcacctatcctatcgcttctcccactcattgctcccattacattctgcccctttacatacacatattacaattccctactcat

SEQ ID NO: 16546 - DNA, 1075 bp, Homo sapiens
  misc_feature (1)...(1075): n = A,T,C or G
ctgggcttgcagatgccggtgttcctttcattttcagcatgggtgctgtacacttctcccttaggaatacttctctctctaaagcctgataggatatggggcttcagaggtcccacagagacaagcagagaaacttgcttgtcaatggcctcctttaataagcgagtgatagatcattcgcgagatcatgctgtgaatagcggtggcagagatatagatcctcgcagagaaaggcaccactagagactacgctgcatatatgtagttgtgacctagcttacgtgctgtgaattgttcatatgccttgattgcatagaagagtatagtaatttcacatcttttgagagatatttanttatngtagttgaatagtgctatgccgatgccttcttagcgagacaccaacacaccatctgtcccctccgcgcgcgccgtcgggtgcagcatcgacgcgacnaccttctacctctctcacnccttcatcaaccgcagtcgacgttgtgtcctcgtgcatcgcgtccctatcgctgcctaaacacgcgtgtatcaatacttcacaatggtgatctctatctatctcttgagcgtgctactcaccatctgtantctaacttacatactcgaagacgcaacatcgtcattcttacgcacgcactctcactccaattatcagtccacttcgctttcatagacgacgtaccactcactaccncaagacacacacgctctccacttcccccgtcgcaccgtcgccgcgtctccgtagtcgacgnttcgctattgtcatattggtgtcgcttttctctcgtgagagatgtcactccgcgaggcggagagacgcgtccctagaacgagctccgcactgtaagttggtaccctctcttccaccacacactaccttcacacctcattcttcaactcactctccccncaccaccgtctccctctcactcttcttcacgcaccgtgcgctcctcttcgccagcacctccgcactcgctacacacaccactcgcagcactcactcgtntntatctctatcatcaccnctcctcatcctacccctcacactcat

SEQ ID NO: 16547 - DNA, 840 bp, Homo sapiens
cccaacccacccccccccccccccccccaacagcgaggtttaaaatggtgagtgtcctagtgaatgctgacccttcttcactgccaccatgagtggaaacagcatgaagccctcccgagaagccaataagatgaatgctgatgccatgctcttgtacagcctgcagaaccataagacaaacaaaagccaaattatacttgtctgtataaattacccagcctcaggtattcctttatagcaaacaaacaaactaggatagtattattggttgagagttttattttgttttgctttctttcagtacttcaaatatattatccaaatatttttaggcctgtaaagtatttgctgagaaattcactgatagtcttgggaaggttatcctgtatgtaacatgccacttttcttttggtgccatcaatatcttttattttcttgggcttgtcataattgatttataatgtattttaatgcaaatatttttgcatggaagtattcggcaacctttacatctcacaaatgtgaatggttatttgcctccctaggctttaaaggttttcacacatggcttatatgacatgatatgtgagcataactccttatattgtacttcttgaactgctacaacgggcacgccggtttattatctcattgtcctcataacgcaaattaggctctcttcactatttccaattagtgtcctgcacgtatcgcgctaaatcatcatcccgaatctaccttcgctaccaccccgtatataacgtacaccccacttaaaacaacaataactacccatccccaaatctccacactccacccgatcgtccctataaattacca

SEQ ID NO: 16548 - DNA, 937 bp, Homo sapiens
  misc_feature (1)...(937): n = A,T,C or G
acgcgcgaacannaaaganncaacaacaaaagacccgcccgcccacgcnggtgggcaaagaacanacaggaagcttgagccggngaccnncactcttgtgctcacaggcgtggagcacaaccgaatgacctcggctaagggcaacctccttttcccgagttaaagcgatgctgctgcctcagcctccagaccggctgacattacaagcacctgccaccatcctctactatagacagggttccaccatgtcgaccagacatggtctgaatccctgacctcaggagaccccctcccaggatgatagagattactggtactgatccaccacaccctgaccaagagagtgagctatacaatctgataataaggaagatgacaaaagatgtctgtagttcatattacggcgccacctcctgacttgtgaaatgcccgctgaagcccgttgactatacagcgagactagcgttcctcgcgtcatagtaaccgagcaggtgctcggtgtcgacagcgccgacgcactgcctgacaagattagcgtgtcatgtttttaaacaagatcaaccataaatgtttattctagtgactaattatttgtttgtttagtgctccgtccgtgattattcttacgtagcgttgctacatagtatatatgtaaactttaatacatagtatacgagcttgcggaccctcagtatccctttcgcatccatttcctatcaccttcctaaatctcgccgacactttctcccacttgactcaattcacttctattaactctcatcacgcgctcagctcgcactagtctgactcgatagagcaccatatatctcactccattacgatcataccatgatggggatccattatattatctcccgtcacacgggttgagatgagacgcgcctccacacgagactgatgccttgtgtagagtacg

SEQ ID NO: 16549 - DNA, 830 bp, Homo sapiens
  misc_feature (1)...(830): n = A,T,C or G
ccagcaagcaaccacgacgcccacccaaaggggtttaaaaagagnggaaaacctagaatatccttacttgtcaccttgacaccaaatttcacatttactggctagaacgaagcaccaaagaagttcctgaatatagcaaaatatttactgccaaaaaattacgctacgattacaattctactggacaagacatgtaaaggagagaaaacagcaacatccctaaaaagcctttatcaaagaatactaccaagctacaaaacggcaaaacccaaagagattcctacttaataagcaaaataaggagtggttcttttccaatatatcacacacacatttaggaggaaacacaaaaacacacagaaacattatgtttcgaaaagccacagagaaaaccagttttttggttttttggattttgtgtgttttgagatagggctttgctctgtcgcctgggccatggtacagtggcccgattacagtgcactgtagcctcaaccacctgaactcaagcaatctgcccacctcaccctgccaagcagtcaagactacacgcatgggccaccaagcccagataatttttaaatttttgacaagatgggggatttgctatactacctacgcctgaactcaactggtggggtcatgctagtcttctgttttgtcctctctaaccgctacgattactcgaatgacctcccgcatcccatcaccgcccaccatacactgattccacaccgcagccatatacattatcagtccctaagtatacctttagaatggaacttaccagtaccacattactcactatagttcttcgtatgccctaaaat

SEQ ID NO: 16550 - DNA, 759 bp, Homo sapiens
gcagctgcgcaagcagggcctgagaattgccccacactacccacctcccagctgcaaaggaaaagggctcagttcttcccccacctgtggagtctgcatgctagattcccgttctccccagagttctggccaggaggcttcttgcctggttcaagttgttatgaagttcagctggagacttccttctccctgtggcattttccccacacctctagctgccctcctgaaggatcctggtggtgccagttgttctggagctaaaattcatgatgtgagcctccgtatgctgctctgcctgtgcaagttggaactgcaatctggttctgcctcctgtctgccgtggcgatccctgatgtagtttctgtgcgtcttcttttgagaaatgccttgcgccctcccgctcttccaggataactcatggcctccatctcctcctttgaaaactgcgctccttcccttcacctccgcctgatcattcatgggtggatgaaactgggctacttgatctgcacaattactccgtattgtggattgggcccttgctcgtacttgtccatgataacatgttctctctcttttgcacatcaattattaatgctaattattgtcttgtttctctgataatttcctaccttggctttcattcttgaggaaggttctggccgcattactcggctaacgaacacttttcttcatcaaccacaattcgtcatcactatctcttccctcccacctattacatattacttctattctttc

SEQ ID NO: 16551 - DNA, 766 bp, Homo sapiens
ctggttcccacccaagaaaattaattacatcatatctccttcatcttctaagttctgccttatccaatcagttggagacctgaatatacaaaaagaccagcctccgggaggaaaaaagaaattctccagcagactgccttcagattttatctgcaacatttgcccttaaaaattcatttgcaacactggctcctccatgagtcatgagcctgctgccctttgaactgaaactgcaccatcagctctcctgagtctccaggctgcgagccttctaactagaactaccattgactctcctgttctcaaacccgctaaactgcagattttggatttaccagcagacattatttcatgagctgctttctataattaatccctttctacaaatagacacattctattgtttcaaatcttctgtacgatcctaacccatacattgcctctatagatttgcctttaaaaaaatgtcatgtcattcttcagacttggggatacagcttgaatctgggaccccaccccaatctcatgtcacatggcaatcccactgcacgaggcggaaccctgagggaggggatcgcagtatgcgcccacgcaaaacccacttgctagacagcggcgcaccccgccggcgcctccgcaccacacaacccgaccccacccgctccccttcccaccccccgcctcgcacgtcctcccccctccctcttccttgcccgacaccagcaccacacccacaccccgacacctgtcacccgccacctcccta

SEQ ID NO: 16552 - DNA, 889 bp, Homo sapiens
  misc_feature (1)...(889): n = A,T,C or G
ccacacccacaccccccacncccccaaaccaagaacccaagaacaaaagaaaaaaaccctagctgacccatagcaagacttcatcagatgtccgctcattgatcttggacttcccagcctccaaaactgtgagccgatggatttattttcttgtaaattacgcagactgtggtattctgttatagcaacacaaaaaggagtaagatacaagccttcccctggaaactgcaggccttcagatggactacacagtcccaaacctacccgcataacacagatcctgacacattgaagactaaatggggagaacagatctctgagactaagtactgaacccacattcatgatatgcctgcgctcccagtcgcacatgcatcccactcccctcaccacccccccccctcctcaccatctccccccccctccaactcgtcccccttacccaaaccccttcccacccccacagaatccacccaactctccactaccatccccccctccatcgctcgtcacaacccccacataactgatacgctcctcatacagaacacacaaccatttccccctctcgccaccctcataagcattccgcaccgaccaaccatatcaaaacaccaccccacagtctcgccaccgccacacccctctctctttttcatctgccagctctaacactagcaaccctctgatcctttcagcccccccgcccccccgtccatcaacagcataccacccaactcaacgtgcgttcctgccctctctataatttccatacacctcccccccacccaaccacaccctccagtcccacacggacaccaacatagacgaagctagtagtagagatcaacactccctctctcatccccccctccactcccctcctctt

SEQ ID NO: 16553 - DNA, 833 bp, Homo sapiens
  misc_feature (1)...(833): n = A,T,C or G
gcccgccccccacccccccacnccccaaccccgcacaaaaacccccaacgaaaaaagaannccccctactacgccctcggcaaaatgttctggtacctgcctatgaggctcccagtggtacaggtgagcaagataatcacttcctgtttggcacaatgagcggtaaaaaatgaattcagcaagttcaggttgtccatatgctgaagactctatagaaagatgtgacccttttcctagctcctgagagataacccttgagccatggaatgaatgaatgcatctaacaaaatttatatgttgaaaccctgacctaattatggagatattagaaccagatggcttctcgaacacacactaagtactctaacgcctgctcttctacccccagacccccgcgccccaagaaaaccacattctccttttgaccgctccctttccttccaaccactctacacgcaccatctcacttctgcatccgcttttcgccgaaacataaacaatttctctatactatccactcattttatcttatctttcctccttccttgctagaccttactagcacgataacaaattcacctaatcttactagtccacccctctcttccgcccgtccccccccccctcactcactccccccctcctaccccctttctccccccttccgccctccccccacctccccaccccaccctccctctactcctccccctcctttccaccacaccgcaccccccttctaacacgatcttcgaccaccctcatcactctaaccaataaacacccccacataactcttcttagtacgtcactcgtctccaccccaccgtata

SEQ ID NO: 16554 - DNA, 820 bp, Homo sapiens
  misc_feature (1)...(820): n = A,T,C or G
gaaggaaagagaaaaaagaannnacgaaagaacaaaccacacaaaaccaacaaaaaacgcnngccttgacacttactcgaaggacaacttgtgaaaaactacacggtaatacactggaggtgagagctatatggcccagttacccctgctgatcgagctcaaaggcagccagcctcaactgagcggcaactgggcacagaaacctatgcaagaccaactgtcaccagaaagtgtatgcaattgagacgaccgaacttaccaggcttgagaaatatgaattacattaatatttttttttaaccattaaatcgcgacggttttgtgattaaaacatatcaacccgtaagacacgactgaattgctatacacaaactattcatgaacatcaaattaaattactttaatgttaattattgatattactcataccataccgcttttttctaacacctcaggttgtcgctgaagtttgtttgatggttcttatcaattatcgttttgttataggagtgggttagttgttgcggtagttataatttttaagattgtttataaagtcaatattttttctcttacccgtcgttgtgggtttcgtactcgggttcgtgcgccaacgtntccacacatcgcatgcccactcaaacaacacgcccccacatctcctcaactgcctcaccgcactcccctacagtccaaccttcaccatccacaccccctcaacaagcctgaactttaccaaataatcttaagatacctcacctttcatacccaccccgccaatctcgcaacgacctgttatctgcctaccactactataagt

SEQ ID NO: 16555 - DNA, 828 bp, Homo sapiens
  misc_feature (1)...(828): n = A,T,C or G
aggaaacaaagaaacgaanaacgnnnaaagccccacgccccgcgcccccgcagacagcaaccccactcactagtttcttgctgggtgtcattcctgtcactgcgaggacactggcaaaccaaagagattggtccttgtctttgggactcctagagttgaggacagataatgcataggaagaatcaggtttcttacttcctggtcacaaaatggctgccgaagtccataagctaaatcctaataagttcacaattttaaggattcatgactacaaccccaaaatacggtacttctgcctgtgtggaaacaacagaagcaggaagattactatgatttttctctggcctttttagcttgaaggagactataaagaagaatctgagctttctctgcaggaaagattcattccacacctgacactcactatagcgaagcaccatgtccctgctatggtgactcggagatgactttaggaatgtgtgcgtatttgttatcgatataacccatagggaactaaaggagagcagtgttgtttgttcgcatcaaaaataattttatactgtgcaatcatatggaagctagcacagccaagcgatatgacgtacttaatatcgagcagaggtgttctttcttatcccacctaccccccctctcctaccctcttcttcccctacacctctagcccccctaacacacctaagcacctccactcgcaccatttactcaacgtcccccaccaaccaactcattatcgctcccccatccccccacagcctcccatcctgcttacttttagttagcctattcttttatttcatataccataat

SEQ ID NO: 16556 - DNA, 855 bp, Homo sapiens
  misc_feature (1)...(855): n = A,T,C or G
cggcggaacaccngaannaaccccccccacccccccccaaaccacacacccctatcagtcacaagtgcagttgtcagnagggtcaccttcacactactatatcaatcgcaactcaacaaggtctccacccgccaaggagctcaattataatctagacactcatacgtctactgggacgctcccggcacctgacaccaaggacgcccgtcacgcagaaagcaccagaaaaaaggaacccgggtttgttggctcttatcctaaaaatgagtagaatacttttttttaaaggcctggtgagtcaatgtcccggttagtccaaactatctccatgacttgcggacaaaaacaaaagcagcacacgtccaccctgctcagacgtaccttgttaccgctacaacacacacattccttaatttcctctaaatcttacgaatattaatatgtcgtgggaccatttcgttataggtccctactccgtttctagtaaatttattaacgaccaaagtaagtaatgaagatgagatctaagaagtaaaaactaataaataataaccgcagnacaccaaatcagagaagggcagataagtcacccaaagacttgggcaaggtttcggcgtcacggaacgttactccatcagtgcacaacccaacatccactacaactcccgcccacacctcccacccacctcaccaactctcgcccacccccccactccacctgtccctcaccgcccaaccacgcccgcctccgacccacaacaactccgtttacctctccccacgcaccgactcgcaacgctcaccccatcacatcaaactagcgcgcgacggaaaaaacgcagacacaaacggcgg

SEQ ID NO: 16557 - DNA, 857 bp, Homo sapiens
  misc_feature (1)...(857): n = A,T,C or G
cccccacccccgcgcccccnnaaaggaagagaaaactcaacacacaaaaaacttgtgctgacaaactcttgttaggaaatgctggcttaggtaaataatttcaagagggcacaatagcctgaagaactttcctgcttgttcgttcattaatcctgaacctagaaaacagtcatgtgatccgcactccagcctgggtgacagaggaagactccgtctcaaaaaaaaaaggaaacagccatgcgcattccacctgctccccagaggcaacttaaaatgtagttgcgctgctgctataactatgatttcctgaaggccataaatacgcgctgaccattatggcgccttgcattcggaaatggcgacccaccacattaccacctcttcgcctcccctcactcgtgccatgctcaacgaagccgtctgtctcccttcctccctctgacctgcacgtctccgtccctacgtcacgctccaccgcgcccactcgtcccctatgcctacccctctccatcttcacaccttttcacctcaccatatcacaccataagctgcaaccacccctagcctcccatacctctcccccacccgtaattagcctcccctacacccggcccattcgtctttatatttctttctcttcccccctcttatttctcctccttccctcacccgagcagtgcgatcagtacgcactcctaccggttcactgctcaatacatgcagctcttatcgcatacaactcgcagccatccgcgacctgcccccccgcggtctgttgatcgtagggtatccacgcgcccccccgtacgtctaccccacattccacagccgaactgcctccccccaccccctcccgc

SEQ ID NO: 16558 - DNA, 816 bp, Homo sapiens
  misc_feature (1)...(816): n = A,T,C or G
gggggggggggggagagnnnnggccccgcaccggnaagcagcccacccacccccccccccctctaggcacctcactgacagaattctctttaaaagactacttcccatggcatccatttggccaatagaaaattcatcatgcttaccacaccaagtagcaggaaggcaggcttgtcacgctgtaccctccttccttgccctagtctccagtactgctccagctggcctctaacctccagaatcctcccattaatatgcagcctgccagcaagtctaccaggctccagactggtactgggggttgtatgcacagagatccgggatgtgaactgtgtgtgggtctctcaggtgcggataccagcacctgctcctgtggaggtcggtcaggaatgaaatgaactttaattcgtgggtttatacatagttaagtgtaaaatgggagacctaggaagagaaaggtaatctctactgcatggatgacctgtctgagaagtaggagcgtgaaaggcagaggtgactgtgattttatgggagttgaatagcggagaaagagactggtagttctgggaatgagatatctgtaggtcggtaacggttatggttaacagtacagtatatctgaaccacatcttattggtgcctatctaacgttcgtatcatattatttgggggtccaggcaaagccggtacggcaggagcaggtgtctgctagtaagatcctaggtaacgtctcgacctatgtatagtatagtaacaagacattcataacagtaattagaggagataaaatgggagttaagataatgggaattgagt

SEQ ID NO: 16559 - DNA, 794 bp, Homo sapiens
  misc_feature (1)...(794): n = A,T,C or G
aaaaaaaaaaaagccctggcatcgactaaaagaagactagaaataaatccctcatattgaaaacagcagcatgtgactcaaaggcaatcgcttacaatatacaagttctgactgctcttgcatgctttacgtaaatggagaggaatctcgtaccacaccaccatctgctcttatagacatatgatttatttcccaaccttgtaccaaagggccgacatattagttcctagctgagcagtgtttcatcaggtgaaactgacacattacacagtccttacataaaaatagaactttaaccatcaatgtccagccattatgccttctctcccgccacatccaccaactcgccccccttttacgatcatgttttctctgtgttttgtttttctttttcttttgtgttttttttttgtataatctattccacatttaaatagttcgtcattctcttcatttgaaaagcaacaaaatgaattttattataaaattgaaatctatatattttcacatattcatatctcaaaatctatcttgcataataaaatctaatattgacatcataaaattttctttttcctctgtcgctaccgacctttcttacttctctacgttcatctaatttacgcgttcgtanccatattcaaacccaactatccacttaagtcaattccacccgacccaacactccataatcatccaccgtcccttgcttcttacccggtacaccttactcacacaaaacaaatgtccccaaatgagaaaaacattactcaatactaaaactaccccaatcg

SEQ ID NO: 16560 - DNA, 849 bp, Homo sapiens
acaccagccaacacgccaccccccgacccccgccggggggcccccgccccgacaaccgcccgccctgggcctctacctacagtaatttttatagttgatatccatgatgaagacagatgatacttaagaaaccctattgatactgacctgaccaacttagatgtctgcctttcttttctgcatgataccattaagactgatagagagataattactcgatgaacatgcaactaaagactggactcctagaacagtagactttcatttcttcacaaacggtatataatggtttaatatacagaccagctgacacaacattcgaacctaccaattacacgatatggtataaatatgtatggcatacacccacatgaactaatcccaccgacctgccctgtcatcacaaaaacatggctaaccctctacccttaagcatggcctccgctccgtcagtgtctcgcggagttgatgaactaatgccctacacgctcctctcgtttagacatagtacggcaagtaaaacattagtcgagccctattcgcgttccctctagactggacgtcccatagtcagagtgaaactagaattccgctctcctcacaatcgatccgcaaacccaccgccctgctcccccaccatccttcacctctttctcaaccaccgactccaccgcacttagcgttctattgagcagcttcaacatcaatcaatctatcacttaccaccgcatttgcaccatgcacaactctcgtattctccacacccaccgcagcaggatccaataacttcaactacgcgtctccccttccatcaaccaccaaccaacacccctaacttgtccactccat

SEQ ID NO: 16561 - DNA, 855 bp, Homo sapiens
cttcccgttaacagaacttcctttctcttttttttgtcatgcaaatctaatggtgatacactccctcagcttttgccttcctggaaaagtctttacctttcccttatttctgagggacagctttgacagctagaaccatggagggtgttgaagagaagaataaggttcctggctgtgccagaaacctttaagaagaagtgttggaattttgcagagctgaagatcaagcgctttctaaagaattttgcccaaaagatgctttgaaaggcaaggaggaagctcatttaccaaaaagcgacacattatcataaggaatacaggcagatgtacagaattgaaattcgaatggctcggatggcatgaaaagttggcatcttctatgtacctgcacaacccaaattggcatttgctatcacggtcacaggtatcactggcgtcagcccaaaggtccaaaaggtgctgcatcttcttcgccctaatcaaatcttctatggaacccttgtgaagatcatcacaagttcgtgtaacatgcgtatcattgattagccatactttgcatgcccgttccctatcccacctccccaccccactcctctccacgccgactctccctcctccacccccgatcttgctgttgcacactccatcccgcccgccttcacttagtcctcccgccacttttactgttctcaccgcgtcacctcctccccccccacctctcttctctaccctctctagttccttcttccccatctcctccccctccctccctcattcccccccacatttccgtatccatctcgtgacttatcgcccacactaccctcctgcacctaatcactcctccccattccg

SEQ ID NO: 16562 - DNA, 842 bp, Homo sapiens
ctcaggggaactatgttgcgggcttcaggcgccaacgacggagggaccagctgaagccatggcagaagattcggatggtgaagataccatggacatttattagttcccaaattaatacttttataatttcttatgcctgtctttactgcaatctctaaacataaattgtgaagattccatgaacacttatcaattccccaatcaatacccttgtgatatcctatgccttgtcttactttaatctcttaatcctgtcatctcgtaagccgattgtattatgtctcgccgcctcagagcccctgtgatgattgcgtcaactgtacacactgcacagcgtgcgccgtcgacctatatgaaatctgggcaccttgaaaaaagaataggataactgttttgttttgggtacaagagagagcaccctctaccctgaccgccggtgaagcgggcggaccagacctttattctctttctcttatacgggagaggagagacatcactgaatcttctctctgattgtgtccttcctccgatcactaagtgcccctgcgggcggtctctgcctcggcctgcggtcccgggcgtatgtcttgtccgccctcgtggggcacccgcccccctctcccccgccccctcgcccatgcccgctcgtcatgcgcgcgctgtgcttttttgagatcgcatggcgtctcgcttgagacgctataacttattagctagcattattaaccgacctctcgctccccactcaggtccctcctgccaccccgcccgtccctccacacaccctcatttctcgccccctcagtacgcgaacaatcccttatctatatccaaccaaccaa

SEQ ID NO: 16563 - DNA, 924 bp, Homo sapiens
  misc_feature (1)...(924): n = A,T,C or G
ggaagagganngnngnngnggnnggnnggcgatataataaaaaaagaaaagggggcctcntngangacgcgcnncgaggncttacgangngnatacaacacagcagcaaggaagaagaaaaagagaagngttccgcggggcacaaaaaccccaccgccccacaacagggagncaccagcaccggggggngacgacgacacaaaaaaccgcccggagcccaagggccaacgcaccaggaaggcaccgggggaggagacaggaacgcagcacgacacagaacaaaagagttttttttcaccccggnccaccagccgcgcccgcccggcggcgaaaatttaaaaggggggcgaaggagccggcgaagacgcggatgggagggcggcgacgggaggcggcgcgacgcgcgcggcgggcgccccgccagcgcgcccacgcgcgccgccgcggcgaggcgccaggaggaaggcggcgccggaccggcgcccgccgcgcaccaacgccaaaccgcctccgacgagggcgagcgcgggccgggagaaagagagagagccgcaagcctggcgacaaggagacagactgcgaggttcttttgcgtcgtccttttcgtatgcgatcgctctcatccgtttgcatcgtctccgcgctggatctattttgttatggttcgcgtttcttcgttctggtagtccgctgtccgcacgcccgcctttcgcctctccgtccacacatctccgtccggtagttgtttttaccgtgcgagctaccgttatcccacaatatctttctatagttctaccgtttatttagtgagtactgtcggattggtgttagcgtcgatttgtcagactcccagatcccgactactactcactttcttgtccctccagctcctccgcggcgcgtacaactttatgttcaaaacac

SEQ ID NO: 16564 - DNA, 871 bp, Homo sapiens
  misc_feature (1)...(871): n = A,T,C or G
cttcagggtgactcacaggccnattcctcctcaggaagaaaccttcagcaaaacaagggaacatgcatcccactttgaggccttgctgtgagacacacagctttcaggatgacacagggaatgctgagttccaagtgatctgtcacctgacaatcgactggatgaggctgtgatcaaggcctctgccaagagacctgctgccgccccagctgctgccagaccacctgaaagctgcccagtccgtgccgtatccagctgctgccgcccatcctgctctcagactactttttgtcataccacttgctgtcgccccagctgctgtcgcccagtctgttgtcacaccccctgccgccccagctgtggcgcgcccagctgctgtcgtccactctgttgccagaccacctggcgttccgactgttgtgcgccctgttggcgcctccactctggtgccgtagcgcccctccccttcttcctcgtactcccccgcccctccggttcccgttgcgcgcgctgctgcgtcctgtagccccgcggccgcgcctctgccctggtcgtctgcgccgcccgcctccacgatctcgatccaacccccctccccccttctcctccctctgtttccctctcgcgctggccgcccccccctcgccggccgccactctccgtcaccgtccccgctctcgcgttgccctctgttttgttttttccttcgcgcgcctcccaccccccccgccaccctcgcccctcccctcctgcctatccccggccccgccccctctgccgcttgctcgcctctccgcccccctggtctcacgctctcttgatttctatccccctctcccgcccgacactcaccagcagagaaagcaaaaaa

SEQ ID NO: 16565 - DNA, 906 bp, Homo sapiens
  misc_feature (1)...(906): n = A,T,C or G
aaaaaaaaaanggnnnnggnaaaaagagaaaggaaaaaaaaaaaaaaagaagcctcctgcnnaggttaccaatagtgncaactgaggagggctaaccctcaacttaccccccaacactcactaccttcactttccccggacaatgacatctatgctctttgaaggatgtctgctcttctctgtctagagaattctagtgaaatcctattataacaaatttggccaggtgatgtggctcactttgggaggctgaggagggaagactggtagagacaaaaagaatgaaattcttttttgagaataggggangaacggatttctatgaaaccgaatacccgacacggccatcagcccacattcaacaaattgtcattacgaagagctttgtgttgaataacagctaggtcgactacgtgcctcccccgcaacttattggctcttgtcatcttgccacaacacccctcaactccccgctcaccccgcgccggagcaccatctagacccctaaccccgttttgctcccccccctcgtccacgcccaccccatcctccatcacgccgataacagcacactctgccgccacccctcgcacatcccctcccccctggttgggccacacccacctcccctgctctagtcctcctcacctttctcgctgagacacaaaccctcccggacgaccggcccagcccccgaccccctcaacaccacgcccccaagacgctttgctcatgacccctcccgcccacccgctacccccccctccactacagacaacacatcgcgccaccccccgcaaagtcccacctctccacctcctcccaccccaccactacacctagcccgcaactactccccctgcgctccctcgccccgctcggccgtaggtgccatgtcacagcgaa

SEQ ID NO: 16566 - DNA, 911 bp, Homo sapiens
  misc_feature (1)...(911): n = A,T,C or G
tgtgaagaagaaaaaagaannngttttgtngnncaccacggcacaacccctgcggcgggcctaccacaaccaagggcccagccaccctacgggnccatgttcagcacgcaagaaccaccgggagacaaacaccccccggcccaggggaagcaagccgggaaggaaggcccaaccccaggccgaggaaccagcgagccccaagagaaagcgacggcgccagaccacagggcgaagcacccccagcaccaaccaaaggcatttttttatgctcagggataagggagagcggccagtaagggccactggactgcctgccgtttgtgctttggtgcgtgttcctccttcggtggtatggactctcgttgattgtccacctcctcgcggctgtccgctccggcactctccagtgcgcgcgtgttcgtgatggctgctgttcacgtcctgccgcgcgactcccgtccatctcgtcctctttgtcagacgcgagcgtacccaccggcgcgcctgcaccgcgttatgctccgcagtcgtnctctcggtctcctcttcttcattatttcccgtcttttgcgcgcccgcgcgcgctgccccctcgccgctaatcctctgtctctgcgcgcgcgccccccctcctcgtcctcccgctccgcctttccgcccagcccccgacccgtccgcacgcgaggatacttcacgcgtccgactcccccccgcgagtcaatcaatatactccgcccgccagccgccccaccatacccgcctggtctcgtgtctcgccctactccacttgtcagcccgtatgtccacctacttgcgcttagtcatgccgtcctgttcacgcgaagcaccttctaatcgctgaaactgcagcacagccaactcatctcgtttcacaatctaaccctaaacag

SEQ ID NO: 16567 - DNA, 954 bp, Homo sapiens
  misc_feature (1)...(954): n = A,T,C or G
aaggaaaaaggnnnnnagaggggaaaaggaaaaaaaaaaaaaaggtctcaggggnaccgngnaagaagttanggggctaacaaaggangnagaactggacatgcatangcagaatttanaaaaatagaacttctctcacaccatgggcaaaaaggaactaacagtgaggagaaccgggaaagcagagaagtgcataagacagcagtggaaaaaacgttgcgtggacataggagggaggaagtaggattgatgggagagatagtagagaaacagaaagggcaagagaagagataaacgtatgttgttttgagggggaggagggacgagttgataaagaggtggaaagggcgctcggccgcgacgcagccggagagcgagccggcacgccaagaacaaagagctagctaagagggctgccggcctgtcacttcacacccaccagatagccccacccccccnctacccatcgaacacccaagagcgactaggcagcgcannaagagggcggcccgagccacgcgcgcgactcgacccgcgcagtgcgcggaggcagcgcgccccgctggggtagagcggcactagccgaccccgcgagcgaacacagcggcgcgattcctcgtcgcgagctcccatgcggagccatagcgcccgagcttgagagaccagccgacgccgaggcggcgcaccaggaagagagggaagggcgcccgcaccggcccgagactctagacccgccgtgcgggtccgaggccacgcgcccccaaggtcggccagcgcccctcaggaccgagccccgacggcatggctcgcgcccgccccgcggccctaggcccccggccggcacggtaggcagcagggaggcggagacacggggccgcgaatggccggcgagaccacgagcccgacattattcacaaatatgttcccccctcaacctaaaatagccaccagacc

SEQ ID NO: 16568 - DNA, 1315 bp, Homo sapiens
  misc_feature (1)...(1315): n = A,T,C or G
aaaanaaaaaaaaagaggaaanaanaaagagaaaaganaagagaganatagnatagaaaaagaaaaganaanccttcanaaggggaaaacgggaagaagaagaaaacctttgaggggtngggaaccccagcgcgccacgnnacgaagcacgcacaggggagaagncgagagtttttaggaggagaaagaagnaagacaccgcgnnggagncagcgcaggggcaggaggagcgacagggtgcaggggcagtggagtaattagcntctcatgtagaatatgaaagtgcgcgtggggattcagtgagngctgtgagtttccatatatcgtatgttaatactattatgtgtattttgaacagaatagtatattttnagtgaagaggtagatgatagatganttatttttttttttgtttagaagtgtgtagttgaaagcaaagagttaggtagagtgtanttatcctcgttcctttgtcatacgatatatgagagtagaaggncgcgtggcttgcgttaggagcaataagatgttcgggcgtgctggatnatggtagtcagtatattttgctcatgtgnatgcagtccagtcgcgagtagcggcgccgcccacgtgttagaccacatgcggacatatatgtgtggaacaggtttncaggtgngaggcagggacgcgtcggagcgtgcagacgntacgcatggtgagcggcggctagtcnagacacagcgattcgacgaacgtgntagtaaataagaacccatacgcgcagatatgtgataggcgagtgtcntcgcgatgttcgcagtcgcccagtgtaagcgcgcattgtctattctcgcagaacaaccgtccaccgtctctccgcactagcactccgtccncacggctagatgattctctgcgcttgctgcccccatccggctcttgacgtttgatctncagacagctgtctcaccgcctactctcngcacgcggccccgtccggtgctgcgacggatcgtctcatgctccggtgtaacaagtttagttctatctcgatgccctatagattgtagatatatatgaagatcgcgtcgccacgtgcacccacctgtagaagtcacactccgactaaaagtgnctctcnaancgtctccaggtcgcactagtcacgcgccctggcgtccgcccacctacgttctcgcaccactcttctacgagtccgctctcgcntgctggcggagcacnnacgcgcacgcgtcaggtnctcgcaccgtatcagactgcactcgcacatttctactattttcttacgctgagtgatcgttcgcgtgaatcg

SEQ ID NO: 16569 - DNA, 812 bp, Homo sapiens
  misc_feature (1)...(812): n = A,T,C or G
tccgctcacgccttggcaaagaccagaggatgcgtgaaacagaagttcaggctgtaattaatgcagctctgcataagagaagaggtgcggccatagacagaaaaagcgccgcactaattcccaacaagaagggcaatgctgcggggaaagccaccaaaacatgcctccctaacctggccgacccgcgacacacccacagacaaagccgaacactcgcgcgacgggaaaccagccgacgggcaaacacacaaggagaagagcgacgcgacagggcgaaagctagaagagcgaaagactaacacgacgagaggaggaaagaggaaagaggccacacgaaagaagacgagagcgaagagaagcggccggggaggagcgagccgcacggaacggacaggggcaaaccgcaaaccaggcaagagcaagagcggaaaaagcagcgaggaggacgcggggacccaagagacccccgacccacaacgcgccgccccccggcacaaccccacccccgccccccccccgccgcccacccaacccaccgcgcgcccccaccggccacaagggagcgaccacacgcgacaaagcccagccgggcgggagccgcgccagcgcgagaagggagagcaagagcgcccgccgcccccgcagcccccgnacaaacggcgccgagccccgaccgagcccgccagccccgcaacgcccaagacggcagactagaacagcaacgcacaacaacggcgcgccccaacaccaacaccccaccccgacccgaaccgccacgccccgccccgaccacggccagacacgacggaacg

SEQ ID NO: 16570 - DNA, 1132 bp, Homo sapiens
  misc_feature (1)...(1132): n = A,T,C or G
gggaagaagaagggngggggngggggggcggaaaaaaaaangncngggggggngnggctcnagggggngacgnnncnacnnaccnccctaggnggnggngaaccngccngccannnaaacgannngannaagagncannaancnctccaacggcgggggcgcaaaaaccccccnngcaaagaacgcnncggaaggcgngngggggaccagagacggccacgaagcgcgcgcgggccngacgcgcgcgagacacgccacgaccgaagcggcgcgcccgagcgcccagcaaccgaccccccacagacgcccggcggacgggcncaccacgcacagaaaaaaagaagaaaaaaaaaaacattctttaccggcggncgcgccccgcggaccccnccagcgggcggcggnnagggcgcgccgccggcgcgggggcggggagcgcgggcgaccccccgcgcgcgcgcccgcgcgcgcggcgaccgcgccggagggagcgggcgcgggcncgnccgcgcggcgccgagagccgccgcgcgcgcgcccgcccgccgcggcggcgcggccgggcgcgcggcgcggcgggcgccgcggcgcgcgcccccgcgggccgccacggcccgccggcnccccgaccgggggaacgcgccagcacgccgggcncgcgcgggcagcgcgcccgcgcgcggggcgcggggcggcgcgcgggggcgccgcgcgggcgcggggcccgccccccccgcgcaccccgccccgcgccgggcgcgccggccgcgncggccgcggcggagcccgggcgcccngcgccgcagccctcagaccacgagcgcgccgggccctcgcccgcccggcgcaccgccgacgccccgcgccgggagngccgactcgccggaggccgcagagcagcggggaggngaaggagacgcgccgcgccgcgcagccacacgccggacccgccccgcagagcagcggccagcgcaatcgcgcggccgagaaacgcgcgacacgcccaccaccgccacgccttatcaccccgcgaggncgcagcagcggccggcccacaggacgaaagagcgccccgccgcacgccgcggcggagaggcgagacgaagaaaagaacacacacaaccaagaaaag

SEQ ID NO: 16571 - DNA, 865 bp, Homo sapiens
  misc_feature (1)...(865): n = A,T,C or G
gcttttggacacnggcggnnnngcttgnggncgtacacgccgcacagccacccgtctgcgtgctgcccttgtgggcggcagccacactcctggggggacatcgtcttctgcccgggttctgaccctcccgtgacgccctccggacggcgcattgtgatctggctgttgccgtcttgagtcgccccctcgccccacaacttactggaagtgagaaaaaaaagactattacgctccggtgnggctgtggcngngctcccccggggcctcctgggggtcccccttgcccccctctccttccaggtctgtttcttgtctttttcctggcgtcgggtgttgcgtgtgctggggctcttgcctctcgcgcggacctgttgctgtcctggtgtggcgcgtccttctgctttgcggctcgtcttttgctgtgcgccggtcggctcctgggngtttttgtctggggtgcgggtcgctggtgcgtggtgcggtggcgtgttgggtgcgtgtcttcgtttcgctgtgttttcgcgccctcctcgcgcgctctcgcgtggngtccgtcggcctgctgttccctccgcctcctttctttgtgcgcctcccctccctcccccccctcgcccgccctgcctcccgcctctccgcccgccctcgcccccgcccgcgccggccgctcgttggttgcgcgtgggcgcgcgcgcgcccgcccctcgcgcccctttcgccgtccngctttcctcgggcctccttccctcgcgccccgcccgcggcgccctcttcgccccgcgcggccgccccgccccgtcctcgtctcccgccgcgggccccccgtccctgcccctgccacatagacacaaacaacacaaaaaag

SEQ ID NO: 16572 - DNA, 860 bp, Homo sapiens
  misc_feature (1)...(860): n = A,T,C or G
ttcttgtcacggcacattcccctatggngancacaagttgtcagttctgttctgacaggcctctgctcttgagcagtgggattcttcttcacatcagatccacaggcgcagaagacttgcatatcctggggtgccaaatcttcagaatcttgacttatgaaagtcagagttggaaacagagcctgctcaatggcaatgacgagctgctcaaataaaaaaacaaattcctcagtcctcggctacggatctggaattagttttctttctttgctggaccgtgcgccttcggtcccntcntgggctgtttcctagaggcttccccccgccggcccggactcttctccttcgctcttatgttgttttccgcctgggcttggctgctttctttgttttggcggtgtatcagcttgtctactcgcgagatgtgccctcgttctgacggcttttcttcgtggccctctcggttcgtggcctttcggcgcggcgtgcgctgtgtgggtgttcccctcgtgcccgccccccgctgcgctccccccccaccgccgtccgctcgcctccgcgcccgcgcgccttgcgtttgcgtctgtgtgggtgcggtagctcggccgtctcgtcgtgggttgtgtcccctcctcccggtcgctcctcccgctcgcccgcctcccccccgcgtttatgcacgcccgcccgtctccgctgtccccttccccggccttctttacgcctgcgtcgctcgtgggccccgcccagcgcgcgcctctccgcccgcggcgtcgtccccctgttccctccgccgcgttcgcctcgctcccgccgccgctccgccgcctccccacccgatgagaaaaaacaaaacaaaa

SEQ ID NO: 16573 - DNA, 845 bp, Homo sapiens
  misc_feature (1)...(845): n = A,T,C or G
cttttgtacacccgccnngccttgngctcnatcnggctccttggctgcgcgcgggcctcttcttccggggtctgacctcattctccngctgctcttggccgatgccctgctcgccccctcggcccggtcgcttcttctcgcctgcccccgtgtttgcttgctcgggcttcgccgctcgcccgtcctctctctctcaattaacagaaaaattagctgcacngnggcgtggcccnngccggcggccgcgcctccnccccgcgggccccccgcggcggccggggcggcgcccccttttttgtgggcgcggcgcccgggggccgtcgncgcgcggttccccgtgcccccgggcgggggtcgcggcccngcgtgggggcggggggggggcgcgtggcgcgggcgcgggccggcgcgcggtgccgggcgcgcgttgttgttctgcgctgggtgcgccccgcccgtngttcgcgcgtccctccgtctgcgtgcgcgtgggtgttgtgcgtgtgttcggcctgccgcgggtgcgcgggccgctcgcgggggcgggcgcgcgcgcgcccgcgccgccgtccctgcgcgcgtcggcccccccgcgcgcgcggcgcgcgccccgcccggctcgtcccgcggcccccgggtgcgtgccgttcgcccgcccccggggggcgttgcgtgccgtcgggccgcccccgctgccccccgccccgcgccgccgcgggccggccgtgcggggcgcgggtccgtcggcgcgcctgccccggctggtgcgcgctcgtccggcggcgccgcccgcttgcgccccccgggcgcgcccgcgcccccgggggtcgcggcgaaccaacacg

SEQ ID NO: 16574 - DNA, 225 bp, Homo sapiens
  misc_feature (1)...(225): n = A,T,C or G
ccttttggactcnccgccgnncccctcnctgnngatacncccccggcnncnacgncnngaggcggngaactgtgctccggccttctgaagccgtcgtctgccngccntgctcctggcgtcccgcgcctggggctccccgcgggcctcccgttgtcctgcctgtcgggtgccattgttccgtcgccctcctcccctcgccccggcccccgagcaaaaaaaaaaaaa

SEQ ID NO: 16575 - DNA, 858 bp, Homo sapiens
  misc_feature (1)...(858): n = A,T,C or G
cctattgctactgccattncnncttggggganaatcagttgtcagttctgttctgacaggcctctgctcttgacagggggattaatccttctcatcaaatccacaggcgcagaagactcgcatatcctggggtaccaaatcttcagaatcttgacttaagaaagtcggaattgtaaacagagctgctacaatggcaatgacgagctgctcagctacagaaacaaattccctccgtcctacagcatcggatctgcaaattaattttctttctttgctggaatctggtaccttgcatccactcatgggctgtctcctagaggcttccccaccaccggcccagacacatctccttcattcttatgttgctttagaaatgtgcacggatgctttctttttactnnananctctaaacttagtctataacagatctgcncttgtcgtgaaagttttattagctggaaatttgcgtgagagaatttcggtgaaaaaatgtttaattttgtcttatgcttctggcgtttggggatttttcgtttttttcagttggaaatgttttccccccggggactgggctctttttcctggccccttgtttttggaaatcgggtgcctccgcctgattgcctgggttgtttgttttngtcctggctgctgncccaatcatcttttggaagccgcctttttgggctcgctggccctcggggggggcctctgccgccgttccctttgcgggggtgcttctgtgtctccctcctgcttgctccgctcgctcccggttgcgcggcggtgtccctcccgcgcggggcgttcggctccccgcgctccggctcccctgtcccatcttaaaaaaaaaaaaa

SEQ ID NO: 16576 - DNA, 831 bp, Homo sapiens
  misc_feature (1)...(831): n = A,T,C or G
ggctgntggccatccctggancttnctgctttgacngatcaatgacttgntttgatcctactcaaangatgatttttaatcagctataggatcttgacaagtgttctcaatgcaagattccattaactctggagattatgacattgccaaaaatacagtactcatgaagaactgaattgttcatgaatatcacgcncgacacgagaacagaatggatagaacaaaaaaaaaaggctgcctntgggtcgcctgggngcttanaactttggtgatccttgctttgctcccctgcgccccggctgcttattctgctctctttatcgcctttcctccttgcgtcccctctctgcctgtgaaccccgccgcctcggcctccttggcctccgcggtggcgctctgcggccgcttccctttcgcgcgggtcccctcgtgctcctcgctccctgcctcgctgcgctcgctcgtccggctgccgcgcgccgtctcccctccctctcgggcggcgctccgttctccccggcctcgggcgccccccgcctgcccccgctctcctcggcctgcgttggcctgccccccgcgcccccgtgttcctgctgtcttcctttgccccgcccccccgctggccccgtccccgtcgcccgcccccgcggcgcccgcccccgcctttgttgtcggcggctccccggcccccgccggcctccgcgcctcgccttgtccttccgcccccgccgcgtgcgccgtgggggggcgcttccgtccgcccccccgcgcgctccgccgcccgcccccccccgtccccgcccccccccacgcacaaaaaaaacaaaaaaa

SEQ ID NO: 16577 - DNA, 648 bp, Homo sapiens
  misc_feature (1)...(648): n = A,T,C or G
aaaagaaaaaaaaaaaagctanagagccgctgttggcggcgggnccgcgccgttctgcgtcttcccgcccgcccgcgcccgcgggcgccgcccccttttttctgtgccngcgggggccgcgccggccgcgcccccctgccggcgcgccccctcgggccgcgccggtgccgggggcgcggggggccgtggccgccggctcggtgcgcgcccggccctgggtgggggggcgtggtgccgcgcggggcgtgcgcgcgtgcggggggttgcgtttgcgcgcgcggtcgtggctcgctgcgcgcgtctcgcgcgccggccccgcgcccgcgcgcccgcgcgtggtttcccgccgccgccgcgcgcccgtcccccgggtggtccgtccggtgccgcgcgcgccgccgcgcccgtcgctgcgccgccccccgccgcccgcgcgcggcgcgcgcgccgcgcgggcgcttgtgttgtcgccgcgcccccgccgccgcggcgcccgcccgcgcgcggcggccgccggtgcgggctgcgggcgccgcccgggggcgtgccccgcgcgcgcgcgccgcgcccccgggccgcggcggccgccgcccgcgcgcgcgccgcgggcccgccgcgaccccgcaggaagaaagaaaaaaaaaaaag

SEQ ID NO: 16578 - DNA, 910 bp, Homo sapiens
  misc_feature (1)...(910): n = A,T,C or G
cctcagggctaccagtactatgtcctatgaacagtggacgaaagtggacatctttgcagtgttccagatcttatttgaaggtctctcagctcctccctattcactcatgatgtcagctcgcgggtctgcggcatatggctttcattatgtggagacgaagcctcgctctcgtcccccccgctggcctgccctggcccgatcttggcctcacctgcaacctatgcctgcactgatattttttttttactgactcaccctcctaagtggatgggattatatgggcctggcatcagcgatggagtttttgtgtttttcgtgttgagatggggtttggcgctcgtattccgctgcgcccctcccctcataccatacgcgtggccttacatcttcgagtctctactagattggtacgtcgtcgcgctgtgctctccgcccccaccaccagcaccgccttcatctctctatacctaccgcccgcggagacgcatgcggcgcggctgatcgacctctccctgctcacaccccctcccctctcccctctcccatccacgaccgttccccggggcgtccgccgcccacccccctcccaccgcggccctcctccacgtccccattctacctcgcctctcccgccctctactctccctcccccagctctccacttgcccctttaggcgttagaccgtctctgccgtccgtgcacggccggcactcatctccccgcctcccccccgccccgtgatcccccccctctcccctccacactccgcctcccatncacactcccctctcctctcctcacctcccgcccgcccgctgcccgcttcgcctccccgccgtctcgtctcccgccataccccgacctccatacagcccgcgagctaacaccagagtaaattaatcccactca

SEQ ID NO: 16579 - DNA, 884 bp, Homo sapiens
  misc_feature (1)...(884): n = A,T,C or G
gggaaagagnaaaaagaaaaaaaaaaaaaaaaaaaggccctcagggaaacgaacatcttctctgggacttaacgacctcagcatatggattattttctttccttactatttcaaaaactttgggttttcacttaaaagaagcactttatgactttcctttggcctacccaaggcgccaacattactactcttgtgtttaggggccattactatgtgaaataagcgttcactctacataactactacaataacttgccagcacgccttttttcctgccaactcgaaccgacctccacaccggggagcacttactgtgtggaccccctgaacatcagggattacccctggccggaacaggagtacatcggagttgtgccactcgccaccctagaagcgacgaaccctccgtattactcatccccccgtgccctccacccccctgcccacaccccaccccccccccccccacccaccctccccccaccgcacccccccgacacgcccgacgcgcctcaacatccacgaccgcgacaaaacaccccttcagtcctctcccctcccaccacaatctttagcgatcatattatgtcacccaccacagcacccccctattaatataccctcattcctgccagcctcaccgcctcattctccctcccaggcgcagatttgcatgacattcacagacatcccgcccctctcgtcgacatccccataatccttaaaccgacaacaaggaacttagagcatctagcaccataaccacacccacacccaaaaccgcctcttacctgatagttgtgagcgcgcgaccacacataaccttccactcaaaccaatccactccgtaatatcgcgctatcccaaatcgacacgaaaaacat

SEQ ID NO: 16580 - DNA, 835 bp, Homo sapiens
  misc_feature (1)...(835): n = A,T,C or G
tcttgtgttacgaaaganggttttgnggncagtaccnagcacttttttacttcccgttcaccctgagttttcccgcagccgagacaactgttctcttcaacaacacattcggcccatgatccactaacaaatgtccagtgctttggtggtctccgaccctttgccnagctgtcttgtgccttatcgatgatgtgtgtcgccgccagctgaaagaaaaaaaaaaccactccctcattcgccctgtttcccgccgcccctctcgccttttcncgttttggcgcccggtagctgtgcctcggctgttctctttttttttgtcttcgtggcgtccttcccgggggcgtgcgctcttttttctggttgcttgtgtttttcttgcttgttcgtttcttccttttctttgtttttctcttcctcctcccctttcccctctgtgccttcttctttcctccgttgttttngtttttcgcgggttttttccnttcctgctctccctcctccttttttttgctccgctccttttttctttcttttcttttcttctttccgtcgggcttcttttttttttttctcttcgctttctcttccctcttcctttctcttccctcccccncctgtttttctccttctcttttcctccttctctccttctctttcttcggttcctctccttgccttcccgtccttttgtcttttctttcttttctcttcttctcctctagtttcttccgtttcttacttttgtgtctgtgtcttggtgtgtcgtcttgcttacccccttctcgttttcttttctcttttctgtctctacttttatgctcataacaatatataa

SEQ ID NO: 16581 - DNA, 495 bp, Homo sapiens
gaagacgttaaaaaatgcttttataaagtatatcctagaacttgacaatttttataactagaaacctaactcaaaattactgcacaaggagaaagggcagatactggcttgatttttaagggcctttttacaaaaacaaaccagaaaagatttcttccttgccaggtatcaagcattaaaacaaatattctttttctctgagattagtttggacagcagatgaaagaactgccatacaagggtgagcctcccttgcctttgtgtgtaaactcacagggaaataacattcccccaccacccatggctactgggacactaactcttgtcccagcatcccagtctcagtttacagcagagtgggaccttacaggaatagagaagttggtgtctctgaggtgaggtttgctgctgagtttgctgcttctacccttaaaaataacttcttttttcttactttaaagcaatatatagccatgtaaaaaaaaaaaataaaaa

SEQ ID NO: 16582 - DNA, 271 bp, Homo sapiens
cctaggagcttcttaaatgattagctccttgcactctgccaatatgaaggctgaaaggaaggagatatgggtgatgtcatgaggagtacccacaagataaacccaaatgagctcatttcaacataccacaaccccagtcccggcactgacatgaaacagacgatggacaacacaagctgtccactcaccaacgtttgtgtttaggacaaataaaacactgaaagcattctctgttaaatgtggtgaagggtggggttttttcttctatggt

SEQ ID NO: 16583 - DNA, 772 bp, Homo sapiens
  misc_feature (1)...(772): n = A,T,C or G
ttatagggtactttgaccggctgcgtgcagaaacgccatctcagctcactgcaacctctgcctcccgttttcaagcgattgtcctgcctctgcctcccgagtagctgggattacagccacatgccaccacacccagctaatgtttgtatttttagtagatacggggtttcatcatgttgcccaggatgctcttaatttcctgacctaatgaaccacaataacctccncccngggtgctgggattccnggcgtgagcctccgtgaccggncntgctttgcttgggtgctaaatattttaggcttgtgtgcccttnggctctgctccccctccttcgttctgctttcgtccttctttcgcgcccgttgctcttcccttttcccttgagcgtgactgtgtctccctccacttttgtcccttccccggccgcccccccctgctgctcttcttgccccccccttgtttttccnttnnttcgctccgcccccctctcccccgatccttctgtgtgtcttcttgttgctcccgttcggtgcggctttgcgttgttgtttcgtcttccgtttcttttttggcttttgtgtgtcttctgcgtgtttgttgccgtttctctttttttttttcgcccgtgtcttggtgtccctctcttttctccctctcctccctgcctttccttgtccttcccccgcgcgcctcttcgctccgctcccctccccgccccccgcccccccctctcctctctcctctcccctctacaaaacaacatcccctcgt

SEQ ID NO: 16584 - DNA, 775 bp, Homo sapiens
ctgtatgtaacgaatgcccacccttgatgaggcactctgctagatgcagaggacacagtagtgaacaagatgtgttttctattctccggggactgacagtacacagatgtagacagactatggaaatgatgttagacaaaaagcaaattcaattgattttcttatttgagttcaaagtgggtcataaagcagtgcagacaactcgcaacatcaacaacgtattggcttttttactgctaatgaacatacagttcagtggtggttcacggaagttttgcaaaggagacgagagccttgaggatggggagccttgtggctggccatcagaagttgacgatgaccagttaagaacaatcatcaaagctgatcctcttacaaccacacgagaagttgctgaagaactcaaggttgactgttctatggtcattcgtcatttgaaacaaattggaaaggtgaatgagcttgataagtgggtgcttcatgagctgagaaaaaatttaaaaaattcatcatttgaagtgtcatcttctcttattctacacaacaacaatgaaccatttctggatccgattgcgaggtgtgatgaaaagtggattttatacaacgactgaaaactggcaatgaacagctcagtggttggactgagaagaagctccaaggcacttcccaaagccaacttgcgccaaaaaaaggtcatggtcactggttaggggtctgctgctgctctgatccactacagctttctgaatcctggggagccaatacatttgagaag

SEQ ID NO: 16585 - DNA, 772 bp, Homo sapiens
cctggtctggcatctggatctcaattgacatcagcaggattgatctcctatttctgcttcctctgaaggagctatatcctcagtctcctggccatgtctcccaacagtccaggctctctcctcatggagatagtggctgtaaacctcctggtgctaccccaacccacagagtgtgtcccagcatctcagcgaaagtcctaagattgacttcgattggatccaccccgaagtaaccatgaggtccacagaaacagcacaaattcttgagttaaaccacacagcaccctcctctggtgcgcagggtgggtaaattcctgtctaaccctcatgagaaagatcctggttgatcatgcaccaaattgttgtccttttcctcatgggcctagtccttgtgaccaagtggctgagttccagtaaaggtgttcagaatacaccactgtggcacaaaaatcatttgggactggaggcatgtgaggatcaacagatgcaaaaacgtttttttaactactcttacctgcctaaaaacagggagaattcaactgtcataaatgccatcccagggcagagaacatcaattcctatgaccagaaaagagatggcgacatcagaataagaaatcacctaaacagaagctggcacagaactatcatatctccaatctattctgctacgggacccatttacctttcttataagctattggttatactgcaagcgcctttgagcccacactgtgcctattaagatggcatatacactccgcactcttatc

SEQ ID NO: 16586 - DNA, 857 bp, Homo sapiens
  misc_feature (1)...(857): n = A,T,C or G
aaggggannnnagnnnngagggaaaaggnaatgtnagnatgttgataaggtttctggttggcctggaggaatagcttttgccgttttcatcactgcagtgcgtggcggtcccagtcatgatcttccctgacacatttcatttttcacctccacctaccataggcccccatctcattctactttccacccatgccttctttgcttttaatatcattctgtccttcctcctccattagacatcacaaacgatcagtcttattaatccccattcttcccctctacccatggaaattaactttctcataatccaaatgtgttgagactgtattaatggggtgatgcgatgaaaatctagttctctctccatgcactgctccttcaagacacccgtttcgatgttgtacatgtactatcatgctctctcaccccgcacgcccacacccccccgccctcccagatgctctcaccatccccgctaccacctcactatcactccaccgcctcacgattcctactccctcgtccgcgcctcgcggcgcccccccccccccactcccacctcccccgacccgctttgtccactcctcggccccctgttatcccgcctcaccccacccctggccgagaaccaccccgagccccaccactcccctcccctctccccgccacggcgcccccccccccccgtcgcgccggtcattccggacactatggagacctttaacccacattcgacatctctcctagaccagcnccccgagcaccccctatgacgcccncccctcgcaggccgccccgcccccgcgtccggcgcgtcccctattcagtgctcagtgtattaccatacaaccacacag

SEQ ID NO: 16587 - DNA, 768 bp, Homo sapiens
cctggatcagcaaaaaaaggaagataattgcctgaaaagtcctgcaggtgttcaagtcctgctgttcagagaaaccctgctcatatatgcaccttggtggccgatggaatctcctcttcagatgacaaatcgctaattcgggtcccagccttagaactgcactgcttataggtgcattttatagcaatgcattgtgtatactcattagattgaatttaccgatttcacaagcatgtgctggggaaccagggacataaatgcacagtgacaatatctaaggttccatagagggagaaatgcgcctacaacagtaacttgaagtgaaggaaccaagtggaagctgccattagaggcttccggacaaagagccagggctcgactgcctcttcagaggcctgggatcatcacaccaatcagcaggcactctggggtgtgatacagcttgctgcaaaggatcctctaggctaaccgtgactcattggccttaggctctcactgcctgttcccatgaggttggagaaagaacatgggctctgagcaaacagagctggaatcctggttctgttctggactggtgtgagatttacaacatttaccacttgacctctctcaacttttgcttgtctggaatatggtgctaatgccccctgccccctaggatggcaggaagtattccattagatattccacagaaagatctcacaaagccatataggaggcgaaatggctttacctacccctgcctccctccaagaatgagaggacttg

SEQ ID NO: 16588 - DNA, 797 bp, Homo sapiens
ctgactggcaatgttgagtgactctacagcctgctggccatgatgtccacatttttcagcccttataatcatcctgtgcaaactcatgatgtcctcccctgggtccggggcatatgggccctgtatttcaacagctcattcaagcagatggaattcccatgttccatgtcaggaagtgcctgcagccagagagacaccaacggcgggacagatcatatgagtcacagcgttttctcctctttgtgtccgagagaaaggacaaactttggattcgataggaactccttaaaatgtttgtcttgaaatagggatggagaggcaaatgtttccttgccacaagcagtggcaaccttgcctatggcctagaatggctgccgcctgaacagacaagatattagtctaagcaccttctatgtctgaggctgatgagattatttgagacccttctgcatcctcaaatcatttgcgccctcagacgctcagcgccaccacccacaacccaccccccacccctacactctgtaatcctccccatccattcattaaccacacaccccaccccgcggacccgcaccctctaacgccctccccgcgtacttgaactaaccgccggcagggtccgccccgcctctccacgctcccgtttatggagccctccgccacttttccctctcatcccctccactcctcggctacacccccacccccctctcccccccctcctcttcagcgcccaataaccccccggtcatctttctttctctgccccttgcacctcactccaataacccaaatat

SEQ ID NO: 16589 - DNA, 743 bp, Homo sapiens
cctagagccttcgctctaatgaagtcattactgtgttgtgagctgccatcctgaatgacccacatggcaaggaacacagggcagacccaggcagcagctggtgggaaattgaggtcttcaatccaacagcttgtgaggagctgaatcttgccaataaccatgtgagcttggcagcaggtccaccctccagttgagccttgaaatgactgccacctcagctgacacctttattgacatctgtgagaaatcctgaactgcaggatccagttatttcatactcaacttcctgacttcataaactgttaaataattaaagtgtgttttaggtctttatagtctaagtaatttgttattaaacaatatctaagatatctgaatgttaactaatgcactcaattactgaagtaatttacatagaaatttgtactaaattggcaggtgttccatatgatacctcaagatcctgttgaatttccaaaaaatgacttattattttattgtattgtggccagaacaattaacatgatctatagctttctgaccaacgcctaaggtcacactattatcatatggctgaaaacactatgatttatggacgaactctacaacttatccgtcttgactaaaacttattgaccatagattattaactcccactctcctcattcgcctaccgccctcccatccctccttcctctttttgtataacaccatgggcctggtctcgctaccttccatccgcg

SEQ ID NO: 16590 - DNA, 726 bp, Homo sapiens
  misc_feature (1)...(726): n = A,T,C or G
gaatgtgaangcanntgagcagttcaaccctttgaagataactcagactaatttggccagcctctccgtctgagggtctgagatcatagaaggtttgggaaaagagaaagttgtcattaaattgacatcaaacaaccagaagacaacttgggaaaaagcaggaatttatgtccttcagcttttgctaagatattcatgccatgatatttggcctatattcccttccaattgaggacctcttctcatggagaaaaaagttaagaacaagagaagaaaactgccttgctcaagtacacataggataaaactaagtgactgagctggaataccaatagcagcctaataactctaattcagtgatttttccaccaaagactcaacagcaactgataagaatttgaaataccacagtcccttaacaaagactgtgagaagacctgcaataaggaagcatcattaactttgatgaacattgtttaccattgactgcatgatgtaacttgaatccttgacccctctgacaccggatgccgaatctcactcccccatttcggcactggcgactgacggcacgagccctgatttcgcctgaactccacccctcctcgtccccgcgctccccctcgccgcccctggccttctccccccgccaccccccccgcacacgacacccccctccaggttatgccctcgtcgcactgcccccgcgtgcctcttgtcctcagt

SEQ ID NO: 16591 - DNA, 791 bp, Homo sapiens
cctagaagtagccaaagaagatgtttagaaaaaaaagaaaaaagaccttccagaaggtggagccaagagtggtggagaacagcggacacaaggtctacccctaaggagcagaactggggcctggaggagaaacattactaatcccagggaagggcttggacacttttgcccagcagacttttcgtcttgctgtgaatgagagcagcaataggccacttatcctttccttttcaaagaggagagggcctgtacctgttctaccatgtgtgttaggcaaggagggagcacatatcttgccttttgagatctttggcctttaaatcaacccaaacttgatgtggattaagaaataatgggctgtgagccggatgcggtgattacatcaggcttcagacgatcctcacatggggcctctactcctaccgccgacctcccccctgcctcaccaccctataattaaattgtaccgtgcggctagaccctagtcctccctagcccccgcacccacgctccactatctttcttccctcccccccctcccttctttctctctcctcttctcccccttccgagggcgtcctgctaccaatccctcccccccctccccatccccaccccctcgccctcataccacgcttccccctcccacacccctccactcttcctccctacccaaccatccctcccggcacgtcctgcacctcgcctcccaccaatccgccgcggaacagcacgctgcccctccacgcctcgccacccaccgcttccaaccacccccaccccctcccacc

SEQ ID NO: 16592 - DNA, 774 bp, Homo sapiens
tggaaccttgggcggtgtctcctgactaccatgtgtgacaagaataccagctttcccccatctctgagcttctaacgttttttatgcctcccccgacttcaaaagtgttaagagttcccatggggatggtgaaatgggccattcctgaatggtataataaatctcaccgaacttcaggcatgtctgtcatcagccaagtcctctggtggggctgctggcatttgaaactgaggcttctcacaatgtatttcatttcttcggctactcagttcaaacttcagttattttagtgttcactcttgtgttaattagctttgagggagagtcacaaataaaaacatcagaaggctttttgccgtctcctgaacaggactgaatgacagggaaggatgaagagtgtaggctaaaatgtaaagaagacccagttcctggctcaaaacaacagacctctattatcacatagtctctggaggacggaagcccaacatcaaggtgtcaccacgactgttctctctcctgaggctctaggggcgggtctgtccccacactcttctgtcttcttgtggccttcctgcactcctgggcttgtggctacatggctgcctcctatggctccatttccacatgggcctcctccttttatacctgtgcctcctctcctctgtccacgccacagccttgcgactcaatctaagacaccccatcataatcaacgataccctcctgctgcataccctaccctaataacactccaaagcaccactttcgatttaa

SEQ ID NO: 16593 - DNA, 800 bp, Homo sapiens
  misc_feature (1)...(800): n = A,T,C or G
ggggggnnaaaaaganaaanngaggttaaaanannntanttttntttgntaacaagcattcaaattacagaggtactgacataaatagagaagcaaattgacatcatggaaagaactaactttggagtctgtcatattcactttcaaatctgtgaaaggaaaataccttgggcccccaaaatcactcaggaaaactcaagctggaaactgcttagggcaaacttgcctcccattctattcaaagtcactcttctgctcaataagatacacgcatatctgatttgcttcctttggaaaggctactcagaaactcaaaagtatgtaaccctttgtgtttcacctatttgtgacctgaaagctccctccccacctcctgttttcttgcttttgcttcatgttgccccacctttccagactgaaccactgcacttcttacatacattgattgatatctcatgtctccctaaaatgtatgaaaccacactgtgccctgaccacctttggcacatgtagtcaggacctcctgaggttgcgccatgggcctatcctctgccttggtaacataaactgcctaaactaactgccaaaaaaaaaaaatcagtctctctggacttcagcgtgcgaccatgccgtccctcacctttagggaggggtaattgatgatccttgcttactgactcattccattctccaacatccattccagcaagcgatataagcgtacccaaaagcggaactcacgcccacccacccactagtagtgcaccatcctgaccttccaccaaacaaacggacccata

SEQ ID NO: 16594 - DNA, 280 bp, Homo sapiens
ctgagtgggagtttcgaccaggattggacactgaggagagcaaagatcacctggtgctcatcaagccggacttccagaggcaaagctccttaactgaagaattcagaagtctttgaggaatcaccaccatggaatactatgcagccataaaaaagaaagataacatgtccttcacagggacatagatggagctggaggccattctccttagcaaactaaactatgtaacaaacctatacttgtaccccagaacttaaaataaaagtttaaaaaagcaaaa

SEQ ID NO: 16595 - DNA, 789 bp, Homo sapiens
  misc_feature (1)...(789): n = A,T,C or G
gttttaggntaaggacaatgaattcatagtttaaaagtagattaggaggaacacatcacacgccctcgaaacaggcacacggaaacagccctccagccttcctcacgaaatgtaaactgaataaatatttacgcacccctggaaaaacgcgcgagctgcacattcctgggatctcaggccggtttccgggaagagcaaacatgggctggagtaaaggatactggactgaccgtaaatcataactgcctcttcgcacctgcaatggaccggacagggtttgaagatggacggagaggcccagaagataatagatgttccatccccctgcatacatttcgcccaccctctctccatcagagaaacaccaacgcagggagaccaccatcttagttcacaccaggctcaatacaaacggaccagctcctaaacacatacaaactaccagagcccccctacagtccgcctgctcctaatcatcacactacctcccacctccaaatatatcatcatgaaaatactatttctattcgtcttaacacagttatatattactccatattttattacaacacaggtcacctgtttctgccgccactccagcgcatacgcgtcgtctacaatttcaactcattcgggtttttcgccttcatacaccctgccttgttgtgactatcgtntctcgactgtcccagtagaatttaaaacctgtgacccacggggggtggtgcaacacgcagacccgacacgaccatccaccnaaccccctcctcccccccaccgacatgtaag

SEQ ID NO: 16596 - DNA, 754 bp, Homo sapiens
gctaagatgccaagtacctggacaccctccaccagtaacaatggcagctgtgaggaggacccagtggctgttgctggatttagagatgaatgagagttgttaaagcaaactaaatatggcctgagaaggactccctgcttctatatttgagtccttgtggatgaaacataacctaccttaatatgcagacaagattgagaacctaacttaggagtatgcacctgtaacaactgagtcttggacaattccagcagccatacttcaaccactcatacactgctgagtgttcaaactgtgttcaaataaggcaaatgccagtctgtaacccgttcagctgtttctgcacctcacttcccatttctgtatgtcacttccctttatttgtttataaattcgccctgaccacaaggaatccctggaagctctctgaatttgctgtgattctgggggcagtccatttaaccaattgatcattcgccaccttaaccacctttaacccacaccacccacacgttcctctccggctcttatagtgagacctctgctgcccgcttcccttccctgaggccactcccatgattctctctgtcagcctacatgcacttgttccaccccgctgcgtatagcattatcacgctacttcttgcgctctctttatgacttttctcctaaacctcagttatcactatgcctacacatttatacaatacgcccatatcgagtgccaaaaacagttatcccgcccccaccgtct

SEQ ID NO: 16597 - DNA, 777 bp, Homo sapiens
cctgggttacttaacctgtaggaagtcagcctctatttgagaagttcatctatcctgagactgttgcgttgtggttgcaggaagttcaagctgctagatggacgggtcaaatgaagaaacagatgcctgaccactactaagctgtaactgatactgcagttgagatacaagatgtgaatctaaaagaaatcacctcggatgtctagccctgtcctcaaataatttcagctcggctgtctcatgactacaaccatacaagaaaccccaagtaaggaaagccccactgagctcaggcagcacagaaaaccaagaaagatgaaaataaatcattgatttgagtcattttcagtctaccactaatagccagaaaataataatcataaaacaaacaaaaatgtgctgatgatttagtatattgcaaacatgagaaggactttgtaaacatttacttgttcaatttcccagcaatatatgacataaacatcataaattttatctttaagatatataataaatgtaagttcaggaagccttggcaacttgctggaggacgtataattgggctttgaattcacgtaaatctgaatctaattctgcttttaatcccttacctattaaagattaaatagacatggcctttaacagaatgtatatttttcagagaaattgcgaatctaacagcacatagattggctgctggggaaagaggaacatgccctgaatcccgtaccttttggaaggtccaaggaagtaaaaatggctctaggcccctcacat

SEQ ID NO: 16598 - DNA, 465 bp, Homo sapiens
  misc_feature (1)...(465): n = A,T,C or G
ctgnngactgctgtttgagtaactcacaaagaagttcagaagccactgcgccagccacggaggtacacggctcaactctccttccagacagaagctgctgggaggagctccagcttccacagcagtcattctgaggctacgccttccccaggcagcttctagccaataactctgcacagcagggagactggaggtgggacatttctgccaacatgggacccatcgaatggctctcctctctggcttggctgaaacattctcagaactgtactgtcatctgaggctctttgtacccattcctccttgcctcttcctctttttttcccaggtgtcagacttacatgatggactggggatctcacagacttgaactgcttactctactctctatgtttgacagacattttcccaataaatctcataaatgtgcttgcaacaaaaaacaatcggcgctcgctggcctca

SEQ ID NO: 16599 - DNA, 781 bp, Homo sapiens
atggaagaggaaaagagaacaaagacagatacacaaggagaccatgatgaggcagaagcaagagatcacagtgatgcttctatgagccaagaaaatctaagaacttccagccatcaccagaagctaaaagagaagcctgaaacaaattctgcctcagagcctccaggaggaatcatcccgggagacatcttgatatcagatttccagcctccaaaactgtgaggcaacaaataatctgtcattttaagccaccagtttgtagtcacttgttccagcagccctaggaagctatcacacagtcagcctccattttttgatgtttgaccacacacaggttggaaccctcacgtctccgttttcctccgactctgtacctgggaaagtcgataaccatgctgaggtgttccctcctttggtgtcagtgggaaatcacaactgcctatgggatcactgagtcgttcaccatcactgccctcacttcaaaacccacctcaccaccttttcccgctcccctcccacccttttggaacctcctagggacccccccttttcctagaccagaaagcccttgcttcttgagacattaatcctgtgcttccccgccgagtctggaagtccccatactcgccctctcctcccacccctcccctcttcgcagcactctctctcctctccctccacaccacgcttcactatcccatccgccccagcattcgaacacggataacttattagaccgcggccactaggctccttccaccaccacccctctctccctcct

SEQ ID NO: 16600 - DNA, 1519 bp, Homo sapiens
  misc_feature (1)...(1519): n = A,T,C or G
tngatnaagatataaaaagtanaaaannnccttgnganagganggannaatccantanatntntnngnnanaagttgtaagtataacgcttggncgatagctagatgtacacgagatacgatggtgatacatcgatgtgctggataacatagtatatcttgtatcaagncccatgccgcgtcacccttgtacatnggtncncactaccacgacattatccacgcaccatcacacctcnatctcacctctaccgcnanatgttcganaaacgtgcgtgctcgcgcgtgcgacgctacataagtgtacaacctcacgtcatagacatngtctgacagcggacgtatcgtgtcgtgaccgctgntagtagntcgtgcaaccacacgatctttgttgcgcacagctaacgcatgtaagtagtgactgtacgtcgttgctaccaatgcgtatagtaagtgtagtcgtagtacnactgcttctcacacgctctccctccatcgcagtcagagtcatacctagtgacgnanacanatactagctgtgcgacactgantcactcagtgcatgtatcntgtcacacgtgtcncctcactaacactctcactgacactcagangcactcatacgcgngtcgcgcacacactcacactatgacgttactctgttagcacgttgtactctcactcancngtctatcccacacnaccacatcgtcgatcgtgctcacggccgctattagccgatctgctattaggagntntcatatggagagangtatcgctgaatgtgtgagctgagagtacatcntagcacgtntatactacatcagtcgtacncancttnacgttgtgactatcgaatatagacagactgcgtcgacacctcttatntatntgtcgatgtcagctgcggcgcttcgcagcgacctagctaagtgtacgcgatcagcgtcancgcaatcngtcactcgtacaccgtctccacatggcaagtcgtacattatgttccaactcactgntcacatcctatatcccatactntgcgaacgctctcncgcacgcgccacactgcatatactnctacactctctctcgcatcacnaaattcagatactgacaantatattcgtgtatgctgtggatcactcacgtagtacncanancgcgccnancatcaagctcgtactctttcgangcnacnacgagtagagagagacatctctacgtcacgataccatcaccgatgcgctagtgtgactcctcaacacagcgtcnctgcactacaatacgtctcatttcatcgtcctcacatcattcacctatctactgcntctcgtcacacgtcggtcgantcgacatccgatgctgacatgcgcagccgagcagtncngcnctccgatctgctatctctcatagtactcacacgtatccaccgcatactagagtatcttcgcacttccctcgctacntatcgatgcanctcaccgctccaacctacccaacccgcaccaacccgctacacg

SEQ ID NO: 16601 - DNA, 231 bp, Homo sapiens
  misc_feature (1)...(231): n = A,T,C or G
tgggcccattcttcgaacttggtcccaactgctgatatccttgggagtggaatgaaaaccatttcaaaaggaagtgaaacaactcagaaacagaaactcaaataccacatgttctcactcacaggtggaagctaaataaagtgttcgcatggacatagagtggggaatgatagacattagattcaaaagaatgaggaggggagggagggaggtcaatgatnacacactcct

SEQ ID NO: 16602 - DNA, 768 bp, Homo sapiens
  misc_feature (1)...(768): n = A,T,C or G
atggaaataaatcagaattacccgagnaatctgtcccatggtctcttgactatatcagtcattcgacagcggacagaagtcacagcatctttaacagacagtcaagagacttaaatggggggcactgaattgctgggagagctaatggcttgtcgaaagcagtagggtcccttttgattacaaggcctaatcaccacctttgccttctgaatgttttgcttctcattgcatctcgtctctgaggatgacagagaaggtgaaatgcaggcagctgtggtgaaagatctggtgtgagggagcgttctccaccacccacacatccttacccagtgtgggctgatttccggctggctgcttttcctaacctccagactgactcactctgtgcttgtaacctcgtcatagcctctgtctccgccttatttgtcccacaggcagggctggccccctggcttaccagtaccgggaaggcatcatagccttcttagggtcttctagtgctagaactggaagagatcttcgcacatcccctcagccccctggctttgctgatgatggagttgaggcccagagagaaggttttgtggccaagtctaaggctcacattgcctacctcccaatatgtaattttttctgagtacttcactctgtcacccaggctggagcgcaacgcgccaacacttggatcactgcaacctttgactacccagctcaaatgattttcccgactgaacttttaagtccctggcaaacaggtcgccccaccag

SEQ ID NO: 16603 - DNA, 307 bp, Homo sapiens
tggtttggatccaaccaccagttctgctgaacgaatgattttataatcagctaactctgcccacgatggaaagcaaaggccagtttcacagacccaaatacatttggcctctgaacgacatggatttgaactgtgaggatccatttacatgtggattttcttctgcctctgccgccccagagacagcatgaccagccactcatcctcctcctcctcctcagcccactcaacatgaagacgatgaggaggaaggcctttcggatgatccacttccattaaacaaatcgtaaatgtaaaaaaaaaaaaa

SEQ ID NO: 16604 - DNA, 269 bp, Homo sapiens
  misc_feature (1)...(269): n = A,T,C or G
tnatacaactagnaaaactcaaacacatcctaaatctcgctgtgccacccagtctgcgatgcagtggcatgatctcggctcactgtggcctctgcttcccaggttcaagagattctcctgcctctgcctccccagtggctgggattacaggcgcccaccaccaagcccaggtgaaatttcaatgctacagagaagagagaacaagataaacatgttccttccatcttaatgtacctatgcgtaagttcttgcattcgattacacataat

SEQ ID NO: 16605 - DNA, 206 bp, Homo sapiens
  misc_feature (1)...(206): n = A,T,C or G
ctcacttgacgctgctgacgtttanagcaagcaaagccgctgaagttcaaaacctgcactgaatctatctcaaacaaagaatgccaggacccactgcagtgacccctaggatgaagacatggaatctgttattatgcaatgtcacttaagtatgtcttttatattaataaaaaagttcgtcttggtaaaaaagaaaaaaaaaaaaa

SEQ ID NO: 16606 - DNA, 114 bp, Homo sapiens
ctgaatatgaagtcaaggaagaccatccacagaaaagatgcttgccaaactcccaggttcctggcagaatgaataatgtgaataaaatgcatgtttagtccaaaaaaaaaaaaa

SEQ ID NO: 16607 - DNA, 449 bp, Homo sapiens
ggactcttatttccccgctctgctggaaatggactctgcctgttctgtgccagccactatgaggcagaagagccgggctttgacaaaggacccttggaagaccagcttcggtctatgctgtaccgcaccccctctacccgcctatggtctggaaccactgtggttgctgcccttcctcctgcctcttccagctccctcctcgtcctcagcccccaaccctgccattaatgagaatcagaaggagagaaatattacaaagccatcatcataggaagaagcaaagagtgtgacagccaaaatcgtagaaaaaaatcactgtagagatatatcaagtagttaattaattaaaaaattattttatttttctggatattgcagtttattaatattgtcagctttttaatattagtattgccataatttcttttcttattctaaataaacaacga

SEQ ID NO: 16608 - DNA, 719 bp, Homo sapiens
tggggaagcgtgagaccaaacggtttagctccctccatggagttgtgtcatagggttctagaaccgtgcgtgaggtggggttcttgatggcgttgtcggatcgggcgggcaccgcctctacactacagcattgtcaacgctgaatttcggaagagtaacagggaatccgcagctgcaatcaagctttgtgtgatcaaagtaaaataactatgtttttgtttttggaattactgaagctttaaaaatttacttatggacctcaagccgatgggacatattcctatggggtctactcccctgataggggttcccaggtgagcgtgaaacatttaggaagcatgttgatctacatgtaccgtggttatgaagatccggctgaggtaatatgagtatttgcgtatatgtttgaagagggaagagaaagaggatgtttccaaaaaagctgagacagtgaatacagctttctatagaagaggtacatttgcaacccctaaattcaatagttataggagatgctccaaatgtgaagaaaaataaatgtaaccaagccactgcgagagatatccggaagtaagaagtcagcaagagagaaaaaaaaaaagagctgccaaacatatgaaaaacaagtaacaaaatgcaagttactccttacctatcaacaatgactttaaatgtgaaaggattaaactatctaattaaaagaaaaaaaaaaaaaaaaa

SEQ ID NO: 16609 - DNA, 339 bp, Homo sapiens
tctggccgcaccggctacccatggtccaatcagcacacactttctctcctctgaggcccataaaagccctgcgctcagccagaactaagcagatatctggatgaccagctgcagaaaggagctactcattccagggcctcctctctgctgagagcagcagacatcaggatgaccagctgcagagaggagctacccactccagggcctcctctttgatgagagctgcagagtactgtgggacaacctgtctgcagagaaaaggtacccactccaaggcttcctctgagctattctgacactcagtaaagctcctctttgccttgctcaaaaaaaaaaaaa

SEQ ID NO: 16610 - DNA, 814 bp, Homo sapiens
  misc_feature (1)...(814): n = A,T,C or G
aaaaaggtgnnnnnggggggggatcataaaaaaaanggggnnggcctcgtgtnaccactagactacctgnaggcattaccaagctgatacaatggacggctcacacttataatttttggactctaaactggctgcacaaacttaatgagactctggattgtctcctgggagagagggtgacggtctcctctgagtgagactacctgtgcttctcgtttcttatgtattcctacgagctcctccttgtcctccagaacacataaaaaacaattttttttttaggcccggcgcgcccgcgcacggcggccgggcttgcgccgcggctcctccccgcccccctccccccgccgccctcgtcccctccgcgtcttacgcgcgcgtctgcccagcctccgcctctcctttcgcctcttgctccggcctcttccccgccctctctccctccttccctctgagccagcactgcgcatcggtgtcctcgccccacccactggcccccggcccctcccccccggtccgccacccctcccccccgcgcccccccccccccatccccccgcttgcccccctcccgtgattgcttgcatccttctactcctatctccaccccactctcgcccccccccatccctcccgctcccgttttccgtgcccagcgactactcctccccctttttggatcttagatcctccacccgcgccacaccctctgctcccatccccactgcactaaccccacttcctctcttgccggccccgctcccgcgccccctccccctgcgtcccccccccccccacccacacaacacacaca

SEQ ID NO: 16611 - DNA, 837 bp, Homo sapiens
  misc_feature (1)...(837): n = A,T,C or G
ggaaaaataggggttattngtggggggagaaaaaaaanaaaaaggcggccttggggtcaacttaaaagnagnactagnaaggataaaaccgctcatattcgaaaacagcagcatgtgactcaaaggcaatcgtttacaatatacaagctctgactgctcttgcatgctttacggaaacggagaggaatctcgtccaccccacgctgtgctgttatcccaccggcagcgatcggccaaccttccgccggcccggcccccgcggggccctgagccccccgcccttttttccggccccccgcgccccccagaccgccgcgccgcgctccgccggccggcgcagcccaccgcgggggccgcgagctggattcagtgtttgcccccttgggctgtactggctcacggcggccctgcggggcgccggggggcgaggcggtgcagcccgccgagcgatgcgagcgtatctatccaccacgcgccgcggcccgtctccctccccacgacctcacgccgccaccccccacagcgaccgcgaggcccccggacgcgcccgcggctcgggcccccggcaactgcgcacggcggcggcatccaagctcgttgctgcgccggcncctctcgccccaccacactctcagcaggaaccacgcccagccgcccctagccccccccgctcccacacggccccgcgcgggcccagcgcgaggcccaaccctccgcacacgacaagaccagataacccaagcaagagaggtacgaagcttcagttggtatagaagagatgcggggcntggagcgcgaaggagcagaagatatgttacgcaaattagagaaagagag

SEQ ID NO: 16612 - DNA, 278 bp, Homo sapiens
  misc_feature (1)...(278): n = A,T,C or G
ggggggtataggggggggggggtnnngcccctcgggggaaaaaacaaaaaaaaaaaaannggaaagctggacgcgacgctccccgactgttgccgggaggacgcattttctttttttgagaagacaaccaccttaccggggcggcaaaccgaagagcngnganaccaaagggaaagcgaccaaccggggcgaggcgagaacacgcggggaccgagaagaagggaggaggcccccgacggccacgggggaggccggcgccgaccacaaaaaaaaaaaaa

SEQ ID NO: 16613 - DNA, 963 bp, Homo sapiens
  misc_feature (1)...(963): n = A,T,C or G
ggtgtatggaaacgtcgacgggaatgcttcatggttgaaacgaaattggccagagatatattgttgtcaaattggtatcgcttatgaatagactcagcgctgagattgagattaaactagaagactttatacacagtctgacccttgaacagcacaacatggaactgcagtttgtgcacgttctcatgtagattcgtgttccacccccgcaccgcctggaaactacagcgctgcacaagatgcttatcgttgacgtccgcgggaggatcttgtgtttggtgtaacacgatgttcgcgctggcctgtgctgcgcgctttcggtcgtggcgcgtcttgggcgcacatcgccacacccctcttcccccaggacaccgtgccctgcgaccccgcgcacgcttcgcccgcgtcccgcgtcgcgcaaatatacgccatctatcgtttgttttctctcttaatttttcgtcagatggccgtgtttgttgtgagggggcggatgcgcgaccacagcgccaagccaccgtgtaatagtttccggatggtcacgtaaacctccacaatctttttgacaactctcgcactcacatccatacctcacgcccctcttcccctaccccctacctgcctccggccctccccacaaccacctccactgatgcctacgtcgcgacgcgcactcgcccgtgacgccgcgcgtgacagcgagaaccgagcaaggtggatcgtgcgccacgcccacacaacgcacgagcacgtgtgctcgccgctgccagcgccgtcaaccccttcccgctggagtactcgcacacccacaccacacctcacggccatagctccgctcctgcctgcgtccgctcaggacgcggaacgcgcaccgaacgaacagagctnccgatcagtcctgcccagcggtgcacacatgatatcacgagttcgacaaataancataaacaacaacaacatcaa

SEQ ID NO: 16614 - DNA, 797 bp, Homo sapiens
  misc_feature (1)...(797): n = A,T,C or G
cctgatgggactgctttttagtcgttgnccgatggaacgtccagaggacaaaaggcaaaacaatattattgtgatgaatgtaaggtgatataatcagacatttacgccaattataaatcacactgcaaaagaactgaaatcatagcaaacagtctattggaccacagcgcaatcaaatttgaaatcaagactaagaaactcactcaaaaccatacaattacatggaaattaattttcctgctcctgaatgacttctgggtaaataatgaaattaatgcagaaatcaagaagttctttgaaactaataagaacaaagatacaacatatcagaatctctgggacacagctaaggcagtagtaagagggaaatttatagcactaaatttaaacgcccacataaaaaagttagaaagatctcaagttaacaaaaataaataaataaaataaatcatatataagcaatccattattgttaaaacaaatcactaactctagagtgaaagaaacccaacttttaagatgaagaaatgtagtttgcacttaatgtacgaagaggtctgtaaaacagacaaatcagagaaccaccaccagacgcaccttttgattaaaagtaacagtgtaacggcagctaatggatgcccctccaccaagacactgcaaaagtacccataattgattgattcttacaatagctgaagccacctaggttttataatccttactgcttgatgtcagagtaaaagttggtggttgggctctatcttctttcaagccttcatgtgaagaaaaaagaataa

SEQ ID NO: 16615 - DNA, 204 bp, Homo sapiens
gctttggtgcaaacatcaaactagagcctagttgtccttaccttgcctccccctaaaattgtgctccaggaaagtgtgaggacatagcaaggaggaagctgtctgcaagcccagaagagacccctcaccacaccatgctggcatcctaacctcaaacttccagactccagaacgttggaaaaataaattcctgtcattacaaaa

SEQ ID NO: 16616 - DNA, 750 bp, Homo sapiens
gtctcctgctggatacatggttcatgaagaatttaaccccgatcaagccaatggtagctatgcatccagaagagggcccttcgacttcgacacgaaaacagtttggcaaagagaggctgaggaacttgaaaaggagaaaaaaaagctgaggctaccggccattgactcaaagtatctgagcaaagcaggcaccccacttggccctaagaaccctgcaggaagtagactctccttgccccacgtgcctggtgaaaaaaacaggtcacctaccaatttttccaaactgattatcaatggttataaggatgaggggctgcgctacccgagcgagctgactaccacacgaggaccccagggtgtctcccacgagaagagcaaaaaggcagggaagaagtctccccgtaggtgatctagcaggagaccacagcacgcgtacccaagctgcttggcagtttctataggcacggttctagatttccgtacccccatgataattagtgtcgtctggggatcgagagaggtcagcgatgatgtagagaaaaggttagaagggagttccacaagttacaatgagcctaggaggaacgggaggggagggccatggtgctgagttggtagctgacgcggtagggtaggcacataaaaaacagcaccaccccccccagcgacgcagcccatataaacctagagcgcgcggcaccccgccaatgacgggcgcgatgaagaagtagccaggcatcaatcaccaag

SEQ ID NO: 16617 - DNA, 109 bp, Homo sapiens
ctagaatgacccttgggttaacatttgacactgttcccctggaaacctaatagaggcagaagagcaactctgttaccaagcaacgtgcttttagttaaaaaaaaaaaaa

SEQ ID NO: 16618 - DNA, 889 bp, Homo sapiens
  misc_feature (1)...(889): n = A,T,C or G
ctgaaaagcaccctaaacagaaacactcattgaagaaaaaagagattgcagtcttctctgtttctgccatgttgtttcttggatacattgattttgtgtcttctgtagaagaaatcatttgatttgtttatttattttatgtagaatatgtgaaaagtaaatgttggttataagtaattaaatacacaataaaaataaaatttgaacacgtaaacacacctaacgccacagaatccctttttactaaatgaactagaaaagaatatggtttattgttggtcttttntgaatttgtctgcacatagtaatacagatggttgatatatagtgttgtatgataatctcatccatctctcctatatatctaaaaaccactatccctaatcccatatacacatttcaaatccacactcacaatgttattaactctcccaattactttattatatctctaattcagtattattattatttatatcatataactttcacgttcctcatatatcctatttatttcaatacaataacataatatatttgtccctagtatagttcataacattaattattaaatatctataattttttacacggagtatatttgttattattgttgtatctccaccacatatgtatagtttactttnttaatattattaactacattttagtcgctttatatcaatctcatatttttcttttatacagttcatataaattgtgaacagaaaattccgcttgtacccacggtatctttcccccttttctntcctcactgccccctccctccctctctcctctccttcttatctcttcttctactctatttaccacacagcctaagccactatcacctccacccacaccaacaccacattctactttcttt

SEQ ID NO: 16619 - DNA, 1126 bp, Homo sapiens
  misc_feature (1)...(1126): n = A,T,C or G
ggggnaaaaaaaaaaaaaanaaaagagaaaaaacaaganaaaaagacganaagcccctgcacgtaccatccctaacctcgttaacctcagaatacgaacttatgcggcaaaaagccgccgaagaacaccatcgggacaacataaggccttcaacgttcaggttaccgtagtctgcaagtgtcagagagaatgcgcaaaagacacgacagncagacggcggggagccgaggagggaggacgacaagcgcaacgagacctcacctcaggacacagcacccccacagccgtcacgcgcaggcccgacaccgccacaacgccacaagtccacaccacccccaacaaacaccccgcaccgncaacacaagataccaacgacacgagtcttagagccccccacgaatgaacgaagagcgcgcccanaaggcgaacgtaaggaagaacggcagacgaggagggaaggatgaaagacgaacgaattagagcaggagtgtagcgtcgcggtgcaagtatggggtgtatacatcgaacgaacgcttagtcatcctcgcatagtaccttccaccattccacactctccaatcactaccgccccccaacggcacataggtcgcgccgcgtacacgtgaggcacggcggagcaggggcgccgcacggtctgaagcaaagcgcacagaagagaggtggtcgagagtcaccataccgaacagccgagctgtaaaaggaaacccagcgacccgaccaaccaagtcgacccaggcggcacccgctatcatacagcgtcaaaagagaatgcacatcacgacataacagctgaccagccaccgagaggcaggccgacacaaagaacacnccacgcagaggcgccactaccgtatcgcgcagggtccacgacgtattaccaactaggtcggagcggtaacgctgaagtactataccaccagtagtgtgcggcgcgcgcgcatgcgaatctgagcgagcgcataccaaccgtcaacatgcactagacaacagagagcaatgacccaacagcccccagccacacgacatcgcgggcgaagtcgagagagacacaacggccgtgatgacgacagaganctgcgcaagagagaagtagaaagaagcgcaa

SEQ ID NO: 16620 - DNA, 848 bp, Homo sapiens
  misc_feature (1)...(848): n = A,T,C or G
ctggtgctgctgatatggtggtttaaaggtgaaacccactactctagtaacctgaagtggactgatgtttanacgcgcgaagcccccagctgaaatcgtcaccgcctttaatgaaaatctacattgcccaatgactgatgtgatgaaatatcctgacgggggaatcccctaagccccctgacccctttagccatccctcctgccgccccgccagcaccccgatcagcctctttttctctccacaccgcttcctggtcttggcggtgtttgggggtgtccctgccacatcattctcccaccttttcctttctctttcgtagcgccatgaacagtcaccatcctgtctcgttcggtcgctataaccccccgccactcccttatcaccgaccccgccctcccgcccattatccctatctttcctccccctcgcctcgaaccccttcctctccctaccatcgtctcccctttcaccccccgctccgattcactcttccctctcccggtgcctctgcccgcggtccgcgtcggtctgtgtcggtgccgatctgcctntcttacgtccctctgctcttcgttttgttatctacaccattctctgtcactctgctcccgactgtctcccacccgtcctctcccccactcttcgcagtacccgcgccccccgcgctgctagcacgttagcgacccgcacactcccccccatccctatcatccgcctatctcatccgaccagccctctccacccacgcgtctctcacgccccttcactctaatctancagtgaggtctcgtcgctaatactccaccgcctttcacgtcccactaatcccctcccacagacagccact

SEQ ID NO: 16621 - DNA, 252 bp, Homo sapiens
ctaggggtcagtctttttttttcataccaaggaagcatcctcacctggagagatttgagcgacaaatactgaagtctcaggcccacgggaaagcaagcaaacagaaagagaagatggcgttcttgcctggtatccgaccactaagcatgtactccattcacgcaaggatttggtggttcctaaaagtaaatactgtgtctctgatatgaataaaactacaatttcttctcagatattttaaaaaaaaaaaaa

SEQ ID NO: 16622 - DNA, 865 bp, Homo sapiens
  misc_feature (1)...(865): n = A,T,C or G
aaaaaggaaaaaaannnngganaaagaaaaaagcaaggaggagagaaaaaagagaaagaagaaggcttagacggaaacgacaagcatagctctgagaggaaaaccttaaaacacatctataccacttagaagcctgctaattggagccttcatctcttcatctccatgacaagaaccttgggttccacaagctgggctcttgttaccttgagtgaaggtaatcggaactctccggggacagcgtactgcctcgaaccaattgcgaactccgaccagcccgaaacgacaaacaaactgttttttgcggtgcgcgcggcacccgatgccgggcctgggcagccgcgcgaacggcacagagcccccgctcgctgaccagggagccacccggcactgcgcgcggcccccccccccgccccccccccccccccagcaccgccccgcgacgcccccggccccccccgcccccccgcacgacaacgtcccgtctctcacgaaagcgtaaccgccagatcgcgacggcaggagttcaacagtccctccccgaccgacgcggtgccacgaacgcgacccgcggcggacgcatgcctcgcggagcgcggtgccctaacagcggaggaacgcccagctccgcgcactgcgctacccaatacaacgccgccgccggcgcccccccgccttctcccccctcggcgagacaaaagtccggtgcaaccccgtcgcagagacaagttcaaacccccccgacaaaccgacacacataccccgcactcctccaccagctccgcgcgccctaggccacccccgacacccaccccgtgccgccgccccaccacagctgaccacgccccacccacacacctccacg

SEQ ID NO: 16623 - DNA, 151 bp, Homo sapiens
ctacgagtccggcagttaagaacattagaagatggaccacagttttgcagtctttagcaatatggattaacatcatcaaaacatgtttaataagtattaaataggaacaagagtctggtaaataaaaattgatgttttaaaaaaaaaaaaa

SEQ ID NO: 16624 - DNA, 1038 bp, Homo sapiens
  misc_feature (1)...(1038): n = A,T,C or G
cctgaatatatacttatcctgttgactcaaaaaattccagctgaacacagtaaaacantcgtgtcatctatgtttactgtgatattaacaaccaacacagactctcaggcagtgataatcaaacaacactcaacgacggtcctcagttcacaaaagtagacacaggctctaggcatgtcgttcgcattatagcctaggatctgacacctcgctcgccactcactatcgctcgccagcacgccctccaacactactcaacatctaacgcttattatctcgcctttccatcatcttctttttntacactccttacttaaaagcgagatccataaatcataaatgtggtcaatactactaatcccctgaatgacgcgccaaagccgacgcatatatataaagtctaaccacacgtcttggtacaggtgtacatcagcgacatgcgtgataaaacataacaagagaacacaacataacgcccgaccgctccgccgcgccaccccagtcattcacgccaagctcaccacagaactgcccctcaccccctcttcgcaatccctctacactctacatcaccgtttacccacaagaactcccgcaccatccacaccacagtcttcaacactatccggcacatccaaacatcatgctctcgcgcccctatgaggaggaacgacagcccagagcgactactccaagcaagcattacagcgctactacattatccgtctcctcacctttctctactacgacccgttctctgataatagctgagcccaattcactccacactgaacgtgtctcactacccatgtgtcacccaacctgtagcacgcgaaacgacggtgcttcagaggtcattcacgccgaccttctagtacccccctgacgctctccaccaagaccgctcttttctatatctttcaaacgactcatattttatacttatncatctataactaacaaacaagccatctgactatacaactccccgacgaacacnacaatctaccctctcccatctctatgtanccactctct

SEQ ID NO: 16625 - DNA, 873 bp, Homo sapiens
  misc_feature (1)...(873): n = A,T,C or G
ggggnggggnaagagagtaggggggnnnnanttctgtttattgacagactcattcacatagctaagggaatagaagaaatgatttttgttaccctacatttaccacagtgaatgttttgagatagactgaggaaattttgaattactggaagccatacgcgaacctaacttatagcccgcaacaaaatgaccaggagacctcctctggtgcttgcttccgcacctactcctgactcgactgccgattgccctccccctacgttatgaacatgtgtcctctttatcttattttgtacaataggactcatatctcatctacccgtctccatctccacccctcccactccggtgacgtctctccctcctccgcgcatccgacctgctcgcatccctttcgccttcggatctctctccatccacccgactccccgcacgtccaaacacagcagcagtacaggcgcgccacgccccacgccgcccccctctctccgcctcccccctttcccactcaaacactctaacccacccacaccacctcccctccctacctcgccctcgcgcccccacgccctcgcctccagccccacctccgacgcccacctttccctcgtccccgttcctctccccggtgctttctctatgatcgcctcccccatgccccccgccccccgccccccccctcgccacccccccggccctaccggtgagtacacggcccacccgcccacctcgcccaatcttctctcccccccacacgcaccacgccctctgccctctagcgtccccgctactattgactatcgtccacgcacctgattccgctctctttagagcaaatactccgtctagtctgaaccgccccccgtgacgtcg

SEQ ID NO: 16626 - DNA, 846 bp, Homo sapiens
agcattatctttccccccatgtacaactgtgtgtcccagcattacaatacatcgtgtggacaaagaagctttctgtgcacagagaaattaaacattccagctgggttttctcaccaagtcctgacacacagtggtccttggcatctcatttgtgggcgagcgctgaaaatggcggacagatcacctgaagcaaatctcagcctgttgtttaggctgccttgggcagcccacataagaccaacatttacaacatttatgacctgtagaacgcatcctctagacctgagcccacactttttggcccacgctcacttgccagagttagttccatggtacctctcttccccctccttttgctgagtaccttctaatccaccgaatattctctaaaagccacgtaagtttgagtgtcgtcctccactctttctctccccctcccttccagcgcgaacaatcagcacatcttcttcgtccctcttccactactcgacccatcctcaccctcctcccaacgctgccccacgtttgtcccccctctccacttcctccccccccctccctcccccctgttcctctctccctcgtcctcgcctcgtcctcctgctatctctctttcctcttccctacaacccccttggcttcccaccacgatctcgctctccacctactgcatccgacccacccccgctcctctctcttctgtcccccaccccgtccccactcctcccgtacttcacattccttctccccacattctccatcctcccatctcgctcaatcccctctcctctccccctctataagccttatctatctatcacccccccccacacgccccaccatccc

SEQ ID NO: 16627 - DNA, 898 bp, Homo sapiens
gtactcaggctggcatgcagtggtgttttatggatagcggttaactgcagtctcaacttctcaaccttgtgatttcaagcaatcctgccacctcagcctcccaagtagccggaaccacaggtttttaacaccacacccagctaatttttaaaaaaatattttgtagagaccgggtctcaccctgtagaccaaactgatcttatactacatggtctctcctcctgatgccgcatttctgtaatgacaggtataagtccctgaacctgggtgttttattactctaaagggcttttataaattgatttggtctgtaattttaaggatataaaatttgttgttgtacgccatttgtttcacatctgaccataatgaatatagttattgggacatgtaatatagtatttctcacttacactcatcaacaccgaaaaatcaatacagcggcatatcacgctaacctgtttctgtgtgtctcgatagcacgtcccgcaccgtgatcgtcactgccggtgtccgacagcccctatcgccttgccatactcttatcgttacacatgctacacaaagcttgccctgccagctcccaatgcttatcttcctacttgggccaccgcggagtgttatattggcgtatcgctattttccagtggctcactattccatagtcctcccccttacgtctcgcttcttactcgttttacagggcccagttacggatcgaaatccgtcgttttatgacaactctgtccaatcagccacacaccgacgactccctccgccgcgccgagccgcgccgcaccctacatccacctcgttatctactcgattgtcatccgccctcctcgcctcccagtatgttcgcgcactcactcatagcacggtgggtgcatggtgtcat

SEQ ID NO: 16628 - DNA, 1344 bp, Homo sapiens
  misc_feature (1)...(1344): n = A,T,C or G
aaaaggaaaaaaaaatanntntgaaanataagagatagaaatatattgtagtgagagagaagaggaagaanacccttanaggcgtaacgaccccgcacagagncgtgtgatctgagnanagagngtngngacactctncgtcgctnaacacgttcgtggcgagatacaaggacgaacacacatacacttcttctttcgtgtcngtcacggnaaagagataccctccgaacttcacacgcganacacacacgcngccgacaccnagcgataggatggggcgacaacgccacgatcttcgcacagcacccctctctacnacgcagagtatacgcanagattctatgcgaggggatgtaactactacgggtctgatctgactcttgccactgtgcgccgagtgtaccttgcagcgccgtagccacctcacntgcgcatctagcatccaaccaactcgtcttttcttcctcagttaaaggagatccgctaggcccgcgagtaacatnntttatggtggaagtacatgtagttcatacggtcgcagagtgctctatcctccgtacactgacaagcgcgcccgntactcagttagagcctgtagctcgggctgttcctgcccctctcgtctgggttgtgttgtgaggagtattgtatggattattgcagtttgatatgattccgctcccctacagcagcgtccagcactagcatagagcacctcatcgacacccgcacaatcacacatacaacgaacaagaccctaagcctctctcactccgcgctcggagccactcacctagcccgaccgtcaacccatacacctcgcccagtcgtccgcctacgcactcactctctccgctctccgtgagtacaccaggctcgtaccctgtcgctcgctccgctgcgccccatgtacacattcagtccgcacacgcttcgtctaccgtccctgggtgtatgacctcatacgtcacgacgcatatcttattcctacccgcatgagtgntgacgctaacgtacgagacgccgaagaacgaggcgcatcagtaccagcacactgtctactctaggcgccgcagcacgctccgcgcactactagtacattctcatcactccacgcaccacatataacgacctatagtcatctacgctgtacactatttcgccagttgtacgtccgcgtgnagcgtcagtacgagtatcaatgttacgacatatcactcaacactggatactgactctcactcgtgcagtaccgtgcgcacaatccggcgcttgattccaccgacacatcacacacacgcagatccacaacgcctctcgccgcatgccagactacgtcgatat

SEQ ID NO: 16629 - DNA, 927 bp, Homo sapiens
  misc_feature (1)...(927): n = A,T,C or G
ttttaattagaanatnnnttagnngttaatgttggttattttatttctngtacttcaggggttgcgctgcacctcccttctcagtctccctaagtgctgagatgttgcagggagtcggggatcccttacagagagatcggttggagccgtggcataggaacataaattttgaagattgcattttaatatggacactcatccgttaacaaataatacattatataaatttctatgctcagtcgtttgctttaatttattaatctctgctacccgcgactattctatcggacgctcctctcctaaaggatcaccgtcgataattgttgtaaaatgataagaaccgactgcgcagaattagcgcctcgtattatatgaaattaattctatttgttattatttcccataattactgctgtgtaaggaatatagacattacatcattattgcaattctactttgcaagcgccacacaaacacaaatctaaccccctcctctcccacgcaccaccctactcggctgggcgttcggagacaggttgcatatctcatcattatcaatatcagacatactcccacacgcatcttattcttcttcctgtatcttctgtaaatattatatctcatcattatcatgtacgctacctacaaaatccaccgtcaagtgcacacaaattctgaaatgtgtctacaactatccatcattgtcctccctccgctctcgctccctatatattacatctagttatgatagctgtacagagcacctcactaacctcgatgccgccgccccccccagatcccgccacccctttcatatatacatattacatcacccgatcaccccttcacgatcgctcaattacactaatctcaaaacgcacaccatctagcgtccactactacagttccgtgttctcttatacttct

SEQ ID NO: 16630 - DNA, 948 bp, Homo sapiens
ctcagtgcgttacaggcatgaagcaacctagctggacgacctcaaagaaatgattctaaatcaagcatgaagaatttgccaaggagcgattgcctgttgagggaggttttgaaagttctttactggatatatgaataaatgacgttaattgcactggcaaaagatggttattataaatctactgcgtcgctgtgccctgacgtatcgctcggccacgggcaaccccaacaaacacattctctttaacagcgcccccgggaccacacactggatattgtgttttgtgtttgaccataatgaacttcgagggagaccggcaccccgtgcgacctaccgtacgctcaaattattgcgcattacatcctaatgactacatagaacttatcttgtctattctcaattttcttcgattttctcgttgtctggccctcttcccatccccggccacgtatgcctcctccacagcatcgcccaacacccccccccacccacccccccccctccccgcgcgccccccaccagggtcacccacaacctctcccaccgtcaatacagccatgcacccatacacctcctcccccccccgccccggagctcccaccccccaccgcccccacattctctcttccccgtcctttccaccccataaacatctcccacacgtcccgccactccaccctctgcgatcctcatgcccgcagcccgtccaatcagaacaacctctcaccgctaactcgagtcaatagatatatatagcctcgctagtcttgcaatcccatcctataacttacactcctgtctcacgctcgtctccaccacgccgtcaattcacgacccccacaaacttacctcgccccattgtcttcaagccttttacggccacgttcttccccaccatgcccaacaacccatctacacaagtccacacaaagcctaatcaataaagat

SEQ ID NO: 16631 - DNA, 401 bp, Homo sapiens
cttcagagcacgagtcttaccctcttatccggctggactgcagtggcgtgatcaccgctcactgcagcctctattcctgagctcaagccctcctccctaaagtccttctttaaaataagcagcttctccgcttagctggagctgcaaggaaagaaacttaaaaacaaacaaaccacgctgctcctttgctgacccttaacgactcatcacatagggataacaagaatagcctgctcctggtggagcacccgctgaataaataatttgactaccgggggttgaaaatcgcaggtgcgacaccaagacacatctccgtcctgaggctgaccacagcggctccacctcccgatggccacatcgatcccacctgttccgatggcgccgtggtccctactctggct

SEQ ID NO: 16632 - DNA, 919 bp, Homo sapiens
  misc_feature (1)...(919): n = A,T,C or G
gtccaggtcccggctatggaaggatggttacattctcacctgttgttctacaatgaaacagatgaagattatactttaaaaacataggagacatcgctaacttcccacatagccctaccattcactactgcccaagaccagtaacaaagcaggcaaccgcagactaatataacatctagcactaaccgtgaagaaaaagatctttgtcccttctgtactctgaataaacaaattaggtctgaccttatgaaaaaagaagaaaggagtcatnagtaagcgtaaagaatagtttttatgataatacgtaaatagaagcgagatgaccccactcccaggcgccctagaggagatagttacgaagatgcgcgaaggcntctcatcggggggacgcggtgggcgggggggacgtgctgcgtacgtccgacggaccacggacaagagaccgcgagccatgacaccgcgacgtccccatctcctccctccccccgtcggcgtaccccttcacctgccccccatgcccccgccccgccgcccaccacccccaacgccccccgccagcggcaccgcgagcacccagttagcccccccaccagccccgccggatgcgtcgtcgcccctcgcgaactccgcgggtgcgcccgcgggtgccccatcgcgcacacagcgcccacgcgctgtccccacgccccagccagcgacaccagacaccgcgccccctccacacgtacgcccaccagcaaccgcccgcacgatctccaactgagagcaatagacgacatccacccacgacgcgcattccgccatggcaccattgctcacttcgcccgcccatcggcagcacgccaccgtcccgagcgacacgcgcatacacccgtccgcacctcctccgtcgcgcagcccactgcgcctgactaccgct

SEQ ID NO: 16633 - DNA, 860 bp, Homo sapiens
cagggcctgctttccgactaggcgtggtggcttatgcctgtaatccaagcattttgggaggccaaggaatgaggatggcttgagatcaggtgttcgagaccagcctggccaacatggttgcagactccgaggctgaaacccctttctgacgggtagctctagagtaaacaaacgcctggactttcttcatcccctgaagacaaagaacttgttcatgagcctctccaggcagctcgtggtctgagctgtcaggaatgacggatgagcagctgcttttgccggcgcctccgcggcagctaaggtagcgctcacaggactgtctacaccatggactcaccgctcaggtgctcagggagttattattggagcagctcactgtatcttaaggcagacagccccgggcaaattgcactcgctcctcacaggggacaccttacgaaccctcaccccctgtcacctcctacactatctcgttctccgacgtgaaaccgtacgttgcatcttgttcttataatataaatgactgtcgacgcatacgcactgattcgttacctagctcgctttaaccgtgtatcccgcgctcctctccctgcctcgccctgcacagcgcgctagccacactcgctaactctatgcgttgctatcctcgatacggctatctcctaccctcacacaccccgtccagattacctctctcatcgacctctgtctctcttcaccctcctcccgagcccgtccgttcattctctgcattccgtgtacctcacccatccctctctacactcaccccctttcacagcctcgtcctcacctaccgttatacgccatcacacacctcccaccctcacctcaacacactt

SEQ ID NO: 16634 - DNA, 942 bp, Homo sapiens
  misc_feature (1)...(942): n = A,T,C or G
aaaaaaattaaaanaaaaaaaaatttaattattagtaattaataaagttccaggctgaanaatgtcaacattgggagttttgaaggattccgggctgtgtctctgaagcaagagggatatgaccaaccctatgagactgaccacctatcgatggaggaagaggaccccatgccaatacagcattttacggcacttatgtgtgatcgaatcaactttttagcccaatccttattattaaacttatatgtcacggaagtcctttccctcaccgccgccggtctttgagacctgtcatggaagacaatcaaaggtaacgaacatgaaacttccgaagagaccattaatgggtcgtggtctttgtgatcttttttttctctattcctttcccaggtccactttatgcctctttcttgtttctttttctttctcatatacccgctacaaccgcccacctgttctccactttcctccccgccgccccctacccaccaactcatactcgtccttccgcaaattccacaccctccgtcgctccccccgcccttgttctccttctccccttccattcttactcgtcgctctctcttcttcccttactcttctccagtctctccccatctcccaccttatatccttaccctctcctttccccacattattcatcntgacccgacaattacttatctatctttctcccttagttttcccgccactcaactcctcctttatgtatctctctttcaccattactcttaccctctattcataccttatttgccccctccttctcctacccaaacaccaccgacgcccccttcgctctataccccacacatatagactctccactccagtccataccgacttgtcgctattacatcatctacttccttcaccacaccccttcaccctatctcatcccgtaccctacattcttattat

SEQ ID NO: 16635 - DNA, 721 bp, Homo sapiens
  misc_feature (1)...(721): n = A,T,C or G
tccctatgtgctaagatgtatgccgatgtcttgtaccccgaacagaaagatccgctacagccggatggaggaacataatcgagaaaggtcattttactatggacctcacctttccatagtgtactacaataacctttatgcctgtctttgctttaatcttttaatactgataactacataagcgactgatgtacctgacctcagaaccactgggataatagtgacaactgcacatatagactgccaaacatgctggttcgaacaatataactattacgctccttgtaaaaacacaattctatcattgttatgggacaagggaatccaactataaggtctgactgcctgcggggacgggcaaagggagccatatatttcttcttgcaaacagcctataaatagacctgcccgcaggacacataccgctcctcccttcccctcccatggcctatcaacatcaaccccctgagaaaggaatgcattcctggggccaggccttcccatactccctatgcgactgcttcttctcctaaacacgatcctcactgtcgtacaccactgacacccgaccacaacactcgcctcactagggctgctaacaacatacacaaccaacaacacccgcaccctcncctcctcatcctccctgcccgactctcccccgacaccccttaccctcccagcgcacccagcccccaaaccccatcaccccttcccccat

SEQ ID NO: 16636 - DNA, 241 bp, Homo sapiens
tctggggtgaccaaatgccaaggctttgagacaggacctgagcagtgtgtgcctggaaactacagagctgatgtggtgtgaatgggagaccactaggagccagatcatagaggaagaaggggacagatcacgcaagagtatgtatgataacaggaaggaggtttggtgtttcatttcatcgttaaagaaagtggaaggtggtgacggggcggagagaagaagcaacaacgaaaaaaaaact

SEQ ID NO: 16637 - DNA, 1097 bp, Homo sapiens
  misc_feature (1)...(1097): n = A,T,C or G
atatagaaataaanannntanagntagaangtgagtgaggaaagagagataannagagaaaatgaaggaagagatattttgagattanaacccaaaaanagataaatntctttattaaataatagaaccaggagagtgggcggagaggggtaagatgatggngatgaaggattttagtgaaagagatgatggaagaagggaatgggggtggaaccaagtggaaggagtagcggaacgagcaaggggagagaggaagagtgaattaagaaagatgatatatacggtaaagaaaaagaagaagaaaggaagaagagaaaaaagaaaataagaaaaagagaggggggagggagaggaagtgagtgagaatttgtagaggagaagaatatacagaaaaaagaaggaagagtgggtgtgtccagccgagaagaaaagtacaaagaaattctatgtagccgcgctagntacgcagcatagaccagcgaacgggcgaactaggtacgaggagaaacacaaaacccgcaggcttcacatgcccaccgcgcaccgacaagcacaagacaacagaaacgagaggagacaagaaacaccgaagggcgtccacacgccccaggcggcgggacgggagagagagcaggcgacgcggtcgcgagagcgtcggacagacggcggatacagagcgcggacgcaccggcgcgcgggcgcggcgggcgccacggacgcgaccgtaagcgagccagcggagcgagagacgcgccgaccgccgatctcagcgccggcggcgagaccacgagacgtcagcgggcgcacgagcagagagaaactccccccccgcccagcggagacagcggcgaccgaggacgacgcaggcgcacgctcacagcgagagacacgcgcgcccacgcggctcgcgcgacgcacgccgcgccgcggcgccacgagcgtagcgccgtaggggagaagcgcaacgatgaatgagaaaggcgaggcgaaaagcaagaaacgggctatgatgcacagcgaaggactagagtgagacagacgccgcagcgaagaccgggtagctagccccacgccagcacgcacgccgaacaccgcag

SEQ ID NO: 16638 - DNA, 894 bp, Homo sapiens
  misc_feature (1)...(894): n = A,T,C or G
cctggatgaacggagaggacttgcttctcctngaatccatagatctgtaagatgtagagagcttaaatttcttttnatactatgctagaccatgtgaccaaaaatgtatacactttgctatggttgggtggagaaaatgatgaggattaggtagtcttgttatttttattttgatgtttgttattattacataataggcagaggagtggagtggatgtctgtgggccggaggggatattgatggtggtgtagtgtggcgttcgcgccgccaacatcttgtgtttgtataggtatccggtattattacccttcctcgcttcccgggtatagcgctctacctccgctgccgagcttcgatcaatattgctatccggtgttgttgtatgactgcctcccctccgcacacctgcagctcccgccccgccacccccggccgcgcccctcccccggcgcccccacgcgtagccccgtacccgcgactctctcctgagcctgcctgcccacccgccggacaggaatcctgcgagccggttgcgcgcgccggccttggtcctgtctcgatcgtccgcgggcctcggagccgttgtgcgcgacatgtacggctgtgtcgcactgttctagctctcgcactgcaggcttcgcctcgttacgtcttccatgtctgtcatacccaccgctccgccggcgcccgcgacgcgtccgcctacgctctccctcgcttgcgcggtcggtcctcgttacttggctgccgtctcgtttggtgnccgcccggcgctcgctccgccgcccctccccacgctccgtccccaccggctcgccgtctcctcgctgtcctccctctccgctctctcctgcctcactctactcacaccatctagcacgctcaccgctgag

SEQ ID NO: 16639 - DNA, 877 bp, Homo sapiens
  misc_feature (1)...(877): n = A,T,C or G
aagagttaggtannnnnnnananataggnnnnnttttctaaatatcactaagttccaattgaagagcggattcttttgcaatttaggcatgtgccggcgataacgggcgagttggaatgaacagagggagagatggactattcctgcgcagaacatgccaatcgtgactctcatcagactcaacacgcgcaccggttccttgatcagcccacaatcgaagagccttagcgttccccctcctctccattgcctgcgtcgctccccgctatctctaccgctccccgacccatcctttagctttttttttccgaattttaaatctgagaaatcgcccgtaacaccgcccctctttattctctaaccccccccacccactcatgttcgtaacgacccagattccctgtgtcactccgaccccccgccgtgccgaaagtggccacaacgccgcctgctcccatttttccattcccctatctctctccttccccgcccccttcgctcccgttccgtcctcccccccgcgccaccccccccccatatcctccccgttccctcccctcccactccctcagtacccagttggcttcctctctccgtgtccccgctttcctctatcccagcagcctgctcccccatgtctatcttacttctctcctccgatcctttctcccccctcgtgtcctctgtttccgcctccctcctctctccccttcatctcccatttccgctaccctctgtctcatccctaccgncctccccaccccacctccctctccacccccccgtgcccctcgcgccccacccggccccttcgtcccaccccgtgctgtacgggacaatatagataccgctcggcgaccgcccccacccactcccg

SEQ ID NO: 16640 - DNA, 842 bp, Homo sapiens
ctggatggcacgcatgaactcagcttggccccgtggtcctcagcccagcccacggtagaagcagtgaattagttataactacagtatagtctgatcattctcctgatgaaattacactgatttaatttgtatgatgtgaaaacataaaattaatggttggaatatgagcagtagacttatgttgttggatctcaatgtacttataagaagtgttattaataattgaaataaatttattattcaaaatatccaaatacaacccgcacttatcagtaatataatagaataaggtgtgtttttgtcatcagcgagcacaataacacacagtcgtaagggtagtcacaccgactacgaggccgtccaccggagcaaggtagataacccgggcgaagcgcaatgcgggaagccccaccccccccctctacttacatccccctagacctacttcatgaaccacccggcgaatagtagatcttctcccccccccccacgtatacgacagcggcaggaagcggtcgcgcgagtgagagggcgtcgcagctcccgctcaatataccctatatctctcccacccacctccccactccctcgctctgctgtgctcgcgaagattgtgccgaaaccgcaggctatattgacaatcgtatttcattcttctctttacgtacgtctccttgactgactaactcttcacgtcactcggtacacactccaacccatctatccacatgcacatagactcaacacgtctccagtttatggcaacaaacgaccctacctttcgccgcccggactctcctcaccctctcttaatactctgtattgcggaaagagaaacgcaa

SEQ ID NO: 16641 - DNA, 771 bp, Homo sapiens
agatatgctcctcactcaaggggaaggcttcccacctggctgcactccacccacaccagaccagcggcactccacccacaccagaccagcggcactccacccacaccaggccaactgcactccacccagtcttcaacctaacagctttcgcttccctgctagcccatggaatgactcaaacatctaattgcatcctccctcaggaatgagggggcacccctgctcctgttatgacaaaacctatctccaacagcctctttgagtcccctgtgtggccctgaagagcatgaagtgtcctcccccaggtgatgagggtgactaataaactgttgtccatctcatctgtccagttttgggcatcacatagtcagccacctcatcctatttagggcagaagaattcccctttgccagtagggggaatagaagatagtcagaacagtagttcctagcatttaaattttacaagcacatttttgttaaaaaaaatatacaatttactacacagaagatagaagagacatgttaaccaatatatttaggacttaatctcagaataaataacagttcttcaagttgaatacttaacttaagtaactaaatttattttaatggaagactcactgccctgtctttattttttcattgtgctgtacattgatgaaagcttaagaactgattggcacagtctgtggacagatgtgtgagaaacactgactcctgtgtctagagtctttcactatggttggaaataaaactgattttcctttgt

SEQ ID NO: 16642 - DNA, 761 bp, Homo sapiens
agcatagaatatgcccagagctatgaggtcctgcccaccacagacaaatgctgctataatctgtttgctgatttgcgagaatccgactctgtcgcccaggctggagtgcagtggcatgatcttggctcgtgcaaacttcgtctcctgggctcaagcaattctcctgcctcagcctctgagtagcagcgactatgggcgtgccccaccattccctgctactttttgtatttttagtagagacggggttttgccatgttgcccaggctggtctcgaactcctgaactcaagtgatccacccgccttgccctcccaaagtgctgggattataggcataagcctttggacctggactgttctgaatgtttcttctatacatgcaaaatattctcctgacaccactgttataactacatcacatcttctgagagatagaggctggtatctgctggtataatgtaaagggacaaagacccctcaacctccaaaaaaggcaaaaaccacgtctctcacgaacaggagctcagacctgtgatctatgtaactcacaatccattcttgcatactaccactccttctgcaaagaactgtgatgaccccataaattttctggtcttccactgagcacccccagtttcttactattttcccatttgcactatattctaaagtccttctaaccctgctaaaactgattaattaacatccccctttacagaaggggggcccagagctaagcacaatttgaacggggcccagtaag

SEQ ID NO: 16643 - DNA, 788 bp, Homo sapiens
  misc_feature (1)...(788): n = A,T,C or G
catggttgtggtgcaaatggatatgtcagctacaaagatgtcaaagaaaatgcaactatcgtcattcatggaattgtatctccccttgaaggatacacatattctattttgctaatcaccatcaaagaaactgaaacaactgaatgcttgactctgatatctcagcatcctttacagcaatagtgcaagggggtgagggagggaggcagtgaagtcccatgaaaaaaaccaatttccatagagtattcaatttgccaaaacgatggctcagagaaagctaaataagttgattactgtatctggtatggacttatggagtgtttcttgattttggaatgccttgcctagatttgaaaatgagctcggagattctagccccagaaggaaaataggtagggaccttccttcccattagctcagtggccaaagtcactggccctgggaggccactgttctgctcagcacaggcatagccagtgaaccctcctgaattcagcattccaggccattactaccaatccatcacaattggcatgcaaattgaaataaattttcccgcccagagtgagaccaactcgcccacttcatagtgtagaaagccctttttacctccactctataaattcttaaaataccgctgctgccaataatctgggagtgtctttctaggtcagctgtggctttgggcagcaacatcctaccttgctggttgtcactgattgtagccacttcccacaatcatcatgtanaagccaaaacaccaattggaaagaaataaggaaatggag

SEQ ID NO: 16644 - DNA, 237 bp, Homo sapiens
ctgttcctacgtttgctttggacttgctcagtccaaatacctgacctcatctggcaactcccagatgatcctctgtccaagagtggagtaataatttggacagcagcagaaccaagaatgatgaccaagtcttctaatgcttatttggcgctatcataatgattatccatttctcttttaatacaaaagcaagtattcatggaaaataaaatgtatttggaggtaaaaaaaaaaaaa

SEQ ID NO: 16645 - DNA, 762 bp, Homo sapiens
ctggaaccttgggcggtgtctcttgactcaccatgtgtgacaagaataccaactttcccccatctctgagcttctaacgttttttatgcctcccccgacttcaaaagtgttaagagttcccatggggatggtgaaatgggccattcctgaatggtataataaatctcaccgaacttcaggcatgcctgtcatcagccaagtcctctggtggggctgctggcatttgaaactgaggcttctcacaatgtatttcatttcttcggctactcagttcaaacttcagttatttcagtgttcactcttgtgttaattagctttgagggagagtcacaaataaaaacatcagaaagctttttgccgtctcctgaacaggactgaatgacagggaaggatgaagagtgtaggctaaaatgtaaagaagacccagttcctggctcaaaacaacagacctctattatctcatagttctggaggacggaagcccaagatcaaggtgtcaacaggactgttctctctcctgaggctctaggggagggtctgttcccagcctcttctgacttcttgtaactgcaggcattcctgggcttgaggatgcatggctcccttctctgactacatctccccatggccttatactcttctcactgtgataactctcctccatgcagctcacgcacctgacgatgaattcacgatccacctgcataatacaagataaactcactgtgacatccttatcttaacttcatctttaaagacccc

SEQ ID NO: 16646 - DNA, 931 bp, Homo sapiens
  misc_feature (1)...(931): n = A,T,C or G
catgatcattccgatgaatggagtgttctctggctaggaaggcgtggtgggcctaancccacccaccagctctttttccatcacttctccaagtcccctactgaaaacatcccaagacgcttgaaacaggtggcgtctaaacctggagtccatggcctcaagcaagttttcccaccgtcgagagtcccaaacactgaactcggactcactggcactcaagaagatccgtccccgcctcggaactcccataaccctgaacgtggactactgggcactcaaggagatacctacccgcgctatggccctccgcaagacctgtatcgtggtcgttagtggtcctgatggcaaattcctcctccgccacagtgactcccgcccacaacaactcgaaatatatggagccaaatacctaaccctctaccactaaacgttagcaaagcctggggcgcgctactatctgtcgcgccacacaacaacacataacatctcatctcaatactaacccatctctttcgtctccctgttccctcgtattatcaacattcatgcgtttagtcagccagtaagaggttgtagcagtttcgtcttctataattctttcttagatgtactgagaggagggacagaaaggtgagatattgttgtgtcagtttccttagttggttctgattagcagcatcgacaccgtgtggctcccggatattagtgtggtatttaggatagaataattgttgataacagttacgatgagagaagaagtgaaagagagacataatagtgtttcgtacttgagtgtcgtgctgtcgatttgtttattaaacacttatattgtcgtctagtaattcatatacataatatctattggtagtatagatacttatactgttcttactgttattttatatgcagttgtgagtcaaattattagcag

SEQ ID NO: 16647 - DNA, 794 bp, Homo sapiens
ctggaactgaggcaaattctcagctttcaaaggtaaagaagaatattgaactaaaaatatccttaacaagtttcaatacagaagcagtcaatatacttcagaatatttagaatatgcgactgaaaggagaccatacaatcccttatcaacttacaaataatccctcatcaacttacaaataagtaaactgatgttcagaagatattaagcaaatgagcaaggttatactcctagaaaatgatgagttggaaagaaaatgttctctttgatatctgtggggattttcctgctatgtaccaaaactgaatcaagaatttgttcattatatgcatatttttgtaataatctgagagctaggcaaaatgtatagaatgtatttctaaacaattgttggaagggcacccttgaaatgcaaaatttctaattgtttagggagttttgaatttaagtgatctatcttctactaagttgtctataaatgcatcactattaatctccatcaaataacatgtaagtgatatcattaaaacctgttaattgctagagcttagtaaggcttgtttgctaatcaaaatggtttaataaagcttcacactatggcttttagaaaaaaaaccactaagaaatatgaatgtgtgataaacttccatatctacaccatctgcctatctccttcaccatatgtgactctattaattgctatttcatccttactatgcatcatctgatctgggagaatggtgcccaaaactaagaaggcctgagcaactcagaaaacccctgctatatgcatt

SEQ ID NO: 16648 - DNA, 676 bp, Homo sapiens
atggaagaggaaaagagcacaaagtacagataccatggagaccatgatgaggcagaagcaagagatcacagtgatgcttctatgagccaagaaaatctaagaacttccagccatcaccagaagctaaaagagaagcctgaaacaaattctgcctcagagcctccaggaggaatcatcccgggagacatcttgatatcagatttccagcctccaaaactgtgaggcaacaaataatctgtcattttaagccaccagtttgtagtcacttgttccagcagccctaggaagctatcacacagtcagcctccattttttgatgtttgaccacacacaggtttgaaccctcacgtctccgttttcctcctactctgtacctgggaaagttgataaccatgttgaggtgctccctcctttggtgtcagtgggaatttcaaactacctatgggaacactcactccttccccatcactgacctcagtaaaaaccccaggccaacaactttgtctgttctctcaaaccatttttgaacctactaaggagccaccctgttctcgcaagaaagccttgttatatgagcaataaacctttctatattgccaaaaaaaaaataaatcgtgactattgcgggaaacagattgcgaaagcacatcctctcggccttcgttggcctcaacgc

SEQ ID NO: 16649 - DNA, 788 bp, Homo sapiens
  misc_feature (1)...(788): n = A,T,C or G
ctgcntggaatctgcccagagctgttaggtcctgtccaccacagacatatgctgccataatctgtttgctgatttgcaagaatctgactctgtcgcccaggctggagtgcagtggcatgatcttggctcgtgcaaacttcgtctcctgggttcatgcaattctcctgcctcagcctctgagtagctgcgactatgggcgtgccccaccattccctgctactttttgtatttttagtagagacggggttttgccatgttgcccaggctggtctcgaactcctgaactcaagtgatccacccgccttgccctcccaaagtgctgggattataggcataagccattgcacctggactgttctgaatgtttcttctatacatgcaaaatattctcctgacaccactgttataactacatcacatcttctgagagatagaggctggtatctgctggtataatgtaaaaggacaaagacccctcaacctccaaaaaaggcaaaaaccacgttttctcacgaacaggagttcagacctgtgatctatgtaactcacaatccaatcttgcatactacccactcttgctgcaaagaactgagatgacctcataaatcttgtgttctacaactgagcacccccaggtcttactattggccatattacactatattgctaagacctgctaagcctgctgacactggattaatgaccattgccttctacagatggtgtgccccaagctgaaatcaatgttggaacgcgccctaatagactgccttgtaccccctgggcag

SEQ ID NO: 16650 - DNA, 563 bp, Homo sapiens
ctaggtgctgctctccatcctttgatcttgacctctatgcagatggctgatggactacattgatagatccccgtgaccgctagctgtcaattatgtttgacgaaaaggaagcccaggcagaagatgggaaaggaagagagaagaggactcaacttggacataaatgaagatgactctatcctggtattactgagttagctcttggaaaaataggaacataagtagcatgtccaaagtaaatggatgatttattctcctagataacttgatttgacaaaaagaaaaccaggcttccaggcccttttttcctttgtccaataaaaataagcctttgagacagcttctctcccattgacactccattaactgtcaatacagtggagttacacagttataaatatgtataatgtgatatgcacaaggctattctgcatagtgtacctgtgttcccagctgcttgctatttttgttcaagtcaaacatgttttgatgtgcctattttgttgtttttgttagaattctgttatattaatgattaaaagcagcttaaaaaatcaaaaaag

SEQ ID NO: 16651 - DNA, 786 bp, Homo sapiens
  misc_feature (1)...(786): n = A,T,C or G
ggnntgagaaaanaaagaaagtttanatatggcaatgatgttagattaaaagcaaattcaattgattttcttatttgagttcaaagtgggtcattaagcagtgcagacaactcgcaacatcaacaacgtattggcccggtaactgctaatgaacatacagttcagtggtggttcacggaagttttgcaaaggagacgagagccttgaggatggggagccttgtggctggccatcagaagttgacgatgaccatttaagaacaatcatcaaagctgatcctcttacaaccacacgagaagttgctgaagaactcaaggttgactgttctatggttattcgtcatttgaaacaaattggaaaggtgaatgagcttgataagtgggtgcttcatgagctgagaaaaaatttaaaaaattcatcatttgaagtgtcatcttctcttattctacacaacaacaatgaaccatttctggatccgattgcgaggtgtgatgaaaagtggattttatacaacgactgaaaactggcaatgaacagctcagtggctggactgagaataagcttcaaggcacttcctcaagccaaactggcaccaaaaaaaggtcatggtcactgtctagaggtctgctgttgtctcaaccctacagctttatgaatccctgggaaaccattacatttgaagagtatcctnaacaaatccatgggatgcactagaaactgaagtacctgcagtccgagattggctaacgaatagcgccaattttgtcctcacagatgcaagcccat

SEQ ID NO: 16652 - DNA, 856 bp, Homo sapiens
  misc_feature (1)...(856): n = A,T,C or G
cctgtatatagacttcctcacggnacattacttcaatgtaaacaccttgtggcactggtaggttctaaatatcaagcaaatgaaaacagtaatgactgggacagaaggttctttggtttggaatatactacatttcttaaacctaaatatgctgaccactgtctgaccaatgaaaagagtatactctaaagatatatcattttttctcacacaacaatcacctagcctacaactctatattttttttaactaacaccctaacgcccccacacaacacaacccgctttgcgccgcctgttttcatcctctcccaaacccatcgttctatttaaacaatcttgtgtctattaataaaataataaatgtataaagacaaaaccgtattgatgagccgacaatccatatatgaatgtacatttctacattatacaccatcatatcatttatatactttatttattaaccatctactacatccccacctctttcttcatacaactagttttacattactctctcttttgtttaatcccactctaccctcacacaaccccacccgccactcacctcctcctctccatcctccaccaccatccctatttaccctcatgaccacacaatacttaacactgtccttaatccctcatcttacaccctatttatatatatataaataacactagttagataaagaaatataaaattacttaattttactaacctccacacatactcccataattccccatatctgtatacctcaaaatcacacaattctatggtatattttttcagtactccacatatgaaacacctttactctcaccatcatcctcatcataaaccttacataata

SEQ ID NO: 16653 - DNA, 456 bp, Homo sapiens
cctgatggaacttgctgacacccatgctggagtgcaccagcacgatcttggttcactgcaatctccacctcccggattcctgtgattctcctgcctcagcctctcgaatagctgggattacaggcatgcaccaccaccacctggctaatttttgtatttttagtagagacagggattcaccatgttggccaggctggtctcgaactcctgacctcaggtggtccgcaggtcttggcctcccaaagtgctggcattacaggcgtgaaccaccatgcctggtcaattttgataagttttagtaactgaaaatgtataagttttatgtcagaaatcactgtgaactgaaagccagtaaatcaataaagtgaaaattcatatattttaaaacaaaccgcgcttccttctatcttcttcctatccccatcacaaaacaccaacccgtcctcctgctcccct

SEQ ID NO: 16654 - DNA, 711 bp, Homo sapiens
  misc_feature (1)...(711): n = A,T,C or G
atgccctgctcgccttcactgaggctgcccattctggcagaagtggcttcaagactttccttcttcaacaccagtcttgttttcagagccagatgaaaggccacctcttctatgaaccctcctctacctactaagattcctaccggtctcatctccaaagaactgtggaacaagagcagatgctatcaaactaccagccacgtatttatatttaattctcttagtagcctttcaagagaacctttcacaaatgcaaggcagaaattcctttctatctaaaattactctaaaatatctaacaccacttgctgcctctttaatgagattgcaaagcttttagatgttggaaatcctatccttctacgtgtacgggtgcctcaaacacagcagatgattcaggaaaaagatcatgattttgtaccacgtgaatttcctagagacgtttctacctaatagagaacacagtgttcacaattggcgtccaacgaatatttatcacaggaatgtgtttcgctcccatggattgattaatagaggcgttatccttatgaagatgtaggaactgatatgtgatggcgttgattataggttgattttgaagttaggaggagggnttgagagatacatcgattatgatgtgggacaaacatctctcgttatacgtcccgtaccctggttcactcagttcctcagactttcaccgttgtgaag

SEQ ID NO: 16655 - DNA, 394 bp, Homo sapiens
ctgaaaatgtctgcaggcatggaacaggaagaaggactttatgctctttgaagtcagaattgtaaaagcaaagagaaggaagattttggtttttccacatacaacaggtgaacaaatgtgaatcattttacacataaccctggcataataaatcaagattagctatgtggtctaggaaatctgaaacactcaagaaagggaagatctggctatgcagaccctcaccccatggtggctgcatccccccatcatctcaccaccgacacccctgccccccgcccccccactcccccctcccccgccccccccccgccgccgccaactccacattttcatctcttttacgtcaaactccgcaacgccgagcgcctgccgccacctcaccgtcgacacg

SEQ ID NO: 16656 - DNA, 374 bp, Homo sapiens
tctggagcttacaaaggaatgagcatgaggaaagaagattctggtctcacttaaaatggactgcggtacctcctctgcttgaaattcaaagaagccaaggttggaactataaaaggatgaacaaattacagcattcaaaatatattttaaaataagagtggaacaaagctgcagcttttgggtgccgatcaaatagaagctaaggcattcatagacaagtgttatttgttttttcaaacaaacgagattaaaagagaaaaccaaataatggagagaacccagcacagagccaggggccctacatccttcttacggagagattatacttaagtattttatcatttgggtaaataaaatattttaaaatatcaaaa

SEQ ID NO: 16657 - DNA, 854 bp, Homo sapiens
agagaaacgagaggagaagaaaaagagaagaaaaaagaggacgccggaggcaaacacacctactaaaatcctttccttcgaggattcactgcagacccgcccgtatggattcaccactgctaacaagccctcagaaggaatcaaacctcttgactccttgattttgtacttctgacctccagaactgagtggaaatcttgctcagaaaaacaagacacaaaaattgacacacaacctatggctggcgaggaaaaccgactccctggcaaagtgttaccaggaaacccatttctctgcaaaaggacccaactctatctgacaggtgaagaagaaggatgcaccccgcgacacgacggaccgcagtgcacactgttgccccccacccacgcccaccacaaacacccacctcctccctctctgttaatatctctctcccctctcccaccatgccctctctctttctttctactccccacaaccccacctcgcacaccaccacccaccacacaccaaccgcgagcatattacatacaacatatcatacacccaatagaataagctaccacacaaagacccacccgcaccaccaccccaatcaccccccacacccaccccatccaaaagaaaacactcatccacactcccaccgcccacagtaaccatactcaccgcctttcccattcctaactccacgtacaccgcccaatgctaccgagcagtacacgaagatcattacaccgataaaacaaaccaggcccagaacacctacaactatacacacattccactatttcccaagcgtgcccccaccactccgatactaacatatataccttagacccccacaaatccag

SEQ ID NO: 16658 - DNA, 757 bp, Homo sapiens
tgataaggggagagatgtagaaagcaatgagatacacatgtcttgactgcttctcttcatgctgaaatcctgggggaaagaagtgctaaatcagttgaggacatgggaacatttattctggaagaaatttgggtacagagacagacaagcaccaagagaagatgatgtgaagaagcacagcgagaacaccatgtgaaaatggaggactggaatgaagcatctacgagccaggaaatgtctgaggctaccagaagccaggagagaggcctggaacagatcctgcactacaaccttcaaagagagcatggtcctgctgacatgttgattttggacttctggcctccagagctgtgagaataaatttcagttgttttaaaaaaaaataaaatatttatattctcaggctaagtcggagtattaaggtaataaatgacgagtgtaatggggtgataggattaataggattttagagcgtggtgtctcgttgccctagccactgagcctttctggcgtccgcctgtgagggggtaaaccctcttgttctcctccaagtggctcatggggctttgagatttatattttttaggtggaatatagtatgataagagaaatgagattgaggtaatgaagaatgaagttagcttgtttttagtgggaacctttgggtataggcgtaagaacggtcccgttcctagacagattatggttccacgttctccatatatccaaatataacgattcatcgtccgtttatgag

SEQ ID NO: 16659 - DNA, 963 bp, Homo sapiens
  misc_feature (1)...(963): n = A,T,C or G
ggggaaggggaggngaaaaaataaaaagaaaagttaagggtagacggactggtgaggttgagaacgcctccagtgagcatgcgcacaactgccgcaaacacgccacgcacaggccactcccaagcatagagtgggcccccacacatgcaaacagcgccatcccacgggcaagaatcagtgggagacgggactgcccgaccctgccaagtatgctcaacactgtaaaacctcccagcataaacctctcaattgtcgctcgtcgatgcgctgcaggttcccctcttcgccgcctcttacaagtagtacttgtgtttcttcttacattttttgctcctatgctctcccactcctgcccatactgccagtgggccagcacccccccgccaccgcgagtcgcccgcgcccctaaggccggacccccctggcagaccaactccactattcttcacaggtctcatccagcccctcgttactcgagtccactcgcaccacttcccgcgaccgtactcggcgtcccgtgccgctttcatgccttttacactacatgacggtacataatttttctgtgaccaagtatgtttacagcccgaccatcgttctacgtgataggaattcagatgccgtcagtgcncaagccgtatcatcacccagataaggtatatactgcaagacgaaccgtcccaccccctagcactcctcgggctctcgacaatatgtgcctacctgacttaattgagtcaatatactacttggcaccaggatgcaagagtaactatnactcccgcgactgctgagctccaggccaccacactgcaagataagagatgagtccatagaagatncacatacccgacgcgcngctctacctcttgtcctctcctcgccaatctactcacgcccgcaggtccnccaccgtctccaagactacgaattagtgagctactcctcagcacatgataatag

SEQ ID NO: 16660 - DNA, 778 bp, Homo sapiens
gctggaaggacaccacatttgttcttaggaaggagtgtgccttccacagaggctgcggctctaaacatgcaggtgccctcagaacactggtgaagcaagcgggagacccctctgcaggagatgtgaagcctctgtcttccaacagcgctcgtgtcctcggtctcttgcctcggcacctgggtggcttgccacccacaccccaccccacggctgggggagctgagcggatagccccccatttgaaaatacaagatactctcaggtgaagaaaacacagactttcgggtcacaacaacatcaggaaagaagaactccccgatctcgccacaccttgggcctccccggacggccgcccatccgcagagctgccggaccctagaccttcccacagggatgtattttcattcccaccaggtagagccaaaatgactcatgaattacccccgacactatgcccctccctagaccctcgccatctgaaatatcaccatgagggacctttacccccgccgccatcttcacacctaccctggtctccttgcattgccccacgagacgcacccaccacaaaacacgccgcccgcgccgcaggctcgcccctttcgcgcctcacatctacccttacaaaccaccatctcctaccatgaaggctagattgcccatcaacacatattgccactgtttacatcttcaccccgccgcccccctccttcgagacctacctctaccccaacgcacccacaccacctatataacatcgacctcctactccatcaat

SEQ ID NO: 16661 - DNA, 862 bp, Homo sapiens
catcatgaaggcaaagagggagaagtaccagctgcctcggcagactgatcctctgagatgctctggagccgcgcagctgttctcattggcacatcagtcctgcccctccaactcaaagagagggtgaccctggtgtgagatgtcctcttatgccgcgcgatataaggtttggactcgtcgggattagacaggtgaaggtgagatacttcgtataatatcgacactccaacaccacccacttttttccccacgccactacacctcacccgccaccacgcgcccgcacccccagccccgacgccccgctcctcccacccggtaagtcacaaaacgcacctacagacgcgcgcgtgtcggcagcgcagcggaccgcgacgctgtcctcaggttagaaacacgacccagaccgtccacaggcggatatacattgttatttgtttttgagatttaccgttgccggtcaccagccatggaggtgtgcaccgcgttctcctttacaattgtgtcgttagtgccctccttggtttactgcccacgcgtcatcagccgctcccgaccgactcacctactcagtcttctcttgaccgcgatcttgtgcttgattgactgacacatctgcagcctctagctccctccccattctaccacccctcgtccctcgaatcactaccgcagatcatcctctccgataggtatgagctctaagtgcttcgtcgtgttctataatacgacagtgtgttgctcgtgtcgctagtaattccttcgccaccgcgactaactctactccgttatcttaatatattccacgtagcatcaatctcaaagacaacaattgaccgctttcacacgcccgtaccccgcc

SEQ ID NO: 16662 - DNA, 774 bp, Homo sapiens
tggacatcacaactattcctaagtaagaagccaccgtcttcctgcctcgagagtcagagaatggagtttgaagctaccaaagcagctaaaaagtgaagaagggagtgaagggaaatccaagaaactggatcacagagaaatgccccataaactgaatctgaagatcaaaagcgcacatcacataccagagaaaactgacacaaattcatctatacaaagatatataatgattaagttattgaactttacggcatctaggcagaaaaattaagttacctatcattcctatcatcatttctctctatcatgtaatgtcataatctgtacataaactccactgaaatctttaactgaccctggaccacacataaagcagggaaactccaaggacaaattaacagtaatagtaatatagcttgaatgtttgaccccttcaaatctcacggagatattatccctaatgctggaggtggggcctaccgggaggagactgcgcttgggtcatgggggtacgcccccacagcacccactccatccaacctacccctcatcaggccaatggtatcttcgagctgccgaagcattaatacggattcacgcagtcaagaactatggtgctgtcgacattgatgacttttcttgcccaaacataaactttcactcgcccgctacacactccccaagtgtatgccccaccacagtcttataacccatcccgacgcacccccgcgccaccatgggccacgaactatcgccgcgccccccacgggggcg

SEQ ID NO: 16663 - DNA, 403 bp, Homo sapiens
ctggttagcactccatatagctcaagtccatgactgccacccctttgaagatccacatctggaggtggatatttgacgggctgaccaagagaagatgaacttgcatgggggctcgtacgactacatgatagagtggaccactggcgcaactttgggacacagtgtcactccgccaataccgacttgaagacccttagaatgactcaaaggcgtcaattactgtcaatagtttcctgcctatgtgtgtatgctttagaattgagagcactgtaactctcccaagaatgcaccgggtgatgtttattatcaccaacttccagggcttacatgtgattgacatgagagaatattaacgcaaataaactttaccagcactaattggcactcgggctggatggcctca

SEQ ID NO: 16664 - DNA, 420 bp, Homo sapiens
atggatatttcttaataaacccagatgagggaatggagaaccctgtacttaggagcagcgatgccatcagtttccaagaagtatcagaggaatgcaagctgaaatgaagttctattttgaagtagctgaagttgaagctttgggaccatttacagagatgatgttgctcctcacttcttcgacagaatttcagagattctgaaatctcttcttgcaccagctagaccatcaaagggtgccatgactggatcacatattataaatactcccttcccacaaaaataccttttattagattgtaccatggcaagatagcatttcccaatatttagaaactccttactctgtgaaaaatgttttcaatttttctttcttccaaaataaaaatgtataaaaatttgtttcctaaaaaaaaaaaaa

SEQ ID NO: 16665 - DNA, 771 bp, Homo sapiens
  misc_feature (1)...(771): n = A,T,C or G
cctgacagctctcctggatgaaatgagcaggtgtgaagattaaaaaaagaagaggagttcagttttggacatgttaaatttgagaggcttatgagccaccaatctgaagatgttgagaaggcaatgatggatacagaagtatggagttcagggaagaggtcagatcacaaatactttatctacaccccaggactttgtatccaaagaccaaggacacttgaaatggttcacagtggcaacagtaagagaccagtggccacactgcactaacctcactgttatggtaacataatctgggcagtattttcttgctgctcatctgcctatggttattgatcattttgtgaatctgggtatacactgtctacatgattatcgcacctacctgtggtaatcacatcaaattccttttatgggcaaagaaacgnaaaaaatggtggtatttttaaccatcgacctttatatgatagatgaggaattnaggtagttgnagtaggttatatgtgattgcgtgtcntgatcgggggacttacgtcaaattatggagaattttcggcagaagttatgtcagtgtatccttattgtaaagatgtagaaatagtatgagaatgaatggaagggtaccgcgnaaatttttttgctaaaataattcactcccttcgtcgttttggttctatgcgtcggtttagtccattacccagggtcatatcgttcgcgagtacactgacctgttggtnaaaaggcgtagcgacgtgatagtatactagttta

SEQ ID NO: 16666 - DNA, 809 bp, Homo sapiens
atgttttggcgtttctactgacatattctgaagcatccagatgatttcctccaccgtgtgcagagtactaatgagaccatcaaagctgtttgttatttctgttacagtatttttgattgtagcagttcctttttgctcctttttagactatccattcttttttagaatatccgtatcctctgcttacgcccatctactctgtctcttgcatgctcgcctactttcccacctccgctgctttctgcccttcgtctgtgaataatgccttgttattaactttacatgctattggttgtgtggctcgctggtgagggggaaaagcacactgcgaggccgccgcgcgaggtagccgcgccgtgcgcccagggcatggggcggcacgtcgtggggaccgagctgagcgaagtaccgcggccccggacttgatcctatacgcggagcgatcgtgtgtgttgtagattggggggtgctaggtggtggccttcagatggcagctagtgttaaggtgcacgtagcacgagaaagttgagatagtcggggcttgagttgcccagcaataggtggtgaggtgagtcagtcagataagggtgagagccccggtgtcggtcgtgagttttgagtaggtattcacgtatctccgttgtcgcgaatttatgtatatggtgcagcccccgcgttcgctgcgcgccctgggcgcgcctaccgctcgctcttgtactcccttactctcaccccgcgccgccgctgtgctgctgcgccctttctccctttctgctcactggttctgcgtaagtccgacgaggtatagt

SEQ ID NO: 16667 - DNA, 1040 bp, Homo sapiens
  misc_feature (1)...(1040): n = A,T,C or G
ataaaaaaaaaaagttgagaantnaganattagtataagaangtttgaaaaagaaaagcgaacaccctaggcaaaacagcctagcaggcgcaaaacttttaaggtaccgcaagcacaattggcaagcaagcacatgatcggcagacatactctgctttcgagcgtgcctgatacacgacacagatggatatatgaaactggacagccggcagacgaagcactcaacaatcttgatccaggtaactctttcgacgcgactcttgcctcatagagaacaattactatgaaatatgaaccaagatatgttagctcaatagtaatctttgtactgttaataaaattaaaacattctcttaattcattatcagcatcctttcacatcataaaccaccacgctcactcctataccttagtcttttatgcatacttcctataccacttttgattcgctctagcacgcgacacaacagcgacgaccccacagaccagcatcaagcgagcgccgcccgacaacagcacccgcctacctcacacccttttcatccactccaagctctcacattttccattatcttcacgtacataatacggcgtatccgtaattacaacatctgtctcgaccaatctctctccttgctccgtccttagtcgtttctacctttattgatatttatagtatatttcctcccgttagtcagtagtttctgcgattgcggtttcatatcctctctagatacagaatcagatcctcccagtgattctgatcgtccgatcactctacaatacaccaccccccgtccgcccctcaacctctctccagtccgacacctatctgtatacgactctgtatacggcaatattaccgaattatgctgtattcccaactccacaacttccccccacctagcccttctctactcattcacacgtacctgttcaccttccctctccctctcgtctattcttctcctcaccccgatccttttatacattattatatctttaaccatgtaacttcaatacccatatccttcctttct

SEQ ID NO: 16668 - DNA, 194 bp, Homo sapiens
atggggaaggagaaagtcaaggacactgacggccaaccagagttctccctttcttcacttttccttaagaaaagatatattgatgaagtttgtctctaaagaatgtttttccgtaaattgtctttgcttgagccttgatctcttcacctatccttgaaataaaggccagaactatctttgtaaaaaaaaaaaaa

SEQ ID NO: 16669 - DNA, 773 bp, Homo sapiens
atggtttctcgaattcttgttccagaggctcagaaacgaaataatcataagaacctagatgtaaagataaccaaatttcatctgatgacatttgcttggagtttaatcagtattgttcagctgagggctcaagatgtgtctcttaaagccccaaattcccactcaacttctcatagccattatgactgatttagctgaataaccttggctaccatgtgttcaggcttgggctcacctgttaaatgactagagactgcatggagcagaggcaagtctgccagccaaggctgtcttagaccagacaacccccagccaacctatcagctgactgcaggtgcgtgagtgaacacagtcaagacatgaagaactgcccatctgagccctgcctaaatcattaacaccaactcattacctaagcactcacgacacaagcccaggatctacctctgctatttcccttggatattgcaattgcactatcccataagactcctggcacctctactctctataaaccctcctccctccgccccccccacatcgcatgcatcccagccatctccccctcctaagccaccttatcccgtcactccccaccccccctccccgcccctccttacaccactcagcggattccgactatctctctcaccattaagaccttaacccacgctacatgtgtcacaaagccgccgccccaccctcgcgatacaccccccgcgcccggacgccgtaaggcaagttttgagacgaagtcatagcacccacgcctg

SEQ ID NO: 16670 - DNA, 281 bp, Homo sapiens
atgggatgaacagggtcacaaaagtcctcggctctcctcgatgggcattctgaagagtcaaaagctgctgagctagccaccttccctcttccaggtctatcattagtgccagtcatggaagtcagcttggatttggggtcagaatttgacttttagtacaacataattgtttcttgccaagagtgtcatttattttagtcttaatcaagcttcataaataaactttcttttaagtcttgcttgaacaaataaacctttagattctttgaaaaaaaaaaaaa

SEQ ID NO: 16671 - DNA, 1199 bp, Homo sapiens
  misc_feature (1)...(1199): n = A,T,C or G
cttgcnatancattagcattntagctgncncnccgaaggatagtcaaganacnaattgatccgatngcggcatccagnaggtgagtatcgngaacattcatcgtagtcagtgcagcagcacngtgcattgngctcgctatanaagcntgcatnatcgaagagatgcatgaaatgacanacgttcgacttatcngaccncacgatgcggtgcactcgcganagtacntgcganngccactgctatcatcaagataattgccgaacngataaaagcactccatacgagcgagcttcntacattcatcgaggtctactctctagaatgcacaagtctactcgcactcntgaacgctcagtctaagtggtgctctcaanaaactatcgataggacatatgcacgcaaacgagctaccatacccttgccgcgcggtanagtaacccacnaagaacggctcaccatgactcatatatgntgatatacntagcgactacgagtaatcctggcgtactcttactttcacacanattcaacttacntagatggctcttatgtaacgaactcntagagacactagtagcgcactaacgtgtagagctacacctcgacggggattcctgtcgtctcttatgtcttcatacaccttatgtaagcagcatagattcttatatagatagacgctccaccagaccgactgtggttcctcctcgagcgagtacctttgtccagacactgaccctcgaccgcctttgtcgaccacatctcaactaattgtctggatccaacatcagtaggcccgcctcttgtcgcctctgctggatagatctncggaaatcagcgatgcccggacaggctgcgcaagcatagcgtcctccaccgttatcaccgcgtgggcgcgcggcgctnatcttattgtctagttagcctgtttgccatatacacagagcaagatggattgcgcggagcgcatatacacatatgaaggcacacattatagtgnaagtattgcgcatactgttcccggattgactcgtcctctcctttttcttacgtcgccctgcgcatcgcgtatgctgcatagaatctcgcccacatccctccacctccaacgatgcccggcacgcattgtaatgacctcgtttgccatcccaaccatcgctatcatccaccactatattgcccatattcctcccacgcgttt

SEQ ID NO: 16672 - DNA, 906 bp, Homo sapiens
  misc_feature (1)...(906): n = A,T,C or G
aacatccatgaagagcaactgactgaagcacttcaacagcctggttcataaacctctctggtaatgcctggaactaaagagaaatcttcaggtgtctccaaagataagcttataagcaaccctgtgctagtagccgaagatgggggtatctgaaaatgagaatgagtagaatcgaaaagtgatggttgtatcgcgcaaaatagtaatcgacgtattacacaaaccagaccagctagtaaagatacttagatgcaaagcaggactatgtatataaaagatgaatgcgcattgggtcgcaggggtatccggcgaatgtagacagtagggtctgagccaatcagggcgggggcgcacccacgcggcaggcgcgggagggcgcccgcgtggcgccccgccgcgcgcggcaaaccctggcgcgagcgcaggacagcgacgacctgccgcgaccccctcctccctctccctccgagttgggtgggagcccatgagcccggtctggttcttcgcggccgctgccgtcgcgacggtgcttatgcacctatatacgtcactcacatcacagtatttcgcgtggccggctgttactggcgacgaggctcacagccctgctagtcccctcgaaccccgccagcgccccgcctatcccgcccgacgtctcctccactcggcgccagcgtagtcggccactcgcttcttctatcatgtcctcccggtctggtttcctataagatcaggtctcgggacgttgttcagcgcagcgcctacgcacactctgcaagccgncacgacgcctgcttcgggccatactgtgacttctgccccatgccctctagcctgatcccaccgatccgcgcgactctgccctccgtccgtcgtgccaggacgagaccccataccctcaccgcg

SEQ ID NO: 16673 - DNA, 213 bp, Homo sapiens
aatgatgtgaccttggcaaatgtggccaaaaaactttgtgggcaaaaatttccccactggcagcaagaggggaggatggcatctggcagatcctgatttacattattccagctccctgacctaaaagataaaacctacccctcctcatttaataaaatcagaaggaaaatgcaaccagagaataaaaaaaagaaaatcacaaaaaaaaaaaaa

SEQ ID NO: 16674 - DNA, 464 bp, Homo sapiens
ctgaagtttctcttgaagaaggaacatttaagctgaaaccctaaggagccacccaagaagacttaagttgagaaggggaaagcaagcaaaatatcagaagactgagaatggggccagaagtaaggcgaagagtgaggcagcagaagactagcagaactttggtgatcaagaagaaatgaaagtcttcccctcctagggacttgatctcctccacagaaggacctttcatggtgtgtaatccctcatgagcccctgttctttctcatctcaatacattgtgtttgcaggactcctctctcacctcctgaatgggacccctcgagggcagtgaaggtttcttatcttcagctgtattccagacacccagcatagggcttgacacatttgtcttttgttgttgttgttgctctcttgttattgtcattttgtataaataaaccaaaggaaaaccaagaaaaaaaaca

SEQ ID NO: 16675 - DNA, 678 bp, Homo sapiens
  misc_feature (1)...(678): n = A,T,C or G
atggtttctataacaccacgagagaacacaccctccagcctgggtcccagaatgaggcaggtgaggcagaacggcagcagaacagccggctacacatctacagcctaaagcagagctgcctgggccaatgctatacctacaactatctgatctttgacaaacctgagaaaaacaagcaatggggaaaggattccctatttaataaatggtgctgggaaaactggctagccatatgtagaaagctgaaactggatcccttccttacaccttatacagaaatcaattcaagatggattaaagatttaaacgttagacctaaaaccataaaaaccctagaagaaaacctaggcattaccattcaggacaggcgtgggcaaggacttcatgtccaaaacaccaaaagcaatggcaacaaaagccaaaattgacaaatgggatctaattaaactaaagagcttctgcacagcaaaagaaactaccatcagagtgaacaggcaacctacaacatgggagaaaattttcgcaacctactcatctgacaaagggctaatatccagaatcaacaatgaactcaaacaaatttacaagaaaaaaacaaacaaccccatcanaaagtgggcaaaggacatgaacagacacttctcaaagaagacatttatgcagccaaaaaaaaaaaaa

SEQ ID NO: 16676 - DNA, 1287 bp, Homo sapiens
  misc_feature (1)...(1287): n = A,T,C or G
agaaaaannaagaanngangnnnaannnaanaaagaaagggagtnntgaaagagannangtggaagaaaagnagaaagagaaaaatcctggagagagggaaacgacngcaagcgcggaccctttcnnaccgggnagaaccccagagaggcaaggnaaggaccggggcacaaagcgagggcacaacccttacaacagcggggagcagaaagggcccgagcgcgcacgggcgcgcagcccaccgacgcggcgacgcgaaagcacgcgagccgacgccggccaccacacgcacgataacacaagaaacacaaccacgccncagaccacacaaggaccagaagcgcaaaanagcgcacgaaggacaaccggcgagaaagggacaggagaagagagngcgcaaagcgagacaaaagcaagaaacnaagacgaaagcaacactctcanagagaacaaagagcagccctnacacccancagcagacataaaacagcgcaacccccgcgccgcccccnccgcacacaccgcagaccacatcacggcacctcaaacgcgcaaacacagcagacgccaccccacacacacaccacaacacgacccgccaactaccacccgacggcaccgccgcgcctgcaccccgacgctcgacccgcgcccccccgcaagcaccgccccgcgacacaacacaccacatccacaccgagagacaacagaaaagccaaccacccacgcgacagagcacgggcacagaccacagaaggaaaccggccacgacagcncaaccanaagaccgcccagcgccgcgggcgaccacacccgacacgacagacgacgcgcgccggagcgagcgccgcaagacgggagcccgaccgacaagaacggccacgccggcacacccgccgcggcaacacgagcgaagacgggagccgacgcgaccacgcgacgcgcgccggcacgcaccgcgcgaccgcgcgcgcacncagacacggactacgcacgctgcagcgtcccgaccgtacgaacagcagcacacgacgcacgataagagcacgagcacagacacacggcggagacacagacgaagaagagcaacggcaccacacgcacgcacaccgagacacgacgagaaagaagacgagaccaggagacacgagacaacaagcgaccagcacnagacggcgaggtcaatcgaagacgngaggaggacacccagctacaacacaacacgagccgccctcgacacccacagtagcgccgacgcaggcaccagacacgacaactagagagcacag

SEQ ID NO: 16677 - DNA, 818 bp, Homo sapiens
  misc_feature (1)...(818): n = A,T,C or G
ttttaaaannnnnnnnttttgttgatttattggtantttgaacagaatgggatttttggtcagtctttattcaacagtaaatgggatgcctctggcaaggtactgagtgtgaattgtcagctggagaaactctgatagccagaatttgaaagcattaactcccaaaatataggagtacatgtacagatttattacatgggaatattgtgtgatgctgaagtttggagtatggatcttatcactcagctagaagatggggaagtcacagaatgacacaaggggatgtgttttcagggcaccagtgacccaaggactagaagaaacagacggaggagcttgaccatgaatttcattatgtggacacagcattataatatggttgttaacctggaatgagcagaaattatacaggcgttgaataatcgctgacaatccacaaagtatcctcatacaggctttagtatcggaaaaggaaatgacacagcttgaaaaagaaaatgcagggaaacatagaaaggttaaaacactaccatacacagcaacctgtgtttttttgcaaacaatgtacttcaacttcagattatgcacccaggcaggacactactctaagtccttaaacatgaagccggctacttgtactccaaatatatctaggagttaaagatccacccatcccatagttggctatgggctgaatgtctaaccgcccggccattcatgcacatatccctacactaaactatagcccaactacgtgccttgaatcatcatgtcattatgtgtctatacaatctggcagaggtcgaggaatgctaaat

SEQ ID NO: 16678 - DNA, 350 bp, Homo sapiens
ctgcccatactgggtggcgatcctttgtcacagggaagtggctgggcagaagcaaggatcaccgagctcttgagcagcaaacccgtgaaagtggcatccggcttccctccctcttccctggtagtgctgagcagccatggagggggaacgcacagtggcaccagtcctggaaagttctcagaggagtctttggaatgattccagatagtcttctctatacttaggaacctggattgaaattttatctccatcattgtgtattcccagcagtttctattttcatgtttactgtgacttgctaaatactgaatgaaaacaataaaatgcaaagcaagtgaaaaaaaaaaaaa

SEQ ID NO: 16679 - DNA, 767 bp, Homo sapiens
ctggtcgaatcgtatggcactatgataaaggagcaaggccaagacagaatgtcctgggggacctgtcaccggacgcatgcaaggaatggaaaagaaacgcattttgcaatgtacataactaaaaattgaatgaataaagtatgaattgaaaattttctctcaagtaatggaaattctctcttttcgaaaatatatgatataataaagcatatacagaaatcagtacattaactttggtggaaaatttcataaaatagaatttatcagaattactgcatgtgtagggcacaaatctgaagcagctccaaaaacagcaagcatgtaagtaacaaaccctgtgtgaaaaacgagatcagccgggcatgggggctcacgcctgtaatcccagcactttgggaggctgaggaggagggaacacctgaagtcaggagttcaagaccaccctggacaacatggtgaaacccgtttctactaaaaatacaaaaattagccggacctagtggggggggcacctatagtcccagcaggagaatcgcttgaaccccagaggcagaggttgcagtgagccaagatcgcaccactgcactccaacctgggtgacaaagcgagactccgtctcgaaacaccaacagcacaaaaaaaaagaaaaaccagtttttcctaaatgtgaaacactccttgaatttttatggtcattaacaaagtataatgctaaaatactcttctaaacgctgcttaaaataaatcaaccatactaggagaaaaat

SEQ ID NO: 16680 - DNA, 399 bp, Homo sapiens
cctgatttcccaagaccttggctcttgtgtcacttttgcagaaaagcatttactgactgttgacttggctaattccctgtgctgtgtttcctagcacgccacacccttgggactgcagccctgtgaagactgaggttctgacgaaagtcaagaaaaatctgcattgcaactcttcgaagagaagaatgtgacatcttgtgtcgttttccagaggcagctgcataaatcacaggagactgaatacaggagaagatgtaagaatccagtcagcttctatcaaaccagacataaaagacatttgcagatatgtaaaacaatgccactcttcacattgcatttttaaaaaatattatttcccagaaaatatatcatctatgttaatatggaaaaaaaaaaaaa

SEQ ID NO: 16681 - DNA, 781 bp, Homo sapiens
catggtgggactctgctcactcagctctgtggcctcccgtgctgtgtgtccctagatgcccacggctgcctccaccctgccacgcctccctgatttcaggatgaggcactggggatccaacagactcctgatgctgcacacgatagaagggacgcccccagggcaggcagctctgtcatgaggcctggccttcctcactcctaggaaggatggagcccctgagcaggaaggaagcagaggggagtggaggggtgccagggagatcagatgcaccgatgggcacccactctccatgtctcctgccttttgcctgtttcctgacagaatgcatctgcacgtcctaggatcactctcccacgtgcgcaggagatcatccacctgcagccctaagcccttgcctgtggtctgctgtggctttgatcacccgtgccattgggtgatcaggacacttcattccacaactgctatggcccagccttgctgcggaacagttcactcagcacagatagtaggtacggcgatgctgttaaagtccaaaaaaaaaaaccgaaagagaccaagaatgtcgctaggaaatgtgacaggaatcagagcctgggaatgaatttgtcaaaacagaggcagccaccattcgctgtctgccctgctagcaggagcttcacgactttgaccaaaaagcccaaacttagttggtctagaaatattgcatcaagaaggaacgcgtgattttcacagaccacccaagtaattgggccctggtgctttcactggtgaggcggct

SEQ ID NO: 16682 - DNA, 650 bp, Homo sapiens
ctgcccgtgagcagccatcattctattctctgctactgcgatttcaacatttttagattccaaatggtcttactctttcaccgagttaccaaggatggtcttgatctcctgacctcgtgatctgcccgcctcagcctcccaaagtcacctttctctttttatatacattttcttctttggttttagtctccttatataaatattcacatatgaaatgttttattattcataaaatatttcattcacagtatataaaaccacatatttaaatactataattcaaataaaataacaatatgactttttgttacgcaaattacatggaagtaattgactttttttttacaagcctcataaataggttgatttatttaaatgtgaagtttgctttattgaaattctatttgcaacatatcttaatatagttaaagtgaatgtatgcatatcattctatacattaaaatgtttatggatttttctacttataattgagtttagcatacatgaaactgtgttaattctttttttaagggcctgagcagtagtaagtatgtattttctttgcttttgattttgaaataatttattgttgccaactgaaaataacatggacccattttcttatgataaataaaatctgtgttaccaaa

SEQ ID NO: 16683 - DNA, 846 bp, Homo sapiens
  misc_feature (1)...(846): n = A,T,C or G
atggaatgagtgtagggaggatnataaattgttaggaataaattgaaaggnaatggttntcctagaaaaaactagatgcagcctgacccaaccaaactgactgctgcaaagggcatgacaacactctttgataactgacggttcaacttagattttcttccgagttaaaccatgtttcaaagttcttttgttctaggaactatgcacatggattgagcatgcttactgccagtaattacacctatcctattcagtcagatcttgaatgtcctgactcttgctcctatgaagttcaccttcctttttaatcatgatgggcacgtggactaagagaaactagtggtcctgattgtcacccttgctgttaagatcctaaagaaaagtagacagggggatgcgggcgatgacctgataggctttgaacttctgatctataagcaaactttgtgacttggcctcgcagagatgctgggattacaagtgctaacaaccagtgccagttatttcgcgtatctatacattgcgtcatcacagatatttcatcaattcaaaagcgagaggttgtctaggtgaaatcacttaacgccagtcggggtccggaaatctattatgtacatgtgatgagaaccaagattctaccgagatccaagggattgatgctttcacgatcacaattttagcgttgcnccagaggttttggctatgggggtggatcttgctcncgtatgtatattatctatgtggtctatcgcnaggggtcatgtgaaatactcgtagttggttaagggaggttggcggttccagggagcgcaggattacgaggccaagactagagctagcgagaga

SEQ ID NO: 16684 - DNA, 765 bp, Homo sapiens
ctgattttctgagaggacaaaggtgattactgtggactcctctaaaggctgcagccataaggaaagaaaaatttctaatctgaagaaatgaaacgaagctacaaatgaaacaaagaaatgaaacaaagttataaatgaaacaaagttacaaagaagtacttagcctcctgagaggaccatccctgcacccttgctgtgctcaggagtcttgagctcttagaggctaaggcatctcattagctaccctaggcagaaaatgtgaagaaggccttagcaggcagctttgccctgggatgccgctctccaccttgtttttcatgtgctggtgctgcttttgcctaactctctgaccaactgcctgaatcaatatgacagagcagccctatcctggttgacattcctggacttggcttttcccctgctggtctcatggcactcacctgatccttcctcccggtaggtttcacacagagcacttctaggtagccgtgctctgggcaatgtgactcactgaccagctgacacacttcaaattccaaagctgtcagggttcactttgactcatcatcctatctacatgtacatgcaggctgatcaatttccagtgacctgcctctggatagtaaagtccctgaggacagtgaccatgtccatgtgtccgctttgtcaccaattgcacactaagaccatagaagactcctagaagaacctggggactaaaagaatataggaagaatcacttaggctcccttttcccttgcatat

SEQ ID NO: 16685 - DNA, 643 bp, Homo sapiens
  misc_feature (1)...(643): n = A,T,C or G
cttggtgaaacttcgtccttgacactcangcaggagtgcgttggtgcaatctcagctcgccacacttctgcctcccaggttcaagtgattctcctgcctcaagctcctgagttgctgggattacaagcgtccgccaccgcgcccggctaatttttgtatttttagtagagacagggtttcaccatgttggtcaggctggtctcgaactcctgacctcaggtgatccatctgcctcaacctcccaaagtgctgggattacaggtgtgagccacagcacccaacccctacaaccctttttataaggcaattgcatcaaagatgtgaccttcccctaacagaggaagtgatattaccaggaagtttgcaaaatgaacattacttcactctctctaccatcgcatacaatggcaacttaatcattattcctgagagttaagtatgagtgcttcaaagaacccatttcgttcaccatctcagttgtctctctcggtgcttttctctaaatgtcacaaagctcataattcaagaacaaggagagtgtgcctaacgatgatgaaacaggaaggaaaagcatggtccatctgtttgacagactatcacactgacactaaaataaaaattactatcgtgttgtatggtttaa

SEQ ID NO: 16686 - DNA, 826 bp, Homo sapiens
  misc_feature (1)...(826): n = A,T,C or G
aagtaagatggtagtggagaatnaataatttataaatagngtgttgagaagnannaagagtcctagtggcatctgtcctggccagttttgctacctgggtgcctggctagactccccttcgggtcaacacctgccagcagctcagagctgagcaaaacaagaagaaatgtgaacaccatgggccttgtggatttacagcacctttattttctttccctgtctatctgggtctgtggcattttgctttcataattattctgggtttttatttttaaaaatctaaatatattcactcttaataggaaaggtttatatgagattatttgattttcacctcagcagtgccctttcagattctttcgccattgctttctttgcgcgttgtattttaatttaattgagtatgtgtaaaaggaaggtgaagcttgaaacactgggtgtcagagagacagagagaattattgcgacctgtctcaaccgtatttgctctgttccttttgtgaatgccctcataaataccaaagacaatcttggttgcaatgttgtgtaaaataaaatgccatagaaattattgttgtgaaatgaacagaagtgggaaggctgatcttagggggattaatgtcattaacaggtgttcgatgggaggttataggggttaggtatgaaggtcacccgttgtaccagagagtnaaaggtgtcattaaggggcctatagaagcactttttgggtatggtgctcggcgacattgagcggcatcgtatgtcgcgagctcatagtgaggnccgggtttcccggctttggtggaaggctaaggtccaacgcggg

SEQ ID NO: 16687 - DNA, 781 bp, Homo sapiens
  misc_feature (1)...(781): n = A,T,C or G
ctggaaaatctccatgcctgcattcatgagggacagaaagaacgaacagccatgggcagggggagagatggggtcttgctatgttgtcaggctgggttcaaactcctggcctcaatcactcctgcagctttggcctcccaaactgctgggactacaggcgtgagccactgtgcccacccgaagaagcaccgtggggactctcactgtaaagaacgacagaccattatcaacactcctcccctctgttccccaaagtcccctcctgaccgcagtatcaatcttgcacgccggccgcacggatgtggtgcctgtggcagacttaaatgagagcatgatggtgggacactccattactggatgagtgtccttataggaagaggaagagaccagagctcactctacccaccactggaggatacagtgagaaggaggatgactgcaagccatagagccctcacccagacagaatctgctggtatctggatgccggattttgtcgcctccaggactgtgacaaatagatgtgagttggtgaacctctcatgatggctgtaatgggaacttcaatcacttggaactaagacctggtcctcgatgacctagaaggngcatcgtcgcggccgctaccctgcagagaggggtaatatgtgacccagcttcctgactcgctaccctctgactttcggctgcggctaccagattcggctgccatcaaggcggcatgcctgttttcccatgaattagggggatacgcaggaattacctggggccctaagggccc

SEQ ID NO: 16688 - DNA, 504 bp, Homo sapiens
ctggtattaccgcagatgctgtttgtgtccctcccacgttcccttcctctacttcactggggagtcacatgcccccagctcccatcacttgcatttctgtgcctgagggctttctctgaccactggagcctgctttgcctaaagtgcagagcagaaataagtcagctattttctcagagatgctgaaacaggcttagcagaaaactagaggagggtccgggaacaaagggtgaactccaggcctctccatctaccaccactgccttatctatacccacactttgacaagaaacagaagaaaagccagaagaggatcagaagtcagaaagcgcgtaatgcacagccgctgagtgagtgcaaagcggaccagtccatccgtggaaacaaacagactgtcaacccatacttactattaaacataatctaaatgtaagcacatgcttttgagttagcaacattgagcgatgaccagcctaactgtgtaactaaaaggataataaattt

SEQ ID NO: 16689 - DNA, 667 bp, Homo sapiens
atggatgccacttgggcaactgttttttgattttggcctctgactctcggatcttctccaccctccttcgttgcagcaaccttcagctacagacccttggcaaggcagcctctggagggatcggcttctaaggtcttgaatgtggacctctctggctggaactgtctccctgctcctttcatccccttcataagtgcggaactgacagggctgtgctgggaaccatggcaatggacttgagaacgagagagacaaggcaagattttcccccagccctgggactgttcttcagaaacttcagagcaggcgagaatgtaagagaggctccaaggaagaggcgcccagagtctttctgtcattgtcaattctggctgcatgaagatctgcctgccctgtgtctgaaggtggaagtgggcaaagggggtgctcaactcccaagagagacatctgttttgcaaatactaaacccatttttctcgggaccagagccaagattccagccaactcaaccatccagatttgcaacagcagaagaaaaacagagaaagcactttctacttcccacactttctcctccttctgtggtagctatctcctgtttgcagaattaccgtactatttttatgcttgaattacctccttaataaaccataagtgcctggtgaaa

SEQ ID NO: 16690 - DNA, 787 bp, Homo sapiens
ctggaacacaagtcttgaagctcatatctgatttgcttccaactctgacactttcctgatgatgtgcaaactttggacaagttacttaacctcttttgagcctcagtctcctgaaaatggacatatcaccacctactcactgtaaagatgaaataagagaatataaattagcagcattattcacaataaccaaaaggaagaagcaacccaagtatccatggatagatgaatgaataaacaaaacatgatatatacatacaacggactattattcagccttaaaaaagaagggaaccctaacatgctacaacacggatgaaccttgaagacattgtgttaagtgaaatatgccagtcaaaagaggacaaatactatgattccacttatttgaggtacttacagtggtcaaattcataaagacagaaagtagaatggtggttgctaggggttaaaaggagggagttgccatttaatgggtatagagtttcagtgtggaatgatgaaaaagttctggagattggtcatggtgatggttgtacaactgcatgaatgtatttaatgccacagaactgtatacttaaaaatggttaaaatggtaaaatttacattatgtatatgttaccacaatttgaaaagacggaagaaggaatgaactgtgatttgaacatgaataaatgattttggggacactcaatgacctacataactattcagggaaacacggaagtggactggaggcactacttctagtttctaattgaatcttacaactagaaactagaccata

SEQ ID NO: 16691 - DNA, 768 bp, Homo sapiens
aggactatgtagacctgcctttgccccccttcactggaacatggcagattcaaccatctgagaaaagtccaggaatgggctcactctcctcaagattagcactgatgtcatcttgccctgaagtctggtcattctcccaggggttttataaatctctacggtctgtccgagaaattcatcaaagactagtctggccacagctgctcctggacagggacttcccagggagttccatgaaggttcttgtcaatacagacagacacacctggagaagtctatagagttcctcctcttccacaagatgaaaatccctgtgcaggaattatacacctgcctactgagaggatggtcctttctgacttaccacacctgcctgccatgatatgagaagtcatggggttttaaatccattgtctgtgatacggaaagcagctcagagggcaacatgccacaggctggaggggcacagtcttgggtattattgtcttctaggcctctggagactatttagtgatatctgatcggggctacaggcctgacctctgtcaggaaacaggggctgttaaacctcttggaatacaccctcagtgaataatagataacccatggccacgtttcataactgtaacaagtggacaataagttcacttatttgtaagttggcccaagtcctcccttccgcagattcataggggaaactgcttgtggatttcttccctcaataaggaggatcaagtagacattctctagatcaagagctatccttaa

SEQ ID NO: 16692 - DNA, 237 bp, Homo sapiens
tgctcaccttccagcgcagaggaggcctcgtgacccagttctacccaaacagacccaaacagaagcacctgacaagaaagtggttatgtttctagagctgcatcagctatttataaccatgatggcaagtcccagagaactggtcttgccatcactgagcagttgaaccaataccagcatcaccaactttcctgtatatgagaaaaataaactctatttcttttaaaaaaaaaaaaa

SEQ ID NO: 16693 - DNA, 802 bp, Homo sapiens
atggcctggcctctttctcttaaatttgacttatacgagatggctttgcagacataatgattactacatgcatatggacggcgaacgcgactatgagttcaaacaagataacaaaccatatggatgagtgtgagctcttactgaaaatctggagaactacttacctgctatcagtgaattatttacggaacattctcaaaaaggtaatgtacattgacctgtaagctgagctgagatttttttagagaatgaaagctaaagcaacattattaactatattgcagcttaatagcgtacgagttgttaaaacatttaatattatataggatattgcttattgtgcttatgatggccaaattagtagtatgtactaaaaacgtgcttattcttgcggaaagaaccctgactaggattaaatcggtcgttattcactgcagcctgactcctactgaggtgtgatccagacaaacatacatcatgggactttaatagctctatttttttcttcagtgaacattgctatcttaaactgaactgtgatttgtactgtgataccatgattatcttcggttcccttttcctgtgaacctgtgggactttggaacacttcttagagtacttgttaactgcttaacatcttaggataacatctgttatgctacaggcgatgattccttttaccttccaccttacaatccttttccttggaagaaatcttcgcatctccttctaatctctaaaagtgacgcttttgtgtttatatttcctttctggcagacgtggattttctgatcctggataa

SEQ ID NO: 16694 - DNA, 783 bp, Homo sapiens
gcttggaagaactacataaaatacaactacatatttgtttgaaggcaagagtgagctgctgaggcagccagaaattgaggtgccaaaccctcagatgtgaagttcgttgagatcatgcctcttctcatagactggaatatggaagtggaggagagccatctgcaaacatgcagataaggcaacacgctcaagatgggagagcaaccaaatgagcaagcttccatcttcagtactgtcaaataattctaccagccttggactcccttctaggagatgaataaggcaaactttgatcctgtttaagtcaagcaagccaatatgtttggaggccttattcttataacaagcaagcctgcatcctaagtactgtatcgtattcttgtccacaccattttttcactggactggtcactccacgtgccagggttctttactactaatcaggttcttgatttgaaagtgcccaaagtttgtgttttagagttgccgttaaccatatttaaacaagattttcttcattccaatgcacctactgaaatctcttttatatgttgggagtaatctttgttgttctagatctaccgggagagtagcttgcagatataaaagttccctgaatgtacaaatggtgattctttaggaagtatttgcctgtgcaatctctttaaaacttaatcactcagcttatgctttgtgctccagatcacactccaaaaaccaaaccataccggacacaacattcaaacatctctcaacacccctgccatttagcttttcttaaaa

SEQ ID NO: 16695 - DNA, 771 bp, Homo sapiens
  misc_feature (1)...(771): n = A,T,C or G
atggtgagaaactctgatgaaacacaacagcccatattgtcgatgaaataattcttcaatcataggtgagtgtgacctgcagaagacactgatactacttgtcatgaactcccagttgaggactcagagaaattaaagagaagacctaatggtagctgtaggagctacaatcttgctactgacccatctccacaggataaaggcaaatcagtgacactgagcatacacggtttacaactatagttcccaattctgaaatctacaaactaaatggataccagtaactttagtaaaacaaacaaaaagtaggctgttaactacctggaacacaactacttataaacataaccgctcctctgcagttacatgcaggttgaatgcgttactcagtcctttagtggggaaaacacacctctggacttcactatgcttttgcagcaatatgataagatagttatttaatagctatatttccctattatataactatataaagaaaattctaggtaatgtgccaagtatttttcagtagtgagtaaagttttcatttatacctttgtatcatcataattcatttatatagtggtctcctaagcaaatctaaccacttcataatgtaacacaatgtaacacatanatctaacacacacacacaaatgcataagggaaaaaatctattttatcccttataacaggagtaaatagagaaagaaatgttatttaaaaacatttttttaaattaaggtttaaaaactccctcattttcagaag

SEQ ID NO: 16696 - DNA, 360 bp, Homo sapiens
tggctatcctatctggaaatactgagttccaggtagacagggacctaatgtgtcttgttgaccactgtaccccaaggactggcatatggaggaaatgctggaatatgctgctggtaatgggaaatggtctctggtttgcagatggataatcaagttgaaagaaggaaagaaaacctctgcatcaggacacagagcaagatctctgattctcccggggtgctgtttaatccgtggtcagaatgcttatatgtcttcctttaacaattacttaaaaccagtcaagatcattcttggcacttttttggttgctttttccagctttgaaataaagtgcaatttgcattccttaaaaatctaaaa

SEQ ID NO: 16697 - DNA, 1109 bp, Homo sapiens
  misc_feature (1)...(1109): n = A,T,C or G
tgctatatgaaaaccagacctaccgtaaagggccggaaagggcgttctgggtgaactgaacgacgacgcttcggcaggccncaccatcctcccgagtgtgagcccaattcagtagatccctaaactcatggcgaatttccgacaccatagctacccaatcacgtggtgtctcagtgctacgacaaccgcagaacataactccgcccgacgcacgaaagtgatactcacccgcaggtaatggaacctaggggccatataccaatgtaagcaccgcggagcggctcggaggcagacaagggagaaaacagaccatgtattttttgtccgcgcgcgttcaatacctgcgtgctaacgccccatcactcgttactttactatcctatctttaaatatgcactacctcccgtttatttaccccgcataatacacaacaacaaaaacgtgatcctcacgttttctccggttcatcctcgccacattactcgagttttgcgcagctccgccgaccgaactatagactgcaattgcgtaggcacccgcacaagaatagaatatcaggcgcattatcagttcccacggctgatgcgctgagtgacgtaccgacaccatctattatacccggagtagctatgtgtgaacggcgtctcaattgcgaactgctggtcgagagacgcaacttcgtgggagcgagtaggaatccggctgcgcctttagagggcgcgacgagacggttccaagctagaagacaggcactattacttaaggaaccattatccccctcgcaccctacgcgattacaatatcaaatattcatatcccacgagtatacacgactgaacaccatagaatctggtcagattcaccggagaaggacgcgtgcgtgcgccacacatcagttacacccttacacccctacatcgttctaggactgtctgtcctccactcttacgatagatagagcacccgggccggcggggcgcatccagcgtactctacacgcacccgtcaagtagaggagcgaacttgaggcacgtgtttctctcaacctcccatgggcgcacgaccgggctttcgatccagacagtcatatacacacacgtgtcccgaca

SEQ ID NO: 16698 - DNA, 1613 bp, Homo sapiens
  misc_feature (1)...(1613): n = A,T,C or G
cgctgtatggtctatatgccgaattctgtacataagacgtgtcgtaaaaaaggacagccctccgtggggaggacacanaaaagcaggcccggcctcncgacgacataaaataacatatacgcgactcagttctacactcgtgtatccgtcccacaacaaatgctgttcgcacattatcgtttgtaaaaattattttcccccaccgacgagttgcacgtcctgtctgtgacattcgcgttcgccggacatatcggctatacatccaccgccacatcgaatcntattagttcaatgtacacatagacgactaacatatacagttgctggccgctctgtnagatccaatataccagaatatagagaatggccatcgaganacagcatggtcgcaataagggatcgaccactgcacctgcntccataagcgttatagtgcgcagctgctctaatctactcatatcatacacagtcgcaatcctaataacatggggcggtggcgcgggctcgagcgtacncacatctggatgtgntggtctagngataatacgtgngatggtcacacatntggtgcgtccacaacaccgcacacgtgtntntattattatccaccacgcactgtcacactcgcgacaccaatccatacacgagcgcaccntcgacaccncgatgtgatcaccgagcattgtacctccattgctcgcatctatcgacagtgtgtctgtttcancgctagtgcgcgacaaacggtgaacctgtgtgatagtggccgaaanantcgactagcgcgcgagaccgaccagacaatatctgttctgctagctcctcgttattgtgagtgactcatacacaacacgtgactatattctatcatatgcatggcgtctcatctattataatcacggtggtgcatattccagtgtnacacaccagttgtacacttcacaacaatatgacgctccnactcatcagataattactgctgcgaggctggtgtccggtcgtgatcaactcacctaataacacacccacacgccacaatcccgcgcagaccattcttgtctcgtgcatgttgataccagacgcacgatatacgtgcgcgcatanttatctcgcgcacgagtacaccacagccnactagatgcacgcattcttcactcttctgtgcgtcgcgacgtgtcctactctcatgactcactgantccgctcatacactctgtatatagttactcgatacatcaatatcaaccacggtccgtctatgaatcagtgcgatcgtgtctgcgcccagctncctcgactgtcgctcgttggactacccacacctctagtgagtctctctctctcgtatatgtagatcagtggtacatgttgatcacgtcgantntacgcatgctcggacacgtcacacagtaccgacgcgacgcantcgacctctctggtgtactgtgagtctcacgtacttgtactaaccgntcagtacctatatcgtacctatactctcgccatgctatatactaactaatactaaccatgtgtatggtgctattatatagggcgcacattaacaagtgtcgcggagaagcgtgtacgcgagagatattcgccaccacaat

SEQ ID NO: 16699 - DNA, 788 bp, Homo sapiens
cgaatgagagtcgtggaagagctgggtggtcggtaaatagaatctaggtggaagcatcaaggtgctgggtatgagtagacaattagctagagtaaaaaaggcaaagtaggcgaatacaagtaaatgtgaaattcagcaagtgcatttgactctcagttgtgcagttaatctcagtgggtttatacattctgggataagcaatcctcccacatcagccccccaagtatttgagatcacaggcaggcaagtaatcatacctggctcctctttcctttaatagggcatttagagtctatttatttgttatataggccatttttaaggatatagttgttactatactttttattacttccttagtagagaatctcagaaatgggactcggaattcaaaaaaagacaagaatcctatgattcttgaaacatactataccaaactgcattccaaaatggtgctattaatacatcaccagtaaggtatgaaagaaggctgttctaaaaacagcgagggcgcaaagcaattaacattcacacgtatatctgaatatataaaataaaaatcatggcttatttaccatttctgtagaatataatggtaaagtctgttgccattcaaaagcctttttaaaacaccaggctgcctgccaaaagcataggacccagagtggccatcccagtaccaatttcactgaatccatactcataataagtatcatgcttttaaattttttggcaaacataaaaaggaataaagaaagatgcggccagcttttctctttacattaaaa

SEQ ID NO: 16700 - DNA, 249 bp, Homo sapiens
attttttatattttttttttggggcctgagggcggcgaaaccacaaggaggggccgagaagggaggccgggagcaaagaaagaccgggacaggcggggaacggagcgcgaaggcagagaagcagaacgaaagcagcgagcgacaaggagagacacagagaacggccccgagcggggacccgccgcacccgccgcgcaaaaacgcagcccaagggcgggtcccaaaacccaacagagaggagcaagcaga

SEQ ID NO: 16701 - DNA, 1396 bp, Homo sapiens
  misc_feature (1)...(1396): n = A,T,C or G
aggcgatacaggcgacaacaagccacactcagcggctccaagagaaacagaaaaggaggacctcatgtgcgnggggaacgcgcgtggggatgagtgagtttattcgcngagctggacaacccgcggcgtcgcgcgaacacgggcacatggcgagaacgcatggctcgacgctccctaacgtgttacatgcagcagtacgaaggtgcaaacanagccatagagctgagggcccgcagagagcgagcacagcaaggcagtagaatagtcataacagatcgcgaccagaggtgcgatctactacacacagcggcgctccgcagaggccacacgccgaacgccagacaagagagaagccacacgagtgcgccgagcaagagccagccagagccggcgagacagtctcacagcaagagaccgcagtatgcatatgtatgcgacgaagcgggtgacgcagatgcccgcggacgcgggcgcgcagcaaccaacgcgctccccgtcccgacacgaagatccgtacgaggacggggtacggcggctggagtaacgataagattataggagctgatatcggaggttagagccgctgcgcctacaagcccgcagtcggcccgaaccgagagcgacaggtgagacatgcacagtacaacaactcccaccgagcccttcnacacgaaaagcgcgtccgacgaggccccagaaggaagaagaaaagcacggaccccacgcacgacacacggacgcgcgatcaggacaaggccgcgcacagacactgtcaccgcgatacgccccggctacggcacgtgcgcggcgcgtgttatcagagcgatgcgagcaccgacgatacccacagacacggaagagcgcgcgcacacgtatatacgncgacctacacaacagtcgcctgaccacaaccagcacgagacacgcgtcgctccacgaagggatcggagtgagactgtctccgagagcgcagacgtacgcgcgagngcccgctctcgacgactgccgncgcaatcaaccgcaatacagcgagagaaagacgcccagcgcgaggaggaagccaacgccggacaccagggagcaggtagtgcaagaatatgtatcaaggcaatagtaataagacaacgcactgacgcgccgcagtcatcgcagttgtttcctacatagtatgccagtggcgaggtccacctcacctagcccacacacactctcgcagctcacacctacggcgaacgtactggtgncgacgaaatgagaaacgatcaagactggtacagcagatgacgcgtcaccactcacgcaccgccgccgatgaacgcgcgcactgactcggtgaccgcgcgtattactgatgcgcgagcagtagagatntgagtggcncgacgctcacacacag

SEQ ID NO: 16702 - DNA, 940 bp, Homo sapiens
  misc_feature (1)...(940): n = A,T,C or G
ctttgaccacgattttttcctacgccgaaacatcccctttcagccgccgcattgctcccctgttcgctccggtggaatttacatcgtgtcccttgatctaataaaccacttttctcaattaaaacccgtgtgttgcgaattctaacagaagttccttattctcgttaaaaatttccaaatattggttccgtctggatgcaaatttctggtatttcaaaccacaattaactcaggctttttcttccagtcctgccaatgacaccatggatccttagtccatggtaaaatagattatgtttggctttgttttgacaagcctccgcaccattactcccatcccaattttcgggtgcaggaaacttaacattaccaagtaatatcctcttagatcatcttccttttcgttgaggccagaaggcccttattacaaacgtgccagaaattttgacggcctcttctttttccagtatttaaccaagcagccattccttttgcagtttatttttctcattgtgtatgtaaatatcgcatttctctccagcacgatttatctattgataatgccctctagggcacaactagtcatcagtaactgaatgcatcttaatcattatggctgcttctgttttttcattaacaaaggttattcatatgttagcatatagtttttttgcaccccctatctatgtctgaatcatttgtcacaagagagtgtgtgctgatgagattgtaagtttgtgtgtttaaacttttttttgagcgagggaagaaaaagctgtatgcatttcattgctgtctacaggtttctttcagattatgttcatgggttcgtgtgtatacaatatgcagaatgatctgaagtaactgtgctgtatttacgtttatccccgagtctttgataaaataagaaagttgtcggccgaagnncccttctctcccc

SEQ ID NO: 16703 - DNA, 754 bp, Homo sapiens
ctcctgtgtgcgtcacctacactagcggctgactcgttaccgcgaagcgttcgatcgattgatttaagtaccctgtatctcaggcttggtgtaggagttctccttatacctgcacaaccctgatgagattgcaggttactcttcagccgagcatcaaccttgtcagtataggtgcatgatccggctctcaattttgccgcacccatatggctcaaatgcagccaatgtctcccagctaagccatacgtagattcatgatgcacacaaactgtaaaatgataagtgtttgctgttttaagctgctaattttgggtaaaatttgttatatgcaatagatcactagtagaaggattaaatgagataattcacgtaaagaacttagcatgcacccaaacaatggtaactgttaattgaactgctaatagtatggaccacacttgcctttcccttttctcaattttcataaatagattaatctataataatcctacagctataatttgatactttatgttactaaagaaactagtatatacatatatttacatatacatatgtgcttatatgtgtatatatggttgcatatatatctatatttttatgtgcatcatatatgtatgtgtgtatgtggtgtgtgtgtgtgtatgtgtgtaagtctttgagttcaaggctctttggctttatcttaagcactgtgttagcttatacaaaatgtaatttattgtataatgaataaataccgatgctggccagg

SEQ ID NO: 16704 - DNA, 771 bp, Homo sapiens
  misc_feature (1)...(771): n = A,T,C or G
aacatccaagacttggtagcatctccttctccccaaaacccagctggaactcggctaatcctaaacgaaaactcaagaacagcacaccagatgccacctgttgttgtcagggtctcaaactccagaggaaatgcattgncctgtcatggtttacctctctaagggcacctgtctgaacttggagctgtgcttccactggtgcctcatggggcctgggcctactctccacctgaattcacacttttctctataaggtatcaggtggggaataagtccaagaaggtgacaagaggctcccgagcaacagagcttgctcattcctggcaggcatctcccacaatgccccagagggctggcgaggccgggacagcataaggacagagaaagggcagaggggtgcttggaagtgctcatcactcaggggagctggcaggcccgggatgacaggcagcctgaacagtgctggaacaaagacagccaccctgcgccccttgtcgagcagctgctggtgatgggaagcagcacgtcggcaccacctccttcgttgcaggaaatgttttgtatcgggccaatgacttcagttttccttgcctggagatgccttcatgaaggaaggggacagggaatacaggtgggcatgctgcagttggcatctctggggctgccaaatcttgagttcacttggggccaaggcactccacaatcccattccccttcatgccatcgaagaagaagaagttgtgtgaggagggtcccgctgaggcagggcct

SEQ ID NO: 16705 - DNA, 425 bp, Homo sapiens
tctccgagcgtctgttactcggctccgacggtctgtcacaatcagcctttgatactcttatatgattctgtatggatgttttaatagcggcatatcggctcaaggagttgaggttattagattggtattaatggaagatgagctttgggaattttagcgtcaggagctttttggagtgtctttagaaatatggggccttgagagagactgtgggcgcatctggtgaatatgatcattcgccactacttagcgtactggggtggtagtgtggtgttcagtgttgtgcgcacgcttcttagattcgattcgtcaaaaaagtagggctcctccacgggtacacaatggttatagtttgcgtgcacttccgatgcatgttgcactcaactgacaagtcgtttgggtatagggaaaattaggcaaagcat

SEQ ID NO: 16706 - DNA, 766 bp, Homo sapiens
  misc_feature (1)...(766): n = A,T,C or G
atgttagaacttcgtattagtaccgatgggttgggagtgtggctcatgtctgtagncggcgaagagctgaacggggttagggccgtcttctacggactccgtgtgagggttagttctcgaagcggtttttcggncagagctacgcgcgtttcnantccggggccgagggaggagnnnggggggngggggnggttcgttagtcttaggcgagacgaaggtctagatttaacttccacccacagtactcttagctacgtacaagtcccaggttcaagcacgtaaggatcaggtcgtcgttcacatcgcgcgtacactggaaggtatcgttgaacaagaagcccatagcgttatatttcgcagagacctcacgtattaccaatgtacgtagtacggttaacgatgtccgtgacgaagcgatcagaccgcattgccgcgggtcaatccgtattaacgtacattacgttagagtcgtcaatatccgtgagacggtggcagacagtgccatgtgcaggttacatgacagtggccggtcccccagtaggtagtcccagaccgtacccatcatgttccgtgggtcccgcaaagtagaggtacaatgcaattacccccgcataggggttttgttccgcggacggttaaacctcgggggtgggtggcctgtaattgggaaagatcgcattattacagagtttacgtgggttgaccacaaacagacgtagttgtagtgacactaccgtattaatatctaacagggtcgagctttatg

SEQ ID NO: 16707 - DNA, 740 bp, Homo sapiens
tcgccttttatcccaaaaggtcggatcttaaccgggatgaacttttttaattaccaacaagctacgggagggctctgaaaaccaggggagggacatgctggatcttcaacactgtgttttgataccttgtccgagaatggagaactccgaattccccaacctttcaaaaaatgtccgatgctacatgcccccaaacctttaaagaaaaggtttttaaaggggaaatccggtttgggggtcttgagacctttcttttttgcataaagagacaccatgcgtgattaaagggctgactgctccctcagagagggtgctccccccccttgaaagggggttaattaaattcttccccaagggaagggggagtcccgaggtagtatccactgttccgtggcgcctctgtaaagggaattctctttctgaaaaccccccgccccaggggagagaatttctttttttgccctttccccaagggtggttcaccccaacagagagggggaggagccctccaataaccaagtgtctttcttttttaaaaaggaagccccccctcccccttaaggagtttaccccctaatatcaataacaagacaacctgggggtgtgtacttttggcattttggaaagcccggcgccttccggggtggcaatgtgggacaagttttaaaatccctgtttgaaaccctctgcctccttgtttccaaaaaccacaaacaggggctaggaagaaaaacctctaa

SEQ ID NO: 16708 - DNA, 675 bp, Homo sapiens
  misc_feature (1)...(675): n = A,T,C or G
ggacggactccccgcagcggccataacaacgaggcgggagggcgatcgatctgcccacatgagtgaaataagatcacgagaccgaggctgacctgtttcgactatatcagcaataaaccacactgacggaaaggcctttcgcaggatgggagatacaccttatcactgttcaggcggcctctntatctgctgccaggacggacgactgtggtctgtagccaggagaatagggtataccctagactggttagccgcgcgtttttttaagggaagctaaaactcgtgatcactcgatcattgcttgtctcggacttcagacgtatgaaaggaaacgaaacttaagggtggaacgttgggttcaaccatagggggtgcctctttaaaattaaccgggccttttcgatgaaaatacaactggcattttgaaaaggctgctggtggagaaatggcgccattcggaattgctgaacactgagattggtgtttcagtcgcccgaggctttctggggggggcaacgaagggggaggcggggggggccctacagagttcccgtttttgagcgaaatgaaccagccgtaagaacaaaacgtgggcaaaggaaattgctggggggggggctgccggaaaagggaaccgcgcatccttaggggtgcctaagcgagcgggagcagaag

SEQ ID NO: 16709 - DNA, 780 bp, Homo sapiens
ggtggtctaacattttgtgtacacctccatccgtgtgtgtttattaattcccgggcggtctcgataaatggccattctgcgccaggggtttaaagagaaaccccttgcaaggttgagatccagggctttttttatgggaaacaagagacccacgtaatcattagagcatgctttaatcgcacgacatcaagcattcattaagttagacgggaaaatacaatagctagatgctactgtcttaacccttatggtgttttcctttgtttaaaaatttaaccaggccttctatcgaattaagaatacaaacaggcaattttaagagagcgttcatgataggagatatgagacacatctgttatttctgaatgacatgagtaagcatatctcagttctcgccgaggcatttctcatgtgggcccaacgtcaccttggacacctatagttgtcacgctgtcagagctatgccatctctattagctagactgagacccaccccttttagacaagaccattgacccatagatcagttggctgtagatggggtgacatgctggcaatagtaaaaaaattccactatcaattcaagtgtttgcctgaggccagggacgggagcaggcaaggaagcagagacaggttttgggggtggtgtaagtgttctaaaagcagatcatggatgatggtagcaccaatgtatagatttactataactcatactgtcctcttaagatgagtcatattttatggtatgtgaattgttcatcaataaagctcgatcggccg

SEQ ID NO: 16710 - DNA, 791 bp, Homo sapiens
  misc_feature (1)...(791): n = A,T,C or G
ctggggaggacagagcaggggaagagacgaaagagggggggaggagggagggaggggggggagggggagaccgaaggaaggtctgacgatgaaaagagggaggaactgtgaaatggagaacaatgaatgactagaaatgggagcatagatattaaaaggatttgggagagacgaggaggaggatagagggggaggagaggagcgagggggggagtggagagggggagtggggagagaatgactgagaagggctgaagaggtaggccaaggggagattgtaatactaaatggtaagcgggatgggggaggagggggggngaaggggaggggaggtggngaagggggaagggagagggggggctggaagagatcgtgtgagtgttgacaggggttcgagttgttgaagtcctagttgaaggctataatgttttgtgcaggccggagtacgtggggggtggtggtatgaacaaaagagagtggagcagaacttcagtcgtatttatgtagatacctgttatttaatttttcgataatataaatctatttcaacaaaaagaaattttaagcaaactcttatgattttttctcctgagaattattccaggacttaaaaaaaaggagaaacaaaacagagtaagtacattagctttattcaacataccatcttgtctagtagtaaactactaaaaacagtctcctgagtggaaaaaatataaatttttgtctatagcatcagtgttgtcctgcgtgttttcataattttctacaatataaattccagatctggccag

SEQ ID NO: 16711 - DNA, 1074 bp, Homo sapiens
  misc_feature (1)...(1074): n = A,T,C or G
ttatatacattgcgcnnngngnnnnnnntttgcagtagncgccggccgccaggtggtaaccacacaagaaatagcggccaacaaggccactctgtcttgtgtgtttgctgaaattttggcaatgcgtcacaaataccagtggatttcattctcgggnctttttagatctcacccaacactctaaaagaggcaacccaccacacctagggcggttctagaccgtagatttgtgttctctttaaccctttggggggttctctttaaaaaacagcacccctcttccggtgcgtgtggtgtctttttcttgatnttggaacttcataacgncgtatattaatcagaccgcctttcttttttcgggggggtgttttnatattcacgtggggaagcgacccaaaatctcttattttctcggtggaagcgtagagtcagttgtattctcccccccccccactggggaggaatctgttaatgggctctctttatacttctgacgcgttgtggaactgtcagtaggtcctttcttcagtttcatcaaacgagaagggaagaactattgctttttattcaatatattctacacttattacttacgggtgcggtgcgtaataaggagaccctctaattgtttttgagagtatgttaatgtgattaccatagacggagtaagacttcgctccaccccgtagttccacttagttaaattactaatcttatgggttcttgtctctgatgtataacacgaataagtaacacttttattctatctcccatttgtgtggagattaaattccgcattcttagatggtcttgccaagatggaaccaataaactcgaataaatgacggcctacctctcatccgagacgtgctccgccatcaccattctagatggtcatgccacaggtccctcgatgcaacatcccctatattcgaatctctgtcgacagataatgaggattgtcttctagtcttccaccgtttcatccctcattgttttacgacttgtgatttgttttagtactcatcccctccatttcccagatttgttgtcctcgtatataagtactaaacg

SEQ ID NO: 16712 - DNA, 786 bp, Homo sapiens
cttggccatttactacctgaactcagtttccaaaagcctttcccgagctaatgcccagctgaggaagaaaatccaagtgctccgtgaagttgagaagagccacaaatctgtaaaaggcaaagccacagccagagattcagaggacacacctaaaagcagctccaaaaatgccacccagctccaactcaccaaggaagactttcaggccaggcgtgatggctcacacctgtaatcccagcactttggaaggccaagacgggtggatcacaaggtcaagaggccaagaccatcctgtccaacatggtgaaaccccgtctctaccaaaaactcaaaaatcagctgggcatgttggctcatgcctgtaatcccagccactcgagaggctgaggcaggagaatcgcttgaacccgggaggcggatgttgtggtgagccaaaattgtaccattgcactccagtctgggcaacaagagcaaaaccccatctaagaaaagaaaaaaaaaaggtgggttaaggttgatagtgcccccaaaacgggaataaaaaaggctaataccaaaaatggcgcacaaataaaatttaaggcacattagatgaagggaattacccccaagttttttcaggattcaagatagtgccaagggactaaacttccaaatagaaggccaaaacttccggtggaaaattaaaatcccctaaggtggtcccaaaagaagacttaaaaccaaggaaaagggcaggcttggggctattccctgatcccaacatttgggagccggcgatttgat

SEQ ID NO: 16713 - DNA, 1656 bp, Homo sapiens
  misc_feature (1)...(1656): n = A,T,C or G
ccgtcgtacagcgctacgatacgtccagacttactcagatctcataagatagtgttctctctcttcttatccgctgcggactcnccgcgcgaccataatctgccatatcactccagttatggtcactcacactcaatgtgcgccttnatcaccgctcttcgcgagtatctcgtccatcgcttcgctctcttcatacagcgagcagtgccgtcgccgcgacctacatctcatactacatctccttactcatacctagacttacttgancacactctctgcanctacttcagcacctgcgcatttatcctaactcattcatctactcgcctactctgatcaagactgtacgtccgaatgtgctatcatatgctggctgtcccgcgccacggtcccacgcatacacgctgatacgcacacgcgcaatctggtccgcgcctcacttgaaagcgcagctccacacgcatgtccgctgtcaccgaccagcctctacatcgacatgatctacacacactcactcgttntctcaccgacaagtcacaactcgttaacacttcactcttcgatcgacgctgtctagacagcacgcgcgtgtcgagcagcgccagtgcgactcgacgtgagtccatcactgatagtcatagctcacagcacgctgctctctgtcgtcgtcacgtattacacagctgcggatactgacgctctgctcacggngtgtagtaggagtatcgatagcgancgcacctctcagctgctgtactcgcgctgtcttatatactgccaacgtatcgctngatcgtctagtgccgcacgtacgcggcagcgctgctgcatgtcgtacgctccacatgacgcagcgccatgtccactcgcctgctctcttcctccatctccatctcagttttcttcctctcgcctcctcatatcatctaatctcatnctgacctgagaagagcgtatagtgtctataatgagtgtgtagagagacatgcatgtattatgctatctacacaacattagtgagctgatactacctaccagtctcacatgcgtttcgatggcccattctctaatagtcttgagagaactcgctgacgctcacaggttctgctacgaatgtgtgtgccagcgtcgnttatgcatcgcaccgcgcgtgcatcacngtcatcccgagcncgatgnctgcactgcctacaacaagaatgagtaccgtggctatcgtcagagcgcgtagtacgcgcgaccgatgtccgcgaccgacgctggtcgcagcgagagcgctcgtaccgttacagcacacctctactaactncgagcaggtcgcaccgtcggagcactgtcagtcagctgtgcggctgctcaggctctagtgagcccgatatagagcctcgccggttgtactatgtcgagaatatttgacgtacgcactatgtcaggtagcgctacgatcttgatgttcaacaggtgacgtcgcaactactcgcgtggtacatgcgctgctgttgcgaatgaaagtattccgaacgcatgccgcgctgcttggtctctctctccagtatcctngaggggggtagatcgtctcacntcgtcggactactcagcgtgaggataggagctgtctcgcgcagtagaacngctatatactcgctctgcactcat

SEQ ID NO: 16714 - DNA, 801 bp, Homo sapiens
cccgctcagacacagtgaccaggagccatctatgagaaccaggagacaggccctagaccagacaccaaacctgccagtgccttgatcttggacttccagcctccaaactggttacccggcaagtttacagagagggaaggagagcataatatttctgcccagaagtcgcatcaagatgaccaagttgccatgaataaatcatcacagaattttgaactggaaaacagaaacaaaagcattgaaagctaaaatgctcgcgtaatcctttcttgattctgtgtatcacccttggagaagtctgcatcgtctcttgctggaggatgactgcatgggacacacttagtgactcttctgaagaagctttctggtctgctctccttgtccctggggttttaaagagaatccaacttctttgcccctgccttatggtaatataaatgttaaaaaaaaacttggaataattagttacctatgattttcccagggttattactcacctatggagaaagatttatttccgccgaatgtttttcgccggattttcaagcattatcttccacgacgctaatacagttttctagattcgcctccctgtcagtctcccaatgttgtaattgagaagaataatatcaaacggtttctagcgtgagcgatttattttaggccctttccctagctttgtctcgttggtttcatgtttatcccctaatgatggtatttaaccagcttgatagcgcttactcggacgtattcccgcccattttgtaccagttcagggccgctacttgtagttttattgag

SEQ ID NO: 16715 - DNA, 984 bp, Homo sapiens
  misc_feature (1)...(984): n = A,T,C or G
cggtctgctcactccgtctcgcctctctattcgacagaacgcgcaacagtacagggtaccactactcctcgacccggcaaagagcaagctctaaagagaaggtagacataccggtctatctgatgacacctccaaccccctctccgcagttgctctccctcacccaaatcattgactgcccggtgcgataatcatccccgcggccgtcgcgcggaaggcaagcgtcggtgcccggcctcctacacctgccgaatcaccccccctcaacagcaggatgattgtcgtgatatctgcccctgtggtctatgagctacggtcgcgaccctcgctccgcgcgctcgccaagtagacaacccgtcggccgcaggtacggagggcgcgcgtagcacacctaaacccacacacgataccctccagttcgtccggcacgcgggcggccggacagggggaatctctgtttctgtcttcatgcagcactagggacagacgcgcccacacacctctgaaaaggcgcaagaatcgtctcgggtgtcaatttcttgctcccgcgaaacatcagagatcacgcccctctcttcactcctcgggggatcgccgcaacagcgagcgagggggagaacccctcccccccccccgcgcctgtgtttgccccccccccccctcgactaaagtttattcacgtgcaaagggtttcccgtagcgcactgggccggcgggaaaaaaagatgtttcctccccccctccctccccacctccgggggnccccttttgggggggagtggaaccaacaaaaacaacccccccccggggttttgtggggccgcggcccccccgccttttttttattttattaataaaaagaagggctccgcggcgcccttcggtgtcgtgtagcgggtgaaaaaaataagaagagtccgctccagccttaacccntncccccgccngccggtgcacccgcgctctgcgtcccgtcccctcccc

SEQ ID NO: 16716 - DNA, 1236 bp, Homo sapiens
  misc_feature (1)...(1236): n = A,T,C or G
atccaccacaacccactctttcccttttcccccttacccttcccttcctcccccttcccctccccccttttttccccttttttccttcctcgtttgcgcccccgtgtcaagcccgcagttttcccccctaaccacttgccgcagcccattaccaccacactcagccaccacaggtacaggatgagccccttgccgtatctcccatgtttacccgcccccccccccctcgtatacctatcaatgttggcgtcccaggtattgtccccactctgtgtttccctccgacccatttacaagcaccaccaccaaatacccattacctccccgtcacaatgatatcctatcccacctcaccttaactgacccacgattgtaccctttgccacgcgccccacccgcacccangattctctattcgcccagtatagggcggaggtgccccgccagcgcaccaacctgttccccatgatctgtgggtacacaccactggcccgtcccctcatccgtgtggatcaccgcgtagtaccaccaccgtcgcagtcgcagtatccttatgctctcttattcataatccgataccacatgcccagcgtctgttgtgtctcccctcgcactgccaactccccagttatgctcacggtgacattgtgcgcgcggagatgcgactgcccgatgggttacgcaccgtacgtctcagtaaatgacgatccgtantgctctgggtcagtacctcttcgtcaaggatcagactcgacgcgtcgcgcgtagtgtatgtcgtgctgcagtcgacgtcactacggtcgccgtatgtgtctggtggtcgagtggtatgtgagaatatgatcttcacactctanattgcgctncgtcttgctgcttgcnctgtgctagtgcgatcgtgtatgtcagaaccgaatggtcgagactcagtttanacgctagtaatgtgcacgtgagacacgtgtgatctgcangggcatctgctgtagtctgagtgctccanactgtactttggataatacnatcttagcgtgaatatatccaggtctcttgcgtgattntatctagacaagatgtcacggatctcgcgttgtcangtcngncgtgtgtaaaagcacgtcagagctagccatgtncgagtctgcgncgacgcctgtgaggggctntgtcgtctgtctntgagtacactaatctaatctcgacgaactgatatgacacgtgtatcacgctcaacac

SEQ ID NO: 16717 - DNA, 1542 bp, Homo sapiens
  misc_feature (1)...(1542): n = A,T,C or G
gtgtatgtcgtcagaggtatgtatttgccgatgtccgcgaccgaaaggagagacgcgcgcctgaattgggggagacggacttctgctgagattcatttcatccgactacattaccgtgtgtctctcgcgaaattgaatagttacgagcggatagcgcaacatcaattatctactccttacgtgcggagatgcgggtgttctgcggaaaactaaatattctaactcccattccntcggaggcacgagggccgctggaggatcgccgtacttttattactctaataacatggtgtccgacgctggggcgcgtattccgggtagagtaccattctcgaaacattttattttattttatattttggcaagctttattgctgatctgatttgtttgccccttgctctttcaattgtgcgggcggcgctcgttccgcgctgtattcaaatcggcgatgtggcccggcgcgcgcgctcttcgattattattaggggggagaggtagttntattagcgtttccgcgtgtagtcgagtcgtttacgtcgcgtaggtttggtatgtatgtgttgttgagtgtgcgcggcgtgatgtcagggtcgcgccgaaggatatgcgtaccgtatacggcgcgcgtcacgcgcgcgctaattttatccgcactctcatattagtgagtggcgatgcaccgtttgtncgcctgcggagtgttacacgcgcgcgttatggcntcacgcgctttggactataacgtatgtgcttagtcacgcgacgcgggtctgtacttaccgtcanagtgcgccatcgcgtttatcgtgtacgcgtgagccgcggctccgcccgatgtgtgtgtaagttattatattgtatgactgccgatgaggcgcgcggagcgagctagatgtgagtcgacgctgcgtgtctgtcagngtctcgancggcgcgcngcacgcacncacgcgcgcgtgatatgatgtagttcgtntatctggatgtantggcacagctgagtaggcacactgtagacncgtttntagtgggaacgctgantatagagcggccgcacgtgcagtcgtagtgcgtgatntgtatgagctgtgtcgacggtatgtgtgtccgtagtagatacgagatcgagcgtatgtaagcgacgtgagncgcgcgtagagtgagcgcggtcgcgcacgctgcgagtacgntgatgtatgacgtactctncgtcgcgacgagacgtcgcgcgcggagtcgcgtgatagttangtcagtgcatagatgagtancgagcatcgcgnagagcgngtgtnagtctcgcntgntcgtcgcgactgctcgnctgcctggacgatatagatgtgntgacgatagtnctcatctgtgagacggatgtcgagcacgttgcgcgcgacatcggcgcgcgagtngcngagcgatagctgatctgagagtagtgagcagcgatcgtcanatgagcgatgcgagtgcganatcgcngncgtaccantacagctcgaggntgatgcacgatacgcacggtcagcgtgctcgtgatg

SEQ ID NO: 16718 - DNA, 876 bp, Homo sapiens
taccatagaggttcgaaacacagtttgacttaagcgcggggctttttttttaccccgcaccagtgttccgtaaaaaagtttgctgtaaacggaaggccccttgcaagttttttggagaggtagcacacatccccagggaatcaggggggcaagacatttaacaaaaggtttcccacacgcatttaaaagaggaaagtaaaaggcaaggcaggacataggaattcattataactctcctttcagcctcctgccagctgcccagttgggatgttcatacaggtcaacatcgtgatagagtgctatatatgggaactttcctctgaaggctaaaacaagctacacatgcagagaacaaacagggggctaagacatcagagactttcttgcaagtcgttaaaagtatgaatatttaaattagaaattataatcgcactcatttagagtctaagtgttcacaggcacgagtaagagataataatagtcgggtgtgtagtatacacgtttgttgttagcagtctcatgctcgagcgcagtaacgaattagaatagatgttaccgatcagtgattgtagataaagagtgcacatggggcgctgtacattctttcttcatagaaggccgtctcgcccgttgaaacaattgccgtggtgcatgcagctggatttgatctacgcaccctgagcggtattgcagcgtgactcacatggatcagacagtacgagataaaggaaagtgtgatcagtgctctgatgggtcattcatccgctgcattgggacaacccgccagataccggaagcaatacctcccggtgtatatgtggtgcttggtcatcaagaggcttaacacgctcaaaccaataaacacagatcggccag

SEQ ID NO: 16719 - DNA, 778 bp, Homo sapiens
aggagtaggagttggttgcgcgttaagacagtcgggtattgacgggtaacggtgagggtagtggttgggctgagggaagggaaggaggcagtattagaaaacatgtggggtgcggacgtaccgattgaagggaaggggtggatgttcggagagtgataggagggggtgaggcggtgggatcggagcgtgtgtgaggaggtgggggggggggataagggtagggtcggatcggtatagcagggaggaagagagagagtgtcctcaagatggtgggacgggtggcgcatgagaggatcgggcaggggggtgagacatcagagactgttgtgcgagtccgtggaatatgggagtttgattaggatttgtgggccatttgatcaaggctacagaagagaaagaaaaatagtggtgtttgtaatactttgtgtagcatctttgctcatgcagaatgaatgagaaaatgttatacagaattaattgtagataaagtcagcacctggggcactctccatttattcttcctagaaggacttcttgcctgttggatcctctgccctgttgctttcagttggatttcatcttcccacccttttcattttctcagcttgattcacatagatcatacataagagctaaagaaaatgtgtttagtgcctgagggaattcattttctgcctgggataactagacaaaatgtgatgcaattcctcccctgaatttaaaatgttttgttatcttgaaggcaattttcctcatccaataaacagagatcgccaag

SEQ ID NO: 16720 - DNA, 1716 bp, Homo sapiens
  misc_feature (1)...(1716): n = A,T,C or G
cgagtntatcatggtngtgtagngncggtanatcttctgcgntngtgganggtntaggtagtcgctgatctatgctnggtcgtcntnatggtgtgaccgtcggtngngctcgctgcntntgtgtngtngntgngtcatgtgatttggggattnntgcagtgtctcntctctgctgatcagtctgtgtctgngtggagtgangatngcatgtagtcagtgctccgatgagtanctgcatcgcggtacgttcggcggcagtgagtatacgcgngncactgaacgagctgccgtggagtacgacgtgtgtgantatctatacntggcgttgngntagtctgcgtgctgctacgcgctgtgtggtcgcgtgtctcgtgacgcgtcatccgtntntcggcgtagtcanatgcatgtcacggtganagtctgtatgtggatgtagatggagactgcngnagtagcggtagtgcgtcgtgtntgggggtcgagtanagntcgagacgcgtcagctgatntntgtagcgatggtagttgagtgcgataacgtcgtatcnacctcggtttcatngtctcgtctgagtantngcgatgcgtgatatgatgtggaganctctctatgcatatctcgcntntggatcgcngagtggctgctcgaggttctcttcgtgtngagcggacgcacacgntgtcgtcaggcgacaagagangtgtcttggcgacggngagtcagntnctagcgctcgcggttgtcgtgtccgaggtgtttgttgtcgtgnttggttcgtgcntggtatgagaactgtaggagcgtatgttgcgagacgtgnacgagacgaaggtgagagacacnagagcgcgagtggcgttgtagtgtgtagctgatgaggatgntggtatggtnggtgagagagtggaggggggntgangatagtggtcggagagttgtagtcgcgcgcgacgcgagagtngcgacgagtactgtgtgagacgcgcggtctgtgatgntgcgactggcgagctgattgtganatcagcgantgttagttcgacggtagagtggcgtnactctgtgagagtagatggcatgtaatnggtagtcggttgacgtcatgtagcgctgcggtcgtcgcagacttgcgctgtgattgtgtnagttgacctgttcagtctgntcatgattcgatcgnacacncgcaagctttgattagtntgcttgtggcgcatgtgtctacctatgtgtntctctatataattgtatctttgattctctaaagtantacgtcctantaacgttactattctctgcatcgtatttagttacagctattacttttcatgtacttgtattctacgctcgtgtntgaatctattgtacatggtgtgtacttgtacgttgacgtgatcatctgctccttcgtcnattanatttacctattgctctactctgtggtccaangtgtctatatgctgtgcacactgttgatgacgtggaggatagcactgcgacaccagtantagtccaagnctttgtanaacatctactgttcagatgctcaatgtttagatctgtaagagaggtaagataagacatgacctcatggctaacaactaaacnaaaactaaatgaaatccatcgtttgcgtgccaggnttcttctttttttttctctctattactacttttctttttttcctctttttcttctccttnccctctcct

SEQ ID NO: 16721 - DNA, 897 bp, Homo sapiens
  misc_feature (1)...(897): n = A,T,C or G
atgtggtttgggtgtagttgtgttgttatgtatgggataatgataacctccgacagttgtttgtttgtgtgaaatttagatttatataaagaagttgataattaatattaaaaattggggcgtggttggaggataagctgatatggaaattttgatttgggtgtgattatagcaatttttgttctgattatttttagacgttgagaagatagattgtatatgagtgtttggggagtgtaggtatttttatgctttttattgatgttgtggggatagttgttgaattaggtttagttagggttttttacttgtattaaaaaaaatgagggtgttttattggaaagaaagtttttataaaatgatggggtatttatttaaaagtttagtgttaaaaggaaggaatattttgaattttaaagattgtgggagttttttggggtttattgtttttgaaaaaatatttgtgggtagttttttgaggtatgggattaaaaggtgttttttgaaggaggaattgttagggatttggttggtggttataaaaaattttggaggttttttggagtagttaaggtgaaaattatgttagagaaaanaggaatggaaattatatcccccccttttagagagaaaataaagagatggcagagatagtatcttatttaggaagttttaaattgaaagggtttgagtgaggacagctgttacagaattccatgacctctgcaagactttctgccctttgaaggagatgatggttagatatcagcttcaaactcatggnaagntcagtttggttgaagaaggaagaaagaatgcctatggcaaaacaaacaaataaataaatctgtatgcggccgtcttttnnnnnttttnannntggtggatttttttggg

SEQ ID NO: 16722 - DNA, 269 bp, Homo sapiens
caagattatgaggacatacaaagggagttgttcaatcagggaacagatttgcaaggaattaaccaaaataaccaatagcgtctccgtgtatatttcccaaataattaacaactaaatggcaagggggtaacatttgcttggggttagggttaaatctttgttaatccgcaaattttataactaatagccaaaatctgggaacaattcatttataagtccagaatcacagcaaggaagtaagggtaagcaattgttcggaataaagatat

SEQ ID NO: 16723 - DNA, 840 bp, Homo sapiens
tttttgtattttttagttttttcgttgtagtttgcagatggcgaagagcaggagcgcgcagcggtaggcggcggacggcgggcactacacagcggggtgtcagagttgtggtgggctgactgtagcggtggggcggggtggatgtgggggtcgggttagtcggcggccgttccgtgggccgcccctacgcactcgacacgcggacaccacgcccgccgaccacagcccgccacggcccccgcgaggacaagagaccgcggtcggggaaaagaccccagaactagaacagacataccaccggtaagtacgccgtaaacggggtgcaacgcgaacccggtcgcctgcgcacaccggggcggccaagcgaggaatcgtggggggagggagggggagggatgggggcggaggaccgggaagcggtgggtacgttgcgcgggggggggagggaggaggagtcgggcaccacgcggcgcccccgcccgcccccggagacggaacgagaaccaggggcggtgggagggagggaacgccatctcccgaaacaagcctccaccactaccgcaaatcccagcctacgaaattgagcgcctgttcggccccgcacaaattagggttttctttattatatacatacatgcaagcgtgtggcttccctttggcacctagactgagtattaactcaggaatgcacatatttgggtgttttctggatagtttccatctgattcatctgtgataaaaattctttaagttctatttgacttaaatttattgttctgacattgacaaaattacagctatgtttgttgttccgttggaggtaatgacagagttccgcaa

SEQ ID NO: 16724 - DNA, 1346 bp, Homo sapiens
  misc_feature (1)...(1346): n = A,T,C or G
tcacgttaatatgtcggatgacgcgcacaatacaccgaagaggaggtgagggggggnttatatacgccgagacctcacgcgcgtgtccggtttcacagcttgaaaactcgcctcgccgcgccatcacggtagtctgactcgcacactacacaacggagtccgatgcgttgacagacgggctcctatgacatactaacgcactactcgtccaacaggggatagccagtgctgcatggattggatcccaattnatgattgccgagtcgactccatatttgatacaataattatacagagcgcactagtatcgagccagtcactctgacactgggagaacgcggtcgcatacgggcgctgcggcgntgcatgcgtggctccgngcgcggctgtgcgcctaatgttgagtgtattgtctgatgagtagctagagtatatgattgttgcgggtgtgtacgcggacgtcacagagccatgcggcggccgtgccgggccccctgcccaggggacggccgcggcgccgccgagcacacgctaagacctccaccgcagcggcaaggatagtgccggcaccgcgggcagagcgagggcagtgtctcaaccaagaggtctggtgcggctctcccggggcgcgagggggaattatgagccagcgcactgagaagagaggttccatgagttagagggattggagactgtgggctgtctcctgggcccgcgtattgttcgttgcacgcagctagcgcgtcgcgagcgtcgagtaatgaagggcatatctatgctgccgccccgtgatcacagtttgggattactattctattggtcttgtctagggggaaggagtttgccttacttttgctggtgcttggtcaatgcgccttcgcgacagactggagactgattagttgagttgaggtgagtaagtatatggcaatataaaacgtaagtgganagtagcgctcatgacctatccaacttaccacacactgctcaccaacccgcacgctggctatacggactattcaacactctctacagccaacggccgcggagtcggtagaaaggcaccatgcgtatacttcagtcgacgctatacgtctgactgatgatgataccgataataaccactagttgacgccggaggtgggcgggtgagtgacactgtggactatagcagatgcgcgagtagactagtatgcgactatcgccagatctgaatatatatttgatctgntctggtacgtnacgccatcgtcgtgtttcatcagtatcgtgncatagtcgggtatgagaatggatgatacgccaggatggactacaagtttagttncgtacacgcagtcatcacg

SEQ ID NO: 16725 - DNA, 1128 bp, Homo sapiens
  misc_feature (1)...(1128): n = A,T,C or G
tgttcctcttctttgtcatcactgagagaagcacaacgcggaggtccacggagaggaggagacgctgatctcgcagaaccgaccactactatgaactgctacagacacgtagacggacgcgcctgnagctatgcgtagtgcaggaggattagtgcacatgtgtcagtgttctctatgcatcgcccgcgaggaggaccgcgtggagaggctagagtcgggctcgcgcttgttctgatggagattacactatgtccgcgcagtttagtcctaggacacctacctgcgaacacatgtgtcacgcaccgcctcacgcatttagtcattctcccaatcctcgtgtcgcgaccaagcctgtatgcgagattgccatgatgcccgcttgatgcgtacctnccggattcatgcgttagaaagagatatcggttcaataattcgtcccgcatacatatgtcccagacgcagcgacacgatagcgtatcaattgacgtgtctcgtgcataagtcgatgcacgctgttgctggtgtcccaatgtgctcgcgctaagatcagatacgcgccgncatctagaccgtccgagctgcgagtcgccgcgtgttctgtggttccgactcatgagcagacgcgaagccaatccgcgtcgcactctccgcggattatagcactggggttacgtgatcactatgtactattagcccattctccctctatatacaacgacggcagtaaccgttttgtttcttgtagggccccacacgacttagtgttaagagcgaagcccaacgatttatgatacaacaaaaaaaacaaataatgataacacaagagagtaatcaccagaactcatagaatcgaccggattagcgccccgacgtattgaatcataatcatcgtgctcacctgtgcgtactacgtccatgcaccggtctcaccacgattattaactatgagtcccccggcgcgcgtgagttaagcttgacatatctcaatcccagcagacacctatacccgtaatacaattcataacgaataacacctctaccagacggagagtcgcttcagagcgtctggcatgcgacgtggttcatctccgaccagcatgagtaccgacggaggcgaatgtcgctgcg

SEQ ID NO: 16726 - DNA, 473 bp, Homo sapiens
  misc_feature (1)...(473): n = A,T,C or G
ctatgaaaatctgttatacaacactcggaggctaagtcggacattcaattgaacccggtcacaaagctgcattagacaagatcaggcaacgctactccggctatgcaagacgaaaatcatttaaagcctcttgttccctggtggttccagttagataaccagaagatcataactaccctccataccggagcgcaaagcccaggctttttgagcttttcccaaagacattgttttggaagttctgttcttcgcaccttgtcttttaggagcaagggtttccaccaagtctacttgctaacaggacccaggcacagtttaaagaaaaagaaaaaaatctgccatcagagcatcagccacagacatgcagcaaaaagtctggtgataaatcccagggccttacatgatctggcccctgtctatatccctagctccatcccatgccactgtccagatcttntggtctctcttcagtt

SEQ ID NO: 16727 - DNA, 783 bp, Homo sapiens
ataataatgaggggatgaataactaagataaggatgaagtagcgattgggaggataggcagggcgtcgaggagctacgaaataaaggggatggatacgtgttgcgtatcatgtataatcgaagtatggatcatgtgggggacgcgggagagatatcagtggtatgagtcgacccgaaaacgtgagaagaagagaggtgcagaagggacgagggaagatagaaacgaaaacgagcggggagggggggggtgggggggggggggtagtgaggaggggtgagggggggggaaggggggggggggcggcgcgggaagcgggagtccggggagaaaggaggtgaagggggcgtgattagagagacgtggccgcagcctaactacaaagagcaacaagccatacaacaactcatgcggatcacagagggggggaaacttgaagggtcgtgcactcaattgattcaatttcacagaatgctaatctcgtcgctctgagtgtgcctagctccttttccatcaggtcgtggcttacgggtcagtttattccagccccaatctaaatgtcatccccttccacaacattctctctcacactactctgtgcttcttcacaatacttatcatgtgtgtgattatatatttatgtgattacttgattaatgtccggcttcccaacagaccaagttctatgtggataggcactgtttattcagcatactatcccataccgagtacctagcctggtgcctggaatacggcgggggaattaataaataaagatctgccag

SEQ ID NO: 16728 - DNA, 1120 bp, Homo sapiens
  misc_feature (1)...(1120): n = A,T,C or G
cgactacctcttaataatactcacacgtatcagaatgcagtatnaaagatactccacagggaggcnacgagatagttagcgataggacgacagattgtgagaaagatcctattgatactgtagatcttcccatctagacttgccgncagcatctatcaagtagcaccttctgaatatactcatctataagtacgtattaggtgctgnccaattgcttgatcgcggctgtatggcttcgggcgagtcagctcttattctctcgcgcgttttcattgctattacccactatgtccttgcctttctattgagatgtcacaccgatccgataattaatcttttcccgctttccttcaatattatgatattttatctatcgccggccgcaggaatttntatttctcttttctctccgtcggcgagtaatatatccccggtaattattcattcttctcagcgccaagtaatgcgtgtactctaagtatacgcatagagcttagcgctgatattagatcgttattatcgtcgcgaatagtttccatacataattcatatctggtcattgatattttttatcttatataatgtatattcgttggtcgtttgtttcccacagatgtttttaatatcgtgattcgcagcgctgacgccgcgttgcattatatttatccctgactctagtgtttataacatgtgtcacatactgtagcggacttatacccggcgacgccgcgcgtttattatgtccnatcataatttaccgtatacgcgtcgcgtattacgctgttctgtagtacgacaggcttcgtgaattcaattatctttcatccctgtaaataatagttttatgattagtcttgactcacccatatcattatttattcttctatattaatatatccagcgaattctatgtntcgttctctccacgaagtcctattggacgacatcacagatctattattatcagacgctccgccgacgttctcatatctcacacatacgctttggttcatcagtgggacaggatgtgcgacgacgatgtcaaatgtgtgtattgcatatattatcaccgccggcgcatgcagtttaccgccgtattatatctcgaacgtaattcgtg

SEQ ID NO: 16729 - DNA, 1289 bp, Homo sapiens
  misc_feature (1)...(1289): n = A,T,C or G
atatatcttagactctgagagcagtgtacgnacagaaacacagacaaagagacacaacgtctttgcttagatgnaactaanccgcacagcggacaggagcttacngangggcgnaagacacgagngacggcggctaccncaacagctggtagaatcagaatctatgagatgctatctttttatggagcgtcactgtacagtgaagtcgcgtagctaatatatggatacgcatacgtcacccgagcctgttcnacacaatgctatgtggcgtatacccgtctcgtgagctattgcaagtgttgacacagtgcggtggtataacgtcgcacatatccaccacacttggttcatacagcgctgcccgctcaatacaggtcttgctcgtacaaatagatgagtcaggcgtcggcacctgcaggacactatccttgtttctgcacgcagaacactatacgccttatcgcgcaacacaacagatataggagtacgcaccncacacgtgctcggcttggctacncactcaaacgtgccgcactatatacgtacaagtactagctgccatggtcagttgtcgtctcaaacgtgcgtgcatcatatatctctgttnagatataagtgatgctaatagngtgtgataaaagaaataacgaacaacacaatagccacgggggacacaaacaancgtgtaacctggngggggtctcgcgtgatcaaaaacaatatcagggccactaagtatctgtaaacacacggtacagtgatgttgactacgcgttctaggacacacacacactgggtgggcgggcggcacgcactgctacttacataacatggcggaagcaggcctactccaagatacacgagaggtgtacaaattaaatgtgcgggaacgagacggcactcggcaagtggtgcgacaatatacgctccacatcgtggcgctgagtactttgtcacataagagacagcaactaagtactaaagnttagcaggtctactgttctccacaaggtttacaacacacatgtggcagtttatgcttcataaaccctggagcattatgtgtataccagcagtgtggggcgccaaacgcagagatacatagtcatcggacgtggcggggcgggtgtgcacacagcgtgcacaaacctgcttaaactccacctacgactacatattgttgtcacccacggctgcctatcttgtcgggtacgtggcgcattacagtacaacaatctgggagctctgtgaggccacacctctcacatagaccacgagcagcctagaat

SEQ ID NO: 16730 - DNA, 1262 bp, Homo sapiens
  misc_feature (1)...(1262): n = A,T,C or G
cgagtctatgagtacggcgctggccggcgcgnnctcatggccggccccgggggcgcgccgcagagtgtggcggttcaatctttatttaaatataacgctcgcgtctcacagtagttctcaatttgttagcctagaatctatgtggcccattcgtggctgtnccaaccaacttgttcgcacttgaccatctaagtaacatatccagtgagtcgcacagcgcacagatgacgagcatgatgtgatacatgtattacaatcgtcacaccacgacttatgctctgggattgccactagggagatacgttatgtagacactggatncgttcatgctngcaccctacgagtataggggaacgctgaccggtggnctcgacgtgggtgcgtgtatgttggggaggtcctagtgtgcaggagtgtggggagagcttgggttctgagcagagaagagatgcgggacagtgtgcgtacagggtggtggcccgcatgctctagcgcacgcataccaaggtgggctgggctcgcacaggtggctggactgggaggaatagttatctactcgtctcttgtgagcgcctatgcatctcatgggtgtgggggaccaagtggaccgacaaccaaagtctggggggcccactcacgtacatattgtggcgattaactggatggtgcgccgggtgggtgtatacatgtaatgtgttgtataaggggtggatatacagtgtgagttatatatatacagtgagtgtgtgcaacaatccacaccagtgctggtgtgtgtcacaatgggcaccatacaacaacatgtactgcagtggggacaaagtagtagtggccatacaaacaccagcgacatgtgggcgtgacaaaaggcgggtgcgtggcggaacaataaaattgggagggctgggattgtaggacatcgtgcgagaggcacaaataaatagctataagagaacagcgccaattggtgatcagtcggaggcgaaagtagtgaatgcggggaggcacactggggtgaataacacacagctgcgcacatcagcacggcggggacgcgcggccaaacaatatgggataccattggagtggtgggcgacacgcataaactaggtggggtgggtgcacagcttggaacgacgtcatacgacaaaagtccagtacagcctgacgttggggaacacaaacggtggaaccaacaacaaaggcaaatgtaaacaacgtggagggggataaaacaaatggaaatatgggtgggcgcataa

SEQ ID NO: 16731 - DNA, 1085 bp, Homo sapiens
cttctccgcacagtatagtgtcctgagatcgatgaaatcaatcgcggcgcgttcacattcattcgcgtgtccgtcgcccggggcgcgtatttgatttttattatcgcccactgattttccgccgcggggaccacatacttttctcgttacccccgcccttattttatctccgccggctatcccccaaagcaacgactacgttcgcgacacacagcatcgacatcggtagtgcgaaggtgatagttcaatacgtatacgaatcgtggagacaatatccactcaaattaatcgtacgtctattccttcgtataatatcgccgcgcggcggtgttgtttatcgcgtcgtgtgtattcgactctgtttacattattctcgcatccacctccagccaacttagatatgttagtagctttcagttcattatttaataatcagtcaggtactgtgcagtttcatacacggcacttcttagatattatactaatatgaggttactacgagggctcacccgcccccgttgctcatataatcgcacccgcaaatcacacgatgtaaatgataacccgggagtgttcgagcagttcgcatatctctaccagtaggtacggtggcggtgcagccggatcgtgtgtttcatgtagttatgcagaatccttatctcgccggcataaagcgcctttacgtatccgtaagatgtatatggcccgcctcttcttcaacatgatgcgcaaggctgacacacgtccagcaagaaacgcgcccagctcgcgtccagagatagttgccgtgatattttcccgctacaatcgatcgtacgaggagttttgtaagtccacctattgaacgcccggatagagtttgctttgttatcccccccccccgatccacagttttcatccactatgcatcgcagttggatattacaatagataccctatcatatgtggagcccccccgtgaaaaaatgcaagcgtgacccatgttgcgcgtattccccgccgttatcggacgccttattatagaaccgacctgtgaggagctagcgatggtatgtctgtacccacatcactcggatatcgtgaaa

SEQ ID NO: 16732 - DNA, 1265 bp, Homo sapiens
  misc_feature (1)...(1265): n = A,T,C or G
cattacgtcgctcgcgctccttgacggctctccctgtcacgctctctctccactgtctgttttatctactctcaccttacaatcgtcgtgatcactcgtgttcgtgactcactccactcactctgcntcgctgtaccacggtgtgctaatctcttcgtattctgcgtccgcgtcacgtgagaggctactcactctaccagcctcgctgcgctactgggagcagtggcgcactgcgtctgtcatcgcgcgngcaggcgtcgtcaaccgtcgcagaatgtgggtatggtanacatgagtagggtctgnggctgctactcgtattcgtatatangntctatgttccgcgcgcatgtgncaacaacacatgtgcgtcctcgccatgagctaaatactcatcggcatatggtgacataataccctcattatcttggttgccacatacatggggntggtcggcggttactaaccaacggtggtgtactgggacagaccggtggagacatgtgaccctgcatcgtgcgtagcatattactactacaactgtggtgtcccatctccaatcatatgtgaccctcctgtgactcggactcgatacacattgacacttgttcgctcttgggacttacagggcacattgcctcctatcagtggtcgtcgtccaaccacccaacaacggtgcacagggaccaccgtgagcaaccacaacacaaaacagggcagcaggtatgggccatcaggggtaatacgcgattgtgacgcgcctctgctcccccggttcgtcggaaggggcgaacaacacgcgaaggggggacatacatacgcacggcgtcactgggggggccacatggacacactcccaccaacgaactggaccgcgtggggggggtcagcaacagggtatcggtgggcggtcagcgctcaccccttgacatgtaccgctgtgggtgaacgtgaaaccggtggggaacaacaaagtgcaggacacggacacacggacacgggcgcgcacacgttgaaagagggtgcacaccgggggcacaaagcactaaacaactggaaccaatggtctgtcaactgttccttggggcaccattgggggtggttggtaatacaacaagggtggggcgggggcccccgggatattgttaacacactatatcggtcacacttattggggtgacctcatgggagaaaccaccacagggtgtggggggaccacagggggtggggcgataacaaaacatgaacgtggcgggtggcaaaca

SEQ ID NO: 16733 - DNA, 888 bp, Homo sapiens
  misc_feature (1)...(888): n = A,T,C or G
ctattatcttcanacattctcctcgcgtatttgggnggcctcctcgcggccgctacactctgctacggggactgcgatcactaacaactatcaattaggggacccacaagcgtgggacgactctgttagcttcgtgactgtggnggggtgtggggggataattgaccgcgcagtggggagcatgttggaanattcttagtggtgctgacaggatgagtcgggataagaaggggaatgggtcgctactgtgggcagagagaacagttattacangccctcgacactctacttnnncactcaactactcattacctatancaatcttcctctntctctataatactcctctcatatatacacctcttaatccttcaaanacaaattaaatattattcatacccnacccacaaaacgcaactncacaatataatnaattcatctgaaactatagataaatactatgtatcttattttgcgttcccgtaatatggaagatatcaggatggagagaaggggatttcttatgtatgtaggggggatgtgctttcgacattgccaccttataaatcactnacaaatcaacaacaacaaaaaaaccgactaccaacaacttaattaatnattaattacttctntctcttncctccaaacacgacacctcaagttcttctcaataattaaaactttgnattcatagacatagcaaaattggtatgcgtatatgcggtttggccagcggggtggtgatgggcggcggcgatttaggcggacttgtggagaaaaagatgtattgttgattggagcttgtcgcgctgtctaaaggagaagaccgggggaagcggggggtncgggacacggttggaaatttgctcgtanaaatgcaggcaa

SEQ ID NO: 16734 - DNA, 1188 bp, Homo sapiens
  misc_feature (1)...(1188): n = A,T,C or G
cccaccgacagagacgacgacggcgcaggagcacagcacgacgacagagagcacgcggggggncggngggcctcngngaaggggaacctgcacgcgnccnnggncctttgngagaggggnaangaacaanganananccaccaacaagacggaagaacaggaggngaagcacagcggaacagagagagcacaaacggcaaggcacgcgagaggcggcgaagagcagncaagagagcagaacagcagacaaggagagagcccacagcagacgaaacacgcgaaagagcgcccagaggaggcgaggaccgccacaagagagaagagggagccaacgccgaggagcggcgacccacagaaagcgccaacacaacacccgcagagcgcaaggcaagcgacgaccccgaatgcttcttaacacaaggggggaggcgcgacaccgcaagcaaacagggggcacaccggcgcagcgccccacaaaggaaccaaggcggaggaagcacgcgacagggcgcgaggagggcaccacggggcgcgcagagcgagaagcgcaacccaacgggggccaccgggacacgcagcaacaacgcacgcgcgcagccgccccacggcgccaccaaacgcgacagnaggagaaggcgaacaaancgacgaagacccccaacgcacggagccaaacaaccccggaagggcgcaccgcgccgcncaccgcanagaccaanagagacagggaccgaacgagaagaaaaacaggggcccacgaaaagcacgggccccacaccgcgacagcccgcgcaccacaccagccggccacacaagaacccgaccacaaacacaggaccacaggagaaggacacaggcagacaccgaacacagagcgagacggcgagcgaaacggagagcgagaggacccgaccagcacaccacccgcacacgcagaaagcccaccaaacagcagacgcaaacacaccgcaacgcggccagcaccacccggacgacgacaggcacccancgaacaccgaacccccccgcccacaggaccgagaccacaacacgccaacacacaaacgaagcaacaagaaaacgacacgncacacgccagaccgacgcgccgcaaggacaacgaacgagaagagcccggacgagagaagaccaacgcccaagaaacggaagcgcgacgcagaagggggc

SEQ ID NO: 16735 - DNA, 1414 bp, Homo sapiens
  misc_feature (1)...(1414): n = A,T,C or G
ctctgctggtgttgcgttgtgtcgtgtctgtgtgtctgcgcctcgtgccgcttgtccgttcgtgtctccctcgcttcncngctgctncgcacgaggcgcggcgcactgtgggcgtctcgcttccagctttgctcgtgtgcgcttcgttgcttgctattgtgttgtggtctcttctcgttaggggcgtctgtatcgctgcggcgcgtgtngggtcctgttgcgtattgtgctcgcgttgcnacggcgccaggtgtgtggtctntcgcgcgtcttcgctctgcgtgttcgcttgtcgtgcgtgcgtgtgtcgtcccgcgtccgtctctggtgtgtttggctctccggcttatgcggcggtgtgttggtgcgcgcgctgtggtgtgtctgcgctttcgctctcggcctcttcgtgccctttgcgttgtggtctgtgatcgctnctcgtgtccttttctcgctgccgttttttccttggctcgtgggtgttcgtccgctctccgcccctctctcgtcgcgtctcgctggcgcggctccggtgtttgtgtcgctctgcgtcttgttctctgtctttcggtctacttggcggctggtgttgcccgtctccgctttggccggttcctgtgcgctgctcgcggtgtgtccctggcgttgcgtcgccggccgtggcgggcgtgtttcggcgtcatgttgatgtgttgcatctcttcgctgcgtcctgcgtgctgctctgctcgttcgtntcgtcgcgtccgcgcggatcgcctccgtggctttcggtgcttgtcttcggtcgcgggcgtgcatgcgtcngtgctctgcgttcgctccttctngtcactcgccgcgtttcgtctgcctggcttcttacgcnttctgtgcctgtggtggtgtggcggcgtttgtttcgtgggggcgggcgtgcgtctctgggcgcgggcggctggcgtcgtgcgctgcggcggcgcttctcggccgctcgtgcgactgtcggcgtttgcgccgcggtgtcctggcgttcttncgtttctctgtgtnttntcgcggcgtctgcgcgtctcccccgcgtgcgccttctttgctgtcctcgcttcccctccgtgtcgtctgctgcgccgttcttggtctttnttgccttcctcggcttctcttgggtcctcgtccgtctccgttcttctcctccttctctcgggcttcgtctcgctcctctcgcgttgttgtttttggtcttcctcttgaggtctgtcttttgcgcgtttgcgggtcttctctnctttcttgtccgtgggtttttcctccctctcccgacgccccgcgcgctntgttgtccgttccgcgtcgagcggtttctctcccccgtctcggcgctgccccgtctgtcgtctccgtgccgcgtctccgtgccctctgctccgct

SEQ ID NO: 16736 - DNA, 1307 bp, Homo sapiens
  misc_feature (1)...(1307): n = A,T,C or G
cggcgcgatgctggctctggggtggtctggattctgtgcgtgtcgcgcgtgcgtttcgcgacgcgtgcgtgtttatggctcgcgtttcgtctcctcggggcttctacttctatgctaccgctcctcctccttctcgttcggcgctgctcgctagtgtggttatagtgggcctgctgggcgccgcggcgcgcggcgcgcgtggccgtcctttacgtgtcgtgctccttctgctgatctgtgctcttgtttcggccgacgctgctgctcgcgcggcgccggcgacgagctgttacttatttcattcgtcgtacggctccatctctccctcgatcgccgccccgctatcctacttggccatcgccaccgcgctgtgcgcgctcgcatacgcgagccgctgttgtccctctcgcattcgctgngtcgctgcgcggcgttgttctgatcacgatgccgactctctcccgctgctttctactgcatgctcctacacacggtcgctcggcccgactcctgtcctattctactgccgttgtcctctccgagtcgtttcgtcgcatgcggccgccggcggactcgtcgtccgcgcggctggttctgtactgggatagcggtgggtgtggggtggcgggcggtgtttggtgttgtgggtccggctgcgggtcccggtggtgtggcgttcttcgcttgntggggtctctgtacggcgttgggctggtcgggcgcggtggtggggcttcggctcgcccgggcggtgggtggcccgtcgtgtggctcgcgcggcgctttgctccggtctcgtctgcgttgcatgatttgggcgttgcgtggggtgtggcgggcgggattacctcccggcgcacccgtgcggcgcggtgctgtgtagaggtctgggttattagttcttttgtcgtgtcgcagcgtttggtctttacggctgcttgtcagtcgtcctacctgcgcagcgctgcccgagcccgctggccgccccgcgcgcggccttcttccgcgctgctcggctcgcggtctcgtgtgtccgctctttctctcgtctggttgctgtggtttcgtcttcttggcgtggtctcgtngtncttccgctcctctttcnccctttccngncctcctctaaagcttcttctttttttttctcttttcttctgcgtnctttnctgcgctnggtctncctcccttcttaaggctntttttttnttnggtttttcctttntaaggttttcttatatantattttnaatnctcctcccttccaccctttttttttatnntncactcttacttcttttttctct

SEQ ID NO: 16737 - DNA, 750 bp, Homo sapiens
  misc_feature (1)...(750): n = A,T,C or G
acatgagctggctcaatggtgtggctatcattgnaccatagaaaaaaaataagagaaattcctgaacttttacttttacctatattattaccaccagtaaactattcagctcaccaaacttgaattcaggcatcccaattgtcccaagggtntggtttagaataaaatgtgttgctaaaagtatagaaacactccagactgttggtattttcccctttaagcatcacaactattattgttattactattttggggtaaactgtttccaaaatgtgcaatccaaagaggatataaaatagaatctcatgttttcttgatgaaattctgccatagttgtgaacatatatgactcttcagtgctggcagacagtaacatcgtgatgagctattgaggtatagaaggccacttacccctatctgaaatgtgccagactagagtgttttaaagtttttaggtctgctttttagatttcttcttcttctcccatgctatcatgccatgccatattcttcttgctattgtcagtatctgcatctagtgacccaaatctctacctcacccccaagctacttaccactacttcttgaaaagctttggttcataaataacagccaacacagccagataagaataacatttataaagacaacatcctaagaatgcagttcctaacctttggaaattatagaaacatggaagaatctaaaataaagttgtaaacactcttcccataaaaaaaaaaaaaaaaa

SEQ ID NO: 16738 - DNA, 456 bp, Homo sapiens
  misc_feature (1)...(456): n = A,T,C or G
tgaaaatgctcgtatagtcatggcttcaaaaaagaagggnngttaggacgccacgcgtaccggagtttttcatttggtactcctaccactgagcaagttatgatggcctgtctactgatggggaatagtggaagaatcgggttagtacagtgagtccttgtgataatataccaccaagacagggttcttttaacatggataccatgcagggaatgaggacgtaggtttcttacccatctctgcaggacaggggattggactttatatagactttttgtgagggcattttgacatctaggagaacaaagatggcgcactaacccatatgcttgtccttatgcctgaaattttttgcatgtttgatactgttgcctatgacctctggaaatgtatgtattaataaaacatgtaacctttataagacataattaaatggattctttaggctcagctggc

SEQ ID NO: 16739 - DNA, 1300 bp, Homo sapiens
  misc_feature (1)...(1300): n = A,T,C or G
tagtactatatctctcctttgtanncgtgtatactanatggttagatgtcatgancgcgtagtcactgtcgactgaagcgtngcaggatncaccgagtagcacagctcgtcangnaagacgctcggtcagtcgtaggacttganagcgtcatgtatcggtgttggtggtggtagntgtcgtgggtggactgctctatgtgtgngacgtactgagggttactcattgacgctgntctacgtataccctccggtacgtgtgcattcggtagcctgaganatattagactattntgcttctcnttgttattgtctgtttgtannatctctctttacactatatctgtaacgcgttctangngttgcacncgtagganagcctgctgacaatattacttatgtgtntgacttcgtgatatagatacttcatatatctcttgtnaattcatactcgttanangactcgagtatagtctttattacctatttacttatnnntctctgtgtgntctgcgcttatgcaacacgatcattaggtacgacttatgttgnttagtgttgattgcattgtggtnagcttcagtgcagagngacatcatctattgagactctgagcgctccatatctcgannganctgcttacttcaacattnncttcttctcctagngctcttctcggggtgttgtgtctcttggggtgcattggtggggttctttttctggtttcttctgtttttgtcttctattggggtgggtgttgagggtatgggttctgggttanngtgctctttctttttttactctttctttggttgttttgtacttgtcatctgtgacttgtgttcttttttagtattatttttgttttattaaatttcttatttatttaattgattnnntattattttatgtaacttttcttatatctatttctcttttanctctttcccttttttnnnattaattttataataaattaacgntctctttatcgtctactcttttttgtgggatnnatatctttaataatattttttttttctatatatcctcttactttttctcttttatacttnctttttcttttntnattttttccctttnctcccctncccctttttctctgnnnccnttccctcactctnnctttctttctccttctcctctttnnnnncttctccttcactataatatccnnnnnnntnnnncntttnnnccttaaaatnnnnnnctttnnnatatctcccctnnnnctctcttcctttctcttcnncctttctnnnnnnnnnctcttnnncccttt

SEQ ID NO: 16740 - DNA, 736 bp, Homo sapiens
atttagttttaccaagtcagattctatttgtcaatatggcagcactacacatgaagagtacttattacttttgggcatctagtttaaatagagacaatccataatgtgcatgtgaaaaaaaatggccactgttcttgaagcattgcccttgagcaagcaacaagtttaaatctgtcagtgtggaagaaattgttttttcttaattgcttaattgttaaccctaggagaaaatgacaataaaattctacttcaaaatgtttatgtttttggaattacaggtacatgtagaaaccataagtggaacactgtattaactgaatatcattgagaaacttcaagcaaacatgttactgatataaattaaagaataattgaaaaggaaaagacctccttccttttttccccaaaaggtaaatgtgttttcttatagctttaactacttgctgtaaaattaaatgcttttaatttctgatacaagggagcagaatacgatgttaatattttctgtatgtcttttgatattaataatgcattgaaaatatctgcaacattaaaattctttctgtgggctttttgtgaatgctattatgtcaagccattaattgtgcacttttccaaaagcaggcagcccatcctgctagctcttgaatcatattgtgaaagcataattgtattctgtgcattcttggttgacattaaaatggtctgttagttgtgtctaaaaaaaaaaaaaaaa

SEQ ID NO: 16741 - DNA, 1151 bp, Homo sapiens
  misc_feature (1)...(1151): n = A,T,C or G
atttgttcaactcatgtgttttattatccttgatacaaacaaacaacaagagaaccctcaattggcgcaaccgagncagcaggagcttgnaccctttagacacacatcacgggcncattatatccagcttaccctccacagtcgaatctccacaacacagcaagcaatcttctcgacaatgacaatggagacaaacgctgacaccaagacagctcttatcggggtcgagtttttacatcctcagcgatggtcggcctctgagtatgcgatctcatnggacaccatcacaactatcatctattctatccaccattcaaaaaaaactacaaaaacctcggcccctcaccctcggttcctcaccctgactgcgacgctcctcacctacgcagcctctcccctattacatagagcgacttcaattcacatagatacccccccctcacctcgacctctcntatgcctacctcagactctacatacagcctcgctatgctcacgccgcccactcaacctatcattccaacagagaccgctccatacctctgcccattcccctcactaacctcatgtgttactatatctgcttacactctacaactctccttatgttataatatgctccctccacatagtgccccttaatctcttaatacacagcgctcctaagtctgcctgcgctcgtccctcctacatcacgtctgccgtcttaaccctcattacgcaaaccacacacataaataacancattccttcttaacccacaacacatatctcatccacccctcctgcgtctctcacacgtatatctatcactcacctcacccaattacaaactctacatgtcacaaccctatcacacactaccaccaacttcttccgactataaacagaaccacacgcactccacactcttttactatattcagcgcacattccgcactccctcccctcactatatcatcctcatcattcacccttcacttgacgtccatattcgacgcaatancatttcacgtaccactacattcttcttatgccaccatcaacactacccgctatacacaacccgacctcgctcgcagcccttataccttaacatcacatactatctaattactctccgcacacactacgctacaatctaacgcaca

SEQ ID NO: 16742 - DNA, 1205 bp, Homo sapiens
  misc_feature (1)...(1205): n = A,T,C or G
cgtnttattaggtcgcagtngtcgctagcacnttgacgtacgcatatctggtgagagagtcgagtggggagagtggtgatgcgggtcgtgtggcggcggtgcgtgcgtgcggagtgtgctgtggatagtgaggtgatagtctctcgcgggtgcaggcgagcgaggtatgtgtgcgagcagcgacgacctgtgaggggtncggcgtgagcggggagntgagagaagatggagcgtgcgtgtggtaggtgggtgagggggtagtgcgctggtggtgtgcgtaatagtgcgcgggcagagagtgagtgaagtggtggaggggaggagcggttggcgagcgcggagggaacggacgcgaggaagcggcgcggggtgtgtagtgaggggatagtgggcgtgtcggggcggggtgagcagacgcgtgatggttggtggggggtgcggtgagggagagggagagcggcggacgcggtgagggcgtaacagtataagtggggaggggagggtggagttgtggggtatcggagtgtgaggtggggggtgcggtgagaagcggggcggaggagaggagaggggagtggaggggtgggggtggtggaacggaggaaggggggagggaaggaggtgtgggtgtctggtagggctctggcggtattttctcggtgtgggggtggtgtgcgtgacgtgcagtgggggcgctgtctctctcgggcgcgcgcgctcactgtggtggtctaaggcgtcggtggtgggggtgggggggggggagggcgtggcgtcggtgggggcgttgtatattacaaaaaaataaatatgtttataatcattcaatacaatcttgattgtaattgtctaaacactcaagacaatagattaaatatgttatttantaagtaatgcagatttgtatttaagtgttattaacataatatagaagtgacatgctgtcatcccgcaatgcctaatagtgattgatagcgacacttattgcccaagtgtctacagtcaagataatttcatctatcactgttgctaggctcttgccctagtaacgcaagacatgtagtagttctgttgcctatgaggatcgatccttaagntacctgccctcgtgccttgtcttggtcacctaaggatannatcttcttttattttcttctattttacttatatcctcccncccctcncccctaccccttccttccccc

SEQ ID NO: 16743 - DNA, 739 bp, Homo sapiens
gtcagagactccagtcaggcacgtggtgaaggaagatttatggcagaaataggaaaccgatgtacagaaaacagaagtaaggtagagaaacaggtagattggtacaacttggcttttgccttattgaacacagtttgaacagttggccacatttgatcggccaaaactcagtgattggcacaagagtgggctacagtctgtttacaattccattcaggttatagttcacgatttaccaagaaatttttaggctgaatttaaaatacgtaaggaggtagctttaagctaaacttgatttaacaatacacatgaatttgaaagggtaaagggagaatatacagagtgagaaagaagaaaaaaccacaacccataatgtgaaaggaaaatatcttgggccccttcaagctgggaactgctcagggcaaatctgcctcccattctgttcaaagtcatccctctgctcacagagatagatgcatattctgattgcctccttcagaaagacttatgagaaattcaaaagaatgcaaccatctgtgtctctgcctttctgggtggaactaacgtacttcttacatgtattgattgatgtctcatgtctccctaaaatgtataaaaccaaactgtgccccgaccaccttcggcacgtgtcatcaggacttcctgaggctgtgtcatgggcgcatcctcaaccttgacaaaataaactttctaaattaactgaaaaaaaaaaaaaaaa

SEQ ID NO: 16744 - DNA, 462 bp, Homo sapiens
  misc_feature (1)...(462): n = A,T,C or G
acaaaccctcaaagaaacagaaaaacccttatgtgaccacgccagggctggcgagaacnaccnnnnggaccaggaagacaagggaccnaactnagatatgggggaggagaaagcctcagncagcnngggggccagaggacggcaaggcccccataccagcnccggaaagcgcccatacggacagnnacaagaaagaaaaaaaaccgccactaacncgaggggcgcgggcaggccagggacaaccnaaagcnattttttttatcaaccctaagccttctctactcccctaggtttgaccatttcctctttgcgatccttctgctctttgctcatgattctatcatagcaccttccataatgtattgtcataacttatgcacctcacatgtaggcacataattatgactgactttagtagaaacctgaaaaaacaacaaaacaaatggccttcctcggcctcag

SEQ ID NO: 16745 - DNA, 1058 bp, Homo sapiens
  misc_feature (1)...(1058): n = A,T,C or G
ctggttctgttgggtcgctgtgctctggtcctcgtcgagcgtcttgttcctctttgngatgctgtctctggcgtcgtgcgcccgttgagggcctgccctcgtgccggggttcgcgcttggtggtcctgtggctcgtgcgcttggtcggaggccggcggccgcctttctgtcgcgggccgctgctttggccgcggtggctggtgtggcgacacgcctctctccctgctctggtcctgtggggcgggcgcgcggcgggctccggtgggactgcgggcgcggtcttcttgtgcctgcgcgnggggcctcgcgtttggccgttttgcggtcgctcgtcttggggctgtcgcgtgggttgcgtgctggctctggctcgccggtcctggcctggtccccttttgcagcggggccttgtgtcgcggtgtctgggcggggagccccgcggcagccctgctccttgcgctcgcgttgtctttgggnggttgcgagccgtggtgtggctctgtgctttccttgctgctggggccctctctctgtnnccttccgcgctctgcgtcgcgttcctcgggtgctccctgtgcggtggcgtcnngccgcccggctctgctgtcctcttttnccttcttctgggggcggcnggccctcgggcccgtcctnccctcccttctctctctctcccgcnnnccctcaaacaaaacttctctttttcttctcttcttctcctctcccctttcncctttcttttctccctcctcccctcctctttcngncctcgctctctgccctcttgcccccttcgcccnncccttctcgcgtgngctccgctccttcttgnnccctccgtcngccccgcccccctcgcgggcgctcgccctctnnncctctctcccctctccctcttctctccncccacctcctcccccccgtttcccctgtcttccccctccnnnnggttttccccctnaaaaggtcccttnctcnttgtctcccctctagcgtttttcttctcttctttctcttctttctctcttannctnnnnctnnnnnnnnnnctctttctt

SEQ ID NO: 16746 - DNA, 737 bp, Homo sapiens
  misc_feature (1)...(737): n = A,T,C or G
gataaatattatgtgtaaataaacatggctacttttcaaagtaataaaaattttaaaataatctgtattttttataacagcagcacaaaagtgtatcaacacagagtaaggattanagttttctgaatcctaatctgaaacattgcttctgatacatanaatcatagtgcatgtgaagctttggaattaaacagactaggcttggtttatggctctcaattttttaaggagtttgggaagcaccaacctaaggcttcacttaaaagttttaaaaatctaattaaaaaaaattcattcctcacaaagtatttggaactcctaaggatgtcattgacatcctaaatagttaaaatattgagtagttttaaggtatatttgtggatttaaatgtcttattgaatgtgctaacttgcagcagggtcttttatgtgttcagaaaaatataagaggatagaatttcagtttatactgaagtaatgaccacaaatgctctaaatgaatgcattaataaatccaaaataatcaggacattcattccattaaaatgtcttttaaatacctttttaaggaaatgattagccttaacataacaattgtttaatactagctattgtgacaagaaacatgtggctcttgctaaaattaaatgtcataagttgtttagagtctctcagttttctgaattgaaaattataaattacttttaataaataaccctgaaaatgtaatgccattcc

SEQ ID NO: 16747 - DNA, 952 bp, Homo sapiens
  misc_feature (1)...(952): n = A,T,C or G
ggaggatgagtgaaaaagcgatgtgtctatatgtgttaattaaagactaaagatctggaggaggctatgcactgcagacactattaacagaatggagtccatgtaaataaacaaaggggtgctcaaagttaaagggaaaggcaacagatttgtttggggaagagcaggagttcatggcggtcacagacataagaccaaatgtagcttttcacggaaatagattcttttctccacggtgccatgatgcttttattattttgggtgtaattaatcataactggaaagcatttcacacccttacaagccctcagaggttgaccattattttccctatgatccacccacaaacgccgatctaacactcaccatgagtctgccttngactatgaaatgtagggaagactaaagaccaccacctatctttacccaccaggccttctgtgcccaataaacctgcagcaccacctccccccgccgacctattaccattctacatttcaaggcttgtgaaaccttccatcacgattacttagatttacctccgctctgcagactcttctcaagcctattattatgttggccccttgctgtcactgtcatgaaaaagttgtttctctatgctcgatgattatctccgaatctatctctcaatttgcctatctcatttcccctattaatatagcctagaattaatacgcaacgctactcgggatcgcacttaaatctatttctncgctagtagataacctatacaagtctgccgcnaaaacgcaccaagaacgatctatgtaatagtncaaacgacggacctgagcagaatatcgtatcacccatcaatcgcgtcgagcatcccccgctgcctcataacgtcgtcaataggaatattccgtacaactaaacatcaaaatnttaatacataacataaagcgctccatacattacttccctcacg

SEQ ID NO: 16748 - DNA, 956 bp, Homo sapiens
  misc_feature (1)...(956): n = A,T,C or G
atgtgtgttgatgtgatgtggagacgatgagtagtcgacaacgattctcgaagctttcaggggttgtgctgtgcgtggtgtagatggctgtttattggctaggggtgaggttgtgtcggatctgtgtcttatgaagctatggggagtaaagaanatagagtgtgatgaaaggaagagaagagaaggagtgatataacgtgggtagattgacggtaggtgcggtgagtggtgtgggttattggttgtggaggtataatatggaatggtatatacgtacagggngaatagaacgatcacaataagtggatgtgaagatataagaatagttggaggaagtacgaatcgtggtatgagtcagacgatgtaaaaggagattataaggttattctatatccttgcggttattatggagtaaatggaaggtgaggtggaaagaggtatattgtatgagtgtaaatggggatcgaggatgtggggtgtgcaactacgagttcggacctgagctccagagtaatgtatatgtcgagactaattgggacgttatgacgcgttatataagaaaaagaaagatattacaacagccgtacacccgatactaaaaactcaaggcctattttaagataattagtacaatatacaataaaaaagnnttaatnaaaaaaaaaatcttttattatacctttactataacaaaatcaacaaaactacaaataatctaaaaaagaatccatctgttcctttacgtcctcttttaattaataatacgaaacccattatgcaaatagtgtcttcagagcataacctcatccaaatctttaatcataaattaaaacactatacnctcttctctttttcnctcatcctcccgtgatagcctaaacgtaaggtagcgagtactncaccaggtttttttttttttttttctttttctaatncnnctactncccttctctcta

SEQ ID NO: 16749 - DNA, 734 bp, Homo sapiens
ataagaaagtgtacctgtagttctttctgcagaaccccgtatttcagttttcgcaaatacaccacacacgcacccattcatggtaatataacataaatatgtgtggaatgtgatttgtgtatcaaaagtgttaaaattgttttgtgtcttaaatggcaagcactgggcattagatatcacaacgttttccacatttcaatgaactgtaggtactcagtgcaaagtaccttcagtagtgaagataatgtgttcaaaatattgatgattacgctctacgatgttcctatgtatattcacttggagcaattagagcatatcattgaaacatacatctatattttcgcgcgtcccatatggtccaaattatttgtccacttgtgtgcctctcccacaagatagtgatttcttcaatagctattctctgtgacttatgtgcagtcaccccccacataacaacgttttgggcagtaatatcctgtataagtgatgatgatcccataagaatatagtggagctaaaaaattcctattgccaagtgagaccatagctgttgtaaaatcatagcaagccaatgtattattcatgtgtttgtggtaatgtaggtgtaaacaaaccaactgtgcttccagttgcataaaaatatattacatacaatgtatgtccagtacataaaacacttgataattataataatcaacaactgtttctggtttgtgtaaaaaaaaaaaaaaaaa

SEQ ID NO: 16750 - DNA, 841 bp, Homo sapiens
  misc_feature (1)...(841): n = A,T,C or G
ccccgggggaagatacacgggtagaccggagttcgaggacaaacctgggccacccattaagccgaagaccccttcaagaccatcagccttagcatattgctatcactacncacgagaagggggggatggacacaaatntccacaaagagaagtgtatgaccccgtctccagtgtctccattcatcgtgctactatgaggacagatatgagattcacggagagagaaaagggactaaaacaaagaatacaagggcctcaagaagaatggggttatccgaggggggggccaagctaccttaggtgacagcgagaaaaagacagcgcccaccgtgatatgagcgagggggcggcctgaggggaaggcagcaggtggcctgcggaacgtcaacaaacccaggcagactggagagcccggatggaagctcgggcaactacacggaggtggccagcctcccccaggggggacggctgctgccggggcgggacggttgactcggggggggggagtgggaagccgggggggcgcggcagcctggtcgcggcataacgttacgccgcgggcgcgggggggggtccgtacggcccgcgcgggggggcgcgctacgcgcgggaggcgaggcccccgcggcgcgggggtagcgcgcggtgcaggcgcagcacagcgtcgcacccgtggacccaaccgggcggcgagatatcggggtgtgcgggtagctgaccggctcggggtgacagccgcgacccgccaccaggacctggccggaggggggggcgcggccctcgggggggaggccgccgatacggggagggcgggtcgcgcggcagacgcgagccgagcagc

SEQ ID NO: 16751 - DNA, 701 bp, Homo sapiens
  misc_feature (1)...(701): n = A,T,C or G
ctgcgatgtcgtgatcgctcatatagtgtacagcgcgcggtccatagactgctgtagcgaatatcggtgatgcgcgactcgctgacgactgacacagatcgtctgctctcgactagtcagcacgtagctagcacgcgacgtatgcgcgcgcgagcgcgccgcttcgcagaacgcgcgtgcatgtacgtcagnctcgtgtctgntgtagacgtatgctggcctgnctaactanacacacnggtagtgagttaggctatacgcagtcctgtacgcgacgctagagtacttcacttnaccttgtgatgtggagatagctgcgtgtgcggtgtgacacgtgagaatagtacgaaagactgcgatatangtgagtacgctagtggtcggagaggcacgcgctctcgctgcctcgagtcgtcggtgacgcgacgcgcgatcgtacgatcgtgcgcgcgcgcgggatccatccttgcaccacgcgcctgctgccctgccggggtcgtcgtggagcacggcacatggtctcggcgcaacatggcagcgcgtaccctgagtcgtcgcgcgtgccgagcgccgcgtgcctgtacgccgtacatgatggctgcgcagcaggccggcggtgggactaacggcgcggcggctgtagtcggccggtgctgacggggcaggggaggtgcgggcataatgatatgagcgacgccgcg

SEQ ID NO: 16752 - DNA, 745 bp, Homo sapiens
aatggtgggcccgcccttttacactaaaaaaacataggctctggccagccacagtggctcacacctataatcccagcacttggaaggccaggcggggtgatcacttgaagtcaggagttaagcccagcctggccaacatggtgaaaccctgtctctacaaaaaatacaaaaatttgcagtacatgggggcacctgcctgtaatcccaggtactctggaggctgaggcaggagaatcacttgaacccaggagtcagaggttatagtgagccaagatcatgccactgcaccattccatactggacaacagcgtgagactctgtccccaaaaaagaaacaatggctcctataataaatggcctaatccaggtatggagcagaaaatgtacaagatgggcccagggcatcttgtggcggaaagaaaatgttaaagattaataagatgtcaggcacagtggctcacgcctgtaatcccaacactttggaaggccaaggcgggtggatcacttgaggtcaggagttcaagaccagcctggccaacacagtgaaacccagtctgtactaaaaatacaaaaattagctgggcgtggtggcaggtgcctataatcccagctactcagaaggctgaggcaggagaattgcttgaacctgggaggcggagattgcagtgagccgagatagtgccattgcactccagcctgggtgacaagagcaaaactctgtcccatctcaaaaaaaaaaaaaaaa

SEQ ID NO: 16753 - DNA, 301 bp, Homo sapiens
attgctgaagaaatgcgcggacttctaccaggaatctttaagtccaacttttcagaagcgcatgtgttataacatgagattggcactatgcggcactcctttgccatgaccctctcttatatggggacccacgccggcccctcgcaaatggcattttggatctctgctctctccagaatcctcaacaagacggacctttccagcgattccacctctcgacctcccccacctagtccctcgtttccttctcggcaagccacactcgatctccctttcctcccgggccctcttgtacactaac

SEQ ID NO: 16754 - DNA, 174 bp, Homo sapiens
  misc_feature (1)...(174): n = A,T,C or G
agggnnnnnnnnnccttntnttttttnnnnnnnnnnnnnnntnnnnnngntnnnnnncnnncnncagcncnnnnnnnnnnnnnagtnnncccnacncagcccgcccccccnnnccnttttcttccctaacacccccccccnnnncncncccnnncnnnncccccttccttcccc

SEQ ID NO: 16755 - DNA, 747 bp, Homo sapiens
ctgggcccagggtaaacattcccctttggctcaatgtcagattgaccaatcaagtttaattgtccatcaactagcatgttagtctcttgccttccagtcctataagggaaattcaacatcaaagtaagaagtttaatgctccctgttcaaaataagagagagaacaaacccccacccttttcttaggatacttcctttacaaaacttgtacattctctctttgtctctttgaaatgtaagtctctttcaaaagttaaattaacctcttgccagctttacaacacaggaatgtatttctcaagaacctgagaaccatctctttgaaatgcaattatccaaaaagctagcactcctatcttccagtttttgtgacacggtataaacctaacttcattggctgccttgctccaaaactacctcctttcagaaaaatatgagtttttttcctttaagcaaaattaataagctaatgcagaagttcactctaccagataaagttcaaatgaaccatatgtgactaatggtgctctgaagtcctcttacttgaggactagttattgtttatcttgagaacatgtatgtaatgggctgtatctacttggctggagaaggggctgagatttctttctgtcttcttgatcacttaaatgaattgcatgatgtatgttatattctggcttattaataattctggttatttcataataaaattgttttctttctcttctgcaaaaaaaaaaaaaaaaa

SEQ ID NO: 16756 - DNA, 1381 bp, Homo sapiens
  misc_feature (1)...(1381): n = A,T,C or G
ttactggcgccgctgctactcgattgctcgttactagctcgtgattcactttactatctggagaactgttgtagcgtcagagnacgcgtgtcgtcgatgtanttatgntaaggtctatgtcacgtcatgcttgcgcgacactatanttgatcctatattgatagtctgctctatctccgcgcgcgcggtgacattgtctcctctcccggtcggctcatgcgactgctcgtgcgctccccggatccactgtcacgtgtctgatactattgtcgtggcgatcgcttagancttagactctatttgtataatgagccgagaaggcctgcgacgatttcatctcatgtcctactcgtgaactcccacattcgtcccttattgcggcgcgtatttctcgcgcgagagcggcgtgagtgcgctcaagtatctccacctatgcactacgtcgctgtactgtgctgcgcgcgtcgctgtacgtgtggcgcataggccgctgtatatctcatcgtcgcaggcttctcatcgtgtctgccgcatatgtgtgtcatacatctacttgatcctgctgttctcgctctcacaccctgtcgcctgattacttctctatgcgtcgtagcctgctcgcagccgtcgttctcagtctatagctgcatcgtttcgctactggtcgcttcnttccgcgtgtgcatangctttacatctatggctcctcgagcgtgtgttctttcacccgcgcctcctttacctcgcggtctccttgtcctttgtgcgactctgtgtagtgtaccgctctgccgcggcccgctgttcttggtcacgtctatgtgtagacgtcattgtcgagttattcgccttgtggggtctttgtgctgctgctgctactatcgtgttttcatgagtatcgcgttactctccgacatcgtcacgtttactctatgggctgtcgctgtctgtctatgaacgctattgtctctcgcggtacgttgtcgccgctgaccgccgagatcgtagactcttcgaggtattcgtggttatagtatcnggcctgtcggtttcgggcgtcatcgagctgtccctattcttcttgccangaccggccgactgtaactacccactttcgtctcgtcactctgccacttggcagtcatagcgtctcgcgtcgcttgtctattcaccgttgcgtatgttgcctctcgtcgagagcaattatacaaacgtggcgtggtctttctgcttcttccctaataccantgtcangannatgtgtccttcngtngtgtcaaacagtctgtgtggnagcgttttcccgcctccacgcactttttcctgccttgtgtttgcctcctagttcttagtatcactcctgccgtactcactgcacacc

SEQ ID NO: 16757 - DNA, 1016 bp, Homo sapiens
  misc_feature (1)...(1016): n = A,T,C or G
aattcatggtgtatatatgttattataggggatctttctgcgagctacttctggcgtggtatgggcatggtgaggtatggtagtagcgagtgtcgaaagtggcatangattacaacgtggtggctcgtcgggggcgcggtatggtgcgtgctcggagggacattattggtnacccctataatagatctcatagttgnaatatttatacctataactcttgtcgagcaacaacctgctgggtgcacggcgtagagtaacgggactgaggtagcagtcaacattanaaaaacctcatagagtcacgactgagactctctgggtgggttgatatttnactgtgtgttaggactccnggattgggcgcgacaagtgtagctttggcgcttntggccatcctctaagttaaataggatgagcacggagtaatagaggagttcgacgataagagacgangagtagcaagaggcttgcggctacgggangctgtgggcctgataggggtacggaacgagtagagttgatagtagaggnggtgtctctatgtgttcgtcgggttgtgggatcattggctggctttgctcccctttggtcttcgatttaggtctatcgtggacatgcttagaaactgggcttgccgcatgctggttataagnacttaatactgtaattttcattgacatggtctancacgcgaccgcctagcnnncctgtactaatcttaccaccaactnangcacactctnnacttatttcctgcatctacgacctttttctgtanatcgcagatgccatcaaatgactcttncatgtcttgtttctcatacaatcagtccacagacaattgccttttttttngctttttaattgttctctgggtttcccttgtatctccgctcttttgatgcgtanactcacgtgcagcgaggatctaaacnncttcactatttttgctttctattnnttctattcctcctctntcttctctccttctcttcctctctctncctncatcccca

SEQ ID NO: 16758 - DNA, 743 bp, Homo sapiens
  misc_feature (1)...(743): n = A,T,C or G
cgcaaaccctagcaaaactaccgacctttcttcttattccaagaacacttcactagaggcacctggtctcggaaatccccgtcgccaggctaacgcttataaggcaacagtaccctcataatgctagntatttgtcatcttcgcctatatcccacacacgttcctctctatggataaactgaccaagaccataggcacatcaggaaagttcttaatgctagctctgtggcggttctctactaatgcatgaccgtgatgggatcaagggtagacccctaactcaaaaggaaccagtgtctccaggaaagatgccagttggtgatgaatcctgtaactgagagggtctggtgtatatcatgccatgttccagatgaataagcagagagccggaaatgggagagaccattcagatacggaaaaagtagcaatagttcctgcctttcagttccaatcttcaggagtatcagttgtatttcatgtcttcatcttcaatgcccacatgatcgacttgcctgttgcctccttataatatccccaatttccttgaactcactcgaatgtgtggttggtttttgcaatgagaagagccttggctagacagagcactaaaaggggtgggcatggtggctcacatctgtaatcactcgaacctgggaggtgaaggttgcagggaactgagattctaccattacactccagctaggcaacagaatgagactccatctcaaaaaaaaaaaaaaaaa

SEQ ID NO: 16759 - DNA, 982 bp, Homo sapiens
  misc_feature (1)...(982): n = A,T,C or G
aacccagcgcaggcggggggcgcgcgcagcgggacgcaagggaagacctggagagagncnacccctcaggcctgaaaagggacgaccacaaaacaagacatgagaagagcacctgaactaattaagccactggagggagaggcggaaaacaggagaacagcaagccccctacgcttcagagaagcaaagactagatcgtgactcaacttctcaatagactcgactctgctgccagcagggagtgtcataacccactcaaatggacgatagccgtgattttttgtaaacgaggggaaaaacgaacggaccgcagctcgtggaacaggaagacgcagcatacggagacccgcatgacaatctaatggcggggctggagccagtgatgcccgtgtcttgacggatattggggtccggttaccgcacttgtgcgaccacggagacaccggttactgtccgcgcggcccgcgcgtgccctccccctacgcgcctcgccgtcaccccgaataggcccgatcaatccccctcctaaacacctgaacgtagagcgccgccccacggtgccaggcaagcaccggccatgcggcgcagatttcaaccctaccccgcgtccccgcggccggcgcgggaaccgagcgggacggccccgggagaggcaccacccagggagtgcgtgtacggggcggggtcggatccggtgccctggatacgacgggcgacgcatcgtcgctcccccctcccgcacaaagatacgacagaatcgtcgccattcacaccgtccactcccgcccccaacacacgccatcccagaccaacgcaatccgcccctcacgagtcggttagcgccgcgttgatgccccacacagcacgcgacaggatagcgccagccctgcacccccctgaatatcacgccggccttatacccgcggggcggtgtgttcggtgaccgaggcgcgtcgcgtgcgaggccggacggggcgcaggc

SEQ ID NO: 16760 - DNA, 273 bp, Homo sapiens
ccattggctcataatagggggcgaggatgcagactcttcttagtccataatggcttcgaccaaacatgtctgagaagagcacctgtactttcccaccctctggagggagaaatggaaagcatgcagctcgcgctcttcgtacgggtatcaataatcaacgaggaatgagtgattttactctttaataggataggcctatgctgcccccatggagggtaataactaatgaataatcaatgaatgccatgggtcttgcgaaaaaaaaaaaaaaaa

SEQ ID NO: 16761 - DNA, 162 bp, Homo sapiens
  misc_feature (1)...(162): n = A,T,C or G
tgaggccaacgaggccattttttttttttttttcacaaatccacatttatttattgatttttcgttagtttaaattcctgaggggtgcgagctagtagatattcctttatgcattcaaccctctcncnncacctcccntcnccccccnnnnnnnnccccccc

SEQ ID NO: 16762 - DNA, 711 bp, Homo sapiens
agagttgataacaaggatatatgaaatatacataattaagagctaagaacagtgcctgccacatgttattctttcaataaaggttagctgaatgaggatgccaattataatgatgaggacatatttaatccccaaaaatagatgcatatttaaaaaatagatgcataatttaaaatagatttttggatgctaaagagtagcaaaaaatggtacataaatactaaaactagcactaatacaatacaaatagttatcagtctccagtataaaaattgactgagaatattcattcgctgggacaagggaatatgtaatcaccatgattttacctaagcagttcccctaacaaaaatgtatagcgatgaattttataaaattagactttgttgtacaaatgatcaatggaaaatgcatttaaaccttgtcaaggccgggcgtgatggctcatgtcctgtaatctcagcactttgggaggctgaggtgggcggatcacgaggtcaggagatggagaccatcccggccagcatcgtgaaaccccgtctctactaaaaaaaatacaaaaattagccgggcacggtggcggatgcctgtaatcccagctactcaggaggctaaggcaggagaatcgcttgaactcaagaggcagaggttgcagtgagccgagatcgcgccactgcactccagcctggcgacagagtgagactccgtctc

SEQ ID NO: 16763 - DNA, 763 bp, Homo sapiens
  misc_feature (1)...(763): n = A,T,C or G
ttcgcggaggttgttctggtctcatgttcttcctcgaactatctatttagtgataattgcggatgatagtcgacgtagctaagcggtggagcgctcgagacctagcgaggtccgcgacatgaatgccgagatgagcgttgcgctgcgtggcaacaccctgaccgtaatgaagatgtggaatcgtactcactttacttcctatacactgtgagtcttttctctcctcgtttgaggtgacatatcttctgaattatttgccatgggtgagggcgacgtgccgccgcgtgcgagtatgcagcgagatgagggcggagggaagaggagagtgttggttgtagtgtgagtaaggtacgatgacgacgggaaatatgtaacccataacgacgcggaccaatgtgttggtcgatttgacacctgtcgtcttcctgttgttctttctttcgtttgcggtctacacttcattatagcacatcagtgaataagtcttcttaatatatagttttcttttaatttgatgtatttgactagatgtgggattgtgggtctcggggaacaaccacccttattataaagaactaaaggggcaacttcaactgtgccgtatataaagtggtgcatcccctaccggtgataggccagcatgcgtcttcttagaacatcaggcaatgagggcatgcgtgagtctggttgcagaactgagcaactggactggaagttaagttgtgtgtatggcattcaagaaggcaatcatagtttnnctagg

SEQ ID NO: 16764 - DNA, 726 bp, Homo sapiens
ccttcattacgttcatggttaacaagctgtggtcctccatatcaggaatcttcctatcaataaagggaccttcatatcagggaatctaacctatcaataaagggaacatccatatcatggaatcttacctatcaataaaagggaacctccatatcatggaatcttacctatcaataaagggaacctccatatcatggaatcttacctatcaataaaagggaacctccatatcatggactcttacctatcaataaaagagaacctccatatcatggaatcttacctatcaataaaagggaaaaaaatacacacacaacctggatgaatctccaaaaagttatgctgagaaaaatatttttattaagaggttacatacgctatgattccattaatataacattatttaaatgacacaaatttagaaatagagaacaggttagtggttgacagaggtgaaggatggagtgggaattgtagggaagttggagtggctataaaatgacaacatgaggaattttgtgatgatagaaaatttctgtaccttggctgtctcaatgtcaatatcctgtttgtattattttattttcattacacaagatatttttattggaaaatgggtaaagggtctatggaatctattatttcttgcaacttcatatgaacccataattatctcgaaataagaaagtttaaatataattttttacaaaaaaaaaaaaaaaaaaa

SEQ ID NO: 16765 - DNA, 1067 bp, Homo sapiens
  misc_feature (1)...(1067): n = A,T,C or G
gagggagtgnnaagnagagnnnnnnnnnaaagattaggaggaagggaaggnnnnnnnnnnnagnnnanagnnnnnnggnnnngngaaagnagnnnnannnnnntnnnnnnnnnagnnggaaannnnnnnaaggnannnnnnnnnnnangnnnannnggggtnnaaaggacgatannnggnnggagaaagagagggggggggagggtagaggggtagaagagtgaaaagtatanagattgttagggtagagggaggngatagagnaaggggtattagacaaggggnnannaaaaatagagtatgagcagaagganaaagaacaagnaaagcnaagaagggcaaggaaagagccaaggtagaaacccaaagaagaaccagcacccaataacaacacgtccgccacaggacacgtgaggacacccacctacaaacccgccccccacgcctccccacacgccccacccccccctcgttgtcaccacgccaaacgtacgagatacccttacatgtccctctctctgtccccccgcccctctgcnccccccacactacccctaaccaaattcccacgctaatacccgaccgcagggggtccccactagcctagccaccacgccgtcgtccgcgccgaccaacaggcgcacccagcgcgccccctacaccacaacgcacacccgccggactcggcccacaccagcacaacctccacccagcagcccagcgcagtagcccaacgccccgaccccgcacgagacaggggagccggaggtagcccagccccccaacatcccccaccgcacacaacacccccaaccgaccacgcgacccacgcccccctgccttcatccccagcccaccccgcgccccgcccgacaccagactgcgaaggcacgctcaccgcacgcatctccccaatagacacactcgcctaatcgtcactgtgacgaggtacatgcacaattcctcccctcatctagagcgcccctcctccgcccacccagtttccttaaacaccgaccccgcgcgctcccaccggtctatagaatatcccccccacccacacgccg

SEQ ID NO: 16766 - DNA, 822 bp, Homo sapiens
agaggagaagaaggaaaaaaaagaggaggaaggaggaattaaaacacaagaacacctgcactgacgccggagtctgttatcagagtgacagcatggtcagcctctgctgaggactgtcttcagggttgcagactgcagacttctcattgtatcctcacatggtggaaagagcaagataactttctgcggtctcctttagaagaacactaatttcattcatgatgcctcctctctcatgacctaattatcttccaaagtccccacctcctaataccatcacactggggtatggatttcaacatgtaacttttggtggggagtgggagaggagtacaagcattcagtccataataactacataataaaaatatttaaaaaatgaaattattaaacaggaacacagtacacataatatgataggacaaagaccaaatatattctatatgttaataaaagtaaatattcattaagataaatcccagaatggatcacaaagcatatccaactttgttatatgtaagaaatacatgtaaacaaagatattgacagagtttaagagttaactacacaccagagaaatacaaatgcaaagaaagcagcgacggatatcttaatatcacacatcataggaatgcaagacatatgttattaactctggaaggaagggtctttttttcataaaggatgtaattccgtgtaacataatatagatagatagcgtcgtgccgaataatacagaagccaccttaatgaggcagaacttttgacagaacaattatgcggtaatgcgaatagtaagggaatgtgatccacttttctctg

SEQ ID NO: 16767 - DNA, 1673 bp, Homo sapiens
  misc_feature (1)...(1673): n = A,T,C or G
aaaaaaaaagggttannnnaangnnnnnnnnnagantnnnnnannnnnnnnnnnnnnnnnnnnnnnnnnnnaannnnnnnnnnnannnnnnnnnnnnnnnnnntnntanatnnnnnnnaatgtttataatattnnnnannattnannanntnnntnnnnnnnaannnnnaagttttttattagaattngannntnantatanaatngananantnnnnttnngattggnannaaatanngntanannnannnggtggntannnnattannntttnatatttgatatttnntatatntagatgtgttatgatgtagttgtatgtcagataangatgagaggnaattgttagaatagtagtatgataattattggtagttgtagtacagtagatgtgattgtatatgagtattgnnttgtgatagtatagattgttatgtgagttgaataggaatatgtatttgtagnagtaaattatggantnnnattgtgtgttgattatttgtatatangtaaagtttataanagaataatnaattggtgactntagttgnnaaaatgtaanaagtatatatataactatgatntnacgtagatatngtagtaggaacgccaccactacactgaaacagcaccatcgaaccncagacacaanntccactctagcagcgtatattcagagcccnctcgctnctacgctcctctacatcgcttcactcncgcatccgccccacanagacatcacgcagctctcgctacatctcctcctctntcttttgctnctctccctcgctcccctcttcctctcacactctcttcttcccacaacctccacctccttctctcgtctnttctatactctcngcgcctcacttctccactgtcngttctgtccgcaccgtactccgcgctgcgccgcgtctctccacactangctnantatgaatttccttgtacgtcacgcgatcagaccttcgtatcctgcgtcgcggcagcgcacgtgacgagcggcgcgacngtagcactacgtctgtctacgccgcgtgtacagtgctcgtcatcgcctcaccacgcgcgactacctaggtacccgtactganctgcgatgctgccgnccggtcagacngngcggcgtactgccgtgaggtcgtcgcgacgaccgcatagcccgcactgatctccccaatgatacacccacatagacgccgcgctagtccantcgccgcgtacncgcagctgtctgcgccggcgcgctccctcacgcgaccacatgcacttcgtctcgcagcccgtgcgcactcacaccancatctaccgctatcctcatgtctctcgcctctatctctccttgctcacctctctcgtcactctcagcccncgtatacgtctcgcatcgtcgtcgatccacccaccntgctcatactacgctccgtacaccactcaatcgcgtcncncagactaccacgcgcgcgacacatgatgccacgcacacatagcgtgatgataccactcgactagtgttcccgcgtcactagcgtgcgacgtcgcgcgccgcaacgctctcgtctctactntctgtatattatcatgaacgtgcancgtctcgtcgtagcgcgtcgctccgactcactntcgcacgttcatgatgcatcctctctcccctatcagccttatg

SEQ ID NO: 16768 - DNA, 787 bp, Homo sapiens
  misc_feature (1)...(787): n = A,T,C or G
ctggaccacctgagattcaaatatgtttatcaaatcaattaccttggatgaccaacttctacatgacctgccttcagcttctccatgtcagtcacctacaatcagggcatacctgaggccatttgattttttctaccgtaaatattttctaccttcctgcctgctttcaagtctctgaaaaattatgcctggagaatataccaagatgccatcggtgttatattctaccatggaacctggttatcaactgggatgtggtacacatgcaggcaccctttgacttgttcctcacagcttgatgagtcttgattttcatgataagtcagcaccagatctaaacttcactctgtttgcatgaagttccttggctacttattcttttctcactgctataaagaaatacctgagactgggtaatatataaagaaaagaagtttaattgactcacagttccacactgctggggaggcctcaggaaacccacaatcacggcagaaggcaaaggcacatcttacattgcggcagaagagagtgaatgaggaagtgccacanctttaaaccatcagctttcatgagaacttactcattatcatgagaacagcatagagggaactgtctccatgatccaatcacttcacaccaggtccctccctcaacatgtaaggatcacaattccagatgaaatttgcgtgggggcacaaccaaaccttatcaccagagttttgttattggtttccatttgttagcattggtgggggaggaagacattcttcttggcacttttgct

SEQ ID NO: 16769 - DNA, 1042 bp, Homo sapiens
  misc_feature (1)...(1042): n = A,T,C or G
aaagaaaannnnnnnnnnnnnannnngnnnnaaaannnnaananaanttnnnnannnnnnnnannnnnaaannnnnnnnnnnantnnatttatttntaaatnnannnnnnntatgtttagtatnnnnnaanatgtannnnnnttnnnatnntnatnnnaaattaaatataataattttaannatgaaatttgtatttattattaaatgatttaatatttgaagatgtaatattaagtggtgaatgatgttttatttttaagattaaaatataataataattgttaattttataaatatttatataaaataaatgataataaaaaaaatgaatttanaaatacaacaaaaaaaatgaattttgaacgagaggttggaggcgacttatctgctttctttcatctttcaaattagagcttccttaatacctcaccatcaacttaaacttttccccatttccttctctgttttgctttgttatcccacatccatcaatacccttatctatttctcgatctctttcgactcacacttttgcatcttagagcacaacgattaattttaccaatttcatttagagaaggtcttacctgaaaaaaaagaacgcaatcaatctatatgcagtgcaacgtatgaccgcaatatgtagttagcaggagaaaagcaaaagcgtatgagtgcggcggcagagagtaacacgcatatacagtagaataaaaccgcatagcaaacatcccacatccaaactgagttgatctgctagtggtaagttgattagtatttaaatttctatctataagtatcgtaatgattagatcttgatcaatttaatatacaattaatataagttctcttgcatgtattattgtgtatattatgttacatcagtatgaaacagtataaattataatattacagtatcaccataatatattatctaacatgatcctccgattatagaataanaccggcagtacatatcagatatatgttctcnaccccacatcaccctcataatctaacatttcctcctcagcctattat

SEQ ID NO: 16770 - DNA, 788 bp, Homo sapiens
  misc_feature (1)...(788): n = A,T,C or G
tgccatatacaaggacatctggaagcattctgaatcctcaagatgagcactttgcaataaataaaagtttaatgaaacccagtttcggcaacaatgctgtattagttcgttctcacactgctatgaagaaatacccaagactgcgtaatttataaagaaaagtttaattgactcacagttctgcatggctggggagccctcaggaaacttacaatcatggcagaaggcacgtcttcacagggcagcaggagaaagaatgagtaccagcaggggaaatgccagatgcttacaaaaccgtcagatcttgtgagaactcacttactatctggagaacaccatgggagaaaatgcccctatgatctaattaccttcacctcgtcctgcccttgacacatggggcttatgaggattacaattcaaggggagatctggatgagaacacggaaccaaaccatatcagatgccccaaaacaaacttttgtgtacttcttgctgaagaagtgagttgatgtggattctttggaaacaattaaaaaatgtctgttacttaattggcattggtaatatgttcacagtaattgcagtttagaaatatattttaagatttagctgcaccccagaanatgccacctaaatttatagtgccagaaaacagatcattggttgcctagggaaggggataggaagaggggtgtcaattcaaagggacaacttttggggctggatatacattcacctgggtgttttcatgatggttgaagagtggcaactctaaaaaatctatgctt

SEQ ID NO: 16771 - DNA, 242 bp, Homo sapiens
atgggttacccaatgcaagtgaaaccattggaattccatgacacctgtaaaccatttctcctcttctgactggatttggcacagctaagcatggaaccagaaccagaaagccagagacctacctgccaaatgaatgctatttcaagatgtcttcgatgttgttgttttccttttaaataaaaatgaaataaaatcacataataacaccacaatgaattctgcacatgctaaaaaaaaaaaaa

SEQ ID NO: 16772 - DNA, 260 bp, Homo sapiens
  misc_feature (1)...(260): n = A,T,C or G
attaaaattgataaataatnaaattttaaatatttttaattattattaaatttaaaattatttgaataaaataataaaaaaaaatattctacataccaaaatcgacacaactcctccccttcttatcctcactccccatgtcatcccacctacaaaacaacacaaacataaaacacatccccgatcccacccaactcacaaaaccgcttcccacctaaaaacccaactcccttctataaagacatacccccctattcccc

SEQ ID NO: 16773 - DNA, 774 bp, Homo sapiens
atgggaggccttcctgttgcttctggcagactattacagaagattcagacaatcttaattcagttgtaaagacaagactacatgtgattagctcttctttctgcaatatagtaatttacaaatcccaacaggaagcttgacatgtttatcaagtgatcctctttggtagttcctgagcttcaatgttatgcactctcccataagattactccaagtctgctggccttctcagacactgctttctgcatctctgtgcttggatctagaccacaatttcttataaacgagaaaatgctatagctaaaatgggccaatgtacacctcaggctgttgcttcagaggctgcaagccccaaacattggcagcttccacaagtgttcgacttatgggtacacagaagtcaagaattgaggtttggggacctccacctagatttcagaggatgtatggaatggctggatgtccaggcagaagtctgctgcaggggcagagccctcatggagaacctctagtttagtacaggggagaaatgtggggttggagaccccacacagaatcccactggggcactgcctagtggagctgtgagaagaaggccaccgtcctccagatgccagaatggtagacacactgacagattgcacctgtgcacctggaaaagccacagacactcaacacttgtccgtgaaggcagcccaggagggagctgtaccttacaaagccacaagagtggtactgccccaagctgtgggacccccatctctgtgtcactat

SEQ ID NO: 16774 - DNA, 348 bp, Homo sapiens
  misc_feature (1)...(348): n = A,T,C or G
agaagaagggagggaaggggaagaggagggtgaggagagggnggaggagaaggnngtggaaagaagnaagaggaaagagttagggataaaaagggaaaactggtaaagtaaataaacatttatttctcagtggtcttctaaggcgaagacaaagaagaaacaggagaagtgagaaaaagaatgtgcctgctctcccttcagaccccgtgctggccttggccctgggcttaaatgttagatactctcggtgggaaaaggtgtgaggttaacaaggtggagccatattgatagatttctctatttgcagagatctctaaaataaatgtcagaaatggaaaaaaaaaaaaa

SEQ ID NO: 16775 - DNA, 928 bp, Homo sapiens
  misc_feature (1)...(928): n = A,T,C or G
aaaaaggggnnnnngggannnnnnnaaaanatgnnnntnnaanannnnnnnnnnntnnnnattnnnnnnanttnnnttgtagtntttnnnnntnnnnttnnanaattttatnnagattnnnnnnttannnaannnntgnnatgtnnnttttgnnttgannngnggttagggtgcgaatgtgtgaaggggtaggatgaagtaaagaattatgtatattgagttatagttattagtgaattagtttagagtgagtttggtannnggagagatagtttataaatagtaaattgaaatataaagttnaaatgatnacgaaataanaaacaaatttcccgattgtagtgagacgcactgaagaaacatctccagctaagacattcgaccccacagagatagatccttcctcccttttcaccccctcgcccacacgcccccgcccgcacatatacccgattataccactaaatatcctccttactcttcccctaatctcacttgaattaatgcattgtgcaccgcaatactgacttccgcctgagcgtcacagttaataaagccctaactagtccccgtcaagttatagagcagcgaaccgatgcggatcctagacacggagaactccacagcaaaagagaactcagagccggcccaccaaagtacgcggccgatatttccaattccctattgcctcacagccggcgtgacccgccctgacgggccgcgtgcgacggtcctcgagagcggccacgtcccccaataaggtatcgagtttcgaaacgcaaggatgaccggataccgttcggtccatcgggcggatgatgtgacagatagtgaaccccgcaaacgtaaagtccccgtccccccagagttgagcgggggtccccgcggtggaggtagagtagttaagtgaaacaatcgcgaccaaaag

SEQ ID NO: 16776 - DNA, 682 bp, Homo sapiens
ctggctctacaggaaacatggcactagtatctgcttggcttccggcgaggacacaggaagcgtaaaatcagagctgaaggtaaagggagagcccaacctcacaaggcatgagtgagcgcaagagagagagtgagcaggaagtgctacacggtttcaaatgaccagaactcactatcgcaaggacagcgccaagccacgaaggacccactcccatgacccaaacacctcccaccaggcgccacctccaacatcagggattacacttcaacctgtgattcaggggacaaatatccaaacaatagcaattggcaacttcatatttagaattactggcattattatcatctaaatctgtttcacttcttggaaaaccagatgtattttacatagggagaaaaagtaatatgggaagtagaaatctcaataaagaatggacttcagttaacgtgaatgtatcaatttttgttaactttaacatatttgctatactaatgggaatggtactgataggataaactggatatgaggtatgtgggaaatctctgtgctgtcttctcacttttctgtaaatctaaaacagtctattaaaaaataccattggtggtggctgtacccccaactcaatcaataaagtcatttaaaaataaaacaaaaaaaaatgggctcgttggcctcagcgggg

SEQ ID NO: 16777 - DNA, 1534 bp, Homo sapiens
  misc_feature (1)...(1534): n = A,T,C or G
aaaannnnnnnnnnnnnnnnnnnnnnnnnnnaaannnnnnnnnnnnnnnnnnnnnacgtttnnnnnnaannnnnnnnnaanngannnanannnnnnnnnnnnnnnnnnnnnnnnnnnnnnnnnntnnnnnnnnnnnnnnnnnnnnnnntnnnnnnnnannnnatatannnnnnannnnnnncnannntnnnnnnnnnannnnnannnntnnnaaaanannannncnnaaatatacttnnnnnnnnannnnnnnnnnnnnnnnaantnnnnnnnntnnnnnatagannnannanantnntntaannannnttngnnantnnntaagccattgtatatagtgagtcaagatgtaatagagcagnagttggtagagngtagtattagagtagtaacgaagtactaatattgtganaatatagaggcagtagcnntatgatggagtgngatnatacgagatganaatatgcgagaatgaaatgcaagtcacgatantcnnncnatcaaaagattagtaaancatcannnntaaaaaaganataanaanantatagtaacntcgacaaaagaaannctngcaatancnacacncnanacgacagncacngcacacaggtantacctccaccatggcaaancaacagcaacagagtaatagaaactataagaaaaccgactcagcnagtaggtacacagctagatagtnntagcatgtagtgtgtgcgnacgctgtgacgtgacagagacnagtattatactacgtgccgaccaactctaagtcgtctcgcatctctncgcattatcgtcggttgttcgtcatctcacgctctctcatcttcncttctagcaacgtaatctcgccgcgacaatgcggcataggccnctcgtatcnccacactagcggtacacgcacttcagtctcgcacgcgccgctccatagaatgcgtatcgacacagcggacgcgaccctcgcacctctcacacaacagcgccncaactatangtatatagaaggcatgtaagcanagaatacnctgcacacatacgactgagcaagacgacgcacagcnaagaaacacacacagccagagaatanagaacatcaccgcgagactcgaatcgtccacgcgacacacacacagacgccagcaggacgagaccgagacgagaccgaantcagangagacgcgagcgcgacacgacacataagactccacattacacagatatagatccnctacatgatatgtgtactcacaatatctttcgaagcatcacgtcagcacgtgtcgcaatgtcgcacatgctcaagtcatgatagagtgaagtacatagtattcacagataatggtcttgttcgtagagttgctgaggaatccgatgctatagcgccggagaggcaggcaaatgtgatgcatacatgatatacantgcctcactatagagtggtgccgctacgctgcgcgtagatttacatattcttcgcccaatcgcagcaacaaggattgtgacagatttgtatgagatgagacngttg

SEQ ID NO: 16778 - DNA, 507 bp, Homo sapiens
atggctcatactgtagaacatcttgccttgtcttagatgagacttcggactgtgggcttttgagttaaagctggaatgaattaagactttgaggaactgtttggaaggcacgatcacattttgaaatgtgagaaggacatgagatttgggatggactggggtgaaatgatatgattttgatttgtatctccacccaaatctcatgtcaaattgcaattcccagtgttggaggagtggcttggtgggaggtgtctggatcatggaggcagattttctccttactgttcttgtggtagcgagttctcatgagatctggttgtttaaaagtgtgtaacacctctccccatgctctctatctcctgctctggccatgtaagatgtgcttccttcctatttgccttccaccatgattgtaagtttcccggggtctcttcagctttgcttcctgtccagagtatggaactgtgagccaattaaattctcttttctttattaaaaaaaaaaaaa

SEQ ID NO: 16779 - DNA, 1782 bp, Homo sapiens
  misc_feature (1)...(1782): n = A,T,C or G
ggggtgggggaggngnnnnnnngnngnnnannggnnnnnnnnnnnnnnnnnnnagaaaggnnnnnggnnnnnnnngntgggnnnagannnnnnnnnnnnnnnnnnnnnnnnnnnnnnnnnnnnnnnnnnnnnngnnnnnnnnnngtnnnnnnaaaggtaaagttnnnnnnnnnnnnnnnnnnnnngnnnnnnnnnnnnnngngnnngttannnannnnnnnngtngntaggannnnnnnnnnnnannagnnnnnnnagnnnnnnnnnnnnannaagagnnnnnnnnngnnnnangnnntatggttnnnnnnnnnnnngagtaggtgatgtnagtgtgngtagttggtggnantatgtgtgtgtgagtagtgtatgtgagggtgatagagcanggaagatagngagagggtgatgagatgagngcgnagtaatgatggngtnntnttatgtgacgnnngaatgacagtaatganagagtacgagagatggaggntntgngcnncgagagtagttganaaantagngnnatanagagntagatgnatanagntgagaagttagagagatnnntagagtgnnnnnnagggtgngangcgagcgagnngaatgagttgngtnanaatcanncngagtatacgcgnncgagtgtgcagatgcacagtcgagagagcgagccgncgcgatngncacgcagnancactnncncgctgcatcctacatgtcgctnacgagcgatagcgcgacgaacagtancanggnngngatacgacgacactgtgacgtagtgagnaaacagtccactctctaccgcacactgaccacgctcgtcgtacgcgctcgcccncgactatgcntcacttcacgccacataacgtctntcgacgatgatgatgctcanctactgtcntgtctgtgtctctctctacttgctctcctcgtcactgtntccacatatcgtgcnncatgaccacgaacatacgacaccncgtgtgctgagatgtatacantaatncttaccagtgatacagatgncnancgagcgtcncatacgtngacgtctnacnncgacaataatngcgcacagcgacgncancacgtcaagtgtgaataggatgagcgncagacacancacagcatgctcacanacgcgcncacagtcatcnnaanagacagcgcgcnntncgcagcacgcgacagcacnttacagagagagcgnacgcacgtaccggcacgncatanagcngtcagacagctangtagaagtgtacgacacacagcaggcgtagcgcgcactgagtgcnacgccgccacaccgcactcancactgatgacgtggatgnctgctgtcantagaggagagntcatcagaagactatgcgacgaagtcaaccagcgcgacatacgacagtcccgcgagggcgctctacggtcgccgccgcatgactacgatgagcgtgctnttacagagtgtcagacacgcgtacgagtatgtgnantcgncnagtgtctacngcaaagactgtgtagatcactacgcgctcantaccgaccgcgcgctcgcgcacgctgcgacaccacacacaacgtcgcgtctccactctacgtcnttccatgacagtatnataacgtatgtatgtaatncacncnccagtctgtcgtcgcgacgcacgccctcgtcgccctatacangtatcttatagctctctacacgttagatagtaggtgtctcncatccgatcgtagtgagagaggtgancacatgataacagtagcgngagngag

SEQ ID NO: 16780 - DNA, 763 bp, Homo sapiens
tgaaaatcctgaggctcccatacgacctacagacaaacagcaataagacgtggggcattcactcagaaacttctactgaagttgtgctgactgtattgtaagggccctgatctaacctaccaccagtcacttgtgtctccttggtcaagttgcctaccctgtctgggataatgttatttcgtcttccattgaaggggagagatgttttctttgagtcaggtaaaaatgttaaaataaatgttatgtgaagaaaaacttcataaattatgggaaaataaatcaaaatttctacaaatcttacctttctttttctacagtaaatttagttgctgtagggggtagtcaaatataacatatagctttgctcagaaagacactttatttttaaagtttgattattaacagatgcattttatttgccttattaaatatttaagattcgctcttggccgggcgcagtggctcacgcctgtaatcccagcactttgggaggccaaggcgggcagatcacgaggtcgggagatcgagaccatcctggctaacacggcgaaaccccgtctctacttaaaatacaaaaaactagccgggtgtggtggcgggcgcctgtagtcccagctacttgggaggctgatgcaggagaatggcgtgaacccgggaggccgagcttgcactgagctgagatcacgcactacactccaagtctggcaacagagcaagactctgtctcaaaaaaaaaacataaaagtggcctcgatggactcag

SEQ ID NO: 16781 - DNA, 341 bp, Homo sapiens
  misc_feature (1)...(341): n = A,T,C or G
ttttnnnnnnnnngaaaaaaaaantatattntttacttttttaatatttaaattttttttttatttacaaataaaaaaaatatgaaattaaaatcatattttataaaaactgtataaacacaaacacctaaaaagtttaaataagtgtgtctttttaccatcccgctcctccccgtcccggcggtttataagcaacctaccacattaatacagaacatacgaatcattgattttaaaaaatataaaccacatctgcagacttagctcacacacaccctgttatttccttaacaaacaagtgttgtgtggagtctagcacaattacctgcagtattacccca

SEQ ID NO: 16782 - DNA, 288 bp, Homo sapiens
  misc_feature (1)...(288): n = A,T,C or G
agtttaatcgagcaaagaacaacacaagaatcaggcagcaccaccaccccctccccggactgatattttgaagtagtcaaatttccagcttaccatctagaatgtcttcactgatattcttacaaaatctatcgtcattggaagataggctattcatgtatgttttctactaattatttagagttgtaattgtttcattcttattacttgatgttccttaaaatagcgacaaaattttcaccatatcatactttgaataatcaggtccttgtnttaaaaaaaaaaaaa

SEQ ID NO: 16783 - DNA, 787 bp, Homo sapiens
ctgatggagtctcgctatgtaccatgctggagtgctgtggcgcgatctcggctcactgcaacctccaactccctggttcaagggattctccttcctctgcctcccaagttactggaattacaggcatgcaccaccacacccagctaatttttgtatttttagtagagatggggttgcaccgtgttggccaggatggtctccatctcctgacctcatgatccacccgcctcagcctcccaaagtgctgggattacaggcgtgagccaccacgcccggccaacactaatattctttcaatatattttcaaaatatactgctgattatcatggaatgcaaattataatgttacataataaattgtcattatcatttagttagttatttttgtattaagcctctctgttatcttttatgatgtaataaattcaatatttcattatttcaccgaggtaacatcgaatattgcttaataaacactgatatttaaatatattatgttagaaaatgtgtagtacattttagatgagctattatatgttttcaaaatatggcttttgtggagatgaatataattcttttatttatatatttgcttaatctgattcataacactttacagctgtgtcctctatgaatttttaatttagaagtttctttggagatcattgttgaatgatcttgcattatgtaatataaaggcctttttttgctatgtctaacttttgaatgtttaaaatcaaccagcatttattatatatgcagtttttaattataatcacaatcccg

SEQ ID NO: 16784 - DNA, 785 bp, Homo sapiens
catggagaaaatgtggtcatggccttctcgtttcccctcagagctgcatgtgagccgctgcgcccagccaggttgtttcttttcacgttgctgagtttcaggagttctctgtatattctgtatatgaatctcttatcagatacatgatttgcaaatatgttctcccattctgctggttgtgttttggtctgttcatgttgccttttggtgcacaaaactttaaattttttttttttttttgagactgagtctcgctctgtctcccaggctggagtgcagtggcgcgatctgggctcaccgcaagctccgcctcccaggttcacgccattctcctgcctcagcctccccagcagctgggactgcaggcacacgctgccatgctcagctaatttttttgtatttattttttagtagagacggggtttcaccatgttagccaggatggtctcgatctcctaaccttgtgatccaaccacctcagcctcccaaagtgctgggattacaggcgtgacccaccgcgcctggccttttaaatttttatgaagtccaatttgcccactttttcttttgttgcctgtgcttttggtatcatattcaagcagtcattgtcgaacccaactttgtgagctcacactgtaaacaagtattctttttgttgcctacgtaatgccgcttttttcacatttggtgcttttgtgttcaatggcctcaggcacagtgctgaagtgctggcaaacgctcgagtgtgcttccatgtgcctttgaagaaaaaaaacctgggttaa

SEQ ID NO: 16785 - DNA, 1723 bp, Homo sapiens
  misc_feature (1)...(1723): n = A,T,C or G
aaataaaannaatnaatanatnannnttnnantnannnnnanatannnnnannnnnnnnanannaaaaanatatannatantaaaanatattatatnttanannatanantaaaanaatanaannaatannnnatananatatnatnnnnanntatntcctttngnntnntaggnngnntngantanggatntnnannttntnatttgnatatcatctatctataanagaatataagggtataagtatagggatnattncgtagatatngtnaatgtattattgtttgtgtngtatttntantatattatatgnatntatatttntnatttgntntattattctattaantnattattattatagtagtagtaatatatagatattgtttgagtattntngatacgaagtgtgttacagagnaggangcgtggcgtgngtgtgtgagattacagtgacgtaggtagtgtntaataaaatagatatcctatatgaaagtaagataaaataagagatgtangtgtatagagagaagtgaataatagaagagagtaaatcatgagagcaatangngtctagtgcntgacttctctangatgactgnttatgtnttactgtgctcatctgtgagagtagttacagacgatcatagtatantaattctatgtatangatanatatatagtgcgtttantaagtancactatcgtcgtttntnagtgccgtcagnngtgatatggtaagangacgcgtanatgctgcgactgatattgtatatatagcaacagcgtgtacgacacagagaacgcagaatctatacgtgtcgagatgtacacgacgaacacagcgatatgatacgctggaagagcggtatggaccgtccacacacccacatctatctccactgcattacacgtgataacgccacacacanacgccctaagtcaccgatcacatccaacaaatgaaaataagcggtacatgccacacctggcactatttgactccagtactccttgtctcacgttcactntccttcttcgcctcctttatcaacactgagacactactcgtcatataatccgacagacgcgtatgtntacgcgcacgatatccacgngaccgacaccnacgtctgtacgtgtacgcatagcatatcattgtgtgntagttatataatagatgagtatgtatatncgaatgacagcgaggtattagtaagaacatatcgtatagaatgagtaaaccgatgtcgcgccgctctagcaagtgtcatatatatatttctacatactatgcactcgccatacacaccgtcgtcccgagcacagcgttccacatccgacactcggacactagtaccactctcccgtgctctttgatacggttctattccatctgagtatgttcgatttctagcatatcttaccaatattgtaggtcaatgaatgttcnacacatatagaccatagaatcaattatacgaatctggtcatgagctcaaatcacaatgatagattcgcggcgcgtctttacgngagcagcaacagtcataagtgcttacatnancactcacagatagcgtatataattatacaatnatatgatgcatctacttatcattcgaccacatctctatattcacactcttacaaccgattcagaacgcaccacacctatctagactagatatatcttggcagcgcatatctctcgacgtatat

SEQ ID NO: 16786 - DNA, 779 bp, Homo sapiens
agatggagtgtcactctgtcccccggctggagtgcaatggtgttatctcggctcactacaacatctgcctcccaggttcaatcaattctcctgcctcaacctcccgagtagctgggaccacaggagcaggccaccacgttcagctgatttttgtatttttagtggagatggggtttcaccatgttggccaggctggtctcgagctcctgacttcaagtgatccacccacctcggcctcctaaagtgttgggaatacaggcatgagccacctcacctggcctaaaatatacattttaataatggtgacataatttggtagccaaagaaactgctttgaatgttccaggctattgggccattgatggggaattaaagtaggttgaaatctcactcagccgatatctactcccgccggcctcttcccttccttttagatatgatgcgattactaactgccctatacatcttgccactcgttacttacctcaatggcactcctactcttaacttgcaaccccacaccgtactttaataacttagagcggcgagcattaccaccgattctacccttcatcgtcgcttaatttgcttacagtagactccctgcccccttctcctgctctagtctaattatgccatccgtttgatgtggctccttcccaccaccccccccccccccgcctccctgctctacacaacccccccctccacccctctgcctccacccctcccccctccttcatccctcccatcctcctcactgacattcctccccccgc

SEQ ID NO: 16787 - DNA, 845 bp, Homo sapiens
  misc_feature (1)...(845): n = A,T,C or G
aaaaaaaannnnnttnntnataaattgtaagtaaaaaaaaaaaaaagnnaaagcttaaagacacaangagggacttttggagaacaaacattaccaactgactgaggaaaagaagactggttacctaaaaacaataagagcttggatcacgcgcagagcaatcgaattacacagacataaacgcaggacccgacgacacgacacccaagaggaatcgcaaaagccgcccgccgccaccactacgggggcacgacaaagagaaaaacacgaccgctttttttatcagccgagacagcccgcggaggcagccagaccgaccccacccgggggcgggtgtgaacggaaagagaaaggaaaacgacacccccaccccccacgcaccccccccgacccccccccccacgcccacccgcccaccaccccatagaacacagccgcaccccacacagacgcacaccccacaccgcagtccacgtaagacgcaccgcaaggcggtggaggacaccgccccaggcacaccagccccacgaacagcccctcccggccccactgacgaacgcaccgccacgcacccggccgccagggccccaccaacaccagccccccaccgcggcatcccaccaagcaccccgaccctcagcactccacaggacccaggccaaccccaacaccccaagacaaacagacctgcccacaccaaggaagacaacaaagcacccatcacgaaacaaacgaaacagcaaagaatacccccgcaccccgaacacgccacaagacaaaccaccccaagcacgggagtcgaacacagacaccctccccgcgccgcgacgaacccacaaaagagc

SEQ ID NO: 16788 - DNA, 781 bp, Homo sapiens
tttcaaaaaaacggtgacgattggccagacagcgtggatgggcacaacttggaaaacagtcatttccaactgactgtggttaagtgcactggtgaccttcaaaacaatatgtccttttctacaaccacagagtctttgaatatgactttatttcaaaaaggcgtctttgaagagataatttaaggaccttgagataagggcaccatcctggactattcggtcggtccttaattcaacaacaaatgtccttataagatactgaagagaatacagagacacatgaagaggaagaggcaatgcgaccacagagacagaaattggagaaaggtattcaaggaagccaggatggcttggaaccaccagatgttagaaggagcaccacaggctctttgcttgcactcttcacaaggcgatcggctgtgccaccaccttgctagcctactctggtctctactacagcgataagacctcttgcctctgtctccttccacctttattgcgcggactagacgttcgataatctgtcaccagctccgtacacgttgattaggttgtatcgagtctccctgctcatttccccaactcaccccccgtaccgtccactctaaggaatttaggctgttctataaaaggttcgaacatcctattccatacctgctattttatcatagaagcccccccgcatggtgcggggcgtgtgagaagcagcactaaataactctcccctaccacttctattcgttcttattccattattttcctctagactgtatccacctct

SEQ ID NO: 16789 - DNA, 1836 bp, Homo sapiens
  misc_feature (1)...(1836): n = A,T,C or G
aaaaaannnnnnnnnnnnnnnnaaaanaaaanttnnaaatggtaagtaaaaatgtnaaagagaatnatatagtaaagatanngtganaaataggatnnnnnaatatttttgngangngatgtatgagctacggtnagttatatngatatgagtgtatganattgattgaagtataatatcgtnnctgacttnnatnttnctatattgttggtgatgtnttntgatagtagtcgctgagtgatatcgtttttgagtgtntattgattagtgntttnatgagatgttgttatgatgagtntntagttgngtagtactataanatgttggattaataagctgagcctagactgcngtngacgatagtgcatatnacacnttgataggnantagtatgtcagnnaatgcagagctnatatanaaggtacgncgcgcagagcgntggaacgtgatatgcgnngnnacatcgcgatagcgatngagatanagaagatcaccactcgcgatctntatcntctggactcactgttccactgtntgtaatatgcgantgtgtttatagtnctccgtcgtgttgnntntactatcgctaggagagtntataanagcgctctgtggtgcttcttgtgntgtgctgtgtncncgcgtgctcctgagtngngcatgtgtngtttatccgccancnacanacatacgagatgtagancncaagcagatcatagctgtatgacgacnnncacnacgtgngaacagtcaagcccnctcgngcgagatagatagacgagcnggacangtcncccagcgtgtaanacgcgagaccgatacaacagctcaacgacccagcgcacaacctctcaactcgtacgcncgcgctcacgacgcgcacagccgcgcacgcagtcgcgaactnncgcggcgcncnacgaccgcggaccgcncgaccgaacgctcgggantcnactcnncncacctctactcaccgctgcatacctatcgtactcacacatctcagccntcncacccncgctacctcgtatacttctaccgctccactcacnacngcccgccactctccctctnantcgtgcgtgcacctcagacgtggtgcagatcncgtncatcgtacgctntcgcttgacgctcgatcgacgtcttcgctcacgctgtgcnntcgtctcccagcgtagcgtcagcctgttagcggctntcgcncntcgatatcntctcgagcgactccgcaccgacgacantcagcganngagantagttaagacgcnngactgctgcattcagtggcgcgagtggtttatcacgtgcgtcgtactcgtctagcgacctcccatagcgcanacncgtcagcaatactagctccaagcaccnatgagctgctcgcgcaccnccgccgcanctccacatatccaccgccngtcacatcactcacccactacctgctaatctntcctgctgcgagtcntactacgctcacgtcctcccactctctcactccgatctctcctccgtcccatcncngctctgcccaccccatcgctcgcgcagtccacatgcctactggcacagtgtgcgcgagtctgcactccaacatacatatctntagcactgtccgtcaagctctactgagncncgacgctacgagnttgctcacgctccacgcaccagtataacaccagtgatgtcctctctcacaatctcttcaccctctctcgcacgcgtatcgaccgcactccttctcattctcgtatctctccaactatatcacctctcncacagtctcacacagagcancaccacgctgtcctccantaagagatacgatgtgac

SEQ ID NO: 16790 - DNA, 769 bp, Homo sapiens
gctgagtttgctggggatttgcttcaggccctattcatctggtttgctcccacacctggagatgtcactcgaggaggctggagaacagcaaagataggtgcctgctccttcctctgggatctctgaccttgaggggcaccgaactgatgccagtaggaacgctcctgtatagggtgtctgataacccctattggagggtatcacccagttgggtggcacagggagcaggacccatttaacgaaccactttgtcccttggtctttggctcatttctatttgaattccccacacctagtgaaatgtcaggacacttaggtgttgaatagataacttcttacttagcaaatgaaacatagaaggaagtttaaaaacaaacaagtattccttttttaagttttaagttcagtggtacatatgcaggtttgttacataggtaaacttgtgtcatgagggtttgttgtacagattatttcatcacccatgtattaagcctagtacccgtagttatttttcctgattctctgcctacttccaccctccaccctccaataggccccagtgtgttttattcccctctctgtgtctgcgtgttctcatcatttaactccacttatatgtgagagcatgtgatatttggctttctgttcctgcattactttactaaagataatggcctccagcttcatccattgttcctgcaaaacacatgatctgacttcttttttagggctacttaatgttctattgtatattcgtaccatggattgt

SEQ ID NO: 16791 - DNA, 1174 bp, Homo sapiens
  misc_feature (1)...(1174): n = A,T,C or G
gagangagaggttgtaagtttgataaaatatagaatatatgtntaagaanatataaatagaaggnnttttnannnnagatangagcgnnctagagatacgtnagaattgtgtacacctatgatcacgtagctgtataaggtaactatatggtgtgagtgtatctgtgatgtacggtatggtgaaatgtaatgtgtagatggaggtagattgtatggtgtcnnatananntttagatntgcttagtatgtagttgtttctgtggtgttggtttatatattgaaatnnatctcgtaaagagtgaaagagagaggcaagatggatgagagcggacgatgtagtattgacgcgtgtgtggtacgcgtctgtacgttttttattatgttttatcttatntttgttatattttattttatgttttattatatataanatatacaataacttagtgcagtggaggtgatggtatagtgggtatcggaaatncgcctcgtgtcctcctcacctcacaatcaccagcccacaccctgttcacatagactaccccccccgcagccgcacgcgtcgtacgcactccgcgtggctggtcccgccgctagaggagtgccncccatcatctcactctctcctcgcaccgtctcgcctactcatacctgttccgtttaccttcctctttactataccatagtacgagctaactttcgatgtctgactggtctcgtgctcgtgttgccctcgttgtagtttcgaaagtgtgagtgagtttgatatgtcgcatgttcattcntcacgatgttgtctttgttcattacaagacacaacatatgataatgttcgcttctacaacgacattcccactgtcagccggcaaccgaacgtggtcgcgcgcaaataattcccatcgccggcgccccacatctcatncgctgatgttctctcgccctaccctcgtcactcgagacaacgccagcacacagtcgcagcggccgacgcacgctagcactctgcttatgctctccctcttccatctccactaccatttacccgttctttactctcacttgctccccgcagtcgtacatctcctgtgtgcccgagtcctccgttgtttccctctactcagcccgcttcctaccatccctctctgtggcgactaacactccactgtgttaatat

SEQ ID NO: 16792 - DNA, 417 bp, Homo sapiens
cctagataatgcggcaaaatcaagattgccctgacagagtacatgcctacgcttgcgactttccaccacttgaccacaagacccagggctcgtgcgcatgctctgctgcaatgtgtccttactacccatacacactccataccgtactgccggaccgtgacctcatggggtgaacaaactgattatactcttactcaaacaagtacctctagacttaacgctggtgtgggaagaggacaacagaaccgaggtggcaggtctggaccacaccagaaagcgttggcccggtgggcgctgatcggcgaaatctgtccggccatttccttttagagagggttaatgctggaccctcactaactgattgaatgccttctggcgcccgcctgcgcaaagaggcctcagtgtttcttagacgcc

SEQ ID NO: 16793 - DNA, 646 bp, Homo sapiens
  misc_feature (1)...(646): n = A,T,C or G
tagaatatagtaatttagnaaaccaaagagtttnaagaaacaaagaagatttgggggagagagaggggggggtaaaaaaatgtaaaaaaaaaggatagaaggcgaaaaaggaaaaaaaacaatagagaagaaggagagggggagaagggggggggacgggggggggaccgggggagagaaagcaagggggggcggaggagaggagagaaagggggggggagcgaaaaccagcgctggatcggaccgcggggggaagaaggagagcggcaacgaagggggcgaggagaaaacggagaaaaaacacacgcacgctacctgctcccttcatcacgaatccccaggcaagaagcagcggagaggggggcgagaataataaagtagataataaaactataacggatgagagacgtggtggctcacacgaaagaaggaggacagagcgaaccaagccccgccagaccacccaaacacaccccgcaggaaccaagaaaccaaacgcaaggcaagtgatacacgaaaatagagaaagagatggggggaagggcaaagaagatcaagtaaaagaagaggcgaacgaaagaagcaaacaatacgaacaaaagtatggcgtgacgcaaaagacaggagagagaaccggacaaaacgg

SEQ ID NO: 16794 - DNA, 780 bp, Homo sapiens
cttggaagcacggagttcgacttttagaggacttatgcccaaggccacatctccatccatccctgaagctgagttgaacctccatcacccagggaagaaaggacctagggaactagaggctcagcaatgccctggagcatctgaggtggggaacaggagaattctcctgttgttcctgccacacagcctcaccagggcatttttggaaatggagtctcactctgtcgccagactagattggagtacagtggagcgatctctgctcactgcttcctacctctactgtgttaaagacattcctctctcaaccttcctactcactggcagcccttggacacacctggaccagtctcattcccacttaatcctccggacctaaccatcactcccccccccccccttctccccccctcctcccctccctcccctcccttcttagcattttgctgctctcctcccctctgtcggacgctatatttacgcgcacctccgcatcacgctttcacttccttcctgccaccatactatatattgcatgtatctgattccaccctcttcacattcgaaccccctctcttctggtcgtgggctcaagtttctcccaccctccttctttcctcttactcatcctgatcccttctttcgcacttttctccttctccctccccccccctatcccctcttcgttcaaccgcccgcctctccgcccccccccctcccctccctcccccacatctcctcctagcgcaactctccccactatttctctatcctcccccc

SEQ ID NO: 16795 - DNA, 1860 bp, Homo sapiens
  misc_feature (1)...(1860): n = A,T,C or G
aaataggttnnnnntaaagattgtnnnngatgtgngnnnnnnnnnnnnnatggtatgannnnatnnnntnnnagatngttgnnnnnnntnangagatatgttctttannnngtgntnatngtgtanattagnntnanaatnagantcaaagtnagagatgtagttntataatatgtagctgngtatatattagcnaagataatntntngagacagtgataagattgtnatgtnatacattatagatcaatatggagaggtagatttgatatgagttagatatatgttntatagtaaaatgnatgggntgtannatatagtttagagtaganagnnanatgttggnnatnangtagcagagataacgaggtgatccgtagagagatatgaagagtgatctgctncagcacanatacgtcntantnntngtgacattannntcacggagantnannaagtgntgtacnntnnanantngaatacgatntgnncnatcatgacgacctnatggtnanngnngtatantccatcaacacagangaangannncgantcaacgaattgtcnccaganangagtcggtgnacagtgtgacactngtttgttgtgtntanatgacgattaagntatatgatatatatcacagnagttntnatcgatagtgagagtganatccgactgtgtntagtnnnnnattagagtctnacgagtacgaattgagcatatcagtcgatnnngcgcgtatgcatggcgntccgnncaaangacacacataccggacgatcacncnncancngaaccactacacgctggncacacgtcgagcaganattacgcgagcgggcagnacacnagagagatgtgacatatagagaaatcgngngtagtccnnaaccacgtacctgcctcgctctancccctatactgcgcgcgaccgagtgcacggtgcgcagcgnacacgacgcncngancgcacggacggcgngtcncngcgtcagcgntcaccacnnccaccgtgcaatctctgttgcgtcagganatctcgatcgtatcgcagcgcatcactantccacacattcacgcatcgcacgcctcgccgactgcacacgcgcacaantgcttactcgtgtctaccatgtcgacagactacganccgcgncccgagcnaccacatcgagcactgcctccgaaagtgctcacggcagcgncncnctcgtgcgcgagaatancncaagtactacacacacncacaatctactctntcatactacacactcgactcacatttaatanccancatctcgatctagtacagcgtctctantctctcacatgtcacactagagtacatacgctcntagtactaatgatcnctagagtcgcgtcgctncnggcgctcntagntcgtcgacgtctactagtccacacatcgcgcgacgcgctcatcacacactctcgcnncacttgagtgatcatccgcaccctcactgcgtcnatagcacatattagnnnnagactgtngcggtatatgctgatctaagtaccaaccactactaaacgaagatatagtgaaagacagtgataacacgcncanccgacacacaagaagtacaacacaaatcagacaaaacgaatacaactccactacatcncttcatgcagcactcatatcgcataaattancacacgttaatatcatnccacacactctacacacccacaccaaagatacatatatagaatacatgtctccagcgcaccagatgaaagtcgtcactcctgctacttgtctaccatnntattaccctctcccacagacacacacntnacaatactagtcctacactacggaagaactntt

SEQ ID NO: 16796 - DNA, 774 bp, Homo sapiens
catggctctgacgagctgacttttattgatcgcataaacggggatgctttgagctctaacttctggttggctgaagcaatgacagccgacagcaggacatcaaaaaggggatgaagaatggagcttgaagggtattcctgtagccccttcctggctggatcacaacaggctggctaggttgccttatcaaactgaaaccgcctttgcaaaattatcactgagacggtgaaagagttttaacttaaccgactccatcttgcttctaacctccttgttcgttcagcataggctgaactaactttgagagaaacttatagtttaaaacaaagatgataacagccctttcccaaagcacacctccttcttgcctggggactagattccctttgtaggactaacattagctacaagattagaaattatggtttaagagtcatgcaactggaggcttcaagattttattcaaatatgtcagtgcttgagatattttgcagaccctgtaattgccggatcagctggcaccacccagatggataaactggctaatctgatcttgaggactcccacccaggaagcgactcaccataggaagacagctccaactgcctatgattctattacccgcccgacccattcacactcccggtaaacctggtcttcccccaccccacccatctattcttatagactctgccactggcttggaccagcggactcatccctataattagaatactttttgggcgtatgcgacggctgatataacccgaccaa

SEQ ID NO: 16797 - DNA, 781 bp, Homo sapiens
cccgtcagacagaagagcatgagaaccaaggagaagagaccaagaagaatgagaagagatgaaggtgaagtgacagaaccttctgagctactccttccctgctaaatcccaggcacatgctccagattccttaggcaaaggaagaaatgaaaggagagaaagagaccaaaattttaaactctattaaaaaggactgcactgatatttataccccaaagaaccaatgatgccatgggatctaaccaagatattaacagatatgaaaagagattcaacagagtagaggagcttcagatatatacctgtcgtggtttggctctgtgtttccacccaaatctcatgtcaaattgtaatccccacacgttgaaggaggggcctggtgggaggtgattgaatcacggcagcacactcgacccttgcttttctagacatggaactctcaagacatatggctgattgaaagtggccgccctttttaccctctcctgtttatgtcttcatacccgttaccttgcatcagcccgtttttcgttctcctcctgccttgccccttcccgggctgtttgcatgttattccaagctgaataatcttcaatagcctggccctacttggatcgcagctttctatctatcaccttctatagtatccatagtacttgactgctattatgtcttacattaccgactcgaagcatcacgcccgtacccccatattctatacgcgcctagtcgctccaagattcgctctcactatcatgccacacccgcgctcgacgctgat

SEQ ID NO: 16798 - DNA, 880 bp, Homo sapiens
  misc_feature (1)...(880): n = A,T,C or G
agaataaaaanaaanngaanagnnaagnanaagaataaaaaatattttgcacaacgccattggaaaaattgagggacgtngctcttggggtcccaaattgtagacatgtattacgaatgccaccgaaatcattccagaaagacagctgcatttgttcgggcctgaagaccctactgcttcatcaccatcccctccctggcgggcgtcttcacctgtctcaatctctacctggattctggtcaggcggcctcggccaaccagcgcccataccatactgaagattttataaattcaaaataagccttctttcttaatccatatcctgatttttaaagaagtataaataacaatttccacaactacaacgaagaagaaaaaacgaaatataccaccaccaccccatttcctctcctcttccccgccacatagctgaacaggaaaaggtgttcactacttccactccctcatctctccacccacttcctcacgcttcgccacccgcccccatctttaccacccgcgccctccactccggcccgcttcacgcccccatatcttaacttcttgtcgagtacgttgtgtcagtaacaagcatacatacctcttagcagcccttcctttttgtaagtttgagtgcaataagaatcagccgatatgtcccaattgtccataccgccgcacgcccccccccctcctcctatgaaggggttaggcgtagcgacccgctacttccccgagatccctaaataccctcccactccatctattctattacctcttgcttacaccaatacactagagcagtcctcaccccttcccgccgacgtctctccgccactttccactcaaatatcaattatataccatacgacgtagatat

SEQ ID NO: 16799 - DNA, 780 bp, Homo sapiens
  misc_feature (1)...(780): n = A,T,C or G
gctggttgtaatcccgctcgaaccctgtaagatggaaacgatcttctgtgccctgagtccaaatgaaaatctctagcaacaaaaaagcaaactgattgggaaaataaaatcattttggactgatcccaacagcatttcagtttcattagtgttctattaatttaatactataaccatatttcangttctgacaaagttctgtattgcagctctcagaaatagaaaaaagcgctgcctgnnctgcnctactcataacattgatgcttttgtgattgtctaagactcgcctgcccctttgcacagtctttgtttttttttccgcacctctccttgctcggctctccttgacttatttgctttttccccctcactttgtcttgtggcagccnctggtggttttctccggccttgcccccgtggcgggtctttctgtctgcctctcccccccccctctgcggtcttcccttccccccctccgccgctcttctccctcccctttcctgttgtcgctgcctcctccccgtttgtgctttcttttcttttgccttggccctcccgccccgccttttcgcctctctttctcccccccccccttcccttccctcctgccccccttttttccttcgcttcggctgcctgtcgcgnggcttggtcctctgctcctgtcccgtcgccgcccctccctccctcgccttctcctggcgtcccctcccctcccttcgcccgcttccgttcctcctccgcttatttcccgcgcctttgcgcagaaaaaaaaaaaaa

SEQ ID NO: 16800 - DNA, 940 bp, Homo sapiens
  misc_feature (1)...(940): n = A,T,C or G
agaaagagaaagaaaagtaaaaaaannttgaaagatggaacggttaacttggccaaatttaggtgtgcagccccatggcctggtctacagggattccttattcgcggcagagaaagccgatggcactaaaagtcaccaggggcttgaacagctcactgtggagacccccatcatctaacaccctacatactagaaccaggctatctgtccgttttactgaacattaaaatagtatttttgtttaggtgagcaaactataaagctctttttctttttttgacgtgcccacccggtataattaagtgtacattggttttgtatttaccgccgtgacgaggtacggctgatacccaatcaaaagaaatcccgctcgagagtaaggcgactggagcgcgggcgcggtgatgctttatactacgaattgcttgctttttttactatacgtactttccctttctcttcgactttcattttttctcttttctcttcatctcgctgccatttatcttttccttacatgtcacaatggtttgtctggctctactcgacacactcgtgcccctcgcccacgttcttctcgatttcccatgccaccgacatccatcactgcacgctccggccaccgtctcttttatacctcttcgcccgacttcctccgccctccttcgtacgcatcttcttctcacccaccccttgaacaacaagccgttcaactgccctcacgtatgcttatttgccctcgagtcccgatccggcactccatcgaacgaatctttgtaacacgccacaggatccaccatctccactactcctacgctcatcgatctctcataccaacaatccctcatcagtatcattagacagcgtctggatattagtattctcccatgtgtaccagtagtgatatgcattctcgtgccgcacccatcatctccttatc

SEQ ID NO: 16801 - DNA, 893 bp, Homo sapiens
  misc_feature (1)...(893): n = A,T,C or G
taggggaagaannnnnnnnggngggaagggaagaactgtttttgaaaagcacttggcacatctggcaaaaaatctctgttctcaacattctctgaattgttccgctgattgcatacaaattgcgcttggagatgaaatttgtttgggaatcaaaccaactgatggaaacaaatagagatttggagaaaaactcattcaccataaaatatgagtatgaattattttcaccaaaacattgactctccgcccagaaaaattactcttgattttagttattttgattgtgtaccctactcttttttttcttcttctacgcatgtttcgttgtcctcggtttccaccacttcaccgacagcggtaaattaattacatagccagtaattttccatcactttccgcttatttttttactccctttctttttcccacatctttttccgtcatttttctcccctcccttcccccccctctcctctcttcctcctaccacccccttccactccccacttctacttagttccactgagtaggcgaatactccgtaccgttacccaccgcccctatccattacccccgatctaccccctatcttcttatctccatccccccccgtctcttacctttcatctctccgtctatctcatatttcgccgtacctcatatatcttttctctatctttatactttctttctctgaccaccccttcttacttatctcccacctccccgctctctttctcctcgcctatttacaccgtcattacccattcctcccgtttccctccgcccgctactatcgtctctttctcattcccccctcgctactccagtccctctcccctcttccaatttcttccctatacttcttttatacctcgcctcctgcctctttt

SEQ ID NO: 16802 - DNA, 348 bp, Homo sapiens
  misc_feature (1)...(348): n = A,T,C or G
ctggtagggactccaatgactanctttgggggagngacactcatgggagaaggcagctcaaaatcaaagattgtagaagtgtatctatcttcaagttcactttctctgtcatctctattctgctattgtgccatcagggtcaagcagcaagaagataaacagagaaaaaaaattaacagttattagccccaccctaatgaagccaaagagttccactgggaaagagcaactgcgtgcgctgcgtttgaaactctcctggactcagtctcatgtatctcccactttggctgatgacgatctatatcctttaactgtgataaacaaaccataactgtaaaaaaaaaaaga

SEQ ID NO: 16803 - DNA, 792 bp, Homo sapiens
  misc_feature (1)...(792): n = A,T,C or G
ggggagtgnttgtactatccctcaggngctcctatgtangacgaccattccttgatttcatctcccctggccattgcttcactggtctggccattcttattacctcatccccaaccacagggattggttcaaggatgcacaggtggtacatccccaaccacagggactggttcaaggatttcacgtggtacatcttcagccaatcaagtccctccctgaaacaaaaaactatgggtaaaaggaagttcctctccctttctagnagcattgttcttttttttttgattaatctggaattgataatgtctatttttttcaccatctggagaaggcctattcctgacctcgngaccgagcaagcatgatggctttccgcttctttcgtttgcgccctggctccgccttgcctgatcacctctgtgacagccttgttctgtgggcccctctcttctcttggctcctcttctcccgtttgccttctgatttctgtccctttcngctggctgagctctgcctttttctgtcttctcctgcttcctcgtctctgttgcctccgctctgcccttctgcctcttccccttctttttctcctcccctctcttccccctctctccctcctttgttcttcttctcgtcttcttcctttctccccctctcgcctccttcctctccctcccccctcttcttccctcttcttccgcttctttctctgttctcctctctcccgctctctcttcctccttctcccccttcctttttccccctccctcctcctcaccaaaaaaaaaaaaa

SEQ ID NO: 16804 - DNA, 816 bp, Homo sapiens
  misc_feature (1)...(816): n = A,T,C or G
ctggttaacacgctccaactgcattgtggactgggcccacacctacactgcagtgaccaatgtttccgactgttggatctgcaccgcccttccagcagcagcagcgaatggcttgtcttggcacatacattcagcatctgcagagaactggacataaccagatacctggtgacccatggtggatccttgggacacaacccagcaaactttggacaaaggaccccacaagtcccacagcacactcaccgcttgggtggaccgtggtgtttatgatgaatggagctgtggggatggataaaaatgaacggtgggcggagcgaatggcgaaaacacgcagcccgagcctaccagaggaataggggatagaagagatgaagagaccgacccaaaagaagcccgtcctaccacatcccgccgacttccccatccctatcgcccgagcacccaaaatccaaaaaaaaacaacccaccaacctactccccttaatttatcccccttaaccatatgtcgtacgcttaccgccgaccggcccggccttgtattgttgctccacctcctccccctcccctgcctagccattcttttatccaagtgtttgtactntcataatactcgccacattgactttgatatacaatgaacgtttctatatgtncattttgcacccgcagtccaccgtcaattctcaggcgactgacgcacgcacatcgtcgtccgtccctcacaatcatcccatcagcttcccttctcctgtcctcctccctcgtcttgttcttctctcttatttgtcaagcgctgccacgagatcctcgtca

SEQ ID NO: 16805 - DNA, 261 bp, Homo sapiens
  misc_feature (1)...(261): n = A,T,C or G
tgggaaaanaaatgntagttaccncgcgcaagccttctngcgtgaaaccnggaccacgagcataaacttttgacaactcaactttttcatgaccaaaaaatcgttttctcanctcccttcccattcattccaaacccttntataatcaactgtcancttttctatcaacattgagtagttctgccatttttcancttcatatnaatggtcaacttcatataaatggaaaaaaacactaaataacctttcagcnngttttct

SEQ ID NO: 16806 - DNA, 806 bp, Homo sapiens
  misc_feature (1)...(806): n = A,T,C or G
ttgacaancttgcaaatctggcgaatatttggtacctatgtatagagatggtgtttctctctttggaagaagccaagatcatttccatttaagggcatgtaagaagctgctgctacacattttagttacccataagaaagtgaagtgggctaagttcactctgtcataagcatttaaaaaattaaaaattacaagtacctcctctaaaattaaagaagagatttaagaattaatattttcgagtgtggtgacttaagtaaatctaacatctaagacaacaaattagataaacagagaagaggagaatgatgcccggctttacaaaaaaattatttccccagttctactgtaagataaactgttctaggaagttcaaaatatcatctcacttactagcatctcttttttatagtaattttcaggaaagcaactgctagattaaatgaggcacatgcctttccaaacattacaaaacttagatttcaacacatcatcacctctaacgcctcatttcctgagaccgcgctgctctggaattgtgaatcaacgcatgtccgcgctgccgcccgctgcctcggactctgcacgggcgcgattgaatcccgctgcagcgtaggtacgttaatattttagtccttagttctcgctcgtgccatcgttatcacttatataactgtgtacgctgttgttgatgtctcaggctttctctctacatcttatttagatagcgctatctggtccatttcgtgagatttgctcgcagtaacagcgacgagatgaacttccatatatgactttccatattt

SEQ ID NO: 16807 - DNA, 861 bp, Homo sapiens
  misc_feature (1)...(861): n = A,T,C or G
aagaaaaggaaaaaagaagagaagaaggaaaaaaagggnntttgcataagctagcaacttctggaagagtcctcgtgccaaactctgactgctaagcagacagaaaagacagaaaagaaaaccaaacaacattttcaacaaataggacaccctattgaatattttagtcaaattcttctgggactgaagtatccagataagcacttttatgtttatgttactttttgggaatacatgccgatcaaaagatactaaattattaaactgtataagaggagtcgacaaagtatctatccaggttagggttagggaataaggatgacgagggtattccacccacgcctccagcagataccctagaggcgtatacacactgagatatggttttagaaccccacccccgcccactgcactgcaaacgtctcttagcctcgctactcccctgcccccccgtacctcaaccacaccctcccctcgccccccttccctccccccatcccttccgtctcgcctatctgcttctccacgccccgcctagactttcaacgatcaatctgcagaaaaacaacccaaatcgacgttccccagtacgagccatttataagtaacaagataacctgtaacttacaggtaaagtccctacttatcccaccgctccgagccccactctccaccgcccgcgtaatgttgcatcttctcgtacaaattcggcccagagatgagatctagttgtaggccagtccctaggactatcaagcgtcgctcacaagacataccaactaaccaagccagcgcgcgtggcgaccgcgcgcgcgcccgataccccacccaacgtacccccatccatcataatacacttat

SEQ ID NO: 16808 - DNA, 794 bp, Homo sapiens
ctgatacaaaacactgatacaggtctgactgagaggagcttctaaggatgatgcaggattctgggaaaatccatccgcgtctggtgaggaaacaacgagttaatgccaaatatgacacccttaaaagcattacatagatagaggcaaccaaatagtaatcaacatatgtcaaaagtagagacaactaatgcactatgtagacaaatatagtgatgtcttttatggatcctttttgaaaaggagaaaatgcagcagaatctcttttctccaagtcttaggtacccttcccaaaagacttcacagttgtttaattttttccaaaaactgtgggaaataagtaaggaaaatactaagccaaagttaaataagttactgtattgtagaatggttcaatctttaaagtgctaatatattgttggagtcttcaggatgagaaccataaaatgtggcttttcccaaataaaatacttttctttcatatgatatgcaataatatctgatagaattttattgtttcatggaacacattttgaagaagataactttaaaatatatgggaaaactggctacacatatgtacaaagacgacactggatcccttgcttacgccttatactcaaagcaatttcaggaggattagagacttaaatcgcttcacctccatccctcagacccctccagaaaacctacgtctgccattagggacctggcctggccacgcctcttagcgcaaaacccaaccccctcgctattcacaacacatgataaacagccctctcacagcttagagatct

SEQ ID NO: 16809 - DNA, 563 bp, Homo sapiens
ctgtcttcactctgacctgtctgcctggtagcctccatcgactgagcaaggagttgttcaagaaatcatcctataccagactgtgtgtgatattccttgaccacagagacaagatttagaacatgcacacgattcagtctggaacaagatgcaagatgcgacggtttcttgcaaagttatggggatgaagtttaactgctctggacagaaagctgctaggagataatctttctttgctcgtcatgacataaggatgacccctgggattgcttcaaccattttgccaccaatatggaactcttctgctaaagaactaagtccgtacggagaagagcggaaccaaaggggttagagagaaacaggtggaaatgccggcttgagcctgccccaagtcccttactgtctctggactccaggtacaggggccaataagctgagtgatattaagagtatgaaacaacttgtataggatgttatatatgtacatataagccactatataataaactactcctatgtgggtgacaaagcaaaaaccacacatggcctctttggccctaaaa

SEQ ID NO: 16810 - DNA, 776 bp, Homo sapiens
ctgaatgatactctggaccaaatttagtctctgaacacttggtttctccctaagtgatgcatggaggacggttgaaggaaaattgaagcacttttctgctatgttaccttttcaacccatttgtttacttatcgaccacttatgggttacaaagaaaatacaccacgatttattgcttggaaagatgatgcagagaatttgagagagaatcactaataaattgatggagaagtgctttgttaatatagagtgctattgaaatacataatgaggaatggcctctccaaggacactcgcccaagaagaggctagaactctggatgctcactcttcatctaacagatcctggcatacaaagcctgaatacagcatgtctttaaccccacttaggtattgtcagaaggagtctccacttctttctacccagtagtgtgcattcagttaacaaagtacaacaggaaacagggcagcgcttctcaaggtttcccgtacaacaaatcgcctgtaatgttggtaaaagagagttgtgtagcctcgccagccgcgccccgaccctgtgagcctgttagtaattcgctgcccggccgttgtccacatgatatctttatatttttttaccttctccgctcatctaccgtgttggagcgatatgcgtcgccgttatcgtgacatggctacacatatccacgcactctatcgcaagctgtggtcctttcactgtctgccctatcccagttattccttccgcttcatgtttgcgcctgcctgttcctagg

SEQ ID NO: 16811 - DNA, 737 bp, Homo sapiens
ttttaaaaatgaaagaagtttaatggactttcagttccatgtggctggggaggtcacaccatcatggaggaaggcaaaagccacttcttacatggcagtggcaagagggagaacctgtgcagggaaactcccatttttaaaactgtcacatcttatgagacttattcactatcatgagaacagcacaggaaagacccgtccccatgattcaattacctcccactgggttcctcccacaacacatggaaattgagggagttacaattcaagatgagatttgggtggggacacagccaaaaaacatcagtgatgttacacatttattttcattatattgctgacaacttgccatcgagtggttttttttgtttgtttgtttgtttgttttttgagatggtgactcactctgttgaccaggctggagtgcaccagcacgatctcagcccactgccacaactgagtgatttttttaattgaaaaatgacatcttactgggtcttggcatgataagagattggctattaagactcacacgtttgcagatagagctatgaagctctggattttaccttacagcttgatgtgcgacccaatgttactcctgctctggccgcggatacgaggggaccgcccttttcgctgctgttaccacgaagaaaatctcaaacacacccttccacctacgtctacccccccccccccggaacgcaacctaccttcctttccccccgcgcgct

SEQ ID NO: 16812 - DNA, 733 bp, Homo sapiens
ttttcttttattattttttattatttttgttttattattttttttttttttgagatggaatctcgctctgttgcccaggctggagagcagtggcgcaatctcggctcacttcaaactccgcctcccaggttcacaccattctcctacctcagcctcccaactagctgggactataggcgcacgccactacgctcagctaattttttgtattttttatagagatggggtttcaccgtgttagccagaatggtctcgatctcctgacctcgtgatccacccgccttggcctcccaaagtgctgggattccaggcatgagacaccatgcccggtcagtactcttagtttcataggctccatcttagaaaacttggcaggctattgtttcttattattattctgctgtgttttatctccttgatcaacatttcctattgctttgatcagaatcaccgaaggatttgatggagattttttcagattgatagtttgagtgaaaagactcgcaggcgagcgttctgttgcaattggggtatgagggagggcagaacttacggattctttgaaggaacgttactactgacaagaaaacggacgagatcacctctacctctggccctcgcgcggtccccgttctgtactatttccaggcagcacggagccgactcggccgcgccccgcgggtggacgagcccaccgcggcgcccgacaccctgccaccttccacccaccccc

SEQ ID NO: 16813 - DNA, 718 bp, Homo sapiens
tgaaaagtgtctgttcatgtccttcgcccactttcaaatggggttgtttttctcttgtaaatttgtatacattccttatagatgctagatattagacctttgtaagatgcatagtttgcaaaaattttctcccattatttagattgtctatttactctgctgacaatttcttttgctgtgcagaagttctcacgtttaattagatcccactagtcaattttggcttttgttgcaattacttttggtgtctttgacatgaaatctttgccttttcctatgtacagaatggtattgcctagattgtcttacagggtttttatagatttgggttttacatttaagcaatgcatcttgagctggtttttgtatatggagtaagaaggggaccagcttaaatcttctgcatatggctagccagcaatgccaatacgatgatgtgatgtctttgcggcttctcaaagcaagagccttttcttgatctttattgggatgcgaaccctgttttactataactgcgccctaataaaccctctgagatccgctcctttttaacagaatttacggggctactatgtgcgtctggagcaccgaagccgtggatcgtgcccgcccccgacgcctttcacctcaccctcctcacacctcgcttcggcgtcgtctcctcgcgggcgcagccctcgctgccgacctaaacacatcgtgtctctagccccccccg

SEQ ID NO: 16814 - DNA, 775 bp, Homo sapiens
ctcctggccgaacactccccgctgtttgccacgaggccgattttttttttttttctggtcagagggactgttttacttccagcaaagaacctcatacagaacatgatctacaattgaagttgccacttgattaaatttatagtaatccattgtcactctttgagagctgtctctcttccacataggctgaatagggtaattgaatgaggatgtgtctggtatctctgcatttctcccaggaaggcagtgttgatcctgatttactattttggcacgcagtggcaattctagaggcttgctcttggcttttcctactacaatagggctcactttatggggcaggagaacaacatggggattctgccaggtgctggatatgcctcttggcacctggactcccaagactattacgacatcaccccagcggatcaccacctccccatagcctccccctatgcacctctacccttccacatgtatcctattcatatttaaaacatcatactcctgctcgccagtgttatcatctatcatgtacataattactccatcttccgcccacactctccgctgtcacctctcattcgtcaactcttgcgcccaattcgactacgataactcttcatccgagcccaagacacatctcgccacctcaaatctccctaccaccgcctcccttcgctctcgccctctccggtccccagtcgccacctcaacccgacgaacttcccgctcagtcctgtcctcctacccccactctcactctcccctccct

SEQ ID NO: 16815 - DNA, 782 bp, Homo sapiens
  misc_feature (1)...(782): n = A,T,C or G
cctggacagagaanctccaccgctgttgccaacgaggcacgattttttttttcgaaattaattgtaatgatatatatttatttgtatatttgcgattcaactcaatgtatcaaaccattatttttatttgttcattttttaaaaatgactgaaatactaaagtgtaaatacacgcacatgtgtgtctttggaaccttaattcacaccacctccttcagtacacttaacgctccaatcctactgaaagtacacagttccctcaaactgccattatatttcacatctctgctgggactccccttgtccttcttgtctgtggagagaactcctactcatatttcaatcttggtgcaaacatctcctctggaagtcttctcggggcttcccaagtggagttgatgactcctttctttctgccattaaggcacttggaagagtgaactgtcattgcacttgatatgctgctttataactggagattaacatacgactctactcagacctgagactgtgggcctatagggagacaaattactcaagccatgaacttgactgctaccggcacatactgcctgacctgatgaatctaaaactccctcgctacttatgagttccacctcacgatggcgaactagcgattcagttacgagacgcctccatggccacggctctcactgctccccgccgcgcttacagcacctatcacccacatccgtgccaaccatccgtccaatgcgcaccgccccacactgccccgctaaccccgctcgccacccaacccg

SEQ ID NO: 16816 - DNA, 735 bp, Homo sapiens
  misc_feature (1)...(735): n = A,T,C or G
ttttaaataaggccacaatatttatttcaaagggtcccagaatcattttttaaaatatcttcatatgcttgacactgaagttcttatgtaaagggttcggtcaatgtaaacaaacgatgactgcttgaagatgcaccagacgagattgtggagacctccaaattcatgacacagccgacaactggcaggtttgctcttccctgcaggctttgcacaacaaccttctttcaagctctgctcacgctgctggcccaacctacctgccgtcagatccccgatagaacccccctgcgcctccccaaggactaccattagtttataaagtccttggttccttcgcctttccttcccacacccccccccactctaccccttccccccccgcacccctcacatctccctaatttcccctcttccacccctcaacctttcctattctacattcctcctcaacatgcaaacatctccgtacatttaatcatggttattggaacgtctcctctactccttccgtcggtgctgcttaaccatacacgtccgcntgcactctcatcctgatctcttactttagttattctatatctataaggaaacacccttgtctccttctcctcctccgcccacctcgccagacccccctttcaccacctcctgcgaacccatcatgcttcactccgccctccacctcgcacaactcacaccacacgccagtacaccgcaagcaccccactcccg

SEQ ID NO: 16817 - DNA, 727 bp, Homo sapiens
tttttatgattataacataattttattgaaaaattacatcactaaatatagtattccacaaatgaccccagaattgcagttgcttctgcatgtgaaaatatttaagaaactctctcagggtcacgacactgaaatgaaatgggtttcattcattaagcaatgtgctgagtgcccactctgtgccatgtggtggagaagagaacccagttggaggcaatgacgcactccccctcccacacctgtactgaggaggaggctgactacgcaacacctgacccctgacaatccatcacctgccctttaaactcacactccaacatgagaaaaagtcagtagagaacgcccccccgcccacccccccccccccccccccgcccccctcccaccgccccccccccccccctcccccccccccccccaccgcctcctcccaccgcgcggcccgggccgcactcaacgtcctgccatcggatgttttctactctcctccacctccaccactctccttccttctcccccacaccaccccccccactccccacctcccccgtcaccacgctttccactcgtcatcccttgttcacccacaggccaccccccaccaagcccccccacaccacaccccctctcctcccctcttcgtatctaccttagattccaaaccaagaagtcgccaaccatcccacgccctccactaccacgccgtgatcagtcccacgccccaccc

SEQ ID NO: 16818 - DNA, 758 bp, Homo sapiens
cgagagctccccgctgtggccacgaggccgatttttttttttacaatgaccatacattctttttatcaggatgaacattcttctaatttttgaaaccatcctcacctttatcagttacctatgacttccaagtacccctatctggctgaattcagagcaaagcaattgctttgctactgaaaatccatatttaggcaggtatatcagaatgataacagggagatatgttgtctcttggagagctggaggcagaaaaggtgaactaggagtgaaggtcaacagcaactgtgagaaagaaagacttgtgccttggaagaaagttgagctgagattttctttctttctttctttgctttttttttttttttgagatggagtaatagttctgatgcccaagctggagtgcaccgaccccatctccgcctccctgacgcccccccctcccgcgctcaccacccttcttcctgtgtcagaccccgcaaggggggggcactatccggcgccctgccctacgtccggataatcttctttcgcattctcactacacgtgggcacctacccagcgcaacagaattggcctcaactcgcccccgtcagaccatctggccagagcctcccatgtccgcggactaccgagctaacccgacttgctcgcctccaccccccttctcacacacacgcgtcagcccacgacccccaccatcccttaccctccctcatatccgccgaccgctgttagtcgtcgctaaccgccaccg

SEQ ID NO: 16819 - DNA, 749 bp, Homo sapiens
ttttgaactttgtccttgttcatatgctatttctttttaaccaggtgacagaaaaatgcccaagcagatttttttttaaaatgtaccttctattgtaccctgttgtcttaaagaagattcagttcagttatccaagtgagacactttagttttgatggtatgtacatgctgatttaccaccaggatggccggttcttgcttggttgtaaaattatggcacaaatacttttcattgatcgcagtttaacagccaatcaagggacagcttcatcccacgatttcactgtgcctttacaattgagaagaataggagctatgatggggactattatggctattgcgcgcctgggagatgaactcaaagatggtgctggagcatgacaagttatatccctgccctcccctccccgcccctccccatcgaaccctccacccctcccagtcattctcagattcctgccctgacctttccacctctttgtccacccgctcaatacccactcagccgtccttcaccttcttttctcactcgtccactctcactaccctcttctctcctccgtccctctccctcgagacccccggacccggcatccacgccttccgatctccgttgtcgtaatctccccttctctactccatccgtgcctccccactccccctccaacgaccataacgccttcatttagcacccctctactctcatcccactcttccggcacacgtaagcacgccgtctatggcgcgac

SEQ ID NO: 16820 - DNA, 301 bp, Homo sapiens
tttttcaaaatcttttggtagaattttaatcaccaacatccaagaatcttggtgcaatatgtagtttctctgcacaggagaccatttctagaggttaacctagagatgagataggtcttggtcttctgatgagctctcagaatcacttgaggagggagattactcgaggatggcttcatcctcatttggctgattcacatacctttttttattactgcggcactaaaaaatcaccaccccccgactttttcgccgctttacagctttctgaatcctgctcagcacaccaccttatattgtt

SEQ ID NO: 16821 - DNA, 788 bp, Homo sapiens
ccttggcagcagcgctccaccgctgttagccacgaggccgattttttttttttggtttgctttcagtttattattgctcattctcatctgataggctaaaagaagggggaaaagtcgagaaacagggatgggtctggaccaaattatatagaaagggtggatagttatcactgctaaagaatcattaaagaaattgctcactcctgaccaggcgcgatggctaatgcctgtaatgccaacactttgggaggtcacggcaggcggatcacatggccacgagaccgacaccatcctgcctaccccggcgacccccctctctactaccccacccgcctcacccccggctcccgccgccacgcagacgacgcccctctctcccaggcccccgcaccccacccgcccggacccccctcacccaccctctccccacccctccccgccccccggcgcccatcaccccgcccagccccccccacaccctacgacgcacatcactattgtgggccgagagtacgaaatctacagtcacgatattttctcacttcgttccttcggttccccctcaattcacatctcccactcaatctaactaaaactcccctcctctcagcatctgttcactctcttatcatccctatctaagctcgccccgcacatcctcccacccgaccactcttccccgccctccaactcaacttaccctcccccaccccagctccgtcctctcaccccaccgcctccgcgccatcgcacatccccacaccccaccgacaccacaaccaaccccg

SEQ ID NO: 16822 - DNA, 781 bp, Homo sapiens
ttttcacttttgttctattttttatttgaaattatttcattcagcagtctgtcttttttattaccaggacttgacattagcactccaagctatattagcatccatttcagcagttcagtaatggtattaaaagaacacttaacttcaatggtgaatggttgtatgacagtaccataaaaaatccacattaaaaaaaacttatgtatttgagccagcaaattatttttcacttgattaaccacttgaaaactatattctcatgacgggagatcacgaggactttgttggtctcaaaaacagctgacagaggtgctcgcgtgattagggaacgtgagtaggccactttttgttgttaaaaaacagcactgtgccttcaaggggtggcactttgatcaccgccgccttgcaccttccatttctcttcctttcccctcgtccacccccaacacccactatcgctcgacgaggtctgcgtggcgggcaggtttcgtgcaacacgcatggttataatgacttaccagccgtgccacccacctcccacgaccccgatcccgacatttgtcagcctctgcacgctcatatttcgatgctcgctcgtgcgcgtcggcccggccttcgcggacagagacagtccccgcttcacgcgctctgtcgaacctccacttgcacacccctacccaccgcgctctgttaacagcccggttgtgcgcgccaagagtcttccaatgtcaactcgcaggtcaattccacgactatgtaggtacacacatggcatgaccgc

SEQ ID NO: 16823 - DNA, 736 bp, Homo sapiens
ttttgctgtttatgacttttattttgagagaatgagtaaaaatcccatcaacatgtattttttaataacatttcttttatcctatttttaagttgctttatcaagttacttcaattagggaaagggacagaaggccagggggaacgatattatccttttgtattaaatcacaggccagatggcaatcttattatttagtcagaattactgaacatcacacttttctgctttgtaatcaacactaatattgacacttaatatgcttcattgttacctcaacttagtcttttattgcataacattgtggtaacacaaagtcagataaaatgtagtctctgccttctacatttcataatctagtatgggaaataaacatgtatttctgagcatcccacagtaataaattgcacattgtgacccatgtcacggtaataaattgtactttgtgaaccagtagtatagtagatataaatgttttttgtatgtgtttacatattacctgacacaaaagtttcattaaacagtatttacctttattttgtgagtgatactttctattgtggtttggatttttttctcttttgggagatttttaaaagaatgctgggatttgcttgatgacgcccgaatgaggcccattcttgagcggcgaaagcgccctacggcctgcgccccgattctttacgcccattctgcgccgcacttcctgaaggacagtcccaaactcacacacccg

SEQ ID NO: 16824 - DNA, 301 bp, Homo sapiens
ttttggcacgcaggactcattaccttatttaatctcaaaacaaccctatgaggaagggtttactgatgacaaaactgactctcacagagaggaagccccttacctaaacccgcaaggtgagcaaccgccacacacccctgaaagcttaatatcaatacatactcccctgcaacgccacccccttcacttgtcgggcacaaccccctctgaatcaaacacagcacccccttattttttccattagtttccattgccatgagaatgtacccccccaccaccacaccccctcccacctcactta

SEQ ID NO: 16825 - DNA, 779 bp, Homo sapiens
gagagctccccgctgatgccacgaggccgattttttttttttagagagggtaataatctgctttatttaaaatcaaatgattgcacatgttagtcacatccacaaaataccttcataacaacctctagactagtgtttggccaaataacagacaccacattctagctgatctttgacacacaaagcaaaccatcactgtgtcatgacaggttcctctcttcctctcacgtgcccagccaatccatcagcagttactcttggcgctaccttcttgatgtacccacactccacccacttctcctcacctctgctgcagcgcctcagtgcaagcgcccatcgtgtcttacgggattattggaatagcatcttaacaggtcttcttttctctgcttttacctcttggggttatgctgaacgcagggaccaaagaaatgctgttagctaaacggatgatgaaactgatcttctgttcaaagcccctgatgggcttgcccgcacacttacatgtgtcatccgcagcaactacggcgctttcctacagctggctgacttaccacttccgcctgacctccgctaccacacaggcattctccctctccatcacatcccacccaacaattatagcgcgcaacaatgacacagagcaaccctgccttataacaacgacaacaagtgcactctacaccacaacaagcagcccccctcacacaccactaccccatgcctctcaatcactctcccgccccaccgcccgcacgtcgagctccactgccatcccg

SEQ ID NO: 16826 - DNA, 729 bp, Homo sapiens
tttttcattttccaaacatttattaatcagctctaatgaagcaggctctgagccagtgctggtaagaaaagcatgagtaagacccagtccaagctctcaacatatttatagaaagtctgtggaaaaaatgagaaaaagttctcagattccctaaacaacatgttctaccttaattccccaaacaacccaaacacttgagtataatttcaaaacagttagtcacagggaggtgtgtaatgttttgcaaacttattggcgtggatttagcatgggcaaattaaacagaaactaatggtttttcccctcagtctgtgagccatgaagacatggctttgctgctcttaattgaggggctttggtcaggtaataaacgcgcacataacactggtgatggtcagggacacgagggacaggctactacctcataacaggtatctgataaggcatctcctattctgtctgacaacggtgggggacggattatgagggggcatattggtggcaggcgcgcctgtgcacccacatgtaagccctaccgccaccttccgctcaatccgccttccccgccagcgcgccccacaaagcttcacagcatatctcaatccctgcacgatccctctgcacagtacgatctagatgctgtcgtcctccggtacccgacgtgcgcaaccatacaccgcggcaaacattgacagagagaactggctatatctctcccgccccgacccc

SEQ ID NO: 16827 - DNA, 711 bp, Homo sapiens
tttggttaagaatatgaataaatttaatcaacgtatcagctgaaaatgccatgaaaaaaatccacacaaaatagaaatctacaggttaattaaacacactcaaaatacattcataaaataagaacatggtgggggaacagggtaaaagaaacagatgaactaaactgacttttcttgcaaataggtatataacagagtggactcaaggttatcctgcataaaatgaatgtggcaaaggagtcctgctaatgactttccaattgctacacaatagttgttttcaaataaaaccaacaagctaattacaggcatattacctgaggccacatattaggttggtgcaaaagggattgcagtgcttgccattagaagtaattaaaagtaatggcgaacactgcaattacctgataaatcttgtttttcttagtgacatttttgtacactcttgcaacaacttctctgaatgtgaataggttgtatatatgcaaaaatatgtgactatataaatatagaatatgttatgatcattgaaaagcctgactcaaaatacctatgccatatttatttatccatgcctttatctgtaaacgcctttattaacatatgtgggctctacctgtactatttgcacagaatttgtggatttgtatatatgactattgatatgacgcatgatacgacatgattttatctggattgttgtatttatag

SEQ ID NO: 16828 - DNA, 751 bp, Homo sapiens
ctccccgctgatgccacgaggccgattttttttttaatgtaaaagattgtttccttgtgtatggctctcctacatatcatatactacatagtataatatatattactcatatattacaatatataatccactatgtttaaagaagccgaagaaccaatagtacgtttgtcatttttagttgcatttcaatggttccataaagggtttgtatggtatgtttagccataccttattatctcttcttgccaggtaagaaaagagcattattgtcacttttattttcccatctgataatgttggcaaatagcacattctccataaatatttgttgactgactctttcaccctcactatacatattataggtgaaaaaaggattccaccctttcctggcgctggagaaaatcattaggactacgtaccaattgctaccccacgacgcgagcgactctacgcacaggaattgcactcttttctattaaactgggctgcatctcatacctcccacgctccccccagcctatctctcctttccttcacgaccctcatctaaacccgatcatgccgcacctgtgtcgtctctcccacacgcccaccgctcatctcactccctgggcgtcctctgtactttgaacctcggagacgctcagcctctcacacccctgcgcctccatcctatctcttctttccccaccccacctcactccctcgctcccactccacccggtcctctcttatcctcctttgcgct

SEQ ID NO: 16829 - DNA, 796 bp, Homo sapiens
  misc_feature (1)...(796): n = A,T,C or G
ggccangtttttttttttnaatctcagttttccattttattatatgataagtaaaatctctttggttgcctacaaggatataacaaatacctaaattcatcaacatgaagctgtaagcatnatcagttcataacaatgatttctgaaaactggntactttttatttaaattnggaagnttaactnanatggaaaaagatattttaacatggntttctgatnactgataactgaaaaattctanaataatataggaactcatacancaaaatanatnatgcttacngnnacanacttgaaanaanccttnccggaanaaagntntttanngagactttanggagacctctacgaannatatgnatccaatatctgctaactaccggntgcangnncctntntttancctctcacanncgcncgccattncnnnatacnaatccccctnncctnnncagcctncntccccnntccattaccnctccnnacantncntantcnnnttnttcnccaccntnttnnnnaccacccnctnncccccnaccngccncncntanancncctnncnccccctccccnatnntncntcgcnacnccccccgcnccntnttnnaccactcnncnnntttcnntgcctctccttcccnacnncnnncgncnctntccgnnnnttcatcnanngtnacnctctctaannggctaaccgcnccntcccnncncnncncnnnctctctcccccnccacnccannncnncgnncncnngncaccactncacnccccnccnccccncnnngtc

SEQ ID NO: 16830 - DNA, 789 bp, Homo sapiens
  misc_feature (1)...(789): n = A,T,C or G
ttttaaagaaagaagatctctatctgcttatatgaagtgatttcctagatatactgttgggtaaaaatagcaaagtacaaaatgatctacgatatgctatcctttgtgtaagaaagcagagtctaaaagaaaataaacatatacctacacatttatgcaaaagattcaggaagaatcaaccaaaaacgaatgagattggntactatgataaacataccctagaatgacctgcagngagtttacctttgtataatnctttnccaaagaacctgngaattgtttntaactaacaggatacagcncaggatgnggcgnancccanacnccttgatgaggcctacnttatggaagatgtnannngttancccatcgnagngagngatctctctnngtngncctcanntnancgnncccttgccnntgnccccnctngcnctatnnnnccaggancncccnacccccncncncgncccccnntcncnccnccgcccnccccccnnctngccccccccctcncnngncgnnngaccngtccnctctcnacanctnccnncccncccccnctccgcgngcgncannnncncncgcccncctnnnngtcnnngnnnggnnncacnntnnccncgncncccntcctcccccnnaccncttcngncnnnnncgttnncctccgccgncnncccnnttctcccncctgcccntcnncncgncccncactnnannacagntncccnnccccctcncccagaccgcnnnnnntgcnnnnntgcccccccccgncnntnacac

SEQ ID NO: 16831 - DNA, 804 bp, Homo sapiens
  misc_feature (1)...(804): n = A,T,C or G
gagagctccccgctgaggccacgaggccgattttttttttcaatttttatgttaaaatcatttggtagttggtaagtgtaaaagacctttattccatgcaatacatttaaattctagaaaatgagctttcctctcatcttccaccaaaacgactcaaaagaatggcactgcctttactaattaaaccatatatttgataagtatgacttttttctttctaatatttgctttattcaggggttaaatataaattcttggcttgtatncgccatcctcttgagtagcactattttccagaattattctgctggcatntgaggggntcattctgaagnagtttttttttttttttacctggngncctatagggagncgnactactcnnagccatggacttgnctgctnccggcacnccatgcatgacctgnctgacatnaacancncccnngantcatgcgnggaccctccatagcctgccactancaccggcncnggcgnnnagncccccnatgccccaanancangcggctgnctncccccncncctcnncccacncccccccgggccccctcanccancatncncgnngcnnnnnanncccggcnccctccncgtgcccnatnccncnngacccccccgngtcggtncgaccggcnnctnncnncccgccncgcncacnncacccncnaccgcncangncgtgnnccnancncntaccccccnttcctcncccccggccnnnccgncgncccgccnccgngncgnngngctngncaaccnannggccgcncccgctnngnncat

SEQ ID NO: 16832 - DNA, 355 bp, Homo sapiens
  misc_feature (1)...(355): n = A,T,C or G
ttttattttttttttattttgctttttaatcaaagtatcacttaaaataaaatgcataaatcttaagagctgaatgaattttttacataaacncacacatgcataatcaccacaaagctcaagctataaaatatttctacagaacatgagtcttttgnntgnntncttaatagaatgncagcctnccaaggnnanaaattnttttttgctaactggagnnntncaatgcttanaatagcgcctgacccanngnaggcccncccccccccnngnatnnggcaccnncngccagngananngnggngngnnganggntnggngcnngtaggaangcccannggccnccccccccccc

SEQ ID NO: 16833 - DNA, 115 bp, Homo sapiens
ttttctttcccatactcatttattctctatgattgggctagataaccttcaggtttctctcaagtcacagaatctgaatttctcactggatgtttttctttcttcttgatattat

SEQ ID NO: 16834 - DNA, 404 bp, Homo sapiens
  misc_feature (1)...(404): n = A,T,C or G
tttggtgtttcttttttgttttaattaatttattcttgaagccaacatttctgaagatagaatgtcacccaccttctcaattacatgattgcatatgccagtagttatacctagaattcattattacatgtattttatagttatgtcattttacagtaggnaaaactaatctgnttagacaccaaaaaaaggtgtatgatctgntgagataatacagatttatgtacattanccatggagnctatnnttatgccttatntgtgacaacnnatnngngacnntgagncngaaccacatactttagngctcncnagagganggancgganacagctngnaangcntnacncactgncnnncccccnnngcnncgtcntnatcggnactanccncctnnctggtngg

SEQ ID NO: 16835 - DNA, 415 bp, Homo sapiens
  misc_feature (1)...(415): n = A,T,C or G
ttctgtggtnnacaagtgtctatttgggattttgttttnattttcctgttagtgatgttgagtacttttccatacatttgnggacattnagtatgtcttctttttagaaatgnctatttaaattctttgancacatttcaggggggattattaacaagtttttactgnnganaatgttngagntnctggaatattatanatattagagntttgtcagatgagtanatntgcacatattttntcccanantacncgttgatgncctggnaacttaaatctnncnncngccnccttcgntgtnacacacccctnccctacannanaanannatactaagcgttnttncccgtcnngtntantntnnnanttttngtntccatnngngannancgntanannnggcnntcnacnnnat

SEQ ID NO: 16836 - DNA, 421 bp, Homo sapiens
  misc_feature (1)...(421): n = A,T,C or G
tttttttncatgggtccatgttctggatatacgtttttattaactaactatgtgaattatttatgtctgaggtaagaaacaatgatgctnactattgacacttatattnaacattgnactanngtgngnttggtaatgcanatangnaatatgaatcactttaaggnagaggaagtcatagggagaaaccanaactatttntatttgnngacnatntgannggntacgaannacaaaanccntgatganngccccgtcacaccaccancaacgcnctattancangatannncaccaccnccaccccctcccccgtatactccnncatantgtacncctnccnnctnnccataccaangaanatgccaacgcctncaccnnntancgnncccctccngcaccncnggccggncngccncag

SEQ ID NO: 16837 - DNA, 789 bp, Homo sapiens
ctggccgagtactccccgcttagccacgaggccgatttttttttttcacgcatgcggcgggtttctccacatcacccccgtttctcgtctttattttcacacacagacttacactgtcatgcctatcaggtggaatcatgtgtccctccatggcgggagggctcagttactttatcttctgagtagaaaggccacactccgcctggggctgggctgggggcaggagtgtctggatgccaaggacaggtaggctgccgggtgcagcgagatcggagaggcaaaagcgctgagacttggtgactctgatcaggaagacctgaatactgacaggcagagaatttctaaggaaacaggtactgttctgagtactgtcgacccacgccccattcggagaggggtttggagggtagagaacagtagggctactgaccagccttacttgctggagcgagagacgctgcgggactatcgacccccccccccacacccctcccccccccagccctcacccggcccgcccccctctcaacttacccccgcccggcccccgcccccgctcacgcctcctctattaattaccgacacacttccggcgaccgcactaagcataaataacataacacgctgaccaagcgctaacgttcctgcccccctcccgcagcgtacgccgcgaccaacccccaccgcactacgcgctccgtacggcgccgcaaccaccatcctcactgtagcaggaagcgcgtgagccgccctccccaggcgggcccctcccccaccatccgcgacaat

SEQ ID NO: 16838 - DNA, 727 bp, Homo sapiens
ttttgttggatgcattctttattccagctctaataaacatattcttgataaagctaaaagtcatagatgaaggtaattaaatcattttgcttcttctttctttcttttcttttctttttttttttttttttttttttttactacattgccattagtcattctattaccaacttggaagagaactctagcacattgcatggcattgggatgaattctttatttccatgccaatgaaatattgtcacaaacaccttgttcaagcaaaagaagatttaaaatagctttgctttatcacagcttgcaatgtactcttggagttaatagaatcacacaaatgaaataaccaaagagatttcctcctttgcactttttgaggtactttctcatcataagtttttcaggtttacaggatggaaaactttctctttgtacttaaggaagagagagagaaaaacgcgcgctattgtacttgaaaagggaagaccatgatggattaaagtaaatgcacagccgcggcccctatatatgactattacggcccctggttggtcctggtttttgccctgtcaaccccaccaccttatcgccgttcattcctccgcgctcgccggaggcgcccgcacaccgatcctaccttcacgcctccgccccccggcccacccgattcccgcagacgggaagggtgcggccccccccccacctccaacccacccccgccccgaccccg

SEQ ID NO: 16839 - DNA, 213 bp, Homo sapiens
ggccagtcctcttttttttcattagacagggaaaatttattcattaattcaaaaactatttattgcatgcttatcatgtaaaatagtcatgcatattcattgcggtgatggaagtatattttccttgatagaaaaggaatgctgttatgcagaacactgagccaaggaacaaaattgctttcccttcccgagccgtgcgttcatcaccatcat

SEQ ID NO: 16840 - DNA, 802 bp, Homo sapiens
ttcaaacgaagaactacaacgctgtagacaacgaggcccaatttttttttttttgttttttttttacaataatccttggaattttatttaatcactggcatttcaagattcctttacaccatatcctttttgcccctcacacttttcaggccttaacatccctcacgacaccacacatgatactttcacgagacacccacggtatacataccgcattactatgcccactatatcaccacagcgactttacacctgcgaagggcatggacaccccccataacataagaattaatatttcattattatgagtttcactgttatcttaaagactgacacctagccccccccctccgcttcccccccgcccaccccccccctgcgtccccaccctgccaccccccccagccccacacccccctccccaccggaggacaaggacagccggagcacggcgccccccccaccccctctccgccccacaccaccccgtaaacacatccacctccacctaactcttcacacaccactccaccaccctccccccccgcacccctccccaccccccgccacaccccccaacccctccacccccctcacccccccctcactacccaatccacagcttcaaccacaccccccgacggcccagaccaacccacccaagcctcaacaaggacacaaaaactccccactcacccaactccgaccctctctacgccccaacccctctcactcccccccacctccaccacagctcgctcggtcccccgcccctccagcccacccgcccgcacaacgccag

SEQ ID NO: 16841 - DNA, 700 bp, Homo sapiens
tttttgttttttttttagaataatcttggaattttatttaatcatggcatttcaagattcctttacacaatattgctttttgcccctcaaatttttcaggccttcacatctctcaagatatcaaacatgatacttttaggagccaaccaagttatacataatgcatttttatgttcctaaattaacaaagagactttagatctgtgaagggtattaaaaattatataagctatgtaagaatttttattcggtaaaacatttgcagtttacttaagggcttaaaagttggacagaactttatatttctaagcaggcccacattgttatgcatggaaaaaaggaaccctacaaacatgcgcattttttctaaggagactcagagatggattatgtggttgggtgttggaaaatacctagcgcgtcctctgcccgccgccatcccccccacccacaggcactacaccctccgctcacgagtgcaccaatcgactgccgcctacccaccctcccataacgaccctaccctgctccccctcccctacacctctcctctcaccatcccctccaaacccgcaaccacagcgctccccactaacactgatttctaccgacatccgcgccattactgcgggacccctgtcctactgcattcacaaacctgctggattcctcgcactcacgccttaacccacaatcgaca

SEQ ID NO: 16842 - DNA, 734 bp, Homo sapiens
  misc_feature (1)...(734): n = A,T,C or G
ttttaatttataaagaaaagaggtttaattggctcatggttccgcaggctgtacaggaagcaaagagtcttctgttcaccttctggggaggcctcaagaaactgtgaatcacggcagaaggtgaaggggaagcaggaacatcttgactgtcataaatggctggagctggagcatgtggggtgcggcagggttgcggggaggtgctacacacttttataccaccagatcgtatacgaactctagcaggacaacagccccacgagggtggtattaaaccatccccggagtatcccgatttgaccagatgcgcctctcttacggtagcgaggtttctcctgtaatcctataaccccccccaccacctccccccctctccttgtccccccccccccacgtcccgcccgcgccgccagcaatgccctccccccacctcttacgcggttctatgtcagtgattggtaatgccaccctccccccccccacctcctatccccgaatccctgcctgtcctctcccaccgcgttatcttttacctcccacccccctccccccccctcgtcgcacgtcccaccctgcccccgcgcgtctcccccccatacaactgcctctnatattccccttcgtaccaccaccgctctacacacattctatctcacctcgccccaccgctccgcccccatagcaacgaactgctgcaccccatctgctaccacccccttctaaccggcgccaca

SEQ ID NO: 16843 - DNA, 772 bp, Homo sapiens
tttttgttttcttcactgggatatctctagattatccttgatttctctctttccttcatagccttctcctccctcattctaccatcgaatgcactgatacttgaattagaaatatttcaagatatgatgcaaatcttccctttgcaaaggttttggtatccatcactatcattcctaatctaggctgacatcatctttcacctaaagtttttgaaattacctcctaccttatcccctgattcttctcttggctttgcaaaccatcccccacatatcacgcacagtgcttttttatgtagatttgactatattactcctactggtgaaaccatcctacaagctcactattatcctcgcaaacacacccaacataccttatgccctacaccgccccacaatgatctggacctacccttccctcctctactgcccaaatcctctgcctcctccccccgctcctctccccccccccccccccctccaccctccaccacccccctcaaccccccgtccccccctccccggcaccatgtctctcctcccctacactgccccaccaccacgccgcttccttcctgccacacccactcacaagcgcatacgcccccccccacccccaccccctccctcccgccgtggccgtcgccctcacattccccgctcgcccggtcacccgtcactcgtcgccccgctcccccacccaccacccgccacatcctcccaacacgctcccgcaaagacgccgaacgagacagcgactcccgaccccccg

SEQ ID NO: 16844 - DNA, 726 bp, Homo sapiens
ttttaaacatttggtgcattttataagtgctcagtaaatgtcattattaatatgtaactatttttggcaagaatacataaaaataagctggaattatatactatatatatatatcaaaaattaaaagtggttgtgcttctttcaagaatagtaaacatctaatgaactaaaggacctattaaatggggagtctttgcacaacagaggaaaaactattaaaacaagggcatattaaagcaaaccttaacacaaaaaaggacatattaaaacaaattcaccaattaaaaaaattaaaaagacaaaccctaaccaagttcacccagctttactgatagtaagtagtagatccaggattcaaagccaaaccttctgattgtgaattgagtgctttctctatgacaccagactgactcttgaacttgactttgattctaccgggtatatggggcacatggacggcgcgatccgacatatgaattacgccgcacccctgtcatacacaccatctgctcgctgccccacccccctcccctatcccccccacctcccatccccatcctcctcctcgatcgctccgtcaggacccccctccttccccacccacttccttccccctatcccaacccctcccaatccatctctcctccctcactgctctaatatctatcaagatcgccgagatgcacaactcggccataaccgcccccctcaaccgtcccaatctag

SEQ ID NO: 16845 - DNA, 681 bp, Homo sapiens
tttaaaattttataaattaatatttattttaagcaaatatgatgtataattccgtcaagcatttatacacataaatacatgaaatatctcttgtacaattctttcttacaattcatgtgcagacagtgtggcaagcataaggataaatttatttcagtattgttacacataaaataattaaaggaaaagctaggataaactaatcagtaaatcaaaacaggtaggaaaatgtgaaaatggagatatacaatcaatattaaatgaatgttattcttttttgaattccaacatatgccatttgtagccattgatatgctggctattttaattagaccaagagattgtagtgagacttttggacacttcatacagggacgttgaacatcacttcttccttttggttatctttattgaattttacagactgtttggtaactaaggctaatgaaactaatgacaacaagcttggcgctttacaccccaccacccgcctcctttcacactcctgcacaccccacctcctcaacctacatactcgtttcatacccactgtcatagccccactttatcctcatcgcccacctcaccaaacagtaccttcagtgagtatagccctagccacgccactcgtctctatctggtctcccagctacccctctcttatgtctctggaacgtgccg

SEQ ID NO: 16846 - DNA, 833 bp, Homo sapiens
  misc_feature (1)...(833): n = A,T,C or G
gggggnnnnnnnnnnnnnnnnnnaaaaaaaagaagggagttgnnatggtttgtttcatccacaagtaggatcctataggcagccctgcagagaagaagaactgacacaggcagccagcaaaggagatgcttttgtcttcagagatgcaggacactaggatctttggggtgtagacagaagaataccagagatccatgaccgacagatttccaacgacaaaatacatgctgtgtgtggaggctggagggattgcggatgagcgcgatgagggtgctatgtcctaccccagggagagagtgctcgcccagcatcaccactactaggccagatttcgttgctgactctgtggtaaatgccatatttagaggtgatgcgctgggtgattgctgctctaactgcgtgcatagaacgtggcctgattggaagggagggtaggggctttgttttttatactttggaatgtgcgtgcagtgtggggcgtggtatggcctgtttggagaagtggtctggttgcttatgatcgttaagtccttaggtccacgccccgcggggtgtccagcagcacacaaataggagaacttattttctccttcctgttactaaatattcgtgtgtgagccgctctcgttgcactctatgctggaggtgctaccatatagcaacgggttccgcggtaactcatggttcgagagtacgaaagcgcgcttgcgtccgatgaggtagtggtgatactacggcggcatgctgacacagatacgctacgtcgcacgtggtccggagtacgactagaggaacgataggatgcgaattaccggtgctctctgtgatcaatt

SEQ ID NO: 16847 - DNA, 1427 bp, Homo sapiens
  misc_feature (1)...(1427): n = A,T,C or G
cctgcggcgccgcgtgagcacaccccgcacaccccgtgtacggaccagggcaccgccacgcagaacaacaaacccgccacacacacacaactaaacaaggggacggggaggacaaaaanatgtaggtgtgcngntcgatgtgtgtagggagagagccgagccatagagnatggngagtgcgcacagtgcacgcanggagcgcgccgcgcagccggcgcacacgaggccacacaccaccaggcacgcccaagaaggtctgttttagcagaactctcgagcagccagcgcggcacgaatcgaanagagangatcaaaccaccgtggacggaacaagacggagcgcgagagcacnactgtatgagcctgnanccntgacaggccgacagtcacaatgcacgtcgagcaccacagactgacacagtaatgagccacgggcaccacacacacagtggcgngcgacactcacagggacgcgccacacgcaggcaagaacacaaataagagaaanaaaagaaagcggcttgtgacaagaacacacaaatgggcgggccgggtggggggcaatggagacgaagacgacacgccccccaccgggccccgaccacacatacgaagcccagcggcagagagatccacaccaagctggccgaggcccccacagcagggcgcagcagcgaaacacggcgaacatagggcccgacgacaaagcgagagcgcaatgggtagcgccgtgattgcgcngcgataccaacgccgtggcgcgcgttgccacgcccatcgcggcccggaagaacatcggaagaagggaggcgccggtttacaccactatacaacccgagtgggcccgggcggaggctcatcgcagcggcgccgccacccgcacacaaatccaaaaccgactgagcccccaccggcgcacccgccaagatgccgccccaagccacacgggcgccgaccacgaacgcgatcgcaccacacaacgagcgaaaacgagcacacgaccgccgtcgaccacacgacgcgtcgccgcagtacttcaatcgacatacgcgatgccggaagtaacgcacggagatcgagaaccagcacacggatctgggtagccgacccagtgcatagcttcgatggccgtggtccaccgangacagagaggagagcgcgggatcgatcgcgaatcaatcacaaacacacaaacaccgccggcctcgtgtgcgatcgaattgagactatacacaggattgaggagagtgtatgcgccgcgangtaggacatggccgacgccacgccgggcgcgacccaagacataacgtcgacacagatcccaagcctacgcgcgagatatgcgggtcgcgcagcgcncgcgcanagaagccacaaccgaatgcgacagcgaggagtagcgatacaccgacgcggcgcaaccgcgg

SEQ ID NO: 16848 - DNA, 907 bp, Homo sapiens
  misc_feature (1)...(907): n = A,T,C or G
aaaaaaaattaaaaaaatagagggatagangnnngngtgtatacagttcaggaggtagcactcactataggccagccctgcagagaagaagaactgacacaggcagccagcaaaggagatgcttttgtcttcagagatgcaggtcactaggatctttggggtgtagacagaagaataccagagatgcagaatcgacggattgccagcgacaaaatacatggtgtgtgcggaggcaggagtcattacggatgagcgcgaggagggggctatgggctaccacaccgagagagggctcgcctattagcactgcgaacagggccaggtgggttcctgtatctgtgtctaagtctttgtcgataggattgtttcggctctttgattttcttctctcagtagtttttactcggattgcgcactgtgggggaggcgatgttgaaccagggtagtcgcggatgtgtgtggactggggtccgagcgttggttgcgagttgacgttaatgtggtcgatcgttcattgttggtggggaagggctgttaggctctcttctatttctttggacgagcgttctcatttgtttgtgctcccagcgggcggggagttacatgtgtgttagtcgcctatcacgagaagtgcgtaagattgggcgatgggtagttcgagactgctatgtggagtaaggtgatggagcaggtgtgacggagttactggattatagggnctcgtatacgcgtcgagcggccaagagagccacctgtgttctcaggtgatttcagaatatctcagcggatggcgacacgggttgttggtgcacgtaaagagacgcacagaggagccgatgtcgccgagtgagtcgtccgttgattcgatgaatgagaggggggcagggtggtttcgttatggtgagtt

SEQ ID NO: 16849 - DNA, 1059 bp, Homo sapiens
  misc_feature (1)...(1059): n = A,T,C or G
ataccaatatgcagtgctcgtttctaccttcccccaccacccccacaccggaaggggaaataattgttgttgttattaaatctgagttgacttgctgtggacagttgcgagaaaaaatcagagcgtgttcggccgcgcaggcaaacgaggacaagaattctcgccgatgagcatagttgtctccttttctaaggtgggagccgccctgccgatacggcaacagatggccaaggaaaaccgggaggatagaatggcgggccggggttgggtatagacaatgaaagggacgcgcgacgcggcacaggacccaaccctcactgcactagcggtcgacctattcagacggggccgccgttacgcaccatgcgcacgcacggccaacaggggcgcgacgagaatgcagcgcgccatcgtgcgccgtgtgtgcagctatcgtccacgtcgccgcgttcgtcccgtcagccgactgattcatgactgacaatggggggtgtcggttgtgcacaatatatcctctctccgttgtcggacggtgttagtgcgaatgcgccgaccgctcgcgccagtcaaaacaacacanatatagtatgtacaccgacgcgcacccgcaaatgtaggcacgcccaagctctccgacaccttacgagatcggcgaggaggtatgtagtgatggacaaatagtagcacgcgtgcacgatgcaagcagctgccacatgaatatgatggtaatgcatttccggcagaatgcatcggagttgcgtcggctgactgggcttggtcgtgatacagtattcgatcgatggataggggccgacgcgaaaatagaagatcgcggtaacatcgctaacatcatataccagtatgcccacgcggcgtcgacgacgataggatcattctcatnattgatggagggtaagagttgagagattgacatgtgtctcggggcaggtgcagcacacacatatcgacaaatgtacccatgcacgcgcatacatggcgcgcgtccaaccgaaatacgacaaaccgtggacatagaatagcacatcactccgcatccat

SEQ ID NO: 16850 - DNA, 777 bp, Homo sapiens
gctccaccgctgatgccaacgaggccatttttttttttgtttttagactggtaaattttgttgtgttttattatctggtaaaatattgtagagtgatacttagaagagataccgagatacaaactttttggaaaattaccttcagattatgaatgtgttttcctcacacaaagagaatatacatttgttcattagatacggggggtaagataagactacttatatgactactgacctgaacaagataaaacatccttttgactccagcccagaagagaaatatgcttgataattatgaacaactggactatatttatagaggcaacctgccgcacgattgtattgggggtggatatggctgattcatattttgattagacgtctcattgacttaacttgtatatagagttgcaaatgtacatccgaaatcatactacgtaggttgaaccaaactgacaagacacgaatgccgtggatcttaccagaagagaaaaagtagagctgtgatttttcggaacaacactgggaggagcagcgaggaacctgctatgctggacgtgtgagggcgggtaagacggaatgctgggtaaatacatcgcgtggttagcgtgatactgctcctaccaagatgagaccgtgtttggttttgtgaccgcacgctgccccacgacttcggggcccacacacaccctagctgcgccacccaatcgcctcctgctctcacctacgcactttacgtactccgacctcgataccacgcatacaatgcgagcccag

SEQ ID NO: 16851 - DNA, 844 bp, Homo sapiens
  misc_feature (1)...(844): n = A,T,C or G
cctggccgcagagctccaccgctgttgccagcgaggacatttttttttttttttgcataagcagggattacctgngttatgtaaaacgaaccatgacattataaatatagcaattatatttgtcagctttgggtgtataacaaagcaccccaaaacttactggtttaaagcaaccactaggttgagctctgctggacggctgcgtcattcctttgatctgggaaggtgcgtcatgctnctgccggcacttacataaagaaagaacaaaaaaataccctccccttcgngagcgagaggcgccttcaggagaccgcgtgagggggcgcccccctngggcgtgngcggggggggggggggaaaaaagccngcgcgcccccccgccccgccccgcgcccccgccccgcggccgngcccgcgcccgccggccgggcgggcgcggccgggccccgcggggccgggccggcgccggccgcccgccgccccggcgggcggccgggccgcccgccccgcccgccgcgccgccccccgccccccgcgcccgcccgcgcccccccccgcgccgccgcgccccccgcgcgccggcgcncgggcgccgccgccggnngcccgcgcgcgcggcccccncgccccgcgccgccccccccgcggccccncgncccgggcgccnccccgcgcgcgcgcccggcggcgccgggggccgccgcgggcgcgggcgcggcccggcgcgcgcgcgcccgccccgccccgccgccggcggcccccacgcccgccgccccgccgcggggcccgcccgccggccccgcgcccgngcccgacgacccggcccgaaagaagaagaagaaaa

SEQ ID NO: 16852 - DNA, 781 bp, Homo sapiens
ttcatcctggccgagagctccccgctcgagccaacgaggccatttttttttttttttatggaaatgagcaatctttatttaattcagtattactatttattgagcaatgaaaagggttggagcctctttgattctttcaaataaaaaggaaggtggcaggagcttataaaaaaggtagggggaactccagtctcttgcctttgataaggtagagggccccaatagtgctaatttgtgcttctgaaggtcttgaccacagtggcagatggggtccagctgggtcgacgagggtcctgttgttccctttccccacttgactcttgggtggaaattctctctgctctgtaacactttggctcaggggaatcaatgggggtcatctcaaaggcgtctactactatgattctctggcttctgttactctattcttcttccttcatctgtggacctatggggagtagcattactcgagacatgatcttggctgcctcccgcaccaactgcatgacattcccacaattttactctccccctaccctccatcccacttcctctcgccgcccccccaaccaccccctggctccggatggtggtagcgactgcatcattatcccccttccaatccctctttacacacgcaccctcgccatactcccgctcacgcccccgccgccccccaccgatcacgcacttaacacccctccccaataacccgggtatcatcctctcaagctttgtcctgtcccggttggcgaccgggggactgggtggtggcggcgga

SEQ ID NO: 16853 - DNA, 800 bp, Homo sapiens
  misc_feature (1)...(800): n = A,T,C or G
tttaatgcttggcgcaacactccccgctctggccagcgaggaccatttttttttttttttttaattcacaatccttctcncaggggaaatataaacctatgttcaggggtggttattggcatgtaacttgcaaaaaataatgtttcgagagaaatcatacacttattttgtaaatacaggcaggtaaattggaagctctgtgatatatctaagttcatactttttgggtgtgcttttttaacaaatggaatgcattgacttctattctttcttccttccctgccaggagnctggggggnaagggatcacatggggatatggcgcaccgctggagaaggtggcacctctcattgtatgtacagacattgaacatgtgccaagggaaggggaaacatcttccaaggccctgatggagggcgccgccgcctcttgtgtcccccttcttcccttcccccaggcgggcccccccccccccccccgtacccctcgtccgcgccccgccgccgcccgcccggcggccccccccctcccgccccgcccggcctccccgcgtcgcgtccccctccccctgctcgtccctctcgttgtctccctcccgcctgcctcgcccctccccctcgcccccctccctcctttcctctccctccgccgcccccttctcgcccccacgcgccgctactgctcccctctcccctgaccgggcctgtcccctacgcgtaccgccccccgtcactgctatggtcccggctgctcgagtcggggcgcgaccctgtacgctagatatagaaataacaagaaat

SEQ ID NO: 16854 - DNA, 775 bp, Homo sapiens
  misc_feature (1)...(775): n = A,T,C or G
actggaagcngcgctgcgccgccctggcncgtnggatcttctttttttttttttgggcttccccctttaattgggatttagacttttctcaggaacctccccgccttttgttgctggttgcttggcaggttgctgtacagaactagataggctgtacgaatcgcttgggggggtgatggctgcccacgctctggagcgaacgactataaaaacaagttcctcccttggaggcccgacancccccaaanggctctttgccggtcttgtattttgcctgatctctttctgttgtgtacccggccttgggctgctcgccccggccgtggcactttggggctcttgtctggggcctggttgtctgtgcttgcttcttggtccctgtggggcggcggtccgcagggggtttccgctcgtgtcgtccccccgtgttgttcgtctggacggtgcgggaggtgccgctgcggctcgtggctttgcggcccgcgtggcttgcctccggcgcccccccgccgtcgcgccctccccgcctccgctccgcccctcccggcgtcccctcgtcgggcccgcccccccgcccccccccccgcccgccccccccgcctgccgcccgcgcccccctgcgcggcccccgcgctcctcgcctncgcgcgccgcccccgtcgccgggcccgcgcccgtcgtggggcgcccggcggcgcgcgcgggccccccgcggcggcggttgccgcggtccctgggtgccggcgccgtggcgctgcgcagaaaaaaaaaaaaa

SEQ ID NO: 16855 - DNA, 301 bp, Homo sapiens
gctccaccgcatgaggccaacgaggccattttttttttttttttgtatgtgtcagacattctatagctactgagattctcattgtgtttgtgaagatattccatgcatgactttatcttcctgtgtagactccaagggtgctgttgggtccgctctgccgccatctttacacagcgtgggcagaggcacatccaccaccctctgctggtcttcaagtacacgtcattcagcagcgtgatatcctgtaagcagccagtatacgtaaaaacagcccagccatgggacagctctctcatccaca

SEQ ID NO: 16856 - DNA, 861 bp, Homo sapiens
  misc_feature (1)...(861): n = A,T,C or G
ggggaaaggggggnnggggtnnnggggnnggaggnaaaaaaaaaaagggggnnggttgggcgcaacactccccgccttggcncgggaaaccattcttttttttttttttcctttttatttattttttgtaggcggacaaaacccattgnatatcctgcatttatggtatacaacatgatgtctggaaatatgtgcccatgaggaaatggctaagtcaagctaattaacatatgtatcatctgacataggttttggggcgaaaacactcaaaatcagacttgtttttagtgctgaaatatgcagcacattgttattaactatagtcttttttgatgggccgtttgactaggccctaaaattgatttaacaacccagggcgatgatcgatggtgccgctggctcgccccagttactcccctcctggtgagtttacccctgccaccgctccccccctctcccccccccccacccccagcccgggcgtccagcgtccacccagagctcacagaccgcggtccttccccctgcctcgggtgcgtttcctctccggtccttcccgtagggccgccaggcgggtggncatgaatcacttaccccccgcgacgatcccacccctcccgttcgcacgagcggctagtagctaagcggccactggatggtgcgatganctcgccaagtcacacctaaaggactaccannncgcgcgtgtcgacggctacagtgtggcacgggtgggatcgcgagagcctgtccgcccccatctgtgggccggtcgttcgttgtgtgtcacggagtagcacgcacgaccccnctgttctctgcagggttgggttagtgcccggccacacagactgtcgaaaa

SEQ ID NO: 16857 - DNA, 284 bp, Homo sapiens
  misc_feature (1)...(284): n = A,T,C or G
ggcttggncggggaccctccaccgccctggccgggagacatttttttttttttttttcattcatcaggcacctattggggttctaccatgctccagccccgatcctggcacgggggccctgctgaaacaaagctgttctctgccctcaggagcttgctctctgataggagagacagggactgcaagctcaatccccaccagaagcgctgggaaaacaaaacaggttgctgcacaggngactggaggagggggacagttcctgcagaactgtttttttgaaaaat

SEQ ID NO: 16858 - DNA, 798 bp, Homo sapiens
tgctcatgcggcccagagctccccgctgaggccaacgaggccattttttttttttttttttaagtaccaattcagtttattggaaagatatggggctgtgggatagttaatgttgttattacatcaaggtaatagtaacctgggcttgggagggaaagaaaccaggatggctctgggtatctcatggcctttctcttagagcactattctcagacccagcctcgatttcccttcatcctggatgtctgtgtacttagatttcaaattcctgcagggaagaatcttattgcctcagtttgggttaggaggctgagccttgaaccaccgcctctgctccgggcatcgcgatactaccaccgtcgcaacgccttgccacccgcccgcgcggcgctgtcttctcaccttccctcctcccccagccccggccccccgctcccgcccccccgctgcgcgcgccgcctgatcctcgcggcgccccacacgcctgactatcgccccgcgctcccccgccgcttgacccccgaatagccatccaccccccgccccggtcacccccccccctgaccctctcccctccccgcccgcaccttcgcccgcctccgcgcccgctgccgcccccactcccccgccgcctcctcaccggccgccctccaccgccctccacacccccctccccccctcgctcaccccaacccccccacaccccacccatccactctcccccaccgccacccccgactccgccctccctccacgccacccgcgccgcgccccgcgcgtgcgcgctgtccgcgcctg

SEQ ID NO: 16859 - DNA, 754 bp, Homo sapiens
ggccagcagagctccaccgcatgatgccaacgaggccattttttttcttttttttgccactgctggctggggggggccagcttttattccattatttgtccccacccacatcctgctgattggtccactttacagggtgctgattggtccattttacagagtgctgattggtgcgtttacaactctttagctagacacagagcgctgattggtgcatttttacagagtgcttattggtgcatttacaatcctttaggtagacagaaaagttctccaagtcctcacttgacccagaaagtccagctggcttgacctctcacctctttcaaaagacaaataagatgtactcccaaatttcaaatagtgatatggacttaccactcacaatattgtgatacttgctttcttgcctggaggaatggatcccctcccaacctcccccctccctcatcttctccctgcgggcgccttcgccgactcctgccccgcgcccctcctccctggctgaccctcctccccgctcctccacctaccagtcccccgcctctattccctccctttctttcacacgtgtctcaatcgtctgcggacgcatatggccaactcgtctcgacgccccctatacccttcgtctcttcccctcgggcggcccccccgccccgctccgcccctccccctccccctccttcaccactctcctccccgcccgccatccgcccccctcacccacgccccaccaccaattactcacctg

SEQ ID NO: 16860 - DNA, 891 bp, Homo sapiens
  misc_feature (1)...(891): n = A,T,C or G
aaagggaaagagaagaannaaagnaggagagagaaaaacccacacgacgtagcgcagcatgtccaccgctgtaggccaacgaggccattttttttttttttttttaggaaaagattttttttcagaatatataaagaaccccttcagatcattaacaaaaagttaagccagacaatttaaatggcttaaacagacagttcatgtgagatgatgtccagctggatgataagcatatgaaaaggccggcggtcgcgacccttccccctatggcgtagaccccaaaacagcccgccttcctgcaggaagctgaactatgaacagacactttttgtggcgcgcggccctcgtttgcgcggggcaggaagagagatggagagggcaagcgaaacgtacaccgataatatacagcacgggtccggacggccaccgtgaagggacgtagtgggaggggaggcaaacgaagacccaccgcactgctcacacgcccccgcccatcccgtaccccccacgctgcagagctctcgtcccgcgccgtagcccccacccggacacaccccccaacggcccgccgacaccccacccatgtcactgccctccgtccctgcgcccaccagtccaacgcacccggcgctatgcgctcgacggggcccgtccccctcacatccccggcaccaaacgccctcactccatcactctgtcacgcatccgagagaccccacatcactcgtatgcggccccggcccactccaaaacaaacccccaccaacctcaccccccccatacaccaccgccccccacagatccgcgaccaggacaccgagccggagttgcaccgccaatccccaccgacaggttcgtgggtgtcagtgnatggcataggcatgtgataat

SEQ ID NO: 16861 - DNA, 239 bp, Homo sapiens
gctccaccgctgatgccaacgaggccatttttttttttttttgcagaaatgtgttatttattagaagttattttagatgcaagtggatttgactattcagttaaaagatacaaatcggcagcatagaacaaaaatgtatatgtgcaactatatgcgtggtgtagaagacttattggggattcagagacgccagtaggtggaaagggagagcatggacccatatatgcgctgcgcgtacg

SEQ ID NO: 16862 - DNA, 408 bp, Homo sapiens
gctccaccgctgaggccaacgaggccattttttttttttttttgtgaagtgcctcttcagttctcttgcccgctttttcatagggatgtctgtttctgaatggtttgtttttctttatatattctcggcatgagccctttgttgttcattaagatgcacatgttttctgccaatctgtagcttgctcttactctcataatcacattttttaaacaaatagaagttgctaatcataatatggtcagtgcaatgtatacatctttttatatcccatttaagatgagctgattttgatggattgcgcggaacaggagcctgcctatataccagtggatctattcacttgcccagccctcattttatgccattgaaataactgacctatgggaaattcaacccaccagcctt

SEQ ID NO: 16863 - DNA, 800 bp, Homo sapiens
tggccgagagctccaccgctgaggccaacgaggccatttttttttttttttttttttctttttttttttaatgaaaagcaagagaagtttaatataaaaaattattcgacagtgatagaagaataactataacaatgtaaagagaactttcaagggtatccgaggattgagggagagtacccaaggaaagacaactcggaaagacggttctctccttaaggctggggtcaggccttgttggagaaggtgtgttcgcagtccactagatgtcaaagaagcctgctgttttccaggaccaggagatggtccatagctgctgggcaaataggatgcaatttcttggagcacaggcaaactgaggctgtggctaagtgcacagacaggccactgctggggacgtgaggcctggagcacacagagactgtgttgaacggctgcgacaaggcgccccccagcctcataaccccctcgaacccgccaccgaggaatgacgcccccgggagccctcactgctccacgcccacaccccgccccccctctccccaacccaccctacagccccacctcccctcctcgtcttcccgcccctgtccctgcctcccccccccgtctgccctccccagacgcccgactacccgcgcccccagccccgcgcgtgcctcgcgacccctcccaccccgccgcgcaccccgcgacctgtcgctcaatcccaagagcaatgataaacacaactaacctaactactcacaccgcacccgcgaccccggcgcctccccacacacgcgccgaacaaacgaatg

SEQ ID NO: 16864 - DNA, 776 bp, Homo sapiens
  misc_feature (1)...(776): n = A,T,C or G
gcagagctccacccgctgaggccaacgaggccattttttttttttttttttagacagagtctccctttgttgcccaggctggagtgctggggcatggtctcagctcaccacaacctctgcctcctgggttcaagcgattctcctgcctcagcctcttgaatagccaggattacaggtgtgcaccaccatgcctggctaatctttttgaatttttagtagagagggggtttcaccattgttggccaggctggtctcgaactcctgacctcatgatccgcctgcctcagcctcccaaagtgctggaattacaggcgtgagccactgcatcatttgatttcctgtgttatacattgacaaacaggacagttcactgtctcctctctagaacataaactccatgagggtaggaacttggacctgttaactgagccaagaattaacacatgtatattgaatgagcgatcatatcgagcgatattcgacccaagggcgctgaccctttcatccccgcgccacagtccagccctgcctgccaccgcccgccaccgcccccagcgtcagctccttgcagtacccttcctctttcttcccctccgcgcgccagcaagccgccactatggccctaacccaacctgtcgtatatcccgcgtctctccctcctcccccccaccccctccccccctcattatcgctccccttccggcgaatcgccggctcactctcctacccatcacccgcatttgttnataagtggataaggtccatacactccactc

SEQ ID NO: 16865 - DNA, 872 bp, Homo sapiens
  misc_feature (1)...(872): n = A,T,C or G
aaaannnnnaaaannnnnnnnnaagggggaaggagggaagagtcagagntagagagnnncttctcaccccggccccaccagctccaccgctgcaggccaacgaggccattttttttttttttttttgccgtatctctcttctttatttctgggacttcagttaacacatatggcagaccttttgattttatcttataactcactatggaataattttcttcaacttatcttttttgtttttcagattcaaaaatttccttttgggttatcttcaagagttaccgactcttccatctatacagtgaatctttaaaaatacatcagacaactcttgaactgccattttgatctttttgttaatgggtccttttgcttttcccggccttatgtatttttaccgcccctcgtgccgcggcccccacccgcgccgccccccccccaccgccgccaaccccccgcccccccccccccccccatcccgccgccgcgtcggccacccacacctctcccacgtcacgcccccgcccccccacccccccccgcgcaccacgaccncaacgcggttagctccccctagtccgccctagcacccacacccccccgcttcccccccccccgcccgcctccccagtgtgcgccctcgcccaacgcccacctccgcccttcccgtcctccgtagcaagcccgcgcagctcagtcgatgagggcgagcaggtgtcccacgtccggcggcgcccccccccccgcccggacactccccctcgcatcaccccggcggggagtacgccccctcgcccgtgctcactcatgctcctacggaccccccgcgcccccaggctcgccccggccgcgcccccccggtgagtcgcccg

SEQ ID NO: 16866 - DNA, 831 bp, Homo sapiens
ttggaaaaaaaaagagagaagagttaataccggccgcatactccccgctgaggccaacgaggccatttttttttttttttttgttctgctttttattatagtatgatttacattcagcaacaaacatgaatcttgaatgcaatttgactgtttgcatacgtagacatccatgtagccacctccagatcatgatatagtagtacattttcatatgcccaggaagttatgttgacttcttttactaaaaaataccccattcccttttcctgaactaactactatgctgattctattaccatgtttatttttggaggggatatgggtgagaatctacaagatcgataccttaatgcctgttctccaccatcccaccgtagctctacaacttttttacaccgccttccgctctccccccacccccccaccgttcccacatcacaacctatagagctatatttgatatttaaatttcttaaaattctaaaaccaccccccctccccaatccccccctcacccgccccccatacttccccacctcccccacatcacaatatcattcatcccacgcgacctagtcacgatatgtctgactaccatgtcccgtatcatatcctctcatcacccccgtccacccctccccaagtcgactctcaccgcgttgcatataacccccaaccctcgcttcatacgtcccgataaactacgtacctcccctaataagctattcggcggtcgtagtggacaccccgccacaccagtccaccccgcgagccgcttcgacccctgcagccctacgtatcctctcgctcgacatcccataccccaaccat

SEQ ID NO: 16867 - DNA, 816 bp, Homo sapiens
cctaaatatctgacgagagctccacgctgaggccaacgaggccatttttttttttttttttaaaaacctttgttacacaaaacataaaatagatttactaatggatctttcagagatatatgtaacattttccctaatattacacagaaaaaatatatatagttatggttacgatagaagtttccaaatattctgaattcataatagaaatatagtagatgcatatacaaattaataagtgaatataatgactattaaaaccaactttgttgattggttctttttttttatgggaaacaaaacggcaaaaaggagagcggaagacatagacgaccgggggtttttggttgtcagagtatgtgggattttattctcggttctaccgttcctcggctcccttctcgctcgcattgccacgcccaaccgatacggccggaggcgaccgatcttcccctttatcctcttatcagttcactcacgtcattgagactttgatgcctccgtcggactcctaggtcaggtgtgtcctagtgcatgtcgcgctctattacacctcttgtctgcatgccgcccgtaactcccctccgccgtccatcctccctcgcgcgccggctatcccggtgcgctcctggcccccgctctgtacgtcctaccgccggtgactcgtgcagctcacgcgcccctcctttatccctccatcgcctcccccgttgttagcattcgcttgcgcctcacactacccctcgtccccaccgccgtccgcctggccgacctgtgggagtgacacacgccgaaccctccgttacttatccatct

SEQ ID NO: 16868 - DNA, 225 bp, Homo sapiens
gctccaccgctgaggccaacgaggccatttctttttttttttacatttttttttttatttataggctcttactataccgccagttctttaagacattaaagaatatttttgaaaatatcttgcaggctttttgtcttcattaagagagctgatgcagattgcagatatgggggaggttgcctggacgtggcccctcggccgagggggccgggcgcccaaaacgct

SEQ ID NO: 16869 - DNA, 779 bp, Homo sapiens
agcagacaacttttctttcgagctattaacagcttttaataatctactatactcctctgaacaaaatttggaacatatttgtttctctctacctaatttccccagaatttggaagctattttttggacaaaattctaatttttctaagctacaagtctgcaaaatgatgtatcgatgtttttttcattttttctaatttggagtcaccataaactaaggaaaaacattgtcccacaatgggttacctcagatcctgcaggaagcaactgctgaggaagaatttcaaaaatctgcaaaaatttattagaagaaacacctatgagaacaaatgaaaaggttggatgaaagggttgggcagaaggacatcaaggaacatttgaattaaaatctctggattcaaaacagatgctcttgtctactgcacagtgttctagtgcctgtttcaaagtcttgatgtgagaagtcaatacatttacaaaaggaaagttctaagacttgccgggaccacttctcaagaaagatgagttcctctaataattatttataattttctctcctatcaacctgattaaacaagaaagtaatatgggtgcacttaataagaaagtgtttttggttttttttattttattttactagagataaaatttattgtttgtgaaaaggggttctaaaaatattttgatttaaaattagttccactgaatcatcaccaaaaactctcaataaattctaattgtcttaagcataaaactgtaagatgatttacaaggaggctt

SEQ ID NO: 16870 - DNA, 1110 bp, Homo sapiens
  misc_feature (1)...(1110): n = A,T,C or G
ctgtgttctctctctttcttctactgntccccccacatatccgacttcattccccttccccgtatttcatactagtattataaataattataaccgagatgagcgcgtgttgataaatgtatatatacgtgtattgagctatgcggattctgatagtgcgacgcacaactatatttcatgtattcctgtaatatatacacgaaaagagacattatttcaagcaagagcacgaccgtaggggtatgggatgaactatagagtgagcccgagccgtcgactagcccaaaacaccacttctatcagtttcatctgcacttaatatcgccgatgccttccccaagcgtctgcaccactcgcgtcgtccctcagtctcaacccacaaaccacaattagtgccatcatttatgcgtcaatgttattcaatgcctgatatcatccccacgaaggcgaggagtatttgttttccactagttggggcggtcgtatgtagggatgacaacattgagctacatggattgccggcaagagatccacgcggtacgacgctattattctccgttcggccgtatctttcttggccggcatgtttcgcccatgctctccccaagctgacatcgtcctcctctagttttgtccatatgcgatagtgcttatcagatgtcgtttattctgtcaagatatcgccctcgcgcccgtagatacgcgatttcgcagccgaggaacagtgtatagtccgaatcgatatagagcgcgcgctatagaatcaagacaaatgcatatcagttatttcgttggacgcgtatcgtctgaagcgctctaggacttataattgacacctcatgtagttttgggtgatgtcggggcaggtgttgaaacatcctccataataacgccattcatcctctctatccgattcgacaccatttgctatgcaaatatcattccgtcctctcacaattcatccgtcgcagtctccttcgtccgtcctccatgcatgcatcgacatcgtaatagtgtacgagttgcnaggatcgtccgtacaggcacacggggagctcgctgtcgacgataggtacacacgatcaggtatactatccgccccagcgctgc

SEQ ID NO: 16871 - DNA, 773 bp, Homo sapiens
gctccaccgctgaggccaacgaggccatttttttttttttttttcgagaaagttaatttatttaataacatatatctacctttatcaggaaaaaataaagcagattatcaaacaatgagaatgatgggattgtgacaaaatctatagatattgaaaagtcaatagagaaatgttatggacaattttatactactaataaaatgtagataaaatgggcaaaattttttaaagcaatactaacaaagttttttcaacacgaaatatatatatcctgaataggcctttttctactaaagacattgaatttaaagaccttgcaattaaaaaaaaaacaataggaaaacagaacaaaacacacaaataccagcagagaagggcgtgcgacctatatggatggactggggtattgaccaagattttactgacaagatcttcccttctatcctccacccatccgcagcgctttccaccctccttgcgcgttcggtactcattctcccacccatttatcctccgaccgcagcattggtcccccgcccggcccccgccgccaccacttcttcttatacatcccatgtctctcttcccccccttttcgacgcgaccatcattattgtggtttacttcgtcacctaagctagtctactagtatagtatgtctgccctcctcttcgtggtttcacctactcgtcccaattatgaattacaacagtatgtcagtcgaggtggaatatatattgagtgtcttgcctcgtctacagcccgacacaaat

SEQ ID NO: 16872 - DNA, 1132 bp, Homo sapiens
  misc_feature (1)...(1132): n = A,T,C or G
gtgggtcactctacactagatagcagactgtatatcnatacagtagacctcgcacaatcncttaatcacattaatatatcagaanttttcaatatatttagaagtctaacatgtgtcacgagaaaggagaacttatacacgttgcactacaagatgaaactatgggcactgttgaaccttgtcgagtcaatcttctggcaatgcagaatagaaaacttgtgtaaggcacctcattgcgacaatcgtgatgcatctgacatctcatgaaacatgcgcacgaagcagccactaatcatctctggaacaggcgcatgtacgtaaaccacgagtgcaccatcactatgcacacgctttccacaccatatcccgagncacctacgcgtgcaacacggtatcgtatgcaacccacgccaccattagtcacgatcatccatgacaaaccacgatgctgtgactactattgccttcacacgttacgatcgacgcgaacaacagcacatatgtacatgcattttataaaaacggtaagagtttataaatggatatttccaatcgctttgccagcttcgccctcacatatgcgaccatatcccgaattaatctccccatcatcctcttcatttcgagttcccttcacattttcctcgctcaaccccccacctgctcatccatcaatctgcttaagatcatcgtatcctcgatccttcctctctcctgattatgcccgcagcatttggaccatttccctcatcatttctttttctatccatccgcccctgtcgaaatatcaaacattccgtttttcgacgtttctttcatctattcgggatagggactcacttccttcatcgtaccttctagcgtcctcatccgcgttcgtcgtcgtctacacccaccattaatcacccatactaccatctcttacgcattcgtaccctctttcggaacatatcagcaactcattaaccatgtcgtcatcctcccgcccgtcgtacccccatccgtccaccattctgcattccactccagtantgatgaggctaacttacatccatagtcattgacattcgcgcatcttcatattcacgtctgcagccagatctaatcgtattctcatacgcccacgcatagc

SEQ ID NO: 16873 - DNA, 801 bp, Homo sapiens
  misc_feature (1)...(801): n = A,T,C or G
gctccaccgctgatgccaacgaggccatttttttttttttttttttgcaaggtactgtgtcaaatgttgaaatgctaagattacattacatagaagatataagtcctatatctccttgctttactgagctgcaattttgtaccataatatgagattcacatcacttttgaataataattcaagttcaaatatcaccaaataaaataaaagcgataatgcaacataatgagctaatgggcatatataacatgattttaaagtgagacagcgcgacatttatttttctgatgaaaagacttccaccaaacttggataaaaaatgcccctacccagcccattgcagctaccagacctcttcttacttcattgcttctattccgccacccccacaccctcccaccctcccctgccacaacccaccctccccgcctttcccacctactaataacatccccaccatgctcgagatctcgctcacgctgctcctgcgccgcccaccccccacccccaccccccctcctcgcccctctcgccacccccggactacccccaccccccgcctctttttcccccccccacgctcctcctcctttatacaatacctcatcttcctcattccccctcactcccgaatctcgcgacacactccccttttctctctccccctctncaattttcacttcctctcatcacaaccccctgctctccccctccccgcgcctcactccgccgacttcactctaccgtcttaccactccccccccccactcatcccaaactccaccctctccaccgaaacca

SEQ ID NO: 16874 - DNA, 1349 bp, Homo sapiens
  misc_feature (1)...(1349): n = A,T,C or G
gcgccatgattcctactccatattactcgcgagcgcatctcccattagantggtacattanaatagatcagccatcgaaagtagatcatactacctggtcgccctctatcccgtccagcgcgcacactcacacaccagtaaagccacagatagatacaacgtcatagatcagcctgcaggcttcgcacgcgaccgcatgctttcggcgtacggatctctacaattccatgacacgtcggcaccaactccgtcgctggcaagagagtncgcgcacgcgcccagagtgnggaataactacgacgatgtgtggagtggtgcggttacgatatatagaaatacatagtaatactgatagtacgcatagtacgtccagagaggagcgggatcacgcgcagagagtgcatgncacaagagagattggaganagtttcgtctggcagcggacagcatagacgagaatcgacatggtacgccgccgctcggagttgcacgcgtagatatcaacgcaccatacactatacaatcaacaaaacactcacncagactgtagcgcgcgagtatccacgtagtcacgcgatcaccgcatcagacatcgcacaatgacattccccatgtccacgccaccacaacctctgcagccacaccgaatcgcacgccgtcagatggcatcattgtaacgcgcaccctcgactcaccgacgtcagaatcgactcctgccgagcacacgggatccaaatgatataaaagagggaggggagggatgcaaaaagtcggaacgctcaggtagcgcgctcggccgcggcctccattctattcatcggaccacccaccgaatcctgttgtgggcgcatcgcgcgggtccccattcgtgtatttcatgcgctataagtggtatgttgagttaatgtcctcgcgcgtacgttgcgcatccgagcttatgtcgtatcgaccaatatcgataaccaatacgtcacgacgatacattcaagcatacgtcgccccgatcggcatcgatccactcatcgcgttcgccacatgtaaacggaattgaacggcgtagcgaagacgcacgcgatatccgcacactaatcactatcgtatcgacgttgcaccacccactatccgcctacggaggcggcggtggggcgcaggaaggagcgtagtgtcggtgcgtgggccgttacattaacacttatactatatataatcgttgccatgcgttgccggtcataatcatcagcactatcaacaatatcttcgtgtcgcacggatatcgccgtctcatcgcaccgccaaccagcctcccacaccaatcgtaatcacgttagtgccgctatagaacgccacgt

SEQ ID NO: 16875 - DNA, 774 bp, Homo sapiens
  misc_feature (1)...(774): n = A,T,C or G
ctgattctgaattccattaggacaactgatgccagccagtttgaagacccccacagaggaaccgaatcagcatgagaatacagctgtttcttctccctgtcccatgacttcaccctgcactcttcaacccatcaacaattcaacacttcggcctcctccaacacccttgaaatccctagccccaaactcctcaaagatatgaatttgaggttcctttccatctcctcatttggtgaccctgcgattaaacctctttctctgctgcaacccagtgtcacagcctattgatttgtccctcacattgggcaacaaacctattacggttacaagtgaggtttctttttcttccccatcgtttcctactccttcaacttccttaaagcaaaaagggcaatttattcctgggtgtttcataaaacacaagggcaggataaagcgggaaagaagttagggctagaatgttctctgtcccttgtttctgcctctttctttttccatctgctccattttttttttttttttttttttgagacggagtctcactctattgcccaggctggagtgcgatggcacaatctcggctcactgcaacctctgcctcctaggttcaggngattctcctgcctcagcctcccgagtagctgaaattacaggcatgtgctgccacacctgnctaatttttttttttttttanaaganacgggggtttcatnatgttgggccaaggctggtctanacctcctgacctngacccctcccaaagngctgggaata

SEQ ID NO: 16876 - DNA, 813 bp, Homo sapiens
  misc_feature (1)...(813): n = A,T,C or G
cttgtataaggaggaagagattgagtaagaggaattctccagnagtctattaactatactacatcaacgcctccaagatactatggtacccatcccaggggaagtggggctacaagaacagtataaatatctcctattggcataataaatggtgtaccccaagaatatgccaagggatgttttgtagagattttgagactaagttcatgcctgtatggagcctctaaacatgaccaagacatcagacttaataagaatctctggataagaccattgaagaggatgactgggttnatttttatatgctaaggggncagtgngcttgtttttttgncactttgggggctgnttattgatacanantntggtgnntcttnttttttggnnagacantnttnntnntntnnnnaacannnnnttnnnnncgnnagnccaannnaangntnnanatnntnannntccnncnctntnannccnccccttgcttnnnctttntntnttnntncnntctctncnnntncncnatnncnncnccccatcncncncncncccaccgncnccnncnnccnnnccccgcacgcntnnncntncngctnttnnnntnnttntntncntcnnccnntnnccncttcnnnnnntngnnncnggcgnngnnnccanctnctgngnncccccccnnnnnncnnncganncntcncnntncnnctncgcactatccgcgntcnccnntctcnncnnnncntnntnnnntncctgcatnaacgngnaatcttnncnnctnttattgcnccccnctgtccccgctntcattta

SEQ ID NO: 16877 - DNA, 1329 bp, Homo sapiens
  misc_feature (1)...(1329): n = A,T,C or G
tttatttnnnntnnnnnnagnnnaggnnnnnnggggaaccgattcgggatatggccaacgagatgcacgagaatcgccaagaagcacatgagactgagccgcagaacagcacgcgcacgagcagagaataatctaccatacaatacgacgccatccgctcttcatttattcatatttcttatatagttgccttaggttcttataaatattatatcgatggcgtagatattatatatcgattcggctattcattggcgtttacattatattatgtcgtcccttctctcctcgactcgaccgcccccgtatctccatcaccagcgccgcagtcgtagcttcgcactcctctcatcttcctccgcgcacccccgcgatcgacaggcgcagatcgtgcctgttttatgctcctccttcgccttagcacagtcgtatgccacgtgccgagcacggtcgcagtccaccgttcgaagagacgcccagcatctagagagattgtatgtctgtcttaatccaaactatcccggtactcccgcgtcaccacaagagatacaccaaggccaggagtgtggcgacagccctcacagcccccactaatttaccccatacacaacagatgcaccgacgaggatagctgccggcgagtcccacacaacaacacataaatcgctgacgggcatggttctggtcgatgtagttaataatccactatcattttcaagctgtcatctatctcgcaatcacacatatctactctcaatagatgcagctcgacatcaatagcaacatctacatcaacatgtagcaccgcatatcttgtgtcccccgtcgcgttatcacagcacgagtacgcactatctgtgagcgactcagtgtgcactatagttacgcatgtgcgccctattgatnagtactctcgagttacatgtgtataatacacagtagatctgcattcgatgtatgcgtctgacgagtcggagagcgagcagtcaagaggttcgcctatnantcacaatagcacagagacannncatctcgagatcggtagtcgcgtatatctgatgtcacgccgaggcctgatagcntcgatcacttctctagtgtaagtccatantatatcctcacagacagcgagcgatgnagagagagtcgatgtgagtctcgantcacgtacaccatctaatcaccgttcttcgcgccagtgtcgcgtgtgcgcggcagtcctctgtgtaggagtgtatgtcgagcgtcgcagcgagngatagtgtagatggtgagttgcgccttcgcccacgcgatagtagtntctancnatctatctatcatcatagt

SEQ ID NO: 16878 - DNA, 2000 bp, Homo sapiens
  misc_feature (1)...(2000): n = A,T,C or G
aaagaagaggggannanngngaggagagngaaaagaggagagaaaangngnanannnnnnnnangagagatagagaggnnnnanaagatgannaggtgggnnnannnnnnggaggnnagangngtggnnnnacagnnnaaagggnnnnannngnnnnanagnnnnnnggnnanagagggtnnnnnnnnnnnnnaanganagtngacagnngaaatagggtnnnataggtggnggannnnnnagagganngnnanattnnattagatgggtgagagatnnnaggnaaggaaggngacannnnacagnnanagagnaaaacatgagagnnnanntaatanannaannnnnagaaagagagtataanganagaagaaggatgagannannnaanangcaggtgtagacgagatatngtgntatgttagaggagatatttacacgcatgtcantgagttctatcgtnancagtagtgcgtcggnnncgttnctgattttgtcgcgatcgtgntntctgaggtctgnncgtgcngtgtacagatacgtaagatacgctnantcacagaagagtggnnnnntanacgagcgcgtactggtncacgaggtntnannagtacangcgcagttnntgatcgtgttnnnnatacnncacacagtcgctaggcntcgncacgtcnnatanacgtgcgtacnctacatgctacnnnntcatncntagtnctgcgatgtnnncgccacagcatcagcagtnacacaataggtntntnttntnattgagatcgcatgnntatntaactctgttntatcgantttagttgtntantagaganantgacggaacggagacanagaagagttaagagagtgaggnnncacgggagtgttcnncncatatcatatttatgactctgaagtgtngtatanagagtgaangnngnacgagagacatggaagcgaagtaatganntcnngnagcacgagagagatangataggtgaggngnnnnnagcatgtgactatagtattcgtntcttgactggtaganatgtcatagacgcncgcacagtgtagtcncnactctattcgatgtatgttgncnttatntggtgactgtgtgtgaacggtagtgtggtcgtctgcgtcgcgtgatgatntacactacnctctctatcncanngtcagccagcaagtaggagcgcttcgagtgagcgagtagagagtgcgcgatgtgttncncagcatagactcactacgcccgatcancgtatgtagcntncatatgtctcactcctacacatattngcatantgtatacaatagttctcacactcgagtaacaagctagcgactgtcgtatcnactacgatgtnntcactcnctccatatgcagaccacagtccacacgcgtcggataggtagctgcngngagtgnngactcatgtgagtagtgatgtagtgnnncagtcggactgagangtcgccaggctnncagggagctgtgncaagatggcacctgtctagaagtgctgcgcggacgagagagtnnnncntcgcacgtgagtcgcgcgtgcganatcanagagagcacagcgtgcgcggagacgctgctntcactagtgacgttcacgctgcgcgttgtggtcnncacacgtcgcngtnccgatcgcantgatgccntacgtacgtcgatangatgatcgctcgncgctcgtgtntcacgtagtcactgcacgcgcgagtagtgcgcncacgcacgaatgtatgncgagactcgcatcnannatcatacgcaactattcacgcgcgatgtcgtcgtcgactcatatgctgtcgcattcatggatgcnnnnnncagagattgtcgtngagtagtcangttgacgngnnncntngnaagagagagtgagacgagtgatgctgtgcagtntcacgtcntacatagacttagtgtctntngagtagtatgcgcgtacagagactnncanaacgtacgatatgntnga

SEQ ID NO: 16879 - DNA, 350 bp, Homo sapiens
gaaggacagtcttgtttttatataaaagttcaagctggtgatgacatgtgtaaaaggaaaagtgctgcaagcagtaaatgctgttcagtttgcagtccattacatcaacatatctaaatgatcctctttagcccaggacttcaataggatggtggaaaagaagacttccactctaataggatgaaacaatgatcattcattcacatcgattctgattccttttacttgcttcacggtccactatccacgaacattcgctctgaccctcactctcctactcttctccccactccgcctctcccctaacgcaccgcgccccctcctcccccctccttactattctattcaca

SEQ ID NO: 16880 - DNA, 533 bp, Homo sapiens
gttgagcaatctcccatctttaacatatgaagcttatcacaagagcagcacaaaaaccgtgaaaaagaaggtggtaaaaaatccatcttctcagactaccttgctgatgaaaaaaaatagctctgtgacacagttcaagccgatgagtaatgagagaagcaccaattaaggagagaagaaaggagtaaagctttggaggattgcagagctgactcactccaagatgatctcacattactctgacatctgaactgcactccatgaaaaaagaaaatgcaacttctctagaaatggctttgcactctctggggaatggtataaacgaacatggacaagtcatgcagaaaatctgctgagagtactgccctgtactctgtgaccgacattaccgaagcagagagttgtaacgaaaagaatgaaaagaccttggttctagtttcagctctgctctgacaacctctataatcttgagaaagtcacttaatctctttaatccatttgatcctcagtgtgatcatttaaaaaaaaaaaaa

SEQ ID NO: 16881 - DNA, 1868 bp, Homo sapiens
  misc_feature (1)...(1868): n = A,T,C or G
cggcgggagcgcccgcgggcggccgcccgcgcggcncngngcccgggcngccccgnccgcnnccgcagccggcgcngngcggagaggcncactttngcgagaganggcnagcggacgagcggagagcgagggggcgagcgggcncgnngcacacgacgtnntntcgcgtcggcgccgccgccgcgcgtgggccctgnnntgagatgggcntggtggtggttgtgtgtgctgtgtcgcgtccgtgtntgtgcgtnctnnntcttcttttcgtcggcgcngtgtcntctctttcatcatcttcgctntcctcncgcctcggnnggacacgcgagggcgngcggtgggatanncacacntcattaccgcgngtaacgaactatagcatatactaatatcaaagantgtgattataatatnatatgcgaggataatatatantattatnatcgcatgagatagtatngtcggggcgcantcagccatattctaacaggttctcatatagaacaacgtgttacgtcnttcactacncttactatgtcgcatcgatgaccacgaatagagagacacacagtacatctaccantagacgactaatatagagaatatggagcgcggagcagaatagacaggagatagatgagtgagaagcgaacgatcgctntacgacatcacgcgtagcataatgttcttctcactcagctggcatatnacatatatttataatatgcacaccatcgatatctaccatcatatatcatgttgcggtggacagtaggcgcgagcacatatataggtaatactttaatattatcatctccttactagctctcgatgtcgattgctcaccggagatatgaatagttccgcgagactgtatgatagcatgagtactacagattagcgcaggagtggcaagcagcgagtagacagtgagtacaatcattagttcgggtgtatcggtgcgagtactatatatgntctgtagtagcagtatgtgtntcgggtgaaggannggcggagcgcgtgtagacagatgagatcacaagaggagcacgcagcgcgcgtcattgtgcgngagcgagcgagagctatgatagngatgcgngngcgagtacgtactatataantcngtacgatcagcgaggactaccacgtacnattgctatcgatgtatancttatatcagatctgagcgcggtcgatgatctnngctagtgcgngtggtcgtgtatgtactactacnangtnatgcgtagagcagggatcacatgtagtctatgctgatgtgtaggtcgcgtagcgctactatgtcgccgcgagtgcgcagtgatngttatggagatcgtgaccntcctactactcatgtacngagnatgcgcgcgagcgcacggagcgagtgaagtgagcatgcgcatagtagaagtcgtgcagcctagcaggctggtgcggaacgcatcgcgcgatgcgatctacntagtgtcgtntagtgtagtcagtngcngcgcgatgatnctattcctaaggcgatgacagtgagagcatgcagcgacgcatcgcgagtgagcagcnatcgcgctcgcatgaggatacgctacgagtggtgcngtagcagagtgatcaatatacactccagatgagcgatgatgctcaggaagctaggtttcgcgcgcagcngcacttatccgctaccacgcgaganagtatagatatatagatcagagatgtacgcgatatatngtctgtggcgtgatcagtgcgcgatggcatagcncggagagcgaaccagcagagagagaggaganngtntatnattctagtagatacatgaatagataatatgcaggcangtacgagatgtagatcct

SEQ ID NO: 16882 - DNA, 1449 bp, Homo sapiens
  misc_feature (1)...(1449): n = A,T,C or G
atagttgagagagtgaaaggtggagttgtggtgatgtnnnattgtnatgtnntatatttggtgagtttatgagtgattaagatgaaaatattgtananatgaaggtttttagtgananaaaatccgtngcgtgccaccnaangctagacatgctgtgacacacatcggatgtgaaggggngcttggggccaccagatntgcgagtggatgnntgcagttttangcaggtggagntgatgatgtaggcgaggaacgatgtgntgactcgcgaagggctcgcggtgtgatagctgtgatcaggtatgatgtgtacagagacctaggatagaaagtgtttatgtgtatgcggtctgccgtggtgaacaccggcancgtctgtccacatgtgcttgactacaatctccttggttgttactccccgtcctcagtaatctcccgcatcctatgttacgatcttagcggtccgtctgtccgtggtgtgcatgtgngtactagcgatctgtggtgcgtacncgatgaggaagagctacggctcgcctctagtcccatnggatcatgttcacacggtaccctcggtacgtggtcgcgctctgctcactactcgtactcgtcgtcgcgtcgagtgtgagcgtgtgngttatatgtttntcgaagtnacagtagtggtcggcacgtacgtcgttcggctgctgacgtgtggtgcgtcgggaagacgtaccgcgcgatgtgcctcatagtcagntcntcctccgctgtcgcntcgtactgtcgtgctcttcgtcggcctctcgtcccgcacgcgacgctggtcacgcgctcgccgtacacacaagcgtgctgtggaggcntcctctcatactgtgtacagacgatacccaccactcgagcgctccaccgactagctcntcctcgccancccctcgctgcctcactcgtatacgcgtccagtgtcgcactagctctcnncacccntcctcagtacctacgcnncccgcgtctgtcacacgtcatgtactctatcacaccgagcatacgtagcgtcntgagtgtcagcgcccctcnnccagtcgtacgagacntacagcacacgccgcgtcacgcctantacgtgattccatctctcacgcgagcttacatcgtcctaagtgcactctcctccacatgtgtcccgtgtagtgaagatttctgtgtctggacgcagctacggaganctttccctatctcactgtgaacaggcgcctcacgcacaacnnntaggcacacgagtaaggtgtanatcgtgcgcgtcgccgccaccgacgctcgccgcctgcccaacantgagctgcgacgaatgtgactncntcanacacnacgtatgcgcatatgtctcataactgcgtggccntcgcgatcgcgacactgtgccnccgagccgtncatccacgccgcgcactccacacgctcgcg

SEQ ID NO: 16883 - DNA, 1886 bp, Homo sapiens
  misc_feature (1)...(1886): n = A,T,C or G
gtggaagggggtgnggggtgnnntagtagngtagttngantagtaggtnnnangnggagnagtgggtagtatgatgagagtgtatgtatgagtagcagtgagagatgagtatagtangttcgtatgtantgtnntntgtgngtatatgctatatgatgntaatgaaagtngttgtntnntngtatggtgtatgtagctgttgcatgtcgntatattgagtatcnattagctcggnanatgaagngagtcagcataagacagagtatatacnatncanacttaagctctatgccatagagagatacatacaggtatgactgtantggtgacgatgatgtgacgtacgcgntnnnagtgtgcgagtntcacgaggttaggtagttacagcgctcgtcgcacgcgagcgaccncggataanangagctatanatcgtactgctgataatatcgcgtcgncntnnntcggttccnttcnccgcgntagtagttcgtctgtgcgattatgtatcgacgacgctctgtgatagcgtagcaacgcagtcgatacgataacgatagatcganatacatacagacactcacgcgagcagcgagcgtcagcgncaatatcactagatcnttcgacagcagccgtcgngcgtcgntctcatacacncgagtcatatntatctgccacctgcaccgtatctcattatctctcgagtggtantcgttctatagactcacttctaacatatctcagacgctcgtcgtcgctacgctgctccagatcgacgtcacgncacgtnaagaatgctagtcgagataagtacgcgnaatcancgcactgcagcatacacatagacacgcgacnctcgctcatcgagtacgagtcagcatagtgtagtgtattcagtatgtcgctgtacttattattccgatcatatcatttgtatcgtctntactcgatcatcaatcgtacntncntcgcgcctacgcgacncntcggcacgcagcttcactctcgtgatcacgtatcagtcntagatcgagtgtgtactntgancacactgcgatatcgatctcctctcagtagcnagtcgctcgtaccgctcctgtcaantactantacatcagcgatagaacgcacgacgacagtcgcgaatacgcacgncagctggtatagtaccctcatcgagtcgacatacgtcgatgncgctcgcagtncgcactccncnccatcctgccagtagctagcgacatctgtcgtagtctcgaacgccgtcggtcacgtcgcgaatgacgcncaccgcgcgcgcccttgcgtatacgtctcgtaagtggatacgcctatagaagtantgcgagctgcgcctcgcatgcattgccgaatcgtatatacctatcgcgcaatagacgtgcacgttcnatgagtctaccctgcatagtactgtcctcagcaaccagcagcatgcctagacagcccgctccaccataccgctntagacgtaagcagacataggataagcgacaatctcatagaagtgcagacaagcaggaggcacgtnctgngtcattcgagaactcnccccaagagaatactcnacagttnagtcncnagtccgncacagccgcgagttcactcgacgtctatacccatacgcagtagctagcatatcagagtattcctcatactatagcggatagagtagatttattcatatcttagtcatcgatcacgtcctaacgccggctatgatacgcactatatatcatatattcacnctcgtatgccctcgatcatcatcacgtgcgcgnattcccgacagttgctcacacntcgccacantcatccaccatcctcacgcgcgcaactgatattattatcctcgtatttcacgattgtt

SEQ ID NO: 16884 - DNA, 2115 bp, Homo sapiens
  misc_feature (1)...(2115): n = A,T,C or G
tttttttggggnnnnntttttnnnntnnntttntttntcgtttctttnntccgncgnnntntttgtgtctttttcnttctgtgtgtgttntcctnatttcgtctgcctcttctcnntcttgagctctttgngtctccttgtgcaacactatctcnatctactgagnacaagatnagcaagccctccgcaacgctgtgtgcgcgnttntgtgctgtagagngtgtaatgtacgagtgtgtgttccgtgtggtgaagtggcgctctntgggaaaagacaagtgtgagtatgacacgacaancaccaacacactcgcanacncgccgtataactgtcttaccagtagtgtgtgatttgtatacatccgcacatcagcacaccganagtatagagcgctcgantgtgcgcatacctgtataaagnctgctccgtcgcaactctcggtgcgtttcgtcgcgcagcgacataataacacacgngctgctcncnanagcgcacgcacaacgccgcgcggcgtggtnggtagctgtaccgttntnacacatcagatacagtcgcgagcattcgcgtgttgctattgcgcacgcgtgatgtgatgcgattcgagccagtctccgcgacgancatatcgagncgcacncacncgactcatctaccgtgtcacatgctctgtncntgacggntgtctgcgcnacccgcgtgtagcacagaccttacgcagagtatccacaggcgcgctcgcgaatcctctgaatagcgatatccacacacgagtcagtcgcgagagatgagtgttactatagtgatctgcatctctatctctcagtctngttaatctcgtcgaggtagatagacagtaganagactcgatangtaccncatacataagtattacatcacatcccacctcacatatataatatagcagaactgctgctcacgcggatcgacctctcgctgactgtgtggacgagaatctcgtgtgtgcttacgaggcacgcgctagcattccgggtacgcgagtcagcgcatgctataattgagactaccagatccccacagcgctacgtgtggctgcggcatgttgttgcgaaccacagagaagatgcgagacgtatcantacgagtgtagcactattcgtgtgtacacacatataccattcgtcatgtgtngatacgcagtacttacgcacagcgcacatctgcgccgatttccactacggagcactgccgctattaccctcagcgccaggaaataagcgctaatagcgctngccgcgtagcgcaccgcgcaccgaatcangtgtattcgccgntcgtatggttattagagttcgtgtagttccttgtcgatcgtgctcgccctccatagaatattatatatatttcattgttcgagcgcacagatctgatatctgcgtgtcgcatagatcgttgaatagctaacatttacgcctcatatagtatgtaaggtacgcgccgcagcggtatgatcaagtgatctcgagcacgtatgaccgcgcgcgcgntggatattgtgtgagtagatacacgagacantacagtcgtagacncgcgcccatatcgcgccgtagcgatcancaatcantntactgctctgtgccgcgtcactcancacgcgcagnacgctgancagntnatngtcagcacgtcgctgtcgtcggtcgancacatattcatataaatattactactcgacggctggcgaactgcagcgtcgagctcgtagcgcgcaagagcaactaagattatattgtatgatatcttnaagttntntgactcgcgcgcgcacgtaccgacngagatnatgtcattgcactctgtacnctaccgctggatagtcgtttgctcatgcagactgtggtntatatcatatcaatatcgatagtcacatatatacaagtcacttccagtatacatcagacgtagatcatctacgtgatntcgcgnacatcatatatgtgtagtgcgtgtngtncggttgtcgcgcgcgcactnatngacgatgtgttatacgagatagcatnatngatagtgtggtntcggcagcntgtatgctgatcagtantacctaatcaatgagagntntngaaccg

SEQ ID NO: 16885 - DNA, 549 bp, Homo sapiens
ccgagtatcagggtaccccttacctcattaggaatatcactgtgccacatataatgataggcccttagaatagaagagaactgtaggactcgctcactgaacaaacccgctctatctcaataatctcatctgaggccggacgaaccatgcgctctagcgcacccgaaaccctaacttgcttgatagtaacctctaactgtgcacacatagtccttcacttaacttaacaacatgcaaaatatatagtgtatggagacacctatatcactagcccgctccgacttcatgatccccagcttgtgggagagaccacttgtaccctattgaataatatgataatgtatgcctttgacatatgcttccatggagatgaacccctgccttttatgacccttactcgctaatacagcagggagcaagcgcgtgttaagctagttaactagccaatatggtctggcgtgtcggctagcaataaatacccgacttacagtgactgcaaagaaaaaaaaaaatacggtcatctaggcctaagcgacggatccttgaggt

SEQ ID NO: 16886 - DNA, 731 bp, Homo sapiens
aattttgacattcttttgtctgctactgcccgatttatgatgttattttggcgtacctactgaagcccaaaacttcttctttattttactacattttagaggaatggttgttcattggtaccatggatccatatatatgaactctgaaatcctgcagttaagacacacccattacataatgagtggctgccgcatcttctggttggtgcatttgacaccaccgattctactgtgcaatttttggattgcattggactttattgacacgcttatcttcactttgttgtgtactacttcgcagacacttgcaccacctgtggaaaggatgctctatgttggtgccttcaacgcttgaattgtacagggccgtgtcctatggtctcggtgatgggtgcgcccttgtctttacttcgctgctctctagtggacgacgcgtacacgccactacgacttggattccgtgtgctgctccctcgcagtctctacgtgtccactgagtctttctaaacttacgctttttacacgtcccaactccctcccccactcccgcgatggtactttgtgttagttgtcgtcctcacgtgacgtcctgctcctgtcctgttttgtccgtatgttatagaatacgcgttgggtatctatatagtgtttttatcttctatgtatttttcgtcctccagcccctgtgtcattacgcattatcgtgcgttaaggctgagggttcaccgcgc

SEQ ID NO: 16887 - DNA, 1341 bp, Homo sapiens
  misc_feature (1)...(1341): n = A,T,C or G
catttttgttcttagcttgcgatgacctaggatatatagtagcatcgttcatttttgcggcgagtacacgtaccntagagatgtaccaggaacacatgtctgttcttattacttttttagcatacgattgtgctngacgagacatagggtttcgtctcannttgtgtgacacagtgcgttactcactagtagtactganacttctctgtaaagtccatcgactgntntagaaagctgcgaccgccaattactattgactcgagggtaggcttcgcccagcaactcctctcataggtcctatngtcgacatatgtagactaacggaccaggatttgctcaccttggcagacaattcttttcttgcgaatctngaccactctagggatcatgtctaattggtagcagcgcgcgtgtaatattatacactcttgtagtgtatcgttgtagtatacgcattctcgtctgaggataagcctgctcctactactacacatcgccacgacgacatatagtatcgcgtctttntatatcatcgaacgtgtcccacgccgtcgnagaagtcgtgtcagcggatatgtnagtctcgctctatcggcgtgnttactccgctcatgtgatctccgccgttcgagtccatatctcgatccncncntccgcctgtcanattattctgcgtgcgcntcgtgcgttatattactcatcgtnttcgatgctgatcgtatactgcgtctctcttcggtcctaactgcgtacgttgtgcttaatccataatgcggcgtcctccgctatatctagtcctctgcgattcacgcgtcggatacgctcgtcctnccaagatacatatactggcttatgcgagcaacatatgcggatacgtcgagcgcgcgctcgatccttcactccgaccatcttagctccatcgttccggcgataatctcatgctcgcgcgatatcggatatcagctactagctgtctgatcgtcanattacatcgctaattcatcatgtcgatgtccagattattgtagcgcgttanctatcaccgccttatatattcagatactcagttacgcatatcgtgcgttcctctgcctgacatcgtgtcatctgatatcgtcggttctntcatagtcgtagcgcgcgatattcactcgacatgaatactcctcaatctgaccgaatagcctccncagttcgccgatatctattctagcgtgntgtctcgcgagtactatatctgtgataataccagcagctcgcccgtcatggtcgctatgtatccgactgtatatatatcgcatntcgatgaatctcctactacgtacgtgtgatatgtgtccg

SEQ ID NO: 16888 - DNA, 729 bp, Homo sapiens
gacttcatcagtctcatccgtcactatatccctaatgcttagcatgatgcccagcccgtactaggtccttgataaatatttgctcaatgaatgaatgaacattgtaggggagatgtcattatcaccatttgacaggtatggttcacaaaggttaagtgacttgcccaaagccacacagctatgaagggatttacagccacactggaattaggggcagaaagggaaaatccttttgcaagcacctgcagcacgcctgccattgcatggggcactttacctgcattatcacatttgctccctaggagcaagacactcctgtccccatttcataaaaagcaagatttgctggggaatattaagtggctgctctgaggttgcacagctagctgcgcggccataacaagggccaatgctattatggctggggccctatgcattggactgattgggcacaagaacggctgacgacaggaccatttcacattgtaccgacccactgcgttcaaccttctatcgaagggtggcctagactgtcgctcgacccctctcctcgagtgctaccccgcatctccccttggtacatgtggttaccccctgccagttgtgcatgcgtgctgatcaccctgcatgctcccactgcgaggggggggggccaaaaaatgtttggtttctttattacaatgtgtacgggagggccgagagccccccccgccccgtcggccttctctg

SEQ ID NO: 16889 - DNA, 765 bp, Homo sapiens
ctgtaaagggagcatggcggcagctgctcagcttctggggaggcctcaggagacttacaattgtgtcagaaggcaaaggggaagccagcacttcaaatggcaggagcaggaggaagacagaaggaggaggtgcctcacacttttaaacaaccagatctcatgagaactctctatagcaaggacagtaccaaagaagaaatctaacgtcatgatccaatcacctcctaccagaggaggaactacactgggaactacaattcaacatgagatttaggcagggacacagatgcaactcatatcagattagaaaagaaatctttctcccctaaaaggataatccttttgtgagactcttcagcagcacacatttcagaattcaattaattcaatatatatttagtaagtattgttgtttaccagttactgtactaggcactaagcatagtgttcaaatatactgttcttcctttcaaaagtgatcataatatggagagacaggcatgtaaaaatattctagtgccataagagggaactatgtgggcaataagagagagccatgtgggcaataatgagaaaataataaattatattacacaatgctttaataactagcatgtctccagtattgccttttggcaatgagttctgcatcataattatttctgggctcttgatggcagaattattgaagtggctcagaaatattatgagataagtaataagttactggtggccaggcgctcttgacaaaatgagcgagaacgg

SEQ ID NO: 16890 - DNA, 1153 bp, Homo sapiens
  misc_feature (1)...(1153): n = A,T,C or G
gagatgatgagagngaggggnnnnnnnnnnnnnnnnanannnnatantaaatgnagagtnnnnannaagaagnnncnnnnnnncaccgtttgncncgcccacaccacaggatacccctcctctccccttgcgccccgcgccgacgtgttgatgtaataaagagttcgccgcgangaatctccctcttnntacaacttncatatgctcattttgctgtgttaactgcgcccgcaccacacatcctccccctttttagttgtgattttattttatcncnatataatgacaaggaaannacttaatagtcnncacgatgnntgggggacaggatgtatatttggtttcgtnnnncnccggaattcctgtatttatgcctccggtctgagtgctaccacttctgcaannccncaccccgccgtcncgcttctctccccgtgttgttctttatattctcaggccataaggtcttattgtgcgcntcccgtcttcccgcctctactcctatncacaccttcatatatgtnccccgacacgcactcctcgtttncccaaatataaaatttcgcctccgttccttccgagctcctccccgctcgccccctctcgtcctctacattatgagtttatcatgcccgcgtctcatcgagtcttgtgtgagtatggatagcgcgtgcccaaacagaagtcntctgagagcctaatctgtncccagcttattatgtgtatagtttcaaccactcactccactgtgcctcgttntatgactaccacgtactggctcttgccttttacgtaaactcccccagtcgcccctctcccccgcgnnccaccctcctgaccgcgaccgaccgatgtgccaaggactagaggtgnnaccttcgaccgactcatctgcaacaataacactcgatgtctcgctatcgcgtttgtatggcacgtcttcttgttctcttccccgcagctcatagccccattactttccttgaccgtgcgcgatgagttcctcgaccgcccacgggcaactactgcgcgacctcaagcgtcacctggtcttgaacacgccttatgtatcatatgatgtttaatactcatacntcctcacacgctcgccacctcccgcgagtctcactcctaacacgaccaggtgtgtagg

SEQ ID NO: 16891 - DNA, 653 bp, Homo sapiens
  misc_feature (1)...(653): n = A,T,C or G
tgttttgtacagatggggttttgccatgttgcctgggctgattgtgaacttctaggctcaagccatctgcctgccttggcctcctaggattacagagactttacacaataggcagcccagacctcaacagcatctggccatcagctgggagttcattctgaaaaggctcttcctgaagtccaatcatctcttttgtcttcagagtcaagacacagtcagctggggcatgaaagagccaattaaatttggtgtaattgcagcagagtttaggaatttgcctcgttgggggccttcaaagaagtaatgaagtcaaaatgaggtcattagaatggcctgtaatacaaccagactagcatccatataagaagagattactacacagatacagagggaaccatgtgaagacacaggaagaagacggccatctacatgtcaaggagaaaggtctcagaagaaatcaatgctgcttacaccttgaactctgatttccagcctccaccatgagataacaaatttctgttgtttcagtcgcccagtctgtggtactttgttatggcagccctagcatactaatatatctacatatgccttgctatatttttctggataaataaatattttctctggattgaacaanaacaaaaaaaaaaaaa

SEQ ID NO: 16892 - DNA, 1367 bp, Homo sapiens
  misc_feature (1)...(1367): n = A,T,C or G
ataggggagaggagggagagagggnnnnngnnnnnnnnnnnnnnnnnnnnnnnntnnnnnnnnnnnnnnntnnnnangnnnaaaggggngggggtttattnnataatcccnnnncacctcntcnncgtggttttnngcgcgcgggtggccgggaaccccttacactctaggatgtcatccgcacacgcgcctcgcgtcccaacgaccccccgcgccttgctttccttcgttgntattttatttccctcttcggcgcgaccacattcgggcaatggcttcngagcctacaanncccagaccgctacaagtactcccncccctcctcccctctgcgttaggtccacaatagtnnagctgagcccnaatgggcagtcagcgcnccccccgctggcccacacacgtccnatagaatcgagnaagtgaggaggccaccggccaatagattnnncnnacccaacccctacnnnacatgatgtgtcaattcaaaatttncccacaatgntagaggtnnctcggcgnnatgaggnatgcggtncgttcttctccgcacgcgcggttgagggtgtnnattacgtacgtgtgagtcnnncagacgtacgcnanacgaaaagtttcctcccatttttaagtctagttctagttctcgccacgcgtgcaccncatgtgcatgctccctccacacacacgcacgccaacgcgtgtaaaggtgcgatgactttnacatntactcaacactatcatcacagagagtgatttacactgtgaatgcnnngcggaggagaacagtancncaagtgggtcacagcgacggcgcgagcactaattgatctctatcgtatggtctggcctctatgcgcgctgacgtgatatgtctctttagataaatatcagccgagagactctcgcgaccggacgaggacgagcgccccgacgcgcgcgaggcgcgtcggtcgtccaacgaggaaagcactgtgagacntgtgaagtgagcgcccagcggtagagagtgaggttctcactgtgagagggatctctcntcgcgagacgctgtgtagagagtagtagtacataccccattcgctcgagacggctngctgttctgatgcatagatcgtgtcacgggcgtacatagtntnctactnctacggcgatagcaatctgacatgctcgatatgacaactagagcgtccgtagcgagtnactacgtccgtcgaggccgaggcaaacactcagagggacgaagctactctctacttatgtagagagatactgcgacagtagaggtatgaggaatcggcgcgcccatatcagtccacccgtgactgtcagagagtgtgtaccgccctatcgcgccgagaaagcaccat

SEQ ID NO: 16893 - DNA, 1275 bp, Homo sapiens
  misc_feature (1)...(1275): n = A,T,C or G
gagagatgggaggagagaagggnnatnnnnnnnnnnnnnnttnagttnngatgagggatggngatagnncnaacncccctttttnttttttttcgnctcttctcgtcccacccacgccttttgggtggctcccccaacccaacttacccacctcccacctccacgcccccgacttctcactcttccctcactcaccattttctccagcgtgtgtgattagttnntcttcgtccccctctcccattcggtgacattatgctccgccccttgccagccgcgttttttatttcctcttttcgcccggcccgggcgcccgagctataggagtggcggagnccccgccggatgggagattattttgtccctcagctagcncataagctgatattncntcccacccccaccaatatatagtatcttctcccnctccgacccaatctcacagccccgcaaagaaacnnnacaaaccaacgaccgactgcgccgcntgattgtaataggagtgtnnnccgccgagccttacaaaaatnttnaataaaaacgaggtcagangtagacctataatgacgtnttcggcggcgaganacacacaagtatccaactatagtatttggcanaatcggttgccaaattaccctctcattctacgaagtcctgagccatacncatctataagacgtggcacagagagagtttgaggaataatgatctagttacgtaaatgcgcgagcgctcggacgaagacagagtccactaatgggatgagctagatgtatgcattacacgcgacggtcctgcgcattactacacgagatagcctcgtagcggatcactngcatacatcagagacagcgccatcagcgacgaacgccagagcgcgcagacggcgcagtcgtcggagtgcgcccgagagtcgctcgagagtacgtcagcacagccgcaatagagaaaccactcgatatcgcagacataagcgatcagaatatatacataccgactgtacagagatatgagaacttccacgctatcgttctcanaccgtcngacaggaagtgagtcgagtactacagcctcgtgcagtatcgatcgacccagcggcgtgctgagtggagcgagcgcctgtggcgtccgatagagtcgagcggtcgtgaggcacgagggtagtggcgtcgtggatgataggtaggagtgagacgtcagtgaagagagtggagcgtagtgatgtatatagcagagtgcaggcatcaccgcgagcgctggacaggacgacagcgt

SEQ ID NO: 16894 - DNA, 414 bp, Homo sapiens
cctagtggtaacctgcgatctgtctttccctaatgactcccaaggtttgtgggctcttctccgtctgatgttgtgttgctgccacctatcaccacgtttgaatagttcgctacaaaacagacttgcacaacatattgcagatgttcatccacagtaaatcagattctccaaaggtaagcgccataaaaagcagagccttcgatttgttctccagcatggcctctgaaatattctggtccacagaagactttcattcaatgaccaaataatctctgttctgccactagtgtcattctgtgatctctcttttgttcttcttgggctagtcttacttttctattcagaaagaaaaatctagacctctttggcagggggatttatttcaaagacaaataaaatggtaaaagcaaatta

SEQ ID NO: 16895 - DNA, 794 bp, Homo sapiens
ttaagagtttaaggaaggagacgaggggagaggagtagtaaaggaaaattaattttgtagtatcatgacattggagggaaattatctaattctgccttaacttaaacctccgcggcgggagtccttatacattcatcgggagcttctctggccccgttcacggccccacacccctccaccaaacgcacctagaaaaaaaaatacccgtcagagtataatagaacaccagtatcggctggcagaaaatttttatgtcacatcaaacccccacaacttttcacgccgccccaactatccaagaagctacccccgcgccccaataattccccccactctaccggcgccttatcccatcttaagataaatatgggaaaaaattaaagttctgttgacaaaaacagagaaaaacggtcacaaccaccacaatcacgaccagagtagaataccacgccggtcactaagattatgttgtagaggttaaaatcagagcttagcatccggcaaccaatgcttccagagccaccgacccgcagcaccacccgttggtacaaacgcgggcgacagagccaatcctcaccacacatcacccacgccacgaagtaaaaactggaagcttgcgtgataaaacgtaatgccagaaaacgccacaacacatacagatgctaatatcatataatatataatcaaaaacaaacgcacatatcagaaataaaatcatttccggagaaacggtcaaagatacgggccccacgacgttgacatttttgcgaggggagtcagactgctagaacagt

SEQ ID NO: 16896 - DNA, 773 bp, Homo sapiens
tgtcttacaaccttgctcacctgattttgccgatgagtcaactttgaagtgtgcctcattttggaaagtgaatcacgtaatcacaatggagtctccctcatgttgcccaggctggagtgcaatggtgtgatcttggctcactgcaacctccacctcccaggttcaagcagttctcatgcctcaccctcccaagcagctgggattacaggtgcccaccaccatgcctgggtaattttgttttttttttttgtatttttagcagatactgggtttcatcatgttagacaggctgatttccaactcctgacctcaagagagctgtccgactcgacttcccaaagggctaggattacaggcatgagccatcacacccaggctgatatattgccgtctgtatataattaacacctttgcttttcagggcgacatatgtcacaccagcccagatgaatcatggcgtggggaaaaaagaattgtgtttagctctcacaagagactgcggacgaggggcaagttacaacagcagagcggctcgctatacttacccccccccgcccctcccgcggttttccccacgagtgcccgccctcctgtgctatgccctccagctctcccccacggaccctctgcgcgcggccgcgaccggcaggcacgcggcagcatccccggagcgccccccgcagggggggggcacgcagaagatgcagggtgagtcggaaaccaagcgtatggggggggagggaggggaccccccccaccacgtctgttctctg

SEQ ID NO: 16897 - DNA, 1397 bp, Homo sapiens
  misc_feature (1)...(1397): n = A,T,C or G
agaggaggaggaggnanagggagngnnnnnnnnnnnnnnnnnnnnnnnnnnnnnnnnnnnnnnnnnnnnnnnnnaagnnnnnntnttgtggtgatgnangatattaaataataggggttgtgtgggagnntnagntcactgaggnggggccacaatntttttttcactaccntctccagtacacgcgtanccagcccacttatcacatatgatagtggacaattgttgtgctanttnnttctaaatttctcctcctgtgatgcgctagggcgggncgattanncccccctccccacattgtcctccaaagaaagacanaagagcaagcgcgcaggtccccgtggtcgggcccntcaaagcccnatgttcttaatgcctctaccaagagcacgacgagtacctatagagactccaacaaatcaccgagggcncgatccaccaccccacccatatccttcatcctatctccacccacaggcngacaccccgacgcgtcgcctcaccccctgcaccatgtctncacggaatcgtggttcgccgcggggcncgccgcagcttaggcaccccgacgcgcgcgcatcaactgacnccctcctcgccgctccactaccaccgctatanctactctgttccccacgtgcttcatggtttcgtctctcctacttttcctcccctccacatgagttctcgtcnctctatttacacccaagctaaggtgtggggcttgtccgggtgagtactacaccgacaaagattctcgtgcaattcatctaacgacgtcgaccatctcagggatgaaagagacgcggnaaacaagaagtagtggtcaagaatatcaacgcctacacccgacgccggtcacgtcccatcgcaagcacgccacctcgcacagggacgatagatagagagataaatagaattacgacgcccgccctccgatcttacgtctcttctgtgcgggcggctctccgacgctcggcgcgtgttgagaggtacgacggcgcagcacacacaaagagcatgattgantataagcagtacngagcgatcgtctcgattgcggaagtatattagtatgcgaaacctacttataggtcgctgctcacaccatgcctacacaagtttcgcctcacagcgactactgccctctctcgacaagagttcgcgcacncgcaacgtacacattccnctgcntaggaccactccgcacgctcaacttggcattatatngtgagtcgccgccagctaagagacggcagcgatccacaccagaccancgagtagtgacgctacgttgaatatgttaatatcagccgcgtccacagcgacatgcgcgacgcggatcgcagagcgaagtgtgagggtacatcaagcgtgagatatgatggtagagtgat

SEQ ID NO: 16898 - DNA, 195 bp, Homo sapiens
gggaccactgcgactggagagagaccatattttggagtgcataagtagaaagccgagagaagaagactgaggctagaaccctgaggaatatccaccgttcgcccttgaaggacactgagaagcatccacaagctgcaggaacaccggaaggacgatgcgcgttcaaaaaaaaaaaccgggctcgttggactcaca

SEQ ID NO: 16899 - DNA, 778 bp, Homo sapiens
ctaggctggactttctgaattacttttcaactcagtattactgatgttcacggtgttccaccaactttgtctattataccgtcagagcacaagaacactgtgatctctgggggcttttgtgatctcactataaagtgtgtcagtataagatttctaatccacaaccaggatttatagtcattctcaaatgttcctgaaatgatccattgcttgcaatgctgaggagttgcagttttccagtcaccccaccaggaataataatgtgggactctcggccaggcatcgtggctcatgcctgtaatcccagcactttgggagaccaaggcgggtggatcacctgaggttgggagttcgagaccagcctcaccaacatggagaaaccccatctttactaaaaacacaaaaaaaattagccaggcgtggtggcccatgcctgcaatcccagctactccggttgctgaggcagaagaatcacttcaacccaggaggcggaggttgcggtgagccgagatcgcgccattgcactccagcctgggcaacaagagcgaaacaagtcctaataatgtaggactctcatacccgggcaatggcaactagtcacatctaccccagctaataattaatgtaagatgccctaggtggaacaatctttcatatatgatgccctagacacattccaatttcggaaatggtaaatgcgaatcgatactgataacatatgcaaataaatgacacttttcttatggtttgcctgcccagcactacaaacacacaactt

SEQ ID NO: 16900 - DNA, 1310 bp, Homo sapiens
  misc_feature (1)...(1310): n = A,T,C or G
gagcgagggaggngagagngagggaggnnnnnnnnnnnnnnnnnnnnnnnnnnnnnnnnnnnnnnaagagaggnanaagtggnntnnnnnnngngagagaaaacacaaagagtaaagacannactgtatanacacncacacaacactacggagaaggagaagaaagttttaaaaggagagattagcagcaatatactttataacgtatcggggtgggggaggtcgtcaacaaaancaccaccacagcanttatctgtggacgggcagggntccttgaggcagatagcaagaagagaggccnccgccccggcactgttcctcccctctatttcatatcacactgcaacacctaatcnctccgcgccgcgcagccgacagtagccacnttcctctcatacatgcaaccgagagcacagcagtacacaacattccanatgtgagacagcgagagagccacgcacaacgaccncncgantgtccgcgggtgcgaagagcgatatgagggcgngccactcgcgcgtctnnctcatacactcagcacaggcatgtggagagaacacctaacacatccctcttgcacgccntgttgcgttaagcggccccataccacgcgccgctcgagacgtgaaagggcacgcagtagtccccaccacgtgagcggagcccccacacggcgccccgtacgattantcccacacaccaacatcggcgcggtcgagatgtgggggttagtgcngaaagttgagagaggtagggagcgacacaacgagtggaggcgcgctcagtaagttatagtgtaagtgagtagaggagcgaggaagaggtgtggggcgtaccatagacaggggcggggccgtcacagggcaccggtggtcggcgccagctcgcgagagagagaagccggaggaatcggggaccgagccgagatagaggataaggaggccgagtgagccataggatggcgaggagaagttaacaggaacgaggcagcgaaagaagagttataaattcgacgctacacgtcctcccatagcgaggacacgagagagagggtccaagatgcggagaacagacccaaggagacatgtaccggcgagagagtgcacaggcaggagcactgacgcgccagtatgagaacacgggaagccagagggatcgagatgggataggtgaatgagggataggaagagatgagcaacgctcggtgtcaagcgcgacactgcgaagacgttgacggaccgagtcgggcggaggcgaactcgtancgaggagaggcagaggttcgcatcgagagctggatgagtagagag

SEQ ID NO: 16901 - DNA, 769 bp, Homo sapiens
tgaacttatggattttgtgaggaaaaccacagaggtgatgtgccttcatgatgtcatttcaggaggaacatgctatctctgtgacttggcactggtgatgttaaccttgactaccaggccaagagtctgagaagccccttctggcctttaccatatgaaagttttacagcaactgtaatatttagagaaaacacacacaaaggatgggaatggaagcctcggcagtcttctcagcagagggcctcccagcagactggatttattagacttttcattttccctcaccatttggattttcaaagactttttattagttcagcctttaaagcacaaaaaatgaggcaagattgcaccactgcattccaacctgggtgatgaagggagactctccaaaaaaaaaaaagaaattattaatgcctgcctgtgctctacataacctcatggacataattggataagtgaaagggaccttgattctgacaaggtacacgcagccacaatgacaaattaccatgttctactagacaaaaccaggacaaaaactgttatgctaggatggatgaataagtgttataaacgcttttgcgagaacggcacgtaactatacaagagacactagacatcagcacctgcaataaagtcaaaatactagatccacgtacaagccccgtcccggggtggtggggaacaatgtaagcgcccgtatacttaagactaagtaaaagtgaagtggcccccccgccccccccccctcatttctcttccccgt

SEQ ID NO: 16902 - DNA, 1376 bp, Homo sapiens
  misc_feature (1)...(1376): n = A,T,C or G
ggnnagaggagagaagcgggaggagcanagcgagaaagtttaccgagggcaatgcgcgggaggtagcgngacncatatggagggaggttaccnncacaancccacccgcaccgcagcgaggcacaactcacgcgcgggagctcgacagcaggcncgccgcagacancgccgcgccggccgcgccgcgccgcgcgccgtacactacacctcacgactcacagaacaacacacagcacctccgcggccccgcccgagcggcgccggaccccagcacgacacgaggagcgccgccgcgaccacacnatcaacaaggccgccagacagataacacgcggcaccangacaancgctnctanaccagctccccggcgcacagccgcgcccgccctcgcgcgcgcgnaccagggtgcgagacgctacccgcgcacacgcgactncgccgccgcaacgcccagctncaccacgacgcggccctcgaacgcacgcaccgctccaggagagacaacacccaccagccgncgggcgcgcgcgcgacgggcgcgcgcgccgcggcgcgcgcgagaagcgagcaagccncgacgacacgcagnacgcacacgcgagcggccngcgaaggaagaanataggcgaagagaccagcgctgngagagcccacacaacacgcagcggacagaggacgaccgcgagcgaaagagacagcagcagccaccgagacgtcacggacgcagcagcgatgtgcagtcgcgacgagacgaggcaggccggccggcagcagacacacgcagcgaagaacgagagacgcacgcaccacagtcaccacgacacgcaccacaggacagacgcacgcgcgcggcngncganggtcccacaacattaacacagcacannaccgacgcgcacgcgcgctcngacgagcgtgcagaggcacgatcaaaaagagcacaagcgcgcgcagcgaagcacngaacgagagagcagtanaangaagagaagagaggaccgatctcgacagcacgaagccactacctaccgaggacgcggacgaggtcgccagcggcaacatanggagagacnactacgccgagcgtgcgcgacaccagcgcgcagaagtgcacagtcgcagcgacancgagggctngcgacgagagacgacaacacatcgcacgcaagagatcaagcgcgagcgcnagcatgcgcgagcngcctgcgggantacacctctcangaaactgacagggtcgcncacatcgngagcagagaagagggacggagagtctncnacgacaagaggatgcaagacagaggcancgagagcgnacgacggagagngacgccgagtacnacgcgagagactacgcgcgacagcagcgaacgcg

SEQ ID NO: 16903 - DNA, 778 bp, Homo sapiens
cggcctggaaatatagtgctttcagctgccatcagtcatctctccctcatatggctgaccatgctatcacaggtcgctttggctcagcacgcagctcttctctgactagtagtatcaactgagtcactcctttggctgtatccagctgatgtctgggctgggttggaagatctgagaagacttcgttcacatggacagtgcctcattctcttccacgtggctggtttgtttcttttcacagcatggttgtctcaggttaatcagatttcttagacggtggctggctttatgaatgaaagcagaagctgccagacttcttaaacgataaacctggaactggcatagcatcacttctgctatatgttactcaccaagccaagtcaaaagtccactccgggtttaagagagtaagaagcagactataaattttggtgggcagagtatcatgtgcatagagaaaaataatcaattcatggcatcttgtttggagactatttactgtaacgtcttcccatcaatctgccaaataatacgaacttgcagcataacaccttacctctgacgaatgccgatcctcatgatataagagctaagaagaaattacttaggcagatagggaggctacaggagtgcttggcaaaggtttgcttttaatgaaaagcagcccccagaccattttcttttgtaacagagagcaagctgtgtaattaagctgcggacatacatgagcaagctgcaagcttggacggcccaatgccaccaattgtgcccatagcat

SEQ ID NO: 16904 - DNA, 1259 bp, Homo sapiens
  misc_feature (1)...(1259): n = A,T,C or G
aagaggagaataaaggnnaanaannnnnnnaaannnatnaagaggaggggnnnnnnnnnnnnncancanaacagctttacacaaaagccactcacaccgttcttaggacaggcaggtgcggttgcttttctgtttagtcactccccccgcgcgtccatttcgttcgcgccatctaaatcgccccgttggttcctccgccgcccaccgtaattaagtaagactagtccatactccggacttcgcacactcnncctcggccgcgcctcccctgccgattccgctattncaataaggtagatactgttacttattcccncctccacctgnttcttgtnncnactgctaactccctccattatgcccaccctcctgccatcgcncantcngacgtnagcatncaaaatatttggccctgagcgctcccctccagacgcnagagatcngatagagccgccgcgaggggggccnaggcaagcaggcggcatcaagattatcnccccacggtcgctatgtccgcccctgcggtcgctcnctctgtgcacctcaccccaccacgcgtcaggctcgcatctagtaactatctgcactactctcgtgctatagtgagtgtagtctcatgtatagtttccnccgcgcnttcctcgcgaccaagtcntgcactcgtgttgtgcgtcccacgtcctcacgcatgctgggtntcgctatccgctagagtgtagcttagcggcagtcatgtgcacgtcgtctccaccntcacacggccgaggggcgcggcatattctacagagatacngcnagagtggcgcgccacgaccacgtcttactctgttcattatttctcgttcttctcaccgaccantcctgcgcggttgtagtnnntctcttgtcttgcacccaatgccacgggcatgtcnancgacgcgtgtaacactgtcccanactcggcgtgcaccgtgtcattgtacggccatgttgtgcaccgatgttcntacgaggcaaggagttgaggtagctcgaccattgagtgtcacgtgcgtgctcgtatagccgcttattcgtttaagggctcagtgtggaatccgacggtggttgctcntcacgagcacgtntgaaggntnnttatagagcgtctatacctcgccctcgacnagcgcggcncaccggcgctncataagtctgcgctctgcgaccgccgacatacgcccaccctctcttagaagggctgaggacctcnaggccgacggtgtgcgctgatcgag

SEQ ID NO: 16905 - DNA, 778 bp, Homo sapiens
tcaatctactgggagaagctgactataagaagagcatctgatagatattccagctcagctgcatacagagacttcatcagctcatgtcatgcccagagttagcctttcagttccaaggctatttttcccatttccttattcactgtgctccctgacttcaagttcaatgccaggattgtggaatcaggtcatttgaataaaacataaaaagtattattaggtacagagctaaatgtaggtcatatttgagaacaaataatattatatttaatcatctaaaaaaagctaagaggaattctgttatcaaggaaatatttgttttctttgacttaaatgctgcttatagtcctaatattccatagtttctttgaagctaatattttgcttttaattatgaaaatcagttaggaatattgaggtacacagataaaaatggtattagtataaacatgcaatttataaaataggaaatcaatgatgctaataagcataagatatactcaaaattattagtactcacaaaaataaaaattaaaaaacacagtaagctactatttatatctatttggctaaaagaatcagaaagctggatattgccttacgctagcagtgatgttggtatatagaaattctgacacatttctgaagacaatatagactaatatagccattgtgaagagcaacctgtaaagtcatttaaatgtgcatataatttatgattagggtaaacatacaactttgagattgaaagaggaagctatttatatttactctgaga

SEQ ID NO: 16906 - DNA, 266 bp, Homo sapiens
gctccaccgctgtggccaacgaggccatttttttttttttttttttttttttttttttctttttttttttccaacccccaatttttttattaaaccatcctaaagggaacctcagggacctggatttttctaaaaccccctcagggggtggaaaggaacctctagctttcaaaaccattaattagggagaatagggttggggggcacccaccccccttcccttcgccgcggtggtccacccccccgcccccgggggattttttttt

SEQ ID NO: 16907 - DNA, 745 bp, Homo sapiens
  misc_feature (1)...(745): n = A,T,C or G
gattttcaggtttctaagaagttttctaaaaagaagtgtttgtaatacaggctctatagaaagcatcgttgtgggggcctcaggaaacttacaatcatggcagaaggcgaagggaagcaggcacatcttacgtggctggagaaggaggaagagagagcagaggaaggtgctacacatttttaaacaaccggatctcatgagaactcactcactatcacaagaacagcagggaaatccacccccatgatactatcacctcccactagccttctcctccttcaacactggggattacaactccacataaggtttgggcagggacgcacacccaaaccatatcatcactaattaatgtttgtgaaagctagagttacattacaaccacctgaggagcttttagaagattacagacgcctgagcttgcatctagattgactaaataaacatatctgggcttgaaaacaacgacacgagtcgaaaagactccgcagggcgtgatcgatgggttccctgtccctcggcgtcgcgtttcttcggtcggtttgctttagggtggttcacccgggcgacacacggcaactggagtcacttagcacgagcgcatggcctgggggggtggggagnttcatgttgggagggagcatagagggctgggccgggcggggcgccaccctacacgtcatccatctctccgtctgggccctcgtacctttccgtcttcgcggcctcgctccctcccgcgcgt

SEQ ID NO: 16908 - DNA, 1525 bp, Homo sapiens
  misc_feature (1)...(1525): n = A,T,C or G
aaaannnnnnnnttttnnnnnnactcaaataaaaatatagttaaatatattttcttatttataagtttagttcncgtatttaatttcttgctcttctatatgcaaaatacgagtaaatattttttttttttcattttcataaatacaaaaaacaaaatacaataccatntatttataactatcccactctcgaatgcgcttgactttgtaactgtcagagtatggaggaaaaagtcagaacaaaaatagagtcattcctatggatattttaaacatgaaccagattaaagaaatatagtaaaggnttaatgattgtggtgttgtagtttanatttagttaatgataatataaanataacgtaccaggatgttttatcagtgncnatgttccagtagtatcgactccttacgttctcctgtctgcgttctccatagactgttatgagtgatagtgaggtgttgacaacacacacgacacagagtagctaactcacatatgcgtcggcttttcgcgancgcggtagtgctagtcacatgctacgagtcttccggtcgcgcgcgcacacgcgcgttacgatatgactatgtcgtgcagtagtcgcagtcacacccgagcgcgtctcgagcgtgtagatggaggtatgatgcattgctagtgatgtgtgtgtggtganggcgaggttgagtgtgtgttgtgttcgcgcgcggtgtcgggtcctgcgcgcgtgagcgcgcgacgctanacatgcctctagnatacgancagctctctctccnctacactcacacaactgcaccntccgaccactaagcatccgtgctgtggagctacgtcgctgagttatcngtcgggatcgctcatagtctctancggctgcgcgtcagcgtgcactcnagacntgtagacgttgagactgtatcgacagagataagtagcgcatgtgtatctagagtcgtattcacatagacgacgtacagactatgcgaacgtgtcgtcatgtctacacacgcgcagacaaacgcttatgtangcacacacgtctngngcgtgcggagtaccgcgctcacgtagcgacgccagatgcgtcgcaccagcgagtagcgcgctgactcgcggcagngtcgagcagtgacgtgtgcgcacactagtntagcggcgcaatnacgtanaatgtgcgagcgtgagagtgtacgcacgagagagtgctggtacgagtatgagtatcgagtaagttgatacnatagtcgtgttgtgtagtgtacaagngtngtcgatnagntngtcggtgttangaacattgacgatcacgtctccacgcatttgncatctggccgntatcagcgccgagctagtcacgctgactcgctnacgggtngacacactggcncgtngttnctacctatcgtnatgtgangtatcgctgcngatcttgtactantgntgatgatgantgtgttgatactgggtatagcgagatgatgagagtctgtcacgttagtgcgacgtcgtactcgtntctcagat

SEQ ID NO: 16909 - DNA, 784 bp, Homo sapiens
tatgctaacagcctgtgccattggtctgcaggagttggcaattcagctgctgtgactctgttgtccatcaccgtaaccatgttcacctcgcctgtggcagtggagtgctgccacttggtccctgcgccctgagatccatgactcccattacatttaagtttccaaattcagtgactgctttatgaagactgagaagtccaagatcaaggagccggatctggcgagagccttcttgttgatggggactctttgcacagtcctgaggcggcacagggcatcacatggtgaggggctgagtgtgctaggtcaggagggtcttggctcttgttataaggccagcaggcccactcccatgataacctatgaatgcattgattctcatatgcattaacccaggtgtattggtttaatcttatgagccaaccactacttaatggctctacctctcccccctgttgttccgccacgcgcgccccacactgccgtccatcaagcgtacgatcattactcgcgcgcgaagttggccattgttctcctttcctaccccgtcccacggttcctcgctgcacgagttctacccagctttgtttccgcggggcccagcatggcggatggatcttcccttgtccatacatatccgcggcgggggggcgaagtttaattttgtggaggaaagggccgaggtcgcggggcccgcgccgggcgccaccaatcacgcactccctcgtcccgttatggcgcacccccgtttcccacctcgcgccccatctcgcctccgccccct

SEQ ID NO: 16910 - DNA, 1080 bp, Homo sapiens
  misc_feature (1)...(1080): n = A,T,C or G
gtgaggtgggaaggagagagnnnananannnnnnnnnnngtaagagaggaggtaaatnnaaantaattnannnaaatannaanaacacaagtaaagagatnacttattatcatacgctccctcctccgtaggtcatcaccgacctccaaatctattctcactccttatctatcatcaacgcttacactcttctcttattcncatctcttntcaaactcttcatccccacgtctaactctctgggcccaccctcacccacacccctcnnnttacgcaggagcgccctcatcagcatctnacctataaggaagaggcacnncaccccatgctttctcttaccatgatccgcgccntctcctcgcacnaccttctctgtgttncatttatcntgatgtncgccgacggtcacatacgaagcacgttcacaccatatgattctcttcactcatatccttattgtagtatcttctatgttacataccgttcacactactcgtggcctcacacatccccctcccccactttaatggtccacctctcccgcgccttgcccacttccattcttcncctaccgattatatagcatgacgacctatctgtactccgctgcacttgcgtgtgcaacccgtcacttgacgccttcctcgtcccaagcctgcaagctctaattgtactagtcgacgtcggccgcggctccccccactccccgcggtcgcccctgccatcccccttaacttacttattctgtcaccctaaatctttactctagccaccgacaccgcccgtctcctccgcaaccccccaaatatcgctatcccatgaagagtattctttccccctgcgtgtgcttacccctaccctcacggaccccctatcccctctggtcccttgtgcnactattttacagcatagaagcacccatcttcaatcgagcgcccatagcgcccaacgctggctagcggggccnacccatcacgtcgttcaacagactccctcttgctttatctccagtgtcccatactcctgccccgggagtgcctaacgtcacctcctctccccccgcacgaggtgcgtgtccgt

SEQ ID NO: 16911 - DNA, 777 bp, Homo sapiens
aggggctttctgatgggctagagtgcctttgataagacccctgcggatactgcattggcttctgtctgtgaagtggtataggctgtaccaatcctgctaatatgaaatgctgtgatagatggaagagcatcagaactagagatatctaggagagacaacaggaagcgcatggaagcttgtactacaattctcttcttggcattaaagacacaagcttatcacagaattttttttcctgctggcctattgctataccaatgatgttgagagccattctgtttttagtttttcattaaaatatattccatatctacaactatgatatgatatactgtgattattctgtacaaccctattaacattttctggagatgacatttctgattgttcagagattaacatactttccagatgcttgattccagccgctgacaactctgaacagctgatcagctgtacctatggagcttggactttaactacactgcgtgacggacgattatctcagatttgaccgtatgactggggactgaacaataagaggactgaacgagccagcaatggccacttcctatactgacaagcataactctggatggcctggacgagctaaacggctgagctttccacgcgcttgcctttagtgaggactatgacatgatcctggatgaatgactcgctgccttcggctgcgcgatctgaatagcggaatccaacactcgaaggcgttcgagcagctatgctccaaaccgcggcacagtgatggaccatcgtgca

SEQ ID NO: 16912 - DNA, 1254 bp, Homo sapiens
  misc_feature (1)...(1254): n = A,T,C or G
ctaataaataataagntngtggggtgntgtgtccccgcaccctctccacgcgcggtcgtgtattatatatacacggtggtttgacacgcaagaatncggccgccggctgtcagaaggaggggtaccgtcgtacgaggtagtaggacgtacctaaacaaatacatatatacacacataataaacctataataaagcagcgacgcaccgtccctcgcgcacagtctgtcgaagaatccagggcgagcgcgggagtatctgatcttcttgtgggtgttgtttacctngatcacgtgatgagtagtggggagaagaggagaaagagagagaggagagaataacataagatatagaagagtagagaaagggggaggttgtgatggagatcacccccccacaactaaatagacagcgcacgcacgcgaacatcatagaagagactcgaagaagagacagtggagagggtgattatgacatacctnctaatctactccattcanatttgtatccaataagtgctcgatcataccagtaacatatgggcgcgaggccgacagagcgagtaatacaaataagctacagacgcatgggccagagttaaaccatagttagtgggtgtgacatacagagacggccgcgagaagacgtcgatcgcccgcatcgcccccctcctggcagagatagactgacagagacggcagagcacgtattatacccccactgatcctcgcagacggtgcgcgcctccgctcccgagcggaaatctgagacgtagagtacacgagcgcgcgacgtagtaggcagcctgtccacggcgcagcaatccgaaagtagcagggcagcagatcgcgactgcgctacgcacccgtgccccgcgcagcgccacgcgcccgtttcgccacgctgcactccagccgcatgcgacagacagatcgggagcgattctgantggtgcngcacgagccgcactgtnattaccagtagtagacgacacacactctgctctacgacatacgcctcagctacagacgtcagcgtgaggggnacgagcgagataagacactcattgantacgtagcagagtagntgctgttcacaagtatctcagatcctggncgagcgcataatcgacgantacgcagcagagagaccgcgtatggtcgtctagcacatcgtctagacgcgcagcccacagtcgcgccttacagatgcgagatgaaccagcgatacgatgcagcatgcgcgacgagtgaggat

SEQ ID NO: 16913 - DNA, 795 bp, Homo sapiens
agctgtttgctgcgcggacccgcgcaggcacacaatatcatgctctggccacttggagagaacggatttggttataatgctgccagccttatcccagaattattgcagggattatgggccagagcggtgacttcacacgccataatggccatggcggcaagtacatgtatggggacaaatctgaagatgaaaactgcattcactaaagcatacagttcctgacatattgaccatgggaaagtgctggacccatcacatatggagcccaagttttttatctgcactgtcactactgagtggatggataggcgaccatgtggggtgcggcaaagtgaaacaatgcatgaatactgtggagggcatggagcgctttggctccaggagtggattgtgagcgagaacatcaccatagctgactgagaacatccctaagaagcttgacttgtgttatatattacccaccggaccattacttctgcacctcaggagagctcccctccaccccatttgttcgcagtgacctagaatctttgagctctcgctgcaacgtccattaggaacctatgtactgcttgtagcctcccatgcctaacggacttgcccgcgcaatgggatgagttgaagcttaacgctatgaacccaggtggctgacgcggtgaatatgagatgaaaggaaataaacgagcgaactgtaacgccgccgggcctatccaacgggcaccgtaccggcgtcccgttattgtcgcgcgctgcgacttgcgaagcgagcccagcgaagcacgccatccccgaccc

SEQ ID NO: 16914 - DNA, 1297 bp, Homo sapiens
  misc_feature (1)...(1297): n = A,T,C or G
gagatannnagtgaagtgtgntntnnnnntngtgtgttggtgtgtggggattngtgatagangtgaaggatggagagagggttaaaagagagagaggagagagaggagagcgcgggcctcgctangaacgagaccgcananngagcgtttnaagagataaatataatatttatcgacangacagcggttctgctgcgcgcgggtgtcgctgatgcgtcactcacctcaatctatgtacacatataatctaatacnnccaccacaactcatataantgcagaacgatagtgagaacagcagtcaatatgtacgagaataacaatnttaggtgtgtgggtgttcgccaaaacagtgaaggggtaagacgtcgttcntaagtgggcagacaggccnggcgaggactcacagcaagaagaatgacatagacaacaatgacccacacacaggaaagcgcctntccaaaaacaacacggccaggaaggaccggccatactgataattaanaatatntgtataataatagcgtctatagggaacgtgccggcgacatcaagcaccatcaagtaagatagatgaaattatattatgncntcgatcgcacacanaatagattccgaactagtacatacaccgagctccaccatactacacagccccacgcccaccgccgccacggatgccaaccacgtataggaagatatgaggtataaatctatttgatgcatttatatgaaagtagcagacgaatagcctacatatgcagagtagtacgaagagtcagacacaatctcaccgacggtgtacatagtagtatgtcacgtcaaactacaaaagagaaatgcgttcggtggcctcgtcgattggtggccccgactagtagcacgactctacatcacgcggatacgcgactagagccgataactatgtatttttatattcatacacaaaaacacacataacatnacagaaagcacaccagcgacagcactaggtacggacagagaagagacgatgacgagtgggacgtaaattaactgataatgtgatagtagctgagcacacagggacgctcgacttggacaactcgcgcacgacagactctactgactacacggagaacgagaatatactaaggngagagacatcagatattaatactacatagtgagagcaccggcctcatagaacgtagcaccccgcagtaatcgaagtatgaaagtaagtatatacgaatgacaacgccagacacgcacgcgaccagagccatccntccgagtatcaacgtaagcatcacgtc

SEQ ID NO: 16915 - DNA, 598 bp, Homo sapiens
gatccactcacaaggggatccactccttcgagttgactgcaccagttagaaactatggattaaatattcacacagtgactagcatgaaccttacaccatagagcttgagggaaaagggaacaatgagaacgatattcatgagacaggtcattggcgcagatagcacgaatgactgcacacacacacagggagatgtaccctaaagcctcggtgacggatatgtccctctcgctgcgcttcgaaaaaaaaaacattatcacacccccccgctgacgccccagcaagagcccacacgcccacctctgcgcgccctaagagccgccccgccaacggtccaagtttctgcatacttcggtgaccacggtcgaccggccggcgggcgccccagcagctccgctggcccgcacaaaaacagacgctacatcctagcaccagccagacgcgcgggggggggggatgggatagcatgtagggagtggtggtgcggtctcaggggaccgcgccgcgcggaaacgattcaacagtatccagcgtcacgctcacgggccgcacgccggttagccgaccaagcgccctcatacaacccacccgcgaccag

SEQ ID NO: 16916 - DNA, 1299 bp, Homo sapiens
  misc_feature (1)...(1299): n = A,T,C or G
ggggggggnnnnnnngggggnngcgcggctgggagcgagcggagatatactgagggtcgagcaagantgagagaagatgaacaagaatctggcagggaacacaactacatgcgctggaaggaccaaaaaggatccttttttcttttcttttcttttcaccatccacatacacaactccataaaaacaatcattcaattacagaaccctagttcaccacatttacttagccatctccgcgctaggaaacacacagccgcaaaacaaaatatcggaccgagaaaaaaaaaacataaacttattataataaacgtaaatataaacacataaatttgaaaataaatgatagataaaagaattatcaacacaataaaaacaatatcaatcacactatttatgtagaaaaattgcccagangatataatattgtaattcgtcgtggagctcgagagaacaccgtgtagcgaggttcgtattcgcgaggtccagcatacttttctttttccccttacctctcgtcatattaatattgtcgtgccgtcgcagtctcaccccttagttcgtcatgttcgtgaaataaccctaggtgacatgggccagcacagcgggggtcttaactagggttaaagtggaataagtagaagaaaaaaacacaaccccaatataaatcgacactatactctctacactccctcgtattcgcttccaccgctcagtggatcgctatgcgctattgtaactatagtctattatcgcggacaacgtcgatttgtcgcgaagcgaagttgataactatgacacgatgtagaatagcgcaacgcttcctcaaacgtcttcacggatgacaccgtgcacaaagagtctctgtacactagctactaatagcacaatgaagacgtcactatacacagacactccaacaanaatancttntaatgaaataagagcgcacatagacaatagcgtcgatacgtagtgaagtaagaagcctcgcgctcacgatcaccgagccacaataagtatacaaaatgtacgagcagccacactcgcggagacacagtctgagtctactccctacccgaatgtgacaccacctcctcatcacagtatgtatagagaagtctacattgactcacngaaacatagaccaacggcacattgcngtgaagacgcggccgcactccgaccacaaccacactatattagttagatacgataatcatcccgaactgacgaatgcgacacacagtccgatgancgatgctgcagtatgtgatataatatcaattatcaatangcta

SEQ ID NO: 16917 - DNA, 763 bp, Homo sapiens
gtgaattgatgttgtctacgacgatatagaaaagaagatgatctattccagaagaagtttcgacagctgcttctccgaacagcactaattaatagtcaggatttgggagatgaaactacagattgttacccacacgctcgagttgttggaaaatcaggcgagacaaagaggagcttcactcacagtgcttcctacatcctgctgaaagtgaacgaacctcagagcatgcagacatggattccagccaaccagaaagatcttcatgaagaccccgaaggcagcggaccggagaaagccgtgatttatgtcacatgacgcatgggattgaagactgacatgatctgacacctaaagagactaaatccatgtttgatagacctttaccgctccacggtcaagctggaaagggaagcttctcctgatgagtttgcaatagaccctaatgaacctacctactgcttatgcaaccaagagccttatggggacatcatatgatgtgacaatgaacagtgcccaattgaatggatcaactcttcatgggtttcacttacctattaaccacagggtaagtgggattgcccccggtgcaggggagataatgagattactatggacattatgactggcaagacagtggaggatagataaagagtgtagggagagccctgcagattgtgcggggcgctttcactttttctaaccagccgcgccccaatgactcgccacggatacgcatcacactttcgttcttctctcccctccg

SEQ ID NO: 16918 - DNA, 1182 bp, Homo sapiens
  misc_feature (1)...(1182): n = A,T,C or G
aaaaaataaaattggttttggggcgggggnanaaaaccgaactctagcggggctactctcatttacctgcaccgctcgcactagcatnataaaacatctatattaattcttatttccacacacctntgttccgtttctagtgaaagactaggcaggcataanccggccgccgcgctgcgtcgcctataccctccctcgcacacgccgcgtctcggagtgagttctacctctgggatttacacttattngccccgatcattgcgagtcagcgcacggtggaaaatttatgtgtgtagtgattatatctgtggagcaatatagatatattccagacacacagaccaagatatagacgggtcaaggaggnanacacacacgacaacaccaaaacaacaccagtcaaaaccncctacctctcaaccccgcacgacttgatacccagacatatcatacccgtncntacacacgatccctactatatcttctgacgcgtgcgcagcgcgctacccaacgtgcattgctgtgtgcttcatgccgcttgaactatcgtagcgaccaaacaggtgtgacatacaaacgtggtgcggactcgtacgacattcatctatgcattctctcgccgcgtgtcaccctcacgttgatcctcaataacgtacatccctagttctagatatactatgtgctgcattgttatatgtntaattgatatgacgtaagctatctctcataggtgtttctatacgtcaagtcacgagagagcaacactcatgtcgcccgtccctcaacgccgtgcggcatcgtccgaggtactcttatgatacagccacgcgtgacctcttaagacacagcccctcccacaccgcgaccctccactagcgcactccgagtagtctccgctctacacacacctgcgacatcagcgcttcagagcgctctgatggcgatacgcacgcatacacgcaccttcgccgcgagcnacagcacgcaggtctcgacgtcagatatagccgagatatacgcagcacctgcgcatgcgcatacctacgcgaccgcgcgctcacgacgtgccaatacgacgcgacctataaaatacgacagacgtntaccgcgcgagaccgatacacagcgagtgtatatagagtatgattttaacagctgagagataggtatagcgatatacat

SEQ ID NO: 16919 - DNA, 773 bp, Homo sapiens
tcttaatttcattctgtaaaaaagaaagttcgagcaacctagcctgggagaaagaggagaaatccgcagaccagaagaacaactggccagagaaaagtgatgtcagaaagcagcatgctggaggagcagctccagcagaagccctggagaacaaggggagattcaaaatcactggacttgacaatgaggagagagattatgaccttcaaaaaagcagcgtcagcagaaaggagcggttacgctttgctcgatgcaagttacccagaaatcatcccctctaatcctgtacttcctgacatcgctttcccaactttttgtaaatactcatatgtcaggctcctccaattccattggttaactcaagaaagcagaagaaaactttatgtgagtaataaaactgtgggtttggtgatactcgcgatcatttgtaaaaccacatgttttaacacgcacacagaaaattcactttcaaaaaacagatgctgacaattttgtgcactctgacacaaagtggctacaggctgagttgtcaaagcctacgtatttggggatgactttctggaaaaatgctagcaaggacctgcgcgtgccgcctggaatgaggttcatgtctgattgtccggcatgatgggggggtgggcgagtttgatgataatctagaagtggctgctgtcggtgccggggtgggtgcctatccaagacctcaacccatgacctcaattgtggccggcttcgcaaacggacgcacgcgcagaagcactcacccacgccct

SEQ ID NO: 16920 - DNA, 1015 bp, Homo sapiens
  misc_feature (1)...(1015): n = A,T,C or G
aaaaaaaannnnnnaanaaagnnaaaagaagnaaaagnnagtgagggagagnagtgnnaaggagtgtgtttattggggagaaggnaatnttcgaaagttatcgaagaataagggtnnatttcctcggacagnncaagaggtccacctgccacgctacaaacctccctctcggcatctagcncaaataagtccttactttagacatgtaggnacgtngggcctggtttcagggcaagtcagccnccacatcgccgaatcncacccgtgagcccccccaccgtatcctncccccactcccctgcccggtcccttgttgtcgggccgcctcgactgcgccgcccccctcgttctccaatcccccctcgtataattattcngtgtacaggatagtgcctcctccttttattcgttctcctcttagtgtatctcatcccatgtcactacctgtgttccatgccccagccccctcctcgctccctgctcccccccccgcggtcagccactcctctgacgtaacccctgtgccgccgacgtcctactcgcgcccgagtccgccgcgcggcgcagannataactagagtcctaccaatgttcatttcgccccattccctgtatgatatnccctacactcgctcgcctctacgcgattctagcgaannctgaccacgcgcactatttatctnnncatcactttgttattttttattgtncatggtgtggctcttgtacgtccgtgcccgtgcccttctcccgtctttnacacattttgtgacgaccactgacacatgtgccttcagggactggggttccagtgtgttagcgtcatgtagctactcnnatatatgtcncacccatgaatgatacactctcgtcgtcctctncccctaataatgtaacgtattacncacttgaatcgctcgtcacgccnctgacgtggaggnngtgtgtttgctcggtggtgttnnntaggacagtatttccatcatcaccccccgtcactcgactcttacgagag

SEQ ID NO: 16921 - DNA, 752 bp, Homo sapiens
tttaaaccaaattttctttttaatctcagcatcatcagaaaatgtttgaagttggagaaaagtcagcctcttcaacacatctttgttatttaatacaaaaagaagaaatacaaagataaacaccaattctatctaaaattgaatgaaaaataaagcaagttatagactgctgttcaagaagcaaatgaaatcagcataagcaatgaattcaaaatcctgagaaggatttcatacagaaagaagaaattcaaagataaacaccaactttatctaaaattgaaggaaaaataaagcaagttatagactgccgatcaagaagcaaatgaaatcagcataagcaatgaattcaaaatcctgggctataaatgaaattgaggccgatttctgcaaatatatctcatacttactctatacctgtctataatgctacaactcctgctttgccatatatgtaaaaaacaagcctaagacaggaaaaaggaacttacccacgaaattctctttaccttgcttctcaggtgaagacaccctagaatccatctcattcttgagaagcttttatacttggcaatttttcatgggtttggagctaagtgtgaagaacaggcagcaactcaaatgtgcttgggagaggggagaggagaaagtatgagagcctgaaagacattccttctctttagtgaactccctaaggcgtagttaccctggtgaggggagcctgataacatacacaaaagatttcttttatgagt

SEQ ID NO: 16922 - DNA, 1045 bp, Homo sapiens
  misc_feature (1)...(1045): n = A,T,C or G
gggnaaagggaaggagggnagagnnagagagaaanttgcaccacaccggctcgctacgatctccaccgctcgaggccaacgagggccactcttgtttttttctttttcaaaaccaactccaatttctatttcctcagagtatgccgaaggctcgatatgcccaggtttcaaggctgtgaaccacacacgcctccgtgccgcgaaccaggaacacgcgaaacgggaagacgacttgcactgatagtggcgcggagaggaaatacgtgtcccgccggatagccgcccccgggcccccgaacagaccccgaccaaagcgccgccacccacaccacntaanacaagatgtagccaatccgccacacacggcagagacaaccaaggcagatttcaacacaacatacaagattctcaatgagtgcatcagcagggcccccacgccagcgcgccacgcgcccgcaagaccccccaaggaccaaacagaaccacgagcagagctaacagacgaatgagactggccaaagacactcgcacgccctccacgaccccccccgcacccaccgcgcgggccgccacccgcgcccggcgcaccacgacgctacaccacaccgcgcacccgcgacaccgaggctccgcaacacgccgcgccacgcgcaccgccaatcgaccctagacgccgcgngcaccgcggcgcgcccccatcgcacggcgcgctaacactcttctcgaccattgcgccgcgcccagcgcacgaccccgccgctacagatccagctcgccacggtcacccgcgcgaaccggcgacgaccctctcaacaagcagcaccccaacccgcgtgccgcgctggcgccccgccgccccgcacttatgtagtggactgtggggtacgcggagcgccgncgcgacgccagaacgggagcggacgcactcnntcaggcgcagccagactagagactcnagacccaggcacccgcgctccgcaccgncgtcgntncgatccgcgcgagtntaaaagaacgcccgaacgccgccgcgcgccctcacact

SEQ ID NO: 16923 - DNA, 800 bp, Homo sapiens
  misc_feature (1)...(800): n = A,T,C or G
agggaacattgactaatctgactctataccgtgcgtatcatctggggactggacacctgtaactaggggcctaccacttgtaacattcttccttgccagagtatgtgctgccaccgatggctatgccattggcttggctggtcttatatccctgatcctaactacgtccagtctcaggtgcgccccgctcggagtgcagtccttactgggccagatcatcgaccactagtatacttactttcatctgtgccataatcactcctgcttcattcccctgtgccagacatcacagatctggtatctccctttatatgtactgacctccctggatctcatgcttgtcactcttgccttaccccactacatgaagcacaagcgactttgtattgatcgcgtgccctaggtgaatgcctacttatggggaagatatccgggatgtgatttaaccggactacaatgcccgtgatcattcactactgtattcagatgcctangagtccttactaggagacagtgtgccatactgttatgacgcagtgctcgataagcgcgtccctcctcgtgccggcccacctgatactactttctacctagaggtggcagacttgagagacccctttagatattcagatggaggctcggcaaaaaccaaatgtcctatctgattagcctcagcagattggctcagcgtgcgaattcctatagagactgctgatcttagatgctcgcacatttattcgatacgctgactaatttggtgtgggtgagcgccttaatctctctcattgcgagttttctcg

SEQ ID NO: 16924 - DNA, 1148 bp, Homo sapiens
  misc_feature (1)...(1148): n = A,T,C or G
aaaggggnaaggaaggnagagnnaggaagaaaagagaagagnagaggggtgtnnataatggntggtgggggnnagggcgccccgcgccgggtggcgctctcgagttccacgtgtcgtcgggtcttcncactcgcccaccgctcccccccacctcccgcgccccgcccccccagaatgtggggnntggggtacgtncaggaggaatgagcggttaggcccgccaagtggatggtcaggtgtctgtaagggagatgagcaggacgggnnacgtgctctgccnccgcggtgccggccggccggcccgcttagaagagacagtanacatggtggatgtcgggnnntagccgttaaagacatgaacccnnnaatatcgcgagcgntggtagggcagcgccgaggggtgcgtnnntaggacaaagaggaggggcgtccaaagttggtgtttatggactgganagatgaggtagagctcaccaaggcccggaactcgttccccgcccccttgctccctggttgaaagggggcttacgtgtgacctgcgcggtccctacgtcaccgtcatgcggcccacacgcggagacgcccccatgcgacgacncacccccccgaaccgagagcagagtgtnnaacaaaatggggnntccgttagaggtaggagttgtgcggggcccgcgcagcccagggccctcgtctgggccccggcgcgactgatggggtgtcgagcgtggnnagtgccgagcgcgacgctcgcgatcacccaccatcagcgctcccttgaacgcagcgcnctatcgcggtccttccgcgctcatggttntagctcccgccctgcggtccgttncgaacgatgacgtgcgaggcgggggtccgaggagggagaggtgcggtggtnantgacgagagtggtgccgtgcgccctgagagaggcggtnctccgttgatgtncacgcggagagcgagagtgagagcaggtaggacnacnccgctcacactcagctgnagcgtgcagaatcnctataagggcnctcgcgaggggtggtncccgcctccgcggtgcncacgggtgtcggtcgcgcgtgctcacnnacagaggagagtagctatgctatgccactgcagctgacgcgggtggtcgtgctncatatgga

SEQ ID NO: 16925 - DNA, 785 bp, Homo sapiens
gcattaaagacgccttgaattctcctccatgatacccgccccactatttgttggcacagctatgatgctgcttatggattgttttcactcctaaagacagtggcgcaaggcaaggtgacctggagcgaggccatcctgagtgcccacccagcttcccaggagcctgttggaatttggaaggacatttgcctctgtttataaagactggctttttgctgaaagccagggtctcaaaaattttgttttattaatagaagctaaaccccaaacatttggctctttttcattccatttcccctttcacaatcttaactattcccaagacaatggatacctctgcctgtatcaagggcagattgtcaataagaaagtcaacaggaaataaacattattatttcaaaactgaccaaaaaaaaaacaaaaacaaacacaaacccctgcctcgcataaacataaaacccccggccccacaaccaacccccctcgaggggttgccttccattagggggggggagtaaatatatctttgtttaaggagtcgcgtccgccccccccacactcaagccccccactctcgctcctcttctccgcaggcgcgcgtccccccattccacccattttctcgctgcacacctcccttatgcgtccattccattcatcaccatcttctcgcccttcatcggtaccgtcccgacagcgtctaccattgatccgcgtcgcaggcagcgcgcgcagaggagcgggcggggcagcagtgccggaactggatcttaggcggcgagtgg

SEQ ID NO: 16926 - DNA, 1231 bp, Homo sapiens
  misc_feature (1)...(1231): n = A,T,C or G
cccctgggggannnnnnnnnggnnnnntaaannntttnnnttntnnngncannnnnntnnnnnnnnnnnnntaccnnccantanaannnangntnntnnntttctncctcnttcattcaaaaannttnatnatttnnatctttaatataaatnanttttaaattattaataaaataatatattatttttggtctcagtatgtgttagatggctttatttttagattagttttatgtaggatttgttgtgatttagagagtaaataataaccaagaacaatatatcagatgagataagtgagtggccaagtcattacaacaaactataagtattatcgttaagaacctcaccagcctcgcagaagtcagaaaatcaatcaatcaaaaaccaatcaaaaaattttaatctaaatacataacaaccacacaaaatcaaacgaaacacactccctaaaaccctcccacccatacacaaaacccaaacctaaacaacttatacgcaaaagatattcaaattattttttgaaatgtacaagtagttcgagtttaaacgtatttagtggacttggtgcattgcaattgtcgcgcggcactgtgccgttaatattatcttaacaatcattcgtcacgcatcagtgtacaatcatctatgcggctgcgctatcaggccacttattcatctatcggctctaactctccantattattcgctaccctctcctgtacgcacgcatcnatgatcagcataagatgtataattgtcaccgacatacgagatagtagaatgagagtcgccagatcgtcgctgtcgcaaccnacgtgtcatcatagacatcacatagtatgcgatcgcnctantagggtcttaacacacttgctcacgacacgcaaaaagtcgtcntccacatgccgtgagtgtatgtcccnacagcactggtaacatcatcattacacagtcactcctattctcacgcatatatcagtacacattctgacagaaacgataactatgtgatacacgagactccgcncacatatacattgtgagtcgcgtcagctctctctctcgcgtacacgtcgcgcgtgnagtagtgcacaatacnagagcatgtcgtgcgtgcgcacaatacataaccgatgctacatncaattactcacctgatcgacaccacgtacacantcaacatcgaagctatctatagctgcacgaacaaacanagtaatcacacagt

SEQ ID NO: 16927 - DNA, 785 bp, Homo sapiens
  misc_feature (1)...(785): n = A,T,C or G
tggaacagttttgaccaacattttctttttaatctcagcatcatcagaaaatgtttgaagttggagaaaattcagcctcttcaacacatctttgttatttaatacaaaaagaagaaatacaaagataaacaccaattctatctaaaattgaatgaaaaataaagcaagttatagactgctgttcaagaagcaaatgaaatcagcataagcaatgaattcaaaatcctgagaaggatttcatacagaaagaagaaattcaaagataaacaccaactttatctaaaattgaaggaaaaataaagcaagttatagactgccgatcaagaagcaaatgaaatcagcataagcaatgaattcaaaatcctgggctataaatgaaattgaggccgatttctgcaaatatatctcatacttactctatacctgtctataatgctacaactcctgctttgccatatatgtaaaaaacaagcctaagacaggaaaaaggaacttacccacgaaattctctttaccttgcttctcaggtgaagacaccctagaatccatctgattcttgagaagcttttatacttgacaatttttcatgggtttggagctaactgcgaagaacaggcacccactcatatgtgcttgctacaggggagaggtgacagtctgacagagcgaacgacattccttctctttacagaactccctanggggacaaataccctgaagaggcgaacctgatcgcatcacacaaaagatctgttttatgaggtcagactgactctggaacagag

SEQ ID NO: 16928 - DNA, 1244 bp, Homo sapiens
  misc_feature (1)...(1244): n = A,T,C or G
aaaaaaaaaccccgnccaannnncaantnnnaacaaaaaaacnaannnaaaananacaanaataaaataacataattaaaaatgntgatanagaaaagtcgtccagacggaattaataagttattattatattatttttttctttagtgtnnattctggtangtgagtgagtttgatatataagccatactcgtaccgnacgcaaggcccaccggcgcgcacgacgcgctctggcactgtcgcgacgctcctgttataccgtaagcanataatgtaggggtgtcagggcgttgattcanaaaattcacgacttcacacgggcattaagtagaagaacagttattattgaancataacactatatagtatacatctagttntgtacggngtagggcanagggaaattttaaatacagagtggcagtatattattgaaaatataacgccccctccccaatactactcctactcttctcaagtcaaggaggtccgtagtacctgcgcacgccnaccgcactccgacaggctcaggtaatcctcacccagacaagnccagtcaaaactttagtctatttataacgcgcaactctccacacacacgattctcaatctgaaatcnnatggtcgttaataaatatgtctgaggcgatcgagcgaagtcgccagactcgctcgtcgacacctgttaagtatatcgctccgtccacctaggtcttacagacctcaatagtatatcgcctcacgtcctcccttatcgtgtttcgccgtttcactccctgcgccctgacatgttgagatctcgagcatacctcgcaccactgcgtacgcacganctgctacaccaccaactatgtgtagttatagtaacctccctgcgtcgtcacgacnaactcgtccgtttgttattcacgagatagacgattaanatgagtgtataggctgctgatgatatgtattatataagtgatattcatgtagcgtcctctataaaggttacgcgcatgttgtatcagcgtgcttagcgatgtaattgtctgntggcgcacactcgccacaacgcgtagtcgtcgttgtccttatgcgtctgtctatatatgatcgcntcagcgttagtcgctgtantacgcatcagtaacacgaacaccgatgttatgncgcggaccgntagctgtgctcncgatctcatagtncntactcnctcactcttcacgctctcactcgcatcgacgtctatactacgacca

SEQ ID NO: 16929 - DNA, 754 bp, Homo sapiens
  misc_feature (1)...(754): n = A,T,C or G
tgttggctgctgacattccttggtttgtggcctcatcactccaatcttcaaggccagcatctttgaatttctccctgatccatcgtcacatggccttctcatctgtgtgtgtggtcaaatctccctctgcctcactctgataaggataaatgtgtgtgcctttagggcgtatccagataaccctccgtcccaagatccttaatttactctcatctgcaaagacccctttgttttgccatacaatgcacaactcacaggccacatgtatttgaatcctgattttatgtggcggcagcacacattcttgaacctaccagccaccgcctccccaaccgctccgcggcgcacacactccgatgcctcacacactaaccacgccatacctcatcgccccctgggttaccctacgccttgtcctcaccctccccttccgtcccctctactacacacccagcactggggcccgcaccccccacaggggattacctacatatcccccgtgcgaacttcagcgagcctgttacgtgtccttcagtagccgaaactcaaaacaccattctcgctagtcccccgccgacgctcgaacaccccaatcaccccattctcctgccatcatcccattccaccctccctccctncccacgctctctcgccgccaccagcctcgccatcacatcagccctattaccgattaacgtctcgcacaccccgagcgcttcgtgccttcgcccagtctgctatttacgccagcttt

SEQ ID NO: 16930 - DNA, 1054 bp, Homo sapiens
  misc_feature (1)...(1054): n = A,T,C or G
cgtccgcgcgcgtgagggccagacgagagcgcatattgtttatcttttttgtttatgccgaattgagtgagaccatagctgttagattgagtggtgcttcttgagtgagagtgaggcgacaggctggcgtgagcagaagctggctggcgtagctaactgagtagtaagtgagggcagtaaacaatagaagtcgagttaggagcaaattgactaacgtccgacagacgcggcctcgcactccctcccaccgcccacgcgccgctggctgccacccgcgcccccaccggcacggcgaagcgaggcgggccgccgcgcgnanacgcacgaacgcgccgngcaccgcgcgcccgcgncaccggcacgcaccaccctacgcgcgctccccgacgacgctaccccgccacggacgaccagccaccccacggactcaccacgcaccacgccgccgcacatccccacgcccccgccacacaccgcggccccncacgcggacacccgacgcagaaccgcacccaacaaccgcacgcccacgcgcccgcgcgccgccggccacgcgcgcgcaccgcgcgcccagcgccgcccgcaggcccgcgcggcccgcgcccaccgcccgcancacccacccgcgcacagaaacaccagccccaggcagacagggtgaggaagtagaagacgccgcaccacccccacgcccccacagcacccgcccgcggaccgaggggcacggaacccgcgccgccggcaagacgacgacgacgccgcccgcccgaccgccacgcgccggcaccgccgcccagccgcccgcggccacgccgacccgccgccccgccgccacctcggccgagacgcgaaaggccccacacacgcgccgcaggcgacccacccacaagatcagaccactaccccgccccacgaggacacgcgccggcacgggagcagcgccggcgcccgcgcgaggaacccgtcagccaccgcccgccggccgagcacccacccgcggcccgcccgagacgcaaccggcaggacgacgcagggcagcacgcgagcgcctgcg

SEQ ID NO: 16931 - DNA, 778 bp, Homo sapiens
gagtgagttcccatcagtttgtcgtctctgttcagagaatattcccatgccctactcaggacactcaacttgaagcctatcaagaaaatcggagctttgctaagagcagactgtctacggaaactcttattttctggcattgacagtagaattctcttttgcgtgtgctaaaaactgtgattatgcggcgttgacaatgcacctgacagttggatatcaccttattttaaagcccgcaggcccctgagtcttcagttcactcatgtactatcaaagacatgtgaaaaggcaaagagtgatcaaagaacagagatcaaggttggggcattaaaagttatattattattttcatcggttaaactctattccttctttgtatgaatgaaagggagatctgtgattggatttccactgattgccacccgctaatccgtgtcacacggacaacatcagctgcagcagctgagggttgttggtgtagatctgggctgagactcagcacgttgagaggatgggagaaattcagcagctgccaaaggaggggctgagaaggagaaacgtttccatcaggctaatgaaacctgtcagcaacagcaggggatccagagcccgtcctcccagaatgcaagaggagcggaagagcagccaataagaaaggaggcaggaggggaggaggaagaaacaagaactcataattataccaattatagcagcagtagcaggagcttggcaggacggctggtcatgaaacaaaagaaacaattaaagcatgggtcac

SEQ ID NO: 16932 - DNA, 760 bp, Homo sapiens
tttgtgcagcctctccgggcggtgctcctccgcttcgcgccgctacgtgggcctgctgcgctgctgctctggaccttgcccctgcccctgctcagctccatcgccttcaccatcgtggcgatgcccaggatggcggcagcaggcccccccaggatggctgccagagcctcgtggagtacgtaggaggaagagcagccgctgccatgctcttctgtggctgtatcatgctggtgacctgtttcatcctcaccttctttgccctctgtgcacccctgacgctagtcctcctaagagtgagttggaggcctccctaccctggctgctgtgttgcaggtcacctccctggtaatcaaccctgtgaagtatacccataccttcaatcttcatgccaacctcgccgtcacatcacatgtgtcactggacccgtggcttcccgtgggtggccacaattatcctgattggctgtcctttctccttctgctgcggcccgaagggcgaagacaacctcctgtgaggcgccaagcccaggtacttccacatccgcctggctggggaggagacccggagaagacgctgccgagaaggactccagaggaggaggctgtttccctaggcgacttgcaacctgttttttggcagtggtcacattattaaattagcacacaacgctgcgatgattggggagaaaatattgcggtatacgtcgctattcaccttttatatatgagttgttggaagtgacatgcctgctgtccctagc

SEQ ID NO: 16933 - DNA, 2011 bp, Homo sapiens
  misc_feature (1)...(2011): n = A,T,C or G
aggttaatnttaaagggagaaagtagnatgnggnnnnnnnnnaaagnanngtanatgnanaagannggggnannaatgnaaagtagaagtagataangnangnagaganannagagnnnnnnnangannannanagnannngaggttngttgtcatagnatanagtntanagnagtatgagatntgtatgatagtaaaatnannnntttanatgagaaganagagagannannaaatccgaannnatnanngnagnaggagnangannnttnggttttagnngannangnngannnnnnnnannnagganganaccccganttagatgnangtgatggtnnatntnnntagtngtnatgatggtgatanatntntaggggtnagtaatngtagtaggagaagtgnagntantantagtgttttnttatgtgaatagnatgagtgatgnnntgnnngtnangnaantaaattgagagaggaagatgaagannatgagtgtntnanagagaagngtagnagagantanatncanatgatggnactcagtanaganatnacccanccgacangaatgancgnnacngnntgatgcnngngtgcggtagggaggatgcgtatgacncggaancggcanagnnnanatgatgtactgcagaggctnanancnancagagcnacgntcnagnacgnacgcagcaatntantagcatcagtcatgcagcgangctacacacnacgacananactaacagagcnacnacagcacctcgacggtgcgngagcnacangacagcagagctgcgcagngcnnnanancagcagcgacactagagtacgagtagncagtgagngagangtnnnnnncgaggaggtncgagaggacgctgcccgagcggagcagcgtcgcncacaacgtcgnganatagatgcgggagatgaagaagtagaggnngatgcacgagagcgagcgntgagcagaggcgacggagcgncncncataccgacgagctcggcggagtgtgtgcgcgncacanncacgcgacgcgtcncgacgcgcgcgcgacgccacgagcgcccgaccgcccgagagactcacaggtgacgncacgcagctcccncacccgagcgcagcgacatggactgcacgcgcgctcgcacacacgagcggcgacgatacgnncgacagcgcgcgagtgtctcagccgccgcagagaggagacgcagaacaccagggcggcgncgaagcagcgcgcgcacagagcggccaacgagcgacatgggacgcgctcgcgaccgcntgcaaggcggctccnntcgccgacgccacgcgcaagccgcgcgcgcagttgtgcagcgggcgcgccccccaacgcctccgcccgcgcgccacagtcngtccacacgacacgatcgcaccntncgaagcgcaccggcgcccgcgagaggcggggcnnngtcncgcgagatcgacggcgtgcgnggcgcgtcgctgcaggagtgacgagccgacgcgccacactccaccacactccgaagngcggaccccacgcagcgangcgccgcggcaacacgcgacgcgcaacgaccgcgcgatctcacgaacagaggtcgcacacacagactcgacagaagtcgncacacagcggcagtcgcgacgaagnnncgcgcgcggcacacgacncgcagcgcagctaccggcgcaccgcacgagcagccacacagacggagcaccacaaggcgcgtctcgtcaccctgtcacgctgagacgggacgcgncnacagagtaagatngaaccncagaggagcacagcgagcgcggagcaganaccgtgaggacgagncacgcgcggacacccacacacggcgnctcagcggaacgcgccngcgagccntcccatcacacaagccgtggtctctcgatcgtccgacgcctctcgggacncacgagccntgtgatatacgagatctgccgatccccgctcgctgccgcgccaaccgcaagagccacacg

SEQ ID NO: 16934 - DNA, 1363 bp, Homo sapiens
  misc_feature (1)...(1363): n = A,T,C or G
tgagtatgatgaaggagaaggaagagaggagagagggggggggaggggaggagaaaagtgagaagaggaagagaggtgaaaaggttggaaggaagagtgaagaggggaggggttagggggaannngagaagaaataaaatgtgaggaagagaaagggggggttagatgggaggttgggaaagaaagaaagggnagaaaggagaggagcgagaaggtaaggggaggaagaccagaacagcgcacacaacagaaatagtgtcacgacatcagaaggaagcgcagaaagccgccacgccgcgaggacgcccagccgggcgcgagaagcggcggcggcgaccgcgagctcgcccccgaagccacgcgnccagcgcgcccccactgagcagccaccaatcgaaaacaaccagcccgacacgcacgcgcctagcacgtacgaaaggggcgacaagcaggccggccgcgaaagcgctgcnataaacgcacacgcgaggatcagagagtntacaaaanaccgtgcgggcgaagggtagngataagaggccgccgcaaccgacacaagccgcggggagagacgagggagagcgggccagcgggccggcgccaggcagagaggcgaggggagcgagcgtcgcgagagagagagcgcaggcgcgagcgccgagacgagcgccagcgccgtcgcgacccccgcccgcgcgtgtgctgcgccgcgccgctancgcagcgtctaggttctacacacaacaggccaatncaatcttgctgtgttaagcatcggcacggaagcgtcggggagacgcgcgacaggcactctcgctgtgtcgcggcacgtccgncgcgcgtcgtcgcgacgtgtgaaggcctgccacagtcagccgatcaggcgcgcgacgagagnagcgcacgtgccgagcgcgagcggggcgcgtatctcacgacgcgacgacgccgccgcgtgagactatgacgtcacacaggacgctgtagagcgagagagcacgacacgcgagcacggcgacgccgtgacangccgctagcgtagcacgaaangtcatagcgaagcaacatggagggtcantgacggtgcaccgtgtgagtgtaggtgagcggctcacgcgtcangagctccaggccggtacacgccacagtcgagcacacagtacncacagaanaccaagacgcacactgcgaccgcgcgcccgccggccgacccctcgcgagcgctaccgcgagcgcgtcagcgggaggatgtagccgacttgccgcgccgctgcgacgnacagcgcgcccagacgcgcnccgcagacggcgaacgagaaggacgcagcagcgccgcacacgcagcaaggagcacgagccntca

SEQ ID NO: 16935 - DNA, 1522 bp, Homo sapiens
  misc_feature (1)...(1522): n = A,T,C or G
aaagaggatgaagaganaagaggtagaagaaggngatgagagtaggaggaagtgtaangagggagaaggngtttgccagtatgtatgagnttgggcagagatcagagagaagaagagaaactgaacacacgactggataggacaccaacaggagagacgcatgtatgttgtattgtgtattgtgntgtatgaagatagaggaggcatntggattnatagggngtacgagtgtgtgtgagtgtgactgagaggatgagtgagtgaagtgtataggagnagatanagaacaggagtctcgnacgaaggtgagagtgtatgtgcggcgacacgtacgcaacacatataggacagatcgtcgctctgtgtgacgtacgatgctagcgatcagtgcgcgcgcccntgaattgttcctcacacgtgtgacaccgagaagaaacaggnncngagccgcgacgaggaggagacgcgatgtaatgggtgagagtctggctgccccggactgactcacgacgatgttacggggacacagatggacactatgcattgcgcctcacgacccgcggccacgcacgacggccaccacgcgagacgactcgcagagacgcgcccgcgcancgccgcgccacgacagaagagtacagtatgcgcgagagagagacgcgaccgcacacgctccncgcgccacacacacgcgcgacggcccggcatgcnncacgcgcccgacacgcgagcacgnctcccatccaacgccctccatgagcccgcccacgcaccgcgcgcccgcacacgccccacgggccacccacgcgccaccgcgaccacgcacagacgcccagcacacgcgcatcccatcacactctctccttccgtcctccccccgcacacgccctgtctcggtcgccgctcttatttcctctgcccatcgtttccgctccatcacggacatcgcccctcagacagcacgcccntgctgccgtnangtcgcgagcacggcgcgcctccacgcacgcanacgctgccacgccctgcgcagccagcgcgtctccgcgcagcgggcggcgcagacagccgcggcgccgcagcgcntnagagacnagcatatgcagctnactgagtgtatctaagcacggcccctcccgcgcacctccgcgtcgcgtcgccgctcccctctcgccgccgcacacctcgagtgagcaggtcacacagcgagaggctagacagtcgacgccgntgacgaacacncgcgccagctcgcagagatcgcncctctgacgtgtcgcgtccacgccgcctcacgcgttcttcgcccgagcatatcgantcgcgacggtccancacgagccgacgtcntcgccacatccgtcgtaccacactgcgcncncgccncgtcgcccgctcgcgacgcnctccgcgtctagctctncncacgcgcgcgcgcgcncacacgcacctcntcccntcacgacgagtgacagctgccaccgtgccgctctcaccgatcgccggactcacgtacccncga

SEQ ID NO: 16936 - DNA, 725 bp, Homo sapiens
cgtggggcacttcactagaaacttctactgaagttgtgctgactgtattgtaagggccctgatctaacctaccaccagtcacttgtgtctccttggtcaagttgcctaccctgtctgggataatgatatttcgtcttccattgaaggggagagatgttttctttgagtcaggcaaaaatgttaaaatacatgttatgcgaagaaaaacttcataaattatgggaaaataaatcacaatttctacacatcttacctttctttttctacagtacatttagatgctgtcgggcgcccgccaaacactacacatacctttgctgagaaggacactttatttttaaagttcgattattagcacatgccctgtattggccttattaaatatccaagactgtgctcttgttcgtccatcaggacttacatgtgtcctcccaacacttggtattgtcccttgcaccataatacaaggatagcagatccgcaccatcctgccttccccggacaatagcttcgtttaccgatcctccttcccctctctatctacgcgtcccccccacccctggcaggtgtgggcaagacatcagttctttcgcggctatataccatcttatctgtctgtccctggtgtgtcgatccaccccaaacccgtttcatgttccccttttgccttccatgccccccttcgtcaccccgtcatcgttcccttgacccgcttgtacctcctt

SEQ ID NO: 16937 - DNA, 1781 bp, Homo sapiens
  misc_feature (1)...(1781): n = A,T,C or G
tagtgtgagagagtgagaagtaagtgngntgtngngntagtagngtgnagtgangnggtgngntggtgtggtnggaggntntgtaatgngtagngataggtagtgagtagtagatgtggtgnagtggtgnaggtncgtggcgtttgngggagagagcagagagtagtgagataggatatgntgggnntgtttgtttgtgtgatgcggtganagtagaaggcgatggatatataagagagaagtatantagaagtatatnagtgggaaggcagtntgtgatgttagggagggantctgtttatggtagagnggagtagnagagagtnggattgagagaggnantgtcganaggtnatatagcgatgtanagtggaggagcagagacgagcaagcagagatgtgnatgangatcagcaactgtacgcgagcacgctgctcacangntagatgcgcgcagcaagnacgcatcgcacgccacgtgccccacgcggacanncaactcgncnggcagtacncacacaataaacgcganacgangatccgccgcngtggtgcgcctgcgcacgccgcgtggcggacagcgacagtcgcgtgcgactatccgcgccacgccgaccngctgccacacnctgcatgtgtacaaataaagatgaagtgcgcgtcacataaacgaatacaccgcaacgaccccgcaacactactacctcgcgcgctccactctcaccgcatacccgcatctctcacactcgacacagcgagcaccacactcagttcagaaatataacgaacaaacgagcatacagcgtagcantacacgacacacgatacnacnanactcactacacacgtcatcacgcacacaccacacatgcactcgcaccncgcgcatcngaatatatcagagagatcgagcgncacgctcgcggctactctatctgctctcacctcacacaactgtctttcactnatcntcgcacatcnaagacgcaggatcgtcagacatnacgcctccgccctcancataagaagcgagagacatagagtgagtaggcgcgcctcgcgcgacgcacgacagcgcgccaggctgagcatatatgactngcacgttgtganagtctacaccncgcagtgtganacccngcnaccacgtgtgctagtcgacgatacgacgtcgacgcangttgacgcgcatagcgcgatacgtatctgcatagacgtgcgtantaagctcancgacgactgcgatcgtagcgccacggacgagtaaactcgcgagtccnacacacgcagacgcacgccgtcacgtaaacatagctatatgacagacancgaccancacacgagatacgagcgcagacgcatctgcgtagactatatntcatcacacgcacgnactgcgnacctacacggctaccactgtgagtagcctnctacacgatatcgtgactgtgctaatagagtatgatacagtatcttactatcgnataacacgcatcacacacacgcncgctcgtaatcacatnacgcccacancgacgacgacgcgcacatacacangtacgtcgacgncnagcagacgctacgcgttcataancaacggatgattagatagtagagnacgctagcggacgcaagactgcaagacagctacgacgcccgctgtgaacacaccacagagcctcacgcacactacaaatatagaaggagcagacgtcacagcgaccagttcgcaccgccacacacanaaacacacctccgtgcgcatgtaaggagcaaacaga

SEQ ID NO: 16938 - DNA, 765 bp, Homo sapiens
ttccttaatagaggccgacctgagtactatgggtttttttcattcaatttgttgtactacttttctaacattttttgtgtgtggctcaaattgtccccaatttggcaaaggagagcccattcattcctgctcttatgtcctttgatatgaaccagttagcctttgagcacttctgtgcttataatgtcctaagttcatctggtactatccctaccccagagctggaatcagtcatttctccaaagaactcagatactattagtaggtaatgcaatttagaaactaaaatctgggactaagtacactcattgctattggggaatcattccttctagatcctttcagtgaacataacttgaaaatatatttttacaaaatgaagtttgtattgatattgccagctgcgtttattgcatatttgcatgctttcgcttgacataatagggaggcttgtcattcatcagtagtccaggctccaactatttctcccattttggcattcgcctttcgcctctccctccaccccgctgaccacaatgccttcacgccgatgttccgccatgcccctccaccagctacccgccccccccaccccccgcgcaggggggggatgagaggagttcgcgccgcccctttctgcccatcccgtgttgtgctggtggtgccgtcaacctccccaacacccctacatcgtccccgtaagcccccgccgcaccccaacctgcccatcacctgcatccgccatgccgcgcctcgcacaccctc

SEQ ID NO: 16939 - DNA, 787 bp, Homo sapiens
gagaaatgtggtcatggcctcctcgtttcccctcagagctgcatgtgagccgctgcgcccagccaggttgtttcttttcacgttgctgagtttcaggagttctctgtatattctgtatatgaatctcttatcagatacatgatttgcaaatatgttctcccattctgctggttgtgttttggtctgttcatgttgccttttggtgcacaaaactttaaattttttttttttttttgagactgagtctcgctctgtctcccaggctggagtgcagtggcgcgatctgggctcaccgcaagctccgcctcccaggttcacgccattctcctgcctcagcctccccagcagctgggactgcaggcacacgctgccatgctcagctaatttttttgtatttattttttagtagagacggggtttcaccatgttagccaggatggtctcgatctcctaaccttgtgatccaaccacctcagcctcccaaagtgctgggattacaggcgtgacccaccgcgcctggccttttaaatttttatgaagtccaatttgcccactttttcttttgttgcctgtgcttttggtatcatattcaagcagtcattgtcaaacccaactttgtgagctcacactgtaaacaagtattgtttttgttgcctacgtagtgccgcttttttcacatttggtgcttttgtgatcaatggcctaaagcacagcgctgaagcgctgccgaacgctccagtcgtctcccatgcgccctgcacagaaaatacatgttgttacacccaag

SEQ ID NO: 16940 - DNA, 215 bp, Homo sapiens
gccaggtacaggacttcggatgaatatactctgatccattacactacatggcaccccaccgatacaatggcaggaaactgaactggaagccagagtccagtctcaaccctggtctgcaactaacacagtatgagcataaacaagtacctaacctgtctatgcttccctttccttatattaaaattcaaagcactggaaaaagaaaaaaaaaaaaa

SEQ ID NO: 16941 - DNA, 1774 bp, Homo sapiens
  misc_feature (1)...(1774): n = A,T,C or G
aaaaaaaggaannnaannaaaagagagaagagaaganngagnnnnnnnnnnnnaggggaaagagtggannaaggaggnaagaagnnnnnnnnaagnggaganagngnnnnannnanaggnnnnangnnnnttttnnnangtttnnaagaagnnnnnnnnnnnnnnnagaaagnnagagttttagngannnagaanagnnnnnnnnaggnnaannnnnnnagaaaagagaagtagangnnaannnaaagaggnnnnnnnnnaaannnanannaaaatagatttnnnagaatggnnanannnnnaagaaaggaagatananaagagaagaangnnnnnnnnagagagaaaataaagatgtgggnnngnnnatgatgattnagggatgagtagatagggcgagtnagtgatatagagagnnangnnaaaantatgaataatagcagatatagaggtnantatgagatatatgagatatagagatgnnnataacaatagagtgnnnnnnnnanagagaatagagtnnanagcagtgnnnnagataagtagaggtannnatatagtgtnnnangtancagtcagagaatgtantatnacatgtcaatatacgatnatnnatagtagantntnnantatgtagagatggatgagagatgtnnntaggatatagngagagagtagnctntcgaatgggtgnctcgcncctnctagaaatganatgacaanttcgngagaggnnnnnaccccactgcaagcgactgtcagaagtcgatntnctagaatattacgtangcgagagtagcnagatagaagtnncnaagaagatacgtgncncagagacatgattatagtctgtgagatactcncactacagcnatncnacacacctcacatacgaacgaagatgncacannnnagtgtagtgaagagagagacgacnnagaagtgagagagttagtgttccatgtgntcgtgtactctatagattgctcgcagacgatnctgtacgtgtaggtggcnnccaccgcagtggcacaccgctgatcgtctcaacgacggcgtgcgncgcgccacgcgagagatcctncgtangacgtatcactactccgagagcgagtggtgcgacgtcgcacatcgagnncnctgcataatcactacgcccgcatactaaactctnnctctcgcntttctctacaacagtaatagtgttatcgtatgtgnnacagcgacgacagatggtagagtaagaggagcgcagttgttagagtacagagtgangagacgacgancataacgactagcagtaaacatcatgtcacgnataagacaagtgtgtgtcnnatgtgaagtggcaccatagntcncgatatgacataagtatgtaaatataatnttaaatagaatgtatctcncatccgtcactcaagcgtgccggatcaccagttgcagaagtccccacacgacgagttatacattaatatttnncactcgtgatntatatagtattccntacatgtattacagtagacagatangtntnatctgtagtcntgacaactagtacccntgccgacatgtgagaggacatacantcgcacatagtgtagattaatatagacttgtctcgatatactacttgattntcnctctcttcggcaatagcactgacaaaaanaccttctatacatctatgctatacgcanaatcgcaagntcggtcacgttcagagatgcnttctctgcgatgaacacggagcntttcacagagatatatgagg

SEQ ID NO: 16942 - DNA, 767 bp, Homo sapiens
ccctcccagtcgacggaagcagttggcctatgcacaaatcatatatcctgatgttctctttcgaaggaatgaaaagtcctcattctgattcacagtacagtgattcatggttctcttcctcttctcttgtcaccctcctcccctccactgaaaacatgaaaacacaattaagaaaccacagggctgaaagctgcagactcttctaagtcaagctgcgggcattttccaagtaggactaggttgatttctgaccttagcagcagtcctggagatgccggcagagggtctgaagcaaaatacaccctgagatccaacttggtagcagctgtcttggtgatctctacagcggatgtgacaggcgggtgagctggtggtggccggcagttccttctcctctaaaggaaaagcctgcaacaaagtacagctcgaaaaacacacaccgcatcactttgctcatcctaaatgtaagaaaaacctggcttgagacactcaccattattcattctctttaagaggctctttagaacaaaacaaatcaccggtgaaaacgatatctgtgtactactcaacttaccacttcaccgggtcagtgtcctccaggacagaggtcagtttccactccccctatttcctgcccagggagtaagcatgtgatcatcaacttactacatcactgcccaaccagttccactgtgagaagggctacagcatcctcttcttcactgcctttggtcattactcatcatgtaattgtagatggatctcca

SEQ ID NO: 16943 - DNA, 1370 bp, Homo sapiens
  misc_feature (1)...(1370): n = A,T,C or G
ttaaggggnnnnaaaagagatggnaaaggttnnnnnnaagtataggtnnnngatgaagagnngnnngaggagaagagnnntgnntggnnagtgttttttnggnnnntatgtnntngnntgggttggattttttgggnatggtatnncccaagnagnnaaggaggatggaatgngtgaaatgagnnnnattgatgataatgttttgatagtgnttnnnaaaggtggagaannatgaagtgnnnnnaaaagagagaagagattntttaaatgtatagaagcgnagataagagaagtaaggtgannaggtacgctgagtagtagagaaggntaatggataaataagagatgtataaagaagttnnttatctatatgagatgttatggtagtgttaatagtgtttcntgtttatatggttgtgaggaatgatgtgttgtatgaatgttgtgagtgtttggtgtcataantgaagaggtgaataggtagagccatggaggtaagtgcttcgccttatgtccctcagcgcngagcgtntctcgtcttcgctgtgttgaacatgtgttatactgtcnnncttgagttctnctcctatgtagtgaggtntaagtcntaccacgcgcatcctctgccctcgaccgcatcctctccctgaccgacccccacactcnccacacacgacacgtctcacaacctcaccgtcaccaccnacgacgtgcgnncacagatattgatctcanaaccgcgcnagcgtctcgcacatacggcgcgcactagctgcgtactgagntgacgtcaccntctctaccatcatatcccttctctgcccgtcgtctctcgtcagcgctcccacgccgctctcaccgccacctctcttctcatctttattctcctcatctcgtgatgaatagcantacaccgatatgagtatcgcaatcaatacgatccncctcncacgtccgtgccctacttcacaccagtacagctactgctcgcagtacagagctagtgggtnacagtgcagcaccccgcccntcgcgccaccatgaaccgcgcacacggtcaacacagcgcccnnnctcgctgtcctactctatgcgccagtccccacgcacagacccccgccgcggccgcgacctagtcannaccatnccacacgacacccgccaaaggcccacactctcacgaacggcattaccacctcactcacctccatccaaaccaaatcgcncaagtgaacaacccagctactatgtacactgactacactcnnccatacgtagccactctatatgatntcccncgctggaccacacatatatatagtcgccgctccactattctnatcgtgcgcgcgcgnnctcctacctgcgcg

SEQ ID NO: 16944 - DNA, 780 bp, Homo sapiens
  misc_feature (1)...(780): n = A,T,C or G
catgngagaattngcntgcnntggttgaattcaacaggaaaccagagaagaaaagacctgttaaagcaattatcaggaggcagcttcttgaggcaaagaatgagaaagaaaaagagcagatgtggaggagcaagtgaaggacgcccaacacagagctgcatctgcctttaggtgattttaacttacaaatggaatgatcttccactgtaacttcattgtcatcactcttccttttgggatatatttagaaagtacagctaataaagttgacctttacgccagtaaagaataaaaatcataacaaatatgtaattcacacacaaaaaacacacttcatattatccatatagtattttaatagttcgatgcttctttggaatacaggatgactaagaagaaacaatacaaaatattttactggtggttcaaattgaaatgatgtttacttttctctaattcttagccctcagtgatcacataatttcaaaatttaattttgattcatgtttatcattttaactggtttattttttgaaaaaaatactttgaaagaatttaatctattaaaagcactttgctcaacaatacattttgcaaaactatatggaacttctacaaatgaaagaatggaaaattgcccaagctttatcccaaacaataaattatccaggatgtatcctctgacgtggtaccttcaccatcattgccatattcccctatccatagtagcatcagctataaaaagcataaatggtcctcctggcctaccgggggaaattg

SEQ ID NO: 16945 - DNA, 966 bp, Homo sapiens
  misc_feature (1)...(966): n = A,T,C or G
aaaaaaannaaggaaggaaaaannnnnaagagagggaatgaaggnnaaaanangganaaaaagnnaannnttttagnnaagagnntnnaacgcaaatttgtaagagttnnaactannctatgcatgagaatagaaagaannnganaaaaaaagttaatagatatnaagtgctagataaagctgcanacncgtcgcggatatctgtacgtgacgacgcgtaatcgactgccctntgtggcgcacgacgcgggggcgggatcgtaggtgtgcagcgggnnaagcgatggagtgtagcgagctatggaccacgaccgactccccagggatcgaattaaacgaaggacagcggggccggcgccccccaggggccgcggggcccccgccccccgccccccccaaggcaggcgcccctggccacgttgagctgactatcaccccaccgcgcccgggggccgggggacgggcgcccgcgcaggcgcccaagtanccgcccgcccccgcgcgccccgcggcgccccgtcccccgcccacccacccctcccaccgccccgcgccctctctatgcctactcagtttcagcacgccccaaccccaccccctctcctcctctaacccgcgggcgttctcacgtcccacgcccgcgccacccccactccccgcccccgcgccgccccccccccccccggcccccgcgcgcacgcccccgcgtcctcctcgcccccagtcgccccccacacgccgcccctccccccacagggggagctcctacacggtccccgcctcctcgcgccgccccgaccccccacgccgtgcccacccctacctcgcgcagggaccagtcccacccctaacgcccccgccactgtcagcccgccgatcgcctgcaccccgcgtgcgcgtgcgccggtccggacgcgcgccgtaccgccatccaggagccccgcggccccgaccaactcttgtacg

SEQ ID NO: 16946 - DNA, 193 bp, Homo sapiens
  misc_feature (1)...(193): n = A,T,C or G
cctgngaactgactcagcacaagaggtaagcttcgacttcctatgatgtcatctccaacccgaccaatcagcactctctacttcctaatcccctacccaccaaattatcctcaaaaaccccaatccccaaattttgggggagactgatttgagtaataataaaacttctccagttcagtcaaaaaaaaaaaaa

SEQ ID NO: 16947 - DNA, 1332 bp, Homo sapiens
  misc_feature (1)...(1332): n = A,T,C or G
agggaaggaaggggggggaggggggganaaaaaaaaaaaaagagaaaaagaaagaaaagggagaagtaaagaaaagaggaggagaaaagagttagaaggggcganaacagaganaaagagaggaaagaagggggaagagaggaggggttggagaagananaaagaaaagaaaaaagaaggaannnnaaggccgagcgagagagggaggagggagagaggacaccggaaggacggattanagcacataacagcgacagagaacaacaaggcaaagcgcgcaaccgacggggnggccgcaggacacgaggataagaaaacgaaaataacgagaaggagaacgcacgcgcccggccagcgacgaaagaggaacaggaacccgacagggaaaacaagacaccacaacccaagctcgcagacacccccgcacaacccccgatcgcaccagaccccacaacaaaccgccccaccgcaaacccccgccacccgcagtgaacacaacacgacccccccggccgcacaggcagaaaggaccacccgcccagcgacgcccacagcacaccaccccaccagcccccccaccccacacaaaacgcaccccgccaaacccacccaccacccaccaaacaccacccaaacacccaccgccaccacancgccaccgagcgacgccaccgcagccgccacacaacacaccaaaaaccacacgaccaacaacaccaaccaaccccgcgagcaggcgcgcgcaggaacgaccgcgcgacacacacacgaacgaagcaccgagtngggaccacgcgcgccccgcacagcactgagcgatgaggcgaccggagagngaccggagcggccacgagacgccggcggcgccaccgacgacaacgagcgcagaggcagataccggcgcgcagcnaacgcgcaagccagcacagcacaggctcgcgcagcgggccgccagcgngnacacacgagaccggcgncacacacgcagataccagcccgaaccgatancacctgacggccggcgacaacacacgacaaacgaaatcancacanaccagcaccagancgcacgcacatcgagccggcacgacatcacgcacgacgcagacgccgcgcacgaacagacgcgcgcagcagtcgcacagcagcacaggcgacacagtgcgcagcncacgacagacgcgcccactcacgatcatcacgagcgacgacccgacacgagacacncgacatccgatacgcgacgcgagacgctctcgcgcctaacgacgagacggccgccgacaccacagcgcaacagcagagcgnagcacgcacgacgagcgcggagcg

SEQ ID NO: 16948 - DNA, 757 bp, Homo sapiens
ctagcctgctacgtgactcaagaacagaagtgaaaggaagtgtcggtcttctgcactctgccacagcaagaaaaatatgagcccaaatccaccaggtccccctgactcaaagcctaacccgaaacacagagaaatcacgtacactcatgccttcttcaaacttcgcttttcagatctggaagctaaaagacgcagcaacaatgactacatgaaaactgcttaagacctttcttaaaacaggcagtgaactggttctttgtaataagaggatgaagcagaatattccatatttaattagcaatcttaagaaagtgaattaacaccttccttctgaggtgttgccagtcaaacacagttggattcccattttttggaggcttggaggcctgtttgggagaggtcattgacagtaaattgctaggacacatgatacgaggcatcacacaaggaaacattgtggaagctaacatttttccacaaaacacaagagagaaaacagaagcagattgaacagcaatggtacttagtgttacccccagcttataaattccttttgggcaggagtgctatataattcattgttgaatttccctaatggcacatgctcgggcacattgaaggcattcgatatatgtttgctattttttaacctaattgaatgggaattgaatttagtgcgataagaaagatacccatgtatttgagtgttatattttgtaaacactgctctaatgggcatcaagctgtaagaagttaa

SEQ ID NO: 16949 - DNA, 989 bp, Homo sapiens
  misc_feature (1)...(989): n = A,T,C or G
ggggggagaggaaggggagggngaaggggatggggggagggaggggggaggggggagaggaaaatatgtaaaaagagaaagaaaggagagagggtgaagaaaagagaaggaaaggaaaagagggggcgggggaggagggagggaggtgaggagtaggggggaanaanagaaagtaagaatgaaagacggcaaaggtagtgtatgattaaatatattgcttcaatgaccgaaaaaaacttatcacatcatttccatacacanttatagtcacgatgatggagaacaagaaaaaaaataagatataaaaaaatacccgaacacccacccccgtacgcacaaatcnactagaaagaagccgaacagaacaacgacgacgaaacacaacctccctagacgcacgcgcattcgcatacttgcatattataagatcagagcccacgagcgaagtctgataagtcgctgagtgggtgggcggtcccccttgctcgctactcacgccccgctctactctctctgctcgtcgtgtgactccttcctacgccttcatctcgtcgtccgacgacatacccgcgcgtcctcccttttcttcgtccatacctcaacgcataggcaggtcaactgcgccgggccccgagtggcgcgcactgcatccggtttacccgaactcaaccaacaaacatacatgcagcgggtgactactataaagccaccgcgatactaactgtgagcagtcacgaatatagttcgcgcgcatatgccacccggtgtcgtaatatacagcaacgaacacaggaagacaccaggcctctcatccaccactcttctttattattgcttatagtggtagacgacgaccacagtttcgaaagacatccagcacagaatctatcgtcccctctatgttcggctactctattcccctttgcaacacaccaccttgttgtagcgcatcgttgctctcgatatcgtgattatactgaacttgaggg

SEQ ID NO: 16950 - DNA, 861 bp, Homo sapiens
  misc_feature (1)...(861): n = A,T,C or G
ccacccaccccccccacgaaaaagccggagacacgggagccatccccccagggcagggccgacttgcgcgaaactctaccaacccttgtnggagactaccacgaatgaagacaaagaaaacatacagacttgtttggctaggttaaggctgctcactgggactgaataatccctaaaagtctctagtaattctatgattagatgattctaattattcctaaataaatgttcctatattggcaacaaaaaaaccaatcccacccaaattacccacccccccccaaatccgcctttcttccacaaccgtccaccccaccccacccacaaccgccgcgttttcttccttcccgccctacgcggtgcgtcttctatcccccccccctccacacgcagctgtctcacgtgccccgcgataacgcaacccacgcgcctccgcggccttttgtgcgcggatcccggtttcccactcccccccaaccgcagaccggtttgccccctcgccgcgccgcgcccccccgcgcacgctcaactctccccgcccgggtcctctatgcatctctctcccatcgccgcgcacccaccgctgcatgccactttgcctcccgcctggttctcccccccaccatcacaccacctccccgctcgcgcgtccacagtgctcgctacggtccccggcacacaccagtgtagagcccaccgccagcgcatctcgccccccgtcacacccnacgcctcccggccacaaacgagtcctgccaggccagagaccaataattccccccatatactgccactccgtcaccgccgggtcggagaccgatgttcgccagacatcctatagcgccaagagccgcgtctgct

SEQ ID NO: 16951 - DNA, 779 bp, Homo sapiens
tactcaaatgtggaatcctacccaggatggaagagggaacctgatgctacactacggtctctgacctgatatgggactacactgagcaccactagcttgttaagttgaggctcgacccacctaatgtataagtagctatgcgtacgacctgctggctttgatcggtaactgacgctttattgtatactaaggagcagctagctctgaaagtctccatcaacaatttcggaatgatttttgcttacctgtgacacccagaaaaaaacaacgttcacaattttacacagaaatcagtgacatgcgtggaaagaacatgcaacacaaggtacaaacctgcgttctggaattagactgccggcggttagggctcatctctcgcactacccacttatatgaccgcaggccaattagggcatctctctgtgctactatttcctccacagcacaaggcgcgccgccacgccgcttgctcaactcgcaaagtctcgccattagactcaacctctccgtcgcctatgacgtccgccctgacacccgctgatccgcggcgcaccgcacgggtcttatcttaagcccgcggcgagtccccaaagcacgccggtcgagcccacttccatacaagcgaggcgcgagggcatccataggccagtctcctaccgaatccctcacggcaagccgtgcctctctcctcccgccgtaagaacgtctatttcgccgccctctcttgagtctgtctatccagcagggcctcagatatccgcctcgagcgcccaggagtt

SEQ ID NO: 16952 - DNA, 1314 bp, Homo sapiens
  misc_feature (1)...(1314): n = A,T,C or G
gttttgtggttggggtnnatttagttaagagtgtgtaatgagggnggaaagagangatttaggaagggtgagagctattaggatacataaggaagaaaaaggttctgagaacagcagagggaagaaatactaagagataactcacacgactactgaactaacctggaaaagccagagagattactaactagatctgcacggccttgccgtagcgttccttgattgattcacgtccacggcaatacgagcaacagcgcaagtgacagcgtactaccaacaactacgtacgaacagaccgctccaagaggtctgataatttcgggctgtgttcgttggcagtacaatnttcctgtctggatcgtaatacgaaactgaaacacgaagaacagaatcacgtcccacgctgctgaacttaaagctctacaacgcccatatctattcgacatacanagaataataaatgtaatatattacttgtcatgagtcagattgatggtatatanttagataccccagcgcacngatattacaacacgcaggacaagcaaataacactcccaccagcattaactctacacatantataatatattagtatactataaatagatggtaggtgaatgatgattacgacgataggccagaggagaaccgccaacacagattacacataatggctcgcacacattcatccaatactatatacgcgcacacagctgcgacgcatccgatatcagcaccgctacgaccgcaccacgaccatcnatcagctgagctcgccgcgcctacgccatccgtactctctactctataagcgacacgccgtcatctcgcgccgcggcggtccccagggaccataacgacncaggtctagtagcttttgtgtcacgataggacgcgactcaataacaagaattgacacacttaaagccaacaaatgtcgccctctatcacggcgntaacgacacncgccatacactccacncgctactagcctgacccgactatcgataacncctcaccatagcgaatcacgactccgttaatgtatatcgtgaaacgcccgtccatgatagatagttctacaccntcacgacaaatcggccgacgactgagcatatgcggcaacgagaatgtgacatactcgacctatcacgtgctcaccagacagactcactcccgagtcgctactctgtatttagacgccctctcgcacacactccagcgtcactccgctaataccgtagcgcgcccatagtagatgctcccgcatactagtctgtccagtagcccagccgatcctcactcactagg

SEQ ID NO: 16953 - DNA, 737 bp, Homo sapiens
  misc_feature (1)...(737): n = A,T,C or G
gtctggagcgcaggggtgcaatctcagctcactacaacctctgccttctgggttcaagtgattctcctgcctcagccttccgagtagctgggattacagaggaaaaagaaaggaaggcaggattccacctactagttgacgtccaacgtgatatttgatggcacaagaagaagtccatctttatgtgccatgattgtgaggcctccccagcgatgtggaactgttggagtgaaggggtgtgatcaagctcacttcagaattaatcttctgaactcaagcaatcctcttacctcacaatcccaggtatctggcaccacaggtctatccaaagggacaactgctaattgttatgcataagtctacagttggcgtttccaacacacgagcgggtatgatgggtgggtgtgtcttcgcgccaccttagctttgtcatgtgctgctgtgtcacttcccgtccctagctatcccgactgtctccgcggcccatgtcgcgtgagcagccggcgctnctttctatgtctccgctccggtcgtccaggcttgcgtgagtccggcccgtggcccagagtgattgtttcccatcgtgattgtcagcggtgcgccgtcctcacgtgcatcggtggaccgccgcttctcggtaggggtcgagcccacacgcccgaccccgatctcccctcgttgcatgcatccgcgccggcgcccggtcggcatttcgccaccgcgatcgaagcgcgctg

SEQ ID NO: 16954 - DNA, 1103 bp, Homo sapiens
  misc_feature (1)...(1103): n = A,T,C or G
tgtttntagaggaaattggnnnngggggnagtgaataaggnngnanaagnnnnaatgnanaangaganntngggggnnnnnnnnaaaatnngttttccntgaaataaaggggnngaggncgaaaggntaatgagnaatatgnntaaggnaagccnacgggcgggcagcnccaagcattacgacgagacaaaaaaaacacaacactttagatgtcattatncatattccttcgtacctactccccgcgccgtatttttggtgtattattaacttattaataataaataatagatnagagtaagcgagaagaagatacagatgtgatgcaaaattantaaagtaaaagccacgaggggccgcccacgcaacaaacgagagagaagcataagagcggnacagagaagtgaatggacaatatagtatcaccacgtccgcacgaccaataacaagcacacagcagtaatatgcaaccaaggggcaacaccacacccgccaccgctggtgccagtgcccgcgaactacgaggagcacaacgctcccttctagtatggctacctaagccattacgccagtggtagccaccgcccatacgtgtgtacactacattcgtccattaccctgcgcgcagcagtgtatccaaaacatacggatcataagtagtggccctagtgatagcggatctaggataggctgtagtccaccacattaccatctactggaagtccaatatcacctcgtgttcagtcgaaccatctccaatgacacgactactctacacatacataagcaccactcttcaaccccaactaagcacgcgagccgccctctaagtngcgtgagtagcaccacancgcgcgcgctcagcggtccgcgcgcacgncggtacagcgtaccgatgttcacgagtgtctcacgcactccaaccaactcgatcgcgtagcgcncccgcgccacatgaaatgatagccagtggagcgtatgtactccagcacgagacgaacacgatgcgcttgagcctaccgagcgatgtcgtacgaacatagatcantgcgcgatcgtattctatcatacnggtcgcgagacgaagccgatcgtncatatgt

SEQ ID NO: 16955 - DNA, 252 bp, Homo sapiens
aggcacgtcagctccatgaagacaggaaccatgcatgtctcatccatgatggcacccacacctccaggcacaatgcctggcccatataaggatagtggggactcaaacatattcattctcctaataatgaactactataaaatgacccatatgaccattgaaaaggagaagacctgctgtcattacattattctcctaaactgatgcagattttccacaaaataaatgtaattatagacaaaaaaaaaaaaa

SEQ ID NO: 16956 - DNA, 935 bp, Homo sapiens
  misc_feature (1)...(935): n = A,T,C or G
aagagaagaggnaaaggaaagggaaagagaagtaaagnaaagaagaataaaaatttcacaaatntagaaaaaagttgaaggnaagctaggncgaccttgtttatcgaccctgacctggagatctacatgaaggacgagaagctggnctccttgaggaagggatcagacttacagaacgaatgcaacaacaaaataaccaaaagccaaccgagacatacaacagaatcacacgccagccactccagccagcccggcctcgcacagaacataagaccttacgcnggacngagtatcacactgcgccacncngcgcaccgtgaccactctcgcccccccgcacccaacgacgcccacacgccgacagccccaacccctatgacaaaagaggaaagtaaaagagaacagccagaagcccgaagctcacgcaacccacactactgccccagagtccaccgcccccactcccgacaccccccgcaccccaccccgcccgcccccgtcccccccctgcaaaccacacccntcgccccaacacctacccccccgccgcccccccgcccncgatggcctttgcacgccaacggtccattccagacacctcgccacccaccaacaccacacccccccccgacgatctcaagcccaccacgccccccacgcccaccctcacccaagcaaggcaacccaactcccctaactcccacacaaccctaccctaccacacccaccacgcccccgacctacccaccacaaccccccagccccccccccacgcccgcaacgccccccgcctcgcaaacgcccggactccacaaaccctcccccgacatacgtaccccaccgcccaccataatcgcccgcncacatcagtgaatgctaccatatcacgcnnaccactcccaacgtccagaagtcctaccccacctcctctcctt

SEQ ID NO: 16957 - DNA, 749 bp, Homo sapiens
agttcctgctggccgaacttgagatcagccctgacctgcagatctccatcaaggacgaggagctggcctccttgcggaaggcctcagacttccgcaccgtctgcaacaacgtcatccccaagagcgtcccagacatccgccggctcagcgccagcctctccagccaccctggcatcctcaagaaagaagactttgaaaggacagtgctgaccctggcctacacagcctaccgcacagccctgtcccacggccatcagaaggacatctgggcgcagtccctcgttagcctcttccaggccctgaggcacgacttgatgcgctcctcacagccgggagtacctccctgagagactggcccacaccaggacctcagagcagggaccagcacagtaatccagaaagtcttcattctctactccatttacagagaccagcaacaaaacacttaccgctgacacagagcagcagagatcaaacagtaaccccgatgctcttttctccttgtagtttcctggaagacacatctgatttatgccatcatgtgacctcatgatccacccgcctcagcctcccaaagtgctgggattacagggatgagccaccgcaccgggccgtggtctattgttctagttacgggaactgaagctcagagaggtgtcaccaccaagtgggcattcccatgccagccttggcgccaggttctccaaggaaggctcttgccgcccaccggcttagactggacctaggat

SEQ ID NO: 16958 - DNA, 201 bp, Homo sapiens
gtgacttctatagtgtattgaaactgctttgaaaaccaaacacgcgggaagaatgtggagtacgtgagtgaacgatgagaagatgcctacttgagaacacgatctgaatatatagagactctgcacaaatgaatacggcgatgaatattttaaagtaaagacaaagaaaagatagccgagctctcgcccccacgcaggcct

SEQ ID NO: 16959 - DNA, 718 bp, Homo sapiens
tgtgttaaaggtgacttcttcagtgtaatgaaactgctttagacaccaaacacccgggaagaatgtggagtacgtgtctgaacgatgccaagatgcctccttgacaccacgctctgtatttctaggcagttgtgccaatcaattgttcttgaatatttttcactaattttaaaatctagatgctgatctattttatagaattaaggaaacatgaaggtctggattttttataaaaatttacatttatacaaggggactcacattacatagaaatgctcatcatacatttttgcagaggattaaaatggtataggtcttccagtgttatattgcgcataacacatctgtcaggtacttgactaagcctcattaataatctgttaacataataaagacgaagggcttctgttgctctacactggtggacctcttcccccacttcccttcagtgtagccaaacttcagatcccccctcccctgactactgatctccgcccgcttcgcttccggctaccctccgcatgtctcactaaatgcttatcaagaccttaacgaacgacccatgccacccctcccagtctacgcctttctagcttagctccaccagttccggctagtcccacgtaccgcagctccattcgccgttctctatcaggcccgcgtcgctgcttgcctagttgctcctgcacctccgcgcggcagttctcctctccacggt

SEQ ID NO: 16960 - DNA, 1028 bp, Homo sapiens
  misc_feature (1)...(1028): n = A,T,C or G
gtatatggtggggagagagatgttnagatagaaaattttnnnnnnnnnnnnnnnttgtgacacccggccgtggcgcacctgggccgaagttcttggggtacctacatttanaggctctatgcgtggccagcctcagccgtgcgaacgaaagaagttctaagatgtagccgaagcaatgcgcgtcatcggagcccggaaggtgcgtgagcgcgcgagtcttgggcgatggggttgatgggtggtccatgtattgcagacagacccgccggcagctgccggcgcgccgcgcatgacctgcgccggctgttaggtattccttgtttttgttgcttgtttttttttgtttgtgttattgcgcctcgtacttgtatacttgcttaccaaggcgcgcccggcgggccggcgtggcccgcacgagagggggggccgccggtcggctcggccgtctttcctccctccaaccggagtccccaccctccctcctccccctccccccctccctcctcccaccccccctcccctccacaccgcccccgcgcccacccgtccccgcgccccgcccgccacccccccccgcccccggcccctcccctctccgcccggtaccctccttacctccccacttcccagcgtcccctggccgcactcgtgagccgggcgccttcgtgccgttagtggggtcgttcgcctcactgtagtctagagcccattctgaacttctaccttgccgtgttagtgtgtctcggcgcgccttctcccccgctgcccgccgctcgcctcgccccgcgccgcccaccccgcccgccggctgccgtggcccgcgcgcggccccgctctcctccgcgtcgcaggctcctcactccccccgcgcatcccactgcccccacgtgcccacccgtgctcttctcctccgctatgcacgcctctgctcagccccccctgccgctgtggtgccncaccggcncccagcgggccccgcgatgcggcacttcacagtcaggcaacggtctctggctcctctcacgtct

SEQ ID NO: 16961 - DNA, 589 bp, Homo sapiens
ggggagttgtgtttgtggtttggtggcaactatgttttttaaaacatcttttaaaaatgttatgttttccctatgtatgcgccccagttctctgaaagttgtccatttgtatgtgcacttatacggaggtgaatcaaagccacttgctgatgcccttttgctttccctcattcctttgtcaaacactcattgaacacctcctacttgatcaggccttcgctgatcactaaagacgctcactgaaacacaacacaagccgcggcaccccggtctctctgttttgaaagggagagatatgatccgcgctcatcccgccgccccaatagcctttctcatgagtacgctaccatactatgcgctgtccctttcacatcttcctcaacaccaatactatactctcccctgtctagtccctatatcccgttgcctcgccagcccccccgctgccgctctccgcctcctatctccctgcatacactgttttctctatctaagcgccatgccccttctattctcctcgcacaccgcgtctaccattcccataattgtccctatatctcccccgtccgatgtatttccctccgtcgtg

SEQ ID NO: 16962 - DNA, 1600 bp, Homo sapiens
  misc_feature (1)...(1600): n = A,T,C or G
aagaagagagtgagagatnggnnnnnnnagagngnaggagagtgggnnaagaggggnnnngtgagngaaatnngnnggnnnagagagttgtgggngngnantgtagtagaggngagagtagtgnngnatnntaggggnnnagnngaggagagtgtgtnnnatgaggnnnnnnnnngtnantaanntgggnagtagagngngtagnnntttgtgangagtagtgnnngngggtgagagtggnnnnnnagggngngnnagtagggnnnnnnggggtngaggagtnagagtagtgnaanagtatagggnnatgtagtgnnnannatatgnatagnngagagagtaangagatgttgtgagtgnnnngangngaaggtngngagnaggagagaggtannnnanagaaatgcatgtgtnntatgcgtagtcttatatgtagtntntatatngtatgttggctagantntnnttgttntanttatgtgtattgtggtagtngnncngcngtgtgttggtcanatcgatgtgtgtntnntatagatgtcagntacgcgngacgtattgtatgataggagaannaagcaacgcacgatgagcgactgtgagatagtgttatgtgtctcatgtatgatctatttaannactcaaggtanatctgctgtttgagagatatatcgcatcgatagagatgcgagtnagtgtgagtncatcgtacgttagcacgtcgtatttnagtatcagttacactacgttgattctactctatatcgtggtccttcctatatatgacgtcgtcgagtgccacgangaacgtcagtcgccccgcncactagaatacatattgcctctgcgtggaatatgcatcggtnnaacgattgnnnnctatgtgtggtccctgctgtggtatntctggtagttaggtgtagtcttagtatacgtcntcgccatnttcgaggtacgggtgtgatgtccnctcccatggctcccgttgtccgttctcgctgcntgctcccncacacgcctgcccnccgtcgcctcacgcatctggtctctntcggctagacgctcgatttgttcntattancacggtgtgcggtcttcttgttcgctttcgccctagtctgctctcatggtgcgncctttctttctgtctcgattctcaagcatacagctatatcgtgntcgcgatgtctttgccgcttccccttgccgccccctccgagaccaccactcgtacgatataaatgacacactagtacttgcctcccattgcttctatcatcttgcctccactaggcgtccccgatcatccncactcgcngattcaatgctcaccatgacgtcncacctcactcacccttcctcccactctctatacgcatttcctatcaagttcctcntttcatctggtgtgcagatgagagtaggtgaggaagaggaatgtggaagancatcactatagtgtccctccacgaactctctctcnctctcttgtcgcggtttctagtgtcatcttcccttctctagggtgtgtgccgacattgttgatttcttgtagtcccctaagtcgcaccgagatcactatgattgtcactccggaccg

SEQ ID NO: 16963 - DNA, 768 bp, Homo sapiens
  misc_feature (1)...(768): n = A,T,C or G
agatgtaggatggtatgggagnagagtacgggtctaccgnccgcggcntttggaaaacncntttgaacaaaatgtgtgtataactattatgtgnggacccacaaaaaatatgcacagtaaaacgctgnaaacacagntcggcaagcataataaagcaaagcgttgtattaaacaaattcagatatagcgatgatcacacaaattgagagtggactaagcaaattgaacaagtctgagggttctttctagatagcgatctaaataagaaacccacctatacactattgccaagacatggctaaacagctgaaaagaatggacccaaccgatgctttcttaataaaacaaactaacctgagcaggcgcattatatttatgatcggcacgcactctcagctttgaagggcgacaagcttctcttacttgcggaacatggaggggtttgatggggcccccgaattttcccatccgagggcactcagaacacaaacctttgtggatagactccggtcaagaatatatcggacggcgacctccagtaccacacgggccagccaccccgccgccgagacggggtcgagcagcatctgcagtcccccaatcggatccccgaacccgtcctcacccgcccttcgctattcttcatcgggcgcagagcctagagtccaggcttccgcactgacgcaccccgtgccggacaacgcacagccgacgcgcgtccatccggttttctcccaagcccgcccgcccaagaacccacacccgcgt

SEQ ID NO: 16964 - DNA, 1216 bp, Homo sapiens
  misc_feature (1)...(1216): n = A,T,C or G
aaaaaaagattaaagngnaggagnaaaganaaggaatgatangaaaaataatatgtagaagtaataaaaaaagtttaaaaaaaaagaaaaaggaggngaaggttgngnaagagaagagaaaaaannaaagggagggganggaaggtgaaaggaaccggaaatttanagcggggngggtgaagggtgggggaagtgggaggnaaataanaactcgagtatataagcacatatgtggatagctgccgtgtnttcgtgtgttctcgtattttgtatctatcacggatctggtcgtcgagtacgcgtctctagcacttcattcnacttacgtattctccgagtcctatgaccagtgacaatacacagcttcacactcacctaacatgcactgacgtaccgatccactaatcagcgcacaaccacacatacgctccctcctacgtantcacattacgtctgacgccgcctacacgacacacccccgcgaccgcgatggttagtgttggtggtgtacagctggatttcggtggtgaggcgcgatgaacggtcgccactcgcaccggcacccatgcacaccccacgctcccacccacttctctcgagcgnccagcagcacagcagcgcgacgtaacagaagacgacacacacgaactaccactgtcactcagcctccctctccgtgaccggtcctctcttctatcgtcttatcccatctacggcgcgcgctctctcagtgtccantattcatcatctttcgaaccgagttaacaactagtatacagatcctgcntcaacaccacatcgcaccctgtgtgctcgctggtgcaccgntccagtgatgtcctgtgtgtctggtcatgcctctcgttcgtgtccgtccagcacgctccctcacgccaccttgaccatcgccgccgtcgttacacgctcgatatctgcattatcctgtcccttcgcngcgtgtcgccgcccaatcgctcactcgcgcgcttgtccggctcgctacatccttcatacgtctccttgtcgcgttagattatgtctagtcggtgtggcgttcnctcctacgctggcccnctcgccggtcgtcgtgcagctccagatcaccgcggtgggcgagccncactaccctcggtgttgctacgaccgtgaccctcgaagcgacatgtgtcacgcggtcgtctctactcgtgtttccttgcgtcgatgnattacactg

SEQ ID NO: 16965 - DNA, 684 bp, Homo sapiens
aatgaaaaaaagacagctgtgctgctgctcccatatgagctccaagattcataatttcgtcatgataccctgaagaagaactggacatggaaaactggcactgagacatagatcatcaggctgctgctgacctagaaaccttgtgtttactgtaaggatgaaataagtgaatgtaaatgtaaaatattgcctcctagacttgatttatatccacagaagtctgaaatatctttcagctcccctcctgcttgactgaacctgggtcattatcatctgcagagtcatcccaaatgaatgcataggaaacttcagtttgatagtaactccagcccttactatgtagaattgaatggaaaagagagatatgcttgccttgagaacctgacttaagaccctagactgaaccttaaatttgtattctagggaggatagagaaagcctatgttggatgaaagcaccgggtgatagcaacccacgagattcaccagccactattattcattagagctcctcggagcgcttcgctgtccaaccatgaggagctggccaagggctctatgacgccctttcatccgatttttcgcctcaccgcgcgccctgcccaaacgaatccgcgccccagcacgcgacgatcgcgtaataccccgcgcacccgccccgcccgccttccacgactgcttaggg

SEQ ID NO: 16966 - DNA, 770 bp, Homo sapiens
agcgacctattacgagcgcaatactagtctggcagaataaattaactttggatgacatatactaccagagtattgaggtttgttattaaattatgcaggaacaaagcattatgtatttgatactaggcatcggaagaataggcccaatggaatggaatagaattgagaaacgagaccccgtcatatatgttgcatctgatgtcactgataatggtcacaatggatggatgcggtacttctttttcaacataagtagctgatagattttgattatcaaaaaaatatatgctaggaaagtaaggaaaacataatctgagagtgcttacttaccgttattattaagctcacagaaaatcacagacgtattataatactgtaattgttatgtgtaaactacccatgcttgagcaaaaagactatgaaatgatgattagaaataacacttaccatcaacttttcagagcacatatgacattacgactaatcatatgcattggaaacaacacatacctcataagtggggggatgaaggtaaagcttataggttttaatagctctgtctttgcttattagctcgatcatgtaataagcattacattgccacgagtctaagataataggtgtcatcagtctacagcattagatcatttttggagcctcgtggacccttaaatcaaacagcctcaacagataacattgaaaaattagccataactctctcttgccacagagaaaaacacctcgctcgatgagatacttaagtaagaagt

SEQ ID NO: 16967 - DNA, 243 bp, Homo sapiens
gctgtcggaactttctagactctattacggaaccttcagagggtgatgggaaagttccctttgccccgacaatgtgtatgcccagagaaaagaccatggcaggtcacagcaagaagtcagccatctgaaagccaaggagagaggcctcggcagaagccaaacctgccaacaccttaatcttggacttccggtttccagaactctgagaaaatacatttctattgtttattaaaaaaaaaaaaa

SEQ ID NO: 16968 - DNA, 191 bp, Homo sapiens
ggaaccataaatattaatctctggaaaatgcttatgaaatggatctagccttgcctaaccattttgcagatgaagaatctgagatacaagaattgacttgcccaacaaaaaggcaagattaagtcaagattattggaaaagtcaagattcagaataaagtttccttccttcctccctcaaaaaaaaaaaaa

SEQ ID NO: 16969 - DNA, 180 bp, Homo sapiens
ctacaccttgagatgaagccttctccatgcagagaaagacctaaaactctagcgtgatgtactcatggataagaattgatcaacatgtatccagagcccaatgatgccaggaagaaagcctaaacataatttaataaactccctctctgttttcttcatttcctaccaaaaaaaaaaaaa

SEQ ID NO: 16970 - DNA, 772 bp, Homo sapiens
ctttctttatttacagaaactgacatgcagtggaaaatcctccaggaaacttctaagaagttttcttgttcctaagaaaaagctacaggaaatcacactctccttttcttctggttgctgctagaatgaagttgttgctgaagaaagcgaaagagagggagaacagccggagtcatgaaatcaacctgaagtttcctccactcctggacttgccattattcacatttttgatgtcttttatatttcaaactgcctgagtcgaggttccttggaccttgaaatgcatcatttcctttattttctgctgaagattccttgtaatgaagatgaggggagagattgggggccactggagtttttcaacaataggggaagattttaaataagggctctggcatcccacatccaggcctggtacttcattcatagtgtgccaggaaacacaggtcagtttcccagtgcatgcctggacctctagcctaaggctccagggcaaaccagaggcggagagctgatgttgagggtctgcttactatggagcagcatccactgcatctttcttggtgcctggccactcacttacatcttcttcactcctgagcatcatggcagggattgttttaatttaattcaagcaacatacctcagggaaaggggacatttcaagatgatttataatttaggataagcaaatttgagatattgtgtttaaatcgaatgctcatacgggagaccatacgcgaagggagaaagagaaggaagaaaggctcta

SEQ ID NO: 16971 - DNA, 832 bp, Homo sapiens
ttgttttaacattttatccattttaaatagctattggagttaactcagggatgacaagatgaagtaaccaggacatcagaaccagtaatgctaactgcaggatttttgtgaaactctttggagaaaaagttcatcctctttctactagaaactaatacgatgtatgtttacagccaccgatactgatcatgttggctgtcctcccgaccgccttatatccacaaggtgcaccccccacattcttcagttggtccgtatactccctcactgcggcccaatttattggacccaggtccctcggttgtgtctctttccacggcgcgggcgggggggtgtgatgctatcctgtactgtctccggtccatctcggctgttccccgctagtctttcccccgctcgttgttcccgtccccttggcctcgattcgggtgttcctccgcgccggttttcgggtgtctcctggcccccccgtgtcttttccccgtctccgcgccttcgctgtggttttgcccccccgtcggcgccaagaaggaccgactccccacttgctctccgccccggttattcttcgcgtctctctgcgttttctcacccccctctggcggggcggcgttttgtcggcctattgtgtttgttgtttcgcgcgtacacgtgttggcgggcccgccccgatttattccccccccgttatttctgtgttttttcgccgcgcgccgcggcatctcccgttatttttacttctctttatgtcgctgaatgtgtccgcgttaaatcacagctggttagcacgcccgtcgcatctcaacgatgtatccgtgcgccccccccccct

SEQ ID NO: 16972 - DNA, 792 bp, Homo sapiens
gaattgaaaaataattcacagagaattgattcccatgatgcgttcacctatgtcctgctcagacacatctaggatcatttcagcgctgatagactgttcaaggagatgcagcctaactcaagaaaattcatcatgctccctccctcttttcctttcttcagtttttggttcccacatatggaacacttttaatgaaaaatttatgagaggttcttggtgagagaggagaaacactggtgggtaagggaaatcccaagaagaaaaaagatagactttctgggccgaagatgcttaactggtccaccgaaatatgcccctaaatattaaaataaacccaaatgccttttctgaagagtgaaatctcaagaggtggagccccccatctactaaagaaaccctcccgataatgcccaatagagggtgaaaaatgccctaccaatgtatagataatggtttatggggggattaaaaaagagaaagaatattttccgctcgggcactggtaaaagtattatgaaagaggtaggaattttggaaaggaaaaaaaaaattgcgttgttcaaaaaaacaattcaattggcacaggataatttttctgtaggagaaaaaaaggggtaagcccacatttaatggagcgaggtaatttttagccaaaattttttccccacggtctttaaattagtaccatttggaaaaactttttgttgggaaaaaaggggattaaaaacccgccccaagtttgaagggggtctcccaaatataaaaaagagacctccctatttgggggcgggt

SEQ ID NO: 16973 - DNA, 258 bp, Homo sapiens
gggcaggaaatagatgtgtaatttaatctggttctacaggatgagatatttccaactactgaaaatgagaagaacctcagtgacactggagctttcattttacatcagcccctttgtgatatggtaaatgtctcgattcataccagcaggactagaatatggacaagagacactgtcaatgtttttaattcggtgagtgacttgtcatcctccactttccaaataaattgctcattttgtacaggaaaaaaaaaaaaa

SEQ ID NO: 16974 - DNA, 784 bp, Homo sapiens
ataataggtaagatgtgcctgtgtctcctttgccgtccaccatgattgtaactttcctgaggcctccccagccatgcttcctgtacagcctgcagaactgatggaacaccaggctatagtttcaggaagccagacttgacccagacttgaccttgcaaaaaatagcaaccccttcagaactggtaaagcaatgagaaagaattgctcagaacttcatggagctgagccattcacccatcctgggacatccaccttcctctggaattatttttttaatgtttttttccttcttgtttaatccactaattctctctcttttcctctgtttctctctctctcatctctgttcctttccataacaacatacactatatatgagtaaatatttgaatatatttaatgataaaagtacatacgcaaatatttacagaactgctcaatggcaagaaatacacttaataaataattgttcaccaatggcctcgatgtgctgcaatatgcatttccaccacatgagtatcaccgaccttccatgcgcaccgacggatgcttgcccaactattgcgttatatcctacatcgataggggggtggttgtctaatggttttattatccacgcgccggggggggggggccccaattaatcccccccgaaaacctgaggttcttctcccccacggcgtttgttttttatacgcccccttatatcacaaacccaccgcagaattccaagtgagagccaacccccccaatacacatcgtggtatccgccatgtcgccacac

SEQ ID NO: 16975 - DNA, 812 bp, Homo sapiens
taaagtgctttgtgaaccatctatttaaagaacagcaaggtttggaccaacaataaagaccaacggtgatagcaggcagccccagaataactagaaaatgacaaaaggaggaccttttactcacaaatatcaaaccatttgacagacactttcaacactagatttgcgttttttaaataactttttttaggccttaagactaatgcataacagctcaaggatttcctacagaaggacataaccagtgctgtcattcgaccacgactcacagggtacggacatcacgtgccggtacatcttttatttttgttgaggaccttgtccgcgcgttagtttcttgtttctctgttcgcgcctacccgacagtcccccgctcccttcatcccgcccggtgtcccccgtctcattccgcccccatccggaattctcccccttcttgttctccgatcgtcccccgccccgccctttttttccccgtttcccgtcattggatgattttgcctcaccgtcggccccggttgtaccgccctcgccgggtcttccccccggtctctccccattctccccattttcccccacattccgaggggggtggtgtttccccccttcgtttttgatgttccccttccccgggtgggcggtgccccgccggtattatctcccccgcggttttctcggatcttatatccgcctcgtgcgttatgtgtttattatctcgtccgctcacaagttcaaactccccgcgagaatgtcgtgtcgggacacacgcccagcccactcccgttcttgttccccgcgttgccacccacccg

SEQ ID NO: 16976 - DNA, 578 bp, Homo sapiens
  misc_feature (1)...(578): n = A,T,C or G
atcttcttttttacagaactgacatgcagtggaaaatcctccaggaaacttctaagaagttttcttgttcctaagaaaaagctacanggaaatcacacttctccttttcttctggttgctgctagaatgaagttgttgctgagaagcgaagagaggagacaagccgagcatgaatcaccctgagttcctcatcctgactgccatatttccatttttggaggcttttaaattcaaccggctgggccaggggtcctttgccctttaaagcgcctattccttttattttgcgggaaaatccttttaaaaaaaaagggggaagatttgggcccctggggttttttcaccagggggggaaaatttttaaaagggggtttgggcccccacacccggcggggggtttttttttttttggcggcgagaaaacggggggttttccaggggggggccggggccttttttcccgggggcgcccggaaaaacaaaaaggggagagagttttttgggggggtttttttttttatgaggagcccccccccccgttttttttttttgtgggggggggcgccccccctaatatt

SEQ ID NO: 16977 - DNA, 889 bp, Homo sapiens
cgcaaacccccccccctccttgcgaaccaagaggaaacacatcactctttctccttattactcatcacaattttacccgtacctggatgcatgatcacaaattgaaactgcaggctgcaagccgaatatttggatcttgaccggatactagaacatgaacaagacttggaagaagctgaggaatatacagaagcacgcctactactgcattcaccgaagcctagaaacctgacaatttcctcgcatgccgcgcgccccgaattaactcatgccccgcattccccgcgggcatcatcccctgagtacccgcctcgtgcccactcctcacccactgccaccgtccctataccgaccacgtatttcccttcccttccccccacaaccaggtaaagtgttcccgtttacccccggtgtacctcgcttccggcataatcccaccccccaatatcaacacccaaaagattcccccactaccccctacgttctttatccccccctgacccccatcactccccccccctctctatagacccctcgctaacccgagccccccatctatccacccgcctgatcgtaccggtccccccccccccgcccagtcacccaacagccaatccacccccctccccctgggtacaaaacatcgcgtacggggcagatcccgggcacgtcatcgattaaatcccgcgatacccgcgggttgattttgaacacaacccccgaatatggtccggtctgtcccgcccttccatatacccccccccccccccccacatttttttcttcccccccccatcctcttattttatcagaactgacacccccacccccgggcccccccctcccattaccccccccatcctcccgtttacccccccccgttcccccc

SEQ ID NO: 16978 - DNA, 771 bp, Homo sapiens
  misc_feature (1)...(771): n = A,T,C or G
gaggagccaccgctgtccagtttctgggccgtttttttccttatgagattgtgcccctgcgtgttgccatgggaaaaacgctacaatcagcccaaagagaatgtgcctccatgaagtgagcccagtgagaggtcaaacaccaaagcataacgagaaaaggacacccccacctgcccacggaaccgcaagggaccgcacggggcatgtggcaggctgggcgcaggtagtgcgcaggcgctcgcgcggggttctgcaacgcgcatgcgccggaagcaagcttccccgcccccaccagctgctggcagtgccatctgttatcagccttgcccaggctgctccctctgaatggctttccctgacgcagacctgctcgccctgtcagatgcaatcaggtcagcccggcactctgcccacgctggacctgctgcctgtcgcagctcccaccagctcccaaggagccacgagttcccgagacgacgctgcatctgccaggaggccccttcttcattggttacttgccacactggcaaatgagggctgtgcaccgcgccacctgagacaggcccaagaacgttgctgacttcctgcagagcacaggcggaaatgtcttccatccggaacagcgtactttccaagctgggaactgtcccaggttctaccacaacctcaggtgcatccaggccgctcaagcgcaacaggcaggcagatgcacacccaggtcccgtcgctctgnaggaagtgagcgggcccataggcgtgatgacgagcgcc

SEQ ID NO: 16979 - DNA, 307 bp, Homo sapiens
tctctgaagaaaaaaagaaagaaagagacagaaaggaggagaaagataaaggaaggagagaaaaaggaggatgaaggaagagagcacaaaagaggaagaaggaaaaaaaagaaaagaaaaaaagaagtcatgaatttttttaaactctaagatttggtttaatctgatttaagaacaagctgtgttataactctcctttataaattagttttgttgttgtttttatcttaaccaaatgattggtggagaatgactttaataagtttataaagaaattcataacttggacttgccaaaaaaaaaaaaa

SEQ ID NO: 16980 - DNA, 177 bp, Homo sapiens
aggaagataatcagagtttggcgtaattgtggtgtctcatttatggccaaattgtgaatcccgctgaagaatcgccagcagcaactgaacggtgggtgacactactgtgaacacacatgtatgcctggtgggacagcttgctcataattaagatatttctatttaaaaaaaaaaaaa

SEQ ID NO: 16981 - DNA, 766 bp, Homo sapiens
ctcttttgaatatactattagtacaatcgatggttggcatcacaaattgaagattacggcagatgaaatacccatacgccttaagtgttatagattccaaccacaaagagtttctgaaaggaattgctactactaacatactctgcaagaaatcctgacttcaggattatgagagaaaaatatatatatctcaagaaagaaaaaatccagcacctacggcataatgtaaggagagaatgttccagcaaaatctaacttgcacaataaatctgttctgtcagatccttgaccggtatgtttatgttgacctctttccgtttgaagagagaggaaagaaactggtgttgatcaaaggttacagcagaataaaaaatatactgggacacgaaattgtgacatgtatttcccccaccagccaggactctatgttcaatatttttatttgattatgcttacaaaagcaaatgaatgtgcctttgtgtttgcttaagaatgaaaagatgaatgtttctttctttgcgaggtgcatggaagctaacaaccttaatactatgaacattgtactgcttgataatgcgtctgacttgaaaacgcggggcggtgtattctgacaaacaataactgtaggggtagacggggatgacctccccgaccccaccgttggtgttgtgcggccgctttccttgagtgggggggggggcatgacgcccggcactgactaccgcggttggcacccgctctcccgtataccgccatcgatcacccc

SEQ ID NO: 16982 - DNA, 234 bp, Homo sapiens
gctgaggtacagaaacaccagctgagaaagcacctgagaaggaccacacagctctgggtccttacacgtttgaaaatccagattcatactaaggcaataaatcctaaatcgtttaccctctcaaaagccaatgaagactgcaagtaaaggatgacatgtttcacaaggaaaattgaacaacatttataaaaactatagggtaataaatggaaactaatcccaaaaaaaaaaaaa

SEQ ID NO: 16983 - DNA, 321 bp, Homo sapiens
gttgctcttggagaatgtgaagacagtttgcttcttgacaagcgagcgaacgggcgcccagatttttgcagcctttccgagtctcccccgagggagaggcggcagagaaaaccccggatttgggagccaccagggaaggatccgcgcaggggagccgccctccttggccccagacccgcctgcctggggccccctttgctcactgtcaatgtatggtctgaagctctgaggatggtgctggggactggggtcgggggaagcctcttgaataataactgcaaagaagaaagaggcgagaacgtctccctaaaaaaaaaaaaa

SEQ ID NO: 16984 - DNA, 834 bp, Homo sapiens
  misc_feature (1)...(834): n = A,T,C or G
aaaaaaaaaaaaaaanaacaacggagggatagaaaaaaaaaaaaagagggaaatggggggggggaggaggggggaaacaggggggaacaaaaaattttccctnnnncnnnncnccattaatcctctcacaaacaactctaanacaccaaaagaagcaaagcccaacaaaccagaacaaggaggttttgtttatatagttnttnncgggcgcgccgccccccccgcacgccccccncnccccncnacnntctctccccccctccgangtgtgaccctgcgcaccaccatcgccnctgctgtgcaccctggacctctctcttacaccatatacacaaacttagctcatcaccgaaatcgaacccttaatcttcaaacctgacgcttgccgattgtccgacggaaacatatagaaagccttctgccacctcacccttccgaagaaccctatagatttctgactaccggcacagactaccccgaccaccaaggacagtatctagatatggccagcttatctcactaaaaagctctgcgacgaacgcacctaatcgacagactatatgccacactgtagaatggcagaaaatatatttataagacaccctaatgataacaggttaatttctacaatgtatcacaaaattatcgcacacattagccaagacaaaactaacctaataaccacattaaatctatgggtcttacgacaccaatccatgtgtctctaaaaacgaccccctatggcccccacatttgaatcttttttagtgtacctatatcaaaaaatgcccctcccnccgccnnnnctacccactttccatttatatttctnct

SEQ ID NO: 16985 - DNA, 873 bp, Homo sapiens
  misc_feature (1)...(873): n = A,T,C or G
ccccccccccaacaacacggggcgggaggggggggagtgggggaaataaataagaattaggaaatgggggggggggtggngcgacacgggatgatnannaccacccggggcagagaaaaaaaaaaagcagcccctccccttttatnctnntaaggaagaagagggacgcctccctgagctgcagaaatgttttcttatcngggnggcnnnnccctccctactgccgcaaagcgcccccatcctcttcnacaaaccagaccatcctgtcctcaacgaagtacctctgcaatcgcttcccttcacagaggattaaatcaagatcactggctcactgagtccttaccctcggacctctgcgtgcgcttacctttattgagtcattattcatgatcctcactcactgactcacaatcctcggatcatctcagcgtagcagaacatcgggagtcaaatgactcaaagagacgccaatacacggtatacacgcaatcagtggcgtagtaacgcattgaataagcatcgcgacccccatggccagcataacggcacatgaacccgtaaaaaggccaggggtgctaggccgcgactgcatatatctcacatacccactggtgagcacccatgaaaactccctcgtcacagctcatactgggtccgaaacctgcacagtgactagaaaacatacccacgcgtttctcccttggaagaatccctggtagctctctcataggttcaagctgtgacgcttaccagtatagctggtacgccttttctctcttggctaagcgtgggcgctttatcctagcgttaactctaaccatttcaccttatcccactcctttcttttgaggtcccctcgtaacaaaaaacnna

SEQ ID NO: 16986 - DNA, 843 bp, Homo sapiens
  misc_feature (1)...(843): n = A,T,C or G
gggggggcgcccgcgcgngggggatttgcgntnttgggggggggggggcgggaatatagtgggcggggggtgatgagntggggaggggggctggtcgtggggggggggggggggggcacgaggggggnggggggggntggggtggctgtgcttctgtgtgggctgccctggatggggggaaaagagtagctgttctacaatgctgtggcccggatctgcctggtgctgtgcggccttggggcgagcggaggttttttgggaggctcggagacgagctgccgcccacctggtttacgggcttctgttttccagggttgatgctgctggttgtatttataatgggcgcctcttttgggcccatgggcatgtctcagggttgttgggaccacggcggtcctgtggttgattccatgcaccggcggacgaggattcatgagctggaacagcaagttgaataactcagattgaagctcaagaccgctacagcgtcgatgcctgaaggcaagaacggcagcttgaaaaattaagggaggttggccacttccggtacgagaacggcgacgtttcggacagcaggttatgggacccctgccgactgactagtttgctatagtggtgggaccggttagggaactgaatcgtgtggggattgccgtttggggtttgagcaattttggtgttcttttctttttatggggtagggtggcgggtttgggggggtgggggcggggtgggggggctgggcgggttcttggtgttgcggggggggtcgcgggccggcctctgccctggttccttcgccggcgcttcgcgccttcgtcccnntnagagntctgctggcct

SEQ ID NO: 16987 - DNA, 814 bp, Homo sapiens
  misc_feature (1)...(814): n = A,T,C or G
aaaaaaaaaaaaaaggaaaggagggaggggggagagagagggaataaaaannnaacaaaaaaaanannnnnnnnntnnnnnnnnnngccccccnnggggnnnncccccnnnncnnnccccnnnnnnnncngnnngnnccncccccccttcccctcggngntgnnnnnncactncgcgcctgtttttcgaatctgtggcgcccatgacgccgaacacgatgcgcgatacacacaggacgcacatcactataaatgacatactgatctaccgcaaaaaaggaactataacctgaatatcctgatctcctcagcaacaactgacatcccaactaacataatacattgaacatccacaaactttttgagccagacctgggagcaaggggcaatctggaagaggtaatcagggtgctggcatattggcacttcagggacattttgatggtttatagggaacaagtagagggccattcattcaaccagtagctacagagtgtgcctaggagctatgcactgagctaggtgctggggcgataagtcccgccctcttagagtcttgaaaatgggactgtactgtaagctgtgccacagcacagatagtctatcatgccacttactagaaacactgtacctccagccctgcaccccttaccctactctgtgagagagaacctgtgaatgaaaaagaacaaacaaggaactaacatgtcacactgaaaaatgaagaaacagattagaacacaaaaagaataggaaaatacaaaaaaaataaattaaaacagaacgaagtaaacataaattaaaaactccatctc

SEQ ID NO: 16988 - DNA, 685 bp, Homo sapiens
  misc_feature (1)...(685): n = A,T,C or G
tcctcctgcctagcctccggagtcactgggattacaggtaccagaaatgattaattagtgctccagctataaagcttctattttccttgtcaatgacaatctcaaggcctctgagctgcctcttgcttgaccttggtttaaaagctcaaagaatagcaaccttgagactggcaccaacaagattcattctacggaaaccagatgcagtacaatagagaaaaaccacgcatttaatcttaaggttttgcagaaattgctctcagtatttcttcttcttaaagactgnannncnnnnnnnnncccccccccccccccccccccccccccccnnncccccctccccccgcccccggcgggggcgggctncgcgcgggggggnnnncccccnncncccnngnnccacacaaccctgggagaacagctggatgcgaccatttagcagtaaagcttttattgagcggatcctgactatgagnggctgctggaggggattgaaataacaatccgacccccccaccccctccccccctccncccccgcccgcgggcctggcgcccttactcttcaactccttcttcagtacntttccattctcccacacattccccccaaagacagttgggagggaggagggatatttgtaccttgctcacagaattgtttctcccttctcagggcagaatac

SEQ ID NO: 16989 - DNA, 606 bp, Homo sapiens
  misc_feature (1)...(606): n = A,T,C or G
agggtctcacctacagaggtggtgggggctgcttttctggctgttcatcccacttgcagagcacagtcactaacttgaccccctgtcatgtctattgtcagtgcacctagtaaaaccccacaaggaagcctgcctttgaaccactgttatttgctattcttaacatttagctgcaagataaaaagagccccaagatgacacactttacaaggtctcaaggaggngnnnnnaanaaaaannaaannnaaannaaaggaaaaaannnnnccnccaaannnnnaannccnnccnnnnnnnggnnnnnnnnnnnnnnnacccccnccccccccnccaacccccccgcgcgggggggggccccacggagctggcggctgctgtattggactatgaaggtctagatgctctgtgatgggactgcagaccacaggaggaaattctgccgcccncccccccctnctccctaacccccacttccccttcccccaatttaccnaactccttnaattccccnnggtaagctgataatgtgctatttgcccagctggcctggaggctcctgaaacaacttctctgatttgctccggtgttcccctcaatgaccagcca

SEQ ID NO: 16990 - DNA, 828 bp, Homo sapiens
  misc_feature (1)...(828): n = A,T,C or G
ccgttgattatggtttcgtggttggtatttaggggnnnnnnnnnctnncnnanantnnnannnnnncaccactggagcagcttcaaaactctattcaagaaagcacacaggcctttgatggacatttgaaaagactttttgaaaggagagtgaaggcagtgatggttacaaaccaggaggaactgaaaataagtaaccttgcaatttctttattgttggatgaagaattaagctctagagaaaaattcctgaacaactaccttacaaggaaacagcacgagaaagttatggatcgcagctttaaaaaggaattttctgaaattcctggtcatcaagtggatatactctacaaactttttaaacgccgaccaaggatttccaaacagaaaacgcactcagaaacaaccagcgttgaccctttcggagaactaccaggatctgggatgttgaataaggatgcctttgaccagttaatgaatgctatggatgaggtggacattattattagcatgccgtatggcttggacccttcggtctggagtggtgggtgcgtgactggacgaggtgagttggtagctgaccacattgtaaggttcaccgctgttccctgattggaaaacgggcccttcctccatacgagagttcctttctattatactgtctttcgtttattgtagagtggactctgatctcgtcctatctccgggccagcaggggggatgcgtctgtaacttccaaactcataatcctcttaagcaatacctcgtccacccgtacatttcgccttgccctgtagttttctcagccattttccccttcttaaactat

SEQ ID NO: 16991 - DNA, 926 bp, Homo sapiens
  misc_feature (1)...(926): n = A,T,C or G
gctagagtacccgagtacttgaaaactgacagcatgtgacaatttatttcgtcggcttgtaatgatctccatttcagttgcatatcttaaaatcacaagctccagtttttttgtttgtttgttttttgtttttgtttctttgtttgttttgagatggagttttgctcttgtcatccaggctggagggcattggtgtgatcttggctcactgcaacctctgcctcctgagttcaaacaattctccntgnctcacccctcccnccccccctcgnncaacccaaccnaacctacacaccntctaccaaaccaaacccaccaaaacaactcnnaccctttaatnattncnnccgacttnnactccccnaantccccattatgggctccnttctcccacattttctatttantttgacccgccctttcnntnttccattaaatgttcgcttcccccccatctatattagacctattatcccagttcctgcaaggaccattcctgccttccaagatcatacagtttataaatgacaaaattagcaacactatcagtattatattcaaaaatgtatattttcaattaaaactgagaataatgctggtgtataaaatatattataaatgaatactcatgtatgtatattagagcgtgtcttttaaaatcgtattaaaatatgctaataaacatgcctgaatgtttattgatctctcatattccaaccgtcccccctcccccctcccctncactcctatcctcgtctctaccgtcctccgtctcttaccccctcactccgctcgcgtcccgcaccgcttcacaaccgccctccacacttatcctatcacactccggccatcacgcttcctctctctcttccccgccgctcatccgtgtgcggtcacacgtctttccgcctccatcccctccctcg

SEQ ID NO: 16992 - DNA, 202 bp, Homo sapiens
  misc_feature (1)...(202): n = A,T,C or G
gcgccaataaccccacagaccctctccccccnnttttattggaacaacaanacacccgtcntctgacatggaggaactacaagatgaaagcagcctgaatctctgtttcaactgatatccgacagcctatgccaacccatgtntgcttttttcatgtgcaaaataaataaatatttattgctataagccaaaaaaaaaaaaa

SEQ ID NO: 16993 - DNA, 900 bp, Homo sapiens
  misc_feature (1)...(900): n = A,T,C or G
tcgctaccttataatgaaaaagcacagtgcagttcattcatacaacggaagactatttagccataaaaatgcaggcacttctactctggtgcggtggctcacgcctgtaatcccagcatcttggaagaccgaggtgggcggatcacccgatgtcaggaattcaagaccagcctggccatcttggtgaaaccctgtctctactgaatatgcacaaaattagacgagcgtgnngnnnnnnnncnannntnnnagnnnnnngggacgnaaaaanaaaagaagnanaggaacacaggaggggnaggttggagagagaagaganggggggggtggacttcaccctgngtnacccaccgaaactccgngcgcgcccnnnacanaccacagcccnnnccntcnctanatcatantaaaccnaataanccagccaggcacttccgacacaggctgcgccatggatgaaccttgaagacattatcgctagtgaaataaataaatcccaaaaggataaacatgaccagcctccgtggctcgcacctgtaaacccagcactttgagaggccgaggcaggcgtatcacttcaggtcaggagttcgagaccagcctggccatattgtgaaacctcgtttctgttaaaatacaaaaattagctgggcgtggtggcgcacgcctgtaaccccgctcccttgagactgagacccgtaatcgctggacccccaagtgcaggctgcactcatctctaccatccactgtctcttccctggcgaccgaaaagactggctccaaaaaagaaaccagaaacgtacacggggttcttatcttctgtcagtgccttcatcgctaactccagagttgcaaaaaaatgttcccccatggggggtcagagaaagaatgaaacacgct

SEQ ID NO: 16994 - DNA, 964 bp, Homo sapiens
  misc_feature (1)...(964): n = A,T,C or G
tttaaattatatccntctcgtccggaagttcacgcggtttgnaggcaccccccccccccccttcctttntgnnnccctctttttnnnnaggattggaatgatctccatttcanatgcatatcttaaaatcacaagctccagntnttttggtngnttggttttcgctttcgcccctttgntcgtttcgagaaggagntttgctcttgncatcccacctgcagggcattggtgtgatcttggctcactgcaacctctgcctcctgagttcaaacaattctcctgtctcagcctccccagtagctgggattacaggtgcctgccatctctcccagctaaattttgtatttgaactcctgccctcaggccatccgcccgcctcgcactcccaagactcaacattttgtgcttcattatatcatattttctatttagtaggattgtttctttaaattttcaattaaatcttacatttaaaacaatttatattagacctattatttgagttcctgaaaagattatacaggttaaaaagatcatacagtttataaatgaaaaaattagcaacactatcagtattatattcaaaaatgcatattttcaattacaactgagaataatgctggcgtattaaatatattataaatgaatactcatgtatgtctattacagcgccgcttttaaaatcgcatttaaatatgctaataactatccatgatgtttatagatatcttatcttgccctccgactttaagtcgttagctcccattttatcttccattctatcccatctgatatacccctcttctccttttcacgttcgtcttcctcgacacggcttcaatccccattacaatgtctcggccgccatctgtcgccgacctctcgtctttctttcctttcgttcacgctccgcccacccacgcctcaccagatctccgtcgcatcaacatcggcccaacccgct

SEQ ID NO: 16995 - DNA, 211 bp, Homo sapiens
gatactcttgggttggtccagtgtacagggttaactgctcctgactgtgacgtctttgggattcagaacagggcccagacctgacggctccatgctccctgtaccatggatgatcatgttggacattcttataacatttgtgaagatggagttttgcaagtctctcctgggctccatttaataaatgtgtttgctggcaaaaaaaaaaaaa

SEQ ID NO: 16996 - DNA, 956 bp, Homo sapiens
  misc_feature (1)...(956): n = A,T,C or G
ttaagagcggggccagngccgtttnnnnncccnattgggnngtccccttgggnggattcanagaactcagtggagatgttgagagaaaatgtaatgctagtggaggggagcaagatttgatctgttcaccgagactgaggactgactcttggtataatatggggggagcagaagcataaaggatttacaatttaggacttaaataaggttatgcttccaaaattattttaaaagttatttattttctgtttgaatttctgctctaacaatccctaaccccaacctccagggagataaatctgataaacaacagcacaatgtttttattatgcatgaccattagaggtacaaacctaaaagttaatatcatttgtttcactaaaacatagaaccagcccctaagaaatgtctggagaatatgattgattcagaaacaatgaactcatctggaaaaagacatccaggagtgaaccttgaaaactctgacccagagaagaggggaaaggaaggattggaacagcattattaaatagtacaaagagagcacgacaggaggaataaaatgagtaactataattggctgacagccctctatgccaaccagagggcataatgcttaatatagttaaacacacttacactcgaaacctctctgagttgacggcttacttcgactaccatttccctaggattttctttttcttcccagacctaccctaaaagttttttggtactgacgaacagcaccgaggcgcatgcatccctccaccctcctcccgggcgggatggcgacgccacctcaccttccgtcatccgtctcgttcctcctctccacagagttccggcccatttttcgtgacgccaccctcctccatctccgcctcacatgccggtccgccgcgcaaccccctcccctccccccctcgacgacccgctccgcgtcgccccgtcggtcg

SEQ ID NO: 16997 - DNA, 197 bp, Homo sapiens
  misc_feature (1)...(197): n = A,T,C or G
tttgggggncccnnngcncnttccaggancgaagcccctattgggccttnaaaaaatagcattttggaataggacatccatataaagtatccagaatggagaagtggctgagaaggagcaacaatgaactatgagaaagagtttttaaaaactgttaaatatatttttttaattattatactttaaaaaaaaaaaaa

SEQ ID NO: 16998 - DNA, 948 bp, Homo sapiens
  misc_feature (1)...(948): n = A,T,C or G
gttcctttccccttctacgtttcgnacccccttagtgataacganacaccatgaggacatggagacgaaaatgcacattgctgacagagtttgttctcacaggacttacatatcaatcagagtggaaaatacccctgttcctggcattcttggtaatatatctcatcaccatcatggataatcttggtctgattgctgtcatctggaaagactcacaccttcacattccaatggacatattccttgggagtttattctttgtggatgcttggttatcatcctcagtgacccctaagatgctgatcagctttttagctaagagtatgattatttctgtctctgaatgcaagatacaatttttttcctttggaatcagtggaaccacagaatgtttactcttggcaacaatggcgtatgatcgctatgtagccatatgcaaacctttacattatccagccattatgaccaatggactgtgtatctggctataagtcttgtcatttataggtggctttcttcatcgcttaattcatgaacgtattttattcagattaaccttctgtaattccaacatgatacatcgcttttactgcgacattatcccataaataaaggattcctgtactgacccctctattaaccgttcaaagcttttcatcctgcctgggtcacccagtcatcactattgcgacaaagtgatccaaattaaatattttcctacatccatacccccctatggcctcttccgcctacccgccgcccccttcgccgcctcccttaccgaggtaatcatgaccccatcacgatctcttccctctctcccgctgagtcgtcgtcatcactttcttcgggcgtcatcttttccctcacgtcccttccgctccatcactccgccacgcccccacccccccacccacaagccttctatcctcttctaaccccacccct

SEQ ID NO: 16999 - DNA, 337 bp, Homo sapiens
  misc_feature (1)...(337): n = A,T,C or G
aatttttggaaggcngaggcagggggaattggttgagcccaggaattggagaccagcctgggcaacatggtgagaccccacttctacaaaaaaaaaatgaagaggaagaaagaaaactcagctgggcatggtggtacacacctgaagtcccagctacttgggaggctgaggtgggactgctggaacccaggagttgaaggttgcagtcagccatgattgcaccaccgcactccagcctgggcaacagagcaagaccctgtctcaaaaataaataaataaataaataaataaataaataaataaataaaaaaaagatttaaacttaaaaaaaaaaaaa

SEQ ID NO: 17000 - DNA, 952 bp, Homo sapiens
  misc_feature (1)...(952): n = A,T,C or G
agagggcggtaataagattaacattcctctcaccttaactcattgaaaggatctgtcatgattttgttccaattgtgtttataattggtcttgcccagtttggcatgtggctgtgagcttcctgagatgggtctttgtcttcttttcaagtggtctgtgagctgcctgagtcagggatgatgtctcttgtttctggactcctctgcagggttggctgtgtcaggaaaatgcaaagtgagcatgtgaggtgggaaggagactgagctaagtgtcagcaacagcagcttctttctccttcagcacatttgctggatgtgagatatagttggagcagtctagaagagtcttcaagcaggagggcaggtgggcacacaggcaggcagagtggacttactgttntgtgaccatgtggtgtctctggctgggctggagtccagctggctccagnggcctgcaggattgattcatgctaccaaaccanagagaaactgagctgctgctgggacagaacatcctgagcccaccacgtacagagntntgcctgctgtgaagctcactctggtgtcttnttccncagtgnntgagtgtcctggaatctcatgtataacagaggataaagaatgcagttcttagctatttagagctgagcagaagatacttcagctagagtcgagttacggagcttattgacactgactcaactggtgaccacagacctgctctggaaggaaaaatatgcagttatgtttgaaaatctataattgcatttaccaaaaaaaaatgcctgctgctacggggctctggcgctcttaggagtatcagaccgtctgccgggctgcgtgtgggacggagtctagggatggctcaatggaccggaactgcaccaagcaacaaaggtttcgtccgccccagacaaaccatagggatcgataccgttcgagctctctcatta

SEQ ID NO: 17001 - DNA, 827 bp, Homo sapiens
agagggcggaataagataacattcctctttcttactcattgaaggatctgcatgattttgttcaattgtgtcataattgcacttgccagtttgcatgaggcatgtgagctcctgagagggtctttgcttcttttcaatggtctgcgagctgctgattagcgatgacgctctggtgctggactctatgcagttggctgtggtggaaatgcaagtgacatgtgaggggaaggatattgagctatggtttttacccgccccccctttttatatatccgatgctgttacatcccggacccccaccacatgtaatcacgagccagtcgcagaccccgtctgtctgaccgatgcgccggacccttgcgtcactgccggcccactcatttgcctcacggcgtccgctcgatcatctaccaccacaattactaacagccgccgcacgtaagcctagctattccgcggactgtccttctggactcacctttagtcttgccccgtgcgcttcgtttcacctatttactacgattccccgattttctaccgcgacagcgtcccgtgcttcctatccgcgtcatctctccctcccgtattccgctcctcgtctgctcggatcttccgtccagtactctcggggccgagtcccagtgtttacctatcttcgccacaaccacattagatcaggccccggcccccctgcgcatacaccctgcgtcgtttccaattcatcggttcgccttcgttcactccgtcagccgcccttcacgtcttatcccttcttttcatccacccaccgacggtcccttttctccaaccattactgtttccctcgt

SEQ ID NO: 17002 - DNA, 1177 bp, Homo sapiens
  misc_feature (1)...(1177): n = A,T,C or G
cctttgcaaaactaaccaacacaaaagcaatcatttcacatggaaaatatccatatcagaaatgttgattggagtgattgaaagtcattcacttaaaactaatacataatcacgcttgtctcccttataatactggatggtcatacccaattcagcagtattgcttagcattattcttgctcatcagcagaagtgactcagaatagaatgtagctaccaatttccttgacaaatagagggggaaatatatatatgtgtgtgtgtatatatatagatgtaaatggcaaagataggaatagcatttcaaacagaaggaacagcatgaacatacacataaatgcaatagggactgaggggcaagagggtagccaatgttcactctaagactagtgaagcataaaagaggcttcttgccatggctaacttcaatcagataatactactatgtatcagattttcacctgtaaacaacctggcttggtaaaaattgcaaagagaggggagatgctatgaagtaactttagtcagaaactattcaaatgagatttaatgaaggctgcnatgtattttagcacatgtcagaaagtttcacagatatccattcacttactntanaccaggtcgagtatagtacaatntagataacattttaccaacattctgcacttannttatgctatactaactgacactganagagcttactctatgccagacacatgtattattgcactttatctnntgtacaatcccnatgaagtagttctcgtattttccctattntacagatgagaacttatgaggtcatgcagctagagtgaagatccagattgacccagctgttgantcagagctagctntaacattctctaaatatgatatgaggtactagacatgccatatattacttgattaagctcacactaaaaaaaaatgctcgtggctacggggaccgcggcgtccttaagagggtatagacctcgtctgatgntggctggcgtngtggggaggttagtactcagggtaacggttccacaccgggaccgcgaacacgtgcaggccnaggcaaccgaagccgtttgtttcatctcgccctacattaaataccaccggggacaccggataaaagctcctgaatcttgcccgtgcgcgttgtactctgtttgtagggttaagg

SEQ ID NO: 17003 - DNA, 1099 bp, Homo sapiens
  misc_feature (1)...(1099): n = A,T,C or G
aatggaatttgctcgctgcgttcgcgngccccgggtctgagagnannannnnnagnanaagnnnccctanatgtgccttatactganatattattnngnacccttttattgatgnnaacgcgacacgcatcctcatcaccaccctcgccattgccatcttgcgaggaaaatcttaaaccttcctattgntgcctgtctgaagccctgaatctcctcatctgtcaccaaccaagcctgacatcagaccaggtctccagctcatgctgtaggcactttcaagaggaactcatgatttgaagagtagaacactgaggaaacagtcaagttaccagaagcaaaactcaataattcaaaccaggctggtatttgctacctatttctaaagcacatggtagatgaagctctcagggagggaaatcggagcttaagaagaaggaaggagctgtgatgtctgaataacctcaggttcacaccctctgatgggcaacatggtgttgggaagttgagaactgagcctactgccaggcaagaatccagaaaccccagctgcgaggaagaggaggtatggagaggcttggaacatacaagtctggagagggtcctgagcccatggtaatactttaagatggacttttggactggttcttcttctttatacatcaaactgcatggtatttagcgctgtatctacagatgcacatcccttcatttgtctgagagagtagagttcactaatcacctctggatgttcctctattcccatctactgagctgcgcaaccactttgctcaacgactcaccaccagaagaagagacctcacgactatttccgcgcctgtcgttaaataccgcttcctgctgactaaagcgagcgcatttccacagcccgttgtttgaaccctctnnagcttaaacccgaacatcacagcatccctctgaccccaccgacacgggtaaagcacccacagatgcccaggtcattcacccctcgcttcctgtccatccgttattcccccgtttcgggtccttttccctttcattttcatcgctcccctccaatccatcactttatcttcctcccattctgtttgtaacatct

SEQ ID NO: 17004 - DNA, 1036 bp, Homo sapiens
  misc_feature (1)...(1036): n = A,T,C or G
tgctgtgctgctagaaatattataatttttctacatcagctctgataaggtaggcttcaacccctgctattaatgccacagtggaagctcaagaggttctgggagaacacaagaaatgtgtcttcacaaatactttcagagaagattatatatttatacagatttggcagataaactcaaagaatccacttgacttgactaagtttcctgagggttacaatgttgcatctcagaaaatgcaagagcagaactatgaaagaactggatatttatttcttgagttgccttcccaatgattataaaaatgaatccttggttttgggcatagcactgagagttagccaatctaggttgaaacattcactctgaaagtcatttgtgtaaattttgggaagtcacctgttctgaacctcagcttttattccttttaagtgagttataataccatcttcacatanaggtgctctataaatgcagtcatacatctacagactgagctcagatgcatagtaagtgcttattnaaattacgtgtgtttggacttagntnttntcccttcagttctggnatatttaaactgacttttgctntntttgagatccacttatggtnnatgctantctctntcagcntctggattcccttccaacatttgtacataggagacgttccnatctccgagaccttctgtctccctcttcatctggatgcctttcacagatctggacttctgatcaggncgtgtctgagccaagcagggcatggagagctggagcattatctcacactatgagtagagagagacaatatgcggtcttcttgtagtgggctgatatgagaccatgcacttaggtacacaccctagtcctgcagaggggtgaggagaggctccgcaaatccatgtgctgtcatcctatgcgggcgcgtcggcaccagtccgttcttgccactcctctccgcgcctcgtatattctactcccctctgtcaatacagcaccatatctcgttccgcgcgtgtgggtgttctgcccgtgcg

SEQ ID NO: 17005 - DNA, 1074 bp, Homo sapiens
  misc_feature (1)...(1074): n = A,T,C or G
ccctaaggcaccnnnnccacactattaccattcctggtagctggcacaagcgagaccaaatcgaccaatggagaagaggcaatatcctgccaactggcacagggacaacgaagacgaaacccgcaccccccatagatcacgcccaccagaccccccctccccaagcgagaccacgccccgccacctcacacacacagcggcaccccagcgccccccnnaancanntnncgnnatgncnnttatataaaannnnnnnnnnnnnnnctcggtggggggggggtncncagagttncntggcgnnccnnaccccccggattaaccaatccncccgcagcccaccactgcggactttgcctgcatcttcaagcctatcgctacacataccacaaccaccccgctcccttttcccatccacgtggttaccaccagcgctctacacactagactttccctaaggctggaacatacgcagccgaactttgagagatcaaacgaggaagctaggaatgaagaaaccttcctttaagctatgctctttatgtctgagtttcttggttttcagaccaaatagtttccatgtttgtgccactctagctgtttttcaatgtagaatccagcaacacattccttaaatagttgaatgataacatttacagctataaataactcgcgaggatgcctttattgtatatcaataattgctagcaattcatctcatctaatccaaacaatcacgtagccacctcttgcacattcccagaccggcgaggccacgccattattctcccccacatctcttcctatgcgtgcgccacataccccgaccatcacttagcgcgcgagaccacataagtaacacctatagctcttcccactcccaccctcatcctcccccgcgcacgcaccacacactcccgccctcccctcgcagcgcacatccgacacagccagagtaacccgctatcagttccgacccggccagccgccccctcgcaccatcgcaccgtccatgtgcagaccccactcaccgacctgcgccggagacgtcgcccgcccttctactcagcccatcaa

SEQ ID NO: 17006 - DNA, 403 bp, Homo sapiens
gttcagccgcacctgcgcttatcgtaatatcgagtgatccaccccgtaccgaggaagatactgcacaaccaagacctgcgcgcctctatctccccctcctttcgcggacttccaactgcatcctcactaccgctccttgccagcggcagaaacgatccgaatcccatccccatcttgcctcctcttatgtgtgtgtttccctataggtaccgacacgcagaacaatccacgcgccatggcacgacacaacacgacgccctccgatatacccatatccgcagaagcgccaatgcttccggtcacatacttctcacgcttccatctcttttcccatggcttgtcgaccccacgcctccaatcagtaccatttatagtccgtgcgcgtatcttggtcgtcacatgg

SEQ ID NO: 17007 - DNA, 1181 bp, Homo sapiens
catggtaaaaacgcactgatggatgctgcccaaaacgcatgagctgcattgatttgaatccatcagctctcccagtggatcagatggcatctcagcactggaatcagtattgctatcacatactcatctgtcgcctcatgggacaagagctgcaagaaatatgaagggaaattgctcctgttaagggatagctacacttatttctgttacaaaaatgccttctatctataatgtacatgttaaaatgatgcctaactatgtaaaaggaatctatcctttctgcccaaatgttaataagctcaacaaaataatgcattatttctgcttcccagccctgttcatagcctttcctggggttgagctaaccaagtgattgtcaaggctgcgtgaaagtgatttgttctcttagaaactcacactcagtgataattcagagacattgccactttttgtgcctatcttcatccttgtgagctcactcaccaaagcacggatccttgcattttcatccattcattaacttccacgacacttctgtcatttgaatcactgccccatttcggagaagcacgtccaatctgacccattttctaaccgaaatacactggtcttggttactggagagcagtgacattctcctaagagctccttagccgtctgaacttttgtttctttacattgaaagcacgacatcgactcccatcactgtcttttaagctcatgaagcaaacagcctgagtaagtctgcactccaacacagcacggcccgaaccccaatcaacacattctactcccccaccattcgccatatatactcctcctcctccatcttctcgatactgcgctttcacccctccgtatatacccactctctaataggcggcacatttattatcctgaggtcctatccagtgccgtaaacgtttcttgtgcaattacgccgtgtataaaaccactgaccgtagcctgcagtcccatgctcaaagcacacacactctcttcccacgatctattcggccaccagctgcgtttagagcgtcgcttccatgagcgtccgcgattcagtgcacaacacgatccttctccccgattccacatcatatcaccattccttcttctgtccgcccgctaccgttctttccactgtatctttcaccaccatctccttcttatcaacttcg

SEQ ID NO: 17008 - DNA, 1021 bp, Homo sapiens
  misc_feature (1)...(1021): n = A,T,C or G
tcgtggacatcgacgcaagttttttattggcagcaccacctgcaatagtgaccccctatgacctgcggcggagctgcttaacgctcacatgggtggtcaccaaggaagggctgctggacaggcagactcccagagcagtggctacttacaaatccagcttccagcagggatatcattaaagggctgcttccacctccagggcggtcagtgaagccttcagctgggagccgcgcgaaaatcatacccaatgcgaactgtgtacccatccatcatgtagctcccacaacacacacgccgaaaatgtccgatctgtcgttcctgcgcgttgtcctccggcgattcgagccttaatagcgtccccgagtcccgtttcggcgacaggtctgcccgtgatgtccccgccccctgtatctctgagtgtcggcatcgcctcacgttattcgctttctacacattccctctcttaccatcccctcgccccactgntatgtctctcgcaccccaatcgcctccgcttctacatgaagagtgacccagcgcgtgaacacacaacgacaaatatgacgcacaccgaagcagaataccattgtccgctttatttacccgtcgattaccgccagtatatttcgccgcccatccacgcgtcccactatcttcacataccaccgctccgttgatcgtcccctcccacttaatcccgctccactttattgtgctattcactgtaccgccatgacgcacgtgccgtgtcgcaagcgccggagtcccctagataataatcaccgtgacaacggcgacccgagactcgatgatgccacatactaccgcggcatttcctcaccatttatatgacgaccgccccgcatataatacgcgtcagacatcaacagtccccgaatcgtcgcagctcccgtacgttcgctccactatcgaatccatacgcgcattcatgtttcttcacccacccactcgttcagttcactgtttcgttccgctcacatatcatatgttgtcaccttgg

SEQ ID NO: 17009 - DNA, 1081 bp, Homo sapiens
  misc_feature (1)...(1081): n = A,T,C or G
agaaaagaatataaaaagagacnnggggcgggggggagaagaggggnnnnnggggngnccccccnnaaaacnncacacaaacagcgnccgagagaaaaannnnnngnnnnnnnnnnnnnnnnnnnnnnnnnnnnnnnnnnnnaannaaaannnaaaaaaagaaggggggggggcggnnngcgnnnnaaaccnncncgagccnncnanccnncccccccccncccnccccccctcccccttccccccnnnaaacatcacaccccccttcccccccgcgcccccnccccccccgcccctgggtcgagatcatacaaccagggaaatggcacagccaggatctgaatccaggttgtctggtgccaggacccaggttctcaagtactctacgtgtctcctctcaaattagccttaaaatgagatctgagatatccctctctctctcctcctctttacgtctctttctctctctccctacccctcccctcatcagatgcctcattatgactctggttccactctcctagttcaggcccaggaggataggagatcccaggtgacgggccgtgcccgatggcacaaaaccactgtatttttcctcttataccgaactcctcctccccgcccccccacacgccccgtggtctgtttcttttccgttgtgtttgtttttggtcatgtggagtgagtaccgctccgcacgccattagcaagattccctttcattcaactcaattcccgcgtattgttcactcaccgacaccgtccccgcgtctccgcctcccccatccatcttcgcccgtcccattctccgccccaattatctccattctcttcctccatacaaatcgatgtcactctcatgttcgacatttttatccctgatattttccctcccaacagcaaaccaaaccccaataccctgtctgaacagatcctccacgattatatctctgatccatatgaggccccaatcacttccctcccctcgtgaccccctgtcctgtcctatacccttttgttttctctccaccactcgtttctntcattttacattcgctcacattccgtcttctcgacttcc

SEQ ID NO: 17010 - DNA, 535 bp, Homo sapiens
ttgcgcgtttccggacaagcttgcggctgatttagtgataacatttgagatacgcacgcctggcaaacattcaatttctctttattctcatctacgcgtacatgcccacttttctttacggacccacttttatatttgtacgatggcttggggtggatttgggaagggtttaatgttcatatccacgcgataggcgttttcctaggcacctatgtttgtgtcttttcgccgttgatatctgccgtcaccttccgcggtatccttccccggtccttgttcgcttcctttttccccaccatggtcctttgtcttcccctttcatatcctgcctccgcgacgccatttataaacatgatgttccgttccacgagtagaccgcgcacgtacgccgcgtaacgtttcctcctccatctcccgttcctgtgcccccgtttctgcccgtcgtcggttgcgccgggtccgttcgttcgccttcattttcttcccctccccccttcgttgcgtttccttcatctctttcctggtttgccctccg

SEQ ID NO: 17011 - DNA, 1061 bp, Homo sapiens
  misc_feature (1)...(1061): n = A,T,C or G
ctggagcccaacccccacattttcccgcccnccacaccccctccctgtcctcctgntcnaagcttttcatcccgctctgacctccttttgggggcatggggcccgcaactgagcgcgacctctacaagttgaatggggtctctattcacaagaagaagaaaacttattacttcattcacgaactgtctagaagctattgcatacatatcatgaactgtcagcaccaacacccagacaggaagcaagtagacaagcatcactctccttagatgctattcattcatgacattacaatatcatgatcctcccgcgcaccccttcgtacacaccatgtcacccgcctgaccaccgccgccaggaccaactttcccattgagcccgccgagcccctctctcactgtacactgctgtgagtggtggcgaggacgcattgtgggttgaagataaaagttcaccccgtcgtttgctgtcccacgtgtgggcgttcgcgggcgcgcccggtccgactacctattctgcttccgttggcgcgaactattcgaagcccccccactatcaacctcacattcctttccgctccccccccccatccccaactcctcccctcctctcttccagcccctgtcttccgtcccgccgtgtgagccccaccctcgtggctgtgctactgatctattcatcgtcactgtctcccctccgtcccccctccccccgcttgcggtacgtttgccgccggtgccccccgcccggtacccccctccagcacagtacccctcctctactcgtttacctgcgtagttatatgcgcccgccgccgcactgtacctctcgaccgaccccttcccttcgtacggttcttctcattcccgccaatccgacccctttccccttctcccccttttccccatcgatgccggtcgacgccattctctcccgcgcccccccttcgccggccgcccgcatcgtgttgccgcgcggcggcgcgataggaccacgcgcacgacggacacccgcgctcccgccttcgtcccccgccccaccctcccgcacacgcttctttc

SEQ ID NO: 17012 - DNA, 1120 bp, Homo sapiens
  misc_feature (1)...(1120): n = A,T,C or G
ggttaggaagcatctgcaaacaattggcaagaaattcctccccagtgacatcaatagtggaaaggtagaaaagctcgaaggtccatgtgttttgcaaattcaaaaaattcacaatgttgctgcaccaaaggataatgaagaatctcaggctgcaccaaggatgctgcgattacagatgactgatggcatataagttgacagcagtagaatttagttatatgtcaaagataacctgaaccaccacctggaagtaaagttaagctctcaggcattgttgacataaaaaatggattcctgctcttgaatgactctaacaccacagttcttggtggtgaagtggaacaccttattgagaaatgggagttacagagaagcttatcaaaacacaatagaagcaatattggaactgaaggtggacccaccgccttttgtngccttttggacagaagtgtgtatctcatgtccaagtggatagcagagaacttgatcgaagaanaacattgcaagttacaatgcctgtcaaacctacaaatgataatgatgaatttganaagcanaggacggctgctattgctgaagttgcaaagagcaaggaaaccaagacatttggaggaggtggtggtggtgctagaagtatctcaattgaatgctgctggtaccgaatagggacgtttcagaagacagtcaccacacagaggaacatgaggtgctataagactggtgagagaagcttgagcacatacgaatgggctcagtaggaagcatcagcagctctatgatatgcacaactagagcaactgacgtcttctacacataacagaactgtatggtcctcttgaagagagaaagcagggcgatagacgacagacagactggaagcaggctcacccaccatattgttctgattaatgtactgatggagactaccagccgtgtttcggaaatcactaactgcaaggagtatatccttgaatccctgagtcaggtcaaagaccccgttagatcaatagagtgaggggtctaaagttgacacccttttcaagggaaaaggaaccataacaaatacctctccgagctaaatctaacgcgctcgaacccctgctcacaaaccttgttgttg

SEQ ID NO: 17013 - DNA, 1213 bp, Homo sapiens
  misc_feature (1)...(1213): n = A,T,C or G
taggcactattcaggctccatgaagggtagaaaccattggtttacatttgatgaggacctggttataatgtgtgtttaataagtattgtcaaattaggaaatatgctatcttcggaaatcattttattcttgttgttatggaatccgtgtcatttacttgtctaggacaaaatggaacagagggtcctgaaagaaagatgagaattcaaacaagtaccaaatttctaggacaaatccgcactctgtaatgttgacagaacagataagagaagtggacaaagatgggtgaactaggggggtatgagtagggattggatgtaagctttctgtttcctgatcttgggctgacatggtttggttgtttgtcaccaacaaatctcatgttgaaatgtgacccccagtgttagaggtggcgcatggtgggaagtgcttggattatgggagtggatccctcatgaatggcttgctgtcaccctggtggtaataagttcttgctctgttagtttacatgataactgattgttaaaaagagcctggcaccttctcctctctcttgttcctttgctctccaggtgacacactggcttcccttgccttctgccatgagtaaaagcttcctgagttctcaccagaagccaagcagatgccagtgccatgattcttgtanagcctgcagaactctgggccatactaacctcttttcttttattaattacccagcctcagtatttctttacttgcatgcanaatacactaatacatagacatagctacccactgctgcanttgggaccttgcggttaatactttctaatatggagcactagcagacagcccatgattatagaccactgtataggaggaccctagttggcaactactcctcaactggcagattaccatattggcctcgtgtgtttgccctattgtctcacctctatcgaggacgccccagagctgtggtcatagacgctacacgtcttgtctcaaatccatatttccacgaggctatcgcccttttccggtatcaaactctttcccgacattagaccgcaacctatcgccnttgataacagtgcatgcggactgaagtctttctcccaccacgaagccgagcgactcctgcaacgcattcgccgcagnccggcgccatncgcctcgcgtcgatacacccacgcgcatcagcatcgccgaccntcccgtaatcgtatct

SEQ ID NO: 17014 - DNA, 1024 bp, Homo sapiens
  misc_feature (1)...(1024): n = A,T,C or G
tgcggggggtgggcaggtggcgtgtgggaacctcaaaattttcattcatggcnngagggaggaggaggcgcccgccttactgggtgacgcaggaggaagagagagcaaaagggaggaggctccggacttttaaacaatcatatctcatattgtcttcatcaaaacttggtgtcccttccccatcccacccttctatcccccacgcccccttttttttccacccctcgcgtggtagcggcgcttggnttggaacgcgggccacaggacacctcaggctctcccancgggatctaactatgagcaaacaaggactctatataaagtaccggcggcgatgtgtattagaggagatgcaagcccgtgctctgaaaacagggaatcacacagacacttttctatactccttgagtgcttccaatgtcatgtctaagtctaacgttagattgcttgactcatgtatatcctggaaatttggaaccgctattccccactgctgtcgtcatcttttcggtgaagattgctttctttgtaatatgtctatctaagagcgcgcttcctctcgactcaggcccccctgcccgacgtggtcacccgtagacaacagatatacattctcttgtcctttttgccacgggcaatctttacctccttttcttcgctctcccactcttcctccaccgccgccctccccccggcttttatttgtctcttccgtgtccttggaccttttccagcccatttacctctttccccttgtcnttgttcggtttgcatcgctccctcgtccccagccggccccgccgctcacgatgcgtgtggttgtcttgttttcgcgcgcttcgctccgcttcgccttcccgtgtttatccccttctttcccttctgttcccgtccggggccgccgctcccgcgtcttcacctcacctctacnttttaccgccctatgcacgcgtagccctccccccacccgccaccctcttcccactgtgatcctcgactttcacgtctgggagtcttttctttt

SEQ ID NO: 17015 - DNA, 897 bp, Homo sapiens
  misc_feature (1)...(897): n = A,T,C or G
tgttggtcatcacccagtttgttgaagaactgcgggttcacgagccatttgtctcttcggaggagctagctatgagatgtctgcgatcacatcacggtaaagcccaaggagtaattaggaccccaggaagccttgctgccagaaaacaccagcgctgtggatggtcccagggctccttgtgaggaaaccttgaacatttccttccaggaatgaaagagaacctcgtcctcaaactaaaggccacagaaatgggcactacctcctggcccactccctgngcaccatgccctctggtgacctgttggctccactcttgtcactcatgtccagatctgcagtgccagcttctccttctcggtgacatgtcacctcccttgcncnncaatcctggctccaacccttctctgggaaaatcgaangganacattctgtctctaatantcanattcaacatatggctcatctcatctaccttcccatttccatgcctagaggccccactactaccactagcaccggtgggtgtttccttctcgagctctgattctcgacatgacggtgctttgtgactttgatccctgactctctgggcccgctcaggctccttaccatcatggttccatccctcgcctgccgacgacctcccgcccgcgccttctacgcagcggtaataggagcctatactggccaatttcctctaaaagaagacgacgactatcccactcgccactctttccgcggtgctgactctcgtcccctctcacgtccccgccccgcgggtggccgccgccccactctcccccccccccacccccaagctcccgcccacaccatcgtccgtcgcccgttccaccggagctctagccgccggcgcgggacgctcatagcctctctgtc

SEQ ID NO: 17016 - DNA, 1123 bp, Homo sapiens
  misc_feature (1)...(1123): n = A,T,C or G
ttagaatggagtctcgctgtgttcacctagctggnatgcagtggcgcgatcttggctcactacaagctccgcctcccgggttcacgccattcacctgcctcagcctcccgagtagctgggaccacaggcgcccaccaccacgcctggctaattttttgtatttttagtagagacggggtttcaccatgttagccaggatggtctcgatctcctgacctcgtgatctgcctacctcggcctcccaaagtgctgggattacagcatgagccaccgcacccggcctttatttttattttttaaatttttatttatctattttttgtgagacagagtctcattctgttgcccagactggagtgcagtggcaggatctcagctcactgctacctctgcccaccgggttcaagagattctgctgcctcagcctcccaagtagttcagattacagacatgtgtcaccataccaggctaatttctttgtatttttagtagagatggggtttcaccatgttcctgcccaggctggtcttgaactcctgacctcagaggtcccgactgactcccatcacagtatcgtcagagctccagctacacagtggaatacatcatctctggntgcacatggctggcagcctctgaagattgggtttaaactgatggngcagctctggnagctaaccatccaagaccaagatgtcagcaggattggttcctgaggcccttgaggagaatctgtccaggactttccttggcttgcattggcatatttctctgggcttcttatgctcctctgattggttcaattcctttctataagacagagctattggaaagacccctanacctatcttactgatacttgttagacttactcgaacctacatcgacattagataaggcatatagattgaggcgcgcagaacaccaccccaccaacatcgagtttcttaggccggcggggccctctccatattatgaaacaagacactgggggagagagaacaccactgttgccgtggcccagggtaataattgccctgttagggctgtttcccccgacacaacaggctccccctttcggcgtatgtaccgcccgcagcgccccccgcgaccctcacttggg

SEQ ID NO: 17017 - DNA, 1168 bp, Homo sapiens
  misc_feature (1)...(1168): n = A,T,C or G
agagtagcgagtaagtgagggngggtggaaggnnaaaaananngtanaannaagnnnnanatnnnnngatgccnnagccagaaaacgncaaaaatggccagcaaccaccagaagccagcagagagcctgcaacacattctccctcacgcacccaccaagcaacaatcttgccgacaccttgattttggacttccagcctccaaaactgccacgcaatggattttggtgttaaagccaccaaggttgtggtactttgttacatcaggaagccatggggaactaatataccacacctcctgggaagaaccaggcagcatcaagttttgcaagggcctggcatatagctgaaactgagcacacagctgatgccagacctgggctctatttcataaggtcataacacaggttgctgagattcctgatgcttttcctcctgagttcaaagtaaaccatgtttgaaaaattgagtaactctaaagatgagctgacttcactggggaaatccttgttcttattcagagaaggacaaagggatggcatacatttgcaatagctcagttctcctcaacaaatatacacacccaagccatggtagagatatgggacagggtcaatattcatcctctaatgggccatgttttcagtgcccaccagtgtggattcagcatcctngagntgcatttcctgactttttatttcagagagtatcattagcactctgttatttcctcccaaatctgatcattatgatgagcacactcactcttttcatcaactctgcacaagggacaaatattgtacaaggaatanagcttttgtcttcgcctgacttccaggaggtctcagctaattaatgttcgtctcatgatattacatcaaacaattcctcgtgcctcgcgcggacttcggcgctcctttagaggttatttcacctcttatgccgcgcgtggcctcggtgcgagcggttattctcaatggatcgcgcttccgatccgcaacccaaaaactgtccacagcgcaacagcgtactgcagccgtgcgcggtnttatagtcgccccacactcacccgcttaataagtgcacccacaatcaccgctcacgtaccctgtcttctcctctcgtttccgccctctagaaggcactcacgccaatcccctcgtccatacc

SEQ ID NO: 17018 - DNA, 855 bp, Homo sapiens
  misc_feature (1)...(855): n = A,T,C or G
gccctttacattttggaangagttaatcctaaggacatttgttttgaaccttcaggagaggacacagttcagaaggtggaacgtgttcctctcagctagcaccataagtagttgaattgattgaatagaggatattgaggcataattgatagagagcattaatgagtcactgtggcacgcagtccaggttgatgagtctacntggtgttgacaaggcaacaatgcttgtttttgtgcactgtatttttcaggaggatgtgcatgaggatgtgttatgtgcacttttgttgccaaccaacaccatagctgcagaactattcaagtctttgaatganacatatcacgaaaacggaattggtcattttgtgtcagtatatgcacagacagagtggctgccatgactgnacagctttctgattcactacttgggtcaaagagttgcttctgatgtgagtcttgtactggtcatcatanaaaaggctcctaccttaaaatgcacctgacctaccatctgacgatgtgattaaataccctccacttactcatctctcccgccacacccctgcacgagatgagatagaaccatctctctatcccaaccgacaggttctaacgccctctcgccagcttatctagccacacccttcactttcacaaacctccctgtgcccttcagcccccgctgtactcgttcatatccatctatcaccctcctctgctccacctccgcccatttgcccccgtccgcctccgtggcgcccgagcgcgcgcgcttattctccgncgacagcccacgactccgcgtcccgcgcgtcctaccccacacacttccattccccccctcctcttcttctc

SEQ ID NO: 17019 - DNA, 961 bp, Homo sapiens
  misc_feature (1)...(961): n = A,T,C or G
gtggaagcaccaacangntggtgangtggtcntggcacacgcatggaagagatctccaatgaggagcgggtgctttcatgaggtttgtgcaggaagatctcgaaaccagccaacactgntgacatttctcagagatttcaaatcatgaaggttgataggcctacaacagtctgcctacctacagacctgcttcttcagctggggctgccccgtactccaccagctggtcatggccgagcgcntgncntatgccatcaacacgtgcngntcaatcgacatggacaantacatgctcgtagganacgtggacacngccgagggctccgacaccgactactgaccgtgccggcgatctcaccctcccttctctcactcaataatgcatagcttgtgacgtgatggtgaactgatttgatggngcgtatcganacgttataggacgatagccgcgccttaccncacatggccacatataacantatagatgatcagagaagtcacaagcgtttcatgtgcgtagntgaccatccaccagcacacgtgccaacacacagagttgcatcatagtgagaagactggaagagtgagaaaccataggcgaagatagaagaaaagcgcgtccgccaacaccaccacgtgaaacggtaagccaagtcgcctccaagccgcgtcagcacctcccttagtgtgttatagcacgccgcccccccttcccggcacgccgccgacgcacacgtgcgaagcagccaacgcacttccctcctatcccatcgccttgcgaccatcccccgcctggccgctacactaccatcaagcccgaccacggtcccgcctccgcacatagcacccacaccaccatagttcgcaacccacatacacagagagtcnacgactcgagcagacgcccccgtatccaccagcggaccccaccggatcctaccgcccatgaccgtttgctttg

SEQ ID NO: 17020 - DNA, 417 bp, Homo sapiens
  misc_feature (1)...(417): n = A,T,C or G
tgggcgagaatccaggccttttcatggctgnaagaaaaattttgtttaatgcataggaaattattttggcatacacccaaactatctgtggaataattttcagtatcacttcatgataatttttaatgggtcaaaggggaaaattggactcacaactcttggaaagcctcctgtctgaaaacttttgaaagcagcactggaatgaggccagagcatgaacatgaatggaggtgagtcagcttcaaccgtgccatgaggacctcaccctaggaggtggcacacacaccggaggaatggaccccacgtcatggaataacctcacattgcagagccaccttgctaatcttggactgctcacctctggactatcactggaagaaataaataccctcttaagttgctaaagccccaaacaaa

SEQ ID NO: 17021 - DNA, 1197 bp, Homo sapiens
  misc_feature (1)...(1197): n = A,T,C or G
tcaaaggtctttccattttgctccgggggaacatacaaaaaaactcaattgggcatttaatctgcatgacataaataaagatggctacatcactaaagaggaaatgcttgatataatgaaagcaatatacgatatgatgggtaaatgtacatatcctgtcctcaaagaagatgctcccagacaacacgttgaaacattttttcagaaaatggacaaaaataaagatggggttgttaccatagatgagttcattgaaagctgccaaaaagatgaaaacataatgcgctccaggcagctctttgaaaatgtgatttaacttgtcaaatagatcctgaatccaacagacaaatgtgaactattctaccacccttaaagttggagctaccacttttagcatagattgctcagcttgacactgaagcatattatgcaaacaagctttgttttaatataaagcaatccccaaaagatttgagctttcagttataaatttgcatccttttcataatgccactgagttcaggggatgcgctaactcatttcatactctgtgaatattcaaaagtaatagaatctggcatatagttctattggctcctctaccatgtcatcattgatgccttcacatatcaccgatctttaaatatcagtgtctcttgctactcattgtatgtactcagtcctaggattgtggatgcctttctaatattgtgacatctgcatttacttgcacaactcaaataactttcatgttcgaacgctgaagttcatttacatccattattcacttagcgagcaggatacaacatacaaaacacatagtcagctctatgccgtcccacttctgtagaattacgcttattgtattttaaactttcagatccctacctctcacaatttcacccgtacagtccgttatcacaaataggcgtgccgaagagacatttacacgcgtatgtccttagagtaatccagcctaccaattgcatttaccctctcaggtcttctggtccagtcaccaactatgggagcgagaggcatacacagatgtcgactctcagcccgcactcntctatanacnacacatagctactaacctcatcttctcttcctcagtntctatcgcagcgacgactcggcctcctcacactcacacacctctacgcgactcctctctcagctacccgttatcctttc

SEQ ID NO: 17022 - DNA, 1184 bp, Homo sapiens
  misc_feature (1)...(1184): n = A,T,C or G
tgtangtggaagcctcagggaatcttacaatcatgngtggnaaaatggnataggaagcaggaacatcttcagacgttggatcaggagagaaagagagcaaactgcgaagtgccacacacttataagccatcagatctgggcttcagtaaaaaattatcacaaacttgttggcttaaaacaacagagaattcaagataatgagaagatataccagagattgggaaacaatacttgtagaagacatatgtgataaaagactgttatctaaaataaacaaacaaaaaaaacacttaaaactcaacagtaagaaaacggcaaccctatttcaaaacataaaatgttgagcagacatctcgccaaagaatatatataaatggcaaataagtatatgaaaatatgttcaacattatatgtcatcagataattacaaattaaaacaacaatgagatgccactacccatctattagaatgactaaaatccaaaataccggcaaacaccaaatccacctttgcccatacacctttatctaaacaaggtcactgtattattctgttctcacactgctaataaagccatactcaagactgggtaatttataaagaaaaagaagttaacgaactcacagtttcacatggctgcggaggcctcacaatcatggcatgacgcagaaagaggagaacaggcacttcttacctggtgctgtgttcggnaatggtggtttcttggtctcactgactccagaatgaagccgggaccctcgcgcgagtgtgcagctcttaggtgggcgtctgcattgtctgttctcccgcggcctggggtctcctgcctcagtaggtaactgacactttgcgctgaatgcagggacgatctgctcacttaccttcctcctggtcaggatcctggccttactccagagcggatcagaccccgctcccccgctatttgttcctgagagcggcgccatcgggcgctgctcactccacccaggcaccttatctccaatgngttacggtgcactccccgatacttattcgctccgcactcccaatgttttagaatcgcacagcttcttcaccactaccccaaacagcttcagtcgttcgagtgtttcgtttgatgtcgtgccatttccgccgaatcgcatccccgaccgggtgaccccgcgcgactccgtctcgttgc

SEQ ID NO: 17023 - DNA, 1239 bp, Homo sapiens
  misc_feature (1)...(1239): n = A,T,C or G
ttaggatttgaacaacactttggaactgtaggacacaaggtacacatcgtgctgcaatcaacatttttacatcatgattattcctgagatatatcttagtgatgtctatgaaattcaaggcaaagaatctttcgaggacccagggagaaaaatgcaagtgacacacaaaggaaagtaaacaaaaacaacaaaaccaaaacacaaaatttatttgaacatgaacccaggctttatgagaaaattcaaaacaagaagttgctttttccagtttttgaagagtaaaagtattaataaaatattcaagttatgtaaacccagacaagttgtggttgatattacttttaaaaaagctagtcttaggaacgtttttcagaacatctcaaagaaaaattgaaagagcttctgctgaaagtggatttgtcatttcaaagaagaaattatcaaatagtataaccaaaaaagttggaagagcaggaagaatttagaaagaagagtaaaaaatattttgaaaagagagaaaaagaaaaggtcaaacctatctttcaacctatccttgaggatgtcatctaatatcgttcgatagtatgtttgcattaatgaggttgcctaagacctccctgattntatgtctgccctatcaataagtacatcanagtctttggtgacatctgccgagtaactgagttctgcaatctatcagagctaacatctggnatccttgaatctgnaaagcatggntanataattatcatccatggnntggcanntaatnngattaacttaattcattntanagggnaggcnantnntacctnnctgattttcaaatctcttgtactcacgntcgntaaagaccacttatctccctttactcattttggctgtataantataaagtgtganaaaaaaatcngcctcgntggctcaccgtggactctgcgccgctcccttatgaggntaatcagatctcgtcatgatcgtgcgtcgcgtcgctggcgacggatacctctcaagcggaatcgttccacgataggaatcgcgaaagaatgagcaagccncaaggcgnaccgcaagccgtggtggtttctagttcccctgaagaaaatcaccaacaagggagaccaagaaagacaggttcctgaccctggctcgtccactctcagactccttcctgaagggttaacctggataacgaggcgcacgtgtgaccaccccgggtggatgtgccgacaactgaca

SEQ ID NO: 17024 - DNA, 165 bp, Homo sapiens
ctaggaaacactgcatgtgtattaatgaaaaggctcgtcgcaagaaaagcacctagattcctgattactgcttgggaaagacctttaaatcaggaatgcccacgttggactttatgtgaatgagcaataaattacatcttgctaagctattcaaaaaaaaaaaaa

SEQ ID NO: 17025 - DNA, 168 bp, Homo sapiens
tttcagtcgaaagcgattttccatgtttgccaggaaggtctcaatctcttggactcgtgatctgcctgcctcagcctcccaaaatgctgggattacagccgtgagccaccgcacccagccaacttttttataagtctgaaactatttctaaataaaaagtttaaataa

SEQ ID NO: 17026 - DNA, 425 bp, Homo sapiens
tttaggggtatttgataccaaaataaaaaatagcctgaaaagcagcacggcaaatagttcctgtggcttattactgttttatttgaacctttaacagacatcacagtgattagagtaaaatcgtaccctatcgcagtcaacaacaagcagaacatccacttcctccaatcctaggatgctttgatcagctgtcagaaagagaatctgggactggacattgcaaaggccagcaaattctttatttatttacagcagatgtgggtttacacaaataatgcatgaaagctggaattctgccataaattaaaagtttatgctgatgttgcctataattacctagaatgtatggtaccatgttcttatcacacgattttgcaaaaattgttcctggagtcttaaattgattaaagtaaaattttacagca

SEQ ID NO: 17027 - DNA, 1208 bp, Homo sapiens
  misc_feature (1)...(1208): n = A,T,C or G
aattccttaaagagaaaatacgatatctgaaaggcgaattatattctatatgttgcattactattttaatttctccacatatttttcatggatttattttatatgatcttaagttttcattaaaaattataaaactgtaagcaataaatactaaaaatgaattactttaaaatattgtcttcaaagcaaaaatatatcattaaagatatagagaaaacattgctacaaattttatgtaaatcattgaaattcattattactcagtattgttaaagtagactggattttcttagcattagtttcttctaaaaatatactggtatgatcctcaacatttttattatttggcgtatactatagcattattaaattgtaaattttgccctaaaaatctctatttttaaataattcagttttattaatttattttttatatgattcttcttctttctattcctttttgtaggggcatagcctttgttgctcttttagctaactattcattgcgcatttctctctctgntatctagtaatactangacccaccgctgtgcaattttatctgagcactctcttttgtactcacgttgcatatataantataacgcgttcggctctctacttctttcagcaaggatgccgtctgtcctacgactactttactctgtaacatgcaagcagtacgccnctactcatgtgaccanggaaactcttcatacagagacagctgcgctactcccntgacaatcgatatctcctantatcatgtacaacacgaaatcctgcgacctgagctatagcgccgagcacttatcgcagatccgctctgacgcggcgccactccacatccacgtncgntacgtntctcctccgcgcgntatcatgcgttctcgcataacaacagcacaggcgcacatcgtctaccgcaccgacgccacgtcttatgcacatgttancatntctctcgtctcgacgcgccagcacctagacgtgtgcgcgnatcgctcgcgacctcnantatcgactcacagtcattcccacactcaatcaatcacgccgcacagacacgcaacagcactagncngcctanacagtcgtcgtccccnctctatgatacccttccntagtcgtcgatcattncttactgatacatgcgactatagccgcttctgccgcgcgccgatctgcgccacngcgtccgtcgcgcg

SEQ ID NO: 17028 - DNA, 1203 bp, Homo sapiens
  misc_feature (1)...(1203): n = A,T,C or G
aattagggaaaataccacatttgtgcatcncnaagtcctcgcagtcctgcggtgtgccctgtggtactcaaggacacgaaagtcagcactccatctgagaaggctggaacacaaacagactaagaaaattcctcatggacacaccacaactgagcagtagagggagaacatctaacattcgcgttagatgttcgcgttaacattcctaacatgtctttgcaatgatttccaatagcttctgtttactcttgggaaaaggcaaaagttttaagggcatctatacatccagagtgttcttattatgcctcaccttgtgctacatttagtggtgcgtgtgaactggcttgtattgcattgcaagaacccatcattaaatttttaggaatattgcgagccccattttaaatatggccatcagtaaaaattaaattttatataagtaaaattaattaaatcatatttaaaacagatattactcaaaactcattactttctaattattttatgctcttgaggttatttatgtctattgtttatgtttattgtattagtatagcggaaatatgatataatgggtgaattactgcacatctctttccaatccatgcttggtgatgcaatattggcagcatgagattgctaacagctccagtattaactccatcgaaatctgcgacatgcttagtctatcacttctcgtatctccgcactcacgatagtgatggtttataaatcgttaatacaggagtngccttggtagaatgtgaagaaatagtgcgtctggttcgccctcactgcgcgaggtctgcgggcgctttccttagcgagggtaatntatgatccccatcaatgcctcctctgtcttgccgtctggtttgggancggttcatttccttatcgcgtaataccgtatccaaatcagggcgtacgcggcagacttgtgccgccggctttaggcctcaccgcaagaccggctgtcgcagttctagtcacatcgtatggcccagcgcggccgcgcagggtcgctcgtgcctcgcacatcttcccccggccccgcgttccctatcttcttctcgcgtcttcttttgatgctctctcaatccttcattggtgatatatattgatgccctctctccactctagtctcggtatccgtattcgcctatgtatgtaacgtcccctccccctactcccgccgcgccc

SEQ ID NO: 17029 - DNA, 447 bp, Homo sapiens
  misc_feature (1)...(447): n = A,T,C or G
aggttgtctttgcagctcttctcaccagnattggnatctattttctcaactcattaaatctgagctggctgtgtgacttgctttggccaaaaagactttagcaaataagatataatcacaagcagaggtttgaaaagtgctggttcgctggggcttactgtattactgctcttgaaatgctgagatgaccatgtgaatgaatccaaggaagcctcctggaagatgagaatgctgcatagaagaaaacagaggtctccagctgacagcctgccaaacactagaaatgtgaatgaggccattctggatcatcttgtcaccagctgacctcccagctgactatcagtgcatgagcaaacccagaaaagatgagctgagccagtccagtgtagaagaattgcccagccaacccacagaataatgagctgaataaaatgttgttttaagcca

SEQ ID NO: 17030 - DNA, 340 bp, Homo sapiens
tttaattggctcaccaggtcatatgccagcctcgtcgctttgtgccaatccagcagaagcggcaggatgggccccttgtgcctccaggcatttccagccttccaccctgagaacatgttttatgactcaagagttttgggaagacaatcttgcctcaaatattcctgttgcaatctacatctcaaatgttcataaaacctatttttttactttgagatacctgaaacagcgaatctgtccccaaatgtctttggcactttctggcttactctgtgtccaagttaagcagtgctgtatttttcttctttttcttaaataaattagatgcatattctcagga

SEQ ID NO: 17031 - DNA, 1125 bp, Homo sapiens
  misc_feature (1)...(1125): n = A,T,C or G
taggggtgaagacaatctccttcaagcttttcagggcccactggaaaacttatgttaattaggcaaagaatatttagaattgttagacaggcacatagacaatggacagatagagaactcagaaataaaatcacacctctaaaccatctgttcttcaacaaagttgacaaaaacaagcaatggggaagtgattctctatttaacaagtggtgctgtgagaactggctagccatatgcaaaaattgaaactggaccccttccttacaccgtatacaaaaattaactcaagatggattaaagacttaaatgtaaaacccgaaattacaaaaaccctagaagaaaatctaggcaataccattcaggacacagacgtgggcaaagattttacgatgaaattgccaaaaacaaaagcaatggcaacaaaagcaaaaattgacaaatgggatttaattaaactaaagagcttctgcacagcgaaagaaactatcatcagagcaaacaggcagaagaaggtggaaggagctgacttgctgagtcttcccaccttcatctttctcttgtgctgatgcttcctgccctcgaacattgaactccaagttcttcagcttttggactcttggaaattacaccagtannnttgccagggctgntaggccttcagccacagactganagccgcatgntagcttcccaacttttgaggtgngaactcagactgaaccacactgctttcttgctctcgcttgcagcagctatatggactcacttgtgacgtggagcactctcttataacagatattctagaaaaaaatcgctcgtgctcacgtgacttgcgcgctccttangaggtatcagactcgtactatcctggctgcgtcgctgcggaggatagtatcagcgtatcgttccagacaggaaccagagactgacaagcacnagcagacgtaaggcgtttgcgttcaagccgccctgcagtcaaatagtagcgagggacccagatagacaggtnctgagtctgctctgcactcgtacgacgcctcctgaggcgtcacacgtgatatggagncccaggggcacgctcctgctgatttgccgaactccggctgagaaggacgcactgcccct

SEQ ID NO: 17032 - DNA, 316 bp, Homo sapiens
  misc_feature (1)...(316): n = A,T,C or G
cagcagaagtcaatacaagcacagnaggcaaaaaatggnagcccgaccanacctggtctgcattcatgccctngatatctgacaagagaagcagacagaatcggaaacaaccatctggcatttgtcctagattataatcagatcatcagtttcagagttcactatgtttaagacatgaagcatgtatgaaacaatgtgaaggagtatgtaaaagaccttcattgccagaagtctggtaactgtcaccagactgaacagagtacaggaattaaaacctcatcatatggtagcattaaaagaattaaaatattcagga

SEQ ID NO: 17033 - DNA, 174 bp, Homo sapiens
ttcaggaaaacagcatgtgataaatgaaaaggctacctcgcagaaaagcacctagattcctgaatactgcttgggaaagacctttaaatcaggaatgcccacgttggactttatgtgaatgacaataaattacatcttgctaagctattcatatttgctttaaaaaaaaaaaaa

SEQ ID NO: 17034 - DNA, 311 bp, Homo sapiens
  misc_feature (1)...(311): n = A,T,C or G
ctagatcacgttgaatggatctaaaaaatcctgtaacagtctccaagaactacttgatgggatggatcagcatgaaatctgcatgtggactggaatgtngcacgcctgaacagaatttccttatgtttgttttatatataacctccagggacttcagctgtacttatcaagagcaataagaagaactaaatatattccatctttgtctggaagccaaaatatattccatctttgtcagaagtccctagcctggttgatttttaaagaacaatgcatttctaataaatactgtttttctaaaaaaaaaaaaa

SEQ ID NO: 17035 - DNA, 1225 bp, Homo sapiens
  misc_feature (1)...(1225): n = A,T,C or G
ttaggaagtcaggccccataacggnaggnacggctggnactgtggcagaagaacataaattgtngaaaattcatggacatttatcagttctngaaaattaatactcataatttcttatgcctgtcttaatttaatctcttaatcctgttatcttcgtaaactgagaatatatgtcacctcaggaccactattgtacaaactgattgtaaaacatgtgtgtttgaacaatatgaaatcagtgncaccttgaaaaagaacagaacaacagcgattttagggaacaagggaagacaaccaaaagatctgactgcctgtggggtctggcagaatagagccatatttttcttcttgcagagagcctataaatggacgtgcaagtaggagagatattgctaaattcttttcctagcaaggaatatagtattaagaccctaggaaaagaattgcattcctggggggaggtctataaacagccactctgggagtgtctgtcctatgtggttgaggttctctgctcttgaaccctgttttctgttaagatgtttatcaagacaatacatgcacggctgaacatagaccctcatcaggagttnttgatttcgtcctttgctttgtgatctttgctttgccctttgccttgtgaatgttattggccttagaagcacgtgatccttgttctccnttttgccctttgatgaagcatgtgatctttgtgacctactncctgttcgtacacccccttcctttttaaagtccttaataaaaacctgctggttttgcgntcagngggcatcangnacctacgatatgtgatggcactctggtgcccaactgtanattcaaaaaaaatcgcctgttgcctcacggtggactctgcggcgcttccttatgaggtcaatatgatcccctcatgactctgcctcgncgttggctggggagcggacactcatcaggcgagttcggtttcacaatcgggatacgtagaaaccgtgacaagccccaaggctaacgtaaagcctggtcgctgttctctgcccgctctcgaatcaaaatgcgtaanaagggtgaccccagatttaacacgcgttcccggatccttgtcttntgtgactgctacagcaattccctcttctctgaggtgttctacgctgagtattgcggtgtgtgtcgcggtgcgcagcccactagcgcctccgtcccgcacacgaacttcgcgccggcgacg

SEQ ID NO: 17036 - DNA, 1107 bp, Homo sapiens
  misc_feature (1)...(1107): n = A,T,C or G
aaaggaaattcgcttttctagattagcaagattgctcttagcaatgaaccccttccctaaactgcattttnactagagaaaatataataggccagtagccatagaagcttgtaacattatccaatgtattgctataaaaagccttaccatctggatcctaattctcctcaatatttaaagtgcagagcattttcttctcttcatcctaatttacagctatcactcaacgcagccctgaagggtgcatgcaaaacgtgccattgttagagctagtatatagtccaaggtaatttggtgaaaatcaccttaagagtataactacatggtttccttagtattcggcacctgtttgcatttcacaaaagcttatagattttcttcttttttttttcttccctttcttttgcgttggtcaacattggtttacaacgtcaccatgcatatgtagaaatgcctgtggacggcaccatcaatcctaccccatagatnggtaagaactganaggtatgtgacccaccagcactgaacattgttgagaacccacttctttggcttaatccatagnatctattcattagctctattttaaataaattctcaagacacccaattcaccaggatgccccaggaatggtgatcagatacagtaggaacnatattgtgtataaactaagaggctggtgactaggagccagaacatgacagacaagcatgacctctggntgtaagcanaatgaatggatcccttctcaagagcaagcttgaataggatctatatgcgcacgtantgggtaacctctttaactaccctccaatctgtcacctggggagaaggngaggaggaaaccaaaggagaacgtccccacacttagtatgtccttgctttccagaggctggtgaatactcttggacttcagtgctgtgactgcaattgcacaacagcaaagaggtttttctcatatcctcacgccacataccatgagatgaatgcgtgtgctctcttactctttcataggatccgccttctaccacggcggtataagctttcgttcacactgtgcacacaactcttcccggcctcgctccgataactccctcgcgcgcgcc

SEQ ID NO: 17037 - DNA, 246 bp, Homo sapiens
ttcagagattctccccctctttggcagaacatgattctgaccttcctagcagcacatcaaaatcttcccaagaatgccaatacagggaaaaatatgttattccttcaatcccgccatcaataatatccaaatttacttttaagtgaaactggacaaatatacaatctaataaggaatgtgttcaagttttatcgcctcttacatcttctgaatataatgattggtcaaaaattaaagacttttgga

SEQ ID NO: 17038 - DNA, 212 bp, Homo sapiens
  misc_feature (1)...(212): n = A,T,C or G
ttgaggtgcattgatgcagcccattgccattggncaaagctgcctaggnactattctaaatttacatataatgccaactctgcttgaaggactcacagagctttgtaagcaaaaccagcagatcctttgatttggctagctgattggctggctgaaaaattatcctaacaaacccaaactttgtcaccatccaattgtagaagaaccttatt

SEQ ID NO: 17039 - DNA, 239 bp, Homo sapiens
cggcccccgccgctcggccggcgccctcccccacccttgtcacctctccgcacacttttgccatgattaatcgcatcatttatggcaaaggatgggatccttatgttggataaactaccttcccaaaagcagaacaccacaggttttcattgcgtgaaaagacaatcgctaaaaccagcaatctgtcatacgaataaaaaactatcttttcatatctgcccgactcttttcatcaatac

SEQ ID NO: 17040 - DNA, 285 bp, Homo sapiens
cgaagctttcaagtgctccttgctgctcctttctctgcaaaactgaggactaagctcacccagctctaggagggaagcttactcaccagtgatccaaaggaaacacactatgtttgaacaaagaatgctcctcatgtcctcaaagctcttgtcatgggattcatggaccaagcctgctttaagtgcagaggcaactatacagttgaaaaaatcttctcagcgacggggctgataaagagatatgatgaaatataaataaagaaatggcctccctggcctcattgc

SEQ ID NO: 17041 - DNA, 167 bp, Homo sapiens
cggctccggctggcccattgtggatacgcacatatgcgacagcactggcatcaagctacagcttggagccaagtccaggagaagacaactgagatcagccaaaccccagccaacctacttatgcagattcttaagcaagaaataaatgcatggcctcgttggcctca

SEQ ID NO: 17042 - DNA, 154 bp, Homo sapiens
  misc_feature (1)...(154): n = A,T,C or G
tgctcctgctccttcttcgnccgcacacagccttagggtctggtccccagcttcagtgcctccaaggcagaaactcacgagacgttgttgaactgcagcctttaatttatgcattactattgaggactgtaataacggatggctcgttggtcta

SEQ ID NO: 17043 - DNA, 168 bp, Homo sapiens
  misc_feature (1)...(168): n = A,T,C or G
aagagcggcttcnttcntcnactccgttcaggcatggcccgttcatgaagtagcaaagcatgtgtcattataaaacatgattgtaactcctctttcagtgccactgattttgtcgtgtgggaaatttttggcaggttttggcaataaagctatggcctcgttggccta

SEQ ID NO: 17044 - DNA, 1080 bp, Homo sapiens
  misc_feature (1)...(1080): n = A,T,C or G
cccccccnnccttttcntctcttgcccttgcataggaacatgagactcaacctgaggcaaaaaaataagagatttggcttaatatgaattaaggcagctgccagtggttctgtaatgagcaaactgattatttttttatgtatcctctattcgcatttatatgtttgattttgtcctttgattgtactgacccgttgtggttacacattattaaacacgaataccccaaaacccactaaatcaattcatgttctcccccgtcctcaccgatgagacgcgtgtcgtccgtttcccttctaccgagcggataacccatgatcctcgtctcattgtctccctcgtcgtgcgccgttcctgctgtcgcgaacggctcctccccttactcatatcctccaccatacaacacccataacaccataccataacacatgttaatcccatgccaaccaacacccccccaaccccgcccacacgtatccccccgccgttttcgcctttcccccttccctcccccccgcccaggtcctctgccccaccgccgatacattatgaatagagtagaccagacgcccaaatccaccgcgagttttcccacgcgttccctatggcctttctgctgctgtgtggttgagcgcaccccgatcgtttgctctacccgatcttcctctcaccaccccccgccaccccatttctgtcccttacattcccgtctgtcgcacagccaccgtagggaacagtcggtgcgtttgtgctgctggtcgctcngtcttccctcttatctttttttctttctttgctgttttccgctggttttgttgtccggtcatttcttcattgtatattaccccgcccactccccccccgtatcttccgtgattcgtttagaggccctcacgattctacagaaggctggccccttgcccgacgtcaccgctaaagtgtttgaccccttacggtcctcacacaaattccagtttcccacgccatgtgccccccttatttcctccctacccataaatatacaccgaatctgcaaacgccccaatccccttatccagtccctctcttttactttctttg

SEQ ID NO: 17045 - DNA, 275 bp, Homo sapiens
  misc_feature (1)...(275): n = A,T,C or G
caaagaaaacatggccntgaaatttaagagttgagtcctccaattgcagtctctttgacagttgtatttatcaagtgcaatcagcagtattctgggatatggtaataatgaggagaggcgttttaatcatatagttatgtatacccatatatgtatgcatgtatatataaaatatgtatgtatatgtaaaataattatagttacacagttatgtatggtatgataataaactacttatatggaatcaaaataaaaagctggcctcgttggcctca

SEQ ID NO: 17046 - DNA, 399 bp, Homo sapiens
tttcacacccatgtaccatataagtcctcccgcctccttccaaaacaaaaagtccatggaattcatcacatccagagaggggtcttactacattgcccagtctggtcttgaactcctggcctcaagcagtcctcctgccttggcctcccaaagagctgagattacatacattggccaaaggatctttcttaaaaggatgctcaggagcttccaggttcaacagatgcgtgacatccatagcagaaacattgctgtcctcttcacattcaaagtgcccaggacctcacgaagccctgcacacatgtttgagactggagctatcaaagcaccatgacacaacgactactctttaaacaattttgatcatgactcctgccaatcaaaacattggcctcggtg

SEQ ID NO: 17047 - DNA, 407 bp, Homo sapiens
  misc_feature (1)...(407): n = A,T,C or G
gatacgagccgtagtgtcttcttgttgggtttcgtggggagcaaggacagtcatgctttggagcttggaactttcagccccagccttattctccatggaggagagagtgattgaatacggagctaataatcaatcgcgcctaccttatgaagccttcctaacacccctaaaatatggggttggggaacacatccatgtgccaggtaagatggctaaacctacnacactcctcgagctgactagcacgctcatacatcagcgaactcttcgcacgacctctaccactgatcagaccatcctctaatgcatggcactatctatacgtgctatccctctcgatgaatcatctttcttacagatatgacactatgcgcctcagctcggccatgagcagggaggagcatcta

SEQ ID NO: 17048 - DNA, 145 bp, Homo sapiens
aggccggcgggatctgtattggattagagcaagcaacactgtgtactgaggtgtaatggacatttggtataccataccacgttgattctgaacacggagctcaccttacagtgataaaaataaagccatggcctcgctggcctca

SEQ ID NO: 17049 - DNA, 201 bp, Homo sapiens
cctcggatacatgagccgtcggcatcctaggttcaagtgatccttgtgcttcagccaccgatagctgggattacagaggtacgacaaagatgaagtgctgagcttcacaaattagaggatccaattcatctgttttgtgaattactcatgcttgacatttgaagaatctataccaataaaatgctggcctcgttggcctca

SEQ ID NO: 17050 - DNA, 283 bp, Homo sapiens
  misc_feature (1)...(283): n = A,T,C or G
cagtacacaaacacttgttgtctttttcagattcaaggtgagcgtcagacntgggcacattcctcattgaacactcacctctcatcggggatcaacatgttcagatgtgccatacccaggatgattcatcgtgatcaaagaaaacaatgtgattgtggtaaatccgctttatcggtgtagctcattattactaccaataactcgaattgattcaagctgcagacttgagtacacctcacgactcagtacaacaacaacatgccgctcgtctggcctcagtgtg

SEQ ID NO: 17051 - DNA, 260 bp, Homo sapiens
  misc_feature (1)...(260): n = A,T,C or G
cgccccctcccnncncttttttcccgcacctgcctctccttgcttcagaaagcagctttctgccgaatcggaatgactgaaacacaaaaactctttttttaaaaaaagagatcacccattatctggctttatctcacagggggcacaaactttatgctatttctaacgatgcatcataggtatatgaaataacttctttcacgcaactctaacaatgctatattcggcatcaaaataaaccagtggcctcgttggcctca

SEQ ID NO: 17052 - DNA, 189 bp, Homo sapiens
  misc_feature (1)...(189): n = A,T,C or G
tccccctcctccnctttctcctcccntcggcgcacaggtgagcatcagagcaacccgtcaggaaatgtgtatctttgtacaagctaattgtgatgataattactttctgctttggaagcacatggataatgccgcctcttacaatggaatttgttcaaagaaatagatcggtggcctctgttggcctca

SEQ ID NO: 17053 - DNA, 125 bp, Homo sapiens
  misc_feature (1)...(125): n = A,T,C or G
acacttcttaagtacntgnttgggaaagaacctttaaatcaggaatgcccacgttggactttatgtgaatgagcaataaattacatcttgctaagctattcagatttgctttaaaaaaaaaaaaa

SEQ ID NO: 17054 - DNA, 174 bp, Homo sapiens
  misc_feature (1)...(174): n = A,T,C or G
gggaaaagaccgcaattcgnatggcacgaaaaacgcaaagcgagaagaatgctttctcatgctacagctgatggctatacccaagtactacagacctccagaggggaattatggaatagctgacacctagttttaccagcacgttaataaacccatggcctcgctggcctcacg

SEQ ID NO: 17055 - DNA, 297 bp, Homo sapiens
  misc_feature (1)...(297): n = A,T,C or G
tgggttggctctctgccctgagctgaagaaagcactcatggctctngattcaatggtctcaattgcttggctggaaaattagaaaacccagagaagaaggaagattatattgactccctcagcttccaactcttactcttgccgcgtgtgtccctgctgtggaattcactcattaaatcaatttgttttttaatacataataagcatttattttgtccaaggcatggctgcccaagatgatcacctgaagtgcacccacattgttttgtgaataaagatgtggcctcgttggcctca

SEQ ID NO: 17056 - DNA, 168 bp, Homo sapiens
  misc_feature (1)...(168): n = A,T,C or G
tcaggcaacgctcggcccattaggataagcacatgtgcagcagcactggnatcaagctacagcttggagccaagtccaggtgaagtcaactgagatcagccaaaccccagccaacctacttatgcagattcttaagcaagaaataaatgcatggcctcgttggcctca

SEQ ID NO: 17057 - DNA, 1110 bp, Homo sapiens
  misc_feature (1)...(1110): n = A,T,C or G
gccaagagccaggaaccatgtctattttcttctctacagttctactcagtacctaattcagtgactaatacagagcaggaatttgacagatgcctgttgaatgaatgacaataggggattttggacagttggattaatttttccatttaagatgagcatactgaagcccagagacattaagtaactaggctcattagcagtgacagtgatgttgccaccaaactgtaaagccaggatttggactcaggcaagtgaccccacagttgtgttcttgagtgctccaccgcagaatcactaccggaagtggactagattctcatgggccttcaggatgacgacgaattctgaacgatttacagcggaaaatcaggattactgtggttttcgcctgctgccccctgctcttgattctttgttgtttacacccatcctcacccacagagcttaaactattaatagcttgaccctcgaccacacattactaattacttcttttagacggcgatttttcttagtgnttgtagtggcgctgtcctgcgcccgacggagcccgcccatcccgcgcgccccacccccccccccccccctgaacanaccccgacacccggccacgtggcccccgccatcataaaaattccttacctcccgccctatccccccctcccatgagtgtgatgtattgtatgttcccgcgcggcaccgcttcatctctctcgccaccgcacttaaccggcacctccccgcagtttactcagctcctngcgcacctccctcgccccataggtaacccccaccaccccacctcgtcatgtatatccatttctagattacaccctccctcccattccacaccgtccccacttctttcctcactccccccctatttcccctcccgcctccccgtgccccgtcccatctcgccccccccccccacgcccgccctttccccatatcgcgatcccgaaagaccccccccccgactcccgccacccgacatctcccccccccataaatcaccccaccgccacccgccccttactttaccccccccctatccattctccccttatgccccttccccccccctgtcccccccggcctctttctccc

SEQ ID NO: 17058 - DNA, 1048 bp, Homo sapiens
  misc_feature (1)...(1048): n = A,T,C or G
tgttttaaatccgttttttagtaggngtgcaagccgtggtctcagcttactgctacctccgcttcccggtatcaagcaattctcctgcctcagcctcccaagtagcctgagcattacagctattnttccaaagtgccccagcgacaggctggtggtcaactttcatggcgttcctccaaagacttcacgtggagcctcatggcagacgttccttggtagacgcctcaggagaatagcagaagcctggacatacaaagctatgaaaaccacaacttccttccttcctgacgctgcaaacctataggagacagtctgctgccctggtccacgcgattatatcatgcaatcttgggttcgacttccatcaatactagtcacaggctcacgttttaagaccctcccttacacagagcctacgctctccttggacacagagatgaagctgacacgacgacgctcccatccaaacccaagagcaagtgcccccacctccatatgttgagtgttctctgtataccggttgtttgagttgggctctaggttcgtgcggtgccgttgcgcgtataacacccccaatcgacgtcgcccccccgccccgccgcccccccttatgcacggcggatgagtggttaagggggccccccgcgtacgactccattacgccgcccacctcgcccccccccatgattgttgtttgatataaaggcccgcccgtcagattgtcgctccgccccccccagttcccctctccaccccccccacccacccccccccctgccccaacctcaatttcaccccccccccacctccacttttccctcccccttttcccccccccgccccctccccttacttttcgccccctcccccgatcggcccatgcccgccgcgccgccccccacgacgccccccgcccatatcgcccccgccggacagtgccccccccccgttatctccctctccccgtccgccctctgccattcctcccgtcctatatcttccctcctccgtccccgccccccccctttccccccttgttttttccccc

SEQ ID NO: 17059 - DNA, 1073 bp, Homo sapiens
  misc_feature (1)...(1073): n = A,T,C or G
gacacctacctcttggttgagccacnttccatctcgtgggctcattcaagtagtcgtatggaaggccatcatagtaaggaatggaggcttccggctaaaggcagtgaagaagtgtaggcttttggcagtgtgtatgtgagtgagccatcttggaagtgggttcttgggcctccttcacgcccacggaggaggggggggtttattgacacagtggctgtgagggtatgagagagtgcggcggtgacgaggttttatggtgccccctgacccctagccccagcacatgtgaccgactgaaaaagcggagtgagccaagtggcaggagaggactagggctgactaagtgtaaagagatttaaagagtcacaagtatcacgtggtatctgttntccttttcggcgccgccccgtgcgccccccccgacgagacggtgtaatgcaagttgtttcaagttgttggggtggttgtgttagatatgccccgaaagataaagattatacaaatttctcatgtattttcgcgaagcacccccctcggtgtgtatgaaagaagaacaagagggcgcccgacgacccgccccccaaagagtaacgtgattgagttgagttattgccccatttttatataaaacacacagctcacacgtcccgcaatttgtttatttttaaatcgcctcaggtggagagtgtagggtgcgccgcgcgcgcccggcacgatacttccaccgaccccgcacactcccacaccaccgtatacaccacacccccaggcacgagtttacccgtatagtattatcccaccacccaatccacaatctcccacaatttaccgcaacgccccaatatctccccaccaagtacctatccgcatttcttttcgcgtgcactgcgcaggccgcccgagatgcgtgagccgaatagtagtaaaaccncacccattatcgaccgaccaaaatagccacgagcgcgtaaattgcccngcgctttgccgccgtcgccacttataacccctatccaatacagatatccttattttccccattccctccactatcgccgcgtcgtttatttccc

SEQ ID NO: 17060 - DNA, 1169 bp, Homo sapiens
  misc_feature (1)...(1169): n = A,T,C or G
caccagtttcactcagcatgcacgcaccatgcaaagttctgcagttcaattctggggcttggaaccactacaaagcaacagaagagtggaagacgcagagaccaagaacatgctatcacactggccttccaaagtctttggtcaagccatctgggatcagttctccaccttgcagaaggaatgtgcttttaaacttaactggattactgttcatgtttaatgagcttccctttgcccatgggttgcatccaaactcctgacacagccctgagtgatctatcctgcttcttttccatcctcacttgagttacctgcccctccttcactcttttctagccacctggctttttcataatttttcaaacgctctacagcaccttctttctcagactcctcccacaagctcttcttcctgcctacaatgtaatcccttcacctcacctgctaccttcccacccaggtctatggtttctacctacctgcctnctcctttggaaagtctttccccactggcctgtgttgaggagctcggcgtcctcttttcctatttattgaggctaaacagaaaacacaatggcgccactcgttcgcccgcgccctacactncatgaactggcactcgcggcggccttttttcacccgcatgaggttatgaaccattctcgcccacaccatcgtctccccactaatgtattatgttgttaatgtccaccttgccccctctcactttatagctgtcgttctccatctnctctctgaattgtgtgttngttagtgccgccccgacacgcatcatgaatttccatgcgcctctaccaccgccttcccgcttatatcacctatatatatatcccttccctctcatacccacttccacccgcacatatactacgtcatcccacccgtctatctnccncaccccacgtccctcgacgccattacctatttcacaacgcacctccctattcccgccgaatttgactgtcgccattaccatgtagtggttgcttccccattatcccctcccgtagcattcgctctccctcattatatattctcctcgcttagtgtacgcgagcctcttgttacatccgccatcccatgtcgcgacttccccgttggatccccacttcctcccgcctaatccctccgcctctttattgttcccg

SEQ ID NO: 17061 - DNA, 1133 bp, Homo sapiens
  misc_feature (1)...(1133): n = A,T,C or G
ctaggtacgtctgcagcccaaagaactgnangactgctcttacatctatgnanaaaaagnatctcactgtatccttggtgtctctcagatgtttcttcagatgttcagagcctgggagcagtaagtgttcaaaaaatggtgtttaagggtctcactccaacacccaggctggagtgcagtggtggtgtgattatggctcactactgccttgacttcccaggatcagatacgggctttcactgtgttacccaggctggtcttgactcctggacttaaagctatccaccagcctcagcctcccaaggtgctgggattacaggtgcgagctaccactagtggcctcttctaagaggatatttggatatacagagagatatcacaatgtgggggcacagaggatagatctctccgcatctactaagaagcaccctctgtanacttaggacaaagtcctcaggataagccaaacctggacacaccttgatccccccttctaccctgcactaatgtgaagttaatattatgtgtggtgaagttactcactctgccgccgtgttggtgtgggagatggagcacctcgtcgacccccgcgcctccctccccacacccaacaacatctggtcccgattgcctttgagagggttactcgcgccactatcttaatgttcttctacctccacttcctcctccgcccaccttctgtgttctgtttgtgtttatctcccgccgcccaccacctcgctaatccccccacgcaccccgacaccggcctgtatgtccgcctctcccccgccccccccgcccctcttctctcccgcccccccacccggtgctcgtagttatccgcttcatcgccctcccccatcccgcgccatccccatttattttctcatccgccccgttgtttcccccctcctcacccttatccccattttcttttcgaccgcccctccccgatcccgcgcgcatggccgagtcccaatcctctctaactcccgcgcccgcatcctccgccggtaccgcccccgccccctatttctcgcattcaggttgtgtcggccattataatttcccctccgttcgtcgcccccttttttcccctcccccgcctttccccccctgctttcgttccc

SEQ ID NO: 17062 - DNA, 1111 bp, Homo sapiens
  misc_feature (1)...(1111): n = A,T,C or G
ttcaggagccatgtctattttcttctcttcaagttctactcagtacctaattcagtgactaatacagagcaggaatttgacagatgcctgttgaatgaatgacaataggggattttggacagttggattaatttttccatttaagatgagcatactgaagcccagagacattaagtaactaggctcattagtagtgacagtgatgttgccaccaaactgtaaagccaggatttggattcaggcaaccgaccccacacttgtgttcttgagtgctcccccccctatcactacaggaagggcactaccacctcatggggctatttgtatgatgaggactcctggcacacctacacagcgatattcccctcacgggtgtgtttgtctgctccattcctcgccactattcctccgcccaacactgtttttgcacccccgacccccccctcttctccgtcgaattccagatcccccccccccccccctttatttctccaattctcctctattatgatcaatacccagtgttccttgtggttagaagagagaggagacagcaaccccaccccaccccgccgccgcccgcacagacgccggcgtggtgtggtctgtgcgtcccccacgtataaatgcgtctcgtccgccccctccgtctctcctcccgcgttattgttttatttttgtagcaccccgcgtctcgcgtattagtacccccgtcgagaccgtccgatccgttgtttgttcgactctcccccgctcagcgccgcgcagattgagccgccacacaccccaggacgatatttattatcattatatttccttccctccatttcccaaccatccacaatcttcttcacaacccccgctatatccncctcccccacgtcccgtatcgccagtttatgttacagcacgaccccaccgctatcccgccccatgcacctaaaaccaattcactcatatattccccccacctattcaacacacctttacttcccccccgcccctcaattatccctactccgcttgctgccccccatcttttcacactcactattacctactcccccatccaccccgtccccccccgtttcccccgcctatattactcccg

SEQ ID NO: 17063 - DNA, 1042 bp, Homo sapiens
cccacctgcacagtgcataaagagtttctggccgggcgaggtggttcacgtctgtaatcccagcactttgggaggctgaggcgggcggatcacgagcaaaagcacacaagcctgtgggaaaataatttggcaataagcagcgagaaccatacaaataccatgttctctagctcaagactctgattgctgggaatttaccctgatgaaataacccgaaaggaggggaaaaccactcagggcaagggtgtggctctggagttacgtgctttgccttgacggcactagagagcaaagttccgaggactgtgttgcaacttggaagcccgcgcaagcagctgggaggggtgctgtgattacagcgcgtgaaggcatgcgcgctgcggcctggccagcggcgtgcctgcagagtggtcatcccctctggaagatgaacttacagggcaccatcttggaagcacagagagcaccctcgacagactcacagtatgctggagccttaatcttggaccttccaacctctagagttgtgagaaaatatatcctatttataattcacccagtccatggagcctgcgcacagcgacacaagtggactaacaccctgctacacttgctacctccgatgtatgccaactaggcgcgcatactgaacacgcgcgaattgattgattacctgtgatcccgcgccggcatcattgttatgcgccgtcgccctcggcccccctgaactagccgccccccgacccacgccagcctcgggcgtcccacccgcccacttgcacttgttttatttttatatcccgccccgatgcacacaccccgtcttccctcacccccttatcacccccccacccgctccccttaatttcccctccgccccatcccccgctacccggtccgttcccgggcacccctcgccattccccgcccctatgtctcccccgcgctattctccccacgcgactcaccgccgatttaaaatccctaccctttcaatacccccgaatgccgcctcccccccgttcccccctttgttttcccc

SEQ ID NO: 17064 - DNA, 669 bp, Homo sapiens
  misc_feature (1)...(669): n = A,T,C or G
tcagctatgcttccagaaggtggtatgacacangaggccttcttcccatgaacactatttcctgctgaaaatattttttttcaataaaaatcttcggagattgtcctaaggatatatagaaaatggagagacatgaaaaatctactaaaccttggtctgtggaacacactgctaccttttgttgccttggctgaagaaaacgagaatgaagaaaatgagtctgaataacaccactcagaaatgaaactataaacattttgatacaattttctctttcctccatacatctatgaatacacatttatttttgacataattcagatcacgccctatatataatgacttagcttgttttaaagatttgatattatcttctgaataattccccatggcattggtcttcagaaacataatttaataactgcctaatatttactcttatatatgcatcataatttatttaatgctctcactgtcggacacttaaatgaattcaagctttcttactctaaggaaagtgctgtgtacataaaccttcatctgaatttgactatttacatagcatgtatgaactctcacagggctctcgcagcatatagcanaactgntattcccaaaggctgcatgaatatttcataccaatanaacattggcctcggtcgcctcacc

SEQ ID NO: 17065 - DNA, 219 bp, Homo sapiens
  misc_feature (1)...(219): n = A,T,C or G
ggggtctcctcatgttgcccagctgnacttgnactcctgcggtcaagcaatccgcccgccttccctcccaaaatcttggatcacaggcatatgccacacacctggcctgttgttttttcagtgtcatgtatccagttatattttcaatgttccttaatcttatgtataaatcttatgggaataatatcatcaaataaacaggtggcctcgttggcctca

SEQ ID NO: 17066 - DNA, 1118 bp, Homo sapiens
  misc_feature (1)...(1118): n = A,T,C or G
tggaaacctctgtggctggtggtgcctctgtttgggatttgcttgtacctgctgggctatttccgcccacaaggcctggcaggctgtgcttggctggtgttactggctggatctcatgcttaccaaggatatcaagtatatatttgcatgtttggattcaacctcccagaagagacaaggttctctctcagctgactcttctgatgaaagcctttggaatacttacctgggaaactcagtgatgatctgcgagaatgtcaacctcctccttcactggcatgaggaattcaatgaaatctggctggtttctcctttctgtcatctgcgcaagggactcattttcatcccaccatctcaccatgccaagacaaatgcacctcacatattccctgcggagggatttttattttcctgacctttagctcattatgatctatttcttctccacctcccacccagcccccacaaaagctatctgtanctttaaagatttccgaaatccgctcccattacataatattgaaacccaccgctccattncaatcgcgaatggcaccgagaaccacgtttatcccgcgcaggatacgggtagaatcccccccgcctngcctcaatattccggcccggcacaaccaccgcccccatgcactagaaggtagagtttagccgcccccccatcaggcaccacccccaccccgcccaccaccctcagtaatattgtcgctggacgatagcatcgcacgacccccagggtattcccccccaccccacccgcttccccctcttaccctcctctattttctcccccctccactccacaccatcccaccttcttcttcccccccccccccttaatcccccaccctcgcccgattccccgtttcctttcatctctctccccccccttcgcgccctttagtaccatacaccctacccccccatcccctcctccgccattcccacccgccctacaagccccccgccgcggcgaagtaattccctgactccttcgcccctcatcgcgtatttatcgctcccgactccatagacacgttcgccctcgtctcgtctccacgtgccgccccgcggtgtccgtccgcttctttatatttttccct

SEQ ID NO: 17067 - DNA, 194 bp, Homo sapiens
  misc_feature (1)...(194): n = A,T,C or G
ttttttggggcttantatgaagtaattttttttggggnaaaagatttaacctttngatggacctccaggtttctcaaaccctgtcagcaacccacctttgcatccaaaacttactaggaagatccaacatttaaaataccgttactgaaacaaattatatgataataaaacagcaaattccttagtcttacaaa

SEQ ID NO: 17068 - DNA, 966 bp, Homo sapiens
  misc_feature (1)...(966): n = A,T,C or G
aattcctttaaagaaaaaataattattattttgaaaggtgaattatattctatattgttgaattattatttttaatttnctttccactacttcttcctgccctttattttatatggtattttacgttttccgcgcgccacctccccgtncgcccccgcgctcnacccttaagaccgcccccacccccaccccccgtacctccaccggccttcctaattctcgccgtcagtctcttgtgttgtatttttgtgagcgccgcgacgggcgccccggccgcgccccccccgcttacacccacccaacactaccacccccgcccccccccgccccccccgcccgacccgcagaacacacacaccgacccgcctcatcgcacnccccatccccatactactgcggagcccagaccgccccaatccacgcccgtagccccccacccccttccgtcaccggcacgcgcggcgtcgagccgcccgaagacgaccgaaggaacaaaaaaatcgacaaaccgaaccgaccaaaacggatagggaaagccaccacccacccgcggccgccgcgaacttgcgccatatcccacaaatatatatcggtagtagttggagcgagcggcagacaagaaagaaaagttacgagtatcgccaggtgtacacgatgaaaaagcgaccgaagaaagcggaaggaaagacgcacagtggggctcggtgaacggcccacgttgcccgccgtccgccgcccgccgggggcgcgaccagatgtagcaccggccgcccaatcaggcgcaccacccatctgccagaattcatccctcacgcggagatctcgcccctcgccggatgacgccgcgcgcgcccgaagaacccgcgcgacctccgcacccggtgtatcccagccaccgccccccccgtcctaccatcagaataaatatgagccccgccgctccaagtaggccgcgcatgtatggcg

SEQ ID NO: 17069 - DNA, 232 bp, Homo sapiens
  misc_feature (1)...(232): n = A,T,C or G
acttnnnnnnnnttnnttnangttgnaataaaaagcaaaaaccaaaatctgtgattcaatctgggacaactctgacggcccttccctacaacagagctcgccacaggacagcaaggcctgagttagactgccctgtaggtagctttccctttgacaatgccaccttcctcatttccttatatctgtatttcccaagagaactttctaataaaccttacggatgcaaaacaaa

SEQ ID NO: 17070 - DNA, 1280 bp, Homo sapiens
  misc_feature (1)...(1280): n = A,T,C or G
aaaaaaaagacgcaatccatggaagctgttatgactagcaaataccagtatctgtgattcaatctggggacactctgacggcccttcccagcaacagagctcgccacaggacagcaaggccctgagttagaactgccttgtaggtcagcttttccctttgcacaatgcacccttcctcatttacttatagacgtatttcccaagagcactttctaataaaccttctgcctgcagatccccatctcaaaaaaaaaaatatcgggttcgttggcctcaccggaggagctatgagagcggttcgctttaagagggaaaaaccataaacccacccccctgcctcgctccccttcgacccccgcgccccgcgagggggatatagatcagtcntcggccgctcgcccccgtataccccccccccagaggcccccgcccccactgtacccgatacgttaaaagcaccaccagcgtcccaccccccgcgcccaccgcgcgccgcgcccgtctcaccctccctcgtcacccgccccatagcccgccgcgcacgaccgacgccacccccaccaccctatgacccactataccacaacaccgccgccaccgccacacctccccccacccccacaccccgccctatttcacccgcgccccccgcgcccgccncgggttgaccgcaccaccgcagtaagcccacgccggccagacacgaggcgtgggtcctctccttcctgctcgctctcccccacaccactttatcctatatacccaatttatattatccgccctcacacctaaatcccacaataaagatatttatcaatcttatattcgccaatcataataacactaaaattccacatcacccagataattaatcattatcatataacatccaccatactcgctgacagagcattgatccggactagtgacgcgcgccgtaccccgcccgccgcgcgccgactgtctccgcgccacagtattcctactgtccctccccaccccatgtatataccgacctcctccgactccacccacgcgacactattataacgctccgccacaccaagaagaatgttcacccgccctccaccaccaaatgtagtatccgctccctcgctcctacatccgcgcacccgccgcttctacgcgccgcccccgctgtagtatccgtccggcgacgcgcgcgccgcgcgcccgcctccgcccgtgtgtngttgtttggacatccgcgcgcgtccccgccacaccctcgatcgtgacacccaccctcgcgccgccac

SEQ ID NO: 17071 - DNA, 188 bp, Homo sapiens
  misc_feature (1)...(188): n = A,T,C or G
aatatgagactccatcttctctcctccttggaaatnaggatcctgggtttcaagcctttggtatcagtatgagttccaccaccagcttccctgggtctccagcttgtccatgcatattgtgggacttctctgcctccataattatgtgagccaattttcataataaatctcattttatatatcctcaa

SEQ ID NO: 17072 - DNA, 1150 bp, Homo sapiens
  misc_feature (1)...(1150): n = A,T,C or G
tttaaaaaggggttattctttctagtagnaaaacgctgtgctatcaggtagggaaatatccagtgccaaatagccatctctgcagggtatttttcttccttgagcctcaaccatgtaacgggagtgaagaccatgatgggtctcctctccccgttgtttgggactgcctgaagcctgcagctatatataaagtaataggagaggtattcacgccaaccacacgtatcacacaccgctgatatgttgcattggcgtaaaggctacactggggtgaggtgtgctcccacaggaggcgatgcgctcacagggagaaaggggagagccaaggcaggcgttctaatattggcgcggtcgtctaccacacaaacacaatgctcagacccacatccacgcttcagacccacgcgccctgtgtacccgctataatggccccaccgcgaccaccccgccccaatgctgagtgctagagacccccccaccatccaagtagagcccgccgccaccccccacagaaccaccttctcacctccccacaccctccacaccccgccccacaccccccccccgtctccctttccctctctcgccccgcctcaccccgccgccccccccctccccccaatccccgtgttggcccgccgcggcgccggcccggtatccgcctccagagataaccacacccccagcccagctggcttgatagttcacccctattccccccagtcgacgtacaccgcgatttaatttgccccccaccacgcaacgctcaacagatgtatgtctatagtttgccgtacgttatttaccaatagtgtcgacgcgctagtatagaaaagtgccgcgttccgtccgtttactgcgcctagatcatgccctcataacacccaacttccaccaccgccgccactgtatagcccgtcgattataaaaccgtcccggcgcattaccacccctccccatcatcctcaccttagtcctcccgcctccatacaatgagcctccccccccgctctatactcgcctcgccgccccaccctaacggtctgcgttcgccctcccccttgatatccgtcagacccccccccctccgcccccgttgtttttataaccttggctctccctcaacaaggggcgtccccacctctcggcg

SEQ ID NO: 17073 - DNA, 203 bp, Homo sapiens
ttaaaggatgaatgattattttggtgtactctagaacaatgatccattaaaaagtggctggtaggggaccagtgtggcagcctcttgtccccagactaagcaaaaccatctggccctcggaggaattgaacccatattatcaacctcaattagcaccatgttttattcacttgaagaaataaaagatgcaattaatagaaaag

SEQ ID NO: 17074 - DNA, 221 bp, Homo sapiens
  misc_feature (1)...(221): n = A,T,C or G
ttggtttcttatttttttatctaatgtgtaaggtacatttctgcatcagattcagcctgtgggcaaaggaatgaggcttcttctacgactcttcaggctggcccttcctgaagtancaaagcatgtgtcattataaaacatgattgtaactcctctttcagtgcccgtgattttgttgtgtgggaaatttttgngaggccttggcaataaagcgtctatca

SEQ ID NO: 17075 - DNA, 291 bp, Homo sapiens
  misc_feature (1)...(291): n = A,T,C or G
tttgtgtatcacctaggtatgttttcagtcaaccccaaggtctcataatccttcctgngactattcttgaatagtttgccgtctgaaatgttgagagcttgccccttggataacatgccctcttggataacaaccaagtcagttcatgagcaagcagtggcaaacactgtgtcccaccagctcctgactgactgagactacacgataccattcatcattaagatgtacctggatttcaagcatgttactgtgaaaaataaaatggagtcttagaaatgaaaaaaaaaaaaa

SEQ ID NO: 17076 - DNA, 1247 bp, Homo sapiens
  misc_feature (1)...(1247): n = A,T,C or G
ttttaggggtgcagccaaatgcctaaggccttgnaacaggaagctgacagtgtgtgcctggaaactaagagctgatgtggtgtgaatgggagagaactaggagccagatcagagaggtagcaggggccagatcacgcaagactttgtagatcaacgtaaggacttcggtatctattccaagcaaggaaggtgaattcgggaggaagcaaaccagaagtggagaccaactaaaagagatagcattttgccatattgcccagcctggtctcgaactcttggactgaagtgatctgcccaacttgggctcctaaaataatgggattatacgcatgagccaccaagcctggctggatgactttcaccaaggttttctgtgaagttttctccttggatcacacggaaatacttcttgaacatgcttttaaagtagtgtgaagccattttgcccaggaaggaaactggcacaaaaaagagatgacttatccaagcttaaccagtcaacacatgtgcatctagtcctgaaattcatgtcttctgactccaaataataccatttgtcaagtgtaccatgctgttattttcgacatttcaaatggataccatactagcagaggataggtcagatttgcatacaccacattgnttcttgctaatatgctcttcaatattcatgaatatatattgtgctctctaatcaactatctgaaccagctgtaacttagtgttcttgcggtaactgcacatctaggaggtgcttggatcaattacacagagtcagatgactccagagttgacaatggcgattgtggattatttaaaagtataggtggtctacatgcacgcaaacaccgtggccgttnggtggtctctgtataacaagnttccttatttgtgttaataataatatgccctttgtcctcccgcgggccatcgccacgtcgcctcgcgaggctatctatgtactgtcctgtcatcatcgcgccgnctcgagtcgcgagcagcgtcgcaccacgggcgacgcgttctcgcgtgctgcctggcacgtacaatctcgcctcgctatgtgccctctctgacgcgcgtccgcgctctctctccgcgcactgtaacttntatccgttatggtgaagagnagtgaacacatgcgcgacgacgtcgttgtcccgcaatcgtccgcttctatccgtcgcgcctgcccagcgagccgntgcgacgttcctgcgtcgtctgctcaactctcctccact

SEQ ID NO: 17077 - DNA, 291 bp, Homo sapiens
tgatctgaactgcctttgtagagagaacaccagatgactatgaaagaagaagtggacaatgcaatcgcaggagacattcaaagaacagactttggcactacatcaaaagagagtacaataagcactctttgcttatacattttaaatgagaataaatgcttatcatacatattcgctgttctttaaactgcaattcaattactaatgctgaacgcaagaacgcacgctggataacgaccttctgattctgtcgaatcaaaaaaatcggccgtcgttcgcctccccacatcc

SEQ ID NO: 17078 - DNA, 346 bp, Homo sapiens
ttaggacatggcctctgcatgcttggaactgagcccctgcctgccctcccgcaggggccatgccctgtgggatctgggcgcctaccttcctcaacgatattgctctgtgtatgacaagcccaacatcaggccgtactttcgccttctctgactagactatgcagcagacatgctgtctctacccctctctgcaagactctgggattggtctgtaggtgctgcgttcccatggcagaatgtattaacgagccatactccttgctcctagagcctactttctgactacttattggaaactccgacacctttatgaaaaaaaaagaaacgtcctcgatggcctcacgtc

SEQ ID NO: 17079 - DNA, 347 bp, Homo sapiens
  misc_feature (1)...(347): n = A,T,C or G
ggtgaggcatatacaaaccttcatactccttgnatccgggaaggtatgtgtcacagagtaaaacaagaaatgcttatagactacaaaggctaacatggagatagaagcaccacatggagcttggaaatatgggaatctcagtacataacataatggctgtgagtctgcaggggtgtcctccagtgcttttgttcttgttaaatccccacagacctttgaaggatagtggggaggggaatcctccaaatacctaccactaaaatttctactggcttggtaggatggaacttgctcacgaaattaaatttacttatattaaaggcaaacgatntggctcgttgtcctca

SEQ ID NO: 17080 - DNA, 293 bp, Homo sapiens
  misc_feature (1)...(293): n = A,T,C or G
taaggagaacaaagtacaaaggaggaagtccagtaatacaagaaacaatcttttttctcccaaaacatattttggggctgacatcatagccacatggcacaaactacagatggaaaagtatctgaactcaaatccggaaacttaacctttatcagatgaagacaagaaagacttcagcaggcaaacgtcacacctgttgggntgaggagctagaaatcaacaaccaaataccaacattactgctctggaaatacnttctgttagaacaataaagtaagatgagggaaaaccaa

SEQ ID NO: 17081 - DNA, 427 bp, Homo sapiens
  misc_feature (1)...(427): n = A,T,C or G
aggcttctcacatgctcggtcacttcacaaccagnacctgncacactcgcagcttcttcagtgcctagctcctgtggtgtaggtgcatatcagccaacagcactcagaaacccagtagcatcttccagcattccctccagattctgtatgtttttttattcggagtgcctaaggtaaagacatcttatgatcagctttcctcagcaccccagagggagaattccctgcaagttctgccggcatggcaccgcaagacttctctgtcacccagtgagcatgactgtgctcacaggtctgaactgcagctctgagaggcaaaccaggaggacctttcttggatgttccatctcaggtgcttcttactactctgtatttattcagttcccttttattaataataaccaattccttgttgcttcaaagaaaa

SEQ ID NO: 17082 - DNA, 315 bp, Homo sapiens
  misc_feature (1)...(315): n = A,T,C or G
tttaggngctgctgcaccgctatgnaacagtcctgnagnaggcaatagcaatggcacattacatgaactcagctcncacactgtttctgtttacagacaaggttttgccatgttacccaggttggtcttgactcctgactcaagcaaacacctgcctcggcctcccgaagtgcggattagaggcgtgagacaccgcacccagccaaatacatttttaaaaccctctttctctcccctaaatgctactctgcttacttctcccaaactaataaataattcgttaatatgatacaagaatgttgaaaatcctaagaa

SEQ ID NO: 17083 - DNA, 1232 bp, Homo sapiens
  misc_feature (1)...(1232): n = A,T,C or G
gtgcctaccaagactgtggagaatcaaagaaatgaagcaagaaaacatacagaattggaagccctgcctccccaaggcacagacagagtctcctccgtcttacttgagctccaccaaactcaggaagcgtgcaaatactttcatcctgccagcttcactctggaactttgctttcttggctactatggaagatctaactctagaagtctccatcaacaatttggaatgatttttgcttacctgtgacacccagagaaaacacgttcacaattttacacagaaatcagtgacatgcgtggaaagaaaatggaacagaaggtagaaacctgcgttctggaattggactgctggcgtttaaagcacatctctgccactaaccacttatatgatgttaggcaaattagtttatctctctgtgctactattttctcaaaagtaaaatgtgagttgcaatgtagtttgtttaactcgaanattctgagatttgaatataacattcaaacgctaagatgtgtacctgacacagaatanatgctcaatagcaataatctcttttttaaaaatgcacaanatgtagaaagcaatacattgacatccattctttanaacgagcacatatctaaatgctgagtaaattctacggagacttacagatcagntcttttttctattgttccccggaactattcagaaagcattntctttaaagcagntctaatggctgtcactatgattaaagctttctcagaatctttacatagggtaggcctgcctaacttacttggacctagnttagataacttccttttacagngtgagtacagcatgagcacataggcaccgcacaccgatacaacacgacacaacacagaaaacaaataatcggcctcctggctcaccggcggctcgcgccgctcctctaaggaggtaaagtaacctgctctgactctgtcgtgcggtgncgggcgcgactacccctgaggggataggtaccaaatgtggtacgcgagcacgggccaggcgcgagcgcacgtgatgcgctgtgggatccacgcccgcgcgactacaactccacgtaggtgaacgcggcataacacgcaccacgacgcctcgctcgcgcgcncgacgcacncgtctctgagacagccttccgctgaccgtnggcgcgtccaggcgcgctctccgcatcgcgctcgcatnagtacccaccacgccagtcgattccaccacaa

SEQ ID NO: 17084 - DNA, 175 bp, Homo sapiens
  misc_feature (1)...(175): n = A,T,C or G
ttttagttacgcccttcgggaatattgtnactggtcctgcttatgagctcccatggtacaaaagaagctgtctgctcaccaanaagaggaccctcatcagacactggatctactggcatcttgatcttggattttctagcctctttaactgtgagaaataaaatgtttaagccaa

SEQ ID NO: 17085 - DNA, 936 bp, Homo sapiens
  misc_feature (1)...(936): n = A,T,C or G
tagatctcgacagctagcttactgacgatcaagccccggtgcgctgccccggacgacgtccaggccgtccccctgcgcggttgcgatccccgccgcccccgtgtcggccgccatgagcggcaccgagctgaagactttctacccgtggctgaatgcaagggtgggtcgggcgacggccgggggggctgacacccggaaggtgaacggggcggtgtcgcgagatggccgccatggcgagtgagcggtccggtagcggcacacagatggaagctctgcgcgccggccaagagccggtggtctgccccgcggcgttgccgacacaggcagggttggcagcgcgtgtctcccgagtgaggggcgacgcccgggtgccgcttctgagactcgcgcccgacctccctttcgacgctcgcttaccgaccgcgagtgagggccgaagacggccctgtgctgacgaagcgtgctgagccgccacgacgcaggcgacgaagaggcagaccatgcttagattaatagctaaaatggtctactctgataaaacaactatcccatgccaacaganagcgttgatgattcggttctgtacaaaaacacgcctcttgtctcgtgtgacctccacgctccttacgaggtatcatggctcttatgcttttgttgtgttgcgtggagagtcaactctcaggcgctcctctcccgattggttacgttatattgtacatgcctcctgcgtatctcatcgccttctggtctctttctcccagacatcaatggctcgtgtggtaatcttcgtttaccgctccctgactctcgcctgtctcgtcgtcggtcgctctctgtgtaggcgtcccgctgcgtcaatgagcacgcgtgtcctgtcttctttatactccatgtcacacctcctcttatctccaccattatcaacattactcaaac

SEQ ID NO: 17086 - DNA, 245 bp, Homo sapiens
ttcagtagacagcactcgattaccttttagcaagtagtcagcacagtcaacaggtagagcatctaataaatgaatgagatcgccaatgcatagacacgttgactttaaccaccaaaaggtcaccatatcttcatgttacttgctattctttgaacaggtctgttcaaaatcacagcttttaacaatacaactatatccattgtttcacacataaaaaaaacaaaaaaaaggcctccttggcctca

SEQ ID NO: 17087 - DNA, 552 bp, Homo sapiens
  misc_feature (1)...(552): n = A,T,C or G
tcagcaacgcagaggctagaatttattgcttcacacattgtggacgtagctgttcgagatattcatctaggctgcggactagattacactgtttgtgtaatggttagtttatcgcttgacttgggcttcatccggaacagacgaattattggaatgcgtttcactctctcggttatgcatctacacacaatatctccccactaccctctcgcgccgcacgcagactaaatttccccgcccgacccgcgccccgctcgtcgcgcgcgnctcggtgtgtgttgggttctgctttgatgtttctgcgcagcgcgtccgactcgctcctcacttgacttcttctctcttgtgctcttccgcgccccgtcgccgtcgctcaggtcgtgatgcctctacactcgatcccgtattgttcttctccgcgccccctcacattgtaatgcatctcctagtagtcttcgtatggcggacggccgcgccgcgggtgtctgtacgatctatcatttttccgctcctccgtcgtcntcttcttctctctcttttcctctcatcctt

SEQ ID NO: 17088 - DNA, 177 bp, Homo sapiens
  misc_feature (1)...(177): n = A,T,C or G
ctaggctgtatgttggcgtgaggttgagctgtacagccatcttcngatacaaaatggaagctgcatgctacaaatgacagaagacaagatcaaaagaacctgtgttcccagcaccacagaactgtccctatggaaatagacatgactgttacataagaaagaaatatnaccctaaaa

SEQ ID NO: 17089 - DNA, 517 bp, Homo sapiens
  misc_feature (1)...(517): n = A,T,C or G
ttaggcgnacttggcttggttgctggnagtctggtgctgttgcttccaaaactaaggngaagctttngcctgagacatcgaggaagccgaaaatatgcaaaggtaggcagttgaaagttctaaatgaattgttctataaaggttttaagacaaccctatagccatttggaaagaattaaattgactttacacttcacaccatacactgagataaattcaaactaaatcaaagacttgaaagcatcaaaaaaattagtaaaattacaaagacattatacgagaatttctttaaactttcacgtggagaaggtctttctaaatatgacccaaaaaatccagaatccatagaagaaaggtcaatatgtttgctttcataaaaataaaatatactgcgttaaacaactactataagctaaaaataaaattataaacttgaagaagatatttactactctacattgggctaattttcctaacaattccataaaagcgaccaccaaatagaaaaaaaaaaaaa

SEQ ID NO: 17090 - DNA, 1248 bp, Homo sapiens
  misc_feature (1)...(1248): n = A,T,C or G
agatacctctagaaaaaatgcatacagctgacccttgacaacatgtgtgtgaactgtgcaggtccatttatacacagattttcttctgcctctgccactccaagacagcaagaccaaccttcnntcctcttgttccntcntcnnctgagcctanntcaacaccaagaacaatgaggatgaagaacctttaagatggcccacctccgcttcatgaacaataaatacatttgctctttcttagggttttcttaataatattttcttttctctagtttattgtattgtaagaatatagcatatagtacatatacaaatatgtgttaattgtttatgctattggtagggcttctggtcaacaggctatgagtggttaagcttttgaggagtcaaagcttatacatggattttcaactgcatgggggtcagcattcccaacccctgagttgttcaagggtacactgtaattacatataatctctatgttgatagctgttgccaaattacatagtanactgccataagatgtgaaaaaagcaactctaaagactacagtagaaacattaacagtttctctccctgtgtcttccagacacattctataaatacttanggtctagtagttctttctaacacttaatattgtgagacgcagtccnantgcactaatacttagtgtcatcagatgatgactgttctttagctgtcacttgataagaacatctaagagagcaagtaacctgcaataagctgcggttatcttaaaaanaaaagaatgcctagttgcctcagcggtgcactgtgcgacgcttcctttatgaaggataatcatgagcctcntactgactcctgacctcgtcgttcgctcggggagcgtttagnttctcaagctgtaatacgttatacttactccggatacgcgccacacactcgcacaagctctaatgcagaccgtaangctcgtttcgcgcgtcataggctccgccttagaaatacataaacgtcatctaagtgcgaccacacgcatatgatcagacgttcctgagacctctgcgcgccggcgacccacgtacggacgtgcgcttgctntgnacgcgcgtcgagacacgcacacgctatggcgcgcgcgcgccgcgcctctcnacgcctaccacagcgtctcatatcgtatacacgattatgacangcacgactcactatacaatagcactaatttctctattngnttatgttnactcctacagtgacagt

SEQ ID NO: 17091 - DNA, 455 bp, Homo sapiens
aggacatgtttcccagtatagtcttgaattcctcagctcaagcgacctcctgccacagcctcccaaagttctgggattacaggcatgacccaccatgcctggccaccttgaggaccttaaaagagggagcatatcctgaattatccaggtagacccaatgtaatctgaagggtccccatatgagggaggtagaggaggatttgactacagagcagaaggcaatgtgacaactgaagcaaaatgctacatgctggcttggaggatggaggaaggagccataagccaaggaatgccagcagtcactgggagctaagaaaggtgaagaaatggactctccccgagcctgtagagcaagtatggccctattgacccttgatctcagccaagagaaattgatttcagacttctgacccccagaactgtacggcaataaatgtgtgctgttttaaacaaaa

SEQ ID NO: 17092 - DNA, 376 bp, Homo sapiens
  misc_feature (1)...(376): n = A,T,C or G
tttacggtgcntgtcatctatattatctcagtattttaaacatcacttccagcccatatggtggttcatgcttgtaatatcagctgttgaagaggctgaaatgagaggattccttgagcccaggagttcacaagcaacctgggcaacatagcaagacccagtctctatcaaaattaaaaaaaaaaaaggtgttcctatttctccacatcctctccagcacctgttgtttcatgacgttttaatgattgccattctaactggtgtgagatggtatctcattggttttgatttgcatttctcagatggccagtgatgatgagcattttttcatgtgttttttggctgcataaatgtcttcttttgaaaaaaaaaaaaa

SEQ ID NO: 17093 - DNA, 231 bp, Homo sapiens
acagaaaactgagtaaagagacttacctagaccccacaccaggaagaccatgactgacgcagtctttcaggctcaaaacatgggctcaggacactgcactacacactgcttccaaaatctccaatttatgccaggtgctgttgtaagaattttcttgctacgttgggactttcccattaaaaattcaattatctgtaattttttaaaataaactatttgttctgctcaaaa

SEQ ID NO: 17094 - DNA, 293 bp, Homo sapiens
aggaccatcagatcacccagtttcacagcagcacctcatgaattcaaacccgtggcacatgaagaagagggcaggactaagaggaaagcacacaacaaaaaaagcactgcaactgtgcgggacacttgtagcgtgtgggttccagacagtggcagaactatacaagcactccacaactcggcactggactgtgttccagtctagtaagatttggctcttttggaactcagaacacattttcaaaatggaatgctgatatagcctaaaattaaacctgttcttatttcttaaaa

SEQ ID NO: 17095 - DNA, 415 bp, Homo sapiens
tgtaacacttcagcagatttaaattgaagtttctgcattcagcattctttagtcttcataccatgccttacatgatgttctcctgacaacttgtgactactaacagaggattaccgcagaatcataagcaaacacggggacagattgattttgagatattttttaagacagacagttgactgcagaaacatgcagactggagcttgtgttttgaaaacaagcatgctagagactaaacaggacatgaaaggtttgcctttcttggtctaaaacacatttcttttaaagatttgccatcataaacacttctttttgaccagctttgttgaaaaccatcttgtaaatttaaaaatgctcaagaaaaaattgcttgccgatgcataccaaaaatataaaatggcctttttgccctcat

SEQ ID NO: 17096 - DNA, 262 bp, Homo sapiens
  misc_feature (1)...(262): n = A,T,C or G
tagggaaacctgtggnaacactcattttggaagctgccggctcttgtcagtgacttcgaaagagaaaagatctgaatctgatcatcattagagggtggtagtggttaaaataatataggttaataaatatttttaggagctttctctttctattagtgtagcagatacatctaacaagtacatcaacttttcctcgccaattctttaagtaaattaaacatgctctatatttgtttaggtttaaacttgaaaaaaaaaaaaa

SEQ ID NO: 17097 - DNA, 1131 bp, Homo sapiens
  misc_feature (1)...(1131): n = A,T,C or G
aggcaaatgggagctcttgccctaggctgggtctcaaatccagaactccaatgatcctccctttggcctcccaaagtgctgggattacaggtttctactgagaaatttgctgatagctttatggaaatttccttatatgtgttttccatgtaacctcattcttctggacatgggacaaaatcctgggactcaccaaacagccagtgtgaaagaagctgtaaagctgtagtcctcccgtactctgttggcaacaggtggctgccccacaagacaggaagtggcggtggctcttggccagcccaggtgctgcaggcctagtggggcaatgggatcgaacaagctggagcatgcccctgtttgccaaagaaaggctgtggatggcaggaacgaacgaactgcaacatgaacgagctgcagcccttctggggcccagacctcgggactgccctagctagaactgtatcactctcacacccctcactgctccacgccagggttgtctgtggtggatgtgagatctgggccagcgagcctggagctgagcacagcctgctggtcgcattgggtggtcatgagcgatactctagcagaggcaccctctggtcanggaggtctccagttggtgaacaccacctgatagactctacgtatttagactacgcactccagaatggcatcctgcacaagttacataggtagatagtgaacgcatcctgctctgcagccagacacatcatctcaatctcctgtaaatgtttacctagccaggtgtatactgcgctgtcttaatgactatcatgagttaggccgcagagaaaccctgcggccaaccgctcaatgtcacgatcctgatgtcggcatgacctgttgactatcatattctctcagaagaaaaccgatacatcacgttctaggtctcacatacgccgtaacaaaaattataataaaaaacgcctcgtctgcggggttacattcttagagtatagacgccaccacgcgggctccgtgcgctcacctaccagcattcgtctgattcttagtcgatctagtctctacgcgttgtacctgccccgcatatgtattccacccacatcgccgccgcgctccgcgttagttttatgtgatttgttg

SEQ ID NO: 17098 - DNA, 174 bp, Homo sapiens
  misc_feature (1)...(174): n = A,T,C or G
cgcccttggcaaaaatgtactggtacctgctctagaggctcccagtggtacagaaagctgtctgctcaccaanaagaggaccctcatcagacactgggtctactggcatcttgatcttggattttctagcctctttaactgcgagaaataaaatgtttaagccaaaaaaataaa

SEQ ID NO: 17099 - DNA, 294 bp, Homo sapiens
ttcaggagtcttctgcaaatagaaactcgggttgttgtttaatcatcagaaaaactcagttgtagctggagacatgaagacatataacagacacgtctataaacttcatcatgaaagctaccatgaaatgtattccaagaagtacaaaatgttcatctattgatatgttgacaagataacttttactcatagggtgggaattcgctggtaatttgttttcttgaacactgcttatgataagatccatgatggcgcaaaatacatacatactccagcttttcaaaaaaaaaaaaa

SEQ ID NO: 17100 - DNA, 166 bp, Homo sapiens
taggcctggctgcaacctgtaacaagaagtatttcaggcaaaaccaatcccctcttggaggacaatgaagatctttccacaaaatttagtcaataaatatttactgagttctcaccatgttcttggcataatcatcactggaaaataaaacacacagaaaatgaaa

SEQ ID NO: 17101 - DNA, 1006 bp, Homo sapiens
  misc_feature (1)...(1006): n = A,T,C or G
agctatcaagacactgctgcnatcactaccatgaagcccagaatgaccagctttatcacaatcacctttagttgacacattactctctgcgaaataaatctttactgctgataggcaccatgatttttcacaatcgacgtatatcttcactacaccacattggaagtaaagcattactgcgataggcgcaaggactacctaggaagacccatttcatatctaccacattgtttgtttgcctctgtttggctagccttgacctcgtaagaatacccgaatatatctctactatgatccctatcctctgactgactatgccttgctagaatgccaagaagacattaagccactactaggaccctgtatcacaacactaaaggctaatgtctatctgccctatacaatagagccacactcaagatagtggacacactttgacgctaatttctgctgttttgccctaatgtcccatataattaatttgaacgttatatcagagatcctcggctattgactgaaggatctataacacatcgatatcgatatgcgagatgaatgtgttgctagtgtgagatctaagacaccaacaatcactgatattgagataaggatgaaggtataagcctctggcgcacctgaagccagactttgtgagtgaagcgatagacgctgagaccttggcctagctaatcgtgaactagcagcttaacaaagagcttgaaaaataacctctgtagctagggggacatcggcgatactagagggtaaaagaactgctctatcctcgcgacttgggcgtacttataggctcagagctccctcaccaccgggaccgaggaaggacaagccaggcaacctacgccggtggcttataactcccgcacaaagaactagggggaccttataaaccgctccaatcttctagggacccgaaaaccctcctggaggttctaccgcccagggtcctgcgcgccccaccacctgaactgtcgccaccccgctaaag

SEQ ID NO: 17102 - DNA, 543 bp, Homo sapiens
  misc_feature (1)...(543): n = A,T,C or G
ttctgagacctcggcccgcacctccctttagagcggtcgcttaccgtacgcgcgtcgagtgccgaagacgccacctgtgatgancgcagccngtgctgacgccgccacgacgaggccgacgaagaggacgaccatgctgatgcctggcagtgagaactgacacagacagtacagttgcgagataacactctgctgtggtcaagataatcttacttgatcagatctgttgaaatctgtattattttggatactgataacattatattgtgtcttttgactctgttcttattaaatgataatatacaagaaaaaaatgcctgtgctacgtgacttggcgttcttagagtatagactctatatctgctgcgtggtggggcgtcgtctaagggatcgttcaaataggtaccgagactgacagccgagcgacgaagcgtgtgttttccgcctagtaaatcttaaggaaccgatgaaggtctgattgctcttcctttaattgttcttaggttacccggcgtggcttctgtgacaaccgttatattataa

SEQ ID NO: 17103 - DNA, 1099 bp, Homo sapiens
  misc_feature (1)...(1099): n = A,T,C or G
tttcaggttggagcgcaatggcgtgatcttggctgtctgcaacctccgcctcccgtgttcaagtgattctcctgcctcagcctcccgggtagctgggattacaggcacctgccccacgcctggctaatttttgtgtttttagtagagacggggtttcaccatgttggtcaggctggtctcaaacttccgacctcaggtgatctgcctgccttggcctcccaaagtgctgggattataggcatgagccaccacgctctggcctgaaaacttttaagattttgaaaaacatggaaggaatttgtagtattttgaaattacttattatgtagatatgttctttattcttctttttaaaattaaaacaattgatgtaacacacacaatagaacagcacgtaataaaattcatcgtgtaccttgatattgaacaaaaaaaaatcggactcctcggtctcacngctgcatatctctcgccgctcgcctctactgacgcctaactcatgagccgcgcctactgactcactgcgctcgcgtccccgcctgctgtgagcgcccgcccctctctcccggccgcccatttctattcctccacttggtatccccaacaagacctctccctacacccccgtattaatcgccccgcaccggccgcatgccgcgcctcgcgctcgctcgtcgccttacctctcccccccgctcccgtctaacggccccaccccgccgcctcgcacattgtcttcccctcccgcgcccccccgcccccctcgcaccttatgtttgattctgttcccgcccgcccccgcccgcgcttaaatagtttacaccctctccacaccccttgcagtgcggtccctacccctaataaccgccgcctgcgtccgccgcgtaatctcacccgcccccgaccacctttacgacgcgtccgagacgtccctgccccgaacatatgtactgccggctccccccgtccttcntctaattctcccgcgcccccgctctcctctctccataccgcgagacataactgtggtccgcgccgccccgcgtatggttcccgcctagcccgcccgccgccccctcttttgtagtgtcgttttaag

SEQ ID NO: 17104 - DNA, 513 bp, Homo sapiens
  misc_feature (1)...(513): n = A,T,C or G
tttaggtggagtacttcatttctcggnaaggngggaaaggnagttgcattacgggttcaccctgtgtgcaggtagtgggactcattagattcagaaataaaacctcagatctggaagagggatggtagaaggaagataagccccacaccaccctctgtcctttcctttgggctataactttcgcattagctctccaacgcacaccacccaagtttcatcagcagaggggattgacagcttgtgcctcagatctgtaaacagatccctgcttttcccctaaccactaacccgctaatctgtcttgtaacctgacacattgggcagttgaaagttaatcagttaaggcagaataatacttcactgcggtatatatgtacgtagatatatgtacacatgctccttgacttacagtggggttatattctgataaacccactgtaacctgaaaataaaataagtccaaaatgcttttaataccccaataaactcatcataaagtcaaaaaaaaaaaaa

SEQ ID NO: 17105 - DNA, 1202 bp, Homo sapiens
  misc_feature (1)...(1202): n = A,T,C or G
tttcaggggccttgcagggcttctcaaaacagaaagggaatcaaatcatttagcccaccaagccggagagctgcaaggaggaagaggtcattcaggtggtgtggaagctccagatggtttcaaccatgcccccacccacagggatggaatgatgaggacagccacttctcccacctcctggtccctgcatgcctgggaggagatgaatagcagatgaccagcatcaaagaagaaaaattgggacttacagaaagagccaggaccaacccttactgggtatggtttatgagcacttcccagcttacatgcttattccacataatcttcataattacaggcatcactacaattgctattcccattccactggtgaaaaaactgaggcttaaagaggttgaatattcagaggccaagggaaggggaaagcaagatgagagtcaaagggttctgggctcacttctcctaggggaagggctccagcaattctagaagactccacttccaaggaggagctatggtccagttccaaagactcagagaacaactctctagtcccacacccttggataattaaattctttaaagcttggctccctcactgataactcanactaataaagcaccatttagntgtgagacctanatgagatcgtacatgtgaagggttgtgcacacttcctggccaaggtcaagtcccnangatgtgggcactgccatcactgttattattccacgtgctgccattatctttctcacacattgtaatatatacagagcattgcacaaagaaaaatcnggctcgctggcctcagcggtgtagctctggggcgcttcctttatggagcgtactcatgacctcgctactgatcgctggctggncggtctgctgcgcgacngcatcactacttaagccgtaatccgtattcaagataggggtacgccgagaacagtgacacagccagaaagcagaacgcgacgccggtgcgngttttctcgtcgccctccacatccaacgcctacgtagggcaacgaggattataacgtggtccggaacctcgcctctggaacttgctacgacgacgttcctggagagactcttatagtgatatcggcgcgtcgatgggtcaaccccgccgcgctcctcatgaaggatcagctcaatgccacacacgccnctacgcttctatatattattccaataa

SEQ ID NO: 17106 - DNA, 1234 bp, Homo sapiens
  misc_feature (1)...(1234): n = A,T,C or G
ttttagaaagaactgcacactatagagctatcaatcaaatatgcttgcacgaccttctacaaaatacctgcctatacttttcaaacatcatggacatgaaagacgaagaaagactgaaggactgctctagattaaggatacctaaagagacatgatgactacatgcaatgtgtgatccccaataggatactggtccacagggaattttttttccttttgccataaaatacattattaggacaaatggaaagattaaatgatagcattgcatcaatattaataccctggttttggtcattatattgcagttacattacagaatgtccttgtatatttaggaaatacacactgaagtatcttaaaaaaatatactctaaggtatttctccagaagatctagacccaaatgggctgtcataattctaaaaatgttcatttggggtaaataggcattatgtctgcaacttactctcagaaagttcaggacaaaaaaatgagggaaacacaataaggcaaatatggtaaaatgttagcatttgtagaatctgggtaaaggaaattcttatacccttcaacttttgcactttttttgtacatctgaattatttcacaataacaagcttttacaaatatatatatttacacacacacaccnacacacacacacactcactatcctaccacatcgtggccagattcagccgctcatgcgtgtaattctggcactgtgggtagctgaggaggcacgattgcttgacgccaggagtttgatacatttnggcaacacagngagactcttctctacaacaattgttaaaatttgctagcatggtgggcacactcgattctacctctcccgagctggagcagatgattggtgagccacgagttgagatacggtgacgcatcttatgctctgcactcaccgcgagaagacttctttctaacagaaaacaaaggcgcgctcgcccaagcgcacttctgcgccctcgctattagactaatatgatctcgtactcagctgccgcgccgtgggtggagcgatacttctatggngaagtgtaccgaacggcgacgagagaagtatcagcanaggcggcgcgagcccgtgtgttctatcgttcttaattataacctctcgcgaaccaaataaagagtccggccccgccgcggtgtanatactctggagnctcacccctcgctcctccttgcgacatcctgtgatgtgagagtat

SEQ ID NO: 17107 - DNA, 1109 bp, Homo sapiens
  misc_feature (1)...(1109): n = A,T,C or G
ctcagggnaaacacgagaatggatctggncccattttngaagtgatttctcgtcttattctccaatcaacaccaccagtcaaggtttctcatggtttttcccaaatgttcctttgagcaactatggtatccctgaagaaaaagtcttgcaacagggtgtaaattcctctatgtctgtggctcccaattgttctttatcaatgttttagaaatttctagctggtccttcttactgggttacatggtattaggtggtattggggtgaactccccccatgctaaatacacgcccgcctctccccccctttcccccccctctttctcttctacagccccgtcattttcagtggccagcgcgtgccgatctgtgttcctccgccccccatcccccacagcccctaattgcgaagcgcccgctccagagaggtcgcatagcccgccttacgccgcacgacggcgtccgcaccgagccccccccccgcccggccccgcatgcgaagaaaccccttacccgaaccgccccccccccattcccggtccccgcctccccacgcttcgccccgactccccctcttccctcccccccccccccgttccccgccccccccccgtcttaccccccccctcccgccgcccgctttatccgcgtatccccactacgcccgcccacacacgcccgccccccccacgtttttccccccccatccctcgcccgtcttatatcgccgccccccgttctccgaccgcccgcaaagcgtcaccccaattcccccgcacgcgcatcccgccccttatccccccactatacttcgccctccccctctcccgatactttcatctttccccccgttacgccccatcccatcttccacctcccctcttctcattccccgccgcttcccacttctctgtatattcgcgatcccgttattgccgccattgttcccaccgcccgccatgtcgcggttatatccgcttatctccccgctctatggtcgtcatatcccatctcggtgtcgttgccgcctatcccttccccagtctcgcgcgcgcgcgtccctctcgcgctgtcacgntacccgtgtccgttctcacactccaccgcgcccg

SEQ ID NO: 17108 - DNA, 391 bp, Homo sapiens
ttcgaaaaaaacagaaaacttcagctgcttccatgtataaggatttaactgctgggccattcttgtgagtcagtaaagcagggacaggactttgtgatgcatcatttccaaggagctctattttgatattttgacctagcatccttgtttaacaccaatgaaacgaaaagcttcaagttctttcttctgtgacgccttattactgcattcagatattaaaggtacagaattcaaagcaaatagagaatatatatggtttacagtcactgggatatcaatcattccacatctatggtaatgactgagatcaaatctacaagtggcaagaattcacttcttattatgtaatcatcattaaaagtgactacagtaaaaaaaaaagctggggaag

SEQ ID NO: 17109 - DNA, 326 bp, Homo sapiens
  misc_feature (1)...(326): n = A,T,C or G
ttggcatgggttaaccaggtaagtgcaactggtattatcagcaagaacatttgagccatanagaacactcgnctgatgaagaaaccagaagaaaattatcttcataaagatgatgagagagagagaaaccaggaagtttgactctccctaaatcggcttcatgttccaagcatcaaaacattcagctgatttactctcttaatatgattcagcctacggaattatatgctaccaaatatagcacaaatcatgcatatatatatttctgtactaggctattcaccaaaaaaaaataaaaaattttgtcattactaaaaaaaaaaaaa

SEQ ID NO: 17110 - DNA, 301 bp, Homo sapiens
  misc_feature (1)...(301): n = A,T,C or G
caggggttccactctgtcacccaggctggnaatgcacnagcgcaatgacagctcatggcagcctcgactcctgggctcaagtgatcctcccatctcagtctcctgagtagcttggacaacaagtggggaagggagaagtggatggactggacttctttgtactgccctgaaggaaaatggctaagaagaaacacttcagcaacagccttaaaacacttcagcaaaatgaacactatctctgatttgctggtgagcacggagaaaatcagtctctagtatttgtccttactaagaacgcagg

SEQ ID NO: 17111 - DNA, 1133 bp, Homo sapiens
  misc_feature (1)...(1133): n = A,T,C or G
taggcaacgaacggcaattacagatagnggaaagcatgcagtaaccttggcacatggtttcttgttaattaggaaggagcgacacaagttgactgtcagcatcgtgtgccccaacaataccactctagagaaccgagagtgaacctgaccttttggacagtntatccatcccctccccggctctcctggcgactctcgcccctccgttatatttggtgtcgcgcgtcgcgaggaaggtggcggcgcgggggggagagcgaggggggccgcgacggtgtctatctcccccccccgcgccccccccagtcccccccccacttcgtctatttcacgcccactcgtcgctcgcccgccgtggcccgcttcnacatccccgccgggcggcgccgaccaggcagcgcggtgtgccggggccgcacccgccccggagaggacgccgcgcgaatagacgaaggaagtaatatatgggtgggaggaggcgaaagaccccggggttttgggatgtccgccgagtccggccgccccccgcgggccggtcccggggcaccccgcgcccgtgtttacccggttgcgcccgtgtgggcgggcgccgcgccggtgggccgctcgccccgcctcattggggggacgagaaggcagcgcgcggaataaaggcgaaccgcgcgacaaaggagagagacgaagcgagcgccgccgggaggacagtgggcgcggcgccgggcgcgcgggggagagaggcggggcgaggaagagcgagaggagggaggcaaggtcggcgggaagaggcggggggagcgcgagacccgcgagaaggagggcgcganaatggatcggccgagggccggaagcgcgatgcggtacatgtgacagccgcggtatgcgcgcgcgccgttatcgccgccgcccggcaatattatcccgccggaatcccgtcgctttatggccgtaccgcgtgtttggcgcggtgtgccgcgacgcaggcttgccggtagcagcgcgtgagcatggcgccgtgatgatcgacgtcggcaggcgcgcccgcgtgcgcgcatagcccggcggagcgaagaccgcccgcggcgatcgtccgtgatcgcgacaaccgtccgcagccccaccatgcgcgtcgcgcg

SEQ ID NO: 17112 - DNA, 1176 bp, Homo sapiens
  misc_feature (1)...(1176): n = A,T,C or G
agtgtgccatagcgatctttcatcggtaaanatgtataggcggcagcagtgatctagtctctttgcaacagatggggaactgctgacgcggctaaagcagattgcagctctgtagtaaccacagatctcataggaaatgttcaacaattctgtgacaggttacacggaccatttgtcgaactcgcctgatcagcatacttggtcttggtgtcttatttatctacacccccatcccccacgttgcggccgcccctcagtacctcttttataccccacactatttatttatatccccgccttgtccccgcttatcccccccctcttagcgccctatctcccgcctcgtttctttcgctcgtcttacgtcttcatatttcgacccgcccgctcaccatatccccctctttcgccccccccaacaacccccttctttccccccccaaaactaccacaccgcaacccccccctccccccaccccccctacccattgtcccttctaccgcgtgtccgtaccagccccccccctatcccgtgtccccccccccgcgcgtgtcatccccgttttcccccctatttgttgccccccccccccgccttaccccgcccgccccccgttttccccccacctattcgcgccccaccatctttcgccccatttcccccaatatgataccaccgcacccacgccgcgccccgcctttcttcgccgcctcgtcgcttccccatatcataactccacacgataaggagcatccgacacaccgctaataacatcgccaccaattaaccaccacgccgccagagcacccactcgatatagacgcgaatatacgttcaccgcaactcacatcatcgccatgtagaacgtttaatccccccacgtattgccccatcccantatatctccctcgtccttttagactattcgccccacattacccgtntctcttactacgctatcgccgtattactcgccgctttgccgccccggtcgcgcgtgtatccgcgttctgtggcgcgctatctccgccccttntttattgtcttcgtcgtcttattctcacgtagcagtgcacacctaatcntcgtcacgaaccgacctccccccacagtcgctatagcacatgtgtcgtcgtcatccgttcactagttaccgtcggcatcgtcatcctacc

SEQ ID NO: 17113 - DNA, 1325 bp, Homo sapiens
  misc_feature (1)...(1325): n = A,T,C or G
tttatgaggttaagaaaccgagttttgggctgtncaaaaagacagacctacaagnagcatgggcaccttcaaaaaggatctacatcaaagaggaaaagggaaatccaaggttgacagcaaaggaaacttctgagagcagctgagaagcaggactaaaacgttaacaatccagacaatccagattggagaatggcaaaggggacacacttatgtcttcttttggggaggatggatgaaactgatattagcaacacaattttccataggtctctgcactcatgtgagcagaggcactgactatctttattccacaccatcttttccacacatgttcatatcccagacagtcgctacaagatactaagatagcatacccctttggagcaccgggcacgcatgcttacagacgcaatataacagattcagcgtacctacactcaggctcttccctgcaatacaacacttgcatatacaacgcaccacctgcgcctcctcctacctcaacacgcctaactcgcgtcattccgcaaccacccacctgcaacgaacacgcccaccatcccgcggtactcccgccccctcgcccaacaatactccccgttttcaccccgatagtcttcctatgctcttgcccaccccattcccaaacgacccgccgcccccgtttgttcacccccgcccgccagtaccaccactccacagcgtcttccacgccgttnacccgccggcaaatgacccccacccatcccacgtcagccgcaccccacctcttaatccgccgccacagtccggtgcccacaatcacattgcacgccgcgcacacaagcgtccgcacacccactacatagccgacgcgcgcacataccacacccccgccccgcgcccacccgctcaaacctcgcccatantataatcccggccgccccgcgatcgccgatataaattcgcgaaatatccgcccacgatgtcgcgccgctccgcgcatatatacccctccgcgccacgatgtatgtctccccgcgcctcacacgcgcatactgttctatctcaccgcgtcatccgccatgttatatntgccgcgtttgctccccacgacttcccccgccgtatccacgcttaccctntccgcctagttagacgtccgcccccgcactcanaccatcgatccgncgngcacctccgcaccgaactgcgagatagacacgacctatacgtnccgtcgcgacgcncgcacgacgcgcacaagccaatcaccttcntcgccgatgatcgtcgcntcgtacacgtacgcatgtatcgccggccgtgtgcagtagtccccgctc

SEQ ID NO: 17114 - DNA, 1113 bp, Homo sapiens
  misc_feature (1)...(1113): n = A,T,C or G
gcgtcgtgaccgattctgttctggctttccctcacacatgagtaaaactctctgaggcctttgcagccatgcttcctgtacattctacagaactgtgagccaattaaacctcttattttaaataaattaaccagtctcagctacttcttcagagaaacgccaaaatgaactaatacagaaaattggtactgaggtgtggggcactgttctaaagacaccccacaatcacgaagtgacttcgacactggatcctccgcacacctcgcaccagcctgtattaccccccctccccccccccattcgccgcccctcatcgctttttgatagccgtcggcgggcacgcgcgtctcgggctccgtccgggggtcggtccgccgccgcgtctcccctatttcccatttttctctgccccgccctccctctccgtcatatccgccgcccgttcttacctccgccgacctccccaccccacgccgcacgccgccaccccccgctcctttttcccaccgattgcgccacccacctctcctctccttccacgtcacccccccacccactcattcctccttatcccccgttatctctcgcccgccgcgccgcgttctccccncgtcccccgcgtttttaccgcccacgttttccgcccccccatttatcccaccttcccgcacttcagcaccaccaccaccgcccgcccgcgccccatatctttcgcccccttccgtcgcgcgcgtaatttcgccgcccgccgtcactgccccagccgctttatgatccgccatttacccacccccccattcccgcctaatcccccccgataaatcccgcccaccgcctaccctttatattctcatttaccccatattgccctcgcactttcccctcccgcttttctctccccgcactctccgtctcttttttccgcttccgcgtttctcccgccgtcgcgccccgtgccgccattacgcagtatcgtcgctctctcccctccggtattaagcgacgacgtcgcacggcgctctcgttccggcgattcgtcgtccccgagccgcgcccgcgngcctactacgcgtcgccacgccacgcacgctatacccccgtatctcacccccg

SEQ ID NO: 17115 - DNA, 519 bp, Homo sapiens
  misc_feature (1)...(519): n = A,T,C or G
ttcgaggaaggccagccaggcacacgnaacccactgggnaggaatgacagctccggncagggaggaacgaaccactctggacgcaccgccttaagagctataacactcactgcgaaggtctgcagcttcattcctgaagccagcgagaccacgagcccacctgaaggaagaaactctgaacacacccaaacatcagaaggaacaaactccgtacacatcagaaggaacaaactacggacatggccgcctttaagaactgtaacactcaccacgagattctgcggcttcattcttgaagtcagtgagaccaagaacccaccaattccggatacatttcggtgacccagatgggactattacctatcgccaagcggtgagaccactgcctatcgctgagcggtgagactatcacctatcgccaagcaatgggaaacattcagccatcaacaggctcaccctttgaaatgcatcctaagccgttgggaccaatttgacccataaaccctttaaaaagaaaaa

SEQ ID NO: 17116 - DNA, 1110 bp, Homo sapiens
  misc_feature (1)...(1110): n = A,T,C or G
ggaattaggcaaggcttatacatggnaagaagcataataaaatttctgcaagccaaaattgaagcattatccagtgtggggtcaactttgggtcatgaacaaattaattttctcaacttcaaggcacaaacaatgggcagtggtgaatctcccaagctaggtacaaccatatacggactattctcagtgtcctgctgaccttctcagggaacactcatttttctcattgagcatttcttctaaattacttatggtatatttagattaggtagaactctgcctgccagctcgcgcacatccctccctacctatccgaccattcgtcaggcaacacatactcccccttcatcatccataatcttcttcctgcctaccgcccacttccgtaattcccgcaatttgagtaccgccagcatctcctacactttttcgcccagaatgaacactctcctcacaccgaccacgtactccgccccgcgccctcctccaataattagaattaaccaggagccccgcgcccccatccgcactaccccatcgcccgaccccgcgcncttgtcccgcgtttccgccctttcccgttcccccacccccctctcgcgcgctcccccactttacctccgctctctccccgcgcccctcattctgctcctttcccccctatccgcccccccccccgccccccccccccctttttgccccccttcgctccccgtcctttacccccctaccccctcatccgcccccccctatccgtcccgcctttcccgccgccgccgccccccacgttcctcaccccatactcccccccacccccacccgcataccgttcgctatgccacccattgccgcgcgcatatatcccccccccctatatttcccgcccctttctgcctctctatattccccggtccgcgcgttccgccgcctctccgcgcccntccgccgcttctctcgtctcttcccgctttgcacccgccgttttattttctcgtcctctctctgtcctctcgtaccccgcgtatcgcgatcgcctcttacgcgcccgcgcgaccatacgctcgatactcgccgacgtcgcatcttcttcgtcgcgtcgctcctccccgc

SEQ ID NO: 17117 - DNA, 1131 bp, Homo sapiens
  misc_feature (1)...(1131): n = A,T,C or G
tcaggacaggaactcagtagttgcccagctggtcttgnactcctagtctcaggctggnatacaatgatgtgatctcggctcactgcaacctcccactcccgggttcaagcgattctcctgtctcggcctcctgagtagctgggattacaggcgccgaccactacacccaggtcctgcagagagagaagacacgagaagcaaaaagtatcatgatgactggaaagattcaggaattgggagcagtgaataactcgaagtgcagtggaggttggtgctgaacatcagcattagctgacaatttgtaccagaagcagttcctggccaggtgccatgggtcacgcctataatctcagcactttgggagacatggaggccgcctcaccaggccccgagacccacacatcctgcctacacagcgacaccctgtctctaccaccacgacacaccacctaaccagtgtggcgggacggccctgcgccccccgtctccggtgcctgtgttgtgactattcccccctcgcggccctcccgttccgcgttttcacgcccccctgcgttatcgcccgctttccgcccgtttccctcgcccccgccgcccgttctccccgtcccgcccccattttccggccccgtctatgcccgcccctcttttcgcccttcccccccgaccacaccccccacgcccgccgcacccccccgtgcttccccccccatcattcgcccaattgtatcgcgccgttccattctccgccccccccttttggctcggcccgtttcccggggcgcccccattcgccgccccttactcgcccgctattggtctctcctcccgcctcgtcccatatgcattcgtattcgcgcccgatttgcccgccccttaatctccccacccctatctatatacccgcactttccgcgcccaattttatcccggtcccgcgtntcgcgcgcgctttctcgccccgtcgccctgtacgccgtgtgtctacccgcttttctcacccggtttttagcgtcgtcggagatcccccgtcgcggtggcccgactttgtcggcgcgctctctcgcgcgcccgccgccgtgtgcgcgtactctcggtctcgctctctcgtctcatcgtatcccgtcgccc

SEQ ID NO: 17118 - DNA, 1168 bp, Homo sapiens
  misc_feature (1)...(1168): n = A,T,C or G
tttcagaatttcctcctcccttttttccccctgtgnatgtcatcaagtgtgagcagggtctcttgtaacaagcataccattacgtcttgcttttttatccagcctgccactctgtgactttgaagtgggctatttagcccatttacattcaagccacatttgctcttggatcccatccaccacgctgcgtaggaagccaaattaccgtatgaagatgccctcaaggagcggcaccaaaggctctggtccatacccttacggatcttcaaggcgaaagccaccaccatactgctagccctaagagtgagtatctcgccagnattatctccaccctccgctgcatgtcctgttgcgcatcacgcacccatccccatcaacccctgcattcccctccccctctccccccccaccgcactgcccccatctaaacacccaaaacacacacacaccccctggtcgccccccccggcgccttttctcctcttcttccttttaccggcggcccgctccccctcttccccgtccccctcccccgcgccgtgtttccccggtttcgcgctgcgctcgtcccgcccccccgccctttctcgccacgccccccccatcttatcgcccacccccttaccaccgccccatttatacccacagtatcccgctagattgacaacccacaactgagacacacaccgcgcatcttttgtgccccgcttccgatcccgcgacgtctcgcccgcgcgcatctcgtcgtcacgtatgcgccgggtcgcgatcgccctcatttatcacctcgcccccgttacaccccgcgttaccgccccccatatctatgccacgccctccccagtcgcgatattatatacgtctattacctcgctctataggccagtcgcgtcatactcgcccggcccggtcacataggccgccgcccagcgcccgcccgtttatatccgcgtgtcccgttgtacgccgcgcggttcccgcaccgtccgccgctattcccggccgcgccgcggctaggcccgccgcggtcctatcccgatcgccatcagacgcaccgcataccatgcgcgacatatcgtactccgcagacgctatccacgcccccagacactcatccctacatcgtcgcgcgtccgatcattcgtcgtcagcatggcgccgtccgccc

SEQ ID NO: 17119 - DNA, 981 bp, Homo sapiens
cttggactgagatcagctacgactttgacgacacgctggcaaccgatgatacagccgccgtggaccttgcctttattgtcatcgggtacacgggactggaagcacatgagggtacagaccttagcgaacacatgtacgaggaataccttgctatacacatgaatacaggattgacactttgcctttgacaactgacgagacagctagcactagcttagctggctttttattagcattgcttgtgattttgcatttttcttcacgactaatgagacggaggctgtaagcacaaactgccttaagggttatcaggcagaaaatatagctattaaaggattctcactccaaaacaaacacggccgttgcctcagcgggggcattgcggcgtcccttacgagctacttatgactcgctcctgctcctggctggtgtcggtggccaccgcccacctatccagggtcatagccaccaaccccccgcacccccccccgacccgcgaccccgcccccccggcatccccgtctccgcgtgttgtgccgccccccccctttgcccctgacaccccgatatcccgcctcgtttccgcccccatctttcggccctcgccctttgtcgccccgccccctccgccccccgtcctcccccctacgatccccccttctcccccgtcggcctcccacccactttgttcccgcggttcgccccgcccgtgccccctaccccgccaaccgcccccccccccgtcgccgtgcatcgtgtccgccctttccccaccctcttcgcccgcctctcttaccccgcccacccgcccttttcgcccggtccctttttcccctttccccccgcccgctttccgacccgccccattcgccccgtgatgtccttctccgctcccccgtctcgtcccgccttctcttccgcgctgctcccgccgcccttctccttctctcccatccttcctatcacccctccgtcatcccc

SEQ ID NO: 17120 - DNA, 1112 bp, Homo sapiens
  misc_feature (1)...(1112): n = A,T,C or G
cagggaaaagtatgaaggtcatccccgttgttcggtcatgggtccaagnagagaactgaagaacacaaagagcgtctactccatttcgacctccagggcgcccaaggagaaacaactcccttgtgattctatttggtcgacacattttgtatcatttgtgtcctggcaggaaggagtccccctgggcctgactcaaatggaaacctggccagaggacctggggagcccactgatcaaaaagatctgcctcccggagcacagcactggtggggaaaggcagaggatagatctgcagagagggacaaagaaaagacactcaacacaaatttgagtgagagcaaaaaggttgttanacacacccttagnntccttgatgccgttacaatgtcccncaccaatgaatgttccagaagcttccatagagcacttgagagtgggacttgtacttaggacaaagcccctttgccatggggtgctctgcctttgaatgaggcctctgattgccacttttctccccatccagcccaaggtctccactcaaggacaaaagataagacaagcactatgctgcatttctcctctaatatcctttagatagntatgctctggtgatagacactgagggccagtcttgcacctgtagcttttatcactaatgatatacttgacaacatatatcgcctcgntgcctcagtgtggactctgcggcgcttccttagcgaggcctattatgaccctcctactgactcgctggctngtcgtcgccgcgcaccgcatcactcatccagcgcataccgtcccatatccgcacccccgacaccgccctaagcccccagccgatcgcccgcccctgtgccgtttatagtctcccctccgctaaaatccctccctgatgccccgccccttctatctccgcccgtcccccttcctttttccgcctccacgcatcccgcttttttccgccgtccccgctttccactattccccttctccccggctaatcgcgtcgcgcccgcctcgctgcgtccccgcgtacccgtccgtgtcccgcgcccgccctccgttcaccgttgtcgccgcgtcgcctcccctctccccttccgtctcccccg

SEQ ID NO: 17121 - DNA, 259 bp, Homo sapiens
agtaatatcattcatggatcctgggtcctccaaacactgtggaatacaatctactggttgacgacggagtctctcctacagaacagcagtttgagcatcacggattatcatttagtccacaaatagttgttgtacctactctgtgccaggtgctgtgtagagaacaaagaacacagggcgcgctgccctccatggtacttccagactggaggaggaacaattaaacatgtaaagaagctgacaaagaaaaaaaaaaaaa

SEQ ID NO: 17122 - DNA, 417 bp, Homo sapiens
  misc_feature (1)...(417): n = A,T,C or G
tccaccaggnatgtcaatctgttgntgggctggnatgcagtggcgtgnactcagctcactgcaacctctgcctcccaggttcaagagattctcctgcctcaacctcctgagtagctggaactactggtgtgtgccaccacgcccagctaatttttgtatttttagtagagatggagtttcaccatgttggccaagatggtctggatctcttgacctcatgatccgcccccctcggcctcctaaagtgccgactaataaatattttatttctatattcccccacctgtttcttaagtcttctctaagttaactcaaacatgtcagacatttcaatatattttgcagaaaaagtttctcatacagtaagggtgtgcttcaataaagagtactcttttgaacttcanaaaaaaaaaaaaa

SEQ ID NO: 17123 - DNA, 1181 bp, Homo sapiens
  misc_feature (1)...(1181): n = A,T,C or G
ttcagcaatttctcacaactctggtgagtggttggcatcattcctggtaggctgtaaatcaattttgtcacaaagtgcagtaggagaaacccagagtgttgttcagtataatcatttttatgtggtattagtgcacctctctgcttaagccatggcaaatgttcaacgtacctgccgcctcactgccctcggntcatttctctacctcccggctgcctctgcctcatccttcccccaatctctcctcttcgcttattccgcacacaatccaaacccctcatataatctnataatatatcgatgacccaaaatcgacctccacaaaagacccccaacataccacctcaccccccacccaccccacgtacccaaaaccgcacaanacgccccacaaaaccaaccgatccacccttaatctcgaccacacctccctcgcgcctgcctcgccgccctccggctccaccgtcactatgttcgcccttccgatgttttccccgcacctccggcccgcttgatttcgcaccccgccacggccaccccgggtttgagggtgtgcccgggacggacgncgcgccggcgggagcacggttgccccgacccgcacgtgtaccccgcaccccgccaccgggcggggtgagtgacccaagaagacgacgccgcccacaccgcaaatataacccacccgccgcgttacccatttatatccctattacttctccacctcggttcacccgcgacacacctttactatcctacccgtccctacacataccccaatatataccgacatatgatatatgctcttcttgtcccgcccgccctgctccagccgacccccatatatattttctccccatatttcttctattttgatctatccctccgcctctcctgcctcgtgcttggtgtcccgtttcctccccccgcccnctatgttacacattataataccctcaccccctaccactgtccagattacncaccataagaacgtatagacctgagatgaccccgcctctcaattccagtttccatgcagcacgcccatccgccccgcacattatgttccttagtccgtcgcccaccgatttggcttgtatttgacggatcacaattccctcctttgcttgttctccgccttctcccacgatatcgtttatcgctaacattctccccccccg

SEQ ID NO: 17124 - DNA, 1048 bp, Homo sapiens
  misc_feature (1)...(1048): n = A,T,C or G
gcattcattgaggcctgacagacaaaaggcagaagatgaagatatgctctttttttttcctgcctgcctgcttgagctgaaatattggccttttgctcttggactggaatttataccactggctcccctggttctcaggcctttgaactcagagtggaattataccacctggatgccgctagcgcctccacactcgcacacagcgaaatcatgatatcgactcaccttcataatcacataagccacctcctcactataccgaaaatcacctttgaataaactatatccacagaaaaaaccactccagaccaaccccgctaatcaaccccaacaccacccncaaacaaaacaaaacccagaaaacgccagcncaaacgcaaagaccacaaaatcccgcccccacactcacggcgtcccaccgcgcaatcccgccccatcattgccccagccaaccctccccaccacgcacctcagctctccccccccccacccaccccgcaaatcccgcccaccgccgccgccgcagcgccggccgtcgcacaacaagcaagatcccaaccgcccgagcgagaagtagaacacgagaaaggccacccacccatatcactcccccgcccactcacaaataaatctattaacacccccacaaacccccaaaccccanccaacaccacacactaccanacctttaaatttatattaagattttcgcgtctcctcccccctccccccccccgttttttttccctgttataatataattttatatccaccccccaaccccgaaatacgccccactatcccgccgccacggcgccccgctcaccccccgcacccccagtctcagctccaccccctcaacgctcccaccttagagtcacacccccgcttgctgttgccctcccccccaccctcctccccctccttgttcgcactctcccctacccaccccctcatttttntcctccctgcatcacaactcccgccaccccattcgacagcactttctcccacgctttgcgtgctccttacggctttacccacccac

SEQ ID NO: 17125 - DNA, 1087 bp, Homo sapiens
  misc_feature (1)...(1087): n = A,T,C or G
ttgagaaacacttcaagaaaagaaaaattgagtttctcgatttcaaaatttcttaagtcttcataccatgccttacatgatgttctcctgacagcttgtgactacaatcagaggattaccgcagaatcataagcaaacacggggacagattgattttgagatattttctaagacagacagttgactgcagaaacatgcagactggagcttgtgttttgaacacgagcatgctagagactaaacaggacatgaaaggtctgcctttcttggtctaaaacacatttcttttaaagatttaccatcataaagacttctttttgaaaagctttgttgaaaaccagcttgtaaatttaaaaatgctcaagaaagaattgtttgtcgatgcaaaagttcagccaggttgcttggaatgatgacagatatgtcgctagaattctctcttctatattctttcctctatttacgctctggctcatgccttggttctggatgacatgagcttcacctctgcgggctccggagggtgttatccggccaatacctgccacagccatgcccagcaacacaanactcgctctcgatgatctgaaacgtgtgactctgaggccgatgttctcgaggaggcgcaacccatgatcctccttaatacccgctcctcccgtcctatttattatccganagtgtcacctcatcaatagagcaccaagacagtanataatcaaatatatctatttccattcgcattacacgctcctagccatgccctccactctcgtcctccccttccacccccccatctcttatctcaccacatcccccactcttgaccccccgccgccccaagatagaagaggggaagccggcngtcccgcgcctgcgcccacctcacgttacccgccccagtagttagcccgccggaccccggagggttagacgtcggttgtcccccccgcgttttgcgttccccccccgcccgccccccctggtcgcgcgacgcccacccacccaccatcactcaaccgcgccgccctcacccaccctcacaggcacccggttgccctatcctggcacatcagtgctccccccg

SEQ ID NO: 17126 - DNA, 1556 bp, Homo sapiens
  misc_feature (1)...(1556): n = A,T,C or G
atatgtgggtgttgaaatgnaagtggnagggntaggnnnnaatgatntagattatgagagnangnnnaannnnannagatgaagagnnagannnaattaaagnnaaggnnnnnnnnatgaagngtagnnnnnannagttatanggnnnntanagattaagttngaagtgnnaggttgaaatggtagtnagagtataatgnaaaagagaagaagatnnnnagtgttagggtaanagtgataagtagggaagaagnnaaagagggnntntgtatntaaaataaatgtgatnatatatagttntgtagttgntataatnatactattgtttataattaatttcataatataaagtacgaatatgatattgatgtgtgtgtnnatatagatgatatgtgatagtntatttntataaagtgagnnncaagatatcaataagatcatgcgtctctctaagcagtntaattatgtgatatatccatagagtcactatattgcgtagatcgagtagatgtnanttaagtgataattatgttnnntcntagtntatatgtacgtgataccctctgctctcttcttactctaggtntccgtcggtatgataatantnnccactatagctgtgttacgttntctttagtctgatttcactaaggttccatacacgacgtatctgtntcaggagtttatncncgattgtcatgtccactctatgtgagtcgctcgtcttcatgagatgagtatggttatagcgaatacctcctctcacacccgatacaattccaatagcctccatctanagctcatatggttctataacttnacacacaataacttaactaacatacncaaagcgtaacacacatcagcatcacgataacatatgcgncgtgcaggatacgtgcaccatatgacaaagatgatacgtgagaagaatantnatagtagattagagctctctcctctncattctcactcataggctcagtcttagttgtatccatgataaataaattnnnactgttgtcgtatatcatgcaattatgtnagatgagtggtnntagagttgttgatgcgcatatacgaggtnactgttagatagtattaggantcaactataattnnnagtatggtaagtactactgaaatgtatagtgcngaggatatgcnattcgcatctccacacancgcgctncctatctatgtatacatacgatcccacagtgtatatatgtacatataacaactcatcacatcttcatcagtcactcgtngtcgagttnacattatatatgtgtctngtgttnctcctcgattccagagcaaaattgagaagttcactaagtatatagagtcatccgccttatgtctctacatagtgaatagagtnntatgcgaattttataggcagtgtctccnctcactatcanctnantatcattatgtanttctgttatatgtatctatatgtgttnctttncattcacgttcgagctagagactatgntgtgttatgaatcngnnattacgctagaagaaatgagatagagattgataac

SEQ ID NO: 17127 - DNA, 1252 bp, Homo sapiens
  misc_feature (1)...(1252): n = A,T,C or G
tttcgtgaaggaagagnnaggtgtgaaganatggaaaaatgaatagctttagatgaagaagcagagtaacgtangganaagatagaagtattacttatannnaaaangaccatcagcaccagaatactattttgcactattcttccagaacatatgagcatatccatttgatgcttcaacgcggtggccagttctcgcgcagactgtcagttcgtacccactcgaccatacacactccagtttacggagatggtataactttatttagaatcgtaccgttgtttctgcgtatttactcgagagaatataggtgataagaatcgctacggtagttaatacgttatagtttgtgtgtcggtgtttgagtgtttgttggggtcgggagtctgatgtaaggacaacgcgctccccgccccgtgtgcctctctgcttatgtagagagtgaatcatgaatttgcnattctgtctcgttcactgtgtgtcacacntctcagtatataggattattattgatagttaatgagcaacttcagatnacacagaacacaggatgttatgaagtgcgacaaagagcccgaactatgtgcgttgtcgataatagcggcgcggcaggagatggacaangaatatagtagtgtgataggttatatagatgnttccttctactgtctcctcagatgtggttcgttctcgcgttacttctgcttccacctttatcacgctcaccgctcggcctcacgcgctagccaggacgtcgagtcctcgctttgtagttgcgagtgtatacttcatgggtctgcgatcgcgagcgccgtagcgtgacctctacgtgtagctcgcctcgtagctgtcttgatgaagttccgtcgtgtcgtaacaatctcgcgcgagagttctatcgctatgttgtagtggaatgcacggtcagcgcgagatatcttgctcgtctctttgctgcctgaccgcgtccatcatcctctccctccacattctaactctattatggagaaggcggcgtttactgtacgcgcggattagaagtacatatgtatttacgccttccacggcttatgtacgacccgattgagttgttntatcaatctccgcacggtaagtagactcgtaggacgcaggggtctaggtagacgagtggtgtgagctgaatatatatttcttgtaattcatcgtcatattcgtcgttacaagacacgcgacttcaaccatactgaatttacgtttacttagtgtagcg

SEQ ID NO: 17128 - DNA, 800 bp, Homo sapiens
  misc_feature (1)...(800): n = A,T,C or G
cttactttatacacagttgacccttgtacagcacaacaggactgcagttgtgcacttctatgtagattctgttcaacaaagcaccgatggaaaatacagcatttacaagatgagaaacccgagtgcacagaggatcaatctttggtataacacgagttccacaaggctaactgtggcatttggatactatgactcatttattcagaagtcgcttggttacctatgtgtttggcatggggctggactaccagcttggactaacttagaaaactgggaaaagaaccaacatgcctcaaaaacaatttctcctctttctctttatcctttttcctctatttagactgctacattaataatgaacctaagctacagataaacagaattcaatcactgtggccaaaagacaggaacttagctgtggtcagtctcccacatctgatgtcctcgtggtagagttcagggttagagactaagctgaaaggaaggatgggactaggaagaattgcataatcagacctgccatatccacacacaaatggccaagtccagccagaaatcttcacagctgtttgaataataaagtggataaatgaggagaggcttcagtaagttagatcaagcaaattctcagtacccagagctatactgggaaaagccgttagataatgataaccaaatgtattttccttgactgttctataggattcaggagtgttactaaattgtgcctccaaatcttaaaaaataaaagcctcaaatctaannnnnnnnnncnnannaannnccaanaaaaaaaaaaa

SEQ ID NO: 17129 - DNA, 781 bp, Homo sapiens
atgaagacacagttttggaatcatagaaggagacaaatgattccaaggacgttaaaagagaagaaaagctaatgcacacaattggtgtaaattctctcccattgcaccaaaacaggaagcatgtctactattccctctctttactgtcccaagttaaatggaacaaaagtaaaacctcgccggggcgcggtggctcacaccggtaatctcaacgctttgggaggccgaggcgggaggatcacgaggtcaggagtttgaccagcctggccaacatagtgaaaccctgtctctactaaaaatacaaaaattagccaagagtggtggcacacgtctctagtaccagctactcgggaggctgaggcaggagaatcacttgaacccaggccgagatcatgccacagcactccagcctgggcaacggagcgagactctgtctcaaaacaaaaagagaaagaaaaaaaagaaaaatctctgccagttactgtgcggcatgaccttggacactttattgctccactctgagcaccagggccctcttatggaaaatgactgtttccccggaatttgcaaggatagaacaagtggacaaatggcactgtgctatgcaatgcggcgagagcaccagagacagcagggagaacgacacctcggccttgattgagtgaatataaggctgcttgaaagtacgtaaatgcaatcgacgccgttgttcgatggcgcatagtggacgcctagcgcgtcagggttccgatatttcggatgtactgactgtcggatctcg

SEQ ID NO: 17130 - DNA, 1368 bp, Homo sapiens
  misc_feature (1)...(1368): n = A,T,C or G
ttggaggggggtttgtttgtaggtttgtttaagtttttgggtttgtattgtaaacaatatgataaaggggattgcgcttaaggaggagggacagggggagggagcgttatgctgcaggagggggcgctagactacaacgcctctactgtccagcccctcctcgctgtcgttctgtggctagcgctgcgagagatacgctgcccctcgctaacccactctccaccaccacccaccccctgcatcnctatctcaatggccagaatcgcgnagagagacgagggatgcggggaacgagagggtggccatgcgcgcggcgaccgcgcctgcaccggggccctctggcggtaggcgatcccgccccgtacccccgcccgccggcccgccgcccccgccgcgcccagcgggcccaccggccgcctgcgcgggggagggcaacgagagcgagcgctctaaacacctcatacgaggcgagacggtcctnncagcggggtactagacaacaagaaatggccaccgagctctaaccaacaacgctacagcacgagacatagacaggcaccacaccgtgacgccccgtcacgacgataaagggcagacgcagatgccgtgtgggttgtggagtgaagggagggaggtcggtaggtgcaagcgcgctcccatgccatcaactcacatctgctgaacgcccacacacccacgcatcccgcgcgccaagcaactggcgcgtgcacgggaccgcacgcccgcgccgcgccgtaccccagccatcgagcctcctcgctcctcgccctcccagccacaccgcccgccggcgatctccctgccgcgcgtcacacgcgccacactagccccagtngactgtaggtggtngtcagacgaggtcgctggagtgtgttnacaccgctgcgaacgcgcgcgctctcgtcagggccctgatgctccacgcgtgccgcgagcgcctgcgcgagtgngtngcgaggatacacgcagtgcgcggcngcgtacaggccatgtgtatactctaccacgctctatgctctaccgantctgtgtgtataatggaccacccgaggcgctcacgtacgtcgcgactctcgatacaagngatggcgcgagcctcgcgaccgggatcaggcgcgaggacgacgcgtagacgcgagcagacacagagagcgtacgtgtacacgacgcgangcacgagtatgtggttgctcgtatgngccgtgcatgtgatgctgtntactggagaggtatgtagaagcgagcngtctcgtctcgacacagccactcacngttatatgnaatatagatctcatcagcgcgcacacgagggaagngatacgtggcgatgacgtgagctcgtcacac

SEQ ID NO: 17131 - DNA, 771 bp, Homo sapiens
ttctagaagggcaaactagtcccttacttcagccaacaccttcaccttgaaagcaggaagataatggctgctaacacatgagagtttgagaacaggtgattgctgtaaaccacttttaattcttctttaatcaaagtgattacaaagtacaatggttctttgacacttatactctatggagctgtgcaatagtaggcgtacaatagtagagaaagaactatggctccattagatgacagccttcataatgaggagaacaggacactggcgtgtatgcagtgtgagaaggagggcaatcatgctgacgctgaccaccatgaagccattgcacccagtatatagggtattaggatattgcatacaccatcggttgaattagcgccagggtgtctggaggactactactactccctaacaaggcgctcagctctcacggaaccctctctgaggacaagaccaacaccaccccctcttagaacgtacgtatccaacatacaccgcgggctcagcatcacgtcccacggacgtaaccattacgcccaaccatcgtccaaaaaccgtatccgacgaacaattctaactccgctctcatccccataattattgcatttcgttgaccccctcactcctgcatgacgccattttatcttcctgtacccggtgaactaaatgtcgaaaccccgacctataattagataatagacaagcgtatgaagccgctccgcttgacataagccattatggagcaacgagtcccacaacgcgtcgtcc

SEQ ID NO: 17132 - DNA, 1413 bp, Homo sapiens
  misc_feature (1)...(1413): n = A,T,C or G
tgtttttggggnnnttnnttnangnnnggtnntagtanngttggtntgntnnnnagcnnanatannnngtngttnantctctttattnnnnnnnnnnnnnttgnnnccttctttacntcnccactctttgcttcctgtcntctcactactcntcgtaagttggctcatccaaactgtctcccgttcaaactatctgtatggtcactctnctcgctacccatcaccntcctgagatatcccactcgcaacttactcacgtactatgatattcttggtgtggtctttagtgttgattctctcgtgctgctncttctcgtttgtaatgagagttgtacatctcgttctcggactgtgtggctgtgctcttgagacacatctcttactcccgtcatccctccatcctgcggtctctcccacgcccctccttaacttcatccatcattacatctactccacgcactcatatcctntgtacattacaatattatatactatggttcgtnattcgctgtgacggtatgnatgagtgtatacgaccagagccnactcgcgtccgcctcantcattggaggctnttgtagcgtacacatcatgtaggctcacgtgctagggttcttgatgaataggcagaagagcgctacgtacgtaataagaatagaaacttacaacacaacacgccgtatccatcaccnccntatcttcttcatacttngattaaaacaattatgctaattacatcgctagtgatcacagtacgtcgttagatttgcgtgagagatgtcctctctcgcacgtcatcgacgtgcangcagcagtagggtagtagcatgacgtgacacaagcgnttatgaattagtaggaaatggttcatcacttctcttctccagtcgcgccagtacatgcatgtatcgctcgtgcggcncgatgcgtgctccattgtggcgtgtgggccagaacgagtgcgccntgctacgcgtgggatgcgttngattagcgtctancatacgatcttattgagctcacgcgcacctgagtagtattccatgatggtcgncatacacggtgtactgtcactcattactgctgaccgtactccacgcagatgtacacatacgtttaatnattatgtatcatgtatctcctcnctaagaatacacacgctgtgatagcgatgagatcatgcgcgtagcagcagtatgcgggcgtacgctcgccagatgcgtgagtgtgaatggtagagttcggctgagtgtgtgcttgacgtacntatgagagatatgatctatactactcactagatacaatcaccacaccgcgacatgacttacgcgtgtactgtcatagttcatgttaagtcgagctggcgcggtagtctcccgtgacacgtaatagtttatgtctagtgttagcttc

SEQ ID NO: 17133 - DNA, 785 bp, Homo sapiens
  misc_feature (1)...(785): n = A,T,C or G
tgttactctgactttcttacagaattggaaaaaactactttaaagttcatatggaaccaaaaaagggcccgcatcgccaagacaatcctaagccaaaagaagaaagctggaggcatcacgctacctgacttcacactatactacaaggcaatagtaaccaaaacagcatggtactggtaccaaaacagaaatatagaccaatggaacagaacagagccctcagaaataataccacacatctacaaccatctgatctttgacaaacctgacaaaaacaagaaatggggaaagaattccctatttaataaatagtgctgggaaaactggctagccatatgtagaaagttgaaactggatcccttccttacaccttatacaaaaattaattcaagatggattaaagacttaaatgttagacctaaaaccataaaaagcctagaagaaaacctaggcaataccattcaggtcataggcctgggcaaggacttcatttctaaagcaccaaaagcaatggcaacaaaagccaaaattgacaaatgggatctaattaaactaaagagcttcttcacagcanaagaaactaccatcagggtcattttttttttaagtaggccgtgtagctcttaggtgttagtgcttatgttactccttatnaatgtataaaaaatttatatctctagaaatgatataaccaaggtaatatttagatgtgacctattggttgggatttaggcctaaatatctcagagaaaaaaatgcgacaaattcatttaactacgcaggtc

SEQ ID NO: 17134 - DNA, 262 bp, Homo sapiens
aagaagaactcattggttggaagctttggaaagaccaattacttaagagtgagatccccttgtttatggaagatttgatggcacatggatttggacaggagaatatgcacattgacgacataaaagccttcagacaaactctaatgtgacattttaaattttggtagagcgagaaaagtgttggggaaaagacagttgtttggatatcatcaggggatcagaaataatggaagaatagaaaataaaaaacagcatggataaa

SEQ ID NO: 17135 - DNA, 792 bp, Homo sapiens
ctgaacctgtattctgatggatcatccggtgccacccagatcagtaaactggctcatctgttcctgtggccgcctcccaggaactgactcagggcaagaggacagcttcaaatccctgtgattccatccctaactcaaccaatcagcatcccctagtcccttacctgccaagctatctttaaaaaaaccatagcacctgaatttttaaggaaactaatttgaggcagatcttaatataaatgtggcatgctgtgcagctggctttgcatctattaaactctttctgttgcacaaaaaaaacaaactcacgacggacgtctttacgaggaccgcgggcgcagccgcccgcccgcaaccgccggcggcagcgtgagcatgcgcgccggcagacgctcgcccaggatgcccttgatcgccttaccatttcacagcccgtaagacagcgcgcccatccttattcccccaagttaatacagcgcatccggggtccggtgaagtcgggccacaccaccgagggccgacccagcgcacccccccccacggaccactccccccattcccgccgcacagagataagtccctgcctgggggcccggcccatcacgacccgccgccgttacattccccgcgctgactccaggtcaccccgagcttgcggaggtgcccccgcgcaacgcccgcccggcgcgcgccgccaccagcccggccggccgcacacaccgagcagcaatcagcacaagcgagagggcagccggctgccacgaatggcattacgccacgtgccagctaccg

SEQ ID NO: 17136 - DNA, 227 bp, Homo sapiens
ccgaatccatgactgctgatatgaagatgcaaagacccaagattctgtgattcaatctgggacaactctgacggcccttcccagcaacagagctcgccacaggacagcaaggcctgagttagaactgccctgtaggtcagcttttccctttgcacaatgcagccttcctcatttccttatagctgtatttcccaagagcactttctaataaaccttctgcatgcaaa

SEQ ID NO: 17137 - DNA, 298 bp, Homo sapiens
ggaagaaaaagaaaaaaaaataaagaaaataaagaggagaaaactgtacattttttttctttaatttgtgataatgtttcaatgccaaagataaatgtgatgaaaatgccaaagaaaagaactgtggaatctacagcattcactgtgtttatatagagattatgcttctggttgttaacagcctccagaaggcaggttgaattatcattcactgtgctttccaatgaagataattgcgtaccctgcaaaaactagaaataattaacatagctgcagaggaaaattaaaaaaaaaaaaa

SEQ ID NO: 17138 - DNA, 301 bp, Homo sapiens
ctctatgcaggaagaacaaaggttagaggaaaatgaaacacattattattgctgggagcatacagaagacacactatgtagaagagatggagtttgagcatccaggcaaatccagactgaagttaaatgacatccaccaaacaactccaggctgtgaagaaacagacaactctcctcccacttctcatcttgctttactaggccattaaactgtgcactgaaaaagatgaacacacctccgcaggctttgcaactatcaaaacaactccggaattctcgacactgaccaacacgggcacta

SEQ ID NO: 17139 - DNA, 201 bp, Homo sapiens
cttgaactttctctcgtctacttcttacccaccactctgagaagtcaacaggagaaggatcatgctttgtgtggaggataaagatggaagttttactccaggcactacaagcgcctcacaggctcaaagggcggctttaaaaacccactacagacttgggggcttaaaacaaccctcctgcaggccccaacccccccacca

SEQ ID NO: 17140 - DNA, 378 bp, Homo sapiens
ctgatggagtctcgctttgttgctccagctggagtgaagtggcgtgatctcggctcactgcaacctccgtctccctggttcaagcaattgtcctgcctcagcctcccaagtagctgtgattacaggtgtgcaccaccacacctggctaattgttgtatttttagtagagatgcggtttcaccatgttggccaggcaggtctcaaactcctcatctcaagtgatccacccaccttggcctcccaaagtgctgagattacagtcatgaaccgccgtgcctggcccaaacataatttttaaaaggcaaatatacaatagtatgttttctaaatgagatgctctgattaaatgtggtatttagagatgcaaaaaaaaaaaaa

SEQ ID NO: 17141 - DNA, 201 bp, Homo sapiens
ctggaagcaaaatttatggaggaaagaactcaaatgttgaaaacagggacaaatagactgcagagtatttagttccaaagaagatgttcccagatgtaaaagttctgggggctgggaagtccaacgtcaaggagacacatttcttcttactggtggaaactttctgcacagtcctgaggcagcacagggcaacacacggac

SEQ ID NO: 17142 - DNA, 771 bp, Homo sapiens
gctacagtgagctaagatcaatcactgcactcaagcctgggtgaccctgtctcaaaacaaacagaaaacccagcaggatcacaggtgaatttcctcaagtgtgagcttcctgagtgccctgagctttctttcccagggcctagcacacccactgtagattcctatttacttgtctatctccaacaacagactgtgaactccttcagggcagagttggaggccttttctcactagtctcagcctccaatgtggtctagcacatggtaggtgcatgggaatgaataaatcaatcaaattgcttcatgaaatcaacataatcactcatcaagagcccttttcaccccagcctatcgaaccacatcacccacctgtcttgccaagccttccatcactgttgccttgtgtcagcattgctggagcattcctcctcacaaccccctttgccctttgcacccttgcctctcccttgatgataccacacagatgccagggccagcttgggagtcccatggcagcaagagccagtggtggcctcctgacccaaggtggccacagccctcaaccgctgaggatcttggggatgtttgacttgcccctactgcgcttgggctgatgactgacgaggggctgcggaccacacgggacaacccaggaccttgtgtgagtgtgactggacaacccgctccacaagaggccgcgaggaccacgtgcccttggggcgccgcgtgcggatgaaggggtttccggggaggcgacgtggcataccctgtt

SEQ ID NO: 17143 - DNA, 373 bp, Homo sapiens
ttagagaacccatgccttctgtccgctagctgcctctggtggccttgcaccctctctgctgctctccctcctggagttcttcctgcagggaaacctaaccaattctgaagcctgggaagtccaagattaagacgccagcagaaacagtgccccatttcctggttcacagagagcaccttctgtccgtgtccttacatggtgaaagaacaaggcaagctggacatggtggctcacacctgcaatcccagcactttgggatgctgatgtgggaggatcacttgaacccagaaggtccagatcagcctgggtaatatgatgacacctcatctttaataaaaaagaaataaaaaatgagataggaaaaaaaaaaaaa

SEQ ID NO: 17144 - DNA, 579 bp, Homo sapiens
taccagaggaaaagaacacttgaaccaaaaccaaagagactggagttttactcccagttttgcctccattatatttattgtgtgaccttggagaagcctgtcaattcttcacactcaaacgctcccatctgcaaaatgttggcaatagactagagaatcttcacaatccctattcaccccatattctttgtattctctttctttgtgtgtgtgtatgtttatgctgctcaatatgcaatatctgaaacagcttttgaaaatgtaaattactcaattgacccactaggtggtagcaaatttctggttactgtataatggcaggcttccaaccacttccataaccttctaaattctgccatcaagaagttagtgaaaaggacttttttgccttgtttgtcaaaaatcatgagttttattctcagctctgtcatttactacttgcatgatcttgggaaaatgagtattgcagggtttttgatttcccaccataaaatcaaagggagtcttgcagatctaaaactttttgcatattgataccataataaaaaacaagacatttaaacggtaaaaaaaaaaaaa

SEQ ID NO: 17145 - DNA, 839 bp, Homo sapiens
  misc_feature (1)...(839): n = A,T,C or G
ggtcttacgtgagagataggtcctctcaatattcaagagccacacttctacaggggacccctggactgcccatcagggggacaggacagaggcacaatcctgcccgtctccctggataccgctacctggctggacaccactttcactaacccatggagccaaccgtgccctgacagcaagaggccaatactcacagaaccaccaccgctgcccctctgtcagcacacagcagctacagaagactgacctttgcgcatacgcctcaacaactgaactcttgcactcatgaagcgggacgtgccccagagggcaccgtccgaccccccgcccccctacgcctccacagatgcccgcggccccccgcccagcagagcgaggaccacaccagagccaccacgcggcgccccgaccacgcccgcgaagccgaatagcgcacccccgctggccgagcgcccgccgcccctcccctccctgcccgtggcctgtttgcggggggtcccgcagaaagccccagagagaacaacgcccctactcacgggtcgccacccgccgcccatcatacaacacacgtacaacccacggacgaccccaccccggccagcagtcctcacggcgccaacacctccccccgcggccgccacggagcaccccgtccccaagtccctcgacctgtcaacatccaaccaaactgaaagaacacgctccaaatccagaccgcgcaccaancgcaccccacctgacgcccaaccaagtctgagagtgtcctatccgcagccgcacagactcctgacctgcacccaccgcagctgcaccgcccgttaggcgcgagacgcgcgaat

SEQ ID NO: 17146 - DNA, 414 bp, Homo sapiens
ctggcagctgctctaaagagcgcttgttcctaagcctcctgcacatggaactccaccatggaatctgtttcccaggaacccaccctgggaccagcccctctgagactcaagtcaacatttggtcctagggctgcaaagaggaggtgctaagaggccaaaggctactcccacctggagaacgggccccgcgtgccagctcccccaaggcctggccaggatgctctgctcggaggcctgtcctgacttcctctgctcattgccacctgaaattacctaaccaacacctttcttcctcccacccttccataaatacttattgagcatctgctaggtgccagttactgttctgcacaatggcaattacagccatgaaagaaataaaacagaaacattcctgttagaaaaaaaaaaaaa

SEQ ID NO: 17147 - DNA, 780 bp, Homo sapiens
  misc_feature (1)...(780): n = A,T,C or G
ctgagagaggacaccagcgttcccccttctggagatgctgcaatagggcgccattttggaagcagagagcagccctcaccagacaactgagcctgctggcactttgttcttggacttccggccttcagagggaccccaggaggtggcagagaccaacagagatgcacagagtggcctctgctgtgcaaaagctcgtggtggaggagcatggtgggagatgtggaagaggcactaactccagactgcagaccacggaaggacagaccagtgcggtccctgagctgggttttcaaaagtgaataagagacatataagttggagtggatgggacctcaagcagagggaatataggagtaccccttatgcatagggatatcttccaagacacccagtggacactgcaggtacaaccaaatcgtatgcaccattttttttgtgtacgcacatcctatgatggaggggaagttatgggtcaggcgtacggaaggatcaccagtgacacacgtatactagcgtcacgtcggtggaccatgcggacatactgccccaccagtttgtaccaccgctccatcatctctatctgaancctctccttgacccaacctcctgtagtctccactctgatcactctcctatgctaccttacccgcacccggtccctgctgctccctcttttctattgtctttgtggcgtccgcccccttccccctatatgcctcgagttgtgatctccatctcctatgtccttatccttctcgtgattgcaatggcgtgctcttt

SEQ ID NO: 17148 - DNA, 404 bp, Homo sapiens
ccttagatgagctgagatgagatgatctgcctgaagacagcagctacccactgcaggtctccttccacctgagagctgagtagatattgggatgacctgcctgcggaaagaagctacccactctggatctcttctctgctgagggttgcagagatgagatgagatgagatgacctgcctgaagacggcagctacccaccgcgggtctccttccacctgagagctgagtagacattgggatgacctgcctatggagagaaactaccctctgtgggtctcctctcagctgagggctgagcagacattgggatgactgtctgtggagaggagctacccactttatctcctgagagctgtactgttgctcaataaagaacctctttgccttgctcaaaaaaaaaaaaa

SEQ ID NO: 17149 - DNA, 287 bp, Homo sapiens
gcagagagtaaattgactatagagtaaaaaggcagcaatgtgatgactgaagcaagacgctacacagctggctttgaagatggagaaagaaaccacaacacaaggaatggaagaaatgcatctccagacactggaaaaggcaaggaaacagattctcccctgaagcctacagagagcatggccatgcctatgccttgatttcgaaccagagaaagtgatcttgaatttctaacctccagaaatataagaaaataaatgtgtgttgttttaagccaaaaaaaaaaaaa

SEQ ID NO: 17150 - DNA, 331 bp, Homo sapiens
atggtttgccacaaaaaaagaagaaagaaaacaaattaccacgtatcagggaagataaagagcatttcaagtctgaaattgggattggaggcccgacatgatgaaacaatatgataaaggaagcctgggttcttgataacgtggagcacaatataggccctgaactgcctatttggtttttatatggaggagacataaatttctattttgtttaggcaaattcattttctgtcacttttctgtcagacagttttctgtcactttcagcataacttaatcctaattactatagcagtcttattctagtaagaacaaattaaaaaaaaaaaaa

SEQ ID NO: 17151 - DNA, 754 bp, Homo sapiens
tagcaggatggttgtgactcaggatctctcataaaatttaagtcaatctattggctgaggctgctgccatctgaaggcttgactgggctggaggatctacttccaagaaggcgcactcccatggctattaccgtggaggcctgcattcctcacaggctcttggctagaggcctgagataattcctgagcatacgggcctctgcacagggctacctgaggatccccaagacatggcacctgcccttccacagacacagcgattcacccccgacacacagagcctcccaccgaacgcccaccaccttcttatcaaccacccttcaccccccccgcgacgcgacacccacccccgtcccgtgccctcacagccccgcattccgtgaattgaccccccgggcgaggccgatcgaccccgccgccccccacgatgggccacgcccaccctgcgctctccccccgaggccgcagctgtggcggcggcccgacaacacaacgcgcggagggcccagccccccacgccccccgaccaccccgcgcggtccaccccacaccgccgccgcatcgccctccaccccgcccccgcccgcagcacccccgggatgccgcccgtcgaccgccggacccgccgacgaggggggtagcagtcgcggcaccacagggcgcggaaacagagcagacacccacgcggaccaaatacggcgctgcgccaaaccaccacccgcccgacccaacacggcggggccggccggcaact

SEQ ID NO: 17152 - DNA, 785 bp, Homo sapiens
gatatggtctataatattgcccaggctggtcttgaatgcctcagctcaagccatcctctcacctcagcctcccaaagtgctgggattacagggtgtccctacatccttcccaagaacatatgttctcagccggatgaaatacggccagttgaagccagtcgtccattctcccatctgttccttctcttaggaaaccagggagagcaattaagatgcaaaaggctcaggcacccaggtgtcttcataatgttatctcttaaagactgttaaatcacaccctacctgtgggaagggtgaccttactccaaaatcaaggtgaaaaacaggaaaataagaagagcttctgactcatcattttggccaattcctaaaagacagccataaactgcatccttcacataaagagttgaaatcacagccagtgatttattggaccttgaacatgggccaggttatgtgctaagagtttaacagatcttatcccattaaatcctcttaactattctctgagaaagcacagaccttctctcaattacagatgaggagcctgaggccaggagagaggtgaagggacttgctcaacccaacagggctaggaaactggtcaggctgggattcaaatacacattcaaatgggtgccacacataaaggcaaataacaacgtgttgaaaggtttctgggctggatgcggtgactcatacctatcacgacaaaacttggcgaggcaccggaaggacgattgctcgacaccggtaccctgcacaccagacgtgcaaaaagacaa

SEQ ID NO: 17153 - DNA, 745 bp, Homo sapiens
ctccagctctcctctctagagttcggaagactttcaaccaatcagtcgttcagaaaataatactggatacctactaagttcaaggcattgtttgtgctatatgaacacagcaatgaacaacaattataacaataaataaacaaaaactcatctatactcatggagtttacagtcaaggggccaagagagaaaattaagaaataaaatgaatgaacagaagctgcgtgaaaggagagctgcaaaaggacaacttgacccacagagagccgccctcaccagggccctcctcccggcttcactgggtctctggatgggccagttgctcaaacaccccaacattacgccaccatcctgtaagcgctcaggcgaccggcccccctcctcctcgctcccgcccaatccccccccacccgctgccctccatccgcgccgtccccccgcccttcgtcccacccccccgttccctccgcactaatgaccacattccccccctgccagaaaccacagccggctggtgaccctccttcacccgcgcccaaccgggtgccgcccctcctacctcctcctagacgccccccgaccccgcctacctgccccccccctacctcctcctctttgcggacaccccccatccgccttctcccaccaattgctcttccgcccccccctcacctgctgctactcgctccgatccctcctcgccccgtacgcccccgctcgacccccatccgcccccggtagccct

SEQ ID NO: 17154 - DNA, 288 bp, Homo sapiens
tggttgccttaataagaagtggtccgaaggccaggcatggtggcttatgcctgtaatcccagcactttggaaggccgacgtgggaggattgcttgagtctgggagttcaagaccagtctgggcaacacagagagaccctatctcaatttaaaaaaaaagtaatctgaagtattacacgagtatactgaaatcatttattaacaactcttgacaacaggaagataaaggctcagattttatttgctcagtagtagtaaaaatagcacatttacttcaaaaaaaaaaaaa

SEQ ID NO: 17155 - DNA, 765 bp, Homo sapiens
tgatggagtctactgtgtcgtgcaggctggagggcaatggtgccatcttggatcactgcaatctccaatctctgcttcccgggttcaagcgattctcctgcttcatcctcctgagtagctggggttgcaggtgcccaccaccacccccgtctaatttttgtacttttagcggggatggggtttcaccatgttggctaggctggtcttgaactcctgaccccgtgatccgcccgcctcgacctcccaaagtgctgggattacaggcgtgagccaccgcgcccagcctgaatatggttctcaagaaccccccaatctagtctcttaccctagtgcctccctagcacccatgtggacaactttgttcaatggtcacaaggtctgagaccttcgctcacaccatggacccgacctgtcctgctttcctggcacagtacaacatagggggcgtgcatatgaactttggagcgaatggaacctggattggaactccagctctgccgcttttcagtggcaggaccttggactacctgtgcagctttcctaagggttgtgttcttcatctgaaacatgcattgttgagagcattcagtgaaacgccattagcactgccacttacggcacaggattcacgacatggaagctgacggcgagtgtcttggcgaatgctatcgccttgttagatacagttattgtggcccggaacatgacgggcggagtacgcatgggcgggggcggtggctcatggtgggcgcactgaaaggtggg

SEQ ID NO: 17156 - DNA, 306 bp, Homo sapiens
atgggtcggtgcagcctatgacttattctggtcaatggaaaggagtcaaaagtgatgtaagccactcaaaggcttaagtgtcaaaccttctgcactatctgctacccttcctctgtttcttggcctgctgctcaaatgcagaagatctaatgaagaatttcaagcactagcacattgaagaaccactagatgaaaagagcctatagtgccaaacagactgtgtagcagagatactttttcagaacttcatttgactgatatgtaaaggagaaataaatattgtgttaaatcagaaaaaaaaaaaaa

SEQ ID NO: 17157 - DNA, 464 bp, Homo sapiens
tggccaggaagaatgcagagaagagatgaggcaatttgtacaaaggacagcaactgtatccatgtcccagaaggaaatctatacaaccttgaatggagtctcccactgtcacccaggctgaagtgcagtgacacgatcttggctcactgcaacctctgcctcctgggttcaagcgattctcctccctcagcctcctcaagtagctgggactacaggagcgtgtcaccaccccaactaattttttttgtatttttagtagagacgaggtttcaccatgttggccaggctggtcttgaactcttgacctcaggtaatccacctgcctcgtcctcccaagaagttgggattacaggcgtgagccaccatgccccgccatgttttctttatccagtccattgaagggcatctaggttgattccatgtctttgctattataaatagtactgtgatgaaaaaaaaaaaaa

SEQ ID NO: 17158 - DNA, 576 bp, Homo sapiens
atgagttctcctctaacatctcccgaccaagacactggctgaggtcacaactcccggtgtccaagatggctgtggatgcaaagaagcctgctgactagcagctcctcctggagggttttgtgatagtaaaggtgaagtttgaggaagaccacctcagggattaggatttttaccttccagagaaccaatctcttgcctgggagaccttcagccagcagtttagacactgctgctgctaggattccttaggaccctgtctgaacctgaaaattatgacatctagcagtctctggggtgcaatgttcagtgagaacattaagcaaggctgattttttcttttcttttttttttgtcaacatgagagtcactatgaaaaggcttatccattatgagactcaatggtattaatctcttattacataaggaacacctaggtgccacattggagagtgagtctgcatgggtaataaattgctgaaaaaaacaaggatttacagaactttatttgtgattggaccctattgggtgcaatgaagtgtcgatgcgataaaacagctatgctgaaaaaaaaaaaaa

SEQ ID NO: 17159 - DNA, 236 bp, Homo sapiens
ccatgatggagcttgtctgaagaggtagagtgatcaccttccaggtggagggaaggggtctcattatgttgctcaggctggactcagagactcaaatgcctgcgctcaagggatcctcctgcctcaccatctcaagaagctatgactacaggcgcatgccccccatccagcttaatcacacatcacaccgctcaccacaaggataccacactcacaccccccccccaccgctgttt

SEQ ID NO: 17160 - DNA, 201 bp, Homo sapiens
catgatttcatcatgtgacaagatttctaggacctgagcactacttgcctgtccagtgccatgatgacatctgagtaattggatatgtctgtttagccacaggctccaacactcataaactctgccacactgactgcatacaatcttgactcggccattatcactgacaactgagcacaacccctccactaccttgacgaa

SEQ ID NO: 17161 - DNA, 187 bp, Homo sapiens
gctgaaaggtagctgactatgacctagatgactgcaacagcctacaatgaagtccctctgcaaacagaagcaataggcacagtctgctcctcctaaagcaagtccacatctctaccccagaaaagagcaaactatttacaactatttaaatacagccttttcatcttaaaaattaaaaaaaaaaaaa

SEQ ID NO: 17162 - DNA, 792 bp, Homo sapiens
gcttgctgaaacacaggcttataggtaatttggccttctcctacactctgcaatcagacacccatcctctgccttgtcaggaaggtcctgaattccagcaaaacagctgaacagctgatggcaagcagtttgaagacctccacagaggaaccaaatcagcatgagaatacagtttcttcatctccctcccccatgacttcaccctgcactcttccatcaatcaacaatctccactctcttaaaaatcctagcccagaactccttggggagacagatttgaggctccctcttatctactcattaggcaggcctataattaacacttctttgtctgctgaaacctgaagcattgcagaactgacttgccacccaccccccaccgcacctcacacaccccccgcaggcccgtcaccgccccccccgccccacccgccccccgtcccccccacccccgccgcctgacgcccccttgggacgcgcggctctcccattcaccctcacggtcgtcccaccactgtatcgcacatgacgaagacaccaccaccgcccactagagtgggccaccccacttatctcccccttccctcctcctctaaagcccccttcatccaccccgactaacccgcagcctagcgccacccggcccgaggaccacccataacccccacctgctcgtcggcgcggctccgacggcggcccgccaccgcggcggggcccccccgggcgcccgaagacctgaccccccccccgacgccaacgcccccactccgttggcgaggcaccggcgtcggg

SEQ ID NO: 17163 - DNA, 752 bp, Homo sapiens
ctgaataaacttccttagaagctcttgggctgcccagaagagatacggacacataaatagaaatcaggacattctcaggaaggagaaatggggcaatggttgttggagaagacaatcaacaatttctactctaatgaagaatagcataattgtttttcaattttattgtcaattgttttttacaattgtttttcaattacgctatataaataaggtatataaagggcatacctatgttatgtacattttagcaggattaaaattgagctaaagctgtcttctaaacataaagcgttacattttagcgcatagcctgtattactctgaataacacattcaaaggctcaccattttccctttggtcaccaatcccccacttacaggactaactccccacgaacaacattattctgaacccacacaacaatgctcgcctaatcccacacccctactgccttatcccctgatttccccgtctctcccttttccacccctccctctactaccccaccccaccccccattctcttccaattatccttcttctgtcctcctctctcttcctccctctcccccccctattcccccctttgcttcccctactatccccgattctcgtccccacaactccctgacgacccccccccccctaactccaaatcccttgctcccgcccacccgatggcaccccgtgccgccctatattccgccccccctctcccgcaccttctaccggcgccggacccaccaccc

SEQ ID NO: 17164 - DNA, 412 bp, Homo sapiens
atgtttgtaaactgaggcccagaaaggttcagccatctgcctgaggtcacacagccacagtttggacctgagccatcaatcatccaccaaaagcctgcattgaccctagaagattccattgcatgttgtcaaggcgcttagtttctctcttgtgtctccccaaaacataaacctggaatggaagagagccacttactctatagatgcttttagctcagaacgcttcaagcttttggagtatgagaaataataacaatcattccattctttcctggagtttgatctcagctgttggtaatattgttgggactgatttgctatctataaagccaaatttgagaaaagacaggttaaaaataaacagggaggatggtggcagtaaaaaaaaaaaacaatggcctcgctggcctca

SEQ ID NO: 17165 - DNA, 778 bp, Homo sapiens
catggagtgtcttatggtccaggacatggagtatctttgtgaacatcacatttaagctgagaagaatgtgcagtctgccgtttttggatggagtattttagaaatttgtcaatgagatcaagttgattgattgagagtgccattcagggcagctgtatcctgactgattttctgtctgcttcatctatcaagtcctgaaagaggtgtgttgaagtcttcaactacaagagtggattttgtccatttctccttgaatacatcagcttttgcctcacatattttgctgctcttttgctcaaaaataatacagctattctaacttcctattgatcacagctacccaggccgctctttcctcataccttcgctcttaccatatcctcacctttatatccgccggccaacccccccttattcacaccatcccccccccccatcctttccccatcacctcctctccccttttctctcgcattcctcctcactcccccgctccgtgccatccgccccccgggcaccccttgcctacccccatccccccttcccccctctcccccctcacccccaccctcccacccccgcacttctcccccctgttgtatcccgaccccacccccgcccactgcctccccgcaccttcctcatgcatggatcccccgttgcactcgctcgacgacccacaaaaggcccacgacgggcgggtcaaccccgggcgccccaacttggcccgcgctccgggcccggcccccaacctgcgggggggggcccctctaccgcg

SEQ ID NO: 17166 - DNA, 793 bp, Homo sapiens
cagagcttcaggatttcagaagaactgaggagttcctctgtgtccaggttgctgtctggtctttgacgagaacctgggaagtctggaccaagcacatacttcctggcaacagcctcctaggacagcctctcatgctgccccatggacaatgcatggcaacccagcctgccccagcgttgctctcaggccttgacccgtgatcacttgtggatacttacactcagcccccgtttgtcatctgtgctttctacaatgaccacatagctaaatgtttccttgaagcccagctcaagtattcctttgccgtgtagtgtcacccagccatggaacaaacctgtataatgtcacccagccatggaacaaaccacagtaaagtatcatccccacagaagatccctgtgaacaaacaccacactctgtgcctaaacttcaggacactagacgttggctaaaatggaactacatcatggcacaaccgtgcacccacccagcctccccttcacagcgcacctacctcctgcaaccgcgtcggaccaacccaggacataagacggaaagcgacgcttgcgtgccaaccggctaccccagtgccccccgttccgttgtcagccgccgccccagtactgaccacccccgccctcttactcccggcaccccctcccctgtgcgctccctcaccctatctacgcgcgctagacatcccgcacgcgccggccgcgcacccaacatcccgaccaatgatcactccatcgtcccacaaactcccgtacctcggcctcggcgacctcgtcgg

SEQ ID NO: 17167 - DNA, 922 bp, Homo sapiens
aactgaagctggcattcctcttccttgaccccatggccctcctccttctggctggctatggctgtgtccttggtgcctccagtgagaacctgcgcacctttgtggactgagacctgagggagcccactttcctgccccaaccccatcctcgacaactcccccctatccctaaccataactgaagaaaaactacccccaaaccattcccctcctcatcctaattaaacttcccgctccctacctgacccacagcacaacatccttctcccctcccccattctatccaccacatatcacttacccataactttttcactaccacagatcccacccattcatcatcaacacatctataccatcaacactacccacactgtcatcactccaaatcacacccacacgcctcacacaattacacccctcaacccaaaaccccactacacccacaaaccaccgccaaccatccacacagcgcctaggcgctgcccccccaaccgccccactcactctaatccggtccctacccacactccaccaattttctacacacaccaccatcacttctaaccatacaccgtatattaccaaatactacaagtcctcatacttacattatccccctcttttatacaagctaccacacccacccacctctgatacaccacgtacactctctttaagtaacacacacacgcacaatatactctctttccaacgactaacattttatactacacaccgaactatccagccctcatctctgacttatcctctataccaccgtacgatcacccagagacactctcaactatatgtagcacttctccgctcattctccatcgatatcacagcacacttgactgacaccacataactacctcgcacaaacaagtcacctcctcacaaataacaacaacaataa

SEQ ID NO: 17168 - DNA, 781 bp, Homo sapiens
aggaccaccagagaattaaatatgtttatcaaatcaattaccttggatgaccaacttctacatgacctgccttcagcttctccatgtcagtcacctacaatcagggcatacctgaggccatttgattttttctaccgtaaatattttctaccttcctgcctgctttcaagtctctgaaaaattatgcctggagaatacaccatgatgccatcggtgttatattctaccatggaacctggttaccaactgggatgtggtacacatgcaggcaccctttgacttgttcctcacagcttgatgagtcttgattttcatgataaggcaggaccagatctaaacttcactctgtttgcatgaagatacttgcctacttattcttttctcactggtatccaggaatacctgagactggggcatcatatccgaacagaagcctcatcgtctgacaggcccaccctgctgcgcaggctcctctaatccctcatcccccccactgcgcccacgcccatcctaccccgtcctggcgagacactgcctgataaatacccctgtgtcccaccttcacccacactccgcaacccataatccaccctcgccagtgaatgctccaccgaatcaacggccactccacccacgttcaccctacctcctcccctttcagacaccgccccatcgtcgctacccgcacagccccgaccaccataccccaccccattcgtgatacacccccttccaccccccataacccacacaacttatcgctcctccagtccaaccgccg

SEQ ID NO: 17169 - DNA, 802 bp, Homo sapiens
agagatggggtctcaccgtgttgctcaagctgatactgaactctggcctcaagtgatccccctgcctcagcctcccatagtgctgagattacagcgtgagacaccatgcctgaccttcgatactacttcttaaggaatctaggtccttctgatataaaaattcctcccatttgtttgaggaaaataaagacagaatccttcaaatatcttgaaaaacaagaaatgtatcttgttatgcattattctgaacaaactgattagtagaaaaagcaaaactgtgtattctttgcatgattatccacaaaaggattagcaccatataataaaagctttattttaaaaaaaaccaaaccaaacactacgtgctccccccccccctttcgtgccggcccatgacgcccctcccccgccccccccttgccccgctgcccgcacccgcatcaccggcggcggggcgggctaaacccgccaccagcctttccaagggcacgccgcacccaccctagagtatccccctgcataccccctccacaacaggcccttacacatacgctacacatgaacaagatcaataacgccaccccctcctacccctaatcaccccacccccttttcaacctccccaccaccttgctcttaacaccaccccaaggccccccgctgctccacccccccgtgatgaccaactcaacatccgccgcatccaatccctcctcagcatcagccagctgccccgcaccaattcaccctccctaaccctcatactcacaaaactgtccagccctcgcgacaccacaccacc

SEQ ID NO: 17170 - DNA, 764 bp, Homo sapiens
atgaggaaaggccatgtgaggacataagaagaagctgctgtctacaagataggagaagaagcctcaccagaaatcagtccggctggcaccttaatcttggacttttcatttttagaactgtgagagaataaatttttgttgtttaacactcatagtctgtagtcttatattatagccacccaagaagactaataatattactaatattacagccaatttccttaaagataatgtttttaagaaccataattaaatgcttgtatatatttgtgtggaattctcttttttgccttggatagttgagcacgtgcgggacactcattttacgcctgttgttgctgtttgttactcacctactacctgacagttgccgccctatgctgaagccttgccccaaagggccctacccggcgacccggcggacgcggcgcccgccccacggcccgcgcgctccgctgaccccccccccccgccaccccccggtccccgccgcccccccgtggccggggcgcggcacctgctacactgcgagcacaccgtatccacacccgcgcagccacagccccagcacgccccaccctttacccccctcgcccgcttgtcgcccccccgccagtgcacgccagactgggcccgccacccccaccgggggggtaacgccgccatccaccgcgcccaaaagcaaccccgtaagccgcccccccgccgaagcgcaccaagaccccgcatgtctccacgaggcgtcgcccgcccggactacgtcg

SEQ ID NO: 17171 - DNA, 597 bp, Homo sapiens
ctatctcttaaaaaaaataaaactgttaactttgttataaaaaatgcttacctttaaatatttctgtaactcagcatcatctgcaatctatgtgtccaaagtagcaacctaaatttacaaaaaaaatttccagtgtttgtaaaagcataactgtatttcctcctacgttttctgaaaatatctgtaaaacttatatattgataactctatttgacctacattccgatacctttcttatatttttgaaatctataacacataatgtgaaatttcagagcatattcgatttttttgctgctgccctccccaaggacctttcttagtacgcacgctaatggaggacaacgccacgcccccatccgcggcctacctctacacccccatgcgccctccctttcgaccccccgcccccgtgttaacggccccccccaacacacccgctttaagcacgacacccatcaacacacacggctggattgcactcccccgccacacgctgcccaccgttcgcctgcatccttgccgcatccgcgcatacctccacgagtgatcaccaaaagcaccccactccagctcggccaatccgtcccacccttt

SEQ ID NO: 17172 - DNA, 799 bp, Homo sapiens
tggttccctgtgtctggctcttggttctcttggctgacaacttgatccttcattcctttgatccattcccgtattgcccctctgatttggaatacacagttttatttccagctgtgaccttggctgctttccacaaagactccgacttgccagcatggctctgctctctctgatccagcccgctgaactctccttggcagaccatagcctctcaggtgggatctgcatgctactctctgatgaagtcagctaaccgcccccatgacctacttctatcatgaaagacaagcttctcagctccaaaagaagggtatcaatgtgctcccgaatcacagaaaagagacacggcaaatagggcaagaggagcaaaaactcattcattgtttcctgcttaaaaaatgagggagggacatatgggaggattcaaattggagcgagagaaaaagcggggggaagctgctctgctcgccacaacctacgatatgcgattgcctgcggatgcccacaccacactaatactcctaatagaatactaccagaagggacctaacactagcacggctttcatcccttaccagtccctttgacaactcccggctctattttatcttgacacctacgaaacctttgcggcctgcggaccgtgaccactaccatccccgaccgagacgaggacgccccccacatcaatcacagctcgcttcatagcgcacgaccccttgaaagacggagctcgcttcacgttattcccctgcggcgccacacctggtatctgccgcagatcggggcctctcaaccg

SEQ ID NO: 17173 - DNA, 771 bp, Homo sapiens
atgctggtggcagaagagcacttggcaatgaatctgtatggaggattcagcattgactcctcctttgttccctgatggagtctcactctattgcccaggctggagtgcaatggcgtgatctcagctcactgcaacctcggcctcccgggttcaagcgattcttcctcctctgcctcccgaatagttgggactacaggtgcgggccaccacacctggctaatttttgtatgtttagtacagacggggtttcaccatattggccaggctggtctcgaacttctgacctcatgatctgcccgcctcagcctctcaaagtgctgggatgcacacggcctatgtaccacctcatactgataataaaagaatactaagaggttttgtttgtaatttctactttattccttcatataaattattgtatttcataacatttgtcagggaactctcttaggcttaataatcattaagaataaattatcttgtagggcgtatgatggctatgatacccatatggctttaacaagctttatcaaggaaatgaaggaatgatgaagaggaagaaaaatgggctcgtttggctggtggaggggactctgggggcggtacgctttagagagggctaatagatgatcctcggtgaatgacgtcgtgagctcgatcgcgtgggtgcaccaagcgattctgtacgcgtcatggcagggtcgaggaactccgacgtaggggtggtcgccgccccgaagactcgcttaaaagagggcgcgccgggctcgg

SEQ ID NO: 17174 - DNA, 286 bp, Homo sapiens
gggaatttcatcccacgacacagtactgtccagagacagacatcccatcatgatggagcaaaccaaggttcaagaaccaaactaaagccatcggcctggatcagctcaattacttgcctactctggacctgagcagctgtggataaaaacaactggagaaaatcactcaacagacagactcaatttactttaaaatatgtgatttcaaacctcaaatgtccaactcctggctactgcactatattccctaataaacttgctttcccaaactccaaaaaaaaaaaaa

SEQ ID NO: 17175 - DNA, 388 bp, Homo sapiens
  misc_feature (1)...(388): n = A,T,C or G
agttcttctgttatataaaggaaagatttcaacagaaacttatgaaagaagacaggtcaaaaaaaatcccttacttggaagttaatgtgtgatgccagttctgagcganacaatggcttttaaaataacttgcataagcccagaagtctatgtaacaactttatgaaatgatccggggtaagataaaagaagcattcaatcaaaatctaagaataaagccaaggttaaattaagctgtgtttaccagaagttatgaattaatgacaaaggtatacaattttatatttaaaagtatatatattactttaaatattttcttttaaaaaagctttgttacattgtttgtgtttaaataaagaaactttttatgaaaagaaaaaaaaaaaaa

SEQ ID NO: 17176 - DNA, 494 bp, Homo sapiens
agggttgctttcagctatgtaacgtttttcgatcccatgagatggaaatcgaccagtgcttgctagagtcccttccccttggccaacggcagcgtctagtgaagcgcatgcgctgtgagcaaatcaaagcctactatgagcgcgagaaggcttttcagaagcaggaagggtacctgaaaaggctgaagcatgcgaagaatccgaaagttcacttcaacctcacggacatgctacaggacgcgattatccaccacaacgacaaagaaggtacatgataagaaagaaggacccgttttctgatgtgatttttcatgattgatttttgttggtttgttgtttttttgatggagagatggggcagaaaagtccttttaaatattggaggctactatcttttaactgtttgtattattcaagaaaaaaatgctctttgcaaagaacatcattaaaagtcctaccacctagtaagataaaaaaatgtaaaaaaaaaaaaa

SEQ ID NO: 17177 - DNA, 195 bp, Homo sapiens
atggatccttgaaggcagagactgtgttcactggtgcctcctctgcacctagaatgatgtctggcacccagtatacacatgatacatattcactgaataaacgaatgaaggaaatatctatccatctgttcctgacctagatgaataattaatgcaattaataaaacttcagacatttcctcaaaaaaaaaaaaa

SEQ ID NO: 17178 - DNA, 545 bp, Homo sapiens
cagaatccttccacacataccgtacttatggtgaagggatttcagatataggatgctattctcagacggaaagactacatgaggacataacaagaagatggtcatctacacgccagggagagaattcttaccagaaaccagctgtgatgaactttagtctgagactttccagcctccaacactctcagaaaatgcatttctggtccttaaaacacccagtcagtgacatttgttgtggtagtctgagcagactaagaaatccactcttttgccctttgctaacttctacagtttaatgtaaatgccagtttaattgtatcaaccaaaaatttccatggctattttttttaaacatgtgttttccagtcttaatacattaatacaattcagattctattatgtgctaattaaatttagatgatttatatgatggtcttctgaactacttctcaaataaaagtagtacatcctccttattagagttctgcatcaatgatgtctttttaatgccaaataaaatatatatttattcaaaaaaaaaaaaa

SEQ ID NO: 17179 - DNA, 634 bp, Homo sapiens
  misc_feature (1)...(634): n = A,T,C or G
ttattataaatgttgacattttaaaataaaatccctttcaatatactcaattgaatctacacactgtaacatattaaatactatctaatgcctgcattcattttaaaagtacattaacatgctcctccatgacagtcaatttttttattctcttttatcttttcatttgtatttctattctgctttccattatattttccccactgatttttatccaaatgtaatatattttaatatttgaatgtcttttattggttatcttggcataattctttgcatcaaaaatatgtgtgaaaatggaaatttgtttttttttttatttttgtggccataaagtactaactactaatagtttctgattgaattataattataattactaacacacaatttatcaaaataacataatcacattacaaatgctatttagtaacgattagacattaaaatgggttttattagaaatatatctcttcaagaggtttatgaggctttattccccttggatgatttttagttattgctacagtgctcagtatcaatttttttgtttgtttgtttttgttttggtttgtgttttgttttgaaacagcctggtgacagagtgagagtctttctcanaaaaaaaaaaaaa

SEQ ID NO: 17180 - DNA, 695 bp, Homo sapiens
aaggttaaacaaattcaaatattccactggtgccagcttttctggttttcttcatataccattgttcttgcatgttagattttatggttccatttcttcaggtgacctaaattagtggctcttgaccctggtttgcaaagagaattgaaaaaatactgatgcctgggtttcctacgaaagtcaacaaaaagtgtcacggcgattctattgtgcagccaggatgagccccaggtgcctttacccaccttcagcactcctcttctgcatgcagcatggcaagcttgtcctcaggaaaataacctgcttaagtcactctagttccttgattctaagatgccaccggttctgagatatactatagattgaataacagctttttgattaaaaaaagaatgaacaaaaggccaggcatgacgcctcatgcatgtaatcccagcactttgggaggccaaggtgggcagatcatttgaggtcaggagttcgagacgagcctggccaacatggtgaaaccccatctctaccaaaaatacaaaaattagccaggcgtggtggcggacacctgtaatcccagctactcaggaggctgaggtaggagaattgctcaaaccaggaggtggaggttgcaatgagccaagatcatgccactgcacaccagcctgggagacagagtgagactccatccaaaaaaaaaaaaa

SEQ ID NO: 17181 - DNA, 311 bp, Homo sapiens
aggtgcctcggtatgggaaacttcctaagatgttgttttggctgtaaatcgtgcggccctctcagagcaatgcatttgtgtgatttgcccaattatgcatgagtacagtcagcatggaaatccagttaactgcaaaatcacacctgtgagctgaaatgtgcatgtgtattttacagggtggaggatagtgaaggcagattcaagcgataatacatcaggtataaatcttctataaatgagattggattactgcagctgataaacatggaaatgagtaattaaaacatggtgtgtaaggaaaaaaaaaaaaa

SEQ ID NO: 17182 - DNA, 532 bp, Homo sapiens
  misc_feature (1)...(532): n = A,T,C or G
aagggtggaatctcactcttgtcacccanagtggagtgcaatggcgcgatctcagctcactgcaacctccgccttccagtttcaagcgattctcctgcctcaacctcccgagtagctgggattacagccgcctgccaccacacctggctaatttttgtatttttaatagagacagggtttcaccatgttgcccaggctggtctcgaactcctaaccttgtgatccgcccgcctcggcctcccaaagtgttgggattacaggcatgagccacggtgcccagcctcaagtaacttttaaggcaacattttatttaaaattctgcctctttaactttcattttttttttttcgcttctatagttttttatttgcattcatttaacacacaattttataatttacacatttttaatgtcttgaattattcctttgagttgttatataaaaatttacctagttgttgaagtttagtttcctatgtttttcattttagttcataccgaaataaatatgtttgtggaaaaaaaaaaaaa

SEQ ID NO: 17183 - DNA, 687 bp, Homo sapiens
gactaaaatctcaagaatatccgagtggagatggggtacctgagcagctggactcatcacgctggatatccatgcagccggaataaccatcacagtgctggcgggcctgtatacagctggtgcaggatgcacacaccaaagctccattataacaggttttgttggctgcacaaaaagaagagagtaatgatcaaggacgccagcgtgacttttttttgtcccactgaattctcacaactaacgaacacactacagtgaattatattactctggattttttctaaactgatattccataacacagacctttttgactaataatccaggcggattaacttagaactgtttgatacaccaaccacatttgcctgaataatcacttcgcagatgtgccttattagggactgaattgcgtcctcacctcaacattcatatcttgctaccctaacccgcaccagggctgtattcactgataggagctttaagaaggttacagaggttctaagaagaaagagacatctgggacgctgtgacgtacaggaaaggctccttgattacacaacaagaaggctgccctctgtaaaccaaggagagagggcttatgagacaccacacctgcctacacgtggatcttggactcttaacctgcagaaaagggagaaaccatattctgtggtttatctgaga

SEQ ID NO: 17184 - DNA, 1317 bp, Homo sapiens
  misc_feature (1)...(1317): n = A,T,C or G
tttctttctcgttcttccatactaatcatatttacacataacctaatattattcaattattctattacttcccactgtacaacaataaattatctcgcttcgacaattaaaaatagaaatatctgtgctcgtccgtatttcaacagtacgaagatcatttaacgccttatttctattacgcttatattctctcgctatcgagaatatctgcggtgtagatgtatatattcgtgtataaacttgatagcgtatcgcgcaactcgtagataatttgctatcaccgcgcaatttttcataatctccatttctcaaactacccggcgctccgtgcttattttatataagtatacataagtaatatacattaaacacttttgtcactgtgtattagagtcccgcgcattactaggtcgacgacatttagcagcgccgcatatctgtgatatttattattataacgatatcttatgatcgcaccttatgacaaatcatccactaacactgctgattatattaacatctcattatttccacatatcgatcactactatttacaagactatacgtcagccgtgcgttattagcggtcatacagtgttacggtctgcttgccgctccgcagactatcttacgacgataactgatccgcggcctgtgtggtgttacatattgagtgtacttatatggggcccgttcgagcgcgtcatccatgactagcgaaaaggcgacgccggctcatcggccatttggactgcgttaatatcggagcatgacgaatacatactgtacacgttacgttatatncgcagctaccactatatactttgttncagtttagcaactataattagtgcgacgatgatacagtgtatatatattacttatgtatgtcactgacggctacctattagagtatgctaaatatagcattcgcaattaatataacattaccancacattatatatgatgtgatatttctaccaggctgaactacatatatgatctcatatatcatctgagtctcgcgtattagtacaatcacggaacagttatcacgtgacatatccaatattagtcgtctcggagtccgatgttaggtatctttgttcactatcatattcaggcctaattgtcctctattgtgcttctgatacctctcaatttccgtatattccacctctcttacattctaatatttacgtactcgtccacgtgatcctccgctccactttacaatattttgttcagacgactcatttttatctataggcccgcgtcgttctcctttcatcagccatcgtagtattcacatatct

SEQ ID NO: 17185 - DNA, 1422 bp, Homo sapiens
  misc_feature (1)...(1422): n = A,T,C or G
agttatgacaagtaggtcgatacgtccataattcttctaggtatctgcaaagtctgcacgtgtccgtctgcgagtatnacgacgacgatcgcgctaaggagatatgcgaaagagggagagagcacgactggaagacggccacacgccatacttagtacgttatcacgaggtgagcgaatctacacgagtatattatgccgcggagagagagacgtgcctatcacagggaatcagcagcacgcagcatgtagagcaccaagacggatatcacttgacaggataggcataatatactattaatgtagaagtattatacggcacggaggctacacgacacaggagnatagacaacgaggatcgacgccgcgcggattgaggatttgtcgcgcagcgcagggagaaggagatcagcatctatccgagcaacgcaacagagagttcggaaaccgacgagagacgcgcacgcgccagaagagtgtagagagagacgaccgngagcangacggnccgatatgctgtatgtgagtggaggcgagctgagagacagtgactctcgagaggtatcgagcgtcagatcactaatgatattatatgtcctcccagttatgtcagatatcgctgcaggaatatatcgtcgacagagcgacgactctcgcagtgtagtcaatgtatactanctactgcagatgtgaggatccgcaaccgtgtaactgtgtgtgagcgctacatctgcggtggtaagagcagcacgccgagacagaagtacgcacatgatagtaagtcaacatatacatacgactcgtgcgacgcaccgatctagccttnacggtaggatatcacgatgcccgctaccgccgccataactgcgcgcacgtctcaacggtcacgtccgagcaatgacgtgattcagtgtcagagagccgcattgacgcatcatcgcgacaacgcgacgtacacatacgtgnctgacgcgcacnatatgctgacgctagtatctgacaccccgctgtgtcgcgactcaactacgcagaaaccccacgcccacgctcccgagagtgcgcgatgataatatacgtaagaacagcaccatgccgagtgattcatgctgcctcgcatacgccggacatagcgagacggtgcagagagacgcagattaggatgntggtagagccgcacatccgtgtcgcgttgatacacttgcggcacgcctccncgtcntgttttgantgtctagcgctcgcacgtccgcgcgatatgctaatatatcgtgtgcgtcgtacgncatgcatagtagatacaacagtatacacgncacacctgcncnangcatactatacatgacgangattatacgcagaagcgtcgaagcgatcagcgcgagtagtcgtgcggtagcgcactgtacgcgacactcgcgtatcg

SEQ ID NO: 17186 - DNA, 258 bp, Homo sapiens
ctgatgcagtcccatgctgtgagtgagtccgaggagccttatgggaaagcacaggactgaactgtgtgaccaacaagatattacagaaataacagcgtgtgacctcataggattaaccatcatcatagctggggagaggacagtccatcccgccatcatcaaaacagaaacgtttcatgttgattacagatctagattcagcatatttgtttttggaacctttattaaactctaaaggtttctacaaaaaaaaaaaaa

SEQ ID NO: 17187 - DNA, 1291 bp, Homo sapiens
  misc_feature (1)...(1291): n = A,T,C or G
ggacaagagaaccagggcacgaggcaagcgcgggagcggagaggaaaagcgttgaaaagaaaaacaagagaaaaaaccccttggaagggggcgaaaacagcgcgcggaggcgcgggagcagacgggcgaccggaacacctctccaggggggggaaggcgaaaaccccccgggcgcgaaccggagcaggcccggagcagagaacgcacgcggcgagacgccgagcgacagagagcggcgcgcagaagcgcagaagcggagcgcgcggcgggcgcgccgacggccangaacgagcgcgacagggcacgcagcgcgaggaagacgggcgagcgcggcgcgccgcgcgccgcccaccganagcagggagcggactcttgggacggaagagggcggacagaacgggcgcgcggcagacgacggaccgaggacgcaggcagcgcattacctggcgcggccaggcagagagactcacgacaccggggggaaccgagacgagcccagggagcgccaacgcgcgacacgcgggcacgagcaccgccgaggagatatcaaggccagagcgagaggagacgacgcgagagggccgaccgccgcgccgcgcgccgggaaacgccgaccgacagggcagggcgcgaccgagcgggggggatgagcccggcgccgcggagcggcgggcgcggcgcggagggcgagcgacgagcggagcgcgaaaaggacgggncgcgggcgcgggccgggagaccggacgcggccgacacgcgagcgcacgagacgcagaggacaaccgcgccaagacagagcgggcgaacgcggaggtggccgcacggcgcacacgcagcaccacacaagacgggccacgcggcgcccgcgacgccgaacccggcaacgccgcaccgngcaaccacacggaggcgcgcccgccggccccgcggcagggagacgacgcacgccgacacgcacaaagcgacgagacgaccaagcacgggcggaacgccaacgcggacggaacagcagcacacgagaacacacagcacgacgagacgcgcgcgtcgcgcaccgcgacacgcacacagcnaggcggcggcggcgcacggagacggcacgcacgacnccgccccacgccgcaagaacacacaacacagataccacacagcgaagaccacgagcgcgccgcgcgcccaccgcagcancaccgagacggcgcgcgaagcggccagcacaancggcgagagcgaccccgcgcgcggagaacaggacaaatatgagagaaaacgcaaacaagacaacaccacg

SEQ ID NO: 17188 - DNA, 828 bp, Homo sapiens
ttcttcatcatgaaagaataatatctggcttcttgaatagtttcatggtgccaccaacaaaaactatcatagaccaacaatggcaagatggcatcggcaagaatgagctggtatgaagaggtgctcaacccatcccaccaccatgggaaataatgtggaagatacaccagagagcttgctccctgtcaccactgttgtgaggacttagtgagaaggcagtggcctacaagccaggaagtggaccttcaccagaacccgaacatgctgggaccctgatctcacacttgcacgcttcacgaacgtatcactcttattattgcgcctgtccgaactacaccccgcccccctggccttgactgccgctgccagaaagcacccctcgagcccgtctgcacttgaacgagccaccaccgcaccaccaccgttgcctctgaatggttgggcctggcacctcctcttgggctccctcggggacctccctcgcgtgcctccccggccgctcgcccaccgcgcacctccactcggcggctcgcagggagagcaaggcgccagcgcacgccccctcctcttctgcttcttgatattcatcaccgcctgttgccccacctgccctgttttcacccctcttggcgccgtggccccctcccgagcctcacaatccgcgcatcgcgcacgacctcggagcaactgtggtgtaccagccccccgctcctaacgtatatggtcctccccctcccccatagcttatgcccctcgcccgtcaccatatgcgcgctgtctcttagattcgcctcctatccgatactgtggtcccgctcccgcactcgg

SEQ ID NO: 17189 - DNA, 1775 bp, Homo sapiens
  misc_feature (1)...(1775): n = A,T,C or G
aagtggaatggnnnanangngnnnnnnnannaangaggaggnnnnagngnnggggngtgagnnanagagggnagagagaagggaangnnnnnnnnanngnnnnnngnnagagnnnnacggnnnnanannnngaggaganagggcnncagaggncnnaannananacgagncnaganancaggnnaggcgnncataggcgacaggcagcancagggaggggnnacagangggcggnnncacgaaggaggngcagatgacagcggacgggaacagncagaggagggaaggcgaagcgaggtcgaggagagcgtgagagaccggaggcgtgtatgtgtctgcggtgagtgcgatactatgtgaagtgttcgtagtgangtgtgacatggtggagttcgaggagcgcagatgntgtgncncctcacgcgaagtggattgaggaggagntgagagttggaacgtggtttattgatagtataggtgtattntgtnctgtgtatctagtagatgtagtgagtagaggtgtngtgtcgtgtgttggtggaggtgaggtgtcgtggttgtgatgtgagtggtgttgtaatgcanttggtgtgnataagatagcagtcgntgtgcgtagctgcgtatggcgngtgntggacgcgttcgcagcancatggcgccgcgcnagaggagaggggaacangtcgagtgtagtgtggtgatggctgagtgttaggtagtagntgtagagataggcnnacaagagtgtgcattagagtggcgtcgtggtgagtggtggtgacgcgcgagaacnagtgttcgtaggcacgtagccactgcgacgcgagtgactgcctatgcgtgcgtgccaggctgncagacacacgaggcagtgggaagtcagatgccgcagagcggtcgnaggagtcacncggcggagcatcgtagcgagatgagagcgcgcgcgtcgcgcgagacnaagggagacgtactacgatctcacgcgcacgagtgtgttcgtactcatgtcgccgtgtgtgtgagtgatgtgngagtgtgtagttgcgtcgttgatgnttgatgtggagtagtcagatagacggagtagatgatcgctnagcgagagtaagacgatgagtnggtgagtagtgaggatntatacacgtagagagtgtgagagtagtgagtgagattgntagnnnancagtgagtagatgggagatgaggtttntagantnagagaggaggttgtggtgtcgcgtagncagtggtatagtgagtgagtgaganagantgantgtgcgtnatcntganatcgatagatcnacccacacganaaatacgcgtgcgagtncgtccgatatgtacgtgatctgctgagacgctgagcgcacgtatggtgacncntcgtntccagtgagtctaggatcgacggtgtgtggtgntcgacagtgtacgtgcacnncgtgagtgagcgagagtcgnacgtaggtagtgcncatgtatgcagagcattcantctatagtgtgnatacggtgcatctacagtgctacggntgaggaatcgtctagccgctagtcaggcgtcacgtgagtgtagcgatgtgagagatgtcaacgagacgcgtcacnagtacgaggaggagacagtagagaggtagtgatatatannncgacatcgctcgatttgcgcgagagatgatttgacttagaagcgctgtgatgtgtctcntgccggagtggcgaggtgatgaagagaggtcagtagcagagtgatgacgagcgangcacgg

SEQ ID NO: 17190 - DNA, 770 bp, Homo sapiens
taacgcgatgattcttctgctccatgtgttggctgctggggctgaaatgtctgagatggcttctttacttgcctattgggtgcctcacagggatggctagaacagcttggggctggctgggcatctctccctccatgcggcttttctacgtggctagattggcttcttcatagcatagtgctcttagggcaattgaacttcttacctgaaggttgaggttagctggcttctaatggaagcggcggcagaagcagaagctgccatttctcccaaaggctaggggtggacctacctcatggacacttccccaccaatgtgtgtcacaaaatcagcccagattcaaaagcaggagaaagagactccatctgttgatatgaagattggcatacatttatggggggaaaaggaactgggaacagctaccttgcatatggaaaaaaattcaaacagtgcaaaagggtacacagtataaaataagtgtctttgacaactctgtccccaagacactgcagggtaacaactgttacgctttctgcgaattttgccagagatattcaatatataaacaaacatatgccttatgtatatgcttttaaacatattgattacattgatagggcgcgtaatgcagatccatctgggggctgcctgatgtatagagagcatgctttggtatgctcgttcagcctacacaggcaggcccctgtatcctttccatgccccctgtcgcgctttagcgccatccgaaccttactcgaacgttcgccact

SEQ ID NO: 17191 - DNA, 1595 bp, Homo sapiens
  misc_feature (1)...(1595): n = A,T,C or G
aaggggnngggggnanagaggnnnnnnnnnnnnggnnagnnnnnagagaanagtgggtggnnaacagatgtgnaggagannagngnnnnnnnnannnnnatnnnatntggnnngagcnnnnnnnnnannannnnnnagtnnaaaaaggnnnncnncgagaagcnanaggcgacgggnngnnanncancacgaacgnaganannggagccgganncacaagcagggcnccnaaggcgagagagagcagnnacgcncnagcgganacnccaagggcaagggngacgcggcgatgatggcanacgccgacacgctagcgccgtgntctatagtcgcgcgctgtcgcagtactgctcgtagaatagtatgtttgatattgtgtgcgtnactacagagtccacatcctagagaggtcgtatagagtgccacggagcgcanccacatatcatagcggggagtgtggtgtgtgtcggctagtagtatgtcagttagaagtatagagaagttgcgattgagagtacaaggtgtagagtntacgagtgtgtatatatggatcntataagtatacatcataacgaattagatgtgncagaagacgcataatacgcacnatggaaagagatatagacgagancaaagcagtgtatagtgaagtgtnaaaggtggtgtgagcggnataggtcagagcccagtgagagtctacgnctcgttagcggcagctgtcgcagcacgtcacacgcagagaggcacgacacaccagngcaacgcaacagcgcgaccgcatgantgggagagagtggaaacacctaggagagtaggtggcgacggcgcgcgcgnccgatagccaaccacccgcacgcggcgagccagcaancagcacagacagcacnatccgccaacgatacncaactcatcgtagtgcgacgaacacgactcaacgtgcttgataacattatgtgnatagtacagacnacatatagagagaacgagaggtgtagatatatgacgatagagatggtgatgcgacgagtggtggctcgagacgtagtggttgtggtaaggatgggngntactanaggagagtagttagaggcggtatagtatatcgtagagatganagaatagtatcaggtatacagagtagtcttgtcacgcgcgtacataatagcttgcaatatgacgacgttcgatcgaagtagagtcagcaacgttgtcccacgcgacacgtcactacgaggcaggcgactgagaatatacgtcggcgagctactaccactctaccgtagcgnacgcgatcgagggacctcgactgtacgcacgcggcacgagggacgtatccgcgcagtgcaggctnacgcgcagcagcgatgngccgtcgaccacactnnaacgacgtgccacgcgcggccacatagataagtcagcacacgcacgcgcgttgcgctggcatgcgagcgacagtgtatagatacgagtcgtgagcaggcaatganaanagaggatgtagattgataatagtatgacgctattcaacggacgcacatatgttcgaggcgtcgtcggtgcgtggctcgcgtcagactgcgtgagttcgcgat

SEQ ID NO: 17192 - DNA, 757 bp, Homo sapiens
gtgacgttattcatcaacggaagactatttagccataaaaatgcaggcacttctggctggtgcggtggctcacgcctgtaatcccagcatcttggaagaccgaggtgggcggatcacccgaggtcaggaattcaagaccagcctggccatcttggtgaaaccctgtctctactgaatatgcacaaaattagacgatcgtggtggcgcgtgcctatactcccagctactcgggaggctgaggcacaagaatcgctggaacccgggaggcggaggttgcagtgagcccagattgtgccactgcactccagcctgtgtgacagagtgagactccgtgtaaacacaaaacaaaacacaagcaaagaaataaataaataatacaaaaccgaaaaagccaggcaggcacttgtgacacaggctgcagcatggatgaaccttgaagacattatcgctagggaaatacatacatcccagaaggataaacatgaccaggctccgagggtggcacgctggagacccagaactttgagaggtcgaggaaggcgcatcacttcacgtcacgcactccacacgaacctgcccatattgcgaaacctcgctcctattcgacatccgatgtcacacggcgcgtactgccccacggccgttacggtacggtctctggtacactgcaacgccataccaccttgacctccgatgccgggggctattgcccgagcctcattctatggcgcttcaacagacagtccagaacgacaat

SEQ ID NO: 17193 - DNA, 1551 bp, Homo sapiens
  misc_feature (1)...(1551): n = A,T,C or G
gtgaaanagaaagnagacganannangnnngtangnaanannaaaagnnnaatttattnataatnagannnntnnnnanaanatnnnnnnnntacattntaantngntnngtattnnaantaatnnanattaannnnnatatatatananntcgtngtnttnnnaatgaaatatatatnntaaanagatanatagttnatnaattngatnnntannataggtaagnaacagaggacaagagagagganacnnnnagnaacancgatnntacatactcgcaatacgtacgctgcacatagctactangtaccaccgctgccgctctcctctgcacatcataccacagccgcctttcgccgcactcgancacgtaatcccactgtcgtcacgccgtagaaacacacagctttctacatatacctgtgatcgtcggcacgtgtcgcgangtgagtgatgatggtgcgcgcgatcaacaccagaccgctttatgagagtaangtaaaagacangatagacttatangtaatattgtagatgtcataaatatctgataatattaacgtccacaaccaacgcggaacatatactctcacagtactaccgcancgcctctgtgcagttctgctacgtacagtatcatgattgcgcttaggtgtcacacatatcaatntacaccacctcacacacaacctcgctattatgtcattanaattgtcgatagtatctcgacactcctgcatctcttcctctcgagcgccactacatcactcacgcactcgcactacgtctcggatacaccaacctcctgctaccctcctactctaccatcgcgtgccatacatcactcgccacacgatgcaatctacctgcacacacgtgacccgcgagcgcacacagagatgcgtgtatgcgcaccatgctcgacgacgcgcgcacagtacacacgacatagtagctacgatganagnagancaagcanaangtagacacgctaccgcgtagagagagagangagagtacgaagcaagaaccatatgtatacanatgagtacgcagatgtaggagagatcgtgagcatanagtatactatgtnagtataaaacanacaaancgagacacacgtgcangatatagagacnatgatgagaggagtgacggagagagatggtcacaaacctacaagagtaagccgcgcagcgtagcgtccttactgtcttncagtcccgacccgccaacgcgccatctccacggcagtngtgccgcgggccgcgcgcgatcgaaagagatcgccgaatatatcgcatgaatatagacatacctgacgcgccctagaatanacgcgctgtaggtctgcacgttgctctccgacgccgtgatatgtacgagagacgccagcacggcacaggacgtcagagacagcgacgccggcggcgcaggcggtcgacgtgaccaatcgcagtacctccccactcgtatatcactgcagtataacgaatcaccgtcgcaacacatntacatatacattatacacttcggcaacgaatccaaccg

SEQ ID NO: 17194 - DNA, 1533 bp, Homo sapiens
  misc_feature (1)...(1533): n = A,T,C or G
gcacggnccccggacanccggcgcgngtgaccancacgacagcagcgccgcngccagcacgagnnatcnntcttgctgccgctcccacnatatnaacgccggcgaccaccagacacgctctcgccgcgcagcnacactcatatactgtcagtcacatcgcgcaccgcgcatctgcgcgcgctgatgcgaagtgcctcgtgaggctcgcgacgcagctgatactagagctgcagctcgcgtcgcgatagagacatggtcgagaagacaagagagagagaggcgcagcgcgcgcgcgtgcgatagctgtgatcgtactccgactacgctgcgagaggcgtgacctgtgataggagcccgacagcgtaggagncgcggatngcacacgcacacgtgtgtgatagcacggcgcggcggcacgtgtgcgtcacgtgtgagagtgcacatcagcgagatagtggagcggtgcggcatcagtagcatggaggatgtgtttggcacgtgcccgcaaccagcggccacccctagtcatccttacgatgcctgcagggtgagtgagaggcaattgctagagaggcgggaaggcgtgagtggacgggtcgcctgcgcagtagggtggacactgtagcggcagggcaagcccccgtcgctcgcatgctccccctgtcagccggccgtaccaccagcacggtactcgaccgctacaccgccacgggcgtcgccgccgagggtgcgtgagccctcgcgcggcgaacgcgcgcgcgccttccgcgggtgcgtagcgtgtgcctgcgcggggcggcgcccgcccagccacgactcgctccggacccgcctcagcactctccgccccaccctcccctcgtccggaggcgacgcgccgcaggtgacgcgcggccccccgcgcgcccctacccgcgcccgcgccgtgccgggaccaccgcccccccccgccccggcgccccgccggcgccccgcccccccccgcccgcccctactcagctcgcccgtacacccccggccgcgccgcgtccgtcctcgcgacgcgcgacgccgtgagcgatcctgccgcccgccccgccgcgcgcgcagcgccagctacggcgccacgctgccaacgccgctcccgcgcgcacgcgtagcgacgcccgcgcggccggcgcacgagcgcacggccgncgagcgacgaccgcggcgcgtgaccggccgccgatacntgtggccccgcgccctccctgttcttcgtgttgcgccgcgactcacgcgccgcccacgccgtagtcggctcagcgttgcgcagcgacgacgctcgatatctctccgcgcggccgttnatcatcatcgcgggcgcgccgcagcgctcgatcccctcgcagttnttatgcgcaggtatctctgagagaagcgtcgtcggcccgcacaagcgcgcgtcgattcacctgatcgggcgcgccgcgcagcgtgagatacacctacgcgcgcgctctcgccgacacttacatgctccgtctngtctagtcgcgccctccctcgccg

SEQ ID NO: 17195 - DNA, 1456 bp, Homo sapiens
  misc_feature (1)...(1456): n = A,T,C or G
ttttnnnnnnnnnnnnnnnnnnnnnnccggccggaattntcgnnttgttngtnnagnnnngttccttttgnnnncttngtntattcnagnnnngnncttnnntcntgatnntannctnttgtcgccatcgttctaatttactntccgctcgattcattccacgcagctcgccgctcatggcagttgtacgtcattcgacacgctaatcagtatatacagcacgatcacattagcccggcgtggaacagcatttctccatatagtacatggagagagatagggcgggacggggatgttgaggagagcgacatgaataataggagagagtgcgatgttacagcgcccgcctgtagccatttctacaccgtttgtgtttgtgctctgcacgcgcctgtcagcctcacttcactacgactcttatgctaacagcttctactctagcgtttcatattgacttatcattatatagtatcaaccaagtatacaaccttttctcactcgtattgaaaacattaacttatccgtatattccgctaattgatttgacacttacgtatttagataagtgtccactgccaccacgacccacactaagcgacgtctacaaacaacgcacactacacgagatacacagtatgatgggcgctcattgaacggccgtcgccagacgctcgtcagccacggcttatatagtatagacaacacacctgaacattcgagttcagtcattgctgacgactaaatctagtgtagtattttngcgagtgaatatgagcaccgacacgactttgtcaatgagtcgcatacaacatctctctataagccgtactcgtcaatactataatcatttaaagtcactatttacacacttcatcgcactacgtgcatcacaaccgaacactcaatcaccgtccacattccgctccacncgtcgtatagtatgtagtatgtagtatattgtggtcattgtgtagagatacatnctctgctgagacacacgtacaggtacgtatgagtgcgcgcgcagtttgttagtctgatcgagatnagtgcgtgagagagatgtgtgcatgttatctattcgatagtgtcttcgcgaacacgtgancgaggtgtngagagtgcgtgtgcgtgatgtgattcgctatngtgactgtcatanatgagtaagtatgtcagataattagtaagcaagctagtatgagatatattctgtgtgttgcatnctgcatataagatacgcagacgtacatgntcgtatatacaatagtacatanactctgcgaggcataagatcaccacaantctgacttgcatgtatatagtttcatctagtcagngctaaatatctgacgtagtgtaatagtgacatagcaatntaagatggctagtgacacactggtacagatattgtagtcgtgtggagcatgcatcagacatcatctcacacgatcct

SEQ ID NO: 17196 - DNA, 1571 bp, Homo sapiens
  misc_feature (1)...(1571): n = A,T,C or G
aaaaaannnnggggaaaantttnnnnnnngggnnaannnaagatgnnacanatganttanngtgntttaatgtgagnnattnnnnntnnnanaggtananaaaancnnnnnnnnannanctactntannnnttnatccagtttnatnatatnatatacataggtctatagtagcgttgatagttaatacatgcgagttcatgaatagatgaganaagtcctagagcatnntacaatcgantatcgctctagcagcagacgcgacgagtgtntcatagtcttctatgcatcgttagctttcggtgctgtgtctgcctagatgcgcgtgcagagtcaccanctcacatgtctagacctcgtagtagcgcacgctacgaggcatataaggtcgagacgacgtccgacagacgtcgcnagtgaacagtcgtagcgcngtgtctnactactcatactcagtggacgcgcgtgcgcagtattngttactgtagcncgtgactcatgtgagcacgttacgtcgacttatactgtgttatagacaatcatagcttatcttcatttntattgangtagtcttntcatgcgggcggcgagtaaaacgcgctgacgcgcatgctggcacgagcgatgctattcattaggcgcggncgctgctntagctcntgtcacgctctagaacgtctatccagttaggagtagtcctagatcaacagtgcgttccgcgcatacgtcgcctttgtctcgttctattcttctgcgatgtttcactctgactgtagtcattagtaatatgatatagagagtacgcatcgttcgtgtcattattgtctacatggctcgtctcattcttctgtctctctctctcncgccttcgctcctccagctgtctgctctgcgtgcgtcacactaccctgattgtcatgtatcgcagcatgtnttgcttgatgaantcggttcaggtgatgctcantatatacgtctatatatacatgaccattagtcttgttnttgctatattctatttgtgctgtagtagtcgtttntatttgcatgtgtctcatgcatagagtngttatacgttgtngcgtcttctnagtctctacggatgcgcttgcgtatctgagcgatacatatattgtacgtcntctctatgtgtgtgctacgcgtcatcgcgacactcacacgtatgttctcactctcgtcgtcatcccgcgccgtactagcctcgtcgctgatcgattcagtanctcgctntacagtttatcagctcatctctttccagacatgatccagcttctcgtcgccgtgtcatgtggccaattctagtgtagacgttcttcatacgtcgcctcgctcgccgccgcagcatcgctctattgtcatngctgcacatacagtagtgctgtcgactcgtagtncgctcttctacgtattatgagttctagcttctatgagtagtgatagtgcggcacgtgcctgtgtatagtatatggatgtcttgcncttgttctgcttagggtcgtgcaggtgaatgctcgcacgctcgctcgtgtcgtacgccatatctaacnaaag

SEQ ID NO: 17197 - DNA, 767 bp, Homo sapiens
tgtggacccaggaagggactacccttcccagggttggctatttcctacaggtagcaaacaacttgcctgcaagatgcctttgatatgcaaaccaactcatcccaagtccatttcccaaactggctcctttcatcaggcttaggaaaccctagacgttatccttctgcccaaaatcaccctagggccagataccattcaactggggaccaccctgatagcccagagcctgctgacgttattcagcctatccaatcctaaacttgctcagtggcttaccctacctcgcccgttccttcccttgagaaccacaaatgaaggaaagactttgcccatgcttttccctcactcctgcctcctgactcgacctggtgcctccctgtgtggctctgaatggtgtggcatggtgtgtccccttctcttgggaaccgtattttttttatagtaatacaagaacagcctaacacaccatccctgaataagaacaacctcctgggtatgtttttaaaaaatcccagcatctggcacagtacctgttacatagaagtctctctctataggatgaaagattctgggcaccaaagaattgtcccatctagtcaaactggggcaaactgacaaactccatcttggttcattagacccatggatgaattatgggatgtagagggaaactgtgcctggcacacgcttaatgaacccagggtctgcagtgatggatggatgtatggaaacgccgccgcgacggacgcaatccgcagacacgccaa

SEQ ID NO: 17198 - DNA, 1489 bp, Homo sapiens
  misc_feature (1)...(1489): n = A,T,C or G
ggggnnnnnnttttnnnnnnnnnnnnnnggggnnnnnnnttttggggggtgtggtnngnngatggnngnanggnnaggnnngnnnnnnnnagtaagcnntcataagggncgnnngnnnntgttaggngatggnagcgcatagaggaaagagnngcgatcggcgccantaggaacgagncgtaaggagacacacgncgcgacggtgggacagcgcagcgaaatgagagagagngacgagcaagcagcacgacgagagcgcggccgacacagcacgagtcaacacacgaaaagataggcgcgcgcatgacacaaggtggggcctccggcgcagcgcgtcgcggccgcagggacggggacgacgccgagagaccactggacgcctagcangaggtgcgagaaagagaagacaaagccgacagatacgaacgtacactacgacactagtcgagacagatccagcacagtcgagaagagcggccgagtctcgaagcgtaggaaagtcaagtctgntagtgaaggacaatttgaccattgctcccgcgcaggacctctgtgtacgtcgctcnctcgcgcaatcttaagttcccgccaacagcctcgccgcgccgccgtcgtgcacgcgctcttctctcatcgtgtagttcgatcatcacccgccgcatcatcccctccgctcgcctcgatatccgtanattgctcagttcatgagatgctcatgtcctagttcccgctggatctcatgtgttcgaatatatagactctgttacntatgatcgtgcagcgattgcgcttatagtatacgtcatatacgatacaagatgtagtattacagataatcctagctatacgcgacctcggagatgtgagtagcactgagtatatgttgtaagtagcagacagcagcagtccgcgantaatgtcacggcatacggacgtcgcacgatgagaatgcactccaattaggcgttataatgacaggatacatgtattagcagatgccangacgnactataatgaaatagcaggcagacgctaactctgacgcannagctactcgcgttcatccacagttcgcagttacagcacactaagtatgtatgcacgtcgcacacgcccgataatatgatcgccatcatacgtaacccatgatcagaccaatgaacattattcaataacctcacatactgcagccaacgacggaggatcacgagacgacggcgaacacatggtagatcgagtctcattatcatcaaactgtctatcaccacgcgtgagctccgagctacgtgactcagacacggcccgcatcaaccgacgatgtcacgantaggcagagtatcggctgtacatgaacatacaagagaccacgcacnacaacactccacatgaagancaacacgacaactatctctagcacacctatatgacatactagctagcttacgagtgngtgatagtctctacagacgctcagatagagccgcagctg

SEQ ID NO: 17199 - DNA, 704 bp, Homo sapiens
aagcatcctttggaaacctatttgcttccttaatgggatgggaagagcagccaaacagcaatcatggatgcagtgggcagacaagatgaagattctagtggaaataaggtcatagagtgacagatacaaggataagacaccttaccatggacaaacatttgaatcagtgaccaagaaaatacggacgaaatctgttccagttttgcgaaatatagaagagtcactcagatcactaggagaatttagataagtaccatcgaattgaagtttgttttagaacatgcttgacctggaagggaaagaggaactaggaagatagtgggagctggagactactgagagaacacatgttccagtgttctcctggaccacactttaggttctcagactgagagctgattctcttggcaggtgtgtcatgtgcctaagactgtcgtgcaagctaagtgagacgatactgttggtctgcgtgtgtttgctccgtgtgaagcgtcaaacatgtaagattgttttgggggtgatttacttgcgagcgcttcaatgtcgcgcttaggcggctgctggaccctgggggctgcccttcagaccgttcagatgggcctcatgtattcccccttcactctttcacctccgtctccattccgtgtgcatttatgtattgcaccatcgttcgcgcgatcgttcgtatatccgagcaaccgcaa

SEQ ID NO: 17200 - DNA, 1468 bp, Homo sapiens
  misc_feature (1)...(1468): n = A,T,C or G
ttttnnnnnnnnnnnnnnnnnnnnnnnnnaaaannnnnnnttaagaaatttaangnangatanntatcnannnnaaangannnnntnnnnnnatannannnaatannnacnnagnnaatanntntnnatnnnnnaccggagatatnagatctaataatcctccatagagaacgngtatatatcagagnttagaggcgggaagagtagacagtgtaagatgaatatagataagcaaagtaaagctgagatcagatgaaataaggacacgagcgtgcggaggatgcgccacgatgcccactcaggcgtctgatctgtcgtgtagtgtagntgacgtgcgcgtagtgncgagataggacacancgcaagtcggagagatatgagagtaggcgaggagagagagaggtgatgcgtgcacgacagtgtacatctgatattaccctatagagcggcaagtccacgacagatncaacaagagtcggaacaattatcatganatagaagcgcagaganagcgattataacagtaatgagtgttgcgaagccganacagtgataaagcacagaccctctnttgaatactacactctcatncgctacaggcagaccagaccaacgggagggtaggagagaagagtggcaggctagacnatcgcacgtccgccgcacgcagactacgccacgccactaacacactcgacgcacccgccaccggnccagacacgcatcacgcccatgcacgggcactccgctctcagtaaacgtcgcatctcactgtgtgctcgtctcagcgccacgtattcctataaatacaaagcaactccgcgataatggcaaggtacgattgatatttacgcagaaccgtagtagacgagangatatacntaacctgagactctccttgctcgcgtgatgtagtattattattatagaattgacttgagtgaaatgtatgagcattgtactagatgaatcgtaagacgctaggcacgtatnatgagtagtgtgcagctgaatgtacgaagtgatgcgcagagcgtgaggacgcgcgagatgcgactacggcacagcagctatcgatcaccagcacttacgctgtagacaacaatacagtacgctaagcgtatctagactacccacacaatacattactctctctncctctgatgcgtgtctcgttcgcggacgagtcgaggcgtaagcgtactgttatagagantggcgaccgccaccatgacacgccactctagcnatacgatctcacgctggatccatccgacacgtctccgcacggacgtacccactcactctactccatggactacncgagatggagngtcacgtcagctcatccgaaccgcggatcatatcactatatatcgcgccacgctccgcgatctcggctgtactattgctcacggttagttgagtgtttcgangtccgtcgaagcgcatcacgccacgacataag

SEQ ID NO: 17201 - DNA, 753 bp, Homo sapiens
tccagtactgtcggatcctgcttcccttgccatagctgattaacccagggatgaacattcatcccatccgtaccacttactggccatgtgtcttgactccagccactataccactgaagcctcagtttcctcagctgtgtaatgggaccaaaaatctctgcctttcctactttgcagagacagtgactggacaaattgagaagatggatgtaaagagtaacatacaaatatcagggaaatcaactcgacattatccttcagcctccagagtgtcattatcattaaatctatccttggccttctccagcagagtggtctgtctcttttgtacattacctgcagagttgctgtcatgatctgcaatagggaatgaaccatgcccagaccacaaggaagggaggaggcatgccatgtgtgaggagaggagtgtctgatcctgaagttctctatgaaatatggagcattacatggggccgaatatccatgaacaccatgctgtgtttactgtggactttgcacgtgctggtggatttaagggaggaacaccagcgcacgtgcaaccctgaaatatgactgcatgaatgaggcttgactaaatggcgtgggatcccacgacgactacccgaccgcggactataagcgaccctcatatacagcccgtcatcatctccttcctacaacacgatggccgtggcatatgtgccacacccagaactaacgccccgtccgcaaccactcctggcggagcgctat

SEQ ID NO: 17202 - DNA, 1408 bp, Homo sapiens
  misc_feature (1)...(1408): n = A,T,C or G
ggggnnnnnnnnnnnnnnnnnnnnnnnnnnnnnnnccggggggggaagtnnccngggnnnncnacagaannnnnnnnnnnnnnnngcccgnncnntnnnccnnnnannnccnnannccccaagcnncccnnnaacacccccacccacgccncnncccgcgaacgnacgtccgcgagcccnntagctccnccnccgcctccaccgcccacccacaccgcncncgcggaaggncccncagcatccgccncacacaatacaaagactcccctgcacagtcattattaaacgcagatatataatatggatccagtgtgacgagaagagccagaagataggtgaagcgatagcacgaacaatcagatatgcgagagtaggttaactagagtttacttattctagacattaaatcaataagatgttaagatcagataaatttanaagtanatatattagtcgaatcnggcagacnatagtgagagacagtcacgtagaccacgcgcgtcccagacccgccacggtggatagncncaatggtgagnaatagtactaagaaggtncagtgcagaggcagacncatctagcaaaccactgatatcccatgtaatttcctcctcacctcataacgcacagcaccgacnacacacggtgagcaccncaggagagcaccgcggccgccnccagttccgactgcacgacgnacgcacgnccgccgcacancccgacccgccgccgcccagacgcatctcccgccgctcacnagacgacgctgccagagatgagcatggctcgccacagncgcgcggaggtgctaggtcgacgtgtgtgagtgncacagntcaatgtaggatatgnagtagtgaggtgnttatatgatgacgaggatgtgtaagtagtacgnagaagcgtcacgtctatgtgatgcagtggactgtggtccgtatattatatgtatggagctccatgcattatgangtgagcgagagagagcggtaaggatgaggtagggncacacacagtagcgacgcagancnaccgacaccacgttcccgtgcaggtggcatagcgcgctcagtcacgcgatagcgtcacgagtcgtantcccgtcaccaggagcnagttgtctatcaacgtgtatgtgtacgagctacgcatgcaacgacgcggctattcggcgtgancaggctcagtgtcggtcgccgcacctctcatgacggcnagtgtgncgacatcacacggatggctatgcatanaatacatgcgnctctaccatntcactccgtcggtcnanctcgccgatcacgcgagtcgacgcagccncatcacaacgacacgactctgacacagtncgaagcggcgtgagaccagnacgagagtagacgatagntntaagtaaataagattagtatat

SEQ ID NO: 17203 - DNA, 772 bp, Homo sapiens
  misc_feature (1)...(772): n = A,T,C or G
acctcatctcaagaataattgctgaaccaacactcaaatgctttgatgaggctcagaaattaatctattgtctcatggccaaggattctttccctcgatttctgaagtcagagatttataaaaaactggtaaatagccaacaggttccaaatcataaaaaatggctccctttttttgtgaggaaggtaaaagttaactaatcactatacttcagggctacaacattttaaatatacaagcatgatgcattgtcttttgttttgtttttaggatttagaaaacattttttacccaaacagatgaataacgttttatacaacaagcctgaatttctaactcagttgtttagaatgtatttgctttaccagctatttaatctcctactgggggagtacaaagaaagtttatagagatacaatatagtcttaaaccaaaactgaatattcttattatattataatgtaaggaattatacatatcttcacgtggcagaatgaaagacttttgagcatcatatacacaattttaaataccattgcttaattcaaaaaaatctcacttttgtaaaaagagaatttctgaaccaaaatacaagctttcatttaatatatttaactgttttttttctgccatttctttccaactatttctaataatgtgggtgcgaaaactgctacgcctctganattatattgtttaaatcacgggaatgcatacacatttatatgcatgtcttgaatgcaccatggaccaaagctcttccaaatatatc

SEQ ID NO: 17204 - DNA, 1362 bp, Homo sapiens
  misc_feature (1)...(1362): n = A,T,C or G
gggagganggagagggggnnggggggngggangngnnnnnnnnanannnnnnnnggagnncntnnnnnagngtnagnanangaagtgagcgagaccggcgcagagggcgcaggcgaaagggagagcgcagagagagagtgaagcctgcgagatagagagagagcgagacgaggagaacagaacacganaatacntctatagcgttcacacacatagacacaattctgcaatcgcactacacgattgatccactctctgactttcttgttatatctcgatcacataccgcagccctattatacgatgattatcatagcccgccgtgggagntgaaagacgcaatcagtaantacaacgactataggccaccaatgaaatcaagggagggcgcgtgagtgcgggtacgaatgagagtgagaaaacaatattaatcacagagtagacggaccgatggcgcgctgccacgctcattgtatgccgagagtgcgcgctcgcgcgatgcagtctcacacgagcgtggaatacgacagtagagaggtcgtgcacgagacgccacacagtatcntcgaatggtgcaccgcgtcagcgcaccgtcgtctcatcgcacgtcgctgcgcatcactcgccacacagcctctagtaacgccgctccctctctagtctctgcatctcttcctcctacttcnactactctgtcatacgctacgctcctgtctgcgnagtacgcgtcggacntgagatgatgcgaagctcacgtagtatatctagtgccatgagcagagaatagagagangnataacgaatcatagaggagcgagtcgcggtgtgatgaagantaataaaagagtaatgtgcggtcgtgtagtggtgcgtcgtatggtgaggacgtgagtgagtngcaganacctccgcggagcgcgagagccatgatcgagctgtgcgtgcatgtgttactatgcgcngtaagatgatacgacgactccgtgcgntgntaacttgatgatagccagagtagtacnacgtcgcgtatcagctgagaactcagtaccacgcaccggcgcaaggctnacgaactgcgtgcagcacgacgtataccagatacnagagtgatctgcacgacggctgaatgtagctatgtcgacgcgatgctgcgagggtctacgtaggacgcaaatgactcatcttcgatgactnccttcactatgcacgtcagtatcatcacataacctacaataactgtcatgagccatgcgcaactacgtatcatctattgaccaggcctacgagacgtagcagatctacgccccgtcaccgtcatagatacagcaaccgcgacacgccacagcgacgcgcgagcacacg

SEQ ID NO: 17205 - DNA, 741 bp, Homo sapiens
ttggagaggttacatagtaagaactgagacctcttgtaacaaccagcgctaagttttcggccatgtatgtgactgtgtgagtcaccttggaagcagatcctccagccctggtcaggccttcagatgactacagtcaaaaccaacatcttcacttcaacctcatgagggaccaggaaatcacaattacctatgtaggtgctcccaattttctgaccctcagaaactgcgtcccatgtgttgaagcttttaagaaaacatcctaaatcattgaaaagcatgtcacaaatgcgctgagaaaaagaaaggagaaaaaggagacctgcgcctctacgaggacaatctcccgggttcatggcacactgaggatgcgggacctggcagctcttataacacctgactgcagccgcttcgatgtgctgaattccggcggaaatgagatgcatacctcaccccgcaaccctgttcatcttattacgcccaggacggcattccgccgcccagctctcacaggtgcgcgtgacaactacgtttccttccctcgacttgaatcacgccgcgcacgtgacgcgccggcatccacacaccgcgacagacggccccggcgaacggccaggaccactaactgggacacacaagagcgcgtccgacttccggttcccaaaccaccacatgcccccatccagcgcactacacgccgaggcacaaaacacccccaatcgtcgcactcgcgagcgtgcctca

SEQ ID NO: 17206 - DNA, 1498 bp, Homo sapiens
  misc_feature (1)...(1498): n = A,T,C or G
gggggnncnnntaanccnnnnnnnnnnggannccncgcccccgcaggcncccggcnccanccacccccncncnncncnncncccagnccnccnccnnccccncccncgccccacggtccccgccccccagccccccgaactcgccccccnacacccgcccctnccaccccgagacnncccccgcgcgcccccccgcagctcnacgaccncccgcgcgtgtcacacccacggtcaacgcgccccacagacaagcgcgctccacgattgtngcgaatgtntttgagtgatcacagatcctttcatgccgctcctgtgtggttctgtgtgagctgatggggatggtcggtgtaagggatgagaagcggtggaggaggcggcaggatataagaagagtagagacatataacgcagtgtagcaaagttaaggattcgctatatctactaactagagcgagcatcacgcatacaaggattacatgtacnatctcgatgttattattatgggcgtngcggccgatcggtgacgaggcagcaggtgcgcgacgcactcgcagccgccgcaccggtggagacgcccnagtcagagtactatcaatgtgcataaggagantacgaacactatgatagtcncaaggagatanattgtctttgtaggagagacatgcgaagcgcagtggacgagtggagagaatagcacacgatacgcgaagtgttaggcgtatgagaacgacaggaagagagttgcgtatcgctcaggattctcatcctccntaccatctctcgtcgctagctnctactccctcgtcgcgcgcactccgtcacttgtcaccgcctgagagtgcatagtactcgctcagagcgcaaggagacgaagaatatagcgcgctccagcgnccgggtaggatgggatagagtgggcacagtggtatacgtagtgttactgggagtagagtagtgcacnaacagagtagcacactgagataggatgttntaaatcgtgacagcggatgagagaatgtgatcgatgtaagtacgcagtgattagtgtttgtgtcggntntgatacaattgagtgtaatgaagtgaancaatcagccgacatgagctcggatgtcacagcaattcgnagcggcgtgcagtgagtagcgcacagagganacccgtggcgcggagacgagcgcacgaacgtaaacntcagnanctagtagcttcataacgcacgagatctcattggntacgagantcctgatgagcgctgcgagttggcaacntacaagagcnaccgcggacaccaccctgacgacgaaggcgctgagagtgagagtgcagcggaccgagtgcgagtatcaagtcacantcgtgacgaagcnagagancagtgcgctaggagaganagantantcgtgtgagtgttancngatagatgtgagtnatacagatggagtcgtaagatatgagcagagaggagagggggtacgccactgagcgagtacatgag

SEQ ID NO: 17207 - DNA, 962 bp, Homo sapiens
ccccccacccccccgaccggaaaccccctccgtttttgcgagaaaagcgagggatttcagtaacatcatcccatttgaggactgctgtgcacaacacagttttcaggatgacacagagaatgctgagttccaagtgatctgtcacctgacaatcgactggatgaggctgtgatcaaggcctctgccaagagacctgctgccgccccagctgctgccagaccacctgttgctgccccagctgtgttgaatccagctgctgccgcccatcctgctctcaaactacctgctgccagaccacttgcggacaccccaacaactgtcgccctaactgtcgtcagaccacctgacgtcccagatgtcggggtgaacagcagctgccgcccactctgctgtcccaccacctgccgtaccgaatgccgccacgccttaccataccgcagactctcctcgcctacctccttctgttttctccgctcctttcatactccgcctcgtgacgtttgcgtagcccttacgggttccctgttccgcgacataccccccgttttctcgcttcccccgatattattcccccccgatccacgcaccccccttttataccgccgccctccctaaacctaccacccttcacacaccaccatacccccccttttaccctgcgctggcctgccgatgtcgttacccagtgcgccgtagtagcctccagcatttatactgcttcttctcgtcttatcaatattgcccggtcttaatacttacgccagcatgtgcaatcccgtttacatattgcgcaccaacattagttgctcgtctcttctcctgagttttcacactcattattccgccacaaaccagattatcgctcccgccccgctcggtcttgcccccacttagtgttttatattcgatccaccgatctgcgattcttcccccttttccttcaccctgttttccatttatcc

SEQ ID NO: 17208 - DNA, 1531 bp, Homo sapiens
  misc_feature (1)...(1531): n = A,T,C or G
gagatgacgcacagacagaagtgcggacaggcgtgtcgaggcgcgcagcacgcagaccacaggaaagcagcngagngccggacagcatgcagagtcccgacncncggtcggaccgcccgacggtcaggttcagtccggcagcgccggcgcgcacgctacaaagcgacgcagccacgcgatgacgagaatagtgcacgccatcaacgcgagcacagcaggnctacnancacgtcaagagcgagcgcaataagacnagcgcaacgcacaacgtagcaatatacgcagccgtatcgagagaatagcgctcagtacgacggcgcgtaagtaggacgagaacgaaagggaggagaaagtagtatactgagaccgacgtagcgaggagcagcctctgtggtagcgcggcgcgcatcnccgtaanaacacaacaataagtaagcgacgaataagacgcatagcatgaaggatgtatccaagaagcaaagaagagatataacaagcacgacagnatcgtacgcggacgcagggagcgacacagcaacgtaggagggataatacaaaggcgcagaccatcagatgataccacccaccaagagcgacacgcgcgcgacagaagcgactcggagaccacacgcggcgagcactgcgaagtgaggcgggcaggacgagcgangagcagcgantagaggcaggagtagagtcgcagaggagaagactacagagaggcagcgcccgactcagtcatgtgatcagatntggtatcgagcagnagacgaaangatagacatatcagacagagcggtcgccnagcacgcataanaacacagagcgagacgcgagaacccgaagagagcatgagcgacacccgcgcnaatagcagtacacgagcgcaggcgcccgcgagagggaacgaggaaacagaagacacnagagacgaggcgacgcagcaanagaangatatatgccgtccagcgcgcgtatctacnagcaagcacagcgtgcgcctcagcacacaacagagnacgcgncganaggcagcgcaacgaagcagcaacaggatcaatgcgaccncaatnctagnatgaggacgnaccttcacanacgacaacatagagtgcggtgngcgcagngaagcgcagtggacctagcagcgagcgacaacgatcanagatcgncacanacaggcatatnanacacgcgcagcacntgggcgacgacaccatgacgaagcactacaccacacatagcacaggagagtagtacacagagaancaaagagacagcnagcagaccaatgagttaggcacagccacacacagaccaagacagacagagacgaccgntgcaagagtcacaccgcagaacgacactctcggcacgagcacaaacaacggagagtcaacgacacgcacaccagcactggagtcagatcaccggcacatgtgtgaacatgaagcaacaataagcaacagacacgactggataacagacgagaagaggnagagagagcacacgggagcagacacangcgtcg

SEQ ID NO: 17209 - DNA, 1233 bp, Homo sapiens
  misc_feature (1)...(1233): n = A,T,C or G
gcggtcagagccagcgcggccgaagagcgaacacaccggcagccgaccgccgacggcccgacaacccacacttccgaccgtcgccgccggccgctgctccttaccatctcctactgatgactgataccggcagttctgcaaaacatgcaaactgcttcacaatgatcagtttatttggatacaatatatactgctaacacgacgcagcggacagaacctgcaacacttaacacacatgacgtctgagaggacaagtagagcaatttcatccgtatgtacacaagagtattagtacatagtaaatcaaatgcagtgcaccgatgactagcagtgtgcggaanaactaccgcacgccagtccacacagnaccgcgcntaccggaacgccacctaacggtgcgcatatcactctgcacagacatagcgcctagccacagtacggcatgagcgcgaacgatgctgaacggcgctacgtgtcgacacagcacagcaggcgaatccacgagcacctctgcaggcacaaaacgcgctcaggacagccgtcgggcaggaccaacaccaagcgccagaagcacgccagagatgcgaagaatcacgccgccaccagacccagaccatgaagccacgaacacacgcaatcgaaaaacgactgaaaactggcgaatagtaaagcacgggagccgcccccccgcaccccaccaagccagcgacgcaccgcgctcaacagaactatcgacatgcgagcgacacagaaagaagagcgacctgcaagacacagagacccgcaccagaacaagcgcgaggaggcacaaactataccactcacggctcgccacacacgacgttggagagccgcgcggacggcgtggacacagtccacacccaatataaccacacacaacagagaaccgacagaggcacacgtaaggccaccagggngcgacgacgaccgcgcggactacgccgcgacccgcagctccatgaggccccaccagtgccagtcagcgggccctgcagcagcgtacccggnccataggcgcggcctcagggcgcgagtaagacccaggactcacacacagtggtagaaggaccgaaatcattagatgcacacaccatcgacacagacacagaggtgtaccgcacagccgtgtgtacgcaggcaggacgcaaaccaacgcnctacgcaggtccacaggtcggcggcatggagcgcaccgatcacgccgacacgccg

SEQ ID NO: 17210 - DNA, 1784 bp, Homo sapiens
  misc_feature (1)...(1784): n = A,T,C or G
ggagttggatgtagaggggttgngcatcgcagggtgcggggaggaggggggggttttctggggcggggagccgcgggaccagggatacagcttttgtgaacagagaataggttgggccaattgctatactccacctgatctcctccttcgctatcaccagcataccggacccgcggcttgatccatcgacatacacgtatcgtaccctctatccatatactcacgtacgcgatgcgcggcgtccttaactatacctccgccgtggtatgtttcgcgttcgcaagtaggtcggtgagaagagatgcgagcttagtcgagcgtactcgtatgacgcgcggcccacgcgcgcgatttacgattgcacagtatcgcgcacagcatggggagaatcagtcaatacgtcgactgtttgttcgtagtcggtgggacggagaaagtatggtggatgtatggcgtggccggcgcgggttgccctttgccgttctgtgggggtgggtgtgaggtgggggggggcggcggggcggagcagagagagtgaggggaacgatggaagaaggtataacggtgttaggttcagacgcggcgcacaacacannacaagcacggaaataaagaaggaggcgagttcagcttgtttgagtctatatgagttacagccacgagttgacggttagggtgcggtgtgcgtgggtgcggacgctcgcgcgatgaacgtgttagagaggaggagtggaggcagtgcagaacggtggcgatgctgttcggtatggcagcgtcggtccggatcaatcccgacccgatgtgaggtacatcggctagcgaggcaataacgatgcggcggatttgcagtcggtaagagcgctgcgagcgcgacgtagtcgccactagaggcacctcttagagatagcgaatacagaacagaaagcaccgccacgcgacatacctcttatggtgtagacgggacataagcaccaccgcgcgatatcggacagatgctgcgtcccatgctcacgaataccgatgcaagtttaccaacatcgcaacgacaccacgtatttgacgcattacgtggtactgcgcgacgcgtgacgcggacgcacgncaattctcgacgttagttcagcacgcgcgcgccgcgcgcccgagataaccatatagtgtataggagcgcagtaacacacacacgtgttagcgcgaccgaacacgaggatatgcgcgatgcagtatgacgtgcgtcgccgcgaaagcgagagcgcgcagtgtncgtataaccaggaaaaacagatagttgtacgatcagagatatgtatccggacacgaatcgcatcgcagggacctacgtattaactagacnatcnacacgcgcctgatccatgtcgngccacacgcaggtatctacacgtatatagtcaaggcgcagcgtgngacatgaagatttttcgtngtcatcataatacagtagcctcgatagcgcgcacacgtgtctgtctaacgctgcacgtcgcccctgantgagaatgagaatggtgtagacaatccgcnacagcacgttacgatatatnanctaacactacacanctcntgctcacttcttcgcacgcgtacacacgctcgcacgatctanataggtcatgatctacncgtgataatgatgactagatcagtgggctgttgtcacgcancgcgacgtagttacngcnagagctcagtagcggcgacgacatcaccgaagtcataaatatcaatgatcatcaaccncatctaccgtcgaagatatgtatagt

SEQ ID NO: 17211 - DNA, 1633 bp, Homo sapiens
  misc_feature (1)...(1633): n = A,T,C or G
gtgtgttttggaggagaatgaggaaagggaaaggtagagaacacagaagacngagaccaacgcagacgagcaggagacagaacagaaaagagcagangacgcgaanagacgagcacaggcgcgcgcggancgtccgtctctgcgacgagagacgctagcatcatcaatccggccgtcggtccgaaccagagacgtcatacagcgtgcctcgcacgcgcggcctacacacgcaccgctatccgcancgaatacaacgtccgccatcactcgagagtaacgagcgtatcagcgaatgtgaaacgatatctgacacgcgagaggggnaataaggngactggcggcggcggcagcgccgcgcggcatctccgatacgancgctgcctctccgcgcgcgagcatgcaagaacccaccacaacgatacaatataggccacacacaggcacagcgcagccccggccgcgcgcacataatacacccagacaccgatcgaacaggcgcgcgcgccagtcaccacgcacaaattgtcgtagcgcattacacaacacgatacatatagtgtgacccgactataatatgcggtcaatganagacgatggagagcgangcggacactcggcgcagcgtcgtcatgattagcggcaggagcagggcgcggtcacaacacagcntntgtcaagtacaagagaggtagtattatgaatgaagagagcacggcgatgaacgnatcaagggggtcagaantggtattagtgacgtgantgtgtcaagagttacgtaacgacgacgancgacagcgccggcacggatatncgagaccgcgacaggcggcgcncgcgcgtacatcagctcacgagcanaacacngncggacnaatagttagtctcacacctacgaccgncncncgcactgctgtatacactcgtantatacgagtcctgtagcgcgncggaccgcgcgatacgagcnccgaccancgagcagncgctcgagcgacagcagctggtaaaggtcggcngagcgctatcgcgcacacagtagnacggacgatgctcgacagtgccttagncagtcgantgtacgagcgacacctgtactcgatcacctccaccantcgagtctncgcatagacacgcaactcggactatcgacgcgacgtagacagcgngncgngctgcgngcntgcgcctgcctgtcgtncgagacancncactgactccacgtatgcgagatcacagaggaggcncgcgtgacacagcgcgatcagcgcaggcactcctcgcgcgactacgcaatcgnacacagtgtcntctgagacacctatngacgncgtacacgaatcgtcacncacgcngngntgagcanagcgcagcgacgagatactaagnacaggcacgccgcgcaccnatngngcaangtggngagacccatcgcgcctagcccgcactactacccatgtcccatacatatcatatgtgcgcgacgacaccagagagagaatgaanaagatgaggatgcaggtgagcgtcagagtggtgagcaagagaagacgagaacacaanacacgagatccgaatgagacagacgcgaagagtatgcgtgagtgcgcncncagtagcagtgctcacgaggcng

SEQ ID NO: 17212 - DNA, 1223 bp, Homo sapiens
  misc_feature (1)...(1223): n = A,T,C or G
gtcgtattcttctctcaagattggttgcgcgctggtgacgacgcacacaccttcacnagagatctagacactgactggtagacgcgcctgaacgatcacancgtcgtcttacgcacggcccgacgaacatcgctgcaccgcgcgctcgtacnaacccgccgaacgcgccgatgcgacgttgcgaactggcgtggtgccttgccgtcacccgcccgaccaaccgatagtacacagccgcgcaacagcgtgttcatcgtgcagtcaatccttgccctcacttcctcctcggcgacgactgttctttctttattgccccgccgttgtatctcaccgattcgcgcctcttctctcgcgtctttcccggatttgcactagcgatgagaagcgacgacatggtgagtgaggcgcgatggtgtcggtgcgtccgttgatcagacttacgtcctacgtggcgacgtgctcacagatgtgggtggataacagggtagggtgagggccaacttggggtggggcgacgtgtggcctggcacacgggcagatacgggttcgccgctctctcaccgatggcgagtaggtagcacccccgggatggcaacttagggcgatgcacggcgtgaggtgttttggccggcatgcggtacaatgcactttgcgcgacggttcattcaaggagcccgtaacatagtccactcgtgcgccccgaccgcagagatatgaccgcgcggacgccaaactcaaaccaagtgctgcgataatgaacgggggtgccgcgcaaacgcgcgcagtcaagcatgcccagtgaagagcaacttctcctcatagtggtgtgcttacaccaccataccaaagagccagtgtcgtgcgatgggacgcgcgtcgatagtaactcaacgccacaatatggcaaccaatgtgtgcctggctgcataacgtcgcagctcgacgactgcagtgcgtnggtcagtggaaagtggattatagtgtcatacagtatgcaccgtgcgagggtccgattcgagcactctcacgccatgcggatagcccttggcattggtgcccatgcgcgcgcgcggtgtgtgcagcgacgtcgagttggtgtgcgacgggacacagatggtatgtggtccctgacncgtctcggtgtggggcgagcgacnctagcgacgcagcaccagtgtatacaggttgtgtgcgttgtgcgaacagagcgcgcactcgtgccg

SEQ ID NO: 17213 - DNA, 850 bp, Homo sapiens
tggcgcatagtgtgtccgtaccactgaaaactgctcaacacacactactatgctgcaacggaggaatggaatggcaacgaaatagagtgattgtgcaggattccgcacacaacacctgagagcccacgccacaaaccacctacgtccgttgtgctgatcgtcatggtacaactcccacaccccgagtgcgcagcacacacaccttgtatcccatgaataccataccagttacacccaaatgcagaggccatatgcggagtagtaagacagaaaaatactagagagtcgtgtgaatatcgctggtctctttgtcttaacgtctccgcgcggcacaattatgatgcaagttggctgtagacgtattatcgcgcggacgagatatataaatctattttagataactctatagaaagataatcaataatgcgcttcccgcacacctacgcagaagacagcagcgaactcaaacaacaaacaataccgcaatcgaaaacgagggtagttacacggccagtaactaagacttttctcaatcacaccacacaatgagaactacaccaataaagcgtgagggtgtggatccagctcgtggccacacgcatgcatgtaaattggtaatgatgaaccttgctgaccacgcatcagataggagagtcacagctcctagcaacattagcgcgcatcgtccctgggcctaagtgtcgccgcgccggtcgatcaccacgcctgccacggtccgtccaactcttgctctccagaacatcgacgtatcaaatactacaggttcaatgaccaccaccacagccacgccgtacaagcgtgaagacgttccccagtctagccactcaag

SEQ ID NO: 17214 - DNA, 1409 bp, Homo sapiens
  misc_feature (1)...(1409): n = A,T,C or G
ggctgttacagtcttcttccacgtggctcccgaataataaaaatcaaatctgatcggatcagacgattgacaaccccccccgcgccctcccctccttgtgcgcgccccgcgccgccccgatcacactatagtttactcatattgtagggtgctctcgcgtcgtcttcgcaccatttttcaccatcgaccaaataccacctatcgcgttctggatttacnccaacgcagcggacgcgtcggcgaaagacggcgcatgcggtgacgtgtatactctcgacccgaaaagagtccgagcgcacatccacagcaactccgtcgcccccgtcgccgtcgtctgatactgcgctcggctcacactgctcggtggcggtgcgttcggctgggtcgctgcgcatgaacccacatccgcacatcgtgagtgtgggcgccgtttaggagtgtctttattcaatgcgctatgcanctcggccgcccatctgttgncacccccgcgggagggcgcgcgcgcgcccgggggcctcgggcacacatgcaggccccatcccacgcagccggagcccgtcggcgcgcctgtattagtaaccctatggtagcacccgtcgcctcgcggcgctgggtcgcatatactggtcgttgtattcgctccaccgggtgtgtactagtaaaaaacgcgacgcggtgcggcggaattaataanaatattgtgggttcagagcaggcgtatatgttggccggattcccactataattaacatttcgtcgtgtgtcagcatccacgtcgcactcgtanttcatatctcaantgtcagcgacatcgctgtacgatccagtgagtaaagtcggtatgcgatgcgcttggcngagcgcgccagcgcncgcgcancaacaatcgcgccagtgaacacggcacgcangcgtgtcgntcggctactcgtgcacaacacacacgctagtttcgctatcatcactcgatcagcncgagtgtggcgcgacaggncgtgtagtgccgcgcgcacgcgacacgatgacgccggctcttccgtgcgcncgcatcgtgtggcccntccactccacgacgatgcgtctattacgctaacacggcacaagtctatcggagcgtaatgcaccacgtcgcgcctcagactgctactnctcgtnttgcactcgtcgtagcacgtctcatgtccatcacgactgctcctgtgtctccgttgctcacatgctgccgtgcgccatcgatgctctcgtcaaactatatgctngcgctctgcgcaggatccacatgcgcgagttgtcaacattctcttcncgtgtgtgtgcgaggtccgaccgccgaccgatccgcgatcgcgtgtccatcacgtggtgcgtacgctagcgaccgccactatagtgtgagctaggctacg

SEQ ID NO: 17215 - DNA, 1347 bp, Homo sapiens
  misc_feature (1)...(1347): n = A,T,C or G
gccggacggcggcgagggagcggcgtggctgtccgtcgtcgaccaacgacgagccagaaccggcgtcgccgatcatcgctccgtcccgaggcggacgaccgcggccgggtggcgtcccgtggcgcccggggattggtccccattgttcgcccatcccccgcggcgccggcccccctttcccctccctgcgctgccgccatcctccgcgcgagatatagcatcttacgcacgccggcgatggccgcggtgcgcgtttcggcctcggcgccgcgaatgagccggacgcgtgtggtgatgcgatgggtacggggtttagtctattatcaggtccggcccctgctggcgcgcccaggcgttcgtgcccgtgcggcgcacgttccccgcgctcgacgggcgttgtgggccggtaggcgaccgttcgccgtcgcgcctcctcgcggcgacgcttggggccccccgcgagggggtgcggcggctggcgcgcgccgggcacctcgcggcgcccactcacagcggagccgcgcggcgcgccggcacggctgggccgcttcgtggttggcatggtgtcgggggccgtgtaggncgcggtggctgcttggancgagggtggtgtgtgttgattatcggcggcggctgcagcgtagtgtaaggatatgcgagcgtgcccggcttctatccggtcgcttccgcggccataagctgacgctggtatggccaggcacaggccgtggtcgtcatacagcgcctgccganggcgacggatacagccaacgagcgccgcggcngccgatgagtgcgtagcgaggggtggaccggtaccactctgcgcgccgcgaccggcttgcagggttgcccgggccaatctccgactccaacgacggtggcccacccgtaacgcaatcatggggcgcggtgcngcgagcggtagcgtgctagcgcncgcgttcggccgagcacgcctccgtacgcatctccactgtgtgacganggttgtcgcatagagacgtgggtngaancactcatgtggccacagtgcantgggtgtcgctggactcacgtgtcgctacagtngcgtccactgcgtgtgtgtccccgcccgcatgacagcacgaggncgtgcgcgacgacgcngntgccccgtgagctgcactgtgcgcgccgggcctgtgtgtgacgtggcantacgtgagagctggtgcacggcgccgtcgacggcaccncacggtgggtcgctgtcccgtctcgtgggtggagcagagagcggagagacagagatcgccgcnagagcgtggtagaggcgcgcgggtggctggngtcntaggccggtggcgcgcggatcagcggggg

SEQ ID NO: 17216 - DNA, 1110 bp, Homo sapiens
  misc_feature (1)...(1110): n = A,T,C or G
ggggatcagtggaggttttggctgtgtggttagtgaggcgaaataacgaacggcgacggcgcagccgatcacagatcggctgacgtcgtcgcacgcgccggcgccggccacggagcgcccgcttatacctctatgtgcacacatgatggcgcgctattatgaacactaggtggaggaccacagagagagccttcgttgaggctgggcgtcgggagagggttatgattatggcgccgcgggtcgcgcgcgtgactcctgcagcgcggcgtggaggcgtggttcgatcttcccgcccccgcgagggagggagtctgggtgggttttccggcctaaggacccgcggcgacatggccacgggtcggcgccgggggtagcagggcagagggggacggagatgggctcccggaagatttggcgggggcgggcacatttatggtcgtctcgtcggctgggtgtgtcattttgaccgggatgcccagttatacattgttggtggcgagacaagactgcgtggacgcgggaactcggctgggccgtcccgacagcgtatgccgatatgcgccgtgcggggcgcgcacaatcagtatgtcgcgggcggttgcgtgtagcgtgcgcgcttgttacacgcgacgggagaccggtccgccggggggcgtggaacagtatcacattaccgtggcggacatctcatgactctntggtgggctggtgcggggggactgcgcctccatgatcctcgcccccgcaggcaacgaagggtactcgacgccaacgcgtcagcccacgcgagccgcaaaggcgtgtcgatatagcacccagtgacaacaacatgcactatgcgtgtgcaccgtctggctagatgccgtgcnatgccgcgccactnatgctctgtagttcccantncgtaggacgtgaagttgacgcggagtacatcaagctatgtgtggtncgtgccggcacatcactgatccaggtgaggatgcttgtcacatctcgtagtgatgagcacgcggcgtcacgcacatccagctacgacacgtcacactcgggattcatagtggcgtgtgttggagagagtcgcgcccacagtatcacagacaactacgcgcg

SEQ ID NO: 17217 - DNA, 1583 bp, Homo sapiens
  misc_feature (1)...(1583): n = A,T,C or G
gtctcagtattctgagatagtgtttattcggccgtctggtttngcctggtagctcgtctcgacctctgatcctcctacgcgacncgcgttctcgaagatcgactgctatnccatctcctcctcaacatagtgtaggangcggctctctgttgtcgctcgcgcgcgcgtcgatctctgctctagatcctcgcgcgaagcgacacgattgctccgcangtcacatcacacactatgtgatgagacnaccactgggcgcgcgcacagcagatatccatactcatgtgctcgtgttacaactcgtactacattgcactcgtctactcctactcccactatangggtacattgctgttccanangaactgcacgacgcgtcgtatgtactgtcccgtgttcggctcgtagcacagtgtgacnatggcctcgaggatacctcgctcgcccgcctcgcgcatccactccttgacctgtgncatggacacgataagagtacacacccttcncancggctcgccgtatctgtgtcctntgactcttacactctactcactcgtacttgtgctcgccgctcactacctgccgtntcgctgtgtgatcatantcgtgtgagtgaagcaatatgtcgtttntacatcgtgggtgagttntcactctagatgtcgtgganagacntgtcgccatacntgctgtgaacatcagtnctagctggcagantaccgcttgcgcacgtagtctaggnatgattcacgatttcgtgtgtngtgccagtgtcctaaggcgagccgcatgcccactccttattgcaggtcagacntagtctcacgcgcgagtnaggccccgtcgctactcttgacgcgtgcgtatancngccacatatatgatcattagtatcaccaccagagagctcgtaattaacgcatgtgtgattctccgtngnatgatctcgtctgtacccgcatccgcctgnccacttcgatctcctactcattgtcnggcacatagaccatgagctcgcgacacacatacagtaacatgtgcaccgacgcgcgntctgatgtcnatcgtcgagtcgggcncngtagcacnacacgcgactgagctcgcacgctcactacgcttcgtgtagagctccnatancntcncnancntacatcgagttntcctcacatctccactgtctgatncgcgggagcgtgatcgtggtgcgcgtgcntcgtacctctcatatgtatcgcaacgcgcgccgcacgagctacacatgtgctcgcatcgtacggctagacacggagagcataacattcatatcttcntanggcctgtggaactgatgcaacactgtgacgtacacgtccggcactcgttcatgagtccagtattggctcgtcacggttctgcgcgagccgcatngttctagttgccccttctatcactacttcgtgagcatgttaccacttttgtgtgtaccaccagtcagtgtgagtcagtggctgccttcgcgtattgagttgctaggtagcaggcatcgcgactcgcacgctgagcgtagggtgtgagcgtggggcctctgattgcgcatcaggccg

SEQ ID NO: 17218 - DNA, 753 bp, Homo sapiens
catcgacactcttttgaagcatgagttacacctcaaaagaaatatgaattcatcaatgaaagaaactctcacggtaccaaactttttttgcatttcttaactagagcatggcatacgattatgccctcaataaataaccgctagacatctactcgcatcgaatgttaccgtacccctcccccccccccaccgcccaggatgcgaggccccccaacaaaaacccgagacccgcccccgcgagcacccacgggccacgcctacccgccccgcgcacgaccaccaaggccgatacccgcactacacccccagcctctcgggacaaccacgccgcggccgctgacggtagtcactcccgcccgccccgccccgccgccctctggacggcccaacctccgcccctcgcacgggagtcgagctatgtgggcaaaagacaccgcggcggccgcatacggaaaaagcggcgggcgccgccccacccgcacggccgcctcaaaaacgatgcccacccgtcccgcgccgagtaattaacgtacactccgcccggaggcccccacccgcccccatgccgccctcgacccgacccgaaacccaaaacgcgcgtccggcatagcgcgacaaccacccccacgaactcatcgcccgtctccccgcgccccttccctcgcaaccgcgccggacggtacaacccgcgccacacccgccccatagcacgccgtacaacccatcccgcctcccttacgggagccacgtcta

SEQ ID NO: 17219 - DNA, 857 bp, Homo sapiens
  misc_feature (1)...(857): n = A,T,C or G
agaagaaggggcgggggggnggggggggggggnnnnnnnnnnnnnnnnnggtttnnnnnnnnnnnnnnnnatttttttttaataaaaaaaatttatanattttttttaaaaaaaaanatagtattttatattccctcgccccnnnnannncnnnnnnnctttctttttatcacnccnnccccccnctnctccctttctcctttacaataacccatctctccccttttttaatacaaacccaaccagccgtagtgaggctattgaaacaaggccctatttctcaaaatacccccgacccgtttaaaatatccgacgaaaattttcggccccccgctcacaccacatattgatttttagtgggcggaggagcaaatttttttatttgttagaatctcctccgaataatactgaagttcacctcgcatataattaatatgttataatacaaaagacccacggcacctgatgaccgttctccgcgcttgaccccatagcctactttttataatttaatttcatttattaacccggcgccgacccgatactctacttctattctacacacacataactcccttcttccgtcatccgttactccctctctcctcccactacctctctaccttgaatcagcggtcaaaaggtaagcagcgcgccacaattcaccctccattaatctcacacaccacataatgcgtaatccccccctatatactttcctattttttctcgcgccccaatcacccctatatcatacatgcgataatatataccatctttccttaccttatgtatggttaacaagatacaaatacaggcacagacttgaaagaaattaatataaacaacccgattgt

SEQ ID NO: 17220 - DNA, 1204 bp, Homo sapiens
  misc_feature (1)...(1204): n = A,T,C or G
gtgggtattattagatagattgagagtggtgacattatagttctgagactacagacttaacgtacggatcgggcacagattaacacacaattctcccgcccgttggatcgaactaatacgtagtcagttcgtactactcgtggaaccgacgccatcgcgtttaatccgccgtcgatggtagacctctgttctactcttacagagcgactattatcctacattttacatacaatcacacctatcattgtgcatataaatcatatatagacgagacacgactacgaacagcaggaagtgtggattctaataacatgctcgacttgcctcgccgataccgggcgttctcgtcgccccgtccacacgcatgtatacggcacgcacgatatctgggctccggccgcagctggcgcctgctacagtatatacactcacgccgcacgtatggagattacttcatcataagtgctatgaggaatgcttcgtcagactctggtgtaccctacgttagagacgtgtaaaagtgtcaggtgcatattgtgttcttatcgcgacgccgcagggacccttgcatatgcccaatcagtgaatatgttagtagaggcattctattaggaagtatgatggagggtgatgaatttgcgcgggcatgcgcgtttatcttattagctcgcgccatgaatttcttaatcgacataactactcctctacgttccacccaatcgatgataagagcgagctggattccatcataacgttattagtggtgcgtactttcgtaagtgacggtgcaaggaaaacactctgcggaacccgtgcgaggtacgtgatatcaactcactgaactgtggcgctccatcgaatacnttagcctggcatgttgtacggactgcacacgcagtaaccacacctatcattgtataaagtggtcattgactacacacgtgacgcacaaacagaccgtcatatggcgaggtatatgcacagtagggttcatcggactatgcgtgtttccaccggntcgttacgtgacctcgtagctttatgaaatgtcaccccgcgagaggtantagtgcctgctcttatttattttgatcggcgcgaactaggcaggtggacgatacaataatgtgtggagccgagtgcgcgacgtacgccctcaatggtgtacggctgggtgagcntggcccggcaggtgcaacgtgac

SEQ ID NO: 17221 - DNA, 1471 bp, Homo sapiens
  misc_feature (1)...(1471): n = A,T,C or G
acggatccgaaggtggacaacacgcgctttgcagcgcccccacacagccaccccgcgccgcgcaacacaccgccgttcgcgacgcccnaccacacccacaccccacgtcttcacaagcgacgacaacaggaatgaatagacacgtaatcatagcatacactcacctcacattagcacgctacactaacacgcaacgctctcgcggcaatncacaccgtcagctggagtgccatcgacccgacaacacacgcctcgcgggacaagccgcgcagccgaagagtcgcagcacatcatcgccgtatataaccgagcgatcatcttccagaatcaccaccgcccagacgtcgcgatagaaaaagacccgcacnaacgaccgcaatcagccagcagagcacgagccagtgtacacccagaagcgcacggagagaacacctaacgctacccaccaacacgctcggctatcgaggcacgcgtcgagacatacatcaacatgcatactacntcgcgtgcacacatatcgaggaccgtcactcagaggcgatatataggccaccaggtccggcagatcgccccgcgcgtctcaccaacacacgggaatcgcaggcatcggaacagcacgatatcagtacacacccgcgcgcagcacggagcaacgcgggtgcgcgcactaggtacatgggaaacaagcgtcagcgcagggataggcgaaatacgtcagcgcgccggagcgccgcgaaacacatacaaatacgagtcccacacgcagcacaccgcacgtgaaaacgcgcacaagacgacaacgccagcgccgtcagccggagccgcggcacagagaagcaaaggacagttccggacaagccaatagcaacagtcgacgacgatactgacacgcagcgcaggactctgcacacccaacggcctcgaacgcgtcgaaagaccaggcagagtactatgacaacactnacaacggcgangacacacgacacancagaacatagaggacgcgcgcgtcggggtacggacaacacgacacgcaagaganagagcgcgatcgccacgaccgcacntcgcgcacacgaggacgcggcacacgaggacgcacaactcagcgacatgcgcgatacgcacacgagacgcacaggccaatcatcgcgccagcgacgaagcggcgtgtgcggagtgacangaacgcgcgcatgacaactgggatagccgccggagcgnctcggtcnaggagccggaccccgcacgacacgcgcaatcgagagtctcacgatccgatcatcgtcntgtatggcgcgngnccagtcacagcgacntgacnacgtggtcgacgcacatgtcaccagnantgagagtggtatacagagtagagagcatcntcgagatcgacgcatncgctatatggctagtcaggcagcgtagtaggacgcgagcccacgagacgacgtagagtcgccnnagtgcaacg

SEQ ID NO: 17222 - DNA, 473 bp, Homo sapiens
gtctaaactcctggactctagagatcctcccaccttggcctcccaacggtgctgggattacaggcgtgaggcatcacgtccaacgtaacagttttaattaccaaaaactctctggaaacagaatcttcttaaaagtcaagtttgaaatatgatttacaacaaaatgcacccattttaagtgtacagttagatgcatcttgacaaatgtgcatacccaggtaaccactactgcaatctagatatagagcatttccatcacctcaaaaagttccttcctgcctctggcatttactctctaaacttcaagtaaccactgatctactgtttgttatcagtttctttttattgctgagtaatattctgttgtgtggatataccataatttgtatgcctgtctgctaacggacatttgagtagtttccagttggaggttattatcaataaaaacactgtggacattaaaaaaaaaaaaa

SEQ ID NO: 17223 - DNA, 947 bp, Homo sapiens
  misc_feature (1)...(947): n = A,T,C or G
cccccccccaaacagagggaannncacaacgcnngnggnganaaaaaaaaccccccccccnccnntttgagagcaaaacaacgaaaaaaagnttttngggggggagacgcgnnacancagcaacccncgcacangcggcggcgcnngtgccgncaacacncacgaacgccgcgccaaacacaaacacggagacgacggggcaacgccaacacaacgcaccgccggagcgaggcgacaaggaaaccccacacaaacccagagggcccgcgggagacacgacccacgaggaaaagcaaagggacaaacaccaaaaaaaaacgggttttgacaaaaggggcgccaccgcgggagaaacagccgcggagaaaaacaccaggggcagggagaagaaaaggaggnaccccgacaaagagaacacccccacgaaagaagaacaaacccacacgacccgagccgcgngagcccccgagagcacgcaacaggggagagaaaaaaaagcaacccgcgaagcgggacgaaaagacgacgcgccaaagcgcaccagacacccacacacaaaacaccaaccaccccacccacaccagcaggcccaccaacccaaccacccgcgacaacaccagaacacggcgccccccccgcgccacaacacgcggcaagcaagagaaaacccgggcgacacaggaggagacgcagagaccgaagcagaagcacaccacaaacacgcgagggaacccgaccacgaaaaaaggaaaggcagacacaaagaccgcgcgccgaaaaaagagagcggaggcgggagagacggcgcggaggaagcccacccccgcacccccccacgaacggagaccccaggagagagaacancaaacacaccagggaagacagaaccaggggaagaaagacacgagagagcggggtaggaagaagaaaacacaaacgacgagggt

SEQ ID NO: 17224 - DNA, 1793 bp, Homo sapiens
  misc_feature (1)...(1793): n = A,T,C or G
ctggatttataactattgtcgccatccggtgtcctccctctccatactccgtccgcaccgcgcacactctgaacgatcaatcttcacattccgccgctccccacgtccgccgccagccgtgcacactcacagctaccatacataattttactccgtctattagtatacccagacccagtatatagcgcaacctatatttactataatagcacaatgatacataatgtaagaagattctaattcagaccactcgcaacccaccgacacgcacgtaagaccacctactatctgtgtagtaaagtataaaactatcgggcacgtacggcacgttgcgacgcgaacgcctacacgtacactcgccggcccgcgctgccacatntatctcacttaantacgtgcgnctacgacancacctatgacnctcacagacagattgcacgatcntcgactcgatggtccgtgcatttattanatgaccatcgatcgattagtctacgantgcgctacgcanttactatcnccntactatttgtcgagtatacattgtatanttgtcgtcactcactattgtatctcacntcntcttgtaggtctgactcgtgcgcatttcaatgcgcgctacatgcgctaacgactgacgcgggaacatacatacactagcgtgagtccgcctgcgatncgatacacagcagagacatatatataatgaatnanagagacgactatagtcgtagataggagtgtatntagaggtagnaanattactngtcgagtagcatatagaactangcgcagntgtaatcgatagtaatatactgtacgccacgtagcagactcaccaggaganatcatatatccatcatacgcgncangacgnacgcgaccgacgtatntatgatgcagngtctcgttccntacngcatnatancagatctatactacgatcctagtagncngtcancnanancgctcngtaacactctganatacggtatctcgacagcgatagatgcactctccatantacacanatacgtacactggagagactgcncttcnctgacgcacacgtgacnacagcacacgttcgctccnacgtcgcananctaacacgcgcagtactcgacgacagagtcctctcgatcgtatactngcatagctccacactgatatagcatcacagtcagatnatgagcntcgctcctntctactacacnaagacatagagcgaagcgcgtagccgcatgcgcgtcgtgtgcgtcctcggacgtctangactatacgatcnancactgcgcatacgtatcatgagtaacgacanatgagctgtgacctcntcgagacgctcactacantacgtgctatcgccgtatactcgacacaagctancnactaantngncagtgttgctatactcatgcncactcccggtgtcgactaccatctccngtacnattncgcagngcatgatccacatacacgtcagantgtacnacatntatcctgttcatgtgacgacnncanagttgcaacagtagcgctcgcgacagncactngcatcgcacacgtcgtgtagacgatgcgcgacagactctactagtgtntctccganctctacangcccacgcgacagcgctagagtggtgacagcgatgtagcntatctcgttagattgtgctcagatgtaggaggtacacataacgcatcgagcgntatcgntatngatatcncgagacctgngnctagtgcagctgtcgccagcacncgtcgagtcncgcgantncagcgcgtcg

SEQ ID NO: 17225 - DNA, 1037 bp, Homo sapiens
gcaaccgacgacacgacagacagccgacgaccgcacgctcgaacggttttctcaacacacaccaagagcgatgagggtctcatatcagacggaaaaatatcaggacaatggaatgcatgcaatgccgaagctaacttaatagcaactagacaccacaatggaggataattggcccggaaaacaaacatctactgaagaatagtatgaaacaacaaacaacgctggctatttctggccccgcatattcatacacccaacaataccatgcacagcagagtttgttcatttttgatcccgtacggttgagtattacgtaggctagatcttgatcgtcctccatactccaacataccatacaataacaataactcccccctcatcgcgtacatatgcaccttacggtagtttgtatccgcatttgggcacaactttcttcccctcgtgtcccacatggccatcacgtgcccacgtgtcacgtcgccctatccgcctagcttattatcttagattaataccgccagcgttctaggggccggcagatttactttccttatctggtacgatgactaccgtgtccccacgcatagcgccctattcctccaattccgacaaatgattattcatacacgggtagactccgtaatacccatttattttacacacccgccctgcctccttgccgtttcgccgccgtatcccacttcgccgcctaatccgcccgagtgttgagagtgcgagcaggtgtgacgggttgtcataattcccagtcaacgtatatgccgttaacccggaattacgatatgaattcacatacgtggcgctgtggacgctgggatattctttcaccaattacccagtccaatatctccgtcccatcgcatattcgttacccttagtccctctgataacccccctttctaaacccccttctacttatttccccccgcctctttagtacaatcttggattttattattttttccagttatgccagttcaattatttgcaacttcgctcgccgctttattcactttccg

SEQ ID NO: 17226 - DNA, 376 bp, Homo sapiens
gttagagggcaactacccaaggagagctcatgcccaaatcatgtctggccggggaagagaataaaactttaacatgcattcccaggggccaaaagctgttctctcctcctaccactgggtaagatgataaagggtgagctcagaactgggcacattcctcattgaacactcacctctcatcggggatcaacatgttcagatgtgccatatccaggatgattcatcgtgatcaaagaaaacaatgtgattgtggtaaatccctttatcagtgtagcttattattactaccgagaacttgaattgattcaagctacagacttgaataaacctcatgatttagtaaaataaacctcactgattttcaaaaaaaaaaaaa

SEQ ID NO: 17227 - DNA, 967 bp, Homo sapiens
  misc_feature (1)...(967): n = A,T,C or G
gcntgngngngggggcggcgggcgggcgcggcccgcccccggcgcccgccggggcgcccgccgcgcggggggggggggcnaccaggcgcgacgcggcggggcgggaggcgcggggaggggcgaggtatcccccgctccccgcgcgctgcctattatattttctccccctttccggcgccactcttatcctctgcccccaccttatttttcttttttgttcccctttttccgccacacacgtccgtcatttattaattttatcaaaaaccatatagaatacgaaacataattcttacccccgccccctatataatctgcgcccgctaccctacgcggccatagtaacaacatcaaaattcaccaaggccgcacaccaacaaaaaacacaacgccccacatatagagcagaacaacaagcgccgcgcggcacttctttaattgtcgcgacctgttatcagtatgtccgtcgccgattaatttatcgcacgacagaatgtattgttctccgcgcacaacaggccacgatgcacacgacagtcttcgccacccacccactatgtatatatttatcgtccatgtcgcgcccctgtcccgccgttattatgtgttcgcgcctctccgcgccaaccngatatttaatacgtggtatacacgccgcaccgcggtatgatatatgtctatattttcttacatgtcctatataatacataatacacaccaccaccactgttcgtgttctaatacgatcgtcgcgcggttccgcgcggatcggcgcggatggcgttgatttcgccgccagcgatgacgtacggtggacgagaggaacgcgcgagcgctcgggcgggcctagggacgtagaatgtggaatggcgataaacacgaaatgaatgcgacaacatagtattcatatttttatatcgaatccgaccttcgccgttaccgatcctaggtgattttggccggaccg

SEQ ID NO: 17228 - DNA, 1426 bp, Homo sapiens
  misc_feature (1)...(1426): n = A,T,C or G
gccctatgcatcttnaaacacatcngcgcctcacanaantannnntatngtagttgatgtatantaagagngtatagttcgaagaaganatattcggcgnatagagatgattntnanacaccgcatcngtttcctanattgtgngctggagacncagagcagaagggcgtgaagtggttttagttgtgtgagttggtgtgtgaagcaagtgataggattnnntncaaacntttntcncttcgtatatctattctatgaaccanctctnttctctgcatctgtattctntacacacgatgtccggtgatgcaccagcgcanacgccgtcacnngtnnttnnnnagtacatatatgacagaacgaggatgcgcgtagcgtaatcgtcactacgcagntgtatgaactagcgcttcatagtcctgtagtcactatatatagatatttattgtactctagatcacgacgatgagtgtgacgtggttncgtgtgatgcgtntctcctgggtctcgcatatctaccgtagattactcgcgtgcgcgtttgtgttgtctgtgcatcagtattagtatgtgtatctgtctgtcgtgcgcgcgcacgatatctntgcgtagtgntgtagtatgtgtcgtttatgtggacgcggttcngcgcgcacgntatatatactccaccacgcagacgtatacgtcgctcgcgttttctcgttgtttttcctttctactcttctatgtgtcctactttatgtgtttgtatctccgtataattatatatattataaaatcatagctccgcctgccggtgccgactgtcgtaccactggcgcggaggatgtgcgtctcgaatggcagctncgtcgcgctacgtgggcatgtttcgccggaagcacgcacccctccgttgagtttttgtgtcgtcttcgccgttgtcgccgcggttttcttcgcgcggcggcgctaggatgtttgcgcgacgtgtttgtgattccaggccctgttttatacaccgcacttcttgttttttccccgcaccgcagtccgcgagctgttccccacgccgccgaatgtaaagcatgtcgttgccccgatttcgcggctttttatttatcgccacgcccccgaccatgtatatgatatttatttatcgtctccccttatagattttgtttttttattgtcgcggtaaggagtaacaagtcccgtactatcgattcgtaaaaatctgagggttcgcgccctatccccagtttcattttatatcctatcccttacaccccaagaaccacgatcaacattcggctcactacctttagtcgaatgaggaggggcggtgtgcgatgtaaggtaaccgcagatatcattacgtttatttatatgattcttcagttaggacgttagaaggtattacacgttgcaactctaatagtgt

SEQ ID NO: 17229 - DNA, 780 bp, Homo sapiens
attctggagaaataaatgggagacaattaagtggaagaaatatggggagggacagatacaaggaagtatgtgtgaagtggaaatcaggaggtgagatggaggacaaggaacaagcacagttaaaacgcacatgaaccaacccaaaacctgcacatactgaccctgcgctaaaacctacagctccctcgtaccaacaacccctgccaatcgttatcaaatccccacacaatgaacatacctaaaaataactttatcacccccatcaccaccccacaaaatcaccaaacccaacccactcacctcccccccaaaaaacacataaaccccctcccacacatccaaccctttcccacctaaaaacaaacaataaaaaattaaaaccccccccatcccccaaaaatcacccccacgcaaaaaccagacccacgctcccccagaaaaacctccccacaaaaatataatctaccccacccaaccacccccccaaataacccgacaccaccaccccccttaaatccccattactacaaaaaataccatattcccttcacctatttccttcacccacatccccccaactctattataatatccacacaaactacacaaatccacaaatctacacatcactacaaactcaatctaaaaactcaacatcccccaactaattcccaccccatcacatataatcactcacactccaccatctccatcacttctctatcacccatcctttctatctcaagcacccatcaataccctcacacctcgcactcacac

SEQ ID NO: 17230 - DNA, 1063 bp, Homo sapiens
  misc_feature (1)...(1063): n = A,T,C or G
cccgtaagacaagcggaataagaacccaaacgtagagcaaggctcaataacataacccaaancgcgcgtctacaatctaaagaaacgatcgcgaaaaggatccgtttaaggcggtaaaaagctagtatacaagggaaatgtacgcaggataccctgaagaaaaagacgaacagcgcaaagcgaaggcaaggggaaccgcataaagacaccncaatgaccatccatcatacgtgcaaaaacacggatcaaaagatactgaaagcaaccagctcaccacagggcccggcgaaagccccgaaggtgcgccagacctgggctgagggtaggaataaaggcagcataagttaggagtcgatgtcgaagatcggacgtgaggagcagaacgagacaccctggtagatattacacatataattgtaaacgagacaaaacacagaacatagacagaagtcccacacaagacgtacacacgagtttggatgcgtaaccgtgaactagacgttcctgttgaggccatctttgattggggttcttttttcgcgtcgttatcgttaagttgaataccttacacacaattacaattttagttcggtggttggtcggggtcggaggttgggagagggtcgcgcatttcgtcggaacacgcaagtcgtcttctatcagttatgtcgataatctgaggtcaaagtagccatgtttgttggttaatttccaggttggtataacgcgcggtccaccccgtttatatttttcgcacgacacatattatacggcaccacacgtatccgaatgccagtaatctcaattcccgagtcggatagactttcgcaatatgttatccccacaccggtttccgccaagattcctatccctgcttcctcagtctcaatctaccgttatccaggtccgtagcggtttttgtcccctccgcgtttgtccgtgtgcttcccttaatatcctcgttttacccataatcatagtattttccataatacgtccatacgatatattataagtccgattgattcgtcggcgccccgagaatttccgcggttatatcgtt

SEQ ID NO: 17231 - DNA, 764 bp, Homo sapiens
tttcttgtctcagatgaaactttggacatggacttttgagttaatgctggaataagttaagacttccagtctgttgggaaggcatgattggttttgaaatgtgagaaggacatgatacttgggaggggccagaggagaaataatatggcttggccctctgtccccacccaaatctcatctcaaattgtaatcccctcatgtcaagagaggggcctgggtggaggtgactggatcatgggagcacatttccacatgctattctcatgacagcgagcgagttccaacagacctgatggcctaaaagggagaggcaccttacctccttgagctctctctctcctgacgccttgcgccctacaaccatgacccacgctccgacttccaacataaatatatcactaccctgccccttccgcttcatgctcactcgtaccaccccccagcttattccggcgcatactacctcgtctccccacccacacctccagaacctctttttatccgagtctattacgagcacctaaacaacagaacctacccacctacatagttaaactcgcattccccccaactacacgccaataatcaataagtcgacacctgtcatcccctcctaaattaatttccaccattacttcaccccctccccctcacgacatataaccccccgtaaatcgctcgttaatccgtatctccctcaccgtttcgccgcacccgtccgcctccccggtatttcgaattaggtcccggcgcgtcaatgtgtg

SEQ ID NO: 17232 - DNA, 1155 bp, Homo sapiens
  misc_feature (1)...(1155): n = A,T,C or G
gaccccccggccccacccgtcgccggcggcnccgcggccaacccgcagcgccccaaaaaccgcgatcgtagaaccgcgcggttcggcggacagcccgngccactacgcacttggacaaagcaagcgccggcacacaaccaacaccacacggaaaggaaggagcggggcggggtgggcgaaaaaaccagctaagaagaacggacggantggcagcggaagggagcagaagaaccacacgcaacaccacgcaccaaaacaacgcaaagcgaaataccaacaaggcgaccacacccctcataaccccacccccccaccccgaccccacaagaacgaaaccaagaaagacggacaaacaaaacataaacaaccgcagaaacacaacacggaccggcgcgcaggcgaacaccccccccccctaccnctaccgtacactataaaggagccgcgcagaaaggatgcagatccccgacacaccacacaccccccccccccccgccccaaccccataccgaccgttcaccccgctccccacctgcgggaccccgcgcggacgatgatatgcgcggtacgaaaagaaagagaggggacgagaacgggacataacgcgcgcacgacgcagccgcagacacaaactccgacggtacacacgacgagcgccgatcgcgtcccataaacgcatcaaatccgcgctcgaccgccgacccggccagagtcacaaggaccgcgcacccacacccgcctcggcgacagccactcgcgcaaacaccgcccgcggccgtcgagagcgacacggcgcgcatgattaacgccacggggacccagcgcagaagcatgacaaacgcgacgcgccacccgtagagacaccgcccgtacagacgcgcagggacacgagaaccgggccacgggccggagcgacggggataaggtaatccctcacactagacccgcgcaccacccgccagaccgcagacagtactatagaagggccgagacgggacgcacgaacccaggagcgtttacgggccgcagaccatatatccgcaacccaaccagaaccaaatacccgcaaaaaaaaaacccgagacaatcgccccgaccggttcgccgaccggctccgcgcggtcggcctcgcctgggctaagtttcaaccccccg

SEQ ID NO: 17233 - DNA, 1868 bp, Homo sapiens
  misc_feature (1)...(1868): n = A,T,C or G
aaaaaaatataanaannnnnnnannnnannanannnnnnnnattnnnnnntnnnnntnaagtattttatatnnngttnnntatatanntnannatatntaganngattntatannnntatgtnannnnatntaatatatttntnntatatnntnnatatannnntnnnatnnnntttantaattnttnnnttatatatatnntnnataatatatnttantnataaatatnttnatntnnnntnttaaatntctccannaatnnnnncanaantagaatattatatnttatanataatatatntattatnatatattagcttntnatatttgttgnnanatgtataaaacannnncannaaaanattaacgacatagtatatcacacgagagcgaccatatatatccgagtaccgaacagatcncgaacacacgctgagaattacacggtcgtgacagtcgcgcgtggaggtgtcgtgtacagcatgagctccgagcctctcgacgccacgtgcgngctcacgaagcaagaggcatcngcagacacacgagagtgcaatagttnntaattatatcaatagaatatacagtantaatntgaatatgcacataataagnantnagagtcgagtatntatnatattatgttntnatatataatgatntgattactatnatagtatatanatagtatatncacnangcacagcacgtatcanancgataataanancagnatantcantacatatgagcacgaagtntacnangtcanacgagacngtcgcagacgtcgngcgcatcagtancangtgacccngcactacgtagccgccgtcatctggtcgncacgtcnngcgatcgcagccagccgctgtatagntgtcagcaacnatagttactagaatcggngnctacgcccgacgtcagtccgtcgcgcagctcggtctcgcgctctgcacactcccncgaccggtctctctgcgccactcaacncgcgncacgacagantctcgcagtgcncatcgctgcgacacccnacggtgcttcatctccagtgtcctgcncgctctcctacgtcatgtatgcagcgacacccgcagtagagtgcgtgtcgtggcacatgatgagacatacacaatgtaccactcgcgcttgnccacggacatgcgcgatcgtgtgatattagagagcagtaaggtgcagatcagtantgngcttcgcantagtgcaataaanatanaggtcatattagtagcagagtcgntatatntaacatagaatggtacgtatgataaagncaaacgnagaatgatacgtatatacagtgtaatatatatatgtcaattagtacatganacaantaaaagatatgtangatgtagaaagatagagagtaagngacggtctttatgtatagttgngagcgagtcggccgatgtgacacacctgcttactattctgcggtgagtagctgctgaccgcacgcancaattgtgtggctcgcgcnctcagccacccatgcgccactgcgctcntctgcgttagtagtgagtatgtngtgnttntcgacgccagtcagncctatagccgcgtcncgcctcaagacgttgctctgatgatctatcctccactgtcgatttagagcagcatgcagtcgtggcntcaagacagagagttgtggagtgacgcaatcgcactgcgngctagtatatgcgacaagcatggncncagagacgcgcacactacattacagacgntgtatgtcgccgcatatatatnanctcggacacgacagagacgacgtactggntcttactgatgaactatagattatcgctatgtcgcgaaantattacncaatgtgtcg

SEQ ID NO: 17234 - DNA, 1874 bp, Homo sapiens
  misc_feature (1)...(1874): n = A,T,C or G
gcaccaccacgcgccgacancgggnttgtggtccactgccngagagggagtgngcgaaaccacccntctntacnacaccaacacgtcagcccgagcgccnaccattcaanaacaccacacgcccataccaacacacacacacgccgcgtctcagacgaatataagatggncgcacgatagganacaacacagatacacgacacacatcgcagcagngatcgcagcataggcgcagagatncacatggcgcagcgcgtgagagagatatagtctattcgagagnatgtcgtcagaggatcgatggagcacaaggagacatgacatagcagcgnaggacagtgctgcgccgtcgggatagacgagagagagctggnagtagaactgcgtgcctacatcagcgagtgctcggcatagcacacagagacatcgatggccgtagacgactctngcagaggcggtgcataggatggagagatcgacacagtagcgcgcanagtgtgcgagagcgccgcggcgagcggntgtgtaatgatagtagagtagcaagctcggtgaggcagagcgactcgcacgataagtgtgtgatgtagacggacagaaatagagacacaaacacacacgacactaatcgacagcgcagtcgtcccacgatacgaggattcacacgccgcgacgatacgagcaaacgtcgagacgntagtcgagtctgcggttcgcacggatgtcatcgngcacggaccgcagcgcacgcggcgcccggccacgctggaacgcgagcgccagctctagcgnccgagatagtaagcggcctgcccgcgtgatcgacagtcgngctctcgtaatatgcagaacagcgatgagtaccacggagcgcgcgcggccgtcccgcacatagaagcgacanctcgcacgtactncaccgtcgcgacgatacntgcagtcagcgcgcagcgcacgacatgcgcccgtcatttcgagagtcagatcagacagctacanagacngtggcgacgtaggagacgacgcggcgatagcagccagcgaccgcagtagagnacgacgntatcagaacgcgagcggcgccgcgtcagtgatagactcgatcagcgtatcanaccacgcgccgacttatggccgagtacacgagcgcgcacngcgtccgccgagccgagtcgccacgctccgcccgccggtccangcgactgncagcagctacggcgcgacaacgcgactcgttcancgatacggagcacgcatgccccacgacacacatacntgacgcctcatgacagagaccgacgatgtgacgcacatncgtgcgcgcgcgcgccctgcacgcgncgaacgctatcatgctgacacatcgacgacngccgaggcgtgcgcagcatcgcacacacccgagcgcacgcgcgacacgncgttacacgctacacgcgagaacatcgctacagagtgagtgcgtaccacgcgcacacgctctatacgcacgcgtgtgagtccgctacctcgcacatnacgatantgcgnacgggagcacctcattatagtcgcacgctgcagcgcggagcgcgcgtgcgagagactcggcacgacggtacagtcgtcgggacgctcatcgcgacgcgacgtcgcaantaacccgcgcgcggcgcacagaaacacgcgcgctcgcggcgtcacgtgtcaagcgcttacgcattcggtccagccgccaccgtgtgaatgatgacgatnacgtagcgcagcgccgtagcaagatntctantgatgagtgaggagagacgcgcgcacacgatgcatcacgacagtacgccggcgacgcagcatctcgatagatgcgaccactgcgatnacagccgccacgacccgcc

SEQ ID NO: 17235 - DNA, 784 bp, Homo sapiens
caggagactcctctctcgcttatggataggcgctctggtaaggtgcccgtgtaccaagaacctgggagaccctgcacatgctctggtgagcgccgcatgggagatcccggtcttccccctaagcgctgaaggtcattgatgcagcaatcgaccgtccctgtggagccggataagccactgcgcttgcttgcggctctgagagaagccaatgctctatcctgaggcggcgttgtataatagaagatactctgactttatgacctgtctatacatgtgagaatgcgctggtgagtggaacatgtatgaggatgtaatacggtcctaatgcgtgttatcagcctatccagagactggtattactgggctgcgtgccctggattaatttaacatggtcttatactgcttctgacagaagggtcacgttggccctactggcttcattgcaggtgactctggactcgcttcgcttaggagctggattattaatgtacactctcttactgtctactgtgagcgatcaaggctcggttagaagagagcggcgtcgtcatgatctaaagcgccggtatacgaggtatccgcagcttcttgggtcttttcatagcaatgaatcgcgatccaaggttgaagccctgccggcaacattacaagcgccttatgtctgactggcttttataggatccgttcccctgactatcatgccatgctctacgctataacacttaggtggacatgctcctactggactgtacttatactaggcttatatccccagataaactcg

SEQ ID NO: 17236 - DNA, 919 bp, Homo sapiens
  misc_feature (1)...(919): n = A,T,C or G
gaatggtggagagatgaagnagtaatttatgttaagatggaaggtatagttatatatataaattataggnataaattatttgagtatttgtggtagttatnatagntgtttaaaatttttttataattttatttgttaggtgnataagggnanataggtgatgtgaaggggtgggaaatagatacagcgtggtactgaaaatatcataaataagaggacggaatgatctaaagaaggaagcaagtagtaggtntataatgtaaggtaaagaatatggttataatataatttattatattaagtaattttattaacgttaataatagtttaatcaatgcttagtatatttttatggtcaattttgttagacctcggtgncattgaggggacattatncatgataggaaagtctcagtttcctcgcatagatctcgcattccgatcctaggcgaaaggcgggcccaatagagtcatacacaataatctttatttattatagcaatctaaaaatgataggaacgaaaggcccctctcttttcgtttttatatctatccttaattagttgcgtagatagtcggaaggtgatagagtagagaggactagaaaggtagaaggggaggnagagtatgagattaagagaagtaagatggtattaaggatgggggatcgagcgtaaaggttgcaagtggaaatgattgtatgtgatgccctaatctccttcaccgcagggacgaattaattatgacaaaaaacggaagacacggccccccggccagtctccaactaccatcaaatcccaagattcaatagcaccctacaccttcaacttagcagccacaggctaatgccccgtgaggccctccatcaacactccaatccgctcccacagtactaaaccaccgcaagaacaccaccgag

SEQ ID NO: 17237 - DNA, 1873 bp, Homo sapiens
  misc_feature (1)...(1873): n = A,T,C or G
cctcattctcagccactncttgttgtgtttngtatggtggcgngcgcccagcgnnngatagtgatggcacanatacaccacagaacctgacaacgcgaaacgacaacacagttcnacctcgacacanntcgagaagatntacgcatcaacagnctcncncatcngtagaggtatgttngctgtgtgtgtgtgacgattgcgtgcgctgcctaggttaatttgctgtgtggtcatgcgatggtggtcgtgcgtggtgtgcngttgtgcagataacagtggagncgagggcatgtacgtcgaagatgagangtanagacgagagtgagatgacagcgtcaggtggancgcngatgcgcagntgatagtgccgcgttcgtgtgcggtgtgtcacgtactatcaagtagananntctacgcagtgtgtagcagaagngcgcgcatagggtgttacggtgagtctgatgcggnacgcacannnntanaccaanagtggcggcaagcgtacgactgtctagtgagaatgaacgtgatacgagcagttaaacacgccncccgctcacgacaatctnttatgtccgccctctcagcgtattctangcacatcgcgcgccgccgctacatnatatacatgagggtggacagcggcgagcggcggagattacaagtgagcgcgcgccgcgcgcgggtttgtcgngtacgggcgcgctctcgtgacgttagtcgaggtacacnctatatgtgcnttgtgtcttatcacatacaganacatcagctcacttcagccgccgcttcacgcgcgagcagctacngcggagcgctaggttgcgcgatgcgcatgtgctattgccgcgatcaatcatagtgtntcaatgttgcattacgagtcgcgatctgtttagcgacccaccagtntattcgntccgcatactgtatctctatcgtatnttntccacgccaccgcganctcattcttatcacccatttatttataccatacaacctgtagagtgcttgcttctctgtcgtatatatataactctcacttattcagaggtcattnattcaatctctatagcagcatgaagtcacgataggagtagtgagtgttcttctgtgtctccggaagagtgttgttttgtcncattaggagcgagccttctttcgccatgttactcagcgatctttcgggcggtggcgtagcctgggcggccttgtgagagagagagtgagcgagggcgtttgtctgttaaagtaacacagccttacacttcttccgcacaagaggcaaccacggcgagagaatgacagcctcccgctctctacagagaaggcgaatacgaatggcgccgagtgtggatnaacggatgaatccagtagagggctgtatagtagcgagaagacgctgtatatgagtatattttgttatataatanaaccacaattaggtgtgtcgtgcgngagaaagaagtcacaacgtatctgctatgcttagcactccaggagttgtagtgagggagtatatatcacgtagaggtaaacgagtggcggacaggatcgtgagagtttattttctgttgtgcgcgctgataatgtagcggagagaccagttgctctaatgacgccacgccncgacacgaacatgtagctttgagtgttttgttatacagaataatacgagtattgatgtgtccgtgagaaggagagcggtaggcgagagagagagatatgctcgcgtgctttcttggttgagcgntcaccaccgtcaatacagaatacgacgtttnacatataattgtgcgcgtgatgagtattccattacttacatagggcaggtaagagtgtttgaatgatggttagcgcagtgtaccaaccg

SEQ ID NO: 17238 - DNA, 744 bp, Homo sapiens
acttccttcagtctgcgcctacctcccaacatgaagtcttccaacttttctgtgcttccatctgcttggtgtctgcctgagaaagaggtttctaagagctactccaaaaaccaaaatcaccctcaaggaaagcatgaagatacaaagataaaatatatatttttataacatgtttgaaagactcacaacacaaaaaagcatttcaaaatgccacctgttattggaaaaataatatttatatgcaaaaggtattttaaaaaaattatgtgaatgtcaccagtcccttgtgcaatatgagtcaactttggccctaagagtgacaagtctaaccaaattgtcaatctttaatgttatttcaagaccctaggcagaaaattattatacagcctcctgtgaaaaaggaataacaaaaatagcaaaagcaaatttcatccccaaagggactctgctcctctccaaacttatctctatgcagatttcatacagaagacttggcctggtatgcaagaaatcagccaaatgacaacaactttatatgttgcaaaaaaatgacaagttatatgtccactcctgaaccatccccgacatttcagcttttatacgcctcacccaagggcctcttatctaacgtcttgccttgtactcaccccttcctgtcccgtgacaagtaatggtccttgattaattccatcgcattgattttctttctctgctcatgtgaacatggtatgaacttggaaacaa

SEQ ID NO: 17239 - DNA, 1187 bp, Homo sapiens
  misc_feature (1)...(1187): n = A,T,C or G
aaaataagnnnagnannnnnnnnnaannanaagataaaaatatgaaaaaatagagatgataaaantttnaagnnaagaatnaanannnanataattttataagaattaaccacaaactaagtgaattaaantaaattctcnatcaaataaaagaaatataattataataactaaaaaaatacaaatagacacacataaaaaaaagaacacaaccaaagaaaaggcacgctccgcggcagactgggcgcacgccacgggacgctggagctcggggccgccacgcccgcagagcaaccggcgcactctgcaaataaacaataacaaaaaccaaccagacaacacagaaagttataaacgacaaatnttaanctatataaattataatatagaatcgganaccgacccaagagcgcgtaccacccaccctcaagagaacacagacanaatcaccacaccagacagcgatggacggcacctcggagacagcgcaacgcagcgccacacgacaccacagcagaaccgcctaccgacgtgaanactcaactacacctctcaacgatcatanaacccnatcgcacacacacagaccngcaccctccgaaccnncatcacaacaaacacagcaagacacccacaccaagcacacaaacccacaccaacgaagcaccacggcagccagacgcgagacagcgcagccgcacggcaccccccagtcaaccacatacaaccgagcacaaaccaaccgcgaagaatcaaagagtaacatacagcaaagaagacacgtcatcactggcctcgcacaggagacaaacaaacagcagaacaagaaacagataatgaaataaaaagcgacaacagaaaaccgacaagaagacacacaactcacaccagaacacagacacagaagaagaacacccacctacgaactcatgacagagagccaagcagagcagacgcccggcgngagacgatgacaaatcagccagaccccggaggaagacgaantagaaggcgcacaagcgacgcagagagtgctgcaccgcgcccccgcatcaaaaccaaaagacaaacacgtgtcgtagagacaaaagaaacacaagagaagcacactcataaagagaccaactcgaccacccgacgaaacgctaccgctgacgagaaaatcgtaagaagtgtgattaagaaat

SEQ ID NO: 17240 - DNA, 2420 bp, Homo sapiens
  misc_feature (1)...(2420): n = A,T,C or G
cccccaactacancanancacgacancncnnatntataantgtgaacacagacagcngacgccncgaccngcgatactgctttcggcgttttttgcgcaccgntagacagcccggccccacgcagcacgagagacnagccagagnacgtcgtgctgncgcgtgngatncgcagccatcccgctgcgcgcacgcagcactctgatgatagtgtggcatggctgctcatagcgcgtcgcgcgcancagtatatgnatcagganagcngagcagtagtcggtgatgagcantactgtagcaagggcagntgtcatcgcatcgcgacggcagtccgatcatgatgacganagtcacgagtagtcggaagtagtcntgtgatacgatacgacgatagaatgattcgcagagnagatgagancagctagacaagtgagagncgttcagtgcgagcttggncagacagnaggataccagcatnanagatngtgatctcagtcgcacttgcgatccgtcgacactancgcagacgttntgcnncntntnctgactgagcagccantgttnaaggtgntggagnagngcgtgaatcggctgntgatgactcgagcatgagatcacgagcacgtacggacgcagacgacgatgtctgcgtcagtccgttcacgcgcngcactcgcgngcacagccacgccgnagcngcagncgcncgtnatgtattgtagtccgacccgagactgcgctacagcntcncgacagcaacaatngcncgnnacactacnacanncanatagctatgagatgatatagangatgtgtgtgnagagtaggagtgntacgagcgangatnacgagntcgcntaagnacgatgtcaannagcacgatgcgacngacgacgagtcaggacaggacngatgnagcgcaagancgagatngnaatngntgcnaagacgcgtgngncanaccacactcntacgtcagcagccagangacgacgatntacgncaactnactacgatacantacgcacgaatgatacctgccgcgccacnaccacntacgacgnacgacgcgnacaccagacacgtacgcatnaacatatcaagcgcagnatgacattgcacacgcacatcgagtatacgcacacaacgcncgacagatnctcgatcagattntccgaaatanacaaatagcnacgacgctcgtatgcgacagcaacgctacagtcgcgcgcgcacgatgaacggataagnacactgcagatatctacggcacgatgctgactgtancacncactacagtcgncagacgcagcgatataacgcgagtcntagatcanttcngagtgaagnatatgtcagagcctgcacagttacanactcgtanatgacnagcagnagtactacacgcancgngacgcgcgacacagcgatcgtncactacagcncgtaatgctcancnncacgacgactgtagaactgacgccagcataggtgntatcagtacacgtctagnctagtcaanatcccngtctnacgacgagnatcaagagtagtgaacgcgtcctacagnagatcaggagcacgatcgctgcagangcngcacncaancaagcngcagcacgacgcagcancacgctaagacggtcatcgacagattcacgacgcagtcacagagtganaccgacgatnacgatacacgacgnagncgnactcgagtctgtngacaggctgcgtacagcaganatgcagcgtgattactgnatgcntatgtcgctgcgcgcacagcatgagangagacatgtcgtcgtgtacgacagtcgcggcgtgccattaacgtatcgtcagacatcgcgaanccncatcgtatcgnagcgacgacgagcgtcntctaccttcgacccacacnatcatgntgatgntacagnancggtacgaatcctgtgcnagctgtatacaggcgtgcagctgtatgagcgcacgacncacagacacacagcagatntcnatnacatgacnacgagatcgatcagtcatatatatggtgagatgctatngntcgtgagcgcacgcgcagcgacacgnagncgctgcgcgctcggatnagancagcatcgatagatatactagcacacaatcacgtcattaatcatacatcgcacgagatggaaatatngtgttatncgctagnacgcacccacngttggacncgagcgatctgcgaagtatgtagtagacgccgcagacgacgtancgtcgacgtgtcgcacggacgcgcgacaacacgacacacaagcatgcgacgcgcatgncgatngctacngatccacgncagcgcanatgtagactagcntacagacgacgtcntcatnagtcganaagttcgtnctgctcgagtatatgtaatcgactgtcgtacgcagcg

SEQ ID NO: 17241 - DNA, 291 bp, Homo sapiens
  misc_feature (1)...(291): n = A,T,C or G
ggagagaaagnnnnngnnnngngngnggtggggnnngttagaaaaaaaaaaaaaaaaaaaaactaaaaagaaagagaaaaaaacccttcggnggngaacngnnncnannnacccaaagaagaaagagggcttctttncgggggcggcacacccnaaaancaacgaccccgcccccgccgccccggcgcacccggacccccgccacaaaccccgccccggcggccgccccccccccacggccggcgcgaaggagcgcgcgccgcccccgagccgggaggaaaaaaaaaaaaa

SEQ ID NO: 17242 - DNA, 1773 bp, Homo sapiens
  misc_feature (1)...(1773): n = A,T,C or G
ggggnnnnnnnnnnnttttnnaaaangggnnnnnnnnnnnnnnnnnnggnnngnnnagtnnnnanntnngggatttnaaggaggnnaaaggantnnngtnntgagnnnggannatntnnanntnntannnnnnnntnnntttttttaannnntnnnnnnnnnnnnnannnnanatnnnntatnattntntntatttttttantgnntgatcaggggnnaggntntgganangnnatngtaagtaggcngagagcagcttnnanancgaaattnanatntttggnnaannaatgnnatnantnnnnntnntgtgnncananntnanggatngtagganaatatagggnagatnntcngntancttnntcngnngcagcttacnancngngttgcgngacngtcagtgatcnancaacgancgtagctgtcagaactantcaccctatgcgcactaatnaacacctacacactgacgnactgcacgtacggcagancgtgnanctatgncataccgatcnaacatacacagacaccagacactcgcagncgcgcacacagcagagcacgcgcgccgtgagcgcgccacaacgtcggagatagatgtatatangangagagatccgacagaacatcaagacgttgctgctgagacgcagtagaagatacgtgacgcntnangaaactgagataaaatatattatatataagacatgatagtagtntgtcacgatgtatacgcacactttaagacatcggtgcgggagcggcgcggcggagccgcgagcggcgccgccgtgcacatgagangcaggcgaagacgacgtgttgacggacacgcgctgcgcactactgtgtcgtgattgtctccantntnctcgtcnctctctcctgcaccatcncttcgtcctcntcatctctcacctctctntncactctnttntntgtaactgtgaatcaccacatcacgtcatactcgctctcacgcctctctngtgcgcgcgtcgcggtgccgtcgcgacgatagtcctgtagcgacgtcggccgcgacgtagcgcacgggctcgangagcatcacgcatgaacactcacgantcagcgccctcacgntnacatgactacgtggcgacgagcacgcgtcgacagcgcgcgcgtgagaataacataataatacgtcggtgatagtcgtngntgcgtttgatgaagagtctgaggacgnagtacatgtgatagtntgatatgtcaattgtgtagtacgtcattgttgagatagcagtgtaagtgttagatatagcgtagagagagacgtaatcatatagaatgcacatccgacgcatacgcgtctaaacgatntcgggactgcatgaacgtctatgnacgcagcgttnagtagcgaggaanacgnagatcgcttgcgaagctgtctactacgaacggctgatgtacatgatgtgacctcatcagaatctgctgtgagacacacctcgtccatcgatcagcgcgtacgtacatgatgccacacctgatactacgaacgctgcacttcnagatagacgagcgcgcgaccgcacgcacgnctgaggcgagtcgacacgtcgagagtgcgacaggtgatagtgggcagcgactacgtgcccncagtgcagagacgcacgacgcgagcacggtgacgcaccaacagcacgcgtctgcgacacctcgactcagctgccgctctgggtaccgtgcgntacgtgcgggnggtcgtcggcnggctcgtcgtgacgctgtcgctgg

SEQ ID NO: 17243 - DNA, 2186 bp, Homo sapiens
  misc_feature (1)...(2186): n = A,T,C or G
ggggaggtccgcgcgcgccgcaattattnataccatgaacacagcctagaagtataatgatttttttttttctgcggnngtntagttggacacagggagaggcgttgagttttgttgtgatgaagtgntaagctcgtgcgagttggcgcggtgtgatttaaggtgagtgcggcagagcggagagccgtgtatttttgttctctgagagaaactaatatatttagttcataagtttcgttcgtatcgcgttctgcgcgcctgcgtggatgttgtgttttaggttgagtgtgtcttatttcttatgagtatagtgngcncggtccaatatngtgacgtactggcggggcgttgttgtcgccgtgtccacgtttccaggcgtgatataagtgtctcacatctgcngaggtcccgcggcgttttgtgtatantancgctctcagagtcgcgccgtaatgagagagacagcgagaaaagggatgagagatatgcaattacaataatatataattatacattagtgaagcaggtgtgtgcgagctcgccgcgcgtgtgttatttattgtcgctgatgtggcgcggatagatcttcaatactctattatcctgaacttgtatgctgtatgtacgcgattagtattgggagatctggcgggcttgattgtgataagcagagagagagaanagaggaggcgagtggacaggaaagcagagtagacaaggatatgataattatgcaatcgaatattgatactccgctcatagaagaactacncgttcacatctatcaccgcgattattacctacgccgcgttctttccttnactattagtatcnctcgcaaatantcccgctcgacgcgtattcccgtttaatcgcatatttattagactacgtgattcgacgtttctattgattcgtgattatcaatgtatctgtgtttatgtgtgttctcttgttcttacgttctttttcgactgtagtctgtcatatcatcttatgtgatgttgcgcttacttattacgactntctaatactattagccacgagcagacaccaatgacttagcgaattcgaggatagtagctcggcacgttcggttattgaaagatgtgtagttcgagcgacgctcggtctctgatatcagcgagagtgtgtcagtcgaattgacagcgcggacagagtacgtcgcgcgagagatcggtgatatgaattgagtggtgattactgtatgcggtcatagcatagctgtgtcgacgatangtntcgtagcgtgagcgtcgtgaggtggtacaccgcttcgaggcggaggaanagatanattatnatagtatcagtcgcgcgcgtcgcgcttgacagtcggtcgtagtagatagtatatcnagcgagtaacggctataggttgtagcaagacgagttanttaggttagaggntgtcatcgccgtagggcgtagtcganggtctanatacagacatatctcgtcnctgtgtaatncatcgagcgtcataccgtaacgaagacgacntgcgtanagctgttgctcggtgctngctactcgtgcatggagtagagattttngtgatactttggntcggtcatacatcagtatgtanntatttgtgtnttcnatgntgtcgtcntctgngtggngtntcgggcggagtgtgacgcagtgactgcggcaatagancagctgtgtacagncgcgagntgctnctttagtngttcatnagaaggttgagnagntcacangnnattgatanattgtctgncaanagncntggcatagtatcaantacgttagatngtaacntngcgcagantaccaacaggtacgncatcggctgtgtnangcgntgcntntgnagncgtgtanttgctgtgtctgactagtttacgtcacatacaaagctaaatcattacgatgtgcgtacgtactacggcnattcatcancagtgnntngcncangtcgatcaggntggcgtctctgaagtaganacngtcnagggtactggtgatcgcatngccgntcgatnaagctattgaatatnttcatncgtatcagtngcngatgatctagcgttgangatatgatgttcaanggatanatgatntgatcagntangtagtcttgantaatnattatagttgttcatgntgtatgttcggcagacnactgatcggtt

SEQ ID NO: 17244 - DNA, 765 bp, Homo sapiens
aggtctcacattcaaatggggtaactgaagatattcaatgacggaattggatgtaagcaacatgagcagagtaaaggaaaaccaacaaaagaaagaaatactccctggtccccacccataggcatgaaagaataaataaatgggactatgcaaactcacaagcttctgcatagcaaaagaagcaattaacacactgaaaagacaacctacagaacaggagaaaatatttgcaagcgtagctcatctgacaggggattaatatccagaatatacaaagaactcaaacatctctacagcaaaaaacacacaaacaaacaaacaaaaaagtaagacacccaaacaatccaatttaaaaatggccaaatgatctgaactgatatttctcagaagaagacatacatcaggccaaaaaatgcatttaaaaatgttcactatcactcatcatcagggaactgcaaatcaacacaacaatgtgggatcatcttaccccatttaggatggcaattatcaaaaataaaataaaataaccacaggggcttgtaacttagtcccagctactcaggaggctgaagctggaggattgctggagctcaggggctcaaggctgcagtgagccatgatcatgctactgcagtccagcctgcgtgacagagcaagattctgtctctaagactaccaatcataaagacagataataacaaaggctgatgacgaggatgtggagaaaatgaaactcttgtacactattggtggaatataagttgt

SEQ ID NO: 17245 - DNA, 1148 bp, Homo sapiens
  misc_feature (1)...(1148): n = A,T,C or G
aaaaaaaaaanaannnaaannnanatttnnnnnnannnnataatannnanataagannantnaaaanatannannnnaattttatanannntnnannnanntaattnnntttattaattnanntaatatnnnnannaatancaaaaganaaatagaaagaaataaatatatatttattttatnaagtaanaaannacaataagaanaaagaatagaatagaaatatattcacctgttttcgctcgccggtcttttcttttgtcagcgtttctgatgtcgttattgttgccgcttctttgagtgtgcaacgttgtcattttctcgatttgtaattataagtacattatattatttgttatccatatatatatcgaactatatatttaatnttttgtntattaaattaaaatataaatctttgatgataatattttctatatattttcactttttgtctcttaagtgtctcattttaatctggtgtttccagattgtttattattaaaggtttaatttttaaaatattttattatatacatataattttactctttcctttctttcattttttttttttttctttcttccttttatcttattgtcgtttttatttttttttatattatatatttttttgttcatttttaacagatttaacagtgatagttatgttggtagtggtatatgaaattatgatttttttatatttttagaatttatatttatatttttttctataattgttatatttataattttatattatttattatatattatatttatgttattttatttaattaatttattttattttttggaaccttcttttttatttaattagtatgacgagtctcaatgaacctctactctcattatatctccactttaataatgtgcattgttattgtttgtttaaaactacgatggtattaaatctgatataattagtgtcttttatcagtatctattctctgttcgtactgacataactttctgcttatattatntctcactcgtttttattgttgttctaagtattgttantatataaatgccgtattcttgtatcttacttctttctatattccaatattcgtagctgcaaatctgtatttatatgtctatgaatgatggtctgtattact

SEQ ID NO: 17246 - DNA, 2247 bp, Homo sapiens
  misc_feature (1)...(2247): n = A,T,C or G
cccgcgcgtcgccccgccgcgnnnggggggggtgggngnnnncnnncnnnccannngcgccncntcnacnnnnttcgttcncctcttttatcgcaccgcancgacnncacnccgcaccaccacaccgacagagtcggcgcacgccttgatcggcacatnatatagctcgtactacacacgtacagacgagttacaacaaattgcaagttgatgttactaagaatgagataaacgatgntgtattataatggatcatccgtcgctgtatcttaatagagtaagagtggacgcgtagagntcggcggaccctccgacgtcgcgcgacgcgacatggctgtgcgatgcgcaggtcgtaatacagctttctgacaccantcgntcagaggtatgaggtnacataccncaactcagatcgaggccgtcaccctanatacaccgtacntgtcacggactagtagagcacgagcaaggaggcgccattaccacaccgtcgtgcgagcgcgcacgcacacagacagcagtaacgaagtaatatacatggatatnagtgacgtggtgtagtatgagtgagtangagattatgagatagatagatatatantantatataagcgcgtacaagtatgattaagcggacgcgagagcgagtgagcgcgccggagacgcagacggcgagaagttgtattaattattngagacatagcagaatacgacacaccgntgcctgctatacctatatctattnatacacntaancaagaatagtgatagcagacagggaagagtgaatgtagagagcaaaggaacgaacgaacaagactaacgaaggagatagacagcgaaagaggtagtgantgtangtgtatctttattcgaacgccgtcncactcctgacaatcantctactccttacgtgacatccataatattcacatcacatcacaataatatatcattctatctttatntcgcatcaattaataccagtactatccgattatcttcaactcttctcatctcgcacgcgtaaaattccgcgcacgcctcatcaccttatttatccaatatttatatcaactntaaattcacacgatccaccctcccacctcctactcactctacgcaatatttcgaacgtgtgcgtnatatgtgcgacatgcatgtgcaggtcagtagggtgtcgctatgttatatacaattcgagtaatgtatatattgagtgaatgccgatcccacggcaccacagcgcgcagtctgtcgaacgtatcgcgcgcgcgcagacgtgaacagaacgtgtgcgtagatcgancaacactcactactatacgaataccgcgagcatcacaatagaatatacatcatccacantcactaatacacgcgagcgccatcgcgcgccgagcagganacgagatagcgtgcgacgacagtagtagtagcactaagtagtgttctacatcgttgtgtacataccgactagcgccgtgcgcgcgccgtcagctgacagtcgtggcgtcatactccgtggtaataatgatgatatagtgagacgctcncgtcagtgcacncgacgcatgtgangtaattgaccgacgacgagtctcgcgccgaatggccgaggaacgtcantctncgtaatatntacagtaaacatgacgncagntnatancattcgatgaggtgacntgagaagctgtacgcagctgtgatgcgagngaggtacganantaaacctgtcatgttcacatgntgtacnatcgatgtgtgtgtgtgatgagtatacgcggcnatctactattngtcgtcagcactcgtgataccgtgattgtgcatatgctctactcgtctagttcgtncgcggcgacacacactactctacaacgatcgtcgtataangctatttctcgtcgggtgacggtgagatgctanagtgtgtatgcgtgacgacgatatacatatgtgtnttggacgcacagccgtcgacacatcgcatgtacgtcgtaagtgagatagtgntaatgaatangngcacgcgaccantacgtagtcacatctagcgttgatgacaacgcgtacncgacgacctatcgtatgnacagtcagtacgcatcgtaggtaacatcacgagacngcactgagagatgataanaggatngtggtngtactggcatagcactgcagtcatgtatangttcatgcgcgtgatgatatcggctattgtaantaagtactgcacaatcatcgtag

SEQ ID NO: 17247 - DNA, 748 bp, Homo sapiens
gatcttacatggcttgctcaaagcccgcaggtgaggacggagaagacacgatctacaagacagcagagtgaagatggaccctcaaaaggacttctcaccccggtctccagttttcccaaatgatttttctcagtaacctcaagtcttgcctgaagagataattacttggcaaattaacagtacaaaaaatgagggaaaaaatcatgcacaatctctccagcagtttgtcatattgaaaatacagcataattgattctattaatgcaccaagggaatacaaaaccgtaatcagtttttctgtcgtgtttatatgtatagtgatggaagtctaattgcataatttatcattatgaaataacagtacagattacaggtatgcgtagtaaacagctggatggtgttaactagcttttgtataaatcattgtaggcccttttgattcagtacacaaatcagtctggggaaacctcaattttgaccatgttcaactatattataattctcacgttaactgtttcaatacctacgtatgtcactagctcaagctctggtcatctcagagggcatgttacaggagggcgaccttaaaaattccctcaagccatgctccggtctgcacaatagccttccatggcttcccgttagcacagaataaattcagactgctcagtgcttatctccagccccttctctttaggccctaccatgcacccattatataagagctatatcagattacttgccactc

SEQ ID NO: 17248 - DNA, 1297 bp, Homo sapiens
  misc_feature (1)...(1297): n = A,T,C or G
gggggggngggggaaannnnnnnnnnnnnnnnnnnnnatttaannttaannattnaagtaattnntaannngtnaannnnttnntnntttttttnnnnnnnnnnnttanttnttgntcttcctttttnnnnattntnattttttttatttgttcttctttaattattagngaataatttnaaattattatatttnnanatatatatttgataaacagaaaaaatataaatgcccatgagaacacggagagagatattcaaatgaagacatgtagaggtcgcagcttgtcgcgtccctagcttctgacggataccaagcgaacaacggcatcacaaaatacgataaaccccgaataatagtatagaaatgaangaagacgaaacgtatttcatcatagattaacaattnattttatatttatattanttttttatttntatattttaaaataagcacccaacaagacagacgtaaagcgcatatctcgaacaacagaacacgcacataatcatttcttatttttcttctccatctgtataagtaacccccgtacccgaacgcggtcgactagggataagatatactacaatgtgaactgttccattcctcgcacatctctcgcgcgctcctcttttctattctcgcgtgcctagctcgtctcgttgctcgttgtcgttgtgtccgcctcgtgccactcgcgctgtggtcgacttgacgactccgagaatcagataacgtacgacactaggctgtgatatcacccactatcgngaccgactgttgtattggtcaatgtncgagtagtacgcactcgtagntatttttaaatcataatgaatcgaaanataatagatgtactaaagataatctatcattatataatanaataaaacaaataaatgaagaactcataatcactatatgatataagaagantattgnaggaaacaatgtgtgagtatgttcgagacataaccccactccgattcttgcgaccgtaatatagtctctataagattattgcgttgactcttcgatctgttcacgacgcaggtgtcgtacgactatttttctaaatccgctcaacacactccagcacctactccacatatcccctataccactcgtgtacgtgaaatcacagacggcctaatagtttatcaataactcttgacgtttactcttgattgtatggtacgacactgtgagcctgctggtttccgtccacgcagaacatgcttaccagcttcgccctctagtatgattcatataccgtcgcgatcacggctgtcacggt

SEQ ID NO: 17249 - DNA, 836 bp, Homo sapiens
  misc_feature (1)...(836): n = A,T,C or G
tagaatgtgtgagtgnatggnattttttatgaaagtgagtttttatatttgnaaaanatgttatttatttttttntnttttattagtgattatatattatttnatttatataataataattaatattattnaagtaanaaagaaaagntgttgacacaaagaacaaaagaataattaaaaaaactaacaaaaaaaaaataactataagcttaaaattaaagagagaagagaggaatttagtacaagggtaatgtaaattagtataatagttatattaatttttattttatttatattgattaaaacgcttgatacaaggtagaaaaaggaagagtgacaacaaaacagtcatcagaaaganggttntcaatttgtattccagtctctaccccctccgtcatctaggctgcgtttcttcctctcttttgctattttacttattccttgaatcaatgggttgtgttgccgcccatgtgcctgtcttgtgttgatgagaagggagaactccttttgtttattttattataaattaatctattatgttggaatgtagttttaggagatatattattattattatttttttttattattgtttttttttttttgggagcaacaagaattacaagcggcgtgtggtcgatgagaatgccaaaggaatacaaagtgagaatggaagatacagcccatccgcgtataaatcctccggtgactctctagaacagcccctccccaggatcgatgtatactccgcgttagccccgaccccgacttctcccccaatttttcttctccttacatcgccgcttctggtttgaggattcaggtattagagg

SEQ ID NO: 17250 - DNA, 1519 bp, Homo sapiens
  misc_feature (1)...(1519): n = A,T,C or G
ttactcccgcccgcgttgagatagaggtagtttatattacattttttaaggtgcgtaagtttccttttgattaaanaaacggagtgctcagtagatattatgtaagatgaaggggagcggagagagttattagagagtgaggtaaaagaaagggagttaagtgggatttctgaacactgtagggagtggtccgcgtgtccggggctgggttgggcctgatggcggcgcgtcccgcggggggacaacatgacacggcatttggcgcgtgtggggggcggtggctatttatatgttatttggtggtattctcttataagggtgtggggagagtcgccctcacatttatccggaccaccgccaggtgactccaaccaatattggttgtatcgggggaagggttgaggaggtgcgccaccccagaaatgttaggagcaaggtacagtatgtaaacgaagcagaaaaggagagtgnagaagagagagagggggcagggagaaggatgcgacccgcccagctaaaagacccccattaagataaaatcccatcacaggaatacactaaaaatcacctattatcatcatccttcttcatccaatctacaccacaaattactcactcccatttcccatattttccgatattacatagtaaataatatatgatactcattctcctccgattgttttcatgttgttcgcctataacttatagtgctttgtgtcgatttttcgcggtactaagttgatgtagtaaggaattgataagacgacaccgtacacacccgcgctaccgtcgctgtaagcgatatcagattgtgaggggaaacagctgaaggtgttgtatagacggatgcgtccggagaggagtatagttgggtatataaaggacgtgtacacgtcagcgactcgttagaagttgggtagatgtcatctttatattattacgtgaagagngagcactcagacacttctcgcgaagaagaggagagatgtaatggngattangtggagtctagagcggngagaaagtgaggatgtagtgtagagttaactatataggcgaacgatanagtatgatcgatatctgatagcgagatgtattagctaaatatcaactcgcttctctcttttgctactctcactattctctcgatcgcacctttaggtgagtgtagagatgaacacgtgtataatattgtaagataagagtaaatattttatgcgctgtcgcacttctactcagcccgcagcgcaccattccaaggactcagcatgtgtttgaagtattttatatatatcgtagcacacgcaganagtaaatgtgtccacgtgatncggtcactcgatgtaagaggatatagttaacaggagagtgaggaatatgagtcagatgtnacggactagcatagacgacaactatanatcaattaatctatgtgcggagatagatgatatgtgcatacggattgctcagttattatttttatatgtggtcgttagattagattaacaacggagtg

SEQ ID NO: 17251 - DNA, 1522 bp, Homo sapiens
  misc_feature (1)...(1522): n = A,T,C or G
aaaaaaannnnnnnnnnnnnaannnnnnnnnnnnnnnnnnnnnttatttttttnanannannnnntnnatannnnagnaattnnnnannnnnanttnntnnnntanntnttnnnaatttttttttannnnnaannntnnananannnannnntttnngtttnttttttgtnnaaaaattatttantaaatanntattataangncanatnatatngatattnntnannnaaatttttannttttatttaattttatatntnnaaaaaagaagnacantcangaaagcgtagaacntgtatgcatgctatgttgtagtcgaatatgaattcagtctgccgcattatgaatggtgattgatgagtgtgttagtttcggtatgtggtctgatatatttagtgtttgtgctgctgtagtagagtgttnttgagtgtggtgtggcgtgtcatttgtcatgttgattatagacaatatgagagatagtaattgttnttatttagatcttcttagaaatatatattattttttatgaaaatagttaattaatgtaantattatttaataatagcttattatgtctaatcatattttattcttttgtgtgttctgtctctatgttattctgtgtctgtgttctcttttctactatatatagcggaggtgatcacgcgtcgngtgtggtgcgnatgagttgtagtgagacgttcgtgtttgattctttgtcttcttgtgttctctcttcttgtctctctctgctatcttctatttatctcttgtgcttctcttcttacgcttcttctggttgttcgtgtgttgtttgcgctttatatttcgtgttgtagtattatatatgagactacatattgtgtatatattcgtattattatcgtcactcatacgatgtctatataattatttaattgtacagtctatgatgtattgtatcttcnatattatattaattatactatatgctgtatgtgaaatttttgatttgtactataattattatatgtattgtaatgtatagtgatataattattatattagtcagtaatttgtatgtcatttctgattatatagtagaactataattgaataanatggaggtgttgagatgatgtgtcgagcagtgtattcgctcttcctctattnacatatcatctattattattcgttttttnctttaccgtattagttgacgttcgtgtaactgctagttgtctgtttatagatattatattttgtttaatttattgattccatcattaatcataagtatcgacacactattattcttcatatgctactattgtgtgtgtgtgtgatcatgttcgctcgaccgtgtggatgtgtatgtatgatatcttctagtcgttgtactgtgatgtacgcatgtgatgagcgcgaagacgtgaaaccgaccggctgatagctaatacttctactgcttttatgtctctgtcgtagttgttattattatatgagatatatgcgatgtgctttgttggtatatgtgatctg

SEQ ID NO: 17252 - DNA, 1323 bp, Homo sapiens
  misc_feature (1)...(1323): n = A,T,C or G
aagaaaagagaaaagnnggnnanannagaggnnanngggagagagagggagganaggggagtagagggaggaagaganaaaaaaaagccttaangagagaanaaaaaanngagagaaaggttttgtgtgngtggatataataagatttgacgctgtgttatcggtgtgaatggggatagtagaaatatagtctggtgagaagagcaaagagaatgtgcgagcgatcnncaccaacagtaagcaccagcagcgtgcatgatagaacccagaaacgcagagaaaagccgcgagtcaggagacacctagtagaagctacgacgcccgcaccgccccgtcgccacggcggcgccaccgcacgagctcggatcgtacaccagcgccacgcgcgggcgtggacgcgcagaggatggtgggacgagagagggaggtaatatggttagtttaatggataaggttctgcgacaggtgacgggacgttcatgcaactctctcagtgcgtgaagcgtcaaacaagactacataataatgtgcagcatcccatatatacacctagaggggacgcaggagtcgtctttctatttctaccatgccccatactgtgattatcataggagtagccgtctgcaatgtgtatagtgtctgtaggatacagatccacccactacaatatcatatatactaaccaaaatataacctcacgcgaatatcctcaaccggagctcatctctcggacgaagcgccgcagcccactcattttgactggagccagccggctgcgcgctgcaccgcgcttgctcttcgtcttgacatccgacgctgcttcagtgaaagtatcttacgagccgatacagagtgaagtgtgcgcgtctggcgggccgtgtcgcgcgggaacgttngagagattatctgtatggttgattccatagtttgtctccgcggcanacgcgatcgctggaggacgtgtgcaccgacgttcgagcnagtcagcgactattgtcgcccacaacactagaggcgcacgcgcnccggacacgctttgatccaacacgtattaagaactaagaacgaagattattgtatatgtatttgtctgactacctccgcaccgcgcggcagctggacgcantatgcgacagcggaggctcgatgcatatagttatattgtgccgatctctacccntagtccacgcgctcgtgacgacggcccagtcgcgcggacgctgtactgactcgccgcgcacacacgtatccgacacgctacgcgccgctcgagcggccgtactcnacatagagcccactcgtccctagcacactcatcacccg

SEQ ID NO: 17253 - DNA, 121 bp, Homo sapiens
  misc_feature (1)...(121): n = A,T,C or G
aaaaannnnnnnnnnnnnnaaaanttataaanntttgggaggatntnagnttttnnngnnnnntttntttataattttntttttttttaananntagaaaanntatatttttttatttttt

SEQ ID NO: 17254 - DNA, 1008 bp, Homo sapiens
  misc_feature (1)...(1008): n = A,T,C or G
caccccccccgcnngtttccacccccgggacncacaaccacgcccccggaacccccccccagaggccccgcagcctccgccgcccgagaataaagtaggaaattgcagtccattatctatgattcgaatacaagaggaatacataatgaaatctctctggggcaatgtgaaaataaaagaaaaatctctgaggataagctgaacaatcttcgcataaaactggcactattgttgcagaaactccaactgggtggtccagaaggcgacctgcagcacactgacacttatttagaagctttgcttaaagaagataatcttctgttccagaacagtttgagtagacgagctatagatgcaacacatagactgcctttacaaaaaaacgaaaagacttcggagcatgagggcagagatgggattacctttcaaaaaccgccgatacgaaaactggaagatcctttcggggattctcgttttttggtgggggtactgagcggggtatggtgcccaacggtacgaagcgcgaaggggtggtgtttcgcgtagcaggatcgcgggctctacaaacgcggacgcgcgccgagtggacggggcgccgtggcggaggggtgcagaggggaccgtttgtttgggaagcttcctcacggctccgcgcccccgctccggctcgagccaatgaagtggagagccgcggcctggccctgctgcggcggtgaacggccgcgcacctcctctccccatagcgcgcccgccgccgctacccctcgacgccctcgccatctccggcgcgccgctcgtcattcacgccgcgcctgcctgcccgcgcggcccgccccccgcggctcggacgctgtagcgacacagtgtcgacaccccatatacccgccccgcccgcttgacacgaatcatcgcacggcagacgaccaggccgcccgcagaacgcacgagctccacccgccgagtgtatcgacccgccctccagagttacggatcgataacccaccccag

SEQ ID NO: 17255 - DNA, 753 bp, Homo sapiens
agctcttgacaccaccgccatgaagaagggagctacgtactgcgagtctcttctctactcatagctggcacagatgacctgacgacctgcctgatgaggagagctgcccattgcgggactcctctctgctgataactggatagacgtcgcgacaacctgcgctgatgaagggagcatacccatctgcctgttccctctccacaggcggctggacagacattgtgacttcctgactgcctaaaggagctaaccactgcaggtcatctgagagctgttttgtctctcagctattaatggctccacttctccttttttaccctacaaatggacatatccctcattcattctggactagatgcccactgctttgtaagactgatagagctagaaacacaaacagggctgagacacattacccttgctgccatggttgctggcaaaggaataattgatgagatagagctgcagaccttcaaggagcccacacgtaagggaaccctgaggcactgctcagacgctctctctggggctatgtaggttctgccttctccaagcttccaagcttcccttttttccccctcatatcaatgtggtgaccagtactgtaagtcacatgcgatatatttgggacagcgacaacttcactcggacctggcacctgagaaagagcgtggagctactgcccctgcggcagaatctgcgtgattgactgttcatagaggccaaatgatcatcctctctccctcacttgct

SEQ ID NO: 17256 - DNA, 1316 bp, Homo sapiens
  misc_feature (1)...(1316): n = A,T,C or G
cgccgggcgcnnncccccgggggggtccgtcgggcgccccgcggtgggggggggcgcgaccggacacgggttttgacaatagcggtgtgtgttgggaccgcgggcgcgcgggggggcgcggcgccgcgggtgggggtgggccggggcgcgagtggcgcactcggtggcgcgcggcgtcgccaccctactccaccccaacgtccgccgactgcccgcgcagcactcatcactttgggtgagcgtgttgtgagtgatagtactttcgtataacgaggcggagcaatgcggcctggcgggcggcgcgaggccgcgcggttatatatggaccctagtcggggacttatgatttcagcaccacagaggagagaggggggagggggatggagagggcggggcatgtaggggaggagggagggagtggtgtagcctgctttcccggtctccactgttctcgggcagcattacttattccctcctaagatattactagtcacgtcacacttatccacctcccgtctcatnattctctttcgcgccatatatccgacctccagttacataatattcaatttcaaggcattacatgccggacgcactggagcgatctgtcatattatgttcaacgacgcgtatgttataacatacgataacaatataatagattaaggtgaagggcatggtaggagagaagaggagagtaggagaattaagttacacagtacgaaggagaatagaatgtaatacgagagacccaaggtgaaaagcacggcgacgggcgacgcgaacgacgcgcgcacgtcaggcctaatacgcaatgacagcagaatgtacactggttcaggctgcacgcactgaaggagtgatgtgttatgccgccgcgctctggttggtgatctggttgctctcagggtcggcacgataagacgagcggcaggttcagcgattaggaaagagtttaaatatatcagtgatgaaacgcataatatcataatatttgtaataaacgaaataagtatattcataagtgagtatatattagtggtgtgcttatgtctncgttgcgagccctagaatgtcaagacggatctgaggcagtgtagatactgatctatcgcagtgagtttaatctcctccacgagcaccgccagcgtgtaacngatantaatatagatcacgagcaggataagtctggtaagaagagggtagtacgccgcgcgatgtgtaagggtagcgagatcactaacgnagtatgagagagttgtacgtacgtcgactggagtagtctctatgagctgtatttcgaacaccggcgaccc

SEQ ID NO: 17257 - DNA, 686 bp, Homo sapiens
aaccagaggtgaagtgacttactgaatgcctaagagaacttatgagaaataaaaataatagttgctttcaaaaagagaatgtacagtattagaaagaagactaggaaaagaaaccagcaacattcaatgattttatgaagcctaatgtcttcaaataattttcttctagtctataatgtaagaatgttaaaaccgtgtccctcaaggctgcaatatacatcgcatgtgtaaattgtatgtataattacaacataatggaaatgaatatactacacatttctctcactttcaaatgttggttttgcaccaactatttttggtttccaaatagagtgaaatttacatccagaatttcattgtatcattaattatatcaacagcttaaggaaaaataattatattaaccaataaatccagttgttaactacatgaaatacataatcttgcttaggtgaatggtttccagaaattaaactagggaaaaagtctctaacctttataagattgtatacctaatgttgctggctgtttaacctgagaactaacgggccacaagagttcaagtgccagatgataagccttctgaggtcaagtgagcctgcgcatatccacttctaccctctgcagtccttgcataactctattacatgaatttgcctgctataaggttcataaaaaaaaaaaaa

SEQ ID NO: 17258 - DNA, 1096 bp, Homo sapiens
  misc_feature (1)...(1096): n = A,T,C or G
ggcgtgtataggaagtttagtggcaactgcttctggagaccctcagnagcttccttatggcagaggcaaagggaacaggtgaggaaaaacgagctacatatgtgaagtaccttatgacatgtcactggcttataagaggaatgggatgcagactgcagacttctgactctcanntacccgccctgctcatctcccaatgcacatggcactgacacacacgcntcttcgttattctgcgacgtcttacgctcaactgtgtcctctcgtactcgtcatacncttattntnactacatctcttttcctctacatatantaccataacctccctctccaatcccacccccactcccccacctccaccatctaacaaaaaagantacaaagctctatcctccanccattnccctttgcgaactccgtgttatttgacccggacgcgcggcggcggtgggtgatccgcggctgacaacataaaccaacacacacacaaacaccaccgccgcagtgcccggacagccgcgtcgcgacccgtacaatcatccgtttgccatcanatggagcgcgcacgagacattgggttcgagagattantctgcgcgttacacctcccccgcacagccccccgcagcacacactatacgacttaatcacacaacacaacatcccccatantcccatctttaccggtttacactccattctcactcttcatcactctccctccccccttcactccgatttcccgcccacacttccttttttcattcatcccatcccccattaatcatcccatcatccctccattcccgcttccgtcctcatcgcccgcgtcgatctagtcgtcatcctttctaccaccaattcctcgttctcccctttcccattcgccccacccgccttttttctcccccgtctttttcctacccacaattatcttgtttgtcgcgcgacccatcccacccacccacgatcggacgtnctcgggctcgcatgtcgcgtgaacgcggaccgtccgcccgtcgctaccgttattcggtcgtctcccgtgttatcctctacctccgcgtccttatctcgcacatacccccggcaag

SEQ ID NO: 17259 - DNA, 211 bp, Homo sapiens
caggccgggcgcatggctcagcctgtatcccacctttgggagctgagcggttggatccctgagtcaggattcgagacagcctcacatggagaaccccgtctctctaaaacacaaaattagccgggcgtagtggtcacgcctgtactctcactactcaggaggctgaggcacaattgttcgaaccgggacgcgccacgcgccctcaccccac

SEQ ID NO: 17260 - DNA, 1014 bp, Homo sapiens
cagggttatttcaaagataaatactgcaagcgcttggaaatgcatatgtttcatgttcaaagagcggaatagaagcacgatgaactactaacgactgctgctttgactgaactttgtgccttgaatactaagagaaagcaagcacattactttcagttggccttgcctcccctcaccaacccacaccgacggctttttaagccacaggacccccaccaccccgcttgccccaccacccccccccttcatccccaccaaccctccaaccaacctcccatcaactcaccaccaaaacacctcgcgacatagcgacccttcccggcccccccacgtcgacccccacccgcgtccactgcaaacataacaaacaaaataacacccgaagcacgcccccccccggccctcccgcgggccggccgtagacagcgaaagcaacgcgcccccctctcgcatcaagacacgacacaccgctccccattcgcccctgggcgccgcgcgatcaagagacagacgctagaacaaagaacacaattaccccgataacacctcgaacccgtaacgacgcgttcacaacatatttcgcacctcccccgcattcatcgccattcacccgccgcgatcttttacacccgcatcccgtcccgccaattatattcgcatcaccgcacatgtccgcacatcatcgtgcagccgccgagaacgcgcgcctaccgcccccgccaatcggacgccacggtgtacgcgccgtatgcgccacatatccgcctatcctccccgtcccgccgtattattccacgcgcgtcctttcgtccatcgccaccgattacgcgtgtgtggtgcggaggccgccccgacccgcatcgtcagccacactatacgtgctaccccgtacctcctcatatccgcccctctcgcagtgcctacgcgcccgcgccccatccataatcctgaccagccccgcatatctttccgatcactcgcatcgatcgcacaccctccaccacccccagcata

SEQ ID NO: 17261 - DNA, 1237 bp, Homo sapiens
  misc_feature (1)...(1237): n = A,T,C or G
acttcaaccnttctcctccaaatgagataagaanagctgtcacnagtgccagggnaagtataatatcatcagaaggggtgaaacctgtgcagaactctgaagcattggcagagcctggcctggtggccagcaagaggctaatggtgccaattaccaacagagggagcctggagatggagcagactcctggaatatgatgatggaggagactgactcatttttggatattttatgagcctgaattgtcctaccactgaagacacagcatgaggtacccaacccatccctgagactgctgtgggggctgatgtctacctggctgcccttgatgcatggataccccactgctcttactattcacccgctactttctgaggctctcactcaacacactcctttctgcgccgacgctctctcccatcgcccccgccccccccccacacccactttctcctaactaccctccccccgcccccaccccccacatccntcccacccctcctgcctctcccgtattccatccgataccctcgtaccctgctccctctccgttcccttccccgcacctcttccccttctcgctctccgcagcccccctcactcatgcccgttctctcctcttccgccccctttcccgttctcccccttttctcccacccccctccgccacatatctccctcttccctcagcctcgttcacctcacttcccgccccgttctctgccccattctcctcctcctccccgttcctttcctccgtcttccccaccctcccatttatctccgcctctccccctttcctctcccgcccatccttccttcgatcccctccggcttccatccctctttcgcttccccgccttccgatcgcgcccccatntccccacatccttcctcctcccccntattctcgcctgtctcacccgcccatcctccgcgttctattttccatccgcctcccactgataccttacttacacacaccacacatcgcacgttcgtgttgttcgacgtcacccacccggatcccacgtccacacacgtccctacactgtacnctgtgtnctacacgatcgcatctccactacaccacgcagcgtatcacgcgctgcacgttcngctgcgccgccgcctcgcttcacgctatctccacntcccctccgcactcgctcctctatacccactccatcctccctctccaatcactcgtcaccgtcgcgtccctcgcgcaccttcg

SEQ ID NO: 17262 - DNA, 301 bp, Homo sapiens
  misc_feature (1)...(301): n = A,T,C or G
cagggcaaagcctcacacatccggctgggnacgatgacacaggtgctctcgagcaccacggtgtactggaccagccactccactcctcaaggccgtttcctctgcagagaacaaggatgggtggactcagtatccctatacagcagtccccctttacctatggaggatacatttggagaccccccagcagatgcccaaagacacagatagtaccaaacctacatctactatgcttctctctactcattcattcctattatgtcactcaacttataattagcgcatactacgacattattac

SEQ ID NO: 17263 - DNA, 1124 bp, Homo sapiens
  misc_feature (1)...(1124): n = A,T,C or G
ggaatgatcatcagcgtggnagtgtcagnaggtttttggnataaagttatgaaattattatcttcaagagttggaaaataaacttactagtaggcatggtagaattttctgaatgtaaatgttcatttgtgattaggagagatattttgaaagtgcgccccattacgaaagctctatcatttgggcccctgacgtactgtccggatgctagtctcggcaattacctatcgtagtactcatcgcagacctcttctctacccccctcgactcgcgctctcgtccgccacccatcccttcgtccccaccgaccctacgccctccccccactaccactgtgcagccacctttaccacacaatatctacggatacagtaagntaaaagcaggtacgtaagcgcacgcatcacatattctgcgacactgtcgccggtctccgccgcgccgccccccgcggggccgggggtccgcgtcccctgcanctcccctgcaccagcgcnaccccacgccgtaccacgcccttcgtcccattcgatccccatgtttgcaccggtttaccgtcattgcttcccgcctgtctatctttactttcaccgtatataacgtgacgattgtccaacaccccaccaacgcaccactcttctcctcgttatacccttattcccactaccccgcatgccccgataccgcgcccgtatacgcgaagtagcacagggccgacctccgacctccatgccccgccccccgttccctctcgttgtccctccccccctacctttcacctgcgtcccctccgcccttttttctcgctctccgtttcgttcccgtatcgtccaccgtccgccctcttaatcccatctcgttccgcccttacgtgcgcccgtaattctcccgctctccgccctttccgctttctccccgtcccccttttttctcccccctcttcgaccaaccaccaacatgcttgttgggctgcggacctgcactgctttctcttttattcttttcctattacctcactacccgtgtcgccattctatgctgtcactaatctatccgtgtgtcgcccgcccgccgttgttatctcaatacttacgtcatcgaacgcgatcgctccgccgaacgac

SEQ ID NO: 17264 - DNA, 1096 bp, Homo sapiens
gcgagtgtcgcgagagagatgaagcaggagagccgccgcctcccccactacgaccaccgcgacgagtgcgccaccactatcacatactccccgcgtcggacgtcgcctgccacgccaccgcgccgccgcacacaaccgtctagtttaatgtctatcgctagcgcggctcacctatgtccaccacatcaaaacctagccgcgccacttactagccatgcacgcagatcgccctcaacacccctgccacttagcgacgcgtcctatgtaaactacctgacggttgtgtacggcacgcacggctcccggtgcgcccgccaaccgccgataatagccaaacaacagcgcacgagaataagcgggtggacagcagcagtgcggacttgtcgccataattacatctcaacactgcacacgtatggcgcctgctccaccgcagttgccgtgagctcatacacgagactacacatccgtacgacacacggtgccgccacggtacgtagcgccgacgatgactacgtcggccatctcacccaggcgtaggccgctcctgcaatctgtcgttgagcacctcacgcactagagagacacacgcggcgcgcgcccacatcatggctagctagtccggcgggagtgcgacattactgcgcgcgatgcccgatataaaatatttaccccaagcaacaactccgtaccgccgcagtactcccgcacaccgtccgccacgacacaatgaccgcggggggctagcaaatccaacatcacgagaggacttgctagccccggcttccacacaaccacccacgcacacggctgccatgaacacaaacggagacacaaccacaatgcgggtggcgcgcatccacctgcctacccacaagacacaagggcgaacccaagggagtaacacacagccgcaatgatcgaccctggcactacgccagcgggacagctagctgcaatcgccgaaccggcaggacccacgggcgagggccggcaaactaagtgcgcaaggcgagaaagggtgaccttagttggggtagagacgcgccacaccacacacattcatggcataggggtggccacgcgcagaaaggcc

SEQ ID NO: 17265 - DNA, 1357 bp, Homo sapiens
  misc_feature (1)...(1357): n = A,T,C or G
tgtggcagagtacagtgatatacaataactcactcatttattattggatatattagtcattcgtatataattcatcnttgtatccatatatctaaaganatatgagtgtcttgtctctcacgtgatctacctccgaanacacacaaatatcacactgcccacgtagatactttacgcaaccagtcacgcagataggcaccntagcgatccgctccatccacctcaccagctatcttccctacttagtactcctatattcagtttgtatattaagtgtgtagtggcactgcgacctcctggacgctgaaaagaagaagtaaaacagtcggcgcccagtcttgtatcgtagtacgcacatgatttaacacaagacaagatacaatatgcgccgcacttatgttatcgttcgttgtatatatatatcatactcgcgccgaatataccatcccaccgcatagtactaacgatcctttacgccgctcggatgtcgcgcgcgcgcgcggtctatagtaccactcgcatgatctcagtttatgtgttgatctcacatactaccccacctcatactcattattatcgcccatatactcctcagagtcccgtcggtctggtatttttccggcggcgtgtcgcttcgcgttgtaatgctgttcgtgagctacttacgtttacactctccgcttatatactcaccccattctataaacctgagacgagtgcgtacgctaaattatgtacgcggtcatgtgcgtataaagaggtagtttaaaatgtgaaaacgtctacggacgtatgagcgcggcatatagaagcggagtacaaaactgaagcatgggctagaagcgtgtgcggcggctgttgaagcgaatgcgcgtgcgtattaaatacaacaccgctcgcagcgcaatagataagggtaaatgcgaggcgggcggggtgaaagatagagggtggttggcgcgcgggcaaatatattcgtaaatttgcgctaatggatacgcgagcgctcgcgatattaaactagcgggacgattcttacgtgactgcgatatcgttcacacanacagtgcagagcggtacgatgaaagctaatcgtataggtgtaacgctgttgcagaatgatatggagtcgactggagtcgatatgtacgggataaatgtaagcgcgccaggaagttatatcaaaacaacgcggtatatacgatgctcggtcatataaaattcacgcgttgtacgcacgcgtcgtcgatgtgaatcaagatcggtgaggagaaatacgggatgttaaaaataatagtatgctatgaagcatgatcgatggtacgggaaagcgagatccgtgcagcgacgagaataa

SEQ ID NO: 17266 - DNA, 831 bp, Homo sapiens
  misc_feature (1)...(831): n = A,T,C or G
tnntttgtgtggaacctcggtacttataagaaaaacacagtgcagttcattcataccacggaagactatttatccataaaaatgcaggcacttctggctggtgcggtggctcacgcctgtaatcccagcactcttggaagacctgaggctgggccggatcacccgaggtcaggaattcaagaccagcctggccatcttggtgaaaccctgtctctactgaataatgacacaatacatctattatcgtcgcgtgggaggcggcgtgacctatccccccagatacttgggaggctgaggcacaaaaatatctgaaatcccggaggcgaccgatctaactccccctctctgtaaccctgccccccccccctctcaccacacaacagaacccaattaaaaacgggcccacacacgcccaaaaagcatngaagccctacccccccctgggggccccggccatcctctacctccgatcattttttcttcaatcattcttnnnnnccccccccccnnnnnnnccataagtagatatccggtgcttatctgcccncatagtnccncccaagaggggaaggaggcccaaagtctncgcgcctgagggggnncngcttggctattcccacttccctgtccctcgtccctcccctctctccccccccagttaccttatgcccctcctntttcccacacctggtttattcttcccctcgttacactaaaatatctccatcgattgtttacattaacacactccccaccttttttctcgcttcacaaccactctattccgcaaccacccataacacgcttacttcttatctcacaccttccttt

SEQ ID NO: 17267 - DNA, 1147 bp, Homo sapiens
  misc_feature (1)...(1147): n = A,T,C or G
ctcatctccccatacacacaccatcacacgagtagatagacagcagagacgagcacagactatcatcgatgtgtaagtattataacaagtgtattctcctcattgcctcgctctctttttacatctgtgtctctctaacaatacaatcgcaatctgtctccatcacctttcactcagcctaccaccacactcagcgctcgcagcacgcaacgacatggcatntccactccacgtccttctcgcagtcgattacaccatccgatcgtcaacgttcatcaacattgcctcggcatcacgaatgttgatcatacagtctctcatgcaccatctcgcactaccatccaccaccaatacctcatacctccaattttatatacgttatcccattactgcacccgcatgtattttatctccgcgttccaccctattcccccccccctccctggccggtccctgtacgatctaatccactatccctctccgcacccnttcttcctcgccctcgcgcgcctttaatttatgacccatcttttgttcgtacagtgacccacaccacccgctgtccctctccctactttccctacctcccccccattacctctattccctctcctcccaccacttacatcccttacagcaccaccattcccacttcatactaccccgccagaattagtcatcacccatccccatctctctaatcctctccccgcccctctcttccatttcccccttcgtcccatgccccctccatcccctatcttgtatcctaacccgcgtccccttccccgtttacctcccccacgtgtccgcgtgattcactcacccctccctccacattcccgttcatgtaatcgccctagttaccaccagtccgtgtcccccctgccacccattcgccctcttttcttcccctcaaccgtttcccatacacataacacacgcgatcgcctgttgtgtagccatggttgccctttcactatacgttgtaccccaccgtctgccatggccccacccgcggcgcggtgcggagtattgatcgccccccccaccaatttctccccttaaactcgccataatccacacacctattatccttatggctctactcctcgccaccccactcttctttttttcactctcccgg

SEQ ID NO: 17268 - DNA, 1377 bp, Homo sapiens
  misc_feature (1)...(1377): n = A,T,C or G
cggaaagacccgaacacagaaaacatgaccnngatggacactacacacaaacngnnntttgcgaggataaaaacaagaaacaccaaaaaagagtagntttgagacgaggagaggcgctactagaagacaccacgagctgtcggatagcggagatgatagcactagcgacaacttgttatagatggacaggaactggatagacgcgcctagacagncaacacatactgacactagaaaagcacaccgctcgaatacactagtcacggcaaatgacatcactcgaacagcactaccaatgaaggtagatagaaaacaaactcgaaaaaccatagagaacatttgaagagacataagcgaatcaagacggacgaacttacacaaagagtagcggcaaagctcagtataccaacacgaaagagaaaacaccgcagacgaggaccctcaaccaaacaaataatatcacaaagaataaaatgaaaccacacgactatatcacattcacaccaacaatcaacgcaacaaagaacaatcccccaccaacctaatacactaacataacacgtatcccaccccccacataataccacccacaaaagcccacgacagcaccaccgcatcgtagaacaccaagtgatcccagcaaccccaccaacacccacacacccctcttattcaatcttcgccaatataacaccacgccaccatacacaaaaataccatcccaacataaacccaatacaccattaagcccgatacccaccgagcgcaccgcattacacacacagattccgcgccgcgaatatcgtccgcatacccgcaaaacatatagttcgctaccccgccgacgccagccccacctcccagcagagaacactcccacgcgcgccgcagccccatacacaaggaccacccgcgtaccacccatacacacaccaaaatacccgcgaatcaaatacaccaaatccatcacgcacaaacccaagaagtcatgaataaacgccgatacgagccacattatccacagaacgcacccagtaaaacaccaagaacctacaggacctccacatcacgaatatgtcaccacactctgtctcaccgatacgcaccgcatcacgcccacgcaacccacaacacctcaatattccaacaacccagagaagaccagagcatcacgcgtcaccatatcatcaggccaccccgcccacacaccaactcaatttcaaccgcaacatcactccangtacaatcccacacgacccacatcttattcgctgcaaagccaccgacattacctcaaaatctcattccgcaaccaccgccaacacgcacttctgacacccacagcaccaccagccccagaataaccacaatattccg

SEQ ID NO: 17269 - DNA, 1489 bp, Homo sapiens
  misc_feature (1)...(1489): n = A,T,C or G
ggttcgacccctgtcacgcaactagatccncacacancgccacgaccacctcatgnntnctnnattataatcgccagganctactccctagtcgcaagaccatgttacgtacgaccagatcgagaactgcggcggaaattgtttgacgaatctagtaatgcgcgcctcataacaccagccaaatctagcaatcatatcattagcagagccacgcatcatcaccgtctagagctgcggaatccacatgccattttacagcactaacttcgggtcaatccgcgactcagtgtaacgctagtacatattatangaccgctgtgtgcatgtgccagcagtacacaatactcacgttacaccacacacatacaggtatatataattcgattatacatacacgtctcatgtatatagtaatcaatatgtagtccacaggaatcacataccgacgctagtagtagacctgcctccaagaatatcaattctcgtagcttctcgtnttcagtcacacctataatagcatcancctactgcgtgccgaaagtgataccaacgtcgcaactctatntntgtcgcgtacgaatatagtgcccgcccgccagtattatagactctacatcgacatcaccgcccagagcaccacccagcgcgatagactacacccaatccacatacacgacacatccatctctactgacacgctattatcgtacaacagtagaacaaacaacgtgagtatggtctcggcctcacatgattattgatatagccgccgaatttggcctaccatcgagtaaagncgagtatccagcgtgccgcgcgacgaatncgatatacacagtcaaaataagacacacaagacacaccgacctcactcatcgaccgtcgtactcatagtagcatgcaatgacatgcaccatggaaggccncgcgntcactcgcgtgttctacnacaatacaccagtgaaatgagatgttagccggtgtatatctacttgtcaccgcataccncccgcaccacacantataacgcgttgtctgtcgntcaatcgtcgtccgttaatcanccacacgaaattgtccgtagagacacacacaactctcgcccactttgacgactcgagatggtaatcgttgcctcncgtctcctcntaggaanattatgagttgacngtgcgactccacgtgcgntgcctcacgctgtatagagtgtgtacagtgaagctcgccacacaacttcaatgtagtgcatgtgtcacatcagcctctcgtgcgacaattcagttcctacnactcagtgcaagtgacgcggctctgtataatttgagtatacgacgccncnncgcatcagacatngtgaccncncagtgtatgcgatagactcgtagtacatacaactaagcagatatggtgtgagctnattatacatatgtgctcctgtcacatgtgtcaccgatccactcgtagtatatatatatactattccgcagtt

SEQ ID NO: 17270 - DNA, 977 bp, Homo sapiens
  misc_feature (1)...(977): n = A,T,C or G
gggagggagggggaggaagagagagaggagaagggaggcgcgagataggcgggggagcccgcggcggggtttaaggaaacaaaaaaaaaggtaaaggagaacgagcccgcccggcgggggggggaggggggcgggccgcgcggcagggcggaggcggcgcggcaagacagaggcgcagaacgcaccagacaaacacgccaaagacccgcggcgccgggcgagagaccccgagacgggggaggagggggggccagcgagggagaaagcaggaggaccgaggcacacagcccgcggggcggcccgagagagaagagcgcgcgggcgcgaagaacnccgngaaccaccccagccgcgcacggaacaaagccgacacagaggaagcggagggagggcgcgccaggcggacaagcacacagccgacaaaaaacgacaacagagaaaagccgagcgaaaagccgaagggacgcgggcgcggcaaaacacaccagagggagcgcaagcgaagagaggaagcgggcgcggccacgcgggaagccggggccacgccccggagggccgagggacgacaaagaggcacaacgccccgcaccaccggaggggaaaagaccaagcacgggggccgagaagcagggaaacaaccgagagccggacgggggaacaaccacccgacacccgcaggcccggcgggaagagcgcggagacccacaaggcgagtgcccccaggccaacgagcaccggggaagggggccgggcacaccggagccaggggacaggccacacggcaggacacggtgcgggaagacacggggagaccaagacagcggggcaagacccgcccggagcgaggggcaccacacgaagggaggcggggagggacaggcgcgcgccgagggggcgagggagggagcgggaggcaagagagagagagagcgcgggaaacgaccgccagccccggcggcccagataaagcacccgag

SEQ ID NO: 17271 - DNA, 925 bp, Homo sapiens
taagagataaatattattcgctttttttagttttgttttttgtttggccttttcttccactcctgttatgcctgctgtacagtctcgtgggggatggttgaggctgggtttgaatcctgactttgctgctgaccagcctgaactccctggtggcctcggacaagcgttctcacctctccgagcccactttcctcccaggctattttttgagagctcgctatgtgccaagtgttatactgggttttggtgatccccatgtccctacacagaccgccccctgcccttctcactacctcgtcttctattatattaccccccctcgcccactttcgttcgcctcgccccttttgatccccttcctgccgccgatagacggaacgaacctccccgttgccttttgcggcccccctcttcccgtcctctccccctcccccccccccccccacttcccctcctcacctccccctcctccctaattacttttcgccctccccccgtcccccgccttttatgtccgtactatcaactgcgcatcccgtgtgttcccggccgcacgccgcgccccctcaattatccccccccccccccccctcgttctctttttttctctccccccccgcgttgtttcatctcccccccgccttcgtttatcccgcccgctaattcccccctcccttttcccatcccccgccccagcccccctaccttcccctccgatctacccacccctcccacttctccctactctccttatcccgtcttgcccgacccggacaacaaatctgccaccccctctcccacccataccgcctcagctcaatttattctctcactcttcctcccgacttccaattgtgtcgcgtatatatttccccctcctcaacccaatatcccccccccctcgccactgtctatccctcctcat

SEQ ID NO: 17272 - DNA, 1718 bp, Homo sapiens
  misc_feature (1)...(1718): n = A,T,C or G
tatgtacctntntannctatncttctctgcactntncntacgatnatcctcatctgtngtgtgctgatctactgnctatagtacttatatacntagtagtgntaatgtatatgtgagtgatagtgtatacagctcagcacaagntatnacanacgcantaacacgccaagacacgaagnncctttttncganananatgacgnagcngnccccacgcagngacagcactgccgcagagccactgngagtatttattctacacncacaanatnnagtacatactactccgtatgattcgcacatnatactcantagtcatacagtcgctatngagtagtcgcatntgatgactactagagtatgatgtcagtgtcacagatcctatcatcgtggctgcactncgtcgctnatctatngtctactagtagtcgtctngtcatctcactcgatctatncnggantcagacaacgcaccatatncaactaccncnanccatnacgtgccgacattnatactacatnangcttatagncgtatntatcgtcccatantatacactcagtcnactagtatcgtcgctcttcancagantcctcatcagcncngcgacgccatcgtgnngtgtaatcacttcgtcagcatggtacccactaaaccacgcactcgacncatgtatgatnactatagntaagtgacagcatgatatgcatnccacatanatactccantacatagcagtagacatcgagcgttctcagtccccctgtagataatatacgctcactcatcctctgtcagcgagaatgacgcactangtgcagtagtcaccagtcagtctcgtcttcnccattgtattatttatctgtgtgancagtagacctcatcatttgatacgacnctctctgtactacgtggtcatagccacatctngatngtagatatgactatatccactnagcatcgttccctagttaagcagtctagtaagtatatataaatagcatcgcagtcgtcntcgacctcagccgatggtctcttatctccctatatagtctctctttagtcaccttcctcacaactttatggtgacgccgacgncagatagttatttgataatctgcgaaatgtgtagtacgtgatatatcctgatgtctcagtcatcaatcattgccagtagggtcgtcctnaatgtactagtgtgcttcggctctgactccgcgtatttgtatatatatncctatgcgatcaggtgtgcccgtataaccgcgtatttgctcttacccatgtccttcatggctcgttgatattaaatataccataccactcgccactcttgtcctcatatagtactagtattcctttgtattcacatacattcnttgtacacaccattgccccacctgtcgtccatgtattattgagtcacctccaccacggttatccattgacacatacacctacagccagccatcatcggtgtgttgaccagtgtcggcgccccatacatggactgagtgtgcccgcgactcattttctgtttgtcacgccccgcaattgcgtggcagctaaagcacgactatcggacacgtacgatatgtatcgagcgtgttaccaagactcaattctactcaaccattctattatgggagactgatcattacgtctgtacacgctccgatcctcattcttatcactgatatatcatatttaccctgcg

SEQ ID NO: 17273 - DNA, 1738 bp, Homo sapiens
  misc_feature (1)...(1738): n = A,T,C or G
ccccacccaccaccnggacgcatcncaacacgcttaacataagtaacaagagtttttattactgagatcccgaagaacaacaagaataacatcttatatacnctagtctctagaccacatagagactggcaagcgatgaggaatatcagataagtcttgtgatagtagttagatagaatagacagatatatagagaatacagcagagatctaatcatcgactagagccatatcatcatacactacgacactcatatgtataatagttacaatatataattatcacatcgaccccacgcatcacaacttgcatagtttgacgtgccgtgtatccgcgcgcgccacctagcataccgacctatttcgactctntaccaacgcgtacacacgcaccacgcgtcgcagtacatcacgatattatntgtattactgttttntatatacctcgaatgacaaatgngacagagccttaaanactaacatctttagattctcaacgagtgcatngttgattatatgcacgagtactgtccacacattactcgcactcacaacactaancttacccacccactaaanancatcacacacacacatcaccaacaattaacacgtacatcgcacagtcttcactacgccaggacacgctnaccgctcacgctcacatcgtatagagagcacagaacgtgttgaatacacggtattaccgaatatcgcacgatgcattgtaacgcgagcacgcgttcacaccagacgtattcacgccagtagcgtgtatcacctgcaccgctaatgtgccaccgcatccatctcccttgtacatcgcccncgttcagccccaataatgtgaacatatgcgtagtatcttttcaccccgacgagcacaataaatgacactagtcgaaccgcactagttcgccgcgtttcatcacctgttcaagcacatagacccgacaacatgccaccacaactctatcgcgaccactctaatatgcacaccaacccacatatatacagcaccgcattacgcacgccatatcttattatagtatcgtagtacagcacancnatcgaccagcaccggaataacgccggccaatatgtatttatcacgctactccgcgacganagcgccgtaatccgacgattttatcacaccatattaacgcccgtactcgcaccgtccttcatcgaccacgctcncatttctactccaccgtatccgcgatcgcactcatccccccgcatcattaccnaacttatcgncggacatcgcaacgcgagtaaattgccaccagtccacgcgcgctatatattatagcggcttcagatatacacgtgtccgctctncgcacatatgtagccgacatctatcaattatgacgatctagcacggtagtgtggtcattcgatctcgacgacgtatctatatgacatctatatcacacgcgacgtttatacgtgtactcttccaacactagttatacgtnatatcgactaatataaacctatactacctcaccgattactttattatctctcncacacatcttcgtccccgtctattacctcaccactcgcgcacgacgngtatatcaatcgtccgcttcctcgcactcgtatatacgttttatttctatattcncgctatgcgcngcgactcatacatcgatactctatgactcccacgcattcgtagttntcgccgccactattgtctctctgcgcgttcgttcgcg

SEQ ID NO: 17274 - DNA, 986 bp, Homo sapiens
  misc_feature (1)...(986): n = A,T,C or G
ttgtatagtggtgttatgaacgcgccgagaaagcagttgtgtgaaatagtgggtgcctcgaggtatgctaagggggagaccaggggagggagagtaaggagggcgcccanaacccgcagcgagcattttgtgtttgatatcctctccctatctccaacgttatctccatttaagtcggtagccaaccacccagatccacgaaggccgagaccaatgcgagcccggacccacacactcctggacactgagtatgtctagacccaaacgataataagcggtgcagaaagggcgatccgggggacgctagaataagtacatctcgcttgtcgtcctgtgcttataggcctgttggtcaagcggaccgtgatgtgagagggaagcccggagagcgatccgagtgtccagcacgtaggagagttttggccgttgacgtgagcgttaatgagggtatatatggtgatgccccggcgaggggggtcgcgcccgatctgggaagtcgcggtcgttacatataagcagtgccgctttgcctttgccgtggtgccattgtggagcaatggccgccagtatgaggttgtgtagttatcggttagcccggttggcgggtctccgggggtaccttacgcagagttgagtgtgcgtagggatgcttgtcacccgaacaccgccaaggacgtgtgaggtgggtagcctgtatgttcactcatgggcgatgggacccacagcgcagaagagcgacttgatggtagggcccttgacccggggtaaagtgggagcancccggggtctccgggcgtggagtctggtgtgcccataatggggaggtggccgccggcgtgacatgggcacgacccgcgagaggggaggttcaggaatagcgctacgctcgcagtgtgccgagtattgcgggtagtacacaaaaattgataattgcgcgcgagaaatgcatgacgtcgacccgctgtgattgaaatgtgacaacacgg

SEQ ID NO: 17275 - DNA, 838 bp, Homo sapiens
  misc_feature (1)...(838): n = A,T,C or G
ttgtttgaaacataaaagctcttctatgtgtntacgcatatatgtttataaaggagaaggcgaagaatttgaaaggttttcatgatcccgcccccttgatataaatccaccaccccgcgagcgataaaactctacaccacgacccccccccaactcgaacaccctagcaactgcgttctctcgcaaacatgaactttcaattcgtggagaacacaaatgtacttaagaactaataaaaacgaacacacgtccncttataccgangagaccgcccgacgacccgccgggcagcaaaccttcgctgccccctcccgtggcgcgtatacgaccgccgcgacgcttcgcgttcgcattctggcgcttcccttatgtaatcgccgccgtaangccgcccgcccctcgccggcgcccgcgcgagcggccttaacctgctccgcctctccgccctactcagggatatataaccacccctcccccacccccccggactagcagccgactgcgtgtgccgtatacagcagttggcccgcgacgggccccgcccccctcaaaacaccccccccgcgccagcaacagatcatataacaccaccccccgcattccatcgcgcccccagcctgatccccccggcgatcgcccaccagaccccacacccccccccccagccccatccccaccaacatccccccccccgccccctcttcccatatccgccatccccccgcctccatcaccgccccgccgccagtccgcttattttgtattcacacttaccccccccgcccaccgcccccccattccccccccacccattcccccgctacccaagaaccaccca

SEQ ID NO: 17276 - DNA, 1393 bp, Homo sapiens
  misc_feature (1)...(1393): n = A,T,C or G
gaggcagcacagtgccggcgcggcggacaggngtgccgagagcgcagangcaccgcggacgcccagccgacgagcgccacgcacnccgcagcggcgacgatgcgcagcggagacgcacgtcgcagacagncnacgacgnnngtgnnnacanngggngagcgaaaccanggcgagagccagaggngagaggnngttgncagcgnagagggaggagcagagaaccanagagcgcacgccgcagcgncacgcgacgcgnccacgcggcccgaaggagcagcggagcangcgaggcgcgcacgacctcacgacgcgncgcganggcaaggcacgagacacagacgccacacaagacagcgagcgaggaacagcacnacgagcgacgacacgccagncnnnanacacaaagaacgcnagcaaaaggcaganaacacagagaaacagacgagncacnagacaagcgcgcgaagagagnggccgcncacacncgagaccgcgcngagagagagagagaggagagnaccgccagcacgcgcncgcccggcggcgagagngagacgaggnggagagaggnacgnagaggaacacagaccggagcgacgacagggagcgaagccgaagaagagacaacgacacagacgcagcancagcggcgcagcagccacgcaaacaccaaccacccncacacgcagcagcaaggaaacaagagaaggacagcgaccgagagagaaccggggcagaaggcggcgggcgcaccaggcgagccgcacgcaaccccaccgaacgccagcaaacgcgcgaggagaagagaacaccggaccaccacccacaggaaacccaagacgcaggcgacagaacaccggccaggacgaaacaccaacaacagaggcgcgacgcccgccccgcgcacagagacgaacagccgcccgacgggccacccgagggagggccggggcccgcgcgcgcagaaagctcgaaggacgccatgatgagaaagaggccaggcaccacacccgggagggagaaagccgaagcccgagaggccgcggcacccgggggggcaaggcacggagcacgagcgggcgaacagcccacgcaccgcccagcgcggaggggggcacccggcgagccaaggcggggcccccaccccgagaacagccgggggagggccaccaccgggacgagaacaagcaccggccgcacgggggggggacaggggagcaccgaacgagggccgggcgcacggacagcgggagggaccccatcgcaggcggcgcggagagggagaagcatcccgcccgaaagagccgccgaaaacgccccaaaccacccacagccgagccgaccgagcggcaaagcgcgccacgcgcgcggaagcgagcaacacacaacggcg

SEQ ID NO: 17277 - DNA, 348 bp, Homo sapiens
taaaacaaacagaaaacagcaagtctctaactctaaacgaactcacagcgggcaacagcaaaatgggaatacacaccgtttctaccattccataacgcaagcagcataaacatccggtacacccacacgggcagaggggcctacctctgagagcagtcacatcacctcacctaccatggcgctatccacaagaatgatacttacctctccctcgcaccaacccaacaccggtgcccaacacgacccccccggcacagcctgctccccctaactgaccccccaccctaccgtacccctcccctcctgcccaccccccccaccagatccctccccaccccacctgctcac

SEQ ID NO: 17278 - DNA, 1224 bp, Homo sapiens
  misc_feature (1)...(1224): n = A,T,C or G
aaaaaaaaaacccccccccacacacgaaaacccacacctttttcgaaaccaacaaccaaagacatttttgagcaactatcactgcgtcttaccatctgaacaacaagtgctcgaggctcatgcatgagcggctcacacctgtaattccatactttgggatgcccaggctactggatcacttgcgtgtcacccacctgatgtatcaccattgcgcccacatgtaccccatcccgccctctcactccccacctctccacccgtaccccattgccgtttcgcccgcatattcatgtcctaccttcacttcncgacgccggaagtgtaccgacttaccaattacaccccacatcatttcgacccctgtcacttatccctcttccctcatccccttctcaacctctctggcaccacacgatccgacaccacgcagacgaccggcaaccgctgccccctttctccccccgccgtgctttcacccccatttccacccattcccccctccatttccccgcctaatcctcctcccccgtttcccccccccccccttgttccgtccaattaaaacgcccaacctacacccatttccccccttattgtatcccttgtccccttcctcatacacccaataccccacccctttaccccccccttccctccgttccccgcatttatatttatccggagacgcatatccgatcatttacccccattatttttccgtctctccgcccacccgccttcacccttctctccccnttccccctcttccaccccacatttctacgctcccgattcacacctcgtgatcatctaccgcagttcagcgcaagtttccaatatatagacccactccgtacgtcgattctacgcctctcccacacccgagtgtttcgatctctacggaagtcgacccgcctcacattccccattttctcccgcagccactcttccgcttcaccccccattccctccctcccttccccaccaatgttcctgtcttctcgcagcgcacatctatgtcgtcgtctaccattcgcttcatcatcacatacattacgccccgcgttttgttcccccgctactcgctcgcatttttccaccccctcgcgcttatttctattcgtgctgcgccttattattgtgttatgtctatccactatgaccccgtctctccatctatcaccccactcatacgcttcgccnctgtattactcnagtattccc

SEQ ID NO: 17279 - DNA, 960 bp, Homo sapiens
  misc_feature (1)...(960): n = A,T,C or G
cccacaaagagaggcgcgggaccggngggtgggaagggcgagagaaggggagtttagagagggaaggagtacgggagagggcgcagggacatgtactactcaaggcgaactgcacgtggggcaacagtaaaatgggaatagccacgctcttcttccattttatagagcaacgagctacaacatgcggtacacgcagtaggggacgagcgggcnctacctgaccagcgaggacactagcacagctacaatcggcgctcatgaacacggctgctacgttacgctttgctatggaagcacaccagcacacgggtgtagagcaaacacaggttgaggatgtgtgtgtcatcgccgcctgaagcaagcgacacttaactgttgtgtcttataagcagagatatgagatcgtcgacacgcccgcccctgccggccagccgccttgaagggatcgaccccgaaccccgagtcctgcatcgcaccccacccatggtcaaggaggaaggaaggggaggatagcgccgccctcgcccactaagatagagtgccgcgcgccccgttgcgcccattcccgccgcctctcccaccccgacctaataaagtagataactcacccatatatcccccccgcgtataatccccccaccccccacccccgccccacatgtcctccccaccacccaacacccccgacctcccccccccccccgtttaatctaaccacccccccttcccgcctagccccccgccaacgtcgaccccgtctatctgcgcccccctccccctcccccgccttttcgtatccgtcccccccgattcaccccgccatcggacacgccccccccccccgcccgtccccccgccccgccatccgcgctgtccgccgccgcgcccatttccgcccacccccacccagagccaaaatacacaaacaacatcccgaacgaaacccctccccacccccga

SEQ ID NO: 17280 - DNA, 1383 bp, Homo sapiens
  misc_feature (1)...(1383): n = A,T,C or G
agacctcctcttaataatcaccgcccccccaccaccaacgcaaccaaagaccacgacaaccacacaccgcgatttcacaacaaaaacataaaaacaaaaaaagtttagagacagctggtactactcagcatactccatcccacatccaagatgagacagtaaaccacctcgaacagcagcccttcgatccctttctcaccgttccctatgagagacacaacacatctccatgaactcaccggcgctccaccacccgcctccctacatacgcacgatcaccattactcactctcgtcctttctatatccacgccccgctccccaccactaataacttcggtacctcctaatcacaccactccatcttctctcccccataataatccatactctcgttctcattaacgctccgtacatccactcctacttccgactatagctaccaccgcgccctccgcgtgcgccttgatgcttnaacactcccctctaacccacccccacctgccctaccccaactacccctacaacctttacaanatgtaatccaaaatcatatctcgatgccgtaagacgaatcacgcattaactcagcctgacgacagaacacaccatcatatagttagtgcggtccgctccagctaaatatgatagatatatcatgctcgacacgcacacacactcgttaagcgccgcgtcnacttctcacgcgcggtttaagcncgatggttgtcgcactcacntcagagccctagagcatccacccaccanaccctctgcctcgcgcgttgttgcttccgtcatgcncacattgctctccagccggccaccgacggcgttgtacatatccacatgttctgtcaagtgangctcgtcgcatttacacaattcccacgcagcatctcgcacggctgtaccaccatgtcacgatatagtcagtaccctatagcgatcaccatccattgacagctgtctctcacaccagccacccacacatgtgcgccctctgcgcgntctacngctcanctctcgacatccgcgtctactacttgtatacacactcgcacaacacatgcctgtcactcagcgatagggtgtgattccacagagttagcgacccccgctgcncactctgtatgaccggtgtgcgtcgacctatcgtgtttacaaggtgtgccaccagctcacacgcaatagagcatcntcganggacacagctgtcanaacngcnctctcgcnccgtatatatgtgcgccacgtatatcacaccacgcgcgagtatctacacgacacagtacatatatatatacgccgtcaatgtcaacagcgctctgccccaccatgtccgaccacacgatcgtagtacgatatancntatagaccctcg

SEQ ID NO: 17281 - DNA, 290 bp, Homo sapiens
ctttaacttcagaacactacaagataacgtaaactcaagtcaaagaaaactgaaagagtaggatctcttaaagccatatagcagagccttcctgaacaagggtgaagtaatcctcaaaatcaaaatataagcattgtttaccatatcaagttacatctatcatccacatcaatcttgaacatcaaaacaagttctagaaagagggatgattattcacaggatgggccatactccaaggattcaggaatttgagactctgatgagaaataaaatagatttaagattcaaaa

SEQ ID NO: 17282 - DNA, 841 bp, Homo sapiens
gtaatgaagaaagggatgtaaacaaactgtgggtatgaagacgcattactgaaaggtcatttaaaaccacgtgaaaccatatgttaaagaagaaactgatgaagatggcaacagatgaaactaaatgttattaaaatatgaaaaggtattgtttgaatgatccaaaaatagtattaaatattaaaaattaaaatagacatttattattatataatattttttcattaactgtatttgcaacaaaatgagtatataccaacatgtgaattttggaatattaatggttgaaaatttatgatggttaatgattgtaatactatgtcgggatgacgataagattttaactatccaacataatacatcgtattatactcgatggcctcaaatatccacctatgtcatttccgtatttctttcaggtttacccattcaccctccatttcgtcctattttccgtcgccgttatattaccttaccgcttcgcgttcccgcatacttttcgccgccatcaccttcacatatccatcacctcgcaccgatatgccagacacacaacgtcatctaccgttacatatttccatcctcttttacgcatcgacccatttttctcccatgaccatctgcaaatttccggcgctcctcctactccattgctgtcgcctcccttctgttactcgggcgttttgtgtaatacttcgtttccattttttcacgacgcgtgttctgccgatatttccattttttcgctttcccctttctcatcaatatacctatatttttttataatccactccctatattcgttttatccactcttttaactccgtgtattcttatttcc

SEQ ID NO: 17283 - DNA, 576 bp, Homo sapiens
aatttcttagtgactccactgttgccgtgccgtcaagcatctgggactggaaaagccgggttgctcgggtggtttggattcagtgcggctgatcttttgtttccatgagaacacagaatgaggccaaccagcaatctggactgaccttgatgcctaaattctaatgaaagagcaagttgaactataatggtgagaatggaaactaacaacattctatcccaaatgttcgacaaacgccttgtgaccaaaggtgagcgactcaaagttcctctaaaatcctgcaaagggtgataccgacatgactaaccttgggaattggctgagtacatctcactacaccgtgctctatggaacgctagcacaccttgaaagcggaggctataaacacgtggcagcagcggcacacaacctccataataatttacgtgccgacaaaagccccgactaattatggccgctcgcgcggccttcccccctacgccagacaatgttaagatcgcctaccccaactgtccgtgccgccccgccaacatgactacataaaagataacccgactcatccccctccaccccgcg

SEQ ID NO: 17284 - DNA, 1648 bp, Homo sapiens
  misc_feature (1)...(1648): n = A,T,C or G
ctgccccgccccccgccccnttcccgcgntcccgccgcnccggcccgcactttgcgcggcggaaggngacgcgcgggctagctgcatgttactcggtgagaccagtatnaggcgcacatagaagatgacactagacgtactcagagacgtacacactgggcggacgtgtctgtgctagctgtgtagagnaatgaaggatcagagngcgacgtggcgcgagcgagantcagtgcgtgcgcgtcgactctgtcggaggagatcgagaagtgagtagagacgaagagtgtgcacgcacgatgtgagagtgatgatgtcacagcagacatngagcgaccgacgatgagaccgtatcatatacccgcgagtaagtccacacggagacacccacagcacgtnatacgcgcgatatnctaacgtggtagcgacgttgttgtggtcgcgcgtgacanacaagaccagcgagtacagagcgaggcgaaacgagagacgagaggtagcgcgcgacgnagacagacacggtcgccgcatacgcgcattccacgtgtcaatttccaacccctaggtcccccatcttcacccgccgcaccactcgtttcgccgtcctcacactcgtgcgccgcgcacgcgtcacgatccatacgcaccgaccaggtcggagtccgagtcgtactcccccgcgtcagcgcaccacgcccaagggttgtcacgcgcagtatatcgagcgcagtctccgacgtcaacgtgtgcacgcacgtcgtatccgcgctcgccccgacttcgccgccgcgccccgacgattagttaccgcatcagttaattacgccgcgaaccctcgaccctcnaaagtccgcacggacggtaccgcgttcgccgttgccaccgcaccccgaccgtccgcgcgaccgattgccgcactcgtgcttgtacggcgcccgcattttaccgacgcctcaccgcctctatacttcaccttccgacgtcgtcgacactcgcgtccggctacacgcctcgtatcttttccagcagcgtccccactctacgacgtcaccgtgacacagccgtatcgtcacgtgctacaccgcgatatctgggcacaatttacacacgcgcatcgcgccgcgcaccgcgcgccagtgtacgattaacgcacccgagtcgccccgtatgtatgccgattcgccacgccaatatagataagtcgacgctagagcagaccgnacgcagcgcccgcnagatgaacgcaggagagtggttaancgcggattgtagcgcgcgcgagtatggcagttcgcgtcgtagccacacttcacgacgtcaccatatctagacacagcagccgcatattatggcgcgtcattctagcttcgttgcgtcactatcacactaccactaatgtaacgtcgcgaccagcaccgctctcttctgtggccagncgatctagttcggtccgctgtctgctcacgcccacccgggcgtcggcgccgtatgtcgagacggccgctctcgcacagccccttctatatccactatataagtatcgctatacgcgcacgacggcgcgcgacagctaggctgcgttcgtgcagatgcgccagctgcaatacgacnttcgcgnacgctgatttgtacaccncgctgtttntctccg

SEQ ID NO: 17285 - DNA, 742 bp, Homo sapiens
gttgagttcttgatttgattctcagcttggttgctgttggtgtatagggctactgacttaaatctaagacccaaaaccataaaaattctagaagataacattggaaaaacccttctagccattggcttaggcaaagacttcacaaccaagaacccaaaagcaaatgcaaagacaaaaataaaaataaataaatgggactcaactaaactaaaaagcttctgagcaacaaaagaaatcagcagagtacagacaacccacagtgggagaaaatcttcacaatcaatacatctgacaaaggactaatatcacaatctacaaggaaaacaaatcagcacgacccaacccatcccattacaaagcggcctacaggacttgaacagaccatcccgacaccacccaccattggacaaaggactttctaatccaagccataaatccctacttcttgacccctacgctacaatactacccgggttagcccgctcctccccccccaccgttttttctccccccccccccatccaccccctcccccccccacataccccccctttatagctcaccccccctcctcctcgtatatttccgttccccccacctcccccccatagacatttccacccccccctcttcctccagcccaactttcaccctataccccccccccccaactacctccgcccgcccgcgacacccggatggcccaactaataatccaatccaaacccccgacgcatccaca

SEQ ID NO: 17286 - DNA, 1031 bp, Homo sapiens
  misc_feature (1)...(1031): n = A,T,C or G
ccaccgaagacacacacttcccacaaaagnttagttataaaaaccaacactgtgtgagggctacatgttcccaatggttgaagaccttgctgacattctgcacagtgatggatagccacacacccctgtactaccaagatggcctatatgctccacgccatgctttgggaggaagcaaagtaatattgccatgttagaaaaccacgaagtcaagaataatttgaaatgctgcatggtgtgttaatcgctgatagattgagtcgggcgttgattgttgtagatgtcgcaaagttcgcttaattatgactactttatctatgcggatttctatcgctaaattaccctaataccgtggcgtttcgtacttaccacactcctcctcccactcgtgccttcatacaatgtacataatcgattaacttcccccccttgtcccttcccgcctttcccctccccaatttatctacccatctaccaccgatcatttctatatccccccactaaaccttcgcgattcccggaccacagtccccactgtcacccgctttcccccccatttcatcccttcgccatcactatttcccacgccatgccgtcgcggccccggttttatcactcgccccgtccatatccgttccacccttcacccgcaccaccattcacccccatattagcccttcctttatctcaccgacattccaatcaccgcatcacaccaatctcccattccaccccccttcacccgacccgattgaccgcctgcaccgatattccccaggctgatgagttccggcacgaagcgcttaccctccccactattcctcgttgcgcgcctattgcgcgttatgtccatatattctgccttgtgagctttccgacgcttatgttccttcccactttactcattttaatcccctcaccccgtctttcatttctgtctacgattttgtcttatttgttgttcatctacacgtcctctcatttttatattccctcatctctttccgccggcatattacaactttgtctcg

SEQ ID NO: 17287 - DNA, 401 bp, Homo sapiens
ttctggcctccgctctaactggtttggccaatatagggtggccaaagaagcaaagaagcaattaaaatgtttattcctcaattctctctctactgtctctgatttgataacacttacacgccttgacaaaagaccgtaactcctatcaagtggctaaaccttaaagcgatagttttgacagacttcccgtcactacggcctcctgttcagacccaggagctgcgatagcttcacactggttcaatcctaggggctttccctacgcctcgccattgagaatatctggctttgagagaagcaccctccgacatctttacttataaacctcgttcaaaacaacaccgttccccccacagtattctggaacaaccttacatcccaccactacccccccatctccc

SEQ ID NO: 17288 - DNA, 744 bp, Homo sapiens
aacattaaagatacagagtgaattctgatcggaacctatctgaaattattttacttaataagaagtggaaaaacactaagtgcttaccattaacattaataagtgaagtgaagcgatgtatattggcgcgtgagtaacatgttgtacagtaccaagcctttggttgcccgagattctcgttatttctttccttccacccgcattccggtcgatcattatccccacccctatttatcttactttatcccccttcgatcttatttacgcatcctaaactttcactacatcccttcctcgtgtcccatttactcgctattaccccattttccccatacccctatcttttttccttcccccttcctccgatccgctttttttcactctccgagtctctacaataatcacaatcactctaccattatcgcgtttcttctttccgtctttatcccacattcttattccacatatcttataccaatcgctccaaatatgattagaatatacatcttgcccttattaccctactgcatggttcacacaatcttccgcagacgcaattacgaccaccgaccacttcgattctccgtttctctccaaatctgtattgcaccacttcatctaccgaacatctaaataatttagcttctgccctttaacgcatagtgtccacctaattaattatttttctccttcccgctcctcaattaattcccgtttaaattccacctctttatccctactccg

SEQ ID NO: 17289 - DNA, 726 bp, Homo sapiens
ttatctctgtataccttgtcgctcccgctgaactgtgagttccttgaggacagagaagggactctgtatctctttcccatctctacatcctcaggtcacagagcctgcacaacgtggaatttcttctcaccaggacagtgcatgctgcggcactccatgatggtacctcatccctgcctctgatgcccagtgccaatcacccttctgccggcacagttacaacctcgactgcgtagttgacacaatgcaaccctccaagttccagaatgatgcttcttttctaggagctcccagagagccaaagccttgagtgtcccacacagaacagattccctctccccagcctggcatccctcttggtcatcccagcaccaagaggactgtctgagcacctatgtctcaagaagacttttgatgacaacagtggaaaccgctccttcagcttctctttacattgtttctttctctagaatctgcatgcaggattttccctctggattaaatgacccatctctgagacagacacccattttcttctcccaaccttccttcccatcattcatgccctgattgtgttccttccccccaggctctaccgaagtgacctgtgaacacttcatccacagtggctaccttatagtcctttataactgcctattgcaagcatttttttcaaggccaaagtgggaagtctgctacataccaaaaacgcaacctggcactcag

SEQ ID NO: 17290 - DNA, 1610 bp, Homo sapiens
  misc_feature (1)...(1610): n = A,T,C or G
ctccacccccccccccccccccnntnnggccnntcgaatcctcgcnccgcctcccttttttttcgagnggngaagnggggagaccggagagaggtggtgtttttgtggtgggggatgagtaatactaataacacgctaataatttaaaactagaagacggagtgatgtagggttaattcgagattttgatgacgaggaagcgcccacagagttagatccgaaacagatatcacagcgtagaccgagattataggacgcacgctccagggaagaatacacagctcngttatatggatcgnaacgtgcacgacgcgcggatttatagaggttccantcggtattctgaacgttcaccagaatgatcccanatatagcacgcgagcacatggatgcgcggcgtgcatcagggtgcaggaggccgggtggtatggaagaagtatttattttttctgatgccgattttatcgatcgtttactctggccttgcgatgtgtggcgtacgcctgttgctccgttttcgtttcttatcgacgcttgcctgtccctcattgttgatccaccgtctctgtgacaccttactgcatcagttgcggtggatgctccgtatgccgccgcttgtgtggttccgcccgcgtctgtaccgcgcgagcacagcagtggctgtgttacatgantagtcncgccgcacaggtgggccgtgcgcgcgccagcgtcctggttgtaacaccaccaactatatcagcttcttatcacgcccatcactcttattcgctcccggatgtttgacccgagttctcatccactatgacacgtcacgtacactacttatattgacgatcccaatttatttcacccgaacgcatccgcttctgtgttcgtaccgacttattcccgtttctccgtttcgacgattcgcgacgaactacccgttttcgccccaatctatccgcacctatgttgcggcgcagtagccgcgcgataggacgagtgcgcgacgccgcgttgcggtccatgtcacctcactttattatgtcgcctcggccgaccccccactttacgcgtacgcccacgtgtcgggacgtgccgcccgcgtattgcccacccgtatagtctcgactacccgtccctatagccgcaccgttccccantatctctccgtcggcccgacccgcagtgtacgcgctgtcgctcagcgctatattcgttgttcggagcatacggtcggtgggcatcgccagctagtgttcccgagatagatgtgtgtgttgttggcgcgcgttgtgtcgtatcagcggcgcgcgacgaagtattcgcatgtgcgcaacgctcgccgctctgtagtcacgtgttcatcgngcatatgctgggantcaccgtcttgtatagaatctttgcaccaccacctatatatgtttccacccactctattctcttcaattatactgacacgctacccgccaccacaatgttcttcttacaactcctcgggccgatatactctgcgtgtgtgtcngtgtgcgcgcgcgagccggccgctagtgcggtgtctgtctacccgcgctcttnttcgcgttccgacgcggtcagtgtgagcgcgagtagcatccgcc

SEQ ID NO: 17291 - DNA, 301 bp, Homo sapiens
atgaatgccccatcatcacccccccccacacccagtccacactccaaatttacaaaaaggtgtagggaacctgcttatcctttgaccaaccatgatctctggctgctattcacaagaaacaggagtgttggatatcacctcttgtcagacctcaagagtcatgaatggccctcaccatactgatgctttctgactgagctcctctctaccctgaatatgagagaccttaatagttaggaaagaaggccgccgcctctattctgcttcaagaagctacagaagatggatcttcctctctctg

SEQ ID NO: 17292 - DNA, 501 bp, Homo sapiens
gcccccccccccccccccggcccacaggggtggcctttgcgcgaggaaaacacaaaaaaagttttgtggtccacgacgcagcagcagataatggtcccaatgctgaggaagtggcattgtcggtatatccacccaccacagttactgcataataccgggatacggacagagactcatgccctacgcacatcgcaggcaggctcgtcaagccgcgcgcatctcgactcactctgccccccaaccagctgctgcaaactatccctgcacctagaacgactaagcatcactcgacaactcgacagatacccaccattaggccgcccccccagcacgagccacgagcgtctagacgacactcctaatgatgtgattgctgtcccgccgagtgtttggcgccgtgccagattacagatacacactttcacacccatcatcaccctcccgcttcgcgtccctccgtactccagtcgcccaccccgcgtcttcccgcccccgtccgcc

SEQ ID NO: 17293 - DNA, 734 bp, Homo sapiens
tttggctctgtgtccctacccaagtctcccgttgtcttatgatcttcagtgttggagaaagagcctgttgggaagctattggatcacgggggcagattttccccttgctgccctcatgatagtgagttctcactagatctggttgtttttgtttaaaagtttgtagcacttccccctatgctctctctctcctgccaccatgtgaaggcttgcttggatacccttcatctcccatcatgattgttaagtttcctgaggtgtccccagccatgccacctgtacagcctgaggaacagtgaatcaattaaaccctttttctttataaattacccagtctcaggtagttctttgcagcaatgtaagaatggactaatacagcatcttctccaaatttaagcacctgccttcccacaattcatttgagaatcatctaatatttcactcatatgctcacaaatactaagctcgctgtataagaccattttatatattccttattttattcattctgcaaagcccctgatgtttctcttaactaaagtctctattatttgcttccacccacccacaattagttttaatgctcccgaatattcttcaattttaatacacagacggctagcttagcccacctctacctttttgaatactcaagataccacaacattgacatgccctaccacagcaggaggtcgatattttcaaaccggaacgaacccgcaccccttccgccc

SEQ ID NO: 17294 - DNA, 950 bp, Homo sapiens
  misc_feature (1)...(950): n = A,T,C or G
cccaggnatttgtactgaaagaggccatgagcgtgggtgctgactcctggatttagcaactctatctgatctcaaaatgtgtatactgggaacaggatgccttagcccacaacagaaccagaatgaatctttgaaggcacaagactctgcttttgccactcttcctctttcctggtatagaagatggatgtaggagagcttcttttctaactaccatctgatcagacaaggaatgaagcaatgactgtgggctgggaaactgtacctacctctctccccactgcaaatttctgggatagaccaaaagtgaatttgattttgtgttggctgaagttcttcattctgactgttgaggggaggttttcctttgaagagttttcatcccagactcagctgtcttttcacatggatgaaataattcctgctaccaacaacagagcttcaccaggaagttgagttttcaagatgccttgttgctttgaagaagggagtgatgacaatagtgttgttacattctgcctttagcaacctgagcaagagactctctgccactgngctgcacaaaaataaattacttgaatctgcccttgaacaggctgacgaactatgttgagctatacacttatactngaacactttggcttcttgataatgggacaacagagcgtgctacagggattgatgattttgtcgtttaagaggacctacatggagcggggataagggttcgcttcgtaggcgtcccacccacgggaagaaattgcgctactgaacaggagagggacattagagcatcgcttgtgagggcggacgtagtccgccaccacgtcctacgtgagaacccgtgccgcgcattaactagagagagaagaaatgagacaatatgtacgctaaccgaccctcgcgggagataggcgcgccatcgggcccgccttgattctcactagccg

SEQ ID NO: 17295 - DNA, 334 bp, Homo sapiens
cttgcagggacgatttggtcaagatgtaaacatatcgtagagctccagcatgggggctcacgcctgtaatacaaccactttggaaggccaaggtgggagaatcactcaagcccaggagtttaagatcaacctgggcaacaaagtaagaccctgtctctacaaaacaataaaaagtaaaaactagccaggcatggagcatatgcctgtggtctcagctagacaggaggctgaggcaggagactgagtctgcagtaagccgtgtttgcaccactgcactctaggcttgggtgatacagcaagatctgtctcaaaaaataaaacaaaaagtacaaaa

SEQ ID NO: 17296 - DNA, 1370 bp, Homo sapiens
  misc_feature (1)...(1370): n = A,T,C or G
caaccgagaaaananccacccncaaacanncataatagaccaacacaccacactnnnttcccnggccacacccaacacaagaccaanagaggagttatttgatggggagggnagagtgaacaacgctacactcatagagagaggcgaggatgactgacgagggaatagcacaagatctactagcgaggcaagcagacatcgcaggagatgaggagaggccgcacagcgatattntctgattgcacagaagagaacagaacactgtactctaagcgatatagaagcacacatgccgcacggaaacgtaacatgtactaactaccaaggaaacataatttaaacaattgaacaggacgcatgacactcctcgatacgaatgacgtttcggaaataggtaagtaacaccatcagttgtcgtatctcagttgagctatggatgttaaatgttaggagaagaggaatagctggcgatgcgctcccagcatggacacagagcgcaataaggatattgcgtgtcgccagtgtggcggccccgaggacgcataacacaatcacgagaggagaggattcaaagaagcaccccgaccggccagtaccacccatattcacccctattcacattcaagatcagccagtatacacacgtcccccacttcacccacgacgccccggtagtgagaacggtatatagccccccatagcgtatcttagttttccgaccacattttgcgatttacacgttctcgattttcctcagtaggagagttaaccccacccttatgcacgcccgcttattcccccctcactcggattacgaataaacccacagcccattcacattcctaagcgcaccattaatatgccacgagcgcacgccgcaatatcaagaaccggcgccttcagcgcgtcgacacgaggtatggccgcgcagaatgaccactatggacagccaaaagaagagcactagtagcgatacgacacacgtgccgccatgatattaaccgcatccactgccggagttagtcacattgccgattgatgacgggagctaacggcaaagatgcgagcaggagaaggagtggagcacgaagagaatgaagtacgaaagacggagaatagggtacgaagtaagtcgcacgtacggacgagtgtggtcgcatcagggctattcgcacttctatggagatcacgccgatagtatgattgctcgcacgtgacgtaccattttatatcccgccgagccacacgatatcgtttgtcctgcgcccgcactatatagagatcgatactagcgcggaggacccagcaattcacgtctnttcaacgcgctgatacagcgtcgcaccggttntatacgcagagtagtcccg

SEQ ID NO: 17297 - DNA, 816 bp, Homo sapiens
  misc_feature (1)...(816): n = A,T,C or G
tgttattttgtatagtagtaaaaatgcatatagatgaattatttatatagaaaagtgaaaaaaatttaanggtgaactggagtgatgtttcagctgccacagtagaaatggttctcaatgactgagaaagattcaatattggaacaaaaacaggaagggaagatgaagacaagggatcaggagctgggcatgttctcaaaaagagcaagagaggaggaacacagcatgaaggcagcaagatcagcctgcttgtagtcagcacagttgggatggctggaccacccttgttgtgtgcacaggtctggtgattattgggtgggtgaatcctgggatagggtatacaaaatcaggatgaattcaccctttctcatactctttttcattgctttgttcccatacttattccttgatttgtttgttttcttcccttatcctaatttgttcatgaacacatccctacgcatgatccactatcccccccatttatgtgtgacccaccaaatcgccccccgctgttctccccggtggacgtctgtcgtcgttttcctttagcgagggtcccctctcgatcctccgctccctgtttttttgctctcgcccgtcccgctgccccccgcgctttttcctctctctatcgccccccccctcctcctcttttattttccttccccccgtcttccccactttcggactcccgacgcccccgcccttcctccaccctttttccgcctttgtcccccaccccaccctcacacgctcgcccccccctccctttcttcctatctattaacccgacatatccccagcctaccgccg

SEQ ID NO: 17298 - DNA, 933 bp, Homo sapiens
caggtcccacactgaaaacaagaagttgctaccacttcaagactgctactgtacagggaggtggtgtgataaaggcacagatctatcgccagagaattgttcttcaagatgaccagcttgacctctgagtaatccttcattttcagaaagaaatgacccatgtttccagatgaatagtagctttcttaacctgttttttaactacgaaggtactgaataaaaatataggtgacagtgggaggaaatgggcgtaaatattccttccatcgtatggatgatcaccccctttttgcgctcatttcatccccctccgtactgttcctccccggctgccccccacacccgacccagtccccctcgcgccttcgtctccccgtcgtcccctgagcatgtgcctctcacccttttgcgtgggtggggccccggtcgcgttggggtcgcccgatatacgtttcgcgttcgccttcgcacgttcccccgtttcctccccgttccccgcaatttctccgttcccctttctatttccggccgcttggctctcttcgcggtgtttgttcccccgcggcttcctgtcgcgttcccccgttagctctcgccgttatccgcccattccgccgacccctctctaaccccttctcgtagtaccactccccgggaatcccgcccccccgttacgccgggccaatccctccccgccctttcgccgcctgtctggtcttccccggcgtagtcaggtgccgcttggcggttatccgacgcgatgcggtgctcgcgttgcgtcgcgtgtgttgtttcgccccttgtaactgcacactctagccgtcgtgcgccacgcgcggctattcgtttcttagccccgtgcccttttataatcccctctaccccgatcccatttcttttgcagctgagcttcgcgcttttctcgctttaccg

SEQ ID NO: 17299 - DNA, 755 bp, Homo sapiens
tttgagtatacatgagagagagaattaggatgaggcagaggaagaatttgaactacaatgcacctgcaacacagaccttagctgatggcacttcagagatatcctaaattgggacaagaagattgggtctttgaacctctgtgaggaccaattttgggaagggggctggccctaagagaagttttaactatgacagaagcctttcaatgagggagttccttgagagtctcacctgtgagctgccttccaggattgaatgtgaatctagggcaaagctacagcatccactgcataccaccccctgactagttagaatccatgtgctttgcatgatggagtctcgctctgtcgccgaggctggagtgcagtggtgcaatctcggctcactgcaagctctgcctcccgggttctcgccattctcctgcctcagcctcccgagtagctgaaaccaccggcgcccgccgccgcgcccagctaattttttttctatttttagtacagacggagcttcacccgcgtcatcagtatggtttccatctcttgacctcttgatccgcccgcctcggcctctcaaagcgctgggattaccggcgtgagccaccgcacccgcccaagatcatctctaacagtttttcgtcctgcctacagaccggcaaaatgttctattgctgaaccttcacctagcactaaccccccggcccaacaacgcaagcaaccgtgctctcttacgcggctcttccccacccctccctccg

SEQ ID NO: 17300 - DNA, 544 bp, Homo sapiens
gaaggcccaggttggacgatcctacgtgatgatttcatgatgggagcatctatgaaagactgggacaaggaaagtgatgggccagatgacagcagaccagaatctgcaagtgactctgatacataaagcatcataggaaatacaattgcagtcgttttattttttctagaaaaatatgtcatcctctgatagttggggaattataaggataccatctgtaagaaagccaaaagacttttaccagatttcatatttccccttttcatgtacactttatatatacttcattaaaattatattttaaacccttgtataattttaagcattgttcctcagaacatttgtaaaaggatatatttctgcttgaccagcgagatgtgcattttgccaggatcatattggacatgtctattggtgtattattacagaatcaccaatgttttcagaaatacagcactaattcatcattaaactctttgaagctgaacaaataccccccctcttccgcctgtccgcgttcttgtttccgcctccggtctcattg

SEQ ID NO: 17301 - DNA, 839 bp, Homo sapiens
aaggaaagaagaggaggggggcgcgccatgacgcaccaaggagaaggaaaaatggcgagttggaaaggacagagtgctgcttgttctgtcaccttgcaactttaaaggatccagtagatgattccaaagatgtacggaatgacagaaagtttataggacccgagaccaacaggagacagatccaaaactgacagaaagcacttttggataatcgagagatccttgagtttgaactagatgctgtgactggatggaccttcaggttggcagccagatttcaaggatctaatgcaagactctaatgccctaaggagttaattttcaaatatccacaacaaactattacatgagtaggaaataaaatttaattttgtaaagctagtgatattttgaagatgttgggtataggacttaccctattcccatcccaccccgaatttaccaacctacattaccccacacctctgttatgcctccctgcaatgtaccactatgcgcattgcccctcacatgatcccccggctattagagccgcactatataaaatgactgcctactctacccccttattccccccccgcccatgtgttaccctctcctccgcgcccccaccaaccccccgcccctctcacctcctcatgtttccccccttcccacctccgccttttttatttcgaccccccccatattcccctcctttcgtgattttgcttcccgccgcgtgttccgccgccgcccacttcgagcgacatcaccgcccgtcccacaaactaccgagccccctttagtccgtcattccgcctctgagtcacccggtcagttccgccgccccccccctt

SEQ ID NO: 17302 - DNA, 1907 bp, Homo sapiens
  misc_feature (1)...(1907): n = A,T,C or G
aacacacaaaacaacacagcacaacacaacacaccacaaaccacagatcaaagacaacacatntttattgtantcacacgtaccactntacaccgacgatagagctagatattagtagatacnacagcaagttctggttagagcgagacgacagcacgatagtcgcgaatacagctcgatagcatatagaagacatatacattgcagatganatagagagagtcaaatgncacgagtgnatagacattagagagatcatctcagcagaacacgagagcacccacagagacgatcagacgacgcgactcgtcacacgctagtatcgatagctgcngagtaatatgcngatagcgtanacatnagcgagcngcaagccagcgtgataaagatatacatagcgctatnatagccgcgcatcaacacgacagcttggatagtagcgatatagagtctgcgatatgatatgatgtgactatgcggatgaggtaatccntgacatgatctgttggattatntcgacaccntatatatcagtatgagcaatctactcagtatgagacaacgacattatagacaaggcttangcatatcgtgcgagaatagntatatngtgtaatcgataagctatagacgcgcgctatatcgacgttctacacaactcgctcgttctcgcgtcgctctaatctcantcatccacaccgcccagctgcgccgtgtcctcacacatcttcatccgccgcngtatcagtcgcacggcgcttcatcgctatcaacggcctcgcaattctgtacaccgcgnaccgtgtggtgttgacaactcgacacggtattcacgcccgcgcgcgtcgtggctgttacgcgcgcgcgcagttgatacgcgcgcgcgataactcgcgagcgtcagcctcatatcgcgcgacnataggtatgaaccgatacacacccgcgtgtataacataccgcgtatcgctacgcttatatcattccgtagacgggcactaattatataccacacagatccgacatccggctaccctcttacactcagcgcacggatcctcagtatatgcttggaattatcagcacctatccagcaccgtcgtcgacctacataattgtaacacttataccttatctcgccgcaccgtntataccgacnccgctactacccctcattagcaagtgatcttacacggatctgccgcagatattacgactgcttaatccgcgccactanttatattatacacggatccaccacacgatcagccgataatagcgcgatacagcacgcacgtaaccgccgcataccacgcggccggatcaaccgcgcaccacagatatatagcnantcgtatatgcacagtactcatctnatcgcaccagacagatctatacgagtaatccagacaccgcgcagcgagacgaggatatagncncgcctatccgccgacgtcgncantaatatcgcacacgatgtcatatccactcgatcccatatcgcgcanagtattagaagccacgtgacacgtaagtctagagtatgantcaccgccgatcaaatcctgtgcacacttacgtccacgataatatgtcactagatatcactccgccgacacganatgatacatacgctgcatcatccgacatacgtgattgcgatcacagtattatcgctgtcntcacacgtcgctcttgcatatatcgtcgcgcgcgcgtccacatcncatcattgatattgctgcgcaccgtcgaccactgtgtcatacactttttnatgtgtcgcacactatatgcgatatnatatgctctttcatcatatctctgcctgcatatatatcaatatatgagtaccagcacacatcgacgttgcgcacgcgcanatnttactnccgctatctatcccg

SEQ ID NO: 17303 - DNA, 855 bp, Homo sapiens
  misc_feature (1)...(855): n = A,T,C or G
ggataaggtagaagagaagaagagaggaacaaaagaggttcgaccggaatgggaatcgaatattagaaaaaanctttttgggaaacaaacaagcaagttacatggatcccaagctgcttctggacaggctacagactcactggatacatcctgacacataatgcttcgccagcacaatgacgatgaccttcacctagtaaaagggtgagtcccgcaaaggagctgccttacccccagaacaaataagggaaatgcataaggcagagctcaccctgaacacagaatgtacattatgaaagaagatccttcctgaaatacctcatatgacagccaataacaatgaacatcgccggccacaccccagctacctattgatagacccaacatccccaccccccccccccccccaactcgaaaaattcagtcccttgccgtccgccccgccacgcaaccatcctccaactcatccacccaatccacccgctcccccccacacctaaattctactccccccttttctccccctcccaacatcccccctctcctttccccccccacctctttaccccccccaatacaccccacctccacccccccgaccattttttatcacttcccccctaccgcccacacccccccccgtcatccccccctttcctatccccccccccctccaccccatttcttaccacccccccccataccccccctccttttaattatccgatccccgccacaattccacccacttccccatcacccacatacccccccccccagctaccccttcccgcacccaacacaacacaaataacacacaaaaatatacctaacatatccccgccccgccacaca

SEQ ID NO: 17304 - DNA, 1464 bp, Homo sapiens
  misc_feature (1)...(1464): n = A,T,C or G
gtagttcactcatagctgtgttatgtgagtgagttatgtcatgtccatctttactgattctggcgtcgggcttctgcgtagatcgtgcgtgctgtggtgttgccgcgaacgagagtagggcgtgcgaggctgtgtaagataacacacacgagaaaagagtgttgggtggcgtgtgtgttggtgtgcgtgtggtggagagtaggtgagagcgtatgtgtgnatgagaggtaagtaaaaatatcccccacagtcaatctcctcactgatcataagttgagtgttggttttgtgcgctccacacgccgacgctcatagttgtaggagtcggacgcgacagtgtacgttgtgtttacatgaggagtgtgagttatagcatgtctatatataccatgatcagagaagagtagaagaggtagngtgagtgaatcaacatatggttacaatcggtttgtgtgtctgttacttatgttgattacttcatattgtactgtcgctctctctttcgtgttgagtcgtatnaatatagtgataattatgtcncacaccctatgcttgtagaggagtgtgagtagggtagagtatgatcggtgttagtataatacgtggcgggtgttatattgtcctcncctctcagggtgtgtgtgtgtgtcactctctgcgataagtttgttattattatcttctcatctattacgcacagcgtttagaggtgtatatgttgctcctctctcctcagagtggagcagtgaaagtgttagtgagatcaatatcnccccacatagtaatgttcgtgaggagttgttatgtcatacgcncccgcgtgagagggtggttatgtacgactcccactcgagagatcaggcatcataagtgtccctagactgtcaactgagagtgtgtaccacatagcgacgacgtcttggtgcactagtgtgattaggatgtggtactagttccgcatgacgtctagcgacgtatcgtctntcgatcatagtcgcacgctatagagacgtgagcatcaagcagtagtatgacttgtacggacggggtgggtgtgcttcatcacagttagtgcgcgcgctncgcgatcttaggcgcgtgagacactgttgtctctgcacacgaggccgggtgcacgntagtcggtgagtgcacgctgaataggtagatgatatcgcagtnccgaggatgtcncgtgtgtgtagagtgtggtgtcctgagataggttagggtgaggngtgggaggatgtgagaggttatgcatgagggagtcgggagagtcgggcagttgctgggagtattctcatggtagcagncgctttcgcgtaggcaggatagctgtcatacataggtcatacgtgangagagcgacgcanaacgtgcgaagcgtcactcttctctattcatgatagagtctgagatcaccncaagacatgtggcaagtcgacgtgttcgcggtatctc

SEQ ID NO: 17305 - DNA, 842 bp, Homo sapiens
  misc_feature (1)...(842): n = A,T,C or G
acttagtccaaagttttctaanttcttcctctcccatctctcacccctaccccgcttccaccactcctcccctctaatacacctgcaataattccgcgtgtttgcttaattgttgggtattcctgtgacaaagaaggcactactcagccagccagaatgcactgaccaccactgcagggtttcagtcacatgagacatctgggtgatagaggggagcgtggggaatggctatcattgatgagcctgtatgttctaagcgatctggggactaaggcttatttttctgcaggcttgtcttatgaacaacttccaccctatccgccacagtatcggtttatacccatacagtaactgatactctcttatatgcatctctgtttgttggacatcccgttctcctgtgctatcccgcctccctttcccgcccccgcccagaccggatccctctttgttccttatacgcccccccactcaatttcccgcttttcgtcctccccctcttttcccccccatttttttgtccttcactgcattgtcactttcccccacactttaatttcccattccccccctcccgccttttttccgccccccccccccttttttctcttcccccccctccgttctctcctctttccccctccacactccccccccctcccgatcctccttcctccatcccccgtccccgttctttctatccccccctccccccatatccccaacgccgtcgccaccatccttactcttttcccacccccctccctcgacactccccccccacgtttcctaattttccgcttcaccgttcaccctttccttctgtcgttttttccccaccc

SEQ ID NO: 17306 - DNA, 1016 bp, Homo sapiens
  misc_feature (1)...(1016): n = A,T,C or G
agacggcacccccggaagaaaaagaacgcncaagacgcccaacaacaagacaaacgacaacaaacaaaaaaccagggttactcacccacccacgcgcgcgccgcgctgcttctcaccccccgccccccatcacgcataggcgaacaagaactcgacagaggcatccaacaacaaacaccaccgaaacacaacggcatcaaccgccaccatccctacttgcgacctccaccaccacacacagcatgatacctacaccacaaaacaaaatcataacataatctcatatgcttctcacgtaatatgaacgaaagaaagaaggagagaagcaccgcaaagaaacacacgaagtaatgcagagcgcgaccacccacccacccacacccgatacataccccactaaagattccccacgcagagctctacgaagaaaagatcccgatatgagtgtttcttccccccccgcgattgaagcccaaataaaaacaaaaaaataagaaaaccccattttgtaaagtaacaggccccacagagaggggagggtagaggtggcaacacccaagcccctggagaaggaactaccacgcgcgggagacacccccacccaccagaagacaaactcccaaccatacccgcagcacaccccacagacccgcatcaggctccgttgcatcctaccacaataccaccaacttcaccctagcgcccccacgtggcaccaacagtccctgaagcatctggtgggcacagccaagtctcacatacgcacagcaacacatgttatccaacgcgaaggaccgaatgagacgcagcctcgcgacagcccgccttcggggaaaagggtagagacgagcctagtggagactgatagggttatagcacgtacagcgcagaggagggcacctaggccattgggggaggcactgtatgccgattcgttagcggacaaaataatagacataccaccaaccattccaaaataaaaaagccccacccccatgtcgaccactcaacacgcc

SEQ ID NO: 17307 - DNA, 501 bp, Homo sapiens
  misc_feature (1)...(501): n = A,T,C or G
ggagtgtgtcgcancaggtggnngaggcaanncccgacaccccccaccacccatcccaaccgcgcccaccccatncnacacccccggttttatagtgacaaacacccattaccctgctcacatttaccatacatgctccaacgcttatcatgcacagcggcgcaccaggccaccactgttaggcgtaccaactcgcacacagcgcgtgcagactgttgaagggatgcatgctggcacgtaatcccacgctcatgacgcgcacaccccaacaccgtccctcttactgctgcaacaacaccacaccggcccacccgcaccaccgcaccgccactactatttaaccacaccacctgccacagcctccaccaggccccgcgccaacaccaccgacccccaaccgcaccctctccctgtcccctcaataacccgcgcgctgcccccgacttaaataaaaaatacaaaatcaccccacccttcatctcacacacccaccccaccccc

SEQ ID NO: 17308 - DNA, 1277 bp, Homo sapiens
  misc_feature (1)...(1277): n = A,T,C or G
gcaaactcgcgaaccaaacgcgacgagacgagatgagatcactgacacatcgcgctctcactactaaatatcnctacgcaactcgaagctggcgagacacaacacaatgcacacatctatgcagcactatcctacgagctctcgtcaatctatagctagcgcgtacatcgacatctcatagcgacttctcacgagactcaatgacgcacagacacagttagatatatagatagcacatatattatacataccanatacacactatagacacacacgcgcgctagtcgcaccaatacatactactcactcactctggcgtcacactacacctcnctacacgactggacacaatngcaatatcgaccactcgacacatgcaaactcgacagacacttgtcagcgccagccacacacccagcaacaccatcacacgtaatgcatatacnggatatacaagagcgcacctcncncgcagacgaactataatactaagttcgctctcatcgcagacagatcacatatctacacgcccnctccacatcatcacactctactactatctcngntatatcacgatcatagctctctctcagcgacacactgactagctatagcacggcgtcatatacgatcactaccnactcacaatctaccctctcacgagaagagcgtatatatcccaatccagcgacgcgacaacagaaagcgagcattcgccctcacacctcccgcctgaggtactactcttaatantccaccacagccacacaancaccgacgtgcaacataaccgctctccgcnctnacactcgcctcctcgctcgcatccgctancaccacnaccnacacaatcantnccatcactcactacacgcnctcattagcacccatcaacaatattctacactataaggcactccagtccaccctgatagagtagcctcacgccagatcactcgcgctccatcgctccagactccacgccacaccgctgatcgcgcctcgacgcatatccacccgatggtatgatcccgtctacacagctataaccaatctacacaccgaacccagngagcagagcatgagactcacaaacgttaccacatatacaaccacatactccagancctagccacacgaccgtctctccggcctcactaaagtccgcgccctcccagaccgactccgtgcttcagctcacagataccaccgtacctacaagccttctctctctataaaaanataactcactctaatcctaacccccctcccctcct

SEQ ID NO: 17309 - DNA, 1641 bp, Homo sapiens
  misc_feature (1)...(1641): n = A,T,C or G
ttgtagttatattaggtgnatnataantgaatacgatgcggagatanagcgacacgagaccagtgtttttgcncgnnggntcagaacggtgatgtatcatagtatgggggatttttattggtagtgaggagcgcgagagnctactcatatttngatagacatatatgacttctanctatgtgtgcagatcagagtaccaccatgtgtagagatagagatagagatcatagatgcagtctgcgtagacgagacagatacacgacgtagacagacagagagtaccangacgcagccacagtagatattagtgagagcagcgtcgtcagatagacagcgatcnatgtgagagtcangnctgacaggacngtcgcagctgcacagcgcgcnagactgtcaacatnagacgcgaccgcacgtccattcgtatgagctagacatccgtcaccacagctactagcagcncacnacgatcacgcgccaccacatatccctaantctcacataatagcacagatacgtngttgacatagctacgatacgtcgncgtcacacncatacgacgagcaacagtagcgtcacggaacgatagtacgtcatgagcgtccgagtggtactcgacctatactgtgacgcactcgtcctgaccccatatatactcgcagcacaccacgtcaacaacaccgtntgtatatntcatatatcgtagaaccgacgccagcacggntgcaacaatgagaatcataaacacacgcgagatgacacagcaccctaccactgtcgcattcgcgccagctcatacccggatcgacttacctgctacctcgccgccgcgactcactgcgcagagcgttgtcgcgacgcataccaccgtaccacgacacactgtccgacgcgatatagcgaccgcgatcaatgcgcgataccagcgccgntattcctcgtgttcgcatcgtcagctagatccaatgctcgatagtaccgcgtcgtcagttcgcgtctcacgcatcgaagtaccggtcgaccctcgcatacgtatcgcatgactcatactgttcggtcgcccacatcctacacgtacgagatagtctcccgtgcacccctcacgcaacgacacgaattaatccaagatgcagacaccgcgatgtgtctcccaagacaccgccgagtttcacaagcgcttcaccaccacttccccacccgcgttcctacttatcccccaacccctcgcccccgttgccatgtgattctcggtcttcacctagtttttctccccctcccgattgtccgtgtttatttcctcacccgatacactccgcatcacctccgttaaccttattcgcccgatttttgtccgccatcccccgcttacatcgtttactaccaccaccatacatgtaccaccacatacaccgatcaacgcgcccgtatatgctgtccgccattcaacatcaattgcgcccccttatcatcctatcagatatattacctatttattcgccgcgcgctatattacctccgcccccacattccgacctgtcccactcttaattttctgcgcaattaccagtcacccctaccgacctccatagtcccttcgcctatgacccgcgatgtttcggttccgtgcggtgcgcatagnat

SEQ ID NO: 17310 - DNA, 754 bp, Homo sapiens
cctgcgtacatccatgtgaagatgatgatgaagacctttatgattcacttcatttaataaacacttttgaaaaaaatatccagtctgcaaagaagctgaaagaacagcacaatgaataaccttgtaccacttgttctagactcaccaactgtaaatgtttcaccatatttgctttacccacaccccaaacacacaccgcctcttgtctctctctctctctgccccctgtaccgctgaaccactttaagtttcaaacatcgggatatttgacttttaaaaacttcagcctctaccttctacaaacaaaacctttcctatgtacacaatatcattatatcacactcaagaaaattaatattgatataatatacaatgcatcctatattcagatatctcccaactgtttagaaaagggcctgaatatttattaagtttttactagtggtcactcattgcatttagttgccatgtctctgcgcctattatatacaacatttcatactattgatatattccgcccctccacgaaagctgctgcgcacattgacacccacacctgagcccccccacaagagccgctaccatccccactccccttgcccccctcaaacccactcccttacccgcccccttccccccaatccccccctcacccatccctcccctccacgccccaccccccctccctccatcccacacccccacacccaccacaccccagtaccgctctccctcccccgctcccatccttctc

SEQ ID NO: 17311 - DNA, 1698 bp, Homo sapiens
  misc_feature (1)...(1698): n = A,T,C or G
attgtggtgtgatttggtgttagtgaatcgntggagatctagcgtagtatacctttttccggacgtagataccgcgaaggatagaatgcggaatagtttgagagagatgtagggtancagagaacgctgcctacacagntatctctatagatgtcgacgtatcgactcagagtgcacagatatagcatatagcgatcgtgatagnaataggagagagntgagattatcagatggttagtctacagaggtctgcgttcgctcacagtcacgcgtgtgatcaatcatcgtgcgatagagcgttgatcatattgatagattacttgagtcacgacacgagacgtagcgacgtctgagccgtgaggtacgtatctcacatacactcagtgacacgcatngacgcagntccgctcgtacgtctttcgtctgcgtgagactatctcattcagatagcatggatctctgttagactcacactctcctcacttctcaccatgcatgtcagacacatcatccttgtcatctcctccctctcacgtcggcatattctgttcactcgtctgctccgtgttcctcgcgtccgtcgctcgcccacgtcacattagcaccttgatgacanatcattattcacnctgacacgaacacccacacttacatacccatcctntataacaacgcgacagctantcatcacacatataatctacacacccgtacgctcggatcagcgagcgtagtatatcacgaagtacgcgtatcggttcacccgcgcgtagacgcgcattatcctcttgcgaatcacancgtcacacacgcaccacagcctacactagcatatctgttacggttagccgtcgcatcgtcacgctatcgcgtcgcgagcgtgccactccactaatactgcctagatcacacaccatcatactcgctatttccgtatatctccctatatacacattcagtcagtccacgcattcaccgcagtcaatatctatcgtacatccgcgcnatcgtgacgtatcacctaantctaccagtactactcattcgcgtccgcctcgcgttctcacatcattataagtacacaaccgatccaccacacgtccgacgtacgctcccacttacatattacaccacatacgcgagtcacagcgtctaatgatacaccccgcacgccacaccccacatattacccataccgctagcaccctcaaccatcgaacaccgtccctttcctctccgttgatcactactccgcgccgcctcccacgattcgtattgtctccctcgcttactacactcttttggcacgcctcgccntattcccgactcttagtgtcgcgccccgnaaccactccatatcatcacacaccatacccntattcacgccgtatattcctcgcccgtacctcgctagtctgtctattttcgcaccacccgtattgcaatttacccgcaattataccgatacaccaacgacgatacactcttatccactccactctgacacttcgccgcgctgttatctcgtctcccgatatttcttagtgtatatacctcacacgcgttactccagcgcccgcccctttcccacccttccctttatcttattattgctcttttatcacttcctagcaatcccgacacgattcacaccgctcctccacccgacatctcccttatcgcactcgcccgaacgct

SEQ ID NO: 17312 - DNA, 2685 bp, Homo sapiens
  misc_feature (1)...(2685): n = A,T,C or G
gtaggaaagggggagngnnntagngantanttnatnatattagtantanntantatttatattactagtagtgnttatgntncanngtnanntnanagnagtaaangcangancngcacgttttttttttctcgacngcantcgngtantnagnattagacgaanacagngannaantcnatcgnngngngantnttcgcgcatcgngttttctatngtgatcggtcgnntccgngggacgatagtcncagatgaagngacgatgatgtagagcatcncgtagtgaaatgtgtagtacgtagagtntggtngngcngcgctgacgctgcgcgnttgagnggcagactggtgctgctgngttgtgacgcgcgtgncgtntagtatgtatacagttcgnatgtgctgtattagttatttgctgcgctgcgnttgcgctntagntntngtggtntnacattagtcgctgatgncgacangtaggagtcggtccgcnatnctcgggagagtcacagctgccgccagcgaagtanagatgagcacgaccagcgcgtaactcgcacggatgagcgatgcgtngtgnagtgcgaaangngcggacgagcgggagcgcgatgtcgcgcacacgtagtntnagtcagggcgtgttagnacnctgtctcncnctnaanacaatnagcagcgcgcgngtcagtcatatnttcatcntgttcngcngctcncnctgnacacnccngcacnctcatcaccggcgagatcnacgcgntcatattacagnacgncgccgaccgtgagcgcgactagcgcgacacntgctactangtccccggcagnagtccagantgatnatnacgtcgncactcngagacgtgcgccgtcgcgcacgcncgcgatgcccgcgcacgcagcgcgcngatgacgacgnanacnatctgcgtactagatatncatgctntcagacnctgcaccagtactacncganancattatacatnnttccnatnctctacnatcatnnacatgtgctcctcggtcgtcacatncgatcgcatcagtctngtctcatcctgcgctgctgcgcgcgcgaagtgntgttgcgcganatggtgatgtatgggatgntggagtagtatttgcttagtgagngacggngacgtagcgcgagtatngtgagcgacgagagntnaggtacagtgtagcgcgcgcgtcttcnnatcgtaccncgcagtctctcaacgcgtatgttgacacgttgcgacgagccacagacatgtacacgccgtctatagatgcactatgtgtcgtcaaggcgttgtctcgtcgatcgtcgcatcgcgcgcatacgttgttgttgtcgcgctgcgcgtagtccangagcgcgatcgcgtctcgcgagtcgcacggagcggagtcgcgtcgtctacncggtttcagttcacagcgatgtgtcgcgcacacacttgtgcgccngcanctggcngncgacgccgacgccgcgctgtatggccgtctggccggcggtatatcgccggtaccagtgcgttcaccgcgtatgcgcgcccggtcgtgttctntcgcgatgtgtcgtcgccgttcgttcctcatttgcgcgcgtagcgccgtgcgcgttctcgattccgacgccgttcctcgcatctcgggtatcgtaganatcattccgtcgcgctgagtagcgcgcgcgcagtgcgcgagttgtgtgcgctgcgngattttntgaggtcgacggcgtaatgtctacgtatgtacgtcccggtacncgactgtgttctcctcacgtccncgacgccgacacgacgcgnctcgtgatgacgtacgtcagcctcggatatnacaggcgtcgtacgctgtgtgtgcgacgagcgcgcgtgcgcngtactcggccgcgcatctcgtctcacgcgcccgtcgcgccgcacgccacaccgcgcgcgatgcgcangcatgtactattcggccncncgctgttcgctacacgcgtgatgtagtcctcagcgcacgccgcgcacgcgttantagtcggccgtgatcgtctgctagtttggcagctgcgacgcanatgtgccactgcagacgcgaattccaccacgcntcatgacgactgtcgacaggtncatatacacgaatcgncggttgatnactgcttncgccnngcngtgatagcgccagcacgattcgtatctcgcgacgttgntgntngtcgagagtagncgngncacgcgccgtatgtactgagtagtgtntacgnctcgccgntatcgttgactcgcgtagtcgcctctacgagagctccgtcgtatnattcgctcntatntnntgctgcagccttccncacgntatctgtcgtttgtcgctcccgcgctggttngatatcgtcgcatcantagttncacccgcgtatntnttagtgtcgactngtgatgatatntccctgctatcgcgacgatatgtanaggtgatgcctcgacgtccacccacacgncnctttttacgacacnctagtntcgcccgcgcctacttctagtganggtcatatcgtcgngacgtgtgttcggacgtncacgggcgntgtcgtcgcagagccgttnttaacacgagtgtgcgcgcgcgtagcgctcgcctatgattttaccggctgatcangtatcgatccactcattttagttttat

SEQ ID NO: 17313 - DNA, 768 bp, Homo sapiens
cttgtatgaacaacaggaaccagtggtgaagtgacttactgaatgcctaagagaacttatcggagaaataaaaataatacgttgctttcaaaaagagaatgtacagtattagaaagaagactaggaaaagaaaccagcaacactcaatgattttatgaagccaaatgtcttcaaataattttcttctagtctataatgtaagaatgttaaaaccgtgtccctcaaggttgcaatatacattgcatgtgtaaattgcctgcataattacaacataatggaaatgaatatactacacatttctctcactctcacatgttggctctgcaccaactatttttggcttccacataccagcgaactttacatccataatttcattgcatcattactcatcatcccagattccggaacaccacttatatcaaccactcccccgcctggcgacctacatgacatccctcaccccgattacgccactgcccattcgacactccgctccccccaccgctctcctccatccccccaatcgtctgctgcagcgccgccccctcacaccccctacgacccccgccgcgcacccgcccccccccccctcctccccctccccccgccccccgcccatcaccctcccccttcccccccttcctccccccatccccaactcctcgccaccactccccaccccccaacacgatccaccccacaccccgtcatccacccacttccccgtatgccatctctctcaccatccacatcccctccactctt

SEQ ID NO: 17314 - DNA, 1893 bp, Homo sapiens
  misc_feature (1)...(1893): n = A,T,C or G
aaatattaaatattnatataagaataaaaacagacaacaagaaaacttttactgagncaacaaaaaaaacaatataacacgttttttttgnagcaagccagagatgtgagaggagcgaagacacgcgcgcccncacgcggtgggcgatgcgtctcgcccgcattgtctacgtcgtcgcaacgaaataaggcggacggatatgttccntcgacgatggaagcgcgtggatatgatagggatgggcgttatattgtgatcccggcagatagaagcgagtagcgtagtagctcgacacatctaatcattatcgcgtttggacgcgcggccgcgacgcgcgtgcgcgtgtggcgcgcatcgacggctcgcgcgccagagagattactgttagaatgtgagtgcatgtgtagacatagaaatatacgataaacagtnatgcgtggtcatacatagtactcgctnatatgttattgtgtagtagtatcgcagtaatgtcgtagatcattntctacgattcgactaggcacatagatgtgtaaattcgataaacaaaacacgcacaaanatagagatagagaaagacagtaacgaagagcaaangtcaagacatgcaatcaggattacantatagcagacacacgcgaacgaacgacagataagcgctgggcgagaacgcataggtgagtgaatagttatacgtaattgtcgcgcgggtattgatgtcttagacgacgcgctgttgctgcgatgtgagntgatcgttgtcgtcatgcgtggtcgcgcgatagtcgagctgcgnatgcgtatatctgcgcgcgcacgtacacgtatgtaggtactgtagagnatgtggtgtgtgaagtagtgtcgtcgctcgatatcagatacagcgttatatgagagaggaagctaggtcaagtagagatccgcacagcgtcgcgatattaccggtatcgcgacgtgtctacagattgatcaatgtcgactattactccgggtcgcgtagtacgtgttaactaccacgacgatccaactcggcaaattacagactcatagcgacgacgacactgtaatcgtcgaacctagattatcggtaagatagaagagcgaacacgcgagtgagacacatgtcatagaccgtagagacgtacgcccatacgaatgtggcgcacaccgacgagcacgccatgcattcacgaccacggcaattctcccgagacgatgtcacgcgatcaaccgacgacatcgctcatattgatcacacggctacacgagatcgtgctccacattgatgacaattattagacttacacagtacacgtcaaattatttntacaccgnacgacgcgtatgtatcgcaatgtatatctctcaccctaccacgaatactaactcgtgatatcgacgacacagagatagcgacgcgatgtgcgacgccctatttattatagacgcagctttgacctacgtatggtatatggtgtgtgtcgagaggacgacgcantgtcacgtattgcgtgccgcgacgttgttgctcacctgcgcgacgcgatcagncntagacagcgcgcatttatagcgctntngntctggttcgcgatatatcgcgccgcgacgntgtgatcagtgctatattgccnatgtatatggatgagatatagatattgctagcaacgagaccgtgatatgtagtgtcgncncgcgcacgcgcgtggagtatcacgcgcantgttccccctgcacctaacgagatatgaggacgtgttgnatatnaggatcacagacatacgatagtgcngtaccgctatcatgtagactanccgnagcncacagntcatcagcactcactccgtatntgagacgtatcggcgcagtctgtctcgcagagtgtttcat

SEQ ID NO: 17315 - DNA, 1081 bp, Homo sapiens
  misc_feature (1)...(1081): n = A,T,C or G
ggggtggattgggtatgaagggagataaaaaaactttataaagaaaaaaacnaccacacaggttttaggnagcaagcacaaagcanagtatgtataacaacaagaaggtataaggaggtagaaggaggtagaggcacgatttcgttggtgactgcgttgttgtcccttttgatcctacgtgctctttcaaaacgacataccgtgcgaaacgcttgacataacaatgtatcaataaccttccacattcgattctcgacatccaaggtacattaggcagaagagtgtagaatgagtaagactacacacaaaaaattatttttattacttaattaattttgattgtctaggaggtttataagtttactataagaatttccgatgcgtggttagtttaccgcccagcctcacctagtactatatgatgtggtgagtatggaggagttggaggtggatgcgtcgtacgagggcggagagttacgtgagtccatgaagcataataacatgatcgtagtcggtcgataaatgtttcgagacacgccaatcagttgtggaccgggagccgttcgcttgcgatggatagcgtacagacgtttcctctccgcgctgtaccgaggcgaaatgcaccagcctttactgtgatatcggcaagcgcgaccataacattaaaactagtcatgcgcttatatggaccggatgccgttaaacaagaaatagaaattctgagacgcatgcgtatggcggcaccagccccgcagatcagttttccggcgaacccttattacccaccacctattcggtggtttttcttcccatcgacgttatctatactgtcctatttccgcgtttcggcgggtgccgcagccttgcgttcgtccggcgattgatgaccgcataataaatcaaatcgatatgcgttgatcgagttttgttagacggcattgctgatccgtattgattttataccatacacttttatcgcgcggtccgtgccgcgtgcgcggaggattgggcggatgatcagatcaagttaccacaaattcacaccgcgttgcgcgatgtacctaacgtcgacagcaattgt

SEQ ID NO: 17316 - DNA, 761 bp, Homo sapiens
cctctacgaacccacgcaggagacttgagatggagaacgagagcaagagaagaagaagaaggagaaggaggataaggaggagaaggaggagaagcaggagaaggaggagaaggaggtgatgaaaaagaagacgacgatcagacgacgaagaagaacagaagatgaccaccccacgatcacgtactgatcacgaccaacaagacctgaataagaacactcgtccaacactttttttttggatcatgatcacgaggatcactcatctccaccccaccttgcacagagatttattgcccctttatgtttggactgagccccccgatagtttttgctctctgtcttgcacgacggaccacacctgcccttttcttacttgtgtcacgcgtcccccctcccctggcttctctcctccctctcctttctgtggctcccctgccctttgcttcccttctctctctcctctctttcctcccttcctccccccccccacctcccacttgctattcttcccttgctctccccactctccctccccctcccgtccgcttctctcccccctttgtcccccccctcttttcctctccctttccccctctctccctccctccttccctcgtgtttctcctctcccttccctcccttcccccccccctccccttcccctcccgcccctccccttcccctcccccctccctcctccctcctcttcttccctctcttccccgtttcccccttcctctccccccctctccctccttcgc

SEQ ID NO: 17317 - DNA, 1452 bp, Homo sapiens
  misc_feature (1)...(1452): n = A,T,C or G
tattgaattaatatgtaattatgatacctgtgaagattgatatagagcgtggttttatccagaaagaaggagcgaagagatgatcgagagagtttttttatggctagagacagtatagtacctagataagatggtcaccatgagctacacgatgtagctgtgactagagacacacttggttgtggaatgtatgatactgggcgtctcgcatagacgacgatctcgaccagtgaggctgctattggacgatgtcangaatatgtatctagttaccgtacctcgtngtgattagaatcatacatcatccagacttcagaggtgatgtcgtccaatagaagtgtagtacagtaccatcatcgctcatgtacactactaccaccacatgctgtgccccgtgattctcctcacctcttatgaagtctcatccagcggcacacacgccgtccgcccacatactctgcaggcaatcatcacatccaccaatatacgtatgccacacgagtaacttacccatactcgccaacccggactaccaacgacttacatatcagcacgcgccccccgccagaagccgcaacacccccgcttggtctccctcatctcccactcctatcccatccccctacccacgtcaccctcccgttcccctacattgcccctactactagtcatacgtatctacccgccttcacacacacgtcacactcccccgcccgtacgtctcgcctgattcataccctctcgcagcaccaaactgccgcgtactaccgtccgtccccgatcccgctacccgctatatcgcgtccgtcattccacaccacaccgtctattactccgccaccacagcgacttccatatccaccaatctaccatcgtacccgtcgcgcctctcccattcccatcatattgactcaccccagcaccaccccccacgaaccaccccacatatacgccgcataccacactacacgctctcttatcctcccgcccgcgcccccgccataccacccccactcgccccaccttccgccctcgcccacgccgtcttttgcgccgcccccccgccaacttcgatatattccccacactacccctctacccccgcccccgtgttcccatcccttggccgccccgattcacgccattccacacacgttaccacattgcgcacaatattccccgttctcccatagctatatatcaccccgaccagtaacaattccgccgttgtcccgttcaccagtcccatttgtccttacacctacctttttcctttccccgcccttttcccctatccctgtttctcgaatttatgccccccccataaatttcccccccgcctccactcacccatccccccatttaattactcttcttattatcattcccctgatcccgcacttttccctgcactcttcccagctattatccgcacccttcacaccttaattt

SEQ ID NO: 17318 - DNA, 753 bp, Homo sapiens
cctgtgagcacttttgattatctgaattgtctgacgtgccaggtccattcttctagccctgtgtaatttatctgcattcatgcacattgcagagctcactgtattagaactctgagcactgtggtagtttaatttaaccaagtgctcccataatgagaagccattcctagaaccctcagaatgttgctggctcataccttgaggccaatatctccggctccggattctctcaatttctctcagaaggctgcaaaagatcaaaagttgtcaagaggtcatatatatagcatgaataaccagaagcatatttctgtttggaacatgaaacagaaactcactgcaggattccatggattccatggattgatgaatgagaagatcccaggtggatcacccttaaatcaactgatctgtataaatagcctactgcctcaatcatgacgtgatgacaagagtcacttgccaataaatgacctgctagatatttgacacaaaacaaaaagcgcagcaccgcgccctaccacgtccgagcggaacaaacaaaacccacggcccttgctgccctcacgggcgcagctctgcggccgcttcccttcactgggggctattccaggaccctcgccaactgattccctcccttccccccccgtccgcgcgagcggcaccctctcctaccggcgacacacgcactccccccacctcgccacacccgtcgccaaacccgtcctcagcccctcccctcgccacccacac

SEQ ID NO: 17319 - DNA, 1366 bp, Homo sapiens
  misc_feature (1)...(1366): n = A,T,C or G
annnnnntanacanatttattatntaactttttatntcatagtgttatttattatattatatcattatatattacttcacaaaccaagaccatacagtagttttactcgcatcaatatatatcaatatatattatataactaatcatttttatctcgttttctttttcttccccatattaatgtaacaataacaattaatattatatattacagcaaacaaaaaagataccaaaaatgaagacttaacaacactataatataaccaaatcacattgcaatacacaccctacacaccataacaaacaatttacctcgcgcacctattattcgcgactacaaccctcccatcgcaccaccccctcacccatttccttctatatcactacaccaacccacaccaaacattacccaccaactccctcacacttgntaggcgacgaatattttttcgaactaattcgtacttattctctagcgcccaccccacatctccgctccttacgaccacactactcaccactccattaccccggccattacagactctacaacaccatacgacacgtggcgccagaaccctcttacagaagcatacctctcgcccccacatagtatcatacacatctatccaacactccatctcagcatgataccagaccccacaccaacaccctttatccctcagactctatcccatccccactactcacatcctcatcccatacccccctcatattccccatccgcctcttcatttccatatacatttccccgcccacccatcccatcatttttcttccattcctcccctctctgtcaccgaatatatccatttcactaccttccgtttctaccccacacacacaaatcccccactctacccaccctccccaccccccttcccccttttcctcttcccacccataccccttcatatttattcatccatttccaccttattcccccccctcccatattccatctgcttttatctccacaatatattcacatattcttccatcattcaaatgaacacagcaatattaccgcgcattccccatacaccatatataccccacacccttgtctttnacgcaccccgattacccttactcactctcgttgttcgctattaatctcatcacctatatccatgctccccaccatatataccccattcccgcttattacaccaggaacgtcaccctcccaccatttatttctaccacaccccgccatatccaccatttccgccacatatatatctacacccgtctataccatcgctactatatctacacaacttattcgccanctcactgaaaccacgttattttagcatcacccaccgctactattaatatt

SEQ ID NO: 17320 - DNA, 753 bp, Homo sapiens
cctgaggagggaagcaatgcgttcctccccaagaatgctttcagctgcaatggaaaagaaaaacaattaaaacaagattggattttgactcgaaggactgcacttcaaaacactttacttcgggctaatgtgcaagacgtttcacgagctgccctttgccacactccggggtcatggctttgacaactccatcagcactctactatcctggctgcaatttccttaggattctctacttcacgtcacttcagtgtatctgcctataaagtttcctctgcctgaaatgccctttcctacctggtccatctttgggacttatcctgagatttactcctctggtcatagcttaccagataccccaaaacagaattagacacccttttttctgagttcctccaaccatgtttcattaaagcttgatttgcttggtttgactctttagcttgatcgctcccgaacgcggatggcgaaatttttggagacaaaactgtgctttactcttatagaaaagtattaccattggctcttacagacccttgaacataaaaactactcaataaacattggctaatccaaaaacacgccgccgcccccccgcccgacgccccggccaatccccccagacccgcccgcgggcgccagccgcgaccagcccggctcacagcccccaccgccgccatccgcgcccgcccaaccacccaccccagccaccagcggccaacgcgcagccgccgccgcacaccgacctgtcac

SEQ ID NO: 17321 - DNA, 2225 bp, Homo sapiens
  misc_feature (1)...(2225): n = A,T,C or G
ttctttncccccgctaatntgcnnntcanccnccaccgcacgcnanatacgncctgcaggatcacactgtgattatcatatatatatancacagagtnatttcgctacgtcatggnctctcgcggtcttctcgcaggtacttcgctgnccagatagtggtgctcngtgctagcccagcatctcgtgccgttgtgtcgatgacanagtgctcagagatcacatatagctcgactagcgaacagctcagggacgagatatgcgagcggtgtctcagatacgngcacagcagcagatagtcngtgacgagnagttaatngtgagnagcgacantcatacagtccgcagcagatgtcgtgtcgatgcaccactacggcnatnctncgtngtcgcntatgtgacgacaggcgacagtaatgcnacagtaggcagattaggcgatgagcatgagctcagcagtagcgagcctacaagcatcgganctgtcacnatgcgatagtcgtgtcgtgctgtcgtcgtgctaagctatatgacgatcagcccnatagtngtagntgtgtattagatgctcancgaatcgtagactgtcagagtcgtgctntgtcacccgacttctgntcgcntcacgtggcacgaaatgcctcgcgccnacgtgcgcagcgtgnntgtgagtgcggagctgtgtcgaggcagacncnagnagtgacgcnactagacancagcnangangtacatcgcaggcacaacatgatggtgacacgagatcgctagatagggcgtcgcangcgagtacacgcggcagngagcgcagtgtcganactagagncgccgangtattntaacgatgacntacatntgtatgtcggngcgtcgtgtgtgtcgccngctgatgtgncgcacggtacgccactgaccgtcacgtctcntagcgctcgcgggtatcgagtcacngacgangttgcgcatcangacgcacgtcgacgctcacgtacaantatcccgncgtaccgacantatgntgccacacatctattcgtcgacgcncggctgctgcagacgttgnttgacgcacgntaatntatgcatggtnttacatcacgcgcgctgcanctcgtntntctcgtntncgcancncgctatnatctgcatccgcgccncatatatgacagatgcacgatcacagatgttcgcgtcagaggntacgccgatgagtcacagcgctacatacgacgacgcgnatctaccgcgngttnccagacacgtcggatacgccgacatgtgtcntacacnatgagtgcgtcagntacacgcgcgagtagtagcgtcgatactccgtcgcagatctatcgaagcncgactaccgcgggtatcgactantgtcgctttcggtnattacgcgcgatatgagacatcaccagcgcgagtctagatcagtccgcgtagagcngctagtacgtatgtcgttncgaatttagcacgggatacaacagtacgaagttggatgcgcgcgtacgcgccgatactatatattgtcgtaccgcngcaatgcacgcgctgatgaacacatacgtagancagcgccgtagtgttcgcggtacacgcaccgtgtacaccgctgcgcagattattcgtctcgtgtcacacgcgcgtgttngatnatatcacgctgtcgatgcagntgacgtcgcgntgatacgatngcaaccacgantatacggcgcgccnacgntagtagtctatcacaccgtcgcgtagcgaacgctgcgtgtgcggttcgctttgtnancacgtgcatgatgacgacgcgcgccgangntgttaacacacgcgtccgagtgnatctaccacgctntagataagagcgnttatatgtgagcatacangaccggcgtcgcngntgcgtgctcgantacacgcacatcctgcagccagcgacgcgccgtagcgcgccangatataatcaagtctgcaganacatagtagcgctgttacagcagacactatcaggacccgtctaacgacagggcgcgtatanatatgtntcgacgtcgctcgcgatgatcagtccgacgtcgtgagtattccagcgatctngcactcgatgcgcgcaccggctnagtatagttacgagtcancatancacacatncngttatataagcaggagtgcagcgntcantncatacgacacggncacatanagtganatcgngtgtgtcgcggatatac

SEQ ID NO: 17322 - DNA, 815 bp, Homo sapiens
gccgcccaccacccccctccacccgctaccctattcacctctccccttcaatcgcttacccaggttgtccgggaaccatcttgcttcttctagcagcagttcacactttctgggaaaggaggtctgtatgaagaggagccagcccaagaaaaattttgcgattagacctattgtttcctcctgctccttctgagaggattcaggaaagacctataaacgccaccattctcttttttttttaaaagacaactttattcaagtgtagttgacatacaaagaactacagatattttatgtatacaatttgatgagcttggacatatgcacacactcatatcatcttacaatcaagaagaaaatccaattcgactttctcaactagaacttcactttgatggcatgacaccctacacctgggaaggttcctggaaccatgagtaacacacccgtaacggacacataggcgacgccgtctgacttgcatctttactgactacatcgtccatcccgagaataacgacgtcgtaccctggtcatcgcaccttctaccacacggcgagccacttgaccattcttccctcttgttgcgacgcgccctcaccaccgtgttatccgaacccatcgcacaccccagtgccagttttccctctctccgaaggcccccttatctgtcaaatggcaacttccggttattagtactctacaatccccgtactctgttaagtgaccccctttcagtcacctctaacccccctggtgccccctcatccctacccgactcctgcccacccctgcctacatcctactttctgacg

SEQ ID NO: 17323 - DNA, 1522 bp, Homo sapiens
  misc_feature (1)...(1522): n = A,T,C or G
gacgcgacgacgagcggatagncgcagcgccacgagncgcccgaagagagaagagaagagagaggcaaagacacnaagcgaacggacaggatggagacgacgcgtgtatgagggagagagagaggnccctgnatgagaaggnagaagacnnanaagacgacggaggagacagggcctgcaangcgaggggaccacgaaaaccccaccgcagagacgacgacaagagagagagaganagaagaagaggcgagaggaagcacacgacacgacagccttaagccnacagagacgaccagagagacggagggagagcagcagcccacgcggcggagacgagccaggcagcnccgacgnaacaggcaggccncagacaggcggacaagagcacgcacagacagaaggcgcgcgagaagagacgcagacaccgaccncggcgacgcagcagacgaaacangacgaggaagacagaggagaggcaggagagagcgcgcgaacgcacagcacncgccgcgagcacacgncagcaaccaccacggccacgagcgagcagagaaacagacanacacgnagggcgaacagaacagagagacgacgaaaaagagccgancacttatataaagaagaggagcgggcactcgagcggagagagacgagacgagaggcgcgagcacacgaagaggacagagcgatagagatagcggagcgcacccgtagcagaggagcgacagcaggcgtggagccgcgcaggaagcagaacggaaatcaacgaagagcgaagcgcccgcaggcgcggaaaagacggacgaagagccagcggggagagcagaaagaacgaggcgagaagaagcgggccacacgcgcagccagaaacaaacgcccgagcgccgcgagagagcgagcgagggaggacgaggagaaggagcggaaggcgaggacagaaaagagacgagggcgcgcagcgccgggcagagggatacgacgccgcgcgagaccgaagnagcgacaggacgcgaggcgccgccgcgcacgcgcgcaaaagaacaccgcgcagacagaataggaccaacgaacgagagcagggggcgggagaggcncgcgagcagaagacgacgcaagcgaaagacgacgaccccacaggaagaagccaaccagcaccgcgagagcgagagagaccgacgaggcgcgagaaaagagaagagagggccaggcgccgcgagaagcgacgcacgaggagaccggcggcgaggggagaaagaacagaaaggagcgggaacgagggagagaagagccgagcagcagagaaagacacaagctacgcgcgacaagaaggtcacgaaaggcgcgagagcggaaggcgggaaacagaaggagcgcgccggcgagagagagacggcgcgcagagaccgcggaagaaacagccgccgacacgcggagaagcggagacatangcgcggagacgacggccggggagagagagaacgcgggagcgagcggcgcgagggcggaaagagagaacagaagc

SEQ ID NO: 17324 - DNA, 396 bp, Homo sapiens
tggattctgttgatgagactatggacatgactttggaaggaagaggcgtcgttcactcattacacccatctttgcatccacccgtacctatgccactcagagccacatgctgctgcagtcaaagccggggatttcactgtgttgcaaagttatagcagacaacaggcacaatgcgtgccagatgcaactgaactgcgagggggcttaaaagggtttgatggaaaatgtcctaactgctttgtccaagaattatcactgggacagtaggctctttgatacgttcatgcaaccagctgctagttcatctccgtttctaatggggtaatccacactgcttttcatcttatttacatcacacatgtgacttttaatattaagagaattcaagcatccaaa

SEQ ID NO: 17325 - DNA, 2171 bp, Homo sapiens
  misc_feature (1)...(2171): n = A,T,C or G
ggggagtgggntgtgggtgggnntatnnnnnnnnannnnnnnngnntttntattgtgtggtgtgatgtaggtgntggatttggttnttntcgtntntnttatannntctgttgntntncggtgttgnnngtngagncggacntcgtgtgntctgtaggctcgnngtgngtgctagtggatgtcgctggagcgtggtgtcgacgcagaccacgggcgcgacagctcacncaccnncgnntccctgatgccgatatactgacgacaatcagtggagacatcgcagctcagactatgtcatcngcgagnagcgcgtgtgatgagcttagacagtgantactcatgagcactgtctgcgacagtcggcnggatggtgtagttattgcgtncgcgtcgtgtctatgtatcgacggtatagagngtgatattaggtcaggagatnagttagatatcaccgagtactagcatgtagacgcgccggcgcggcgctgcncgcngngcagacagctcgcngccncttgcacatcgccgatcgtgatatagtgtgtgagggagnagcgagcgacgcgcgagtagtgagtggatgttcagtctgtgcgagcgtcgtggcagagtactatgtagtatnangtcttcgtcggtggacgatgccggtgcgacgagntgcgagtgcacggtcgtgcatgttgancgtcgtntccccggcnccgcgtccggtatgagnagaggagacgagcgtggttgcgtgagtacgagcggcacggagaggtgctgagtngttatgcgaataaagatcataatgacggacgcgcgctacgcgtagtgtacctgtactctaaggatacgacgnagcacgcgcgcgacacgagacagcaagcaaacgcgtcataacacatacggaggcgaatatgactagaaatctactccattatgttacatgctgacaattctctacgtgatgacgtgcgtcaccggcatcgacgatgcgcgcgcgancgccgccggcgcagaagatgtgagaggacatactagcacgtacgcggtcgctagtctatgccggganagngtatggctgatatgtatatctgtgtgaggcagctcgtgcaagatggtaattagacagttagtgtnctggaagcatgtggcggcgctgcgcgcgcgagcgcgctcgcggagcgtcgtgtcagcggcgaacgtctcatcggcaccgacgcaacgtgagngtggaagagcgacagtgtgtcgcgctggagatagaagatacgcgtacgatgagcgtcgatcgtcgtgcgcgtgcgcagcgtctctacggaacagacgcgcgtctcangcgtcgacgcgttcgtcgtggtcatgtggtcgaggtgnatgtcgtaatagtcggatgagtgtggtgtcgctgacgatatctcgacgccgcttaccggatatactgaagccataagtggagcgacacagcagtgagatacgttgcgtcgcncatactcaacatatcgtcgtgatctctagcgtatgagtgtgcgtcacccgcgacggagacgcagtanagatgatatcttcgtacgtangcgataacagacataacacagagatagcgcgcccgacgccgcggcgcccattcctaaagtgctanactcgctgtacgcgcgtgcgctactgcatcagggatttctgcaccgagcctccgcgctcagtctcgtntagttgctattaggcgttcggtcatcgnagtgaggttgtagtggttgtgtcgcgtgactagtatactgtgtcgcgatatcaataccgttagagagagggcagcgcgcgttcttgtcaagcacgggaagacaggtgagtacagtcagatgcaggacataacgccagaagtatgcacgcaattagctctgcagtacgtgcgagtgtagtgttaatcgctctgtcagtcagtctacaacacgcacaaatgtgacagaacagatgctcaggagcntgctctcataacgatgntatcagcgcgatgtctacaaccatatctatgagtgttcgaaggagagatgaacatgaggagatgttgtagagtgcgcggcgcgtgctgcagatgtcgagctatgacnagtntatgtcggagtgacaagacacgtcgtgttaggcacattgatacgtagcctcgagaacatcatgactatatctct

SEQ ID NO: 17326 - DNA, 636 bp, Homo sapiens
agatgaagatgaagatgaacaattatcagtgaacagtagagcttactctccctccagaagcccatctagcagcaactactaccagagaatccttttatccttaagtcttccatgctatagctaatcaaccttctctatgcatgctgaggtattggagaggagcacggttgtgtgtaggaaaagttgaggaataaatattggatccctgacaggctctgcacccggatcttcttggtcttctaggagcttcaagtttcccctcctaacgttactgccgttggcttcccagtcccggtcctctttcttctcacgtgaattgtcatttcgcgtctgttggaggcgcttggtaactgaaaaattttctgcattggttggaacatcatgatgtgctatgatttgcatatagtggggatggccgtctgtggcagtaatggtgatgcaccagcgttgaggaggaatatcatgtggtgggatatgtgttctttcccgggtttgctttgtatattccccgtttatgttgttctccctcatctcgtggttgacccccgatgcgggtgttcgcgtgtttgccgtgctatagacaatgttatgcaaatatggatgatcctctagtggacgtaggcaaccacgtgcgaa

SEQ ID NO: 17327 - DNA, 1952 bp, Homo sapiens
  misc_feature (1)...(1952): n = A,T,C or G
gagagtgaggaagtgctaagatatagaaacanagtgacagtcatattccaggtccgccgagagacacacacgtttnttttnaagacanagnaaanaggntggaaganggcgaacagcaggcggtgtgacggntttantnctgtgcnccctcctcctcgttatggtgggnctatgcgaagcgagatcganggcgtatgcgtagtgaacatgatgcatcgcatgtaggcctcttgatcggctgnctctgtgcgntcccagtccnanagtgtagatgtcattgnacgcgtaagatnctgagcggcataagtgtcgcgctcatattcacgtgtcgcatcgcgtatcatctgntngatatacnagatatacaccagatacnacgcgaatcataacgtattatcaccatatgnaacacagcacgagtccgacaagacgccaagtcagtgatcacttagtgtgatnctctcnagcagtactacagcgtaaccatcttcatattattattgatttctttattgcagccngtgagtangtnagtgtntgtatgaggtataagcantaccatttntcttttactgcacntgcacctcttctcgcacacgacaactgagtacgagcgatcacatgtctgataatgcggagatgagagttcgtcacatcgatgtcggncgctgccgccngtctgcgacgagacgcaatattatgtatcggtgcaggcggcgatgagcatgtngnataaagtagagaatgagctaagacgcacgcgcatatatagagagaantacatacgtacgaccaacgcacaccngacaagaagcacacagcatagcattcgagaggtgacactagacggtgaatngcgtgcgcgtagacatggcagtntgtgtgttgtgcgatcgcatgtggcgacagaagtatacgggcgacgacctaaaacaagttagactaagatccacctctcgcacgcacacggccgtacattcattatatagtgtgtcgccgtcgcctcgccaccacgcactatatatagagatcgtatctcgctctggtatggtaagacgtggtccctcaaccgactatattatatcgatgtgcggcgcgcgagatctgtcgacagctcttgtctcacgtaccgtccagacattcattgcatcgggacccatacagactgcgcgcacacacactacgaacataacgctagatccgtgtctgcccgcaagtatcagtcggacggcgaatcaatatacagatctgccgctcataatccgccgaggtgttgctcggngagcggtcgtcactctcccgccacgcngcgaacagttagagctgacggaagcgcggcgcatgcggatggcagcgctccgtcggacggtacggatgctgtacaatggttgagcgctgcgcgtgcgcgcgacgattgtagcgtgtntntctttgctcgtcgttggcgtcgtctccantgcggtactgctcgacccgcgcgctatacgtcgactcattctcaaagattctatgcagaaacgcacgaagcgtatgagtatatcgatagtttagaatctccgcaccgtgatggattgtctgtggtacnantangtgtttgcgctttgcgtgtcgccggcgncgtcgtcacgctattagactgtagatgtgtcggactgncagtgcaccagtacccgcacgccgaggtgctacgtgtgtgtcacgtatggcatcacgcgcgcgtgtattccgatcctgcgggtttaccgcccgtactaacgtgaggactcccaaggagcgttgttctcgggtatcgcgatgctctgatgacgntgattgacggccgtgncgactcgctcgagcaccgtgcgtgtgtttatatggaacgccggcgctgccgtgaatagtagcatgcaaacggtgatcgcgaagtggactctgctcgataaggcagccgccaggcgttgtctagtctg

SEQ ID NO: 17328 - DNA, 801 bp, Homo sapiens
agccccacacccccctccccccgtactagataccctcttcgacaatcatcatcccctgtacttggaccttcgacatgaagaagaggcacatatgagtgggcggacaacactttttggcatctctccaatgcagctgttagcatctgctagtgccttcttcacagctaacagctttggctacttgctcatgacactccgtctctgatcacagagcaaatccactgtctccattggttaccagtactagcactcagttgtactcaatcccacctgattgcaggagacatagtggagaagtgcacgaaatcatcatctaccatgcacgtacagccttcctttcttcacgcagaaaatctgattctgaggcttcaaatgcagcatccaaccacggacaacactgttaaaaggggccaaaccatgcctgccctgcccaccacaccgatgcactgtcccgtacgttctcaagcatttgacccactttcatggcgcaccctgccaaccggccacaactcctcactcatgcgactacctacttgacacccctccacacgtgtaacagctcgatcgatgaccaaatcagcctgcttttgtgattacctctggttagtcgttgtaattctgccggatcataattcgagctcgccaaacgcaatcgctccgaccgcccgcgatattgtctttcccccctatcccacgccccccgcttcaccacatcctccgatccccgtcctcccactaaacaaatctctgatatcatatcccgacggccccttccaacgagcctgttggttgccgttcatt

SEQ ID NO: 17329 - DNA, 1407 bp, Homo sapiens
  misc_feature (1)...(1407): n = A,T,C or G
gagagagagggtaaagaantgaagatgagaggcgcgcggggggttacgaaaagaaaaagaagaccaaacaccttttacagccagggggagagaccacctcaagcatcacccccccttctgatccgtctcctcctccccgctcattctacattgttggttgatcttatgaccatttacttcgtcttttgcctattctcgactaaacatctgaccaacagagcacagccagagcgaaagatggtagaagtgcggatgcagcatggcgtgtagtataacggaacccatatatgctaactgctcccgtttagttgttgttggatatgttaccagacaagagaaagagtaccacgcttgtaccaccaacacccctccccctacacaggcgcgctctaggcccggcggggtggactaccaagacaagatgacgggagagggggggncatcggcgtaggcgcgacgacggacgagagaaggagagagggcgacaaacaaggcaaaacaaatagttgaaaaagtggaaggacaagacagagcgcggacgcgcgacgacagagggatgcggcgagcgtcgactccgcggtgatcttatgggtcagacgacaccgcctccttcattatcccgttcttgacttactagacgcgcacgccgcactcccagtcgtatctgcgccggatagatggatggcattcgatgatataaagaacatacccacgagaagaaattacaaatgatttaatacgtgtgtacataaggtcgcgatactcacgatatatgtatatagaactcaacagcaacaattccccgcgagggggtccgcagattagttagcttgcgtatacacacccaacaatccacgtcatgtgccagcccgcaccgtacagctggccacgttcgcgcgagcgtgtattcgacgacacatacttccacccgcccatcggcacgtgtgtgcgattttttctgtctgcgcgttgcgtataagtcagatggcgattgtagccatgccgcgagtactctcctgctcttccacttgctctcgcgcacctcgcttcatcatctacccgccagtgcaccatacactcataacagtaattccatttcacatgcgagtggctccgccgaattgatatgatccggcgaaagatgagcagaccacaccggctacataaccaacaaattatgataagattctaacgcacaccgttagacctagcatatgcgattcagcgacacggcgaccacatagtatgtcatcagcgctcaactcagacaccgtgatgagtcagccgcgctcaaacgcacccgcgcgcgtagtcagtgcaaantatcttatctctatatactgagatgtatgtagacagatcgccttcaactacaccacgacgctacctcaatcgtatttgatncct

SEQ ID NO: 17330 - DNA, 1380 bp, Homo sapiens
  misc_feature (1)...(1380): n = A,T,C or G
atctatcttctcttccactccacctgtccctcttatcgctattattcaccatcgcgtatcgcccatggctggtccatcctgcatgtttccacaatgatatcgaggagacggacttagtcttgcgatatcacggatgtactccatggcggcacataaggcaatgcatctaccactttactcttcgcaggcacaagagcatatgcacgccggcgtcgacgatcaactaacatacttcgtagtgtatacagcatagtaacggatcgcatctatcgaactgactagtgtgtggagtgtacactattggtcctgcacgcacgtcgacatataccatgtggcaaagtatagtaaacactgataatggcacatgcagctagacctaatcgacaccgtatgccatcgcgcntcttcaanaccacctagaactgactcgcatagacatgcgagcgtacactatcgtctgtataccacccttgacacacacactcctngcgaaccatagacaacttgncgtgatatcaccacaatccacataccgactgccgagagtctnattgtcacacttgcacanctaaccacactgtgtgagtaaacagacttgacctgtacctattctacactactgcggtacgcgatcatcgcgtctgacagtctgttcatcttccncatcacgttgcagcgcgatcgcgcnaattatcagcccatccatattatccaggacgaccacacacgatccttatccgcgccgctatcgcatccgatccgcacgtgcgacgcatccacttcacccgtcgtaccttgatattgatcacatccatcgatatatcccgattcaacatgtcgtgtcgatcatcgatacgntatgatcgcgtcgctaatcttgttatcnacacattatattatggatcattttgctgctccgattatcgctgatagtcctacatcattagaccnggatcgtcgcatncgtgtgcgcagacagtcgcagcgtgtcacatacatagttgtcgtgcaacgctcacacggtgtagtcagagtacaatgtgtgctanttaccagtcntcgcgcctgtatagctaatatcgatcgtcgtgtcgcgtacaatacgcgccttactcgtgatattctattcacaaccaatccttgctctatattccgtctgatctccctattacttctgcagctgtgcacacaccgctcgcatatcgtatgcatcgaatctcgctgccggattcgcgaccgcgtcctctncgaccatcacttttntgctctatatgcatgctaattactgatntcgatatgttgcgcttcaggtcgtatctctgcgctgtccgctagctacattgtgcctcactactcgtcttgctccacgagcgcgatagt

SEQ ID NO: 17331 - DNA, 1524 bp, Homo sapiens
  misc_feature (1)...(1524): n = A,T,C or G
ttgtaggtgggttggtnnttttttnttttnaaagtgtgcgtgtgtttttttaaganagnagtnangtaggtccngtgtgcgcctcgcntggggagatcgccggcgtgtgtgtcgcctccgctcaccaccgtcaaccgaccagcgccggcgcgccgcgcctcggtcgcgtattcacgtcacgcgccgcaggcagtggagcgggtcggggggtcgaggtgtgcgggtggagtgtggagcatgtgcagaggaagtgggccggcgcggacggcgccgccgccgcctcgcggagtaacgtgcgggtacacgatcctccgccaggatacctgaatataggtcgggtgacgtctccgaggcgacgaagaaaagcggtaaccacgcacacctcaccnccccccgccacgccaccacccgtacaatcaccccaaggaagttagcaaaatcacggatagagcccggggtagctggtgccggccgcgccgcgcgcccccgccacgccggcgcgcgcggcgagagaggagtgggacgcgacgacggttgaaacccacggcgcccgaggcacccgccccccgggacggtcgggtgagcggcacggggagcgcgccggataatcaccaacgcccacctcacgcgcctacagccgataacttctaaggataagattgacgtggtgcgccccgcggaggagtggcgcgccgctcagccgacaccggcttcgggccgttccgccacatcaggccagcgcgactacgggagcccgcgtgcacacgccgacgtcagcggcacgctcgcatcgccgcgtcccgacgcgacgccgcccataaaccaatacgcccgcgtgggcgcactgtgggtggcgagcgccgtcgctgcccaccaccgctgctcgcccgccgccgcggcccggcgggagggagacactcccacgccgacgacagtaggtcacgcacgtgccggcccgcgccccgcgcgcgagataagacacaacacgncaccgaccaggccgcacgncaggcacgtgacggacacccagtcaactacgacagttcgaggcgcgtgatgcgccactaccgggagcgtcggaccgtcgtcgctgcgtcgccgcgcgcgcctcgcccgcgcgagcccgtctantcatcataggagatcgagcacacgatcacacgtaggaaggcatatacacacgaagtagatagcagacatnccncggctcactgtagccctatcgcttcgtcacacactaacgcgagtcgccgacgagagatgcgaagtantcgagacgtagcgcgtcatcgacaagcgcggcagnagtacgagattctataccagcctgcgcgtctcgcgcgcaccgcgcatgtgatactaggcgaagcgctctgggtctcacgccgantgcgcaccngctactgcagtagatataatgcaggcgctgcgacacaagagaccaggcgcanagagaagactgcgcgcacgactgnagcatatcacgttgntcatcgccgtgngctcacnagtacagatctactg

SEQ ID NO: 17332 - DNA, 727 bp, Homo sapiens
tgtctagcatctactcggagagttcaacttgcagctgacccaataaaaatgagaatgagtgggttcgaaccccagcttccttgccattagagaggcaatgcagagccaagctctgtccactctcggagtgcatcctgtgggatggagcctgcattgaaaacctgctcatcaagacaaaaggagagcctccgacatctgcccatccctgtctcaccaccctccacctcccactctctgcatcctcatcatgcttcctggagtcactttcctcaagctatggctgcacctaaatctttgcttcaaaatctgcttttgggggtaacccaagcaaagacagcctcacatatcccatgggcacctgtaaaacacaataccagcatttcccactgagtcacactgcttcgtaacctaaaagccttcttcacggatagtctcccataaagccccaaagtatatctcctgtggtgggtgacgtctattttgaaatgtaacaaaacaaaggaaaaggaagtcacacctctcattgagtgtccccagagaccttttgttatagtttttctttgtcaatctatggcctgtgagactggtctatagaaggtctcattctccaattaaagaattaatgagtacatatgtatgaagcatttttagaaagactaccctacattaatctcaatttgctggatgaaagactgacaacatggacacagtgtctggaggtatctca

SEQ ID NO: 17333 - DNA, 1542 bp, Homo sapiens
  misc_feature (1)...(1542): n = A,T,C or G
gcacagccggcgcgcaaacagagganngacgcgccgccgttcatcccaccgcacgcccnagaccannaaatagcggtntggnaagagagaaaaacacaacacaacgccctaatgggcggcgcccagagagaagaaagaaaacacaanccannaaagaggaggagaaagccggcccgccacacgccgccattataaaagagaaagaatgagagagagagcgaagagaagagaaggaagagagaaggagaggggacggaccagacagaaggaggggaggaacagggagagagcaggcggcaccgaagcgaggcgacgcgaagggggcgcagaccgcaccgataacgccccccgagaggagaaagagaggaaggcagccggagagcgcaggcgggagggggggaggagagagagagcgggggaggaccggacgcagagaccagaccacacacacacaccagctcgttttcctcaagaggagaagagaccggcgagagggggagcggagagcggacgcagggcgggagaggggggacacgacagaggcgcgccgaacagcgacagagggaccanagaacaaaactcccagaccgcgtgagaaagagagcggccggcagccgcgcccaccaacaaaaggacaccagccccgaccaccgcaaacaacacccgcccgaaccgnaacccnaaacaacgaaaacaggaaaaaaagcaaccaagaagcaggcacacaacagcgcggaacaccaaagcaaacgaaccccacggcgcagcagaaagagcaggagaaagcggcgcagagaacgaacagaacaaacggaccgtagcggcacaaagaacgcgaaccacgcacgcgggaagcggagcacgccggacgggagagaaggacagcgccccagcagccaggagcgcgaagaaagccgaaggagcacaacacacagcacacacgcccgagaccgaggagcacgcccccgcggaaccgagccccaccccccacagaaaccaaccacgcgaacccacccgcagacacaagcgaacgatacacaaccacagcccaacaaaacaaacaaaagcaacaggcacaactcaaaaaaagaagaatagagacacaaccgaagcacgcgcagatgccacccgcgaganagacgccgaggcgacacgacacacacacccacacgccacacaccgcgacccgagcagagatcccaacaccacccaagacagcgaatacagaccacaaaccccaaagcagccgacacgacacagacaccaccgaggagaccagcgacaaaagggacagcccacgaggagacaacagcacgacaccgaccccgcaccacgaagaacaaaaaaaaacgcaggaacccgggaggaccgcacgggaaagacgcggaggagggcggaacgaaatcgaggaacgcgcgcgcacggaccacggtgagaggagagagacgcgagaccgcgcgcaagggaggaacaaagccggacacagaaccacacgacaaggcgcccgcgccaccgaagagcgacgaagaccgagcgcgaccg

SEQ ID NO: 17334 - DNA, 1200 bp, Homo sapiens
  misc_feature (1)...(1200): n = A,T,C or G
tcatatatcagcaaagaagcacacctattcacatcncatcactatacataccatactacatctcgtgccgtcccgtatcaccgctcccagagcacagaatctatacatctatatgtacaccacaatatcatgtnatataggaanagacttgtatcagagatncgtgtagcgtgctgcgaatagaccatatacgacatagagaactctatagcagcagctatgctctgcattacaacactcccgcatcacactcatcacaatatatattggatatccacagcgagcgatcttgtgtngntncatgtacacatgtctgagcatgtgtgcngcntgacaccgangananantgtgtcctcgcgntgatactgtcacaacaactgtccgcacatcactcactcagcntgtacgtcacgcgcgtaccacacaccagcacccngtacnangaatatgtagggccaantatacacgtgacnttgcaacatatcaatantacgtngcanacacacacaagatacacacanactcaatatatattcacaccatatgaanacagacacacaacacatatacacagaacacatagacaagcacatagccctagacaataagagatggcagagcacagcacacgtcaacacaagagtacgatagccagcgaaagttcgtaaatcattcaggtcaccacattcttactccggccctatattgaacaataaaaaaaaacaaataaatcagcacaaataaacacttgttactctggagaaaaactcaggccacccatagataaaagaaatacggaatcaaaaaaaatctcacaaaataaaatcacaccaaaagagatagtaaaaaaacgtaaaatcaaataataaactcattatctattccaataaacaaccaaacaaataccaacaatataaaatgcagacacttaaaccgagaaattcatatataatccccaatatatgacaataaaaattatactaatgcagaggaagcgtacgacgagaaatgaaaaagccagcctcactccccaatatcaaaagaatattatacacgtccgacacttcggacataacctatttaaaagagccctatacaaataaccatattacggttcacaatcgacaaaatctataaatctaacaacatcacaacggcccatctaaaatctatccagggaactaaacaaataataccct

SEQ ID NO: 17335 - DNA, 1585 bp, Homo sapiens
  misc_feature (1)...(1585): n = A,T,C or G
ctccttnnnaaggatagggcgngcgccgcgcgcagcggcgttttttcgnccgcgagcacgcgcacaaaaaattttatctgaaaaaacaatttattctcaagagacaaacgttatgcatactaggcgaggtgagctgatgagcggagagaggatgcaactgtngtggctagtatagcacacacagtggatgcttcgtcactgcgcgagcagaatgcngcacgatctcgtgtgttgatcatgaccaacccgagacctagcgaagcagcacgtgacccgttcacctcgtctccacgtagcgcgagtacgcggcgcgccacccgcatcacgcacccacacgagtggcacgcagacacgcagcgacgcgtacgcacgtagaagtagatctgatgcacgcggccgcgcagcgcgcggtgtgtgcgcatcaccgcgcgccgcatctagtggtgcagcccgtcgcgtagcccacctctgtcccatcacggcgcacgtcccgccgcgcgcctcagtaacaccgagccgctgccgcgcgacgcatcatgcggccacgcccgctccgcatgttgtgacgccgtcccgcgcccgcccgccgcggtgctcgatcggcacgacgctgccgacgcgcgctcgacgcgagcgcgagtcgngacgatcacgtatgcgccgcgtcaactntacgcagttttggcggcacgccgcagcacgcgagtacgaccaccggcgcccgcgacacgatcatgaaatcagccgaccgcagcgcgccgctgagtgcgaggtccctacgtagtcgcccgaggcaccagacgttgcgcgcgatgacaacagcgcgcagtagtgtgttgaganctgctccgacatcccacactccgagcgcatcgccgcgcgtanacctcaccgtgcgcgttacgctgtcggtagacgtccacgcgcgcgcgtacgcacatgtaacgcgtcgcgacngctgcatctggagcctgcgagacntcatcgcccggcgatgcgtgcgatcnactcgctgcctccgcgcagcgatcgtgcgtgcgccgagagacatgcgtactcgctcgtcatcgaagcggatacgcagatccacatccgcgacacgactagcnccacgtgactcagccgaccgcatagactctaccgtgacgcgcgcgtatgagacgccgaccgccacccacgccgcccctccccccgatgtaccatctccccaatcagcggccagccgagagtggctgatatggcgtagggcgcggcgtggccacccgaccgtcggtccgccaacgacgccctcgctcacgtgatccgccagagtngatgatgtatagacncatagcaccgcgtgctgatcgctgtactctacacctaacttcgcagtagccgcgtattcgcccacnacggatattcatatcgtgcgcgccgcgacagcantcgggcgagcgcagccggcgcaggcacacactcatctactagatagctcatagacagcgccgnacactcangccgacacgatgtcatccacgantntcgccgcgacgcgctagcatcgaccgcccggcacagacgcgacaccgatacatcgtgagca

SEQ ID NO: 17336 - DNA, 705 bp, Homo sapiens
  misc_feature (1)...(705): n = A,T,C or G
attctgtgggtngtgtggtcaaagatgacttctgcagataaaaacatcatcttgtatgcaagagatacgaccctcttttatatagttgaactgcaaagactaccttactgttcactcccagaatggcaaaaagatagatgaagatggagaaatgtgcacctaacactgcatctttatgagcaaaggattttctttggaaaaactgtgattatatgaaaatcataggacattttatttgtgactacagggcgtggtgaaaacctctgctaccatactggatacaaggtctttaacttctcagcaccagttttatggagcctccaccgctaagcaagtatgcaaaatgcagtgctgcttcgcattgggaaatccccaatctggtgccaagaggttcataaatacagtaatggaccctcttatgtcaaaagaactttggaaaaatgcagacattaaaacagaaaaaacattgcttgttgtcttttttctttggatctgtagagttaccagaagaaaaagatgggaacagtggtaaagttagtacatttcctaggatttagatctactggaaatgtctggacccctgcatgcctctagccacaagattgcatcacctatcataaaactccctgggtgcgcttttctactgagttcacatttacaggtctaataatgccttcagtacaagatcatctccaaggaatcaaa

SEQ ID NO: 17337 - DNA, 1106 bp, Homo sapiens
  misc_feature (1)...(1106): n = A,T,C or G
catgctctttcacctgtctttttcctccgttcgttctcagctccgtccggtttgatttctttgaaacctgtcccacactcctcgaacatgtggcgtcacactgatgatagaagaatcatactcttggctcataaagacctcatgggaaacgttatttgaatacaccaagcaccagaccgccatctggcataacaaagaaagtgcctgtttgtagttacattttatgaacgagatatgcctagcttataatggtgtcgtacattatagtgttgtattacgttgactagcgcgtagaggatcgacaactatgcaagcgaagaatcgcggtactatatactagccgcgatgtttgtcgttgttcgaaatggagcctagagtacatcttaatatacattgtattattctcaatatatcctgcactgtgactcacattcaatcggcttcgaatgcatattgcagggtcgtggcggagcgaaggagaagaagatagaagcttgctgaattgctattatatgtggtaggcgataatgctcccacagcattgcatatgtatgtatatgttgtccgtctcaactttcttctctcgatattatgacgtgacgtcaccgctcgcgaggagctacatgttgtatttatagcgtgtttcagttgcggatctgtcgtccgcgataccgtcgggagtaagacttggtcaatgatgacgtttcgcgctagatttcgaattactgggagtacacatctcatctcacatcactgttttcccgggaggaaccgtaaccgtcgctaggactactggcttcccctctgttaagggtttcgtcaagtgaggcgtccgcagttcgctatacactgtaccgagttgccctatcttctaatatccattgtacggcgcagagtcccgctgtcagctgtcgcatatgtatctatgtcgtattataaccatggtagtggtatttccgtctatccatcatttggcttgtagtttatcgcgcatctcgccgattcgcatancacgcacagtcgcattattgtctcagacgcaatcgcnctcacacggcgcattgtatacaatgtnatcccatgttagtattcacattcaatcagtg

SEQ ID NO: 17338 - DNA, 1327 bp, Homo sapiens
  misc_feature (1)...(1327): n = A,T,C or G
gtggtagagggggcccagcgagaggtgaaacacccaaaaaaattttttgtagagagggaggaggaggaaggagggtttttttggtgaacagccgctgggatgctgggctataagggcttgagcgcatgggaaggaaaggagtttaactagacaaaggctcgagacaggtaaagggaaacggcatgggaacacgggtgacataagaggacaggcgctcgaaccgcagcgcgcgtgtaccgtaggggtacggtcctcgctttgcctcgtttcgcgatgcgcgcccgctaccgcccatgtgacccagacccatgcgccggggcgagcccggccgntggttagccggccagtccgtccccgtggttaaacatcacccgccactttatttccacgcacagtgaaaaataaatgtgaacccagaattatcagcgaatagtacacgtcggttgccggtggtcgcgagtcggaccccgcacctggacgactacgtggacgcgcccactcttgagaggcacctacccagttatccaccccaaccaataaggggcacccagcaacggtggcggaaaggaaggggaccacagacgcacgggcgcaggggaacggggacgggtgacgcgaggtccgccgcagttagcgcgcggaagaatcggcgacggccagaagggcctggcgccatctggtgctggcaccgcctgggaaaggcacacgagacgggggggggcgactggcgacaatgtggttcgcgccgacccagacaataacgcgcatctcgaaaaaaacgcaagagggggaagggtgacgaacacgaccgtgcgtggagggacccaggtgtacggcccgacgaccaagtttgtggttgacgcggagccagcaggggtgatgagcgggcgggggaggagagggcccggagaataccacaaatgtactcatcccggccccgccagttcccgccacatcagcgttaccgacggggtccgcacgtgcggcttacaagagcggaggcggatgccaaagaaaaaagaggggggagggaagtacgtgcaacacacatcgtgcgcggaacgaccccgacaaagggcacgccgcggtgggctgccgcggcggccttcgcgctccagcgaatagaccttgcgagttatacgatacgggggcgagcggcgacgggagcaaattcgcggaggaacaagccgcaagatacactttgacagcnccggggtgtatacccgctccaacagcggctataaggagtcatccgcgccacaaacagttgtgttnattcagagcgacccccgcctaaccacgcgtggatgtgggtacaaccgcgctg

SEQ ID NO: 17339 - DNA, 236 bp, Homo sapiens
  misc_feature (1)...(236): n = A,T,C or G
gggataaaattagangnaganaaattttgaaaagatatagaaaaaaccaacaaaaacagccagatgcttccgcgagacccccggcccaactttccacctgctctccctttgccttcccatgattgtaaggttacctgtgtgtttcaccagtagcagatgctggacccatgcttgtaaagcctgcagaaccgcgagccaattaaacctcttttctttaaaaattaaaaaaaaaaaaa

SEQ ID NO: 17340 - DNA, 2090 bp, Homo sapiens
  misc_feature (1)...(2090): n = A,T,C or G
aaccccctctatctacttagtatgtcatttgtcgtaggagtcgcgaaggatacagacagtttttatctgcnttgggtgcggcaagagcgttgtcaggtgtcgttactttttaccgtggatgtaagcacgcagggcagngaccgcgagatgnagagatgtggggaaaagagacgtagacatacaacatacatagttcagtgtaacgttatttgccgacgagtcaccttgaatnatttacaattttaccaacantatcacantacacgcgtagataaatatatacgtgttantcttcacatctctaccgcggtcagtaacgtgtatactatgaacgcgtgtaatgcgtcgccagcgtgctccgtcggtttgtccgtcctacccagcgccacacgtttacccgctcttcgtgtgtntacgcgtataccatcagtccaacaactaatttcgcntaaacacgatccactatttgtctgtcacacgtcctcagtcttcantgtcgtgtcggttgtgtatactgcgcctgttcctcgcgcgcgtngnttgtggttatgggccgcatcccgcgtagtcttgccgtcgttttgtgtgttgcgtcacgaccacatatgtgtaatccagatatcacanttctatgattcanacagatgctaggtatatcccgcgattgntgtgtagtcgcacgtatcatagntatgaacacagaaacactgtattgtcgatgagtatctcagtctgtgcggcgatgtgcacgctccagtagcatgttctgtgtgatgcgagcctgttgtctacgctgcggtgttctcncgctcgcggngcgatcagacgagcgtgcttagttagttcagcgcgcacacgcttcagcacgtgatgtgtcgtatcaacggacgtcggcngactggcgtacagcaacanacgtcaagctacattngtgatgtatacagtttcatcaatcatatttaccacgagattgtagctgatgtgtgtgtagaacgacgacgcgttgtttctcgcacgaataccacaacatcacgncgaggtgagagcagtagtttacctgtgtcacttgacgaccatgggtatcacgatgctgatgagtgtttctgttgcgatacagatacttgtagtgcagagcgtcacaacacttatcgcttacatgtctgctgtacgttcaggctatacaaatctattcgcagatcgcagtgtgttntntgtgtatactcggcgctgtgtgcacgactgaatcatgtanatcgcgngatgtatgtgtntggattctgtatagacaggagntggngacgcggccggctggtgtgatgtgacgtagtatatgatacatacacagagcacgagtagtatgtgttatttnagagcagcagnatgtgtgattgatcgcatctagcgacanccacatattagtatgatngtatgtacacactactcacacatcattgcatcgtactaggatctattttcgacgaccgacgtatatattatactactacagacacatacagtgcgtcgcaccacatgtttgtttatcancgccgcggaccacgccgtactgtgatncatcgctcncattacccgtgttgntaccaccgcctcacctagccacgtctancgcgagtccantctnacgcgcgctccatttgtcacagtcctctcccactatcacgatcatcacgncgcntgactgctcgatcgtacacacagagactcgcagacgtanttacccaccgtacatcagacagggcagccacatttccatcgccgcagtgttgttgctgataccgcgcaagcanaatagtcgcacngcgtgtatggtataaccgaaggtcgcganagtataaccacaggacttgtgtgggcacgcgagagtggtgttagattcnctgatggtaggtattcgcgacgttgttgatttagantgtgcgancatcaccgtttgtttatctcgtctcgttcatagacacgcattgttatgactatatcgttaatgacagtatcacgatatatcgtatgagtgacaagatggtgtctgttcgcacaacgagaccgttgtgagatagttgagncgaacacacact

SEQ ID NO: 17341 - DNA, 1254 bp, Homo sapiens
  misc_feature (1)...(1254): n = A,T,C or G
ttttttttatttattatattaacttaaaataaatttataggtcatactatacgtcgcccatacgcgcaccgtcacgccaagccatacctcttccgacaacaaaccgagccgaccacaggcattgtngaagctcttacagcaatgcaacctggtaaataaatgcaaagcagcgttacgtactgttgtattaattatcattgcggagtacctactgctatgtttgtagcacgctgttgaaaaaagcaactccctaaggtacctgaatactgaacgtgtgtaacaagaatctccgtttctatcgatgtgctagggaccaatgttgttgtacttgctgtaccccaatatgagtgacacaaaatgacgatgcatgttccactacgtcaatcacaatcgagccacgcataaccgacatagtatgtcgtgtacacttgaaaccacagtgggatgcgtcaacgtgccgacaataaataacaaacgcacaaattatataatatcacctacccaaccagcacttcaatatgatanacaatgacgaagaacaaccaccatattaacgcccccgcctctcgccctccgctctgtcattgtctgcacctctcctccttgctgcgctatgtaagcacgaatataacacttagtgcactacntgattcttaacacattctattccgctatttcccatatcatgcttccctccctccaccatatcttgttcgcccgtcgagttcacagagtctcgccatatctatatccccacctctctcccgcactgagatctacctctctcgcgtcatcgtgncgtcctcccccnccacttcccccgccggctacccctattattataacaaactcttatatttactctccctcccaccaccctcccttctattatattccgcgctcccctctgcctctcatctcgtctcttcttcatcgtctttctctactcctctcctccctctctcacttttcaatacgtatattactcacctatattatatattcttattactctgatgactcgtattttccaatttcatcnaatacgcataagccnacacatcccgacgacattatatctccatatgtcgttattcgattatagtattctttcagctactgctcgctggtgcgaacgtgtgttaacctcagcgcagctcccgcgctacctcattacaactctctttntcatattctactcctctacataccaccatacatctcaatctaataactcacccctctacactctnt

SEQ ID NO: 17342 - DNA, 1522 bp, Homo sapiens
  misc_feature (1)...(1522): n = A,T,C or G
acccggcaggtgtggagaggttgtgtttgtaatgattgtgtatgttgtttttatctctgtgtctctcgttcgcagccccgtctgtttttgttgttgtggacgaccaccatagaatcactaaagcatagacgactcttctgctcgtgagatattccagacaaagtagcagaaatgagtaggagtattagatgattaaagaaattgagagacgacactctaaaatctaccagcactaaagttatagcaanataatacagagagccgtcgtctcggactggcgggcagaaggagaggattgtggtagagagtgaatgggagttggcgtggcgctttgtgcgtctgttgtcgcaagtttgcaccgtgagcgcaccgcgcgccgcgcacgcgagacagctatacagcgacaacacaagaagacaataaaagatctttgttttaaggccgatagaaaaataataaaataaaaataaaagaagagaagaatttatatagttgtaacagtgtgtggtgtgcgtgtttgtgtgcggccgatgatttggcgacctatcgttgtttgatctttctgactcgcctgcgtctctgcgcagtttgtttttaagttgtagtagttagctggccctctcgccgtgattcggcagggctgtagaagacagttgactcgactacgtcgtcgacacgacgaatatacaaaagacgacaggagcgtgtagttgtcgtatactctgtcttatctactcacgactccctctctaacgtgacccagtatgttcgtattcantatttatatatctttctcgccctacactctcactccgccgctcgtatcttacaatataataaccctgcgtatantcatgctcatatttctccacgatcccgtctgtatgtgtgagtgtgcagcataggctagtccatctagtgccaatcctccgacgctatacttatctcagtcttttcacgctagaatatcagttagttatactcgaaccctccgcgttctataattgatattttgtattccgtagccgataagtcttatgactttaattattaccactgatattattatatttacatatatagtatagttcaagctttacctaccacttgtncagagtaccgccactgtctcttattcgtgtcgtgcggcgccttgtcaatgtgatttcnttatgagtcggcacggtgttatgntggtgaaaatctgtgctgcgntgagtaatgttgtatgtatactatcagcatcattatttcatactatctctggtttgcgtcttatacacacttaaccatataattccatcgagtcgacggccggtgcggtaaacgttcatacccgaacgaccgataaggaaagaccggaatcacgaagagcgccgtccgtatagaagtcaagaagacacaccgatgagagacattatatacctccgaccgtaactgtggtatcatgatagcgcgcggccgagcgcgggtcacatctagttattctacactctcactctcaccatcacttatgctctcc

SEQ ID NO: 17343 - DNA, 271 bp, Homo sapiens
  misc_feature (1)...(271): n = A,T,C or G
gaccgcacacgcgagntgnnntnntnnaatgttgtctgtgtatcattttattttgtttttctgtttttatatgcgtatttttattttattacacttattatactcaaagcaagtttatgctgtgatacttctcaatgcattatatgatgcacgtgaagaaggacatgtttgcttccctttccaccatgattgtaagtttcctaaggcctccccagccatggggaactgagtaaattaaacctctctcctttataaatgaaaaaaaaaaaaa

SEQ ID NO: 17344 - DNA, 1412 bp, Homo sapiens
  misc_feature (1)...(1412): n = A,T,C or G
cggccgggttttnttcttttttgtttgtttttgttggttttttttttttttttttttttttcttatttgatttgttgcgttttttgtactctgatagtcgggtttttatcttattcctatcattgcgggaccccggcagccccaggcgctagtcaatgtacatcgcaccatctaaccgtgtcgtggtccggttgatgggtcggtgatgtgtagggtgcgagttctatgggcgctcgtgagcgtnttggggtggtaagtgtcggaggagttttttcttatattcctttatacgaaaagagtgtgcgtgtgaggtgttgtccggtgcggctagctcgggttgatatattttttagggttttttttatgttatgtttattttgttggttgttggctggtggttataataatttatgaagaagcggggtggagcgtgtaggcgggggcggtggggaagcggacgggtattttataatatgttgagttggcaagcccggctgttgatattattatcgattcaccgccagcacggcgataggtgcggacggcaaaggaaggacggcaggcgcgggcccgcgccaagaggggaggaggtgatagttacttttgttttttgtgtatgttataaagatagatgatgggttgtacagtagtatctgtgaattgttcattatttttatctgatctatcgcacgtgcgcgcgatcgtgtctaagtgtttgactaattgtgttattgtgccctaccgcctcgcgcaagagacaaagtttaacgtacgcgtgcgttcgacattcgtctcgcggatgcgcgatagtaggacatttgagtcgtctgtggcacgagtttacgtgatgttactcgttcggtttgtccatattaatatatgatagttttcatgttgtcactagcgtttaatcgtcgagaactttatattgactgagtattatacggctacttatatagcgtagntggaagtgtcgtacagagagcatacgcgtgcacttcagatatgatgtgcgtgcgcgttttcgctcgtggcccgccgacccggttcgttacgcgacgtttacgataagatcggcttcacaggcttattgcagtgatatcacacaataagtaggagttaacagcacaagttattaggatacgcaaatactcgttgttacaacaaatatcgggttggaagatgttatacatacnttgtcacgtgatgtatttattatttgtcttggtgatatatgcggtcgctgttggtttttccagccggcgaaccgttgtttcaagatacgcattatattgatttcattgtttcgtcttattatgttgttgtacttatgttttagcctgctcatgtttcagtggagagatcaattttatatttaactgtatcgacgcgtctctcgatccccgtacgaa

SEQ ID NO: 17345 - DNA, 889 bp, Homo sapiens
  misc_feature (1)...(889): n = A,T,C or G
ggccccgccccncggggnnnnnnnnnnnntncctgngttnttatnttttttttctacttctttattttcttggctttaggttttagatttaccgcccccgcaccttttagtagtgagcgagatggcagccgacaaagatggaattaaacaatgtgtctgaaagtgaaagcattccactggcctttggaaaatatatcgttgcgactgccacatattgcatatcctacaaagcgagcttattctgcctgaagggacacaatgtttcagccagagtggaaattgtaatggcccactcacgaataagccctacatgggacctcatacccccgccatgaatcatcaccaccctttcattcaccgaatattggctaccacccaaacacaaaccggcctcccccgcccccccccacgtcaccgcgccccccgatcactttatcgcgggacaaatatattatcccacctctacccccccacacccacccgaccccaccacctcccaacccgtatttttcccccctccccagcttcagcttcccacatcgttctcaacctttacccgtgacttcctccccttcctcttcgcctcccttatactcacctatccccctccgccacatccaatcccctcagtccgtctacccatccccctccccatcccacccccccccctccctcccctaaaatattccaaatccctcctcgcacccctcccacccccccccgtacaatcccactatacttgtcctatctttatattctaccttacatccccctcttcatccccacacgtttcatatccataaaactcgtaatgaccccgtcccttcccccgccccgatacctcctcctaaacaccccccccccccaccgccccccccctctccccatg

SEQ ID NO: 17346 - DNA, 1824 bp, Homo sapiens
  misc_feature (1)...(1824): n = A,T,C or G
tgacgtgccgtctgtntncatcgataacncgnctannacanantatacagtncnataggccacacgcacgntnactcgttttttttntgcganacncnccagangaccccgcgagcgcccgacgcgccgggcgtgngtttttagcagcacgcagattgttggnangncgngccgagatgccgcatagacngaacganaccgcacancgcagtagccgacagatagtgcncgagatcgattgctcatncgcgaatgccatcgtcgtcggagtgctcaccttnggncagnancgaccncccnttgagnagngcaaagnctcgctgacacagnaggcgaaaccacctccgacgnacacacgccgccnnaccgtggngaccacaccctgtagatnagcgacaagacactagttgctgagnatagctngacacacagtgtactggngacgtcaacacagtactgnttagacttncgtacagatgcaggtggtgagtgactgtcgttcgtccgtgccacacacacagccacacacacacaggctcacgcgacatgtcacgacagctcgacgaggcacaccgatcgacactgcacangccaacacactgatggcctgctgtggncgngcgacagttgacangnatnttgacctcgtgtgtgngtagtgtacacacacgagatgngcatagtggagggtgtaangcgaatgacgctatacgaccttggccgtgtgctccnacgtgngccacnacagcaaggacccacgactgtgtcgcaccttgctacnatcnatcacctagccacacagtcactctgtcgtcacgccgcaccgcgtcgtgtcgacaatctatcacatacactcaccgcgcacccgcgttgacgatgacgcccccgcgctgacgcatcgatgtagcgcaatctgaccagctccgcctacgtgcggcgctgcgcggcgatctcgccgtcacagtacacgtaacgtctgacgtacgtaacngcgacacatcggcacacctggaacgctccaccacacacgagccgataattgccgctgctatactaccgccgacgctccgccgcgccccgcgccatgctctctgcgagattccgcgtcgcatcgccgccgtcgagcacgtccgcgacgccgcgcgtcgcaactcgcggtgcggaccacgccacggtccacttcccccgaccgactactcagaaaatcatgcgagtaccgtcacggcctgacgccgcgtccgcctcacctcctccgcctcttatcgtgaaacctccacacccnagcgtccgcacgcgccgccctgcgtagacgnaccttcactcgctcacacgcacgacgcccaaccacagcgacctctcctactccccgcccacacacacacacacacacataccacccacgcacgttgatccgtccacgantcgtcccccgctcgcgatgccgcgctgcttgtcgctccacctcgccgccgaccatcgcgtcgcactaccacccacaacagaattctctcacacgcaccggatntacaaccagcgcaacccccctacgttcttgtgcacgttctcnaggcagacgatcagctctgacgagccgccgcaccctagactattcctcgtcgtcgcgcttgcgtccattcgcggcgtcacgtcgattagcgctccccgcgctcatctaccgtatcacgccaagtataattgtgtaagaatagctctatcgccaccnactacacgtctactcgccgtgcggacacacacgtccgacctcacgcatcgacgtgatatatacnctgtctcaccgccggtcgtcgccaccgccgctcgccg

SEQ ID NO: 17347 - DNA, 851 bp, Homo sapiens
  misc_feature (1)...(851): n = A,T,C or G
ccacccccgcccagagacccttaccgcgtcgagatttataccttcccgcctttcctctttttttcttcctttcttcctgcacacctttgcaccaatcatgataaccaagagaaatggaatatgatgatcagcctgtcctgaagaccctaagaagtgaaaagaacctccacagccactggaacttatggagccatgagtgtgcaatttgactaaatcgtgctgacatagtgagacgctgtctcaaaaagaaaaaagcaaaattaaagcaagaacataataagaaatatgtttggcactgtgttacggggagaaaaaatcaatagggagatagatcctgctttcagggtaagcgcaatttgctgagtaaaagaaatattccaagataccttaaaaaagaaaacaaaggctggtggaaattggatattcaatcaaatattcttgggcatattggcagatgatagatctaatgaactcggggtttatacatacacagaatgccacattgtcactaatcttttatgttctgggcaaagagttatacccactctgaaaatgactggcggttgctgctctgttaaaaatacagacttctttcctgtggcacatcacgaaataaaaaatactggccctgatcgacccataacggaggacatatncgagtccagtttccttttagcgaggtagttctggatgacaccctgtaaactgactataatctactcttatgtctctcctgatatattttcgtgctttatcctttatttttatggtgacacgcgatctactcacagccccgttgctcgcatcgacgacgccccatctcctccttttcgactttgtctactcctcct

SEQ ID NO: 17348 - DNA, 1839 bp, Homo sapiens
  misc_feature (1)...(1839): n = A,T,C or G
gcgaacggataacagaggacgaanaaggttgaatattcgagnggtgttttttctcttngatgaacgtggagacaagagaggcgttgtgcgncgacccacacgcaccncgcggaggaagaagaatgacctagcgtganctagtacaanagagagacggcgcgaagggagagagagggatacatagggaccactaaacagaagcacagtgactaagatgcgtacagacgatcgacggcgccacagcgagcgtagcgaatgcgaagtaacacgtaaatcacagcgtgtctcacacaagaatcactgcaatcaccttggtagtcggcttgtggactgtgagaccatctcgtgtgagcgtgtctcnccctcctctaacccttatctccgccacacgagagatacggaaggacgctactatagtacacgttaccgttgctctattcgtgtttaataatatactattctcaccttttggttgtggtcgtggctatagtggtattaatgtataaatacganagtatgctaaggtagaagcagatttagttgttatgtaggacatactatccatagagatgcgtggtggcgcgagacagacgagggtgagtgatggagagaacgaggcgaaacgatgagtatcgttacttatatctccgcccacgctacttcagtacatatttcatactagttatatcactccgagtacactgtactacgctgcgtgcgccggacatcgaaagagcaacgctccccaccgcctcgacccgcactccacactaagacattatcttgttcttgtgcatcatctctcactgtttagtcttcttcccatcacgattagatgcgtatgatagtcatctaatatctcacacagtgccgcgtgcgcgcacggtctcgaccgacggttatagattatcagcgtagtcagctccagtgaagcgtaaggagcgccggtgctatagttactgtcgttgtgcataactaatacaatatagtacgctcctactcgccacgaaattaanatatcagataaatgagcagataaggtanatttatgtcactaaggactgactgctcagtccgcgcggcatcctgtacaaacaaggcatgacacacagccgtcgagttcagcgaggcagatcgcgtttcttcgctaaatttcatgactctgatggagttctcgcacttctaatanctgtatgcacgcatcgtatatcantactttcatancnatagtactgacgcacatactcacagcgtacggccgtngcgcgcaacaatagaantcgcggtgtngcgctacccatgcagacccaccgctngatgtatctacgtgcgtatacgtgtacgtacagactacatgcacgagcagtcgtctctgtgatggacgtgtcgttgacatgtgcagcatagtagttggtaatcgagtgtactgctggtcgcgctcngtcttgacgtcctnctgtgcacgcgtcnctaaagtgaataccgatgatgacgncgcacgngaacanancgtcgatctcgagctatacgtctcacgtgacagtattgagagtangttgtgtnntgtatgctggcgtcatgccgagtatctagatntcgtgcgcgctactgcacacattnctccctcgcacgtcncgtagtatatctcntcgcgattantgcacgacttctatagtgtgatgttatctatgtcagtgtcgtcctgtgtatagatgatattcgtgttgctttgctcacggtattcatctcgtgctgcgtcgacgccacgtgagtctacgcatctctcgtatgactcgtcatctctcgcgatgacggtaacatggacatatacaantatct

SEQ ID NO: 17349 - DNA, 272 bp, Homo sapiens
  misc_feature (1)...(272): n = A,T,C or G
ccccccgccccnccccnnnacnngaacaccgcaatccatcacacacccacaccactacccaacccccccccgctcgacccaaacagcccgcactttgtttttaaagttttacctgtacatcatcctagtaagtatatggcaagggcttggaagtgaccctggatgtttatttctgaagaaacaaaaaagatgactagtagaggatacaagagaagctggaagctcctgatttatgaatagaataaaaaatgcacaacacaaaaaaaaaaaaa

SEQ ID NO: 17350 - DNA, 1582 bp, Homo sapiens
  misc_feature (1)...(1582): n = A,T,C or G
cccgtcttttctcttnttttttcnntnntaatttcgcggnannngtttttttgaggatgtgtttggtagcacgttctcggttcttttattacttttaatatagtataactgttcttgatctcccatccgcctagatggccgcgaggaataaacctagttattatagagctgatatgctctagatttacttaaaaacaataatgcgagaccgtcaagtacagagaataggagatatacgtcctatcttataagaaagattaattgccgctactcggagtacgggttagatcttttttttcaattcacatcggcgaaggtactaaataatacctgtcgccattactccttttttttatatattctcgtgttcgatggatgggagtatgtgaagtattactgtctttcatggttgggttattaggtagaccaggacaatagaaatgtttcagctcgttatagcagcacggagtgttgtctacggatcgcctctcattattctaatattcaataatctccactccgccgccgtaatattaataatgataataccccaggtgcttgtcggcaccgtgttctaccacccacgatgatgctatatgactagtgcgtcagggcgtcgcatgcaacgacaggactatgacacggtctattagttttcgtttcgattagcgcttcgtcgtcatgtgctgtgtttcatatctatcgtcgtgttgactcgcatctcatttcatctactcatcgtacatccagctgcataggccgtacggtagcgcggaatcgtataaaatattacaacgtaggtttcagactacgatatgagacgccgcaagctcgttgatgtctgtttgagttacacagtcgtcgataagagaagtataagaatgcctagcgtctgtatgtataaattgatgatcattcatttnctacccactcattatatcgtatctacatagttgctatgttccgccttgcatctntaattaacgcactcacctgtccttatacaaaacgaccttaaaatcgatttgtacaattctttctctcctacctgcccgtcatttaattctctcatctcttattatttgataaaatattcttaaagaggacaatgatgtccacgcgcacagtcttgttttgggccggtcgtacactgttaagtcggtgtgtgnatgtcgtccataatcgctatcatcgattattcagtatatcatactagattgttacggtctcttcgcgtttcacgcatcttttatgcgtcgtcgtangattttatccgcagttgaacattcacaatacattactaatgaagtagcatcgtgcgcacgtanttcttnattacagcagtctatcgttgctccgattccattaattctgtatatacatcccacgcacgcgttgttgactcacgttctcagcaacacagtatatgtgagagnatgatttccataagtgcgtgagttatatggtatatgtctatcagtattcatcaccacatccagtccactacacanatccgctacgtctctttgtgttactactacatcctgcagctcgagtgcgctgtgtgggtagtcgagagcac

SEQ ID NO: 17351 - DNA, 863 bp, Homo sapiens
  misc_feature (1)...(863): n = A,T,C or G
cgccgcgcccccnncncccctctccncctctttcacgctctcctctcccccacttccccctcctcctcccaacttttctttaacaaactattaatcttagagtaggcacggagggcttgagccagaaaggagagacaagtgcaatcggactgtgcatgatgttgccactgatgactgcaagcatttgctggagaatctgaatgctcttaaaatacccttaaggatttcagtgggtgagattgaaccaagcaactatggttctgatgacttggaatgtgaaaacacaatatgtgctttaaatatccgcaaacagacatcatgggatgattttctaaacgcagcgtctccagctctgacaaatcattcacacccgctatcttctgacggatggcggacaccggaaaactgttcttgccctatcacctttgtcccccccattgtacttttaaaaattatttatcattatcataactatcacactgcggacggcgcccatcgcacctccccccctactctttttctccaaaatctttctttgtctctccgacgtcccccctccttttgcccccgctctatctatacacacccctgtcccgcatctaaatattaaagcacttccatactatccccctccccacaaccaacactccccccccgcagctaaccataagctaacgtccgcgtctttatttccctctttccatccatcctaccaccccacctttcaacgattactacgatcattctgcccgtcgacccacgtccacaccctaacaataccatcccccctcccccccctccccccgcctccatatatcgcaattcaacctctctctattaattgaccgacgcttattctcatg

SEQ ID NO: 17352 - DNA, 1402 bp, Homo sapiens
  misc_feature (1)...(1402): n = A,T,C or G
cgagtgatgtgtggtgtgggaggagagaatactnnaaaaaagtttatanacaagaagcaacacagaggcggaattatgggctgtactctctctacactgtctattacacgtcttgcgcctcncgcgctcagtctacccgccgccgacagacggtgtagatatatgtatgagaagcgtgcggatgcctgaaccacgggtaccgcgtgcgcgctcctgctagctcgctttcactgcgctagtccctcgatgcgggggcgngtgtggcgtgttgcgcacggcgaggtgtgaggctactcctgctctgtgattcgtatgctcattcctatntatatgctatagcgccaattctgtacagcgcggccactcaactcatcgttcccactgtttagctgttcntctattnttcttantgcttgtgttgctgatgtaggtgtgtgctgtagactgtagtagtncgagagtgcagtatattgtnatcatagtcggtgcgcactatttcgcgccgcgtgtcgcgcgcgcactcatcntcacccagctaagcgcacactgtcttatgcaagacgcagggaccgtccgcactgcaactanantaatatcgctcgctcgccgctccgccacgtntcttcccgcccggcgccgagcaggccgccgccccgccggcggtacgcaccgccaacatgcatctcagtcatgtgtctcgttactaagttgtccatgtacatggcgtccgtgactctccacatccgctctgtcgctccgcccctcataacgacctatctataatcgacttattgctatgtgcacttacgccggacgcatttcattcgttgtatcttctcccgcagtccatcatgcgcgctcgcatacttatataggaccagatatgagaaagatcacatatctatcagtttcgccgtcgcatatggacctcgcgtgtancagtcgtacacactatacgttgtgtctctccttttcactatctacccatgcctatctatgatgtatgtgaggtgtaggagtcaatacgaccatacacgaccccacgtcctacatgacaccatacctgacaagttccgtgtcttctcgcaacgagcctagcgcagttaaattgtgtgactgtaatgtatcgatcatcgctcanttctttttcttttctctttttattctacatttcgctgtcatcttacacacattcgtgcctctgtgttgtacttttaatcatccgctgttttatcgtcttagtcgtcgatttccccgccgccgtatanaccgactgcgctcgtgagatgattggcaatcgctcantagtgntatanatgcgtagaagcagatagagtccatcctgccgacgaagacccgcgtgatattttcccctccacacagtactacgcgcaattatacg

SEQ ID NO: 17353 - DNA, 240 bp, Homo sapiens
  misc_feature (1)...(240): n = A,T,C or G
gccccccggnnggcgggggngggcacatggtgtttgttcagtagttagtgtattatattttagaaagggcaggaacttatttctgaggaaaaaaagaagaaaacaaaaagaaagaagccaggtactggcttccgaggctgcatttacaaccagtggttccatatacttgcagatggatggctgctgccagtttcctcgggggtagatgctaaaaataaaatgcaaacaaaaaaaaaaaaa

SEQ ID NO: 17354 - DNA, 1737 bp, Homo sapiens
  misc_feature (1)...(1737): n = A,T,C or G
acacggattgggttgtttcgataaaaaagaaaaaaagttaanatatagtttgatgtactgtgtttttcttttctatttcttctgttacaatggtttgagatgcaataagttagtacaacaagactatatttggttcantgatagcaatatacatattttttagactcgcaaccggcggtatttaaacaacagatgataaagatagatgaaactcagctttattgtcttccgccgctgttctagttaatttctcttctttcattcttttatcctttcttccgatctcgtgctttcctgtttgtgtcggcgtgcttaccgcgtgctgatgttttttgattgtatgtattggtgattggtatagtgttagtttatttttcttgtcttatttactgtgatcagtagttaatataagtaatgtgataataggatttcgactgtagtgagtgatgctagacggttgactcgctggcgtggtatggttctttgtctcattctgtgccgccgggtcgtcggctcgtctattattatatttatatgagtccgtatggacaacgcgttatatagcgagatgcagcacacaactaaacacactctgtctcgcaccacgcgtcaaggatcgaggtcagagggtaggantatagtaatgagcaatcgtgtgtagtgtagtgacatgttgatatcatgcgatctctctgtctcgtgtgcgtgtgttttcgtcttatagcttactacgcgtaccgtcccgtcacgcgcactcacatcctattgacacgcattgactttactaagtagatcgcgatgcgcncgacgcgaacgccacagtcgtcgagtgtgtcgttcagtctatcgcgatcgctagatgagataaattctacgcacancgaggacggtgagtagtgagcgtcatgagcggtgcagtgcggcgttaatatcgggctgtggcagtcatcgcgtatatgtgggtgcgcgatgancgctcgatacgtcagcgcagttggtacgtacggcgagctccagttagtacagagtacgtattgttatatatntctattagtgtatgtagcagcgcgatgcatctttatcttgcttcttcgctcagtgttatttatgtanatactgatgattgtgacgcgngaaatgtaagnangtcacgtgtngtgacgtcgagtggttgtgtngcttttggtgcgtgcgcgtcgcgcgtgtcgcatgcnagttttncgcgatggttcgatatgtgtcttagagacgancagcgntngtcgncgtcgacgngtctgtacgttgtcttnctcgcgttcgatcgtgtnttgtagctttcagtgaagtgntgagcgantgatcatgctgtacntcgantagtaccgtcntnatntgtcngnactgcatgtgatcgactgagngtcagtatcatngttgtagtagatatngtgtacgcgactacgcgcgnttanttagtgtagtaatctcagagatacgtaagctgttcgtgcgatattacacgttataagtcattantacacgcncccgctcngcacgtgctacattgtacnactgnacagcgagagacnagcaatatttgtctattcgacagtctncagacangtgtcgtgtntgatcagtagatatttctaatacttcaacctgtctcactccgtccnctaccgtactgttatctgtttgtatttttatattgctcnanntcagtgcgttatcttcgtcttcgtgtgtacatcg

SEQ ID NO: 17355 - DNA, 699 bp, Homo sapiens
gcttaggttaagtgatctctgctgcctctgagtagtggatcacaggcgtgagccactacccaggatatttttgattttactacagacggggtttcaccatgttggccaggctggtctcgaactcctgacctcaggtgatccacccgcctcggcctcccaaggtggtgggattacaggcatgagccaccatgcccagccaaattcttgctggagaaatgaagcgagaaatgcaagagcgatcagacaacaatcccagagtcttgaaccagtttatagaaaactagaactgaaggatttcctcttagaccccaaacgttatacctcttatgccccaacataccgtgtgacagttattttatgtaagatacacatcttttcccatcccctattctctgcctgccttccatcattgtagaaggacaaagacctcccgaaataaatattacgtctctcctcgtatcttacttgttggagtttatatactcccctttccttctctgcgcgttttctcaatctcattcgtgtattacttctatcattctaactctccccacatcaatacaccaatccatatacccactttgggtcgtgtctatctctcacgttttattcagtatttatctctacgactctttatttttaccattatttatatattataactaggatgggttctgagttgcgctccttatatccatg

SEQ ID NO: 17356 - DNA, 1849 bp, Homo sapiens
  misc_feature (1)...(1849): n = A,T,C or G
tgctgtccgtttttgntntcgttttangtttgaagttttgcgagggngttgtttctctnnnccccncaccgcgcagccacccccatttttttttttcnttcttttgtttgtgtgtgacgtttcttttcttcgcttctcgtctgcgtgctcgctctcgcgccactccctgccttccctcctcttcacttctcatgtgttggggtcgtgtgtnatctttccttcattctcttgggtgcttnttgtgttgttgtgtnttgtcggcgcgtcggaagtgcttgggtgtcggtggtggcgtggctggtgtggtgcggctctgttttggccttctgttctgctttttgtgttgtggtggtcagttgtttttttgtgtgttgtccccctcattttattttagtttggtttgttgttgtcgttgttatgttgtgtgattgttgtttttttgacgtggttggtggtggtgttactgtctgggttgttttcttttgtgttcttctngttgttgtgttctcgcgcccttcagacgcctcacgctccacctattttatttacttgttttcctcctttctcgcccctcactcttcttctttcgtttttgtgtttcccccggtcngcgcgcggcgtgtcttgtgctcgcggtggncgtggtatgctgggaggagtgcgcggcgtgccggcgatacgagtgagcgaggagccaggagtagtgaatcgtttctattattgcgatgtatttgtgatattggtttgtatctgcgtgtttcttcgcggctttctcttcgcnctcttttctgtcagatgttcctgcgtctgcgcgccgcttcgcgacgctgtgtcgttgatcggtaattgttgctattgtctctgtcctctctgctgctagtggctgttgtgctgcgccgccgctatcgcggttgtctttgtttgtgagtgctttcgtgcgntntgtgtgcctgatttgtggtctgtctgccgccttgtcatntgctatgcgtcgtgtacgttgtctgctgcgtctgctttaattcgtgtgtagtgttgctagtgtgttctcctcgtttcgtgtgattatatgtctttcgtctcgtccgtgtcttcctcagtcggtcgcgcgcggcgttagctngcgtcgtgtcttagtgtatgagttctcagtcncttgttcgccgncagcgatggtttgattggttgcgtgctcggcttctgctatgtgcgtcggtagacgaatgagtcgtgtgcngnctctctctactcttctagctgtgncacgacatcacgctgttgagtgntgtgtagactagacntctcgttactgntgctgacgtatcgtatatcgtgacgatccgtacagttattctcgatattgtgtcccgctgncgngntgcgcgtggcgtgtagtgctcatgtgtntgatgcgctgtcctgtctcnagtctagtgtttggcngagtgtacgcatcttgcgtcgantgactatcttattgtctgtgtcntcgtcctatatcgtgnctgtattcgtccgtcgtctcatgatntctatttctctcngtgtctcttgtgtcgctcgtagtcttacgttcttttcttttatctatcgctcgtctatttctattgttctcgtgtgtccgctagctgtcgtgaatcgctcgccgggtcgcgatgtgtaggtagcngtgtgtactggccgtgntgtttgtattctgtctcgctctcttcctgtgtgtgtgtgttgtntgttattgtgtgctcagtgtgcggtgtcgtcgtcgctacgcgtgcgagtcagatgacgttttgtagttgtttacttgcgtcngttcggtcnatagcgtcgtgcgcngttgtctctggcg

SEQ ID NO: 17357 - DNA, 272 bp, Homo sapiens
  misc_feature (1)...(272): n = A,T,C or G
tcccccccgccnnntntttcctttctcccttgtttttgcgttttccttttcaacatttttcctctgttctgccacgcgctgtccctactttcttttaaaagttttacctgtacatcattctagtaagtatatggcaagggcttggaagtgaccctggatgcttatttctgaagaaacaaaaaagatgactcaggggaggatacaagtagaagctggtagcctactgatttatcaatagaatgaaatattcacaacacagaaaaaaaaaaaaa

SEQ ID NO: 17358 - DNA, 1155 bp, Homo sapiens
  misc_feature (1)...(1155): n = A,T,C or G
ggcggggccgcccccccccctatcccgcccgacgaaataggggttttaaaaaccacccacanatgagtgttttaanagaaaacccatgactgcactgaccgtcacacttgcggcagcttattggtagtaacatggggactataaggctctgtcgccaaccaaccacgctatcgctacgtagtatatagttgaccacaactgtcctgttgtgttgcgtgattgatggggggtgtacgagacagtagaggaagtgtagaanatattaatacgaaacagcagagcacacaaaccccccaccaccgcttttttttttgtctacaacaccgacacactcactattctcgagtgcggcgagtgtagacacggacgaagagaagaggggatggggcaggtagagcgggcgaacacacggaacagcgttgcccgcccccataggataaaatcacgacgaagagcccgcacgtacgccggcggagacaaagaagcccacacggaccccacacccaccccgccccacgagtgtatcgcgacaacaccccccagtcacataacttggaaggagaggaacgcgcagggccccggacgaacgcgccgcgcgccgccaaagaccccacgagtcgtgaagccacccccccccgcccgccgccttcccctccacacacccccaccgcgcccgaaccgatccgacgatacccgcaccacccccacaacatcgcgcgcctcctcattctcccgacacgcacaccgcccccggtcgcccctccgcacagttattaatccaccctttatatgaccatatatgattgaggccacaacgtataatagggcagcgcccgccaataacgccacgcgacccaccgcgtaggccgcgtgatacggaggctccgagcgcgcggacgaccgaccgcccagaaaacgaataatgtcacacagcgcgctagagagagacccgtaaccgctcccacgaacgcacaaacccccgccgaaggatcacantaaaactcgcgcaagcggtacacacgaggcggggtgccgctcccccggcagcgccgcgccacagcgtgtcggagagtcactattacctgtataaagacattcgcacgaccgacgcacgcaccctatatagaatccctccgcgcgacccaccacaccccc

SEQ ID NO: 17359 - DNA, 754 bp, Homo sapiens
  misc_feature (1)...(754): n = A,T,C or G
tttacngaaaacagtactgcctgcctcagccttcggagcttttggagtttctgggactataggacttgtgccaccaaccagctatctacgtagtattcttgccaaaaatgtttgtttcttcatgattatgttcattagacatctccaaattgtgggacgttctacaagaaaactgatctaacgcttcaaaaatgccaatttcataaagacagaaggtggcggggaataattttagatgaaagaagattaaggagctaagagagtcaaatgccatagtaatctctgattggctcttgcattgaaagagagttataaaggacatttttagaaaaactgagaaaatgtgaatatggtacatgtcaatgttaatttcttgagtgtaaaaaaagatgtggttacgtagaagaatgaccttgatgtaaaatgataagtgcttgagtattattgatgtgatgatgtctgcaattcacttttgaatggttctgctgggggaaaagggaaaaaaaaggaatatataaagagaaaagcagatttgacaaaatgctgactgattactataagcagggggcatcatattgcgatttccgctttgctgtactttcatcattacctcacaccacagcttatcttctaggggggaaaatggtgtgtgaccgacttaaaagattgagacattactttgcagactaggcctagcgatccgatttctaatgtttctcacctataatgctcccctccgtgcttagtacccgat

SEQ ID NO: 17360 - DNA, 731 bp, Homo sapiens
attatactacaacctacctgtctaggaataaaccatcctagccttgagcaatcagatgaaacctggaccagagactcattttcttctaaaatgctttctctagaagatttttaaaaagaaaaggggggaaatgtgaaaggaaaataaatcttggggcctccaaatcacaaagctaaaggaaaaagtcaagctgggaacttcttagggcaaacctgcctgtctttctattcaaagtcatccctctgctcactgagataattgcacatctgatcgcctcctttggaaaggataatcagaaactcaaagaatgcaactgtttgtctctcacctacctgtgacatggaagccccctccctgcttgaagttgacctgcctttctaggcagaaccagtgtacatcttacatatattgattgatgacttacgccaccctaaaatatataaaaccaacctgtgctcttaccacctcgggcacacgtggacaggacctccttatgctcttgaccagagagggtgggcgtcctcaaccttgtaaaaataaactatctacgttaactgacaaaaaataaatcgcacacaatgctctcagcggtggatctatgccgtcgtctccctttacagaggcctcagtatagatactagctcactaactctctaccctcatatgatacccttatcgttatcgccatatcatccctatcaggatatctccacgtgctcccctcatatatg

SEQ ID NO: 17361 - DNA, 563 bp, Homo sapiens
cttgtgacccaatcctgaccgaagagaagttgaagacttttgaggaattcttagatttttaaactctaaagcttataccttaagcttctctattatattgctatcctgactaaataaattatataagggctgggggaccctatcttgtcctccactgtatgtctaggtctaggcacacctggcactgttgccatctataagcacttaatacatatgtgctcaatgaacattgtaaaaaaccatatcaattattgaccaaatatctattttcattttactgacggctgttcattatatacattctctcccacgctacatgcgaaatcatgaagccacactccctcattccctcactgcattcctattttcaatagattaggcgaggtgtcgtcgatgggaaactatccacacgtttaatgtgcgcaggttgacatgctataacacgtgtatacagtttgcgccccttgctccatgatgcccagtccatatatccgccatatgcctcacaatgagctggagctagttcaggaagaatccattcttggagaacgctcagctcaaag

SEQ ID NO: 17362 - DNA, 748 bp, Homo sapiens
ttttcagtaatggataggaaagtgtacaatatacaataatcataccacatgacctccaagtagaggagttctttttatctcaagtgttttagaagctgagatagggctacagaaggcttacttagttaactatcaggacttgaacctcaatcctccagtaacctggagtttctgaaatattattctgtcttctattttgaaatccttctattctcttcctttggggggataaaactttattgagcttattagagcaaagatagcatggtctttggattagctgccatttggctctataataaaataatgttaactaaatgtcctatttctatacatttacttttaaaaaatcctctgataagcaagggtctgctttatgacacattaggctacctaactcttgaatataaaaataggtcttagtctgcagagacctctgatcatgccactgcactccagcctgggcaacagagtgagaccgcatctcaaaaaaacaaacacacacaccggtcttagcgatgaggaagtcaccagatcgaactcaaatccttatttgcaatcgcaatggtgttttgcattaataaaccactttctatttctaaatcaggcacactactaactgttcttttttaactaccaaaacaaaggttcttgtttctagggatacattatagaaaaaaatacaactagatgaagcgtaatctacatgactctgtctcaatgacggagacacatagaagactgaagg

SEQ ID NO: 17363 - DNA, 712 bp, Homo sapiens
ggctagaagtgaagatatgtgccttgactcagatgagactttggacttggacttttgagttaattctggaatgagttaaactttaggggactgttgggaagacattattgtgttttaaatgtgaaaagaacatgaggtatgggaggggtcaggggtggaatgatatggtttggctctgagtccccacccaaatctcatgtcaaattttaatccctagtgttggtggaggagcctactgagaggtgactgaatcacaggggcagacttccttcttgtttctcttgagatagagagtgagttctcatgaactctggttgttgtaaagtgtgcggcacctttcccttcactctctctcttcctcctgctcttgccgtgacatcaactgcatgctccccctcctgccatggcaatcagtgcattgtttcccctcccgtcatgacaacaaccgtccgcctctcctttcgcctttcttcccatgtcttcaaagatcccctgaacctattccctccttgctttctgcgcatcctgcaaatctattatccccgttttcatgtctttgtatattatcttcccgcatcaacgctttcctttattccctacgtcaatatccgcctacctcttatccatctttatcattcttccggatgagctctacgtaccatcagcccatatgcccccctgatcaatgcttcccaatctctcatgatacatg

SEQ ID NO: 17364 - DNA, 759 bp, Homo sapiens
  misc_feature (1)...(759): n = A,T,C or G
attcnttctgaatcctcaagatgagcactttgcaaagtcaaagaagtgttttactattcatttgtaacttagatgccattgaaggaaggaaagacaaggacccgactcatgctggaatctggagtgggtttttcaggggcagacagaaaactgttttactatgaaaaaagatcagcggggcatcttatgcacattattggattgtatgcacatattgccaaggagacctcatgtttttgttaaatatattagtaaagacttttgggaatgctcctcaagcaaaggaactacactatagagactactccacgtctctagagtagtgacttcaccaaaaccttatggtccctctcccaaagccctataagtgtgttacttctcagaccaatattttactcttctcataatatatgtaataacacattctaggggaggttgaaataaaaatacaacataattttgttacaaatcataattgtcttcatccgtgagacatataaatcatcactgaacaaagctctgtatagtgctttaacacatacttgctctgacagtaaaaatgacgcccttggatattcctactcacacttgtgcaatgcagtgatattgcaaagaataatttcttcctgttactatcaacattacatttacatggaatattgtttctccctcaatatattttcccgttttatactttctatgctcattgcggtttatctttgccatgcccaagtattcactattttcgtcaggtaattg

SEQ ID NO: 17365 - DNA, 853 bp, Homo sapiens
  misc_feature (1)...(853): n = A,T,C or G
ttcttaaattgtttttagatgtgtatttgttttcggtgtatttttatgttttataaaagttaaaggcgaancactgagacatctgccatactgcattcagagactgcacaattagctgatcagagcttttctagagagaagctgccttttcttcacagaaacaagaattatgatttttaaaaatgttctgaggaattaaatgcaaatttatttcacttttactagattagttgcaccctatttacttattttcccagatttattctctgttcccacctcccttttatttttttttatttgataaccgattccctacatctcataatatggccactttactgcagcactggatctttttgagaatcggcaatagccatagtattctacatttccatctgctcgtgcctgctttcctttttaatccgcgtcgtcgctctcacctccctcctctatcccctcccgtctcgcctcttcccgctcgctcctcttttcttcgacttcccctttgccgccttatccgcattcctctcccccctttctttttttcctctctcttttttctcctccgccgtccagctctctcttcatccgctttcctatctctcgattctcacttacacgaatcccgtcccccatctctccatttcgcgtcgacgttgcttatctgcccacttcattctcatccaccacaaatgcttccgatcattatttccttcactctatatctcgctgcgttccgaatcccccggtatcattatgttcccccgcctccaatcattcccgattttagttatctttctctattccctatttccgcccggcatcacttctcaacgatctactatctcccatg

SEQ ID NO: 17366 - DNA, 734 bp, Homo sapiens
aattgtggaatccaggccttatgtggaacatgaaggatgaagaccagatctccccaaattaactattaggatgcttggagggtcattacatctagaaattctaactctaatcactttaaaaaatgttagtcacctttttaaactatatagttttctttctgaaaacagtttaagatttggtataaacagaacatttctactcacttataaacagggttctcataaatctctgtggcttctgtactatggtccagaataagaaatgaatgtgaggttggataaagactgaacaccttgctttccctggttgttactatttaagtgaaaaatcttcctcacaattatctgagaatagggacatggaattccttcttatcccatgcaaaaatattggattgatgagtaacttcacctacatcaattaaattagtatgcgtcaggtatttacgatagtatacaccacatggcgctgtgtcagtgccaatcattatacttactgttcacccattattgctatttatcaatgcacatgcgtagatgcacgtactactattagggaatatgaatatgctttggcctcttactatactgacatcatcaaaaccttacattgctcgctctgatatggacataaaaacttacttcctctacacccaccgtgatccattgcccacactcccataccactcactcagcacatcatctatctgccacttgtcttacttaacacttct

SEQ ID NO: 17367 - DNA, 649 bp, Homo sapiens
acgatgcagtctttccagtcccgcagcgccttaccatgaaccacacgaacatcacacactccccctgccaggcccaacatgttcattaggaaaaccatgactttgaatggtaaactgtcacaagagtaacatccttctgaatgagatgggtacatatgaatactgaagagtcatcccctgagaccgccgtccttagaaaggcctgcttggaaaactggactttggctgacatctaaaaacagctctcagagcgttcccagtcaactgttagccaataaaagtggctcacggtgcactagaaacttcgtgcaaataatatggcttatgctgaacacttgctttccttctggaagtctagactgacagaaggtacatatgccaccccccccagtaaaaccctggggcactgagcatctactggactttcctggacataaacattgcacaaatattgctgccttttttgctctggataaagaaagcacttctgtgtgaactcttatcctcgggagagagatacacatgcctggatacagattcctccacagtccttctgtatctttaccctttctgaccattgatatcatacatgttaggcgtgaatacaaccatatgctaaaaaaaaaaaatccgactcatttggcctcac

SEQ ID NO: 17368 - DNA, 827 bp, Homo sapiens
  misc_feature (1)...(827): n = A,T,C or G
cggttgcgaggcggcgaggagaggtcggccgagacaagaagaaaaaaaaaaacatattaacacaccttgtcagaaacagngccaacgtctcaantggaccaaccaggnatcattctggaaagaggaaacagacctttcaaaaaatcacaccacttcctgactgaagaggtgcaaaacagacataagaatgaacaaaaacacggatcaacaatgcactactttataaatgacctaactctggaattctcaaaaatccctaacacactagaaccacccatggacccaaaagaagacatttttataactaaaataggagagacaaacagcctcaccataaaagcaaaggcactacagatcaaataaggaaactggccacgccgaacaaagaacacaaacccaaaccaagcggaagacacagcaaaaaaaggagaaaccaagaccacaaaggaaacggcaaaccatcacaccacatgcccacaaatgatgggcttacacaccataacatcaagacacacgaccaaaggccctcaccccaccccccggaagctactctgcatccactacaacaaacacacccccacaagaaacaacgacgaaacacacaacacaaacaaggaaccaaacattcatacggcacaacgtcaccacacatacaaccaataaaaccagaaaaagacacaaaaaaccattcatacccccaccagtgaaagccaaccacccacccagtcactcaacaaaacgacacgccaagaacccccccggacgacacccccacacgtcccaccatcaaaataactagagatataacaatacctaaaacaaaaaat

SEQ ID NO: 17369 - DNA, 354 bp, Homo sapiens
attgctgtcagactggtcctgaattcctggtctcaagcgatccaactgccttgtcttccaaaagtgctggaaggacttggggcagagcaaggtggcagatagaaggctccactgaccatccactcagcaagcccaccaatttaacatctacaccagcagcattggcgtcagtcactgcacctggctgggattacaggtgtgagtcactgcacctggccaatttatcattttaaatgattgcccagcattctactattgataccagaatttctttagctactctctactgttggatatctagactgctttcaatcttttggctatcataaatattacaatattctattcacaaaa

SEQ ID NO: 17370 - DNA, 838 bp, Homo sapiens
aacaccaatcccagtccgccccatttattttaaaccgacatgaaatgctcctagagcgacaatagacagtttgtgtctgtgccgtattatttttgagggctgtgttctgtttcactgtgactgtatcttcaaagaattgaaaacgctagatgggaaacagaacttataggaagaatcctacaaagcaacttcaataagggaaacataaatctgcaaatgctattctatttaagttcttatatgacactcaacgaaaattattgttcacataaattccaacttatcacactacccctctcattcatacagtcactcctatttttctgccaattccaatacatatccctatattcccctatcaattctcaatcaacttacctcgacccttccctactctctcctctttcattcgtgcgtttctctttttataacggctccgttcccgctttccattgccctccccgtcctctgctttctccccctccctgcgtcaactccccccgtttattgcacactccatgccccgcataatcacacgtcacgacgcactcactgcaggccccccaacaaaaaaaccaacccagaccgacacgacccagcatcgcaaccctacataccgatagttgcgtctctcccgctcctcgtggaccctattcctcccgccttcttcatacgcatagtcatacacatctcacacttattcattcagcttcttccaccactcataatgattgtgaatgatcttgcgtataattcttcatattgccttcctgttctgctccctgtcctccaggtccgagcgtgttcttcacttgtactatcctattttccttcctct

SEQ ID NO: 17371 - DNA, 745 bp, Homo sapiens
  misc_feature (1)...(745): n = A,T,C or G
attangatggaagaacctgtgcagtgtcacttcggggaagctacgtgtcagggtggaagtagaatgaacctgcacatttttaaaacatttttttactttggtccttggaggacccaaggacttgtaaagaagaagaagggggtagactgtgagtttgtagctaaaagaagaagagagatgacccagcaacctagagaagcaggaagaaaatgtgtgttccaccttcctctcctccccagaattctgcagtgcgtggagaagagtagagtggcctccggcctccatgagagggcctgggccagaccctgctgaatgcagagagctatctgcagggtgagcgtccaggcagacaggacccagggtggccgtacaaaagatttccccagtacggtgaggtgtataagtattttttagccatcacttctgaaggagatgactgaactcaattcttcttttgtgaagaggctttgctcctaaggagtctcctgcacttatttttctgtcacagtatacttagcttgcatacgtttactgtcaaggcacgtgtattctttatctgtcctctcatcaattattattctttgattcttactttcccataccatatgctgctggttgttgagtgttctctcttaaggcatggactgttagcgttttgtttactatttggctattttctttatccacacgagggtggttacttcgtctggtttccttccttttactttcttttcttcccttcact

SEQ ID NO: 17372 - DNA, 827 bp, Homo sapiens
ggttcttgccctgttcgggttggcgcccccccccccctgctctcgcctccctacccagcccaccgttaaaccaacaatatccgcacttttgtttggactgtgcagctcgggtcgccttctctgtggaacagcaagtgaagaaagaggcgcagagccgtgtgttccaaaccctggagacaattgagaaagtgggaacccattattccccaagcccagccagcaaaccttaccgatgaaacagataagctctttctgcaggtggggccgacactggccaggacacagtcctctctctcactgccgcgtcccaggttgtttgtgtacacattttttaatttggttacgacttcgtctattcaattcgatcacttttgaagttaaaccgaatttactgaactgggatctataacgtctatcctcttctacatacgacaaagaactatcgcgtcattcattccattatgtttttatctgcacgccttatcattctcctcttactgtttgaatcacccctatattctttctctacacccacctattctcatttattaaacctcactatcaactcctcccactatccatacgggtcgactcactcgtgccaacactgctatttactgatttggttgggaagtctcatctattagtagattacccactcttcccctcccccctgcccgattagtcttaccctaccttatatagtattatcctcacacttcgctttatagcttcatgccttctctattttctacgtagatagtttcctggatttctctttcggttttggtttattttattcgtcttcgttctctttatgcctttct

SEQ ID NO: 17373 - DNA, 739 bp, Homo sapiens
gtaaatgtactggatttgttcagaagctgaatctgcttgttctactggacctattaaatgacaaagatggtcatatatgctatcaccaacttccagagaagactctctactatgagtatcagtgatgtggctttcagtggatctagttattgaagaagcctctgtggaactctgcaagcttggtgcgtgacgggatgaactgtcaatgacaggaactgcacctttggctcgttcaacagtgaatggttccaagatgttcagaagtgctgctactctaaggaaatggctgctcctcattcaaagcaccatcaacttcattttcagttccttcactttgcgaaaaatgtctgactctaatcgaccggcgaacgttctaaccccaaccaatacatgtgttttactcattcatctctctacacaccacctatttccccttacttcctcccccctatttctcctctcccttctaccccacctccctccccgccaaaatcgttcctctcctcacccacttccctcactcccacctcacaattccactctactatatcacacgacgaacatattacaactttattttgtcacacatcatatctaaccaccccatcaactcatatattggtctctctcctcctctcctcacatcttctcgccctctcttcggtctctgtattacacgacccctccttctcactcagacccattgagacatttattattgtacctttagcgccccagc

SEQ ID NO: 17374 - DNA, 275 bp, Homo sapiens
ctgtctcggtccgttcctgttctgtcggtcgtcgcaccatgctacgctggccccgtggccgcgcgccgtttcggcccgtcccttgctaccatttggtaatcaacacacaagtggaactggaagctgtgagttgaagatggccaaccttccatcatccaggcccccataacacccatgtcagaacagagactcctgttaacctggaccttccttggactgtttatatgagcaaaaataaactcccatatgagtaagaaaaaacaaaaaaaaaaaaa

SEQ ID NO: 17375 - DNA, 823 bp, Homo sapiens
  misc_feature (1)...(823): n = A,T,C or G
cggccccggctcagccgggtccgtccgcgccgcccctccctcaccccgccgcacccccgacnacccttcgcctgacacgcaacggcgtgttctcggctcactacaacctccacctcccgggttcaagcgattcttctgcttcagccttctcctgagcagctgggattacaagtgcgcaccatcatgcctggctaatttttgtatttttaatagagacggggtttctccatgttggccaggctcgtctcaaactcctgacctcaggtgatctgcccacctcggcctcccgaagtgctgggattacagatgtgagccactgcacccagcctaaagagaatattttctcaattaaaaacactataggtcttcacaaaagaatctattaaagcgatgagaaatttcaaatatattaactacaaactgcaactttgaaaaataatgcaggctatcgtattaagctctacacacaaatgtcctccacatggtattataaataaatatagctgataaacaccattaaagtttatgaaaatataccagcaataattatcctgcttatgctcttctaattattggcacccattttgacaagttcgccacatgaaccgttattctcacgataacttccatcttggtaaaatgtcagaaaatatactattagattatttttattgctgcaggcaccttttttcgatgagcgtttctttttctagggccacctgccatacctgcgctcgccgcccacaatagtgatgctctatgtacaccaccttcattgaggattagaattgaatcgtacaattgatatctgtatcgtaaatct

SEQ ID NO: 17376 - DNA, 831 bp, Homo sapiens
ttgcttgttttttttgatcttattctatttcctttttgacacgcattattacgcacactttttcagaaccgtctaatagttgtgcaatgtgagaacataaatacaagcttcccttctctcaattggattcaactttgaaggtcaatcacagcttcagaactcgccagaagtccaactgaagtcagaagttggaggcacctgtagtctacgtgggaaaacagatctagggcaacatcttagctgtactcttctaaacctggatgttggaggaatttatcagtttaggaatcctcagcaggttgttcataatagggatgatgaaaatgataatagcaatgatagttgatatagttttgcggtccccccacccaaatctcatcttgaattcccatatattgtgggagggacctggtggaaggtaattgaatcatggggatggtctttcctgtgctgttatcattacagtgattaagtctcatgagacctgatggttttataaggaggagtttccctgcacaagctttctctttgcctgttgccatccatggggacttactgctccttgccttccaccatgattattaggcctccacaagcatgtgcaattgtgagagcattacatcctcttccttttgtgaaaaaaaaaaatagtgacttgatggactaatcggtggactctctgagatcgatatcgtatactgagggtatttcgatgacactccgtcactgtctccatttccacgctggtattgctgttgttaattaaatctctccctctcttgcctctattcgtcacacctacatcctaggtatttctcatatagacccctc

SEQ ID NO: 17377 - DNA, 698 bp, Homo sapiens
cctggaagaagagaaaaaactgtaccttaatgagtacaacttttataacaagaaaaggggatgaacctccttaatgctacaggaacagcttggttatgatgtcaccaattgtttcaaagaagcatgacaacatgacaacctaacctcaagaagccaaggtgctccctgaggccaaccatttttcctccatgaagcattccttaacgtagaaatcctgcttaaattccccccaatccattctgaattaagtgttctcatctgtgtatccctcccatagcgttttctcagtaccttttgtagcatttttcatactctaataatctgtaactcgtataatcttctccttttagaccaccctcaaatatcttactttcagtcctcaaagcttagaacagtactctaagcactaacttaatggtggttgaggaaatgataaacaactattaaagaaatgaacgaatcatcccaaacacacaacaccacccaccacaaaaatttcccccccccaccaccacccatcggttcgcagggaaataaccccattgggcctccctgcccctaccgggggaacttcgccgccgttcccctttagggagggttaatcaatgaatccccctcaccgaccccttcccctcgatcgaaccgttgcggtaacggcaatacttttattaaaggcggcaatccgacatcgaaaaagt

SEQ ID NO: 17378 - DNA, 721 bp, Homo sapiens
gactcctctcctagtcagaaggctgtactctgaatgctgatattagctacaacaccaaggcttcccactatacaaactggatcctcaaagtcatccacaccaaatgaactctctattctttctcccagtagcctgagaactgggtttaccagccttggcccttcctttccttctagcctcaaaacaggatgggaacagagtctttggctgtgagaatgggctcaataacaaaataaagatgacagaagagtcagtgacttcaatgacagagcgatagaaattaccaatataaacggagagaaaagagattttttaaaaatgaacaaatccccaaggacctgtgagacaataactgtgttaggttttctaaacttacaagcgttgttatttatatatgggaagcaactatgcactatttgcgtcagaattattttttgcgcgtatttaaggtctactcaccgcaattcatgtcaaaacctgtcgcccaccttccacctccgcataatctgcgtcctgcccccacaatggcgcgttgctgttccctcgcttccccggaactccttgcccccattgcaaactaacgcgctcgggtgatacttcctgcacacagagcccgcttatttgcgttcaagatgaccactttcaccaatatcctcacattcctctttctcatcagtctcctcttatccgtccatcgcgacctcatccatctcttaccgat

SEQ ID NO: 17379 - DNA, 167 bp, Homo sapiens
ttctggattcactaaactatactcttattctgtaccgggaagttctatactgttgctttaatccttggtgctgtttatttcaaccaagatacaccttgaagacaatctgcctgcaacactcataatccctgaatggatagcacccaataaatgagagaacatcaaaa

SEQ ID NO: 17380 - DNA, 693 bp, Homo sapiens
tcggaccctattactctgggtctctcctgcccctggaaatatcaccagtggaggctgtagaccagcaaagatggcagcctgctctttcctctgggagctttgtcccagaggggcactggcctgatgccccccggaacgttcctgtatgaggtgtctggagaattttaaaatacatttttaaaccaatgaatgtagtgtttgtcatgcatatagataaattttgtatatatgtataatatacatgtatacatatgtgtgtatacatatacacataaagaaagagagagaggaatgagagatagaatctattttatctgtatttgtcaattaaaaaataaaatagagagaataaaaggatacaactttaatatggtcattcaattacactcccaatactctgtgaaattgagtcagcagcagaactaaataaactagaataaactaggattgtacatatgctgaaacccacttaataatgccataatctacaggaattggtgacaactgtataatcacctattaattttgatagtgcttcatatctccaaacatatttggaaagttacagcaaaatctggacctgagtttgctgcgcaaatgccattcttcaggtgtattcatgtaaaaaatttctgaatacgcgtttaaaaaaaaaactcttctccttcgctctcaccgcggcactctgccggc

SEQ ID NO: 17381 - DNA, 426 bp, Homo sapiens
atccgggatgggctgtgctgtgctctctcagtacacctcaccacaaggatactccccctgagactgaatgggccatccaacatcaatcaatttactttgtgactagtttgccaaccacaggagccccaacctttgatgagtcttgcttcttcacccaggatggagtgcactgacacgatctcagctcactgcaacctcagcgtcctggattcaagcaattctcctgcctcagcctcccaagtagctgggattacaggcacgtgccagcacgctcagctaatttttgtatttttagtagagacggggtttactgtgttggccaggctggtcaagtgatctgctcgcctcggcctttcaaagtgctgggattacaggcatgagccactgcgcccggccaataaaaagaatttttaagatatgctaaaa

SEQ ID NO: 17382 - DNA, 889 bp, Homo sapiens
ttcccattccccatctcccctcccccctcaaatacacgttcccgttgtccccctcatctcctttcccctctccgacaggaaatattttgtcatctcaaaagtcttggatataaaaattcagtctgtgtggcagggaacagctcactcctgactggttgaagataggaggttgaagaaataaatgaacttgaagcagacttgaagtttcatgcctgagatcctaaagtaagataatgtttgtaaggcggattgctcatcaagacgccttattagtaagattgtcctaattcgaatgtattccttggctgaccaacccttcccgatttacgagctgcgctacctcctccctcaacatacgcgagttatcggacccggatcgcccccccgcttgcgcttcctcttccacctttcccacgggcgcgcataccgaccgtcctccgtactcgtaaatacgctgggccattccgaccttacgtttttttgtcctatctttttctttctcctccccccatactgatcgctatctttccccgtctccatttatttttcccgcgattcgtttcctcaccccttccatcccttgctcctctcctcccctcctcttctccttcacacaccctctccttcccatctgtatatgttttcttactcttcgttgcttaccccagctactcgtccacttttgttttccttacctcccactgttctcgcaactcccccatcctgcttatttttcccccgtcccactttccacatctccaccccttatcctcccattttttatcgtcctcgtacatccctctattcaccctattaccctctcctcccgctttaccctatctttattatcattctatattttcctccctcccatccctctcttcctcat

SEQ ID NO: 17383 - DNA, 810 bp, Homo sapiens
ctccctcccccccccccacccccccccagcacgtcttccccgtgtacatgattctgcaccttctcttgcaacttcaccaaatttactgtattccatcagcaacaaaatcctgcattttgtggttcatttatttggaattgatttagctgcacctggatccaagctgatttgccttcaatctcccagacttaactgttgaagtctatagcacattaagcatttaggtctacagagtcacagccattcactgacccggctctaattttcacttggagttagtactttttgatatgggatttgtgaaaaggcaaaaatatttgtcagacacccactgccaggaatgctgattctaatttcgtgacttctactgcagaaaaaaaaaaaaggtaattttcccacttggagctcttatccatggatatcaggctacaatattttccccagaggtatgtttcctgcttaattcttttggcaaaccttacatggcggacccaactgaatctttagtgccttcatggaatttctgccctttgaccacccacaccaaggactcttttccgtttacgaatggcactcccctccctccccccccgccctccaaaatttttctattcccggccacccccccgctccgtccctgtgtcgccgcgccccctgttacccattcaccttccccatcgcgacccccgcagatccaactgccaccctttgccaccatttaatcctcctttgatcacctttacccgaagcgcccctatccctatcccccgacggccgcttcctgcatgccgccggctcatcgtctgctat

SEQ ID NO: 17384 - DNA, 757 bp, Homo sapiens
tggtctctaggattcgcaacaggggcaaaaatcctcatcccaggcaaatccaggggcctcaccagcacagagctccaaccactcacctgagcatcaagggacaagaaccaacacagaatgcccattgtgggtttagagaaggaagggcagcatctaagaggtccagaccgtggcatccacagcaggcatgatgatacatgctgaccctgcccttgacctaattcaacatccaattgtgcctatatccaagaaaaacaaatggagatattttgctacctgttaatctcattgatttcactgtaaacactcattaaaatggtttctctgtcctgaaaaaaaaacaatcgactctttggactaaaccgtggaccctcgcacacgccttcctttagagacggttcattcctgatccccaccatctgactccttaagcacggaaggcgggattgacgccgcctcgccccccccccccgcccgtcccttcccccaccctcttctccccattccgactcctcctcccccctcccctccctgccttaattctgccccactcatggcctagacttccgattgccgttccttctactcaccttttttccacattctccccatccccttttctccccctccctctacctttcatcctcagtttctcttcgattttatcctctttattttcctattttcctcagttgcccttctacccacttcccccatcaccccactccaacccccccccatccccatgtctagccct

SEQ ID NO: 17385 - DNA, 879 bp, Homo sapiens
  misc_feature (1)...(879): n = A,T,C or G
atataaacccccgtattccttctttcccatcacttcgccttccccctgtgtatttcncttatcaccttaagagaagaacagaccaaaatatactctgctccaccgaactcttagagcatcagtgggaatcacgtgactcagtcattcactcaccaagtgtgtgtggagtgcccatgacatgccagcccctctttcaggagccagagatagagaatggagttccaagcagcagctgaaaggtgttgctacctgcgatctgacatatagccccaaattattagttggctcttaaccttgtacatgcatcagaatttcctggatagcggcttaaaacattaatgtggtgggatccactcccaatgcggcccgacattcatgttgtttggttcgccttatattctgctcatctgttttcccaaccctctcctttctggttctttatcctacttttttcttagataccaccgcgccaccccaatttgcttccggcctgcattccttgcctccccctgttccttcacccatttttccacgcctccatctccttgtcccctattcttcttccccccccgcccgctccgaccatccactcatactttcaccttccccttccactccatccctttaccatcctccttattttttgtctctctctcgctcccccgcgttcaaatccccatttcctcctcatcgccgactttccttattcccccgtttctcgttcgtttcccccgtctctgttccgtttgccgccttcagtacccgccgattgtgttccctctcctctcttctactatttccctattttcgattatcttccctttttccctccatctctccatttcctttctttcccccccctcttcctctcgtccccct

SEQ ID NO: 17386 - DNA, 858 bp, Homo sapiens
tgtttcttccacttccctccgccccacagtgagtctttccccgtgtaatccttcctaaaacctcagcctaaaacacaaaaagttctattactaccgactaaccacaatctgcaaacacaaagcttttatttcttaagggagcccactctatctcttggcctctctgtacacccaacatagactctggaccccatggccacttccttctggtatggcaagaaaaatgagagacatccacattctccatgagaagggcccaaactgctattgaaatatgaaggcgcaaagtatgccagtggaactcgtagactcaacctatacaaccacaccgtgagaacagaaacgctcgaatggtctattggcgtgccttggtgttttttgtaccctcgaaaaatcgtcgctttttacgttcgccgcccaccgattagaaaactaggaactacttctaagaatttcccactgcggcgctaatgggcccgcccacgaaagataatctaccacaaatcttattccctaaaacttggaactcaatttagtccaccttcaagtccccctccccggttccaaaacgcgttcacgagagactaaccgatacagctaccccgagacaatattgattttttcccccccccataccctcacagccgtacacgaggtattgttctccacgcgaacatgcgtccgcctgcccccaacccacatataacccccacctcacctttccaatatgcacgcccgtttcaccggtattgatctttctcgtagtacggaattcgtcaagtatccattcccttcccattttcacccccgtctttcctttaccaaatcatccacgaccgctaatcacatatatcctaa

SEQ ID NO: 17387 - DNA, 817 bp, Homo sapiens
  misc_feature (1)...(817): n = A,T,C or G
gcgccccgcggcgngggggtcgcccggcccccgccttgttattaatatggtcggttattcaaccaggggccctatcatcttagggcaacacaagagtcttggagctctatggcaacaaaatggtgtgcaaggcaggcttatcactaagggccccaatacaatgtagcaaggtggcttaccatctaacctcaagtgattcttcaaaagcagacataaaaaaccagagcacccaagataaacaagaaggggctatttgaaaaggctgttagaccctgggatccctgagctgtactgatgctaaaatggatatggacactggatgccaagaattccttttttttgggcattcaacccacatcatttacggttcaaacacaaagaccccgcactccaatgcactcccgacggcaccaaaacatcgtgagacatatcgtcacacccccctaataaaatcccataacctcacacccccctcacccccacgatacccccccttctcactaacgtcattaccttccccccccttgcaaaccaaccctcactcacacacaacttataccatacatcccctcctacatcgattactcctctttcctcacgcatgaaaaaaattttttcataaccccccccacgcaaccccaattaccactgtcattgccaaaaacaccaacacgacaaatttataaattatctacccccactcaatacattacgtataacttcctataccctaacaccacccccactacacacctcaataattatattatttataaaaaattaattacctccgccccccatcacccgcccccccccc

SEQ ID NO: 17388 - DNA, 864 bp, Homo sapiens
  misc_feature (1)...(864): n = A,T,C or G
aagggaaaaanannnncaaaaanaaagaggaccgggaacgaaggaaggggtgtggtgtgtatttagggggttaaaaaaactgcacgggaaaaaactggcagctgctgtaagcactgacgtggccaaaatcaaacacatcttaccttttccgtggagccatagactgttagagctcaagggcttccagtcatgaagatgagaagcctaagaccccaggggctaaggaagtcactcggctgtggcagttggtagccaaaccaagactagagttcggatctaggaagcgaagtgatttggtgcactggattttgtattctgtgaatgtacccagaaatgagtgatatgaacatgcgacggttcagcttgcctggacatgtaaactaagctaatacgagcgccctgcagagtgatggggtgccttccttcttctacctccctcactcttccctgccattaacccgaccatacaaacctccgcccgttccccagctctgagcgcagacccattctcgccccccgccgccttctctcttccctttcttgaccggctcacgccgttaccgctactcgccgcactctccgcccatatgcgctgtcttcctcacccttccgctccttcccctgatttgtgtgatgtagattgataattcttgtccgcccaccctaatagattttagatttcgttaatcagccccgcactccgccatcccgcgcgtaactacactatcacactcccattcatattcattcactagtactctgtgttcattgaaaccgccccctccacctctcgccgcatatatttttttgtcttttttttttaattcactaccgaccgaccacgcgctcccgcgcccacgcccc

SEQ ID NO: 17389 - DNA, 707 bp, Homo sapiens
  misc_feature (1)...(707): n = A,T,C or G
aattaaatatcataactccccactccattcctcaggagaaaaggtcatgaaaggagcatctgcagtttctctgtgtcctccactcactcctctccaggaccagcagatgactgatctgatggctgggcttcagagatggacctgtgtgtgactggcttaattctttccaggttctctccaatcaaaaacaacctgtctaaccacgcatacaaactttgtttttggcttggaggctcacgctttgttcctataagaggaacaccttcgttacacttgatttgttattatgagggggaggcccccctcaccaggaccactcttcagtgccttccccccccgctttttttccttttgtctttgcgttctccgttttctttactccagtctctcgctttgttttttgtcgattataatttgcccgtgctgtccgtacagctctaaaccacacctatcttatataaatataagagggaagtacacnacccagttttattttgttttcctaccaccccccccaccaaaaaccccatcttctccccaccactcatttcaagtcgccttcctttgtccccgtccccctcccctttcatacactcatgatatctcgaagaatgtgcccaacggacccccgcaccacgccaaccaacttccttttttatttttaaataagataacgaaaagttctctcgatccccgcgccgaaccat

SEQ ID NO: 17390 - DNA, 288 bp, Homo sapiens
tttgtttgtgggggtcgggtttattttttatttagtacttgtttgtggcttttgtttcgcatctatttggatacaaacccagcaaggttcctattttaaaatcctggctgatagtagcggctcgtgcctgcaatcccagcactttggagtctgaattggaaggatctcttgaggacaggagttcaagaccagcctgggcaacatggagaaacccctgtgtctacaaaaacgtttttagttaaaaataaataaataaaattctgcgattccaaagtaaaaaaaaaaaaa

SEQ ID NO: 17391 - DNA, 758 bp, Homo sapiens
tagcccagtgttcgtctcacaagctggatattaaaaaaataaaaaaaaagcaggaaccatgatcttcagtttttctctagaaataaatatccacactttggatatagaaaaaaagtgcttaaatgaggttttctgtttccactgcaacaaaatatactgatatattttaacagtgcctaagagacaatattttaaaggggtagattttgctgctaatgtaacctgaaaatcctcaataattagagggttagcatattctaggatgtatatatcaaaaattgtgttatgtttcaacattttaagcatgcatgcatgtatatgtagacacaaatgttccaaataattttcattgtcattgtatagattctacagtatttcttgacatttttatgcacttgacaaaacaactgcagaaacatttattggttaatttacgctttaggattttattgtcagcggacattcgctaactggctatcacccatttttttttttttatccgtacaaagaccttaaaattgcaatgtattttttttattttatttacccccaaagccgatatatatttacttttttggtcttctcttgggggggtggaaagacacacaacacacagccgctccgcctattaatatttattagatttctttggttttcttgtaatccgtctcccgctcaccgctccgcgcttaacgtttattgtatttttaaataatatacaaggaaacggacgcgcctgcgcgcgccatactctcctg

SEQ ID NO: 17392 - DNA, 842 bp, Homo sapiens
  misc_feature (1)...(842): n = A,T,C or G
gaaaaaaaaaaannnnnnnannnnaaagggngagggacgcaagcgaanaaagagagatagtttatggggtttgnaggacgaacgaccaccggatttgaggcctatctggccacttatgccgacgaagatcggcttattcttattttattgataagagcaggagctattattcttctgaatctttactaaattcagattctttatatgaactaaattaataatcaccctttgaaaacttctatgatgtagacattgcctaacttacagatgtggaaacggtagttccagtctaaaacgcctatgaatggaaaaaatattgtcgctgcataatgcccagcaaaaaagatcaaaatgtgatatttcctgagagccttttatgctgagagctgaacttctcaaacacacccattcattttctaaaacagcatcctactctaatgagaataccatcgagtatttcaacgatttgagacccttatgggcgcccaaaatatgttgtgactcgtcatcgaataccacggtactcccccgcgcctttgcgcatagaccccacactgccggccctgttgacccccatggtggacctctccttccgcgtcatgagaagagggatgacacgcgtcctggtttgcatgctcaatgtcctcccacgggccctgtcggcttgcgtttctacatcccacaggcaccgcaccgggccctcttcacatgaagccgcacccatgaataaccatcataggtctcagagtggtcgtatccgagggcgaaaccacggcaccagtaatttttttttattttttatttttcctatatcagccacaccgatcccacgccccccaccc

SEQ ID NO: 17393 - DNA, 826 bp, Homo sapiens
ttttaaaaaaaattaagattggtcccgcgcggcctgtgtgggggatagcgatttcgcagaaacgtctcctctgttgctgaggctgcatgaatggcagaatatagctctctgcaaccttgcactcctgggctaaagcaatcctgataccttaggctgtcgaggagctgggactataggaatacgccactgtacctggcactccatatttgggtgaatgaagtggggagatgatgagctacccatagcggactcgctcaggaccacaaatagctatttgatactttgagcgccacattatcactgcgtttcccaaacacagatacaccccacccgtgtttccacttaaccctgaccggcaaaccgcgcccttattacatgtccatacctgaactacccaaactctaaacagaaaaaaggatccacgaaaaggatagacttatgcgtaaccacagcaaccactgaatcaccgacgcgcacatcggcgcgccgaggtgatatgtttaaccgtacatttcgcccgacctatatttgagatatgtaacgaccaggccctcgcgcctttcttatttagggcacgcttcagcgacgcagagacgacatatatccgcccgcgccataagctgacgcgcgaagcatcccgtactatggcgtcggtcgatatagttgcccttgtaatctgcctcatccttaagggtcatccggtgatttccctgccgaagaaaactctcctactacagcgaagggtatttaagtattcgcagcgtggtcccaccaccactattccccccccccccctatatatcactcccgcccccacgccccacct

SEQ ID NO: 17394 - DNA, 821 bp, Homo sapiens
  misc_feature (1)...(821): n = A,T,C or G
atagtgtggggaagttgattggttccaccaccatatttgccttattgttcnggaggatttaggtgtacatcggttgccctgnctgcagtgcactggcaccacctcagcttactgcaacctccacctttagggctcaagcgactcccccgacctcagcttcctgagtagctggaactacaggaacatgcctgcatggccagtgcaccatgcctggctaatttttttttttttttttttttttttttgcagagacagggtttctctgtgttacccacgctggtctttaacatctgggttcaggtgatctgcccacctaatcctttcaaagtggtgggattacaggcctgaacccccatgaccagcccacaaattctttacagaatatgacgcatctaacaccaaaccctggggctgagtttagcctataagttagaggctactcatcgaatagttccccggtcgctgcatcccatgttaccaccccgtatgtgtatctcttaaatttatttccatataactctaagatccccatatttctatatcgttatttatccccccagccctcgcctcttatcttttctcccccccgctgtgtgctggcctatccggatgggaaacaacccccttattcttggtccccactcttcgcctgctgttccctccttctttttacctcggcgacgcttctccactaaaagaactgacgcatgttatagctcgttgtttctcgacattcgacgcatctgttaatcttatcaccactattgttcagccagtccattcctcccccctcctttaaatatctacacaaccctacaacc

SEQ ID NO: 17395 - DNA, 375 bp, Homo sapiens
  misc_feature (1)...(375): n = A,T,C or G
atgaagtagagattgtgaatntggtccnccctcttccacctctagggtgttaggggagattcttgaggacccgggcatccttcatggcctataccctgtgtctttattctgaacagaacagggcatttttgggaaaatgctggctgctcagctagctcacttaaaaaaaatcacgctagcctgatggatgatgagagacatgtggaatagagcagagtcaccacattcatctcagctgagacctttctagatgggtcaacagccctctacccccagacgtgtgagccagcccagccaagatcagccaagtccaacctgaataattgaacactgaggccttgttgcacaataaaagtgtattattgcaacccacaa

SEQ ID NO: 17396 - DNA, 742 bp, Homo sapiens
tgacacgaaataagcatatggatccgtgaatgtacccttcctcctctgctgcattctgaaaggaaagtcagaagctcgtcaaacttagaacttgaagctaagctaagacaccctcggcaatgcaggggaaaagtaggaatgagaacaaaatgaaaaatcctgaagaaaccactctgggggaagaagtcaacaaagaaattataccactatgaggctcatgaagcccgtgcaggccaaaaaccttgttcctaaaagctacccatgtgtggttgctaatgctcaggaaatgtgattagctgccagagaaaggcctacaattactcccattctgactacatcactggataactacatagcaatcccctctaccctgactgcgattgctccattcaaagtggccgccgccatttaaatatctgaaccccccccaaatctccttcttttactgtctcatcttggcccgcccccccgccgctctttgttaattacaaaactagggtgatgtggcaaggaggatccttatcagcgcatctctttcacagcctccccgcgttctctttccttctctgttcatatcctttcatcgctatctttcttccaatcatttacatcatcccctctttttgttcttctttctctttttttttctccacttcttctattattttatttcttttctatcttcccgtgcgtatgtttttcctcccccccccttatatatctttcgtcgcccccccccctc

SEQ ID NO: 17397 - DNA, 792 bp, Homo sapiens
  misc_feature (1)...(792): n = A,T,C or G
tttagggccngggtccggttccaccccattaattatatatctctttcaagcccactcaggggccagaattcctcttgtttccagacacactccgtgaccccatgagctcctcaggacaggtatgatgtcaccatcatttttgtgtcttcaactcctccacctcatagattctcagtgaatgtttgctgaatcagtagcgccagcttcacatgctttagaggcagaagatacaagctggaatctcaactccagcacttaatagctttgtgatcttagatcgtcaatgatgaagcatgcagtaaataaccccccctccatggaagtgaagacagcctgtgggggagaactggctccattaaaggctccaagccacacgagttgctttctccggagatgatgaacgcgggctggaaaaagagacaacagttacctacttggtgcggttgtttccccccaaactggtggaagttctttaccctctaattttatgttttttagagagctgttccacggccctattgcaccagtaaaaaacaccccgctcctttgtccttattatggaactacgatgactatctcatttatctgtagttcactcgtcgatcctggctgactgactctctgttcatttccgcccatcttgattccagggttcctcctatgcactatgcgactttcctgtattcccacaattggtggcgtcctttcagtaaaatgtatcagtttaccgcctccttcaccacccccgcctattcccccccccccctaatattctcccccccccccccccct

SEQ ID NO: 17398 - DNA, 742 bp, Homo sapiens
cccttcctagagcagatttggtttggagcaaatgcatgaagagtggatgcagatgacacagagaaacactctccccctttttacagtttatatcaggctgcctctaagcagcctggccacagagaagacaatcttttcagatactttgagaccagacaacatgctaacatgctccctgggcatggacctggagccatgagggtgaggaggaagaagaaaaggcataaggaggagagaagaacgttccccagaaactcccctgctctccagagcagcagccaccagtttctgaacttcagctcctaggaattttaaaagctatctacacaatgagtcatattttataacatgcttatgttttaaccatgatgcccttccctgcaatccttgctgtggccactcaggctcatgggctggtgcctgaagtcagaagggagaagggtgtctgagtcctctcatccaatccccatacttcaggttggtcagtctcacggacccagaaagcccagagaccctcaacgttagccgtaaaaaaaggctcatgctcttcccgaatccaactcgacttctttttctcccaggactactaaggagataggctgtggttgaaatggggtttctgaaaaggactaagagtcaccttgaactactgctatccattgaactgaatcaacttacctgtgaggtagagaacaagctctaggctagaaagaatataaatggaaccgactcttccaaaaaa

SEQ ID NO: 17399 - DNA, 815 bp, Homo sapiens
  misc_feature (1)...(815): n = A,T,C or G
gtccctccgccctnttntttnnntctatcctcactgtgtaaccttagtcccaccctctngcggaattggcggnaacaaatgaagagtctttcaataaagcaggtgccacttcttcctgccaaattctgccctggtattaaaagcagcccacctaacgacaagacccaggcagacaaatacagcaatggaacagaagaacagaagagttctgaaacagacccacagatgtacagtcacttgatgtatgacaaaagtaatgctgtaatgaagtgggaaaaagatggacacttcaatcaatagtcctgcaaaaaaaaattcagaaagactattgacttctacctcacaccatacacaaattcaattacagatcaggtgaatatctagatatgaaagatgaaaactatgaagcttgtggaaggaaatacatgagaatattttgactacttcgaggtgggccaaaactaattaaatggagcaagcgaggggctatgttctggaccataatattattttgtggccctcatttccctgacatgccttttttaccaataggatacaacgggttcctggttcgttatcgcgcgcgagaagacgcgtgccctccgtgttcgcatccggcggccccttgctctggcggcgctggcaccgggcggtgttcatcttctaatggtatgcaattcgtcgtctgtatgttgggtcgccgcgcgtttgggagacgtgccacgcggcttttagctgtcttttcactcctattcgttcttcggcgcggggggtgttcgtcggcccgcttaatttagagccgggccgtgccgggg

SEQ ID NO: 17400 - DNA, 708 bp, Homo sapiens
agacatcgtcaggcagaagagagagcctttccgtgtatgggccaggagatcattgtgctttctgctttgaggaagaggatgagctaaacaggaaaatcctttgggccacacgtgcaccgtgtggttcatggattctaatcagaatgcctttttagaacggtccatttaattaaattttgtgagaaaagactagcctggggtttataggttcctggctcaaggtgtaacatgtccaatacgataccacatgacaaaattctaaaaattttctttagttaaactgtttcccacaccctgttttgtgaaccagacagtaagtttggtgataacaggtttgtatttgcagtaaaagagtgtttagtgcttaagaataaactttataactaagtcttagctttcgagcttataaactatctttaggcaaagcagcttacctataaggacctcggttgccacattataaaaatatgttgtataacaatgatcgtaacattaataccatattgcttcatcgttgttgctggggattcaaatatgttccattcgtaaagctcatgaaagaatgtttccatattctatctctttgctattatacctgtgatctccttctacatgcattaacaatatttagtctctttcgtcattacgtggattcttcgcgccgctttcttttgcccggcgttatattattttcgcccctccccccac

SEQ ID NO: 17401 - DNA, 812 bp, Homo sapiens
  misc_feature (1)...(812): n = A,T,C or G
attttaattgttgttttcgatnttttttcgcgccgcgccaaccccgggtgattaaaaaagcttatgagaactgcctactttgcncggtagcgccctgatccacccaccaggtttgccactgatccattctaaaggttagtcggcactgaaatcaatcttgcaaaccattgaaaccaacaaggacttgcaacttcatctagagacagttatatgtttttatcatagtgggaacaaaaagtgtaaagatttatatacagaatattcaacattgaaagcaattgcactgagtcatcttaagtaattatattgatatcctgacagctgtgtataaatgttggcttcaaaactttatacaatgaccatgttatatctacccttgaactaacttgatactcttaatacttatgaaggtgggtcttcatcccttggcacttaccacatgttaatactgaaaactacatcattacacctttgaaatttcacatgcattaaacagactgatgtgtatgaggttcttcactaaaattgttgaattctattgatgggaagctagtgtttatatttttgaacatgctttgatctgtatatataggatttctttttcaggagacagtatgcatgattacatggagaacgtgcctttactattcctgggaggttataacatttgtttatcttagtttttctctactgtcctctctttatagcctattatgcctcttattcttctttcatgtatgatttaactctttctatgtcccccccaccttttcccggacccccctttttaaatcttcccccccccccccccc

SEQ ID NO: 17402 - DNA, 810 bp, Homo sapiens
attgaagccggaatcagtcaccttcccttcatactatcaatccttctaaaagaattcaggtctatgccttcaaatttccctaccagagaagcattatccatctctggtactggcaagggctaaactcagacttttgttgatggcatctggatgcaatcgtctttgagtacatcagcttgttgcaggataacacagagcactatcattgactctcatcgcggcaaagcagatgttccttggccttgtacaagccccacctgcaccactctggatgtccttgactgcgagacacacagtcaagaggtcctaatggcaatcacttgagctctctcaaactgcagtgccacttttaatttgtgtgctttaaaccgctatgttcctggccaactgtgtctcaatgccaattaagcgacagtccccttttcgtcgggttacatagatttgtttctcctggtcgataaatctcgcttccatccccactttttaagtcccgcattatcttcttatttccctcctattcccctccacataatcaacattatttaccccaccccctgcccctatacctgttttcgttacatactgctataagtaggccagtcctaacaccgcgcccttctgttgtgtgatatcattacgatgtcgtgttcatccccttcatctccgcccaacctccctctcctattcggtacttccctcctttgttcttttgttcccgttgaattaaataacttatcatacaaaacccccacttgcttccgccccctccttgcccccccccccttaataacccccccccccgcccccccc

SEQ ID NO: 17403 - DNA, 713 bp, Homo sapiens
  misc_feature (1)...(713): n = A,T,C or G
ccttctcttcngcttctccatttttcagtccccacagatctccaccattctcccactgacttgatactggacaaagtgcaacaaaagaggattccaatggcagtggtttgaagttgataattaattacataaagtcacatttggaatgaatagcaccaatgatcctcgtccaaaggaacagctattattccctcaatttcctatcaagacaacctgcaaaatattcttgataaagtgagaagagatttactaagaattttatttattttctaaacttaagaatagaaagtatgggtataacatctgagaaggcacctcacaatgttttgatctgattcctaatttttacctctataaaaatagactaactttgtgacttgttaactcaataattgtgtaaatcaaaattcatgatcattaaaatttatggcctataacccacctatccctgttcatatgttacttaaaatagatcgatgctattataacacttggttaacaaatgtctactgcctcgaatacacctcagttctaccttgtacatttctgtgtcacctatttaactcaagctcagtgatttcgtctgcagtatatacggtgtactctcctgcaaatcaccttctacttatatttccgtttgctctccatttcttcctactacattattgtctccccccccctcttaatattactcacacccacccactcactag

SEQ ID NO: 17404 - DNA, 901 bp, Homo sapiens
  misc_feature (1)...(901): n = A,T,C or G
tttatttattttattttttatcttggtcgggggaaggggaggagggnggtggggggtcctttgcaggaaactangagggcattttcctgcacaaactgaggaatatacaaaagaggaagaagacataagattacggaacactggggatccaacctaggaatcgtacccagcctagagagcaacctatccagagcaggagctctctagaaaggaagaagcggggataagagcacatcacagaaaccaggggaggaacaacaccgactgagccgcgcgggcagggagctgcttgggtgattcccctgatttggtcgctgtctcgacggatgatttctgcgctgccatcgtttgcccttgacggatcgcgccataccagcccctttttttcgcctcccttccctttcgctaaactacatatcattcatgtactcgatcgggcgtcgatcatctatttattgcgtagcgcttcctattccaagaatctcctcccgcttttttcgccgcacacatttttttatgcttattatcgcagcgcaattcccgctgtcccacttcttcatatatcttgtctcggcggcccggggccgcgcgcttcccttctctcgcgtgacttcgcatccctacagagaccgccgggtgcataagacccagcgcgcttccgaatgcgctacctccgcgttttcgccaactctctaccgacacccctgggcctcggcgctatgccctcccgcccgcaccagtcgcgctgcgtgcgcgaggtataggtctgcgcgtttgctatgatgtatcaatcatgcgcgtccttgtgtgactgagaagtacacgacgaatgctcacgccgcgagcggctttccgcccgccgcccgcgtaataacacctcccccccgcccgctccgccgcc

SEQ ID NO: 17405 - DNA, 1036 bp, Homo sapiens
  misc_feature (1)...(1036): n = A,T,C or G
tctcaatctctaattccttccattatcgtattttaaccgtcgcccccgaaaccatttgcgcgccctccacgaccccgaacactcgtttagcaacaacaggactcgctctggtactggtcacctaccctttaaaaatccacccttgctgctgttgaggtgcaatccttcataagaatgaacatgaaccgcatcaacactgccttctttctaaacgaccaaactgtggaattttaaaaaacccctcacacactcgccccccccgggcccccatctgcgcctatggggattattatatagcggccgagatacttcgtccactcatccatcagatcgcatcgtgttcttaccccgacctatactcagggcgatcgtgcgccggtgttattaaagaaagcaacacagagacctcatcctgtaacgtggtatcgacaccttcgaactacttatgtcgaagaaatcacactgtctcatcaattgaggatagaggtgcactcacctctcgtagtacacccttctcgccattantgtacagggagtacggcgtccacaacaccacatcagtccttccatgtcactacagcatccagtcatggtacacgacgtagtgtccacacctcccacctcattcattaagcggtgcgctgttccgcgtatacaatcattcatcgccgacaatatatcatcgctcgattattctgtcgatccccacttgcgtggtatatccccacgtacgtacgttcccgctctccccgccccgttatgctcccgcgcttagtatcgcccgtcccggtcgtgtccgtcgccccgatcccgattcgcatggttccgcgatgtcgtatcgagggtcatatagatcttatattcgccgattactcgcccgtacatgtcgattattcgtttatcgtatccgactgatccggtatctgtcgctcttcccatcccgcgtctacattcgccacccccttcatattttttcgtgcatattccgccgatcccttccgtcctgtcgacttcgtccgtactagcgtcattttcc

SEQ ID NO: 17406 - DNA, 719 bp, Homo sapiens
  misc_feature (1)...(719): n = A,T,C or G
gactgacccacttttgtccgttgatctatcacagcagttggggaccctgggacaattccttcatgatctagagcgctgaagcgcaggatcttgctgacaacatcagaaaaagactatctctaccatccacactacagaaaaactttggagccttgaaccttgggttcataatctcacaatggagaggggcccctccacactcctagaactgcacatacattggaacccttagggtaacactaaccacgaaagtttctccccagaagaagatggcattcttgatgtaaactgcttttcccaagatcactaatcaacacttctactatcgagagacttatctttgaatatattttccttgcgtatgtccctgaccaacacatacgaaaagggggtctattatgcgcatctatttatagggtgcatccctatctgcgagggactctgtacccccccttacatacgacttaccatattctcccacacattacataccaccgatcaccccccgtgaaacaccacgggtgtccacacgcctcctccttctcatcccatctctctgtcatatcaccttttgcgcgatacgacactctcccgttacgttttctctcgtctatccccactctctcctccttccctctcttattcgctcccccntcttattgtcctcgttcaccccgtcccttccgtcgtgtcgtctcctcctttccatgttttttccg

SEQ ID NO: 17407 - DNA, 663 bp, Homo sapiens
tttgggaacacctaccttcatattgtcgcctacacagtcccccaggcagattcctgacctatggtcagtaaaaaatgtcactttctaacaggtccacgtgctccaagcttatcttacgaactaagaggaaaggatcacccaactacagcatctggtggaggcaaatgagtatactacccattggaatggcggatagcaattaaactccaaatggtgctgcacacacaaccatgcatcaacatgccttttctctgaggaccctaacagaagccacaactggtgttcttcacagggcactccttttcctcagaaagtaccgatatagacgtccctcttattaccccttgaataacaggtgtcggcaacactccccttcaattccactccctaaccgcccataaccaacatccctgctgatttgccacctgcaatccatgcgccccaaccccccccctcgtaccgcgccgcattctcctccccgtgggatcgacaccccctctcgttatctgaatttcatttcgcgtttcctccgtcttccgttttcttttcttctcattttcccttctttcccctcccttcccatctcattcccacctccttcttgttcttcatcctactccccgttcccttcgtccttcttcttctcctgtcctcatcttcttc

SEQ ID NO: 17408 - DNA, 248 bp, Homo sapiens
ttgtgcaaatctctcttgagtcaaaaagacctggactcaaagtcagcttcctctgtgtacttaccctgggccacccctctgagctctgatttgctcgtctgtaaatttgagataatgtattattatcccaaaagctatgtgttacaccttgctgggttctttatagggtgagtaaaatattgtatgagatagtgtcaaccacgtaagaaccatccaataaatatttatttccttcaaaaaaaaaaaaa

SEQ ID NO: 17409 - DNA, 322 bp, Homo sapiens
gattggcaaaacgcaacagatatctcttgcaacacaaatggttagattgattttgaagattgatgacattcgtaagcctggagaatctgaagaatgaagacattgagaaaactatgtagcaagactccacttgtgtgattaagtaaatggatgtctcgagatgcgtctacagttatttattgttacatccttttccagacactgcaaatgctataataaaaatagctgttcggtaaccatactttcactcgttcaaagctgtataatcgtgggggtactatctcaactgcttttgtattcattgtattaaaagaatctgttt

SEQ ID NO: 17410 - DNA, 241 bp, Homo sapiens
ggggtaggactgatgctgcgatggtgcagctacaccaaagaagcatcctgtaatcctgagtcaccacatggagagcggctgccctggagaatcacccagacctgcatcagagtctgtgtgagtgagaaagttttgtgctaagctactgagattttggagattgtttgttacaacagcttagcctatcccatcctgactaaaacaataaactaatacttaaagaggtgcaaaaaaaaaaaaa

SEQ ID NO: 17411 - DNA, 164 bp, Homo sapiens
  misc_feature (1)...(164): n = A,T,C or G
cctangtcggaaaacagatcttctacttgcctgcttccctgaagaacttcttgaaacagagcccaacctttccctcatctaaaaatccttgaaatattcagttgaaaaaaatacaaactttctactaaaaaaataagaaatccttctgttgaaaaaaaaaaaaa

SEQ ID NO: 17412 - DNA, 732 bp, Homo sapiens
gccagggtgacatgcatggagacacaaggcaatatagagaccacactcacctcctgcagatacaactccaaagtgctaagactctaatatctttaataatgttctctctttattacaggttttggacttggagcctttaaaagaactaaacatttctcactgaaatataatgccctgcgttactaacaaacctaaaaacaaaaccgaaccacactgatggcacatacagtgactcatccgctcaccaaaacatacacactacccccaccgaccaggtccaccccacataatgccacacgcttcattccaacaatcgacacccccccccgcatctacaccaccgcacaatcatatataatcgttttttaccccaacattcgccattttattttttctccttccttttcccctctttccttcttttactcgtccccatcccctctattttttatttccccccacccgcacccacatcccccccccaaagaatagacccgccccccccttttcccctcgatcaccccttttccatcgaaattatccttaatctcccgctcccacaatcttcccccaaccaaccactatacccactcccctcgtgctctgtttcctcgccccccattcccatagttttgtcgccatccctccgccccctcctcctctaccccccactccttacttttctctcaatttcttcccaactcaacccacacattattatccctacccccc

SEQ ID NO: 17413 - DNA, 830 bp, Homo sapiens
  misc_feature (1)...(830): n = A,T,C or G
tggtggtggtgtgggtgtgnncggttacttttcttgggccggggccgaagtgaggtgaatttacatgaaccacacttgcctggaagggcccaacacttggttgaatttgaagagcaagctcttctctttaaggaagaaacaaaattgcaacttgatattaaaaaagaaaaacaccaagatgtaatccaaaagtataagaaagaacaagaggaactacaaatgaagaatacttttcttcaggagacagtgcgtagagaatgtgaagaacgctttgaactgacagaggctttgagtcaagccagagaacagcttctggagcttagtaagctttgcggaagtttaccattctcaccgtgttccctcagtaagggcagcctaaccttccctgctgcagtggatataaattatggagagagaagccttgctagactgaactctgaaaaagtgaatccaaattccccccctgcccggggtgtaaaaattaatcattttcccaacctcagataatttaattagggtcggacgatgacgcgcccatttctttttatccacatcccccccctggttgaactcttttttttttttggcaccaccacacagtatgtcgggtttttccgcatgttaccgcagttgtctttttgttctcctcgggaccgtgtttgcagcgacagagcaagattaattccctctatcgagtatggatcagggctcgccgcgcctgccagtgccttttgctcctatcgttcgccgtgaacttattgttcccctgacacgtttagtaaaaattaattttccccatcccctccctatcgactttattccctacgcgc

SEQ ID NO: 17414 - DNA, 194 bp, Homo sapiens
tagattaagatgcagacctccttctttgatgatcagcagccaccttgcaaccattcaagggtggacataagctccacccctgaattcctaatgacatggataagtgcaacttttgaaattatttcatgagaaaaacaagacttctgattgtttaagccaatataactagttgttggggtttaaaaaaaaaaaaa

SEQ ID NO: 17415 - DNA, 1206 bp, Homo sapiens
  misc_feature (1)...(1206): n = A,T,C or G
tggtactcaatccttttctccccctcccttnttccgcctcgcggtatcttctctcgcncgagtgtggncgctggtgccggcgcgccggcggcgtcggcgcgttgcgacggccggaccgcgancgccgcccgctccgcccgcactcccccacgccacatctcgcgtttgatgtgntcggtgcgtgtgtggagcgagagtgtattgggcgtggtgggtcgcgccgcccgncgccgtcctccatgtccgccctcgctctaccgaggtccactcacacctagatacngtcccacgccccgctcactcgccctctcctctcctttctctctccntttgttccccggtcaaactcccgtcngccgcgtcncttccnngcccccccccggccccccccccccccgccgcccccgccccccctggntttttttnttntctcttttatttccgngntnnnnannactcttttcccggaggcggnncaacctccgtnnnccacgaagnntntnttnttttnggnncttngnncncgngngnnnnacnnaacttnactnnactnngnncnagnnaaatnnagnaatnananagcttgcnanatggnaananatntagntnaagcnaaanaccccacnactagnnaactccttggnnattgagccnaaaaggaaanactttggggtccaagttcaccccaaaaggnaaantactttaatttcaaaagagaaaagagggggaggaattcttggcttaacctaaaaaacaaggagttttcaaaaaaaaacttttttcccaggcagaggtaaattttaaaattattggggcaaaaaggcgccatttggtttaacatctgggaccaaaagagggggaattttgggcttttttgcgcgagagatataaattatatttgtgggggaaaaatattttttatttaaagggtttgttctctttctaacaaaaagtgggggggcccccacaggggtaaagaagtttgggtttataaaaaaaaanaaaaaacacccgcggggtttgggggggggggtcttcccgcgagaaaagacaaaataccaccgatcggtgacacaccccgcgatttctgcatgtaccacgatcatattaacccttcagtacagacccctataaagcacgtcctccaacagcagagacaaagaccgacaaggaagcgggtcagcaagcggagagcgcagcggctgg

SEQ ID NO: 17416 - DNA, 373 bp, Homo sapiens
ctaggcatctcaaggcgtcggttagcgcggcagagtcgggaacctgccatcctagagcaatacgccctgagtgacagccctgacaaccggagtgatggatcgggactggaaaagtggtgctgggagccaggcagtgacaccagcgcgcctccactggccgccgagcgcgcggagaagtgggctccccagagttcggcacccaaaggaccaacttcgcctccggaaaagcggcggatccggaacttggatgtcaggactatgactacgtaaaatctctgcccagggcgaagctagcaatgcacactgtatcagaaaggcgcagggagtcgggaagggtattgttattttaaattaaaagtttttatcccggaaa

SEQ ID NO: 17417 - DNA, 132 bp, Homo sapiens
gtgcggcgaagatggcaatatgggaaggaccttggtccttgaagatattgtgccactatatcaagcgtccgctgaagcctgaattacctctggatgcctaataacgtggagcaataaatttccttattgttt

SEQ ID NO: 17418 - DNA, 218 bp, Homo sapiens
gtaccgatgaccaaacagtcaatgaagagattttcgtgaccagctgcttttcaactggagtctactgtaagaaacagatgtagaatctgtcagtgaatgaaaggacacaagactggttcaagttaatccacatttcactgcaggttttcaagctggaattagataatatatttgaattattagagaaattaaatcatgtaacatgaaaaaaaaaaaaa

SEQ ID NO: 17419 - DNA, 780 bp, Homo sapiens
gttaggacccaccttcgccgtgctgttgaggaccccaggccacatagagagagtgaggccacatgtaggtgttacagccagaagccccactgaaaaccaaacctgcaaccagcatcaactgccaaacatgtactgaagaggctgagatgattccagcacttgtggatgactgcaaccacatgagagacccagagcaagagctacctagctgagcccagttactcccagaatcatgagagaactatgtaattgattgttattactatataagccactaagtttacatatgatatgttatgcagaagtacacagctggaacaggagccaataaacaccgaatgaataaatgtggataggtatggatgacggaaaaaaaaaaatccaaattacttcttgacgtctcttttctcagcccccccccgaggccccctcctgctcccgccccgccctcgcccccccccccgcgccgcccccgcccccccccccccctctctctctccggccttttttccgccctcccccgcacatcgcgtcttatctctcgccccctccaccccgcctccgcatcggttccccctcacttttccatctccatcttttctctctcccagttacgcccaaccctgattcccatccccccccaatcccacattctcctttccccccctctccacgcccattttaactgtcccgacagctccctcaactcgcaccctgtcttccccccttcccttccctcacccacctaccatcctttccgcgtcctgtctcctgcacccc

SEQ ID NO: 17420 - DNA, 767 bp, Homo sapiens
gtagaagactcacaaacgcaataattagcacacaagtgcttcttcactcctcccagaattaggaaccagggcctgaaatggaaaatgcagatttcaatttcgaagccttcatctgtgcctgggagaatgaaatctcacactatctctttggctggagtgcagtggcgcaatcgtaggacactgcaaccccctgcctcccaggttctagtatttattcttcctcagcttcttgaatagctgagaatacagatgcacaccaccacacctgatggatttttagcatattggccacacttgtctcaagctccagacctcaagtactctgcctgccttggcctccaaaagtactggaattacatgtgtgaatcaccatgcttggcccctgattgaaattctaattcaaaaaaatccctcttgcaaaaccttattttgtatattacattttcgatgagctcctctatatgcctgacaattaacagcccatggcgtctacagcccaacaatttcccccatcccccattgtcattatctactacattcccacccctcccccacacctcattcactagcgcggcccgctttgcccctcatgggggatttttccctcatctcccttccagtgcgcgttacccccaaaacgccacctcccatcccctccactccccccctatttcttcgcccgccgtctccctttcgcctcccccttcttctgggttttcgcattctcactgcgaacccccgattatgaactttttttactattatcc

SEQ ID NO: 17421 - DNA, 760 bp, Homo sapiens
ggaatccttaatcgggcaaaagctttgaacagaagagttcacaaaggaaccagggttgtcttatggcatcagttacgccagagcctctgggtcatccacatcaggagcagaagcacttgttggtcctgctgccacggtttgggcgcccaacacgcccacgtccacctcgtcctcccctgccaccatgttctgggcggccaaggtctccaaaattgatctccagctgagatgttatataatctgctggcttctggaaatgatggtacataaccgattcttaagaatgagccgcttcactttctgatttatgaagaacaaatccctacttccactgaccataacaaacttaattaggatttaaaatcccaaatattacttttgactcatttaaaaacacacccccctccaccgcactcaccaatggacctctacaaactcccccccttccccgccggttcttcccctacccccccttctctttccccccttcttttaccccctacccccccccttcttctcatatttatcctctcactcacctctctcccccctccctacccccccggctatttttccttcttttatccatttcaccattctgccccccccctatcccattcccccgtccgtgcacttcccccttccccttctcttccccccccatccattcttcaccccttctaaccttatcccacccacttctccccatatctcccccccaggcaacacccacccactccccctccactcactaaccccg

SEQ ID NO: 17422 - DNA, 752 bp, Homo sapiens
ggatgtttctacgtagattttctttttgcttccctgctctcaagtttgatcaacgatcatgttggaacgtgtctgttcagaatttaatatgatttagacaaaggcttgaagttatggttgcttaattgaaagtttcttgcaaaagagaaaaaatacagacgtttgaaggtggaaaactaagagatttaagaaatatatgaggaaactccttttcccctccaccagcttgaggaacttcaaacacctagaaggcatttgttattcaaataattattttgttagtgattactgataattcattaacggcgcataccacccacatctggtcatcaactttatatttaacgatcaatatggagcgccatgttttttttaccagctggtaggggttcggatgagcacgcggcgtgatggatataagacgaaagaaaagcagcatacccgttcgatatacgactaccccccaattctctttttcgggttatttttcccccatccgccccccgacgttccatgtttgcccccgtcttctttccctcttccattcctacaccccatccgggttcatcctctttttcccgccccccccacacacgccccccgtagcccatccccgcggtgtcttttcttcccccttcccttctcttccccgccctttactttgcctccactttcccctgtgcccatccgtttccccttcttttaccagcacatatagattacacccccttccccttcgtctccagccgctc

SEQ ID NO: 17423 - DNA, 498 bp, Homo sapiens
ttagacgtacttcacctgctatctgaacagaaactctacatactgataaggaatgggacgacaatgaacttcgccctccccagctcaaccttcttcataacttcactgcagaatgacaagctcgttgccagtgaatgccactctctaatgccacagaaattttgatctcagctgtccgatgcaaatttgtgtacgattttgtatgcattaccaagctacgaaataagtcagtgtgttaggatgtgtgaactcatggcttgctcttgtttctgaacataatagttcctaatgtctagtgtactgtgatattcttggttcaccctgccctttctcttaaagaaagcctatgttaatttcgaacaaaactgaagaatggcataggacaagctcctgtctaaatactgtttcttgtgatggcataaaataagtagtaagtgataagatgagttggtcatttttttaatttaaagagggaagaataaacaatttatggaacag

SEQ ID NO: 17424 - DNA, 746 bp, Homo sapiens
ttcccaactttctagatgaaatgtatgtggatgtgacagaactccaggcaggctgctgaaaaaagattaactcagctgccaggagtactttttgcctctctactgctttgtacctgtttcctggaatggctgatgagatgactgagcctcaagcagccctcttggaatatgtggcaacactgtggacatgctgaggatggcagagcagaaactaaaatgagtagctctgaaaactctataaggttcccataccaaccctagatttcttattctcagatttcacataagaaataagcccttcagtgtttatttttgtttatttattatttttttctttttggacaactgaagctattcatgaataatccaaagtcctgtctaagaaaatgccaaggatcaaccaggtgtggtggctcatgcctgtgattccagcactttgggaggcaaagcacgttaccaatcgctggagaaagcagtaatcactcttactctgccctccccgtgggcctggctagaggagagagcatatttcaaagggcacgagatgctgttttgacctcaaagggaaggtgttgcaccctcctcagctcttatttgtcatacagacccacctcatgattgatgctacgctcttttctcccgttatttaaaaaacggatatctatgttaaaacctggccaggacatgttacttttctaacactctgttacggctcgcctgttacccattatcattccggtcccggt

SEQ ID NO: 17425 - DNA, 766 bp, Homo sapiens
agaagcattagggggaaaaagaagagagagagatgagatgagccctaatagagttcatggctgtcggtgagccattgaatgcacctgaatggggaagttcttgaggttgcataatatcagctgatgcttacaaactgttacttcaaggtcaatcatgacgtggctgtccccaagggaatacagctgttcaatactccaggcttgctaacttggggaccattggatcttgcttggtgactaaaccctagttgtgttcacaccaccacaaagacagaacctcacctccaaaggcatgaagtggtaagaccaacacaccaagacagaacgatgccactgccacctggagcacaatacagtgaagcatgtatgcagaattaatactggaacaatgctggacaagtgacaaacaaattaatgcaagcttctgtaatgattatgctatttaattagaggatacctgacctgtgttaaattctgaaagagttccccactccccaccgcttacattttcgctttcttgggaaccattctctctattcaatggaatgactgacagccttttattaaaattataactggaacgcactgtcctactcgcaggagccattgccgacctatttccttttcacgccggtcaccttcatcgtccccccccttacctgccctccgtatcctcttcccgtatgtcctctcccttcgcgcagatatcttcccctcctccggtcgccccccactctcttttccccatcaccctgtcatgttccct

SEQ ID NO: 17426 - DNA, 856 bp, Homo sapiens
  misc_feature (1)...(856): n = A,T,C or G
tcctttcccaatcatttccccgcgntttcctgcgcgccccgagcccggccgtccctcccgtccccttaaacaccactcccggagaatctaagagatggggacctcacctccaagatctcagaatttcgggggatgtttcatagccatccaaagtaatgcaaaagcactccctttgaataaaggccaggtgcagtggctcacgcttgcaataccagcacttagggaggccagggcgagcggatcactttgaatacaggagctcgagaccagtctgcgcaacgcggtcaacccccgtccctataaataaataaactcataacattcacacgcgtcattatatatatgatattgcataaaccaccacccagactatccggattctttcagacaccctcatccctcctacgctccaataatccccaccacccaacatgccggatcatacaattgtgtttttttccccatatccttccccgtttccccgattatcccccgttccacccgcccatccccatttcttccccccaccccctccccatctattcccctctcatcacctccccgtcccccctccttcctccattcttcccttcttccctccttccttccttttttcgtccctcattttcccccccgttcctcccccccttccctccctcgttatttcccccctccccccttcctccttttctctagacctctccccttatttgtcccctttcttttatctttcctctccctcctcctttcccctcttcttctttttttttccccctccctcattccttcccgcccttcccgtctcttctaaccctcccccttcatctcttattccccccccctccctcttccatct

SEQ ID NO: 17427 - DNA, 778 bp, Homo sapiens
  misc_feature (1)...(778): n = A,T,C or G
gaaaatcgaaaatggaagtacaaactttccaacagcacacattttctctgctctctccttggctctgaaagaggatgcgtgaaacagaatctcaggctgtaattaatgcagctcttcataagataagaggttcttttatctacagaaaaattgctgcactaattcccaacaagaagtgcaatgctccggttaatgctctttctacaagaagaattcaccatttctaccctctacatatttacagacaaatttgaatattttgttatgggaaactgaagatgggtaaacatacaatgataatagtactttatagggctaaatctaaaagccttaacgattaatattatgtccggataaatgctgaataagtttacataaacactctcccaataccccaaaatacaccatatccgcgcttccctgccttatacttccgcccccctctcgccgtttttcctcctcgccggcatccccatcacccccctctcactcttcatcccttcatctcctctttccttcttttttatctccatcctttccccccccttccctcccccccttctcctncctccctcttttcccctctctcccccgtattccccttccgtctttttctctcccccgtatttttccctctttcttttactccccctctccctccccctttcccctcttcttttctctttttctacccccctcacatctcattccccccctcccctcgttcctatccctcccccttcncaccttcttcccccccccttccctttttccaccg

SEQ ID NO: 17428 - DNA, 293 bp, Homo sapiens
gattaattcctatggtgtctctgcaaaagattactgtgaagtgcaatgaggaagaacatgacttaagagtttcagtgactaccctgttactcaaatagaaaaaatacttacttgacataaatatattttgtgtaagctccattcttctcctagagcacaaatcttaatgtcactgttttcaccattcaaaaataatgtttgataaatatatttagatgtactctttaattttttcctgttaaaagaaatgaaaaagtcacatatttatataaaactgaactttttattgaaaa

SEQ ID NO: 17429 - DNA, 361 bp, Homo sapiens
aaggatctccgtccccccaccactgccatggtttgggccgagcccatccgttattaccactgcgcgctccttaccttgcccccatgccctccttcctgccgacctctcctcttccttacctttatctttcctacaggtccccctcgtctacctccacctttccgcccgccattgtttgcctcctcgccccatttccccttcctctttgttccgtcccgttgggtcccctttttatttcttttcctgtacgtccccgttcccgtctccttttttgttttgtcccgcgcgcgctccttccgccgtttcgttcttcctttcgctccccgtcgcatccttttccccccccattccttttccctcg

SEQ ID NO: 17430 - DNA, 162 bp, Homo sapiens
gggtgtaactacatcacaccctttccataagctcactgcacacaccacttatgattcagaagactctaccaaaggaaatcaaactacagaacagcaacaaaactcaaaaaattaacatcttggcttttgtgttattaaaatattttctcagcagacaataaa

SEQ ID NO: 17431 - DNA, 770 bp, Homo sapiens
attaaatgattcttgaaacatacctaggttcccatggccaggagaccctctaaaagacagcgttttcatgcctttaagttgtggacagatggctcagtgacaggcgatgggtattcatacgtgcaggactgcatctcattacactctaacaagaagatcgcaactggaaacaatgaaaaccaagcctggctaatcacatgcaacagacactgattttttttttttttaactaaaggcaaggactttattctcgttcctgcctaccccgcacatggctgcgtccacaccaaccatcgcctctcacccgtcagcgaaatatccaccacggccaaccccagcccgttactcccccaaccccatcatcccccctcctcacaattttttctatcccacctccattccccgttttccccataaatcccctttccacccacccacccctttcttcccccccaccccaccccgtttttccccgccctcatcttccccttccccccccctcctcccttcctcccctcctctcctcttcattccttttattcttctttatttccccccccctttcccctcctccttccctccctccgttttttccctcctcccccctttttctcctttctctttttccctcccctttttttcctctttttttcttcccctttcctcccctttccctctcttttttttttttcttccctgcgcatctcttcccccctcacgtcctccttttcctcccctattcttcctttcccccccatcccttttccatc

SEQ ID NO: 17432 - DNA, 281 bp, Homo sapiens
aaggcctttgaggccttagagaaatactcactgacgaagaaccagaagaaatattatcttcataaagatgatgagagagagagaaaccaggaagtttgactctccctaaatcggcttcatgttccaagcatcaaaacattcagctgatttactctcttaatatgattcagcctacggaattatatgctaccaaatatagcacaaatcatgcatatatatatttctgtactaggctatttaccataaaaaaataaaaaattttgtcattaaaaaaaaaaaaa

SEQ ID NO: 17433 - DNA, 837 bp, Homo sapiens
agtattttcacctagaccatgtacgaattcgcgccctgtgtaccccatactttctattccacacttgaagacttcctgcctttaaacttggtaggccctgcaaataacacaaggaagaaaacattcgcctctatggaccaaaaatcagagaaaaagcaatcaaactggaaatgcgtgaaagtacacaataccgaactggatcctatgattttatatcatataacattcagtcgcccccgcacccccaaaattctaccccctcccccccttcccattaccattacccttcccgcactcatactaacctcttcatttatgttctcctctccccctcctctgtcccttttcttttccttctttgtcgctgttttatcccctttcccccccctctccacccctcatcctattcccctcccctctccttccccccctctttccttccgtttccttcctccccattccttctttttcccttcccaccccattccccatactcccaactctcccctaccccctcccccccccccccccctcttcccacacaccacacctttcgcttcatacccccccatttcctctcccatcttcttccttcccccctccttatcctcttatccctccctccgccctttccttttctctccccccccatctttccctctccttccgttacttccccccccttcttctattcccccctttttttctgtctcttcacgttcactttcctgtttcttcccaattcctatttccctatcttcagattttttccccccctttttctatacccgctcccctccccctatcctttttataatctccctccactcccatcct

SEQ ID NO: 17434 - DNA, 743 bp, Homo sapiens
cctgtcctactcttctggtgcacccgtttttacgttgaacccagttataacagatttatgtcagcaggatgcttcctttcaaggcttattagatactaccggatgctacattttttctcaactttaaccaaggctgaataattttttttctaaatcatttgatttccactggaaccactgaccagaaaatggttgcaattcaactgatttcttaaggttgacagtaacgacatttctttacatatgtttatgtaaactgagggtgactgtctgtttccgtaaagtccccacttttgaagaacatctcactactgctgggactttcccatgaaatggttgtttctctctatctataattgcttttcctacatccctcttccttcttctttcacatcctctccaccatccccaccatcccacttctccccatcccccttccccacccccccactccctttttccgtaccccccacacctctcccgttctcactcatccttccgctcatcatcttcctcccccctccctttcttttccgctccctcccccttttcctttctctccccccccctgtatcctctccttctttatttacccccccctcctcttatccctcctttttttcttttcttctcttcccttcctttttttcccccttcctctttcctctcttcttttttattccccccttttctatcccactccctccatccttttttttttcctcttcctccctatccctctt

SEQ ID NO: 17435 - DNA, 520 bp, Homo sapiens
catgtctgtgttccgctcttgttgcctgggctggagtggaatggcacaaccttggcgcactgcaacctccacctttcaggttcaagtgattctcctgcctcaaccttccaagtagctggaattacaggcatgtgccactacacccagaatggagggatttgcaagttgatggcagatggaaggcattattgaggcagaaatggatgaaaatcaaacctgctcttgatttacacagctgatctgggcactgagtgaagtcttatttcctgcctatgaaagcagacacttgaaccaatcactcctttcttcatacaatgtgtgtgcacagaatcaaatttgctgaaatctggaatttgggactaaagctctgattcttttttaatgaaaaggcaagaaggcatttgaaaattgttccaaaatattaaatgggggaataatcgccctagtggccccttttgattaacataaaaaaacccttcggtttgttttttttaaaacctctaacccaaaaaaaaaaaaa

SEQ ID NO: 17436 - DNA, 883 bp, Homo sapiens
ctcccccccactccccccgccattcttccttgccctcttcttcccctccctcgtctctttccccccactcccctggcgatacgggcttctcctcctttggatggctacagttctatacatgaaaccctgacctttagaagcacctttgacggctacttcaacttttacctccgtgtttccagtccatgatgaatttttgggaaagagagctcttttctcacagctgaaaacactggcagcctgcacatgtggaactctcagctgggaaacatgaaacttctcgatatcccaaaagcccacaccttggaagataaacttcacccatgactaactaaagccattcttaacacaaaattatcgcgcggactaacatgcctcatccctttctctcagcttccccgatcacgaccctctacagccacataactcccttcctgctctatccagcctgactctcatcatcaccacacccttgtttgcctgggttcttccttcatcccaatcacttataactcctcccccccttccctatcttttgcacatgcctgacatgtctcacccatcatcactgtgcactttaacacactggtctattgcggacatccagtggcatggttttggatggttgggggaaaagaggcggtctgatcatcattctcgatatgtgtttgttcttgaccttttccctctctcaccagagtgcatgccggtttctcccattatgtaaactgcgatttcccgctccctccctttgtccatttcttgaccactctcacttcttcgacatttacgtcttccatgtcccgctaacgctccatccatcgattccctatccgaccttttttttccccctcgtattttttttcgcacacctacccaccct

SEQ ID NO: 17437 - DNA, 209 bp, Homo sapiens
cctacttgacactgaccccctatgatgaaatgcttccacgaccagcacaccagaaagaacctcctgatggtgagtagggccagaaccaccacctgcctgtcacaacactaactcttcatttgattcctcttgaagtttggcccgagtgtgaaaaatgactcttcttttaaggactcgtaataagcagaggtgacacaaaaaaaaaaaaa

SEQ ID NO: 17438 - DNA, 804 bp, Homo sapiens
  misc_feature (1)...(804): n = A,T,C or G
atacgctttatactctcggattttctcttcctgagggaagacatggtgtagcacatgaaatacatttgacaattgcttttgcacataacaatgataaaagaaaccaaagcatctagctacactactgaacagtgtcttgttctactactaaaaaagaaagaagaagagaaaaagaaggagggggaggaacaagaaaacatacagtagtaatcgtagtaacgcagcagtagcaatcaaaaggacaatcaaaaaattctattttgctctacagggtagagcacccataagcaaatcatggtttcccttctgtttcccatggatatcctggtgcgaatcactgctttggcaccacctgtggaaaatgcatggggcatttgagtcacattgctaatcagagttatagcgacacaaaggaaactggagttgattttagtctattcatttcccatgaaactcctagtaaattacattgtggataagcaacgcaatattaccacaggtaggcaaccacttacaggctgtgatttaaggatgcctgaaaagcctccctccttgccaataactcctgtcctagtctagcttcgtgcttgacaccacgctctgcattaagttctatggagttccagggatttcttagtctgttacgaaagtcactgaagatagaaggaagatgcggagaatactcaggaagcctcatgcattcaatgaaatgcaatgcctcctcctttgttctacaaatcangattctgagtcaaaacatcttttgcacaagggatctgggctagaagaatttgagaactggtg

SEQ ID NO: 17439 - DNA, 796 bp, Homo sapiens
gattgaggccatcaagctacagatggtcttacaaatggaaccccaatgagctcaactaacaacttctactgatgacccctgcaccaacccgctggccctttgactggcataaagagttcccctctggaggacactacaactgcagggctccttcttcaacccttccagcaggaagtagctacagaggtcattgcccaattcccaacagctcttggggtgccctctttagaggggggattgagaggtgaagccagctagactccctgggttgagccgggacttggacaacttttctgcctagctagaggattgtaaatgcaccaatcagcgctctgtgtctacctgaaggaccgtcaacgcaccaatcagcactctctaaacacaccaccaccagcgctctgcgtctatctacaacactgcatcacaccatatagcactccgcccaaccgctccactcacccctctgtgcctatttcaagcatcgcatatgcaccaatcctcactttctacaacggaccaatcaactctctgtcaaatggaccattctctttgatgagggccgtcacttatcaatcaacattagctgttcaccttccccttgtatcccctcccccatttgcgtccctttctccactacattatgccaccactgtttcgcctcccactaattatccatgcctttgcgcgtcactctccctgcgctttctttgtacaatcgccgaccctcccccatccttgcgtagctttccttcctttttatctcgccttgtcatatatttcccccaactccaccacg

SEQ ID NO: 17440 - DNA, 892 bp, Homo sapiens
  misc_feature (1)...(892): n = A,T,C or G
agtgttcggcacgtgcggatcaccaagtatggaaatgggcatgggtagggaatggcagacacgcgacttcgttagggctttgcgcggttggtcaaagcctgacctgctgtgcacttcagagaagcaccgcacctcatggaagtgactcgtgtaatgtcgccctactacacgtacggccgtcacgcagatagccgcagaacggcctgtatgccgtgctaagtacagtaagcagtgagtcttctctacccccaccactcctactcatgttcagttacacttcaccgccttgatttttttctcactcttccccaactgttcagaattaattctctgtcattccccatttttcccccctttcgttctcccccgcctccccatcctgatttcttcagcgtctccccccccattccccttcttcctcctcttccttatgtttcccccacgcgtatccaatccttccccccccactttccccccttctccgccctcctcgcccgtttttcctcccccccttcccttctctttcccattcctttctttttcctcccttcgtcttttttcctctttccgcccgctccttcttcccccgtttgttacatcccagttattatacgcgtctgtctcgtccgcaattcgcccttcctcttgttctccctgcctctcgttttcgttcgttcacctgtattcgcactcgccgttgtccctccgtttgttcccctcattttgcgccccccttttccccctcctctccttttttccatttctcttcctactccacaccccccttccctttctttctcccctctccccaccactccccccatccatcggttcattttccatcctcctcctgttcnccgtaatgtatcttattcctctccactcccccacg

SEQ ID NO: 17441 - DNA, 795 bp, Homo sapiens
atgtgagactcgctccttaaatgaaaaacacagtgcagttcattcatacaacggaagattatttagccataaaaatgcaggcacttctggctggtgcggtggctcacgcctgtaatcccagcatcttggaagaccgaggtgggcggatcacccgaggtcaggaattcaagaccagcctggccatcttggtgaaaccctgtctctactgaatatgcacaaaattagacgagcgtggtggcgcgtgcctatactcccagctactcgggaggctgtggcacaagaatcgctggaacccgggaggcggaggttgcagtgagcccagattgtgccactgcactccagcctgtgtgacagagtgagactccgtgtaaacacaaaacaaaacacacccaaaaaaataaataaataataaaaaaccgaaaaagccaggcaggcacttctgacacaggctgcaacatggatgaaccttgaagacattatcgctagtgaaataaataaatcccaaaaggataaacatgaccagcctccgtggctcgcacctgtaaacccagcactttgagaggccgaggcaggcgtatcacttcaggtcaggagttcgagaccagcctggccatattgtgaaacctcttttctattaaaaatacataaattagctgggcgtggtggcgcacgcctgtaaccccagctacatgggagactgagacacaagaatcgcttgcacccacgatgtggaggttgcattcatcttagatcatgccactgcacttcagcctgggtgacacacaaaaaccgtcc

SEQ ID NO: 17442 - DNA, 781 bp, Homo sapiens
caatgaagatgccatatgaaggggaacaaaagaacccagacaatatccagaacagagagcccagctatatggccccagttgatctggccccgttatttcctaccgtccaaatcacctcaactgaagcctcagattctctgctgaagccaagcatgatccaaaggcaaaaactttctcatagtccacagtcaatatggctactacaggatacaatgaaaactcttagtgacagtgattgttcttccaagacccatctgctgacgctgatgtgaagaggcatttcgtatacctaacctgacgaacatcgaacatcgtaatttaccctagcctattttaaacatgctcagaatacttacattagcctacaattcggcaaaaatcctctaacatagagcctattttatgataaagtgctaaatatctcatgtaatttatggaatattgcactgaaagtgaaaaacagaatggctgcctgggcaccatcataaagtagaaaaatcatacttcaaaccatctgcaaccatctgtagtctcgagcactcatcataggactgtctgtactctatgacactcatcccaagcttgtatgattacttgtttgcgaatggacttttcaaaagtatctccataacttattctttgaatgcccagcacccaacctaggctcagggacactgggctttaagtaatgtttaccaatgaacgaatgaatgaccaacggccatataatcgatacaaaagactctttatataaaagcaccatggaaaagggttgctacct

SEQ ID NO: 17443 - DNA, 167 bp, Homo sapiens
agtgttgcctcagagttgctgaggtcactcttattctctcatgtttgctcagacctccacttcaagaacaggtgatttgcttcacttcaaacaattttttttgttttattatttctgaaagtttcagaatgaataaattgaatttttaagaatgaaaaaaaaaaaaa

SEQ ID NO: 17444 - DNA, 229 bp, Homo sapiens
tcggacggagtttggaaattatttctgagagatacctctgcttcctgctgcccctattttagaagtcaatggattttacaagaccttgttaaagacaaccagcggatgttccaatacatgctcagaatactcattgtggaggaaaccaatctgtgaggaaaaaaggtgtagacagagaactgtgattcatccagaatatatgctttcacaaaccccaaaaaaaaaaaaa

SEQ ID NO: 17445 - DNA, 584 bp, Homo sapiens
gaggtatgggggctcgccatgagaagaccccatatgcctaaccttggcaattagcccctgacccagccaagccaaacagaactcttttctgggactctctccacttgagcttacagggataagactttccagtcaggaacccacacggacgtaaacatggagtacaaggggtcaacctaccaagagcaagagaagcagagacagatcccgccagcctccgctgctcataagcttcccaaggccagatccaacccttcctcctgcccctccgtgacaggggcgcataaattttcttcctatgtttcaccttcctcaagccggatttctgccacttacaatcttctactggtgactgacaccggggggtctgcagaaaaagcccattccgcacatgatcatgccgtgtatcagctccctgtagcaggccgtgacatcctgatattaacaagcgcttgcggccacaaccattattttttccaggttttctatcgctagtggcaataatattcactataacaacctcttacgaaatccatactttgcgtagggggatctcccagatgggtgtcccctcccacacacgg

SEQ ID NO: 17446 - DNA, 773 bp, Homo sapiens
ttcctttagaatcccaaaagaaaagcaaatactgacaagttttcaaagccatgatttacaggaatgaattctgaaaagcaagtggctaacatccgagcttcatcatcaaataatatttctaaagcaccctctagtgtctggccccaagccagatgattcaacgcctggagaagctacagactttttaaaagtaaaatagactcatgtctgctcatgagaagcaagtcagcgtcatttaggatgccttaggaatgtctctctaaataaggattaaaaatggattgctgtagaaaaagtaatacaagtacaaacactaataatattgaatgcaatttacattccattttaaaatagataatagggtttaaaataacatgttgaaaattacactggaattagcaaaatttaaaatcttaggaacaaaccaccctaatttgtctgtgaacctgtcctgaactgaggaaaattaatactatcaagagtagataggggttgtctagtaggaatgttagacccatcagccatctgattatgctgcgactgatactagcgcgtattcttcacccattagattattatgtggtgcagtataaaaagcatggtatggatcattataacacctattttggtggggggatctctactactcccttggtcatgtggtttggaacccagcacaaacatttaggactcctgtgctcctcccaccgcgtaatatgatcgttatgatccctgtatgacaacctgttaatttttcccgacccatcccctgc

SEQ ID NO: 17447 - DNA, 169 bp, Homo sapiens
agaagtgcaggatccattcctaaggaagatgctgctcacagggtctcactgtacgactacggcacagtttgtttattcatcctgctgctgctggacatctgggctgtttcccattttcggcaactatgaataaagctgcaagagacattctcgtataaaaaaaaaaaaa

SEQ ID NO: 17448 - DNA, 747 bp, Homo sapiens
tctttcccttcagaaaaggggctctgatacgccttgattaaatcacctttcaaaagccaagaaacaaatcatcgtcccctaaggatgactgaggagcaagaagccagtacttactgtgtgtctcaagcaagctgatagaagctagagaagaccatctggtttgagataaagtacaacagtgccggacccactgctctgctccagaaagcaagacttacggaaaagggccacgatctgattgaaacgtgctttcattgtgctccacaaaataaccattgctcatatctataattcttaccgaatcgaatataaggagcaggctactgcctttagcgtttgaacaactccgagtctccaaacttgtgtcagacccaccaacacctcttctagatattgggatgctggttccccttaagcaaccctgggtagcttttggtgcccctgtttccactctcaccatttttgcatttgtttcccactgagaagccagcgacttcttcagtaatgtaaattagattatattgctctggaactaaacatcctccatgaaatcccattgtccccttagctctgctgatcataatctctcaacctcagttattccatttttaaaatggggatattattgaatggatacttgagaggtgcactggaggatccctggcacccaatgacgtactcaatgcagggcattattgttatcattaacaaaacaaaacctctatgaaataagatgccttctgttta

SEQ ID NO: 17449 - DNA, 284 bp, Homo sapiens
tctctccccaaaagatggcattctgcaagactgagaagatgcccacctccattcccagagtccaggccttcattaactcacacgagaactacagaagcatcacccctagttctcctattagtcactcctcctcaactgcctctaatccatccatccatctatccggcatgggtcatgtaaagttacagctgagaaggtactccctctcttaaactcatcggggctccatgtggcttcaagattgaaaataaaactactgtgtatggtatataaaaaaaaaaaaa

SEQ ID NO: 17450 - DNA, 761 bp, Homo sapiens
ctgatttacctgtggctaagcagctgcttatgaccttgaacaaagcagaagtgttggaatgccttcctgctgtctgtatggacctgctcttgccagttactgcacaaagaaatagtttaattccacttggaatacagatgctgtaggctcaccctgatccagtcctggaatgagccatttctccaaaggtgtctggttctttctattggataacagcattagaaagcaagattggcgtggggtagcatttcacagtggataagcctgaggatccctatctcacgatcttagccagcacaagaaaaacatcagataacttacactagagtagcattctacaaaatacctgatcagtaatcttcacacctgtcttcaaaaacaaagaaagtcatcacttctccgcgcaaatgaacgaaaccaaacaaacaaaagcctcaaaataagcaaggaaagtctgagaaactgttacagcatgagaagcctaagcctaaagagatatgagaactaaatgtaatatagtatctgcatgggaccctggaacagagataaaaaatgtcagattaaaacaaagagaatctgaataatgtatggactttgattattgaaaatctgtcattattgattcattaattgtaaaaaatgtccataccatgtaaaatataaataataagaaaaataggatgtggtttatggcagacttatctgtactatttgctcaatgtttctgtaaatttaaaagtattcaaaaaatgaagtctatt

SEQ ID NO: 17451 - DNA, 253 bp, Homo sapiens
  misc_feature (1)...(253): n = A,T,C or G
gggtggtggggggtggtcgggngtggggcttttcgttgtttttttgggggtggcntgnncgcnngcgcctcnaggggcctcgcttctggggcaatctcagcacagtataaattggtgcaatctatttggagaaagattcatcattaagtatcaaaattataaatgtacgtgttcacgggccagcagctccacttctgggaatttatgccataaatataacctatcatatgccatctcaagaaaaaaaaaaaaa

SEQ ID NO: 17452 - DNA, 749 bp, Homo sapiens
tctaattgtagaatctgtgaatggacactttggagcccattcagggctatgggtaaaaacagaatatgccaagataaaaactagaaagatgctacctgtgaaactgcttagtgatgttggatttatctcacagaggttggaaacactttttttatagaatctgcaaagggatatttgggagcatatggaagcctatgttgaaaaagaaattaccttcagataaaaactagaaagaagatttctgagaaaccgctttgtgatgtgtgtatttatctcacaagattaaatctttcttttgattcagaaatttggtaaaactgtttttgtccactgtgggtatcgacattttgaagctcatcgaggccaatgctgaaaaagtgaataccccaggataaaaactagaattatgctatttgagaaaccgctctgtgatgtgtgcattcatttagcagaatgaaacgtttcatttcactcaaccgtttggaaacactgatattgtagaatctctgaaggaatatttgggaggtcattgaggccaatggcgaaaaagagaaaatcctgagatataaaccagaaggatgctatctgagaagccactttgtgatgtgtgcattcatcttgcagagttaaacctttcttttggttcagcagtttggaaacactgtttttgtccattctgcaataggacatttgggagtgcattgaggtctatagtcataaagaaaatatcttccaataaaaactagaaa

SEQ ID NO: 17453 - DNA, 285 bp, Homo sapiens
gattcatttaatgctttcatgatgtagaaaataataaatcagagtcacattggtcagcagcgtggggaacatacaaggcacttaaacaccacaaagcctggattttcaggtgtgcaacttttcacactgatgagattatatcgccttggaaaaagctctgaagatctctcagctacagttcctgctggagataataactaccatgaccactattcctgatgttcatgagagccaaattcaatgttgtctataaagcattatgtctgtacattaaaaaaaaaaaaa

SEQ ID NO: 17454 - DNA, 461 bp, Homo sapiens
  misc_feature (1)...(461): n = A,T,C or G
ctagtgggaacctggnggacctttccatgcattgacgatgcacagagctttcctgagagaccgccgccgtcctggcctcctgcttgccccgcccgtggtgctgagttttcgagcccgggttccggggctgcctgggaagcagctgctcagggaccagggaagcggtgacggtatccacacaacagaccacacagctgccgcaaagaacagagccaggcccaaaaggtgtaaaccacccagtgtccatcgagggacgaacggagaagcaaaatgaggtccaccgacacggcggaatagtattcagccctgaaatggaaggacattccgacgcaggctacaacatcacccttggtagaataagtcagccagccacaaaatgaaactggcccgatggtcccctggaactcacgttcatggtttcttttgaataaacatagaaatgagcctgaaaaaaaaaaaaa

SEQ ID NO: 17455 - DNA, 311 bp, Homo sapiens
taatagtgatgtgtggcccggcgcactggctcacacctgtaatcccagcattttggatttccgaggcaggtggatcacctgaggtcaggagttcgagaccagcctggctaacatggtgaaacctcgtctcttctaaaaatacaaaaattagccaggcatggtggtggacacctgtaatcccagctacttgggaggctgaggcaggggaattgcttgaacccaggaggcagaggttgcagtgagccaagatcacaccactgcactccagcctgggcgacggaacaacacttcgtctcccaaaaaaaaaaaaa

SEQ ID NO: 17456 - DNA, 499 bp, Homo sapiens
aatgaaacctttcagctgaacctgcaagatcacgcttcacaatacaagtacccaagaaaaatatcttctggactcatgtgcttagctgtggagtaagaaattctactacttcagatactgctgggtggatgaattctccttctctattatctgtacttcagagtcagacttgaaagggaactagggaaacttgcctcagttaaaacttaactatttctggggtaagaatttggctttagggaaagcaattcactgtttgacatgagtgcgatgaaatgacattgaatttttaataagaattactattgctattttattaatatttgagaattacatctcagaaatttttcttacttatttttccaattatgtaagtctgtatgaaacagctgtgtattccttaacaattcttaactcatagataaaaagttattccaaagaaaaaaaaaacaaaaaaaaactacccaaaccacaaaaaaaaatggcctctctggcctca

SEQ ID NO: 17457 - DNA, 492 bp, Homo sapiens
gatcagagttgtaagatttaaggacttgcagctatctatatttttcaatacaaaatttttgttagcaatatttaaagaaacaatattgtaattaaatatcctttatgctggctatcaatttttacatatattttactggcaaaagtatgtctttgtctggcagagctaaaaaataaaacacaaacctgggaaattaataattttgaaaataccttaaggttggataacataatttgaaatcccaccatttagccttaagggcttggaagaaatcacaaaactgagtttctatatatcagaacaatgatcaaataatcaaacattgccataagggttgcctatattattatttatgtagtttgtctacaaatcaatctccaacttattagtcaataattatattcagatgtctttttccccattttcaatagcagtaaagataatgaaaaaattaatacataaaaatgtttaagaatcacaaaaaaaaaaaaa

SEQ ID NO: 17458 - DNA, 761 bp, Homo sapiens
gttgcggaaactaattgccagcgtggtacttcatgccttcagacacatccagggatcacgttttaccagttatccggcactgcaagaccagccaagctgacatctgaaattaaccatcacagggagcatctgccgccccacatcctcaggaaactgctgctctcctgcccagttttagagtctcccagcaggccctcaggggagggctggagcacatcaagttatgacggggagcttcctccaagaccaggctgccacatcctgtgcacaaagcctcgtgaaccgcagtgacaggctcatttagaaacaaattaggggttaagtaaaaagtgcaggacagaggcaaaaccgagtttccctttccccttcctgtcggttagcattagaaggtgcccatgagcagcgtgtgtcaagaatatgaacgtgagatgtcattttggctgcctctaattgaagccaggataaatggagtggaaaggcagcgtctaatccaatcaaaacatgaaaaaggtattttgacatgtaaattacaaacttcctgtgtattttgtctccccaattacaccctcccctgtcatgtttttttaaattatatcttaatctcccagtctcctaaaaaaaaaacagaacagaaaacccgccccccccacccctcccccctcgcatgattatttccgcttctttcccgcctttactcggattcacgacggctcatcgatcaaacacacccaaacgcgccccttgcggcacgagcggggccg

SEQ ID NO: 17459 - DNA, 419 bp, Homo sapiens
  misc_feature (1)...(419): n = A,T,C or G
gggtttttggggggggnttnttttnngtttttcttgcttgcgttttttcgtttttttttcgcgttcgctaactatcccagagtatattaaaaggccattaatagccagcaagagaaaaggactcaacacccattactttgtttactccccagcaggtgccagtgtgccctggtgatgagttatgggccaagcatctgggagaagctactggctcctcatgaacccctggtttcggctggcaccctgcctcctgagtgatttccacatggtcgctctgccccatatctgatccatcaagcttggcactctgaatatctccacctctccctctctaggacaacaaggcgttgcacaatgggaaactatgcgaatgaaattgctttatttcttgaacaaaaaaacaattaaaaaaaaaaaaa

SEQ ID NO: 17460 - DNA, 416 bp, Homo sapiens
gtgagccaccacgcccagcctgaaaattttctaaacaaaataatacaagcctttatgaagaagcttacataattttgaatatcctccttaaagaaaaaagtagatgtaagtacaaacacaaaatcaagtttaaagttaaatgtttttagaattagaaaaagcacaaatttaaaaatggtaaaattggattaagaatctcataatttttttaatctaaaaactatctggcatgcttttttttctatatttttccaaaacctcttaaatttttggctttttattcttttactgcctctgcaaatgacaagcatttataacgttattttctctcaatagaaaagaataccattaatctgccttttgttaatgatgcttggaaggtataaaatctatcttttcatgcaaaaaaaaaaaaa

SEQ ID NO: 17461 - DNA, 751 bp, Homo sapiens
attaaagtgaagaaattgaatacaggaccacaaagagtcatttggggcgtgatattctgactctggcaaataaatgacatacttgctgcaatctccacatcctgtgtctgtggcagacatcactaatcaaatgtggcctctttttcctgagcctgagcatgttatcagaatccatctccacccagagctatgaagacctgcatcagatatttagatttggcaaaaatgaggaaccctctccaagagcaggagctgctttctcaaatctctctccccagcacctaaaatggcacttgatccagatgaagctctgtgtatattttttcattaaactaaagcctggccaagacacacacaccccaccagcagaaaccgccccccccaaagaagggcggagaaatccagcccgaataaacaacgtaaggtgcttcacctttccttcttgctgtcgcggttcacaacaccgtcgccgcccctcggcgcccacgcggcccctccccgtcaccatcgatccttgtggggggggggcgctcagtcggttctttttcagcccacccatttctccccccccccttagtccccccctacataccccccccgcccctacttccccattcccaaccacgggtttgtccgtcgtaccctataacactttcaccttccgtccaccggcttgtactccttctgtaggatgctggtcgcccgctcgctccttcccccccttcccccctctcccttacaaacaccgtcc

SEQ ID NO: 17462 - DNA, 326 bp, Homo sapiens
ggcttgaagtgcaatggcacaatctcagctcactgcaacttctgcctcccaagatcaagcgattctcctgcctcagccttctgagtagctgggattacaggatgattgtgaggcctccccaaccatgtggaactgtgagcccattaaacctctttactttgtaaattacccagtctagggtatgtccgtacagcagcatgagaatggaataatgcaagggaaatggcacaggcatccaccatcttgtctcaccaccaaccgagacacagacatgatttctattcataagtgcctattaaatgttctttctgagaaaaaaaaaaaaa

SEQ ID NO: 17463 - DNA, 625 bp, Homo sapiens
agagtctcgtgctgtcgcccatgctgggaatgcagcggcaccacctcggcaacctccgcctcccgggttcacgccattctcctgcctcagcctcccgagtagctgggactacaggtgcccgccaccacatccggctaattttttgtatttttagtagagacggggtttcaccgtgttagccaggatggtctccatctcctgacctcgtgatccgcccacctcggcctcccaaagtgctgatattacaggcgtgagccacagcgcctggccaaatacttctctcttttcatataaaaatgtcagaagtccctggagatagaagtatatcttatttttgtattttaaagttgtgctatattgcttaagtgcacaggaattatagtgaacttatactagaagttttatttaaaaattcctgttatatggttttagaaatcattttaagagaataaaagcctgaagggactgttaagaactccttatattatttgtgtactattctaaaactcataattcaatctttctaatttttgaacaatgctggcacttatatgtaatcaaaaaggattctctcatctgtcactgcctaaacaaacaaaaaaatggcctcgctggtcctcacgtc

SEQ ID NO: 17464 - DNA, 364 bp, Homo sapiens
gtgagtactcgctaccttatgaacagctgaaagcctaacagaaaaaagcctaactgccttggagaatgagaaaattcactcagcagactgcctttggacttgaactgcaacatcaacccttccctgggtctcctgtcagcctgcctatcctatggattttggatttgccagcttccacaattgtgtaaaacagttgcttaaaataaatctctctcgtgagtgtgtgcatggacacccacgcacacactattggttctgtttccctggagaactctgaaaataaaccccttaagtataatgaataaagacactttttatcttatagagaatgaacattaaaaaataccaaataaaaaaaaaaaaa

SEQ ID NO: 17465 - DNA, 758 bp, Homo sapiens
agttaaccagctgtgaatggtaccttacagagtccaagaatcacactaatactcacgtattcatgggaggcctagaaccaaggctcacagctgtaagaaacttggccttgagtctcagatgagactttggacttcagactttgggttgatgctggaacaagttgacttttggggactatcaagatggaatgattgtattttgcaatgagagaagagtatgagttttgggagggccaggggtgaaatgctatggtttgaggcttccaaatctcatgttgaaatttgatctccagtgttggaggtggggcctaatagggtgtgtttgggtcatgggggcagatatctctgaatggcttggtgcagtccttgtggtaatgagttgagttcttgctctatcagttcccatgggagcctattgttaaaaagtccatcacttccctctctttctctctcaccatgtgatctctgcacacatgccagctccccttctctttccaccatgagtggaaccagcctgaggtcctcaccagaagctgatgctggtgccatgcttcttgtacagcctgcagaaccgtaggccaaataaacctcttttcttataaattaccagcctcagatattcctttatagcaacacaaatggactaagacaaatatgtatatttgtataacatgagttcataatttacttgcgatttttaatgtctaaaacccatatatgatatcatttccttaataaactattttagttatttgaat

SEQ ID NO: 17466 - DNA, 757 bp, Homo sapiens
aagcacatatttttccacgttgattttgcatcctgcgactgtgatgaattaatttattagttctagcctgcttttttgaggaactttaggattttttatacataaaatagatgtcatctgtgaagagaggtgcttaagcaagcagtgggaaagaagttaaatggagttttaatagaagtactgcacagattgctatggagcagagaggaagacataattatctttgcctagacagaagaggctgcacatcccaaaagtgagcattgagggataaataagaatttgtatagtaaagaatacgcctggtattcaagagatagaagttgtttccaaagcattctgggaagaaaaatttcgtgcacataggggtggaaatatagtgtcacattcagggaatttcacatagaagtgcatacactgcgctgagaatttggaataggaataatagaggaggattgagagatggtaaaaacatgcaggaaaaacactacgaggggcactgtacacctttgctaaaccatctcatatcaagacttgacgatgggcaaaagtgtatcaaactatatttgtaagtgacagctttcttgaaaatttagacaaacattttttttgtgtaaaaagcatatattacatgtgtgatgaaaaaaaaataaaaaaggggtctcttgtgccttagcgggggagctctgcgcgcgttttcttttagtggggttaattaatgccctctctcactgcctcgcttgtctcggcctgtggg

SEQ ID NO: 17467 - DNA, 723 bp, Homo sapiens
gtgatgagaagtacctacatgcccagggaagctgccatctccacttttccttagttccaggcacaacaggtgatccactgtgtgatacataagacaagtgtccttcataagaaaattgacacagaactttatgatagataaaccaggggaaagaggagaacagacaccagaaactggccatgggaagagttctcaatagggctgatgctaacaagctcagtgatacttggtccctgcaccaagaccttggctgacaagaaaaacctccatgcaatggtgatgggtatctcattcaacccagcattctctttatctttgccagaaagttccagtgatggtttataaataagacccccaaactttactctttatttggtatagtgccagtaaacatactaacttagagcgtagaatattcttggtctacaattaaaaccacatttaaatttatttgttgaacagtagttatatttcatacattgtgtcattgagaaattacttaatccctttttattttgactttggaaaaaaaaagaaaaaaatggccttattgggctcatcggcggcgctctgcgcacgtttccttttagtgagggttatttttttaccctccctcactgatttgctgctctcggaccttttgcgccggtagcgtcccatcttcctatgggctcagattctttatactccaatacggggaccccgccggaaaaacctcgcggg

SEQ ID NO: 17468 - DNA, 768 bp, Homo sapiens
  misc_feature (1)...(768): n = A,T,C or G
gggatgtctctgactctcaggaattgcctggattgtgtatgccataaaatgaagtattcatcttctacgggatgctgaaggagaaacaagatcctatttctagccctcctcttccttaggaagagccaaagtactggacgcgcatcatctagaccactcttcccactctcccgtgcatgtggatggggtcatgagactgactcccacccaatggaacgggagcatgaacgccttctgtgcatgatcctcttctttattccacactttgtctgccaagggcaattgcgcatgggagaagatctgggggagaccttgggacgcaccatgaagagggggggaacagtttttttcaccctggggcctctaaaaacgtggtttgacgtttattccccctctcctttggtcctttttctcgccagggggaaaaagaaacccctacacaatttttgtcctcggccccaagaaaaaaaattccccccccaactcggtgatggggcccgaatatgctaccacttttctctttcttctccttgttaccctatttttatatctgtgcgtaaaagcgcggntcttttttcctccctcgcgcccgctttgtacccatattagactgagctgcgtgcttccctccgctcccctctcagtgtacctctccccccgtctcctttctgacggctggcttcattgctctctcccttctccctctcctcctgtatttttcttttacggcggtatagcaccactagaatgatataatagaaatactac

SEQ ID NO: 17469 - DNA, 807 bp, Homo sapiens
  misc_feature (1)...(807): n = A,T,C or G
cccccgccgggncgcccggcgcgcgcgccggaccccccgccccccccccccccgcaccgcgggcgcggcgccggcgaccgcagtgcatacaggttcttcattaccaaaaagatcagacagctgcgtgtggatggatagtccattttgcaggccactcatactacagttgggatgaatcccccaaagaccaaaccttcatcatttctacaggatcaagatctacttgagagatctgctgatccaagcctgagacctcaagagcatatttatctcttctttctctcttcttctcctgcaccctgacggacactccttttactgcacccctgtgaatctgcttcttaatacgcgagactcacccccgctctaccgaagcaaaactccttggtggcgataaagacggcccacgtccactggataggacaagtcgaactattttgggtgtgtatttctcccccttttatcccaccctctctgccttcccctctcttctctcgtccgtacgttcctattcttctacttttatccctcccctatcccactaatctccgccactttccttataggcccccctacacctatacatccgattgacccccaccccacccctacccgtgcccccttcccgatcccttttcttgaggcgctgtgttttcccccgccccccataatacatctcttctccctcttcttccccctacctccattttataccataaccgacctccgacaccttctcgtcctcagcatccatcagtccaaaatactcccaaacccgagttttgctcttgtcggccccctccttcc

SEQ ID NO: 17470 - DNA, 754 bp, Homo sapiens
tgggtttgaattgccaagccagtgactaccggaaagagcgccaggtcagccatcacatctgcaggaagcaggaagcaagagatgatgggagggggatgtacctcccagctgagtcgcacacatttgctgaaccttcttggatggtccacacaacactcctgcttgtacctcattggccagaattagtcccagggtcactcctggcttcgaggaaggctaaagacttttagcacaacatattgccaccctaaataaaatctgtattttattaccaagaaaaaaagagaagagcagctattgagtaagcagcagagtacctgccacattcctcgtccataaaatagaaataatattaatacctaacttatggaattgatgcgagtattcaaggatataatgcaggtaaatgtcttagcacagcgccagagtggacatttgatcaatgttagcaataacaatatttattgctatatagtaatttgactgtaatagactattctatgacaaacaggaaaaagaaacactctttataacttcctttctctagttccacatagctacctgaagccccgtataaattcactcagataaacttaggaatgaaatttctactattattgttttgtttcacacggagtatttgcttagtatagaacagcctgtttatacatctagcaatcaataagcattaaaaccatgtactccactctggattttcctgactgtacaatttttacacagctttattcactta

SEQ ID NO: 17471 - DNA, 460 bp, Homo sapiens
gtaaaagagctctacttgccagcgtcctgcattatacataaatagaaaggaagaaagatgagctatatgcatcctggaaagaagaaaatccaattgttattctggattctaaacattacctgtgtggccgttggataaacttgaatcttttcatatataaaacaagggaagttgaattaaattatttctaacccaccctccagttgaatattctatgatttcatctgacaaaccctccctcttttcatccttggtgtgtgagaaatgctccatcactcatcacagatgcttaaaataaaatagctctctctctgtatagaatgtctgcctttttttctccagatagtcatggcaccatgttgacattttaaagacccaagtgaagagacaaagagggaaataaatccccccctataatcctatcaccaaaggattgtgttataatctaaaaaaaaaaaaa

SEQ ID NO: 17472 - DNA, 406 bp, Homo sapiens
tctcctctgagcatgctgtgtgcattcctgcctttgtgggttcctaccgcctgactgtgtgtatctccgagttgacactcccaaccctaatcctatcaagtcttcaagccccatcccccaccttaactctactcctttctccaggaagcttatactgacttcaccatcagatctggggtggaattctagatctattaagtgacaagagtgagaacttgtggaaattaccgttctctctgccctgttttttcctctgtaaaactgcagtgatctcaccaaactcatagattctgagatttaaataatgtggatgaagtgcttttaccatgcctataataagcacccataataagtgcttaaaaaataataaccaataaattattattgacatttaaaaaaaaaaaaa

SEQ ID NO: 17473 - DNA, 544 bp, Homo sapiens
accgttaggctcgatcaacgtcaagttcaggtttgtgtttgttttttctttccttgcaaattacttcgttggaagtggagaattattatcgccttccttgaggaggcaacatagtgtgcaggattgtcttctttttgccactcctcatactcagtatctgacagcctgatctaggctgtaagaagctctccatcaccctgacacctagggggtgccattaacattattttagtgggaggtgcaaaggggagattttttttaaaaaagattctatcatcccttcttcatttacgcaggggaatccctctattaaagataattttctgaacaccaccctgcgcaacatggaaaaagcccatctctactaaaaataaaaaaattacccacgcgtgggggtgtgcgcctgtacccccatctactcagggggctcagggctcagggagtataacctgaccccaacacatggggggtgcagagagccatgatcacaccattgctcttcaccctgcgccacagagcaagaccccatctaaaaaaaaaaaaa

SEQ ID NO: 17474 - DNA, 391 bp, Homo sapiens
gtgatatgactttcccaacttaacacaggaagatcgaccaaggttaatagagagcagcttccccacagctcaaatgtggatatcgcacatagctgactgctgaacagaaaaaaccagtgtcctgccaagtcctccgcggtgctctggacccagagccagaaatgtgctcacctccagcgttttaagacactgaaatgagaacccgcacagcttggaaaaccagcacataaaaccaggctctgtggtgcctaccctctccacttatttaaccatgtcagctctcaggcaactggaaaacatgaaaagggcctcaggatgcctcctggaatatggtctacattaactcacaggtggtagcagttacagcaaaattaaaaaacatcggagcaaa

SEQ ID NO: 17475 - DNA, 385 bp, Homo sapiens
gcttagtggtgactagaatatgaatttcacgagaaaacagctctgctgcaaaaacttcactgtaagagctggaatgatcaccttaagcaaactatactcaagaccactgcaactgcagaggaattgtatgcagaaagacattatctctcaggctcagagcacagtgcttggtaaagctaattatattccattggaagcatttgaaaaatttttaacaataatgaaatttttatatgcttctgtagtctctgtttaataagaaagaaaagaaattgtaaagattggcctggagggtgaagaattaaacctctagatgtgtgttttctgtatcacttcaaatttatggaatgaaatacatttcttcttatcttcaaaaaaaaaaaaa

SEQ ID NO: 17476 - DNA, 681 bp, Homo sapiens
ctgttgtctaccagaaacgatctaattgttggcaagaaagacttatactagggtttgtcctttttttgactttaaaacctgaagttagaagtacaactagagcaacaagcacacaatcagttcctgaaaacctacaatatctttgagggttatttttaaattttgattttattttctccaacattttattatgaactttttcgaacatgtagcaaaattagattaattttacagtgaacttcctctaggagcagggatgtccagtcttttggcttccctgggccacaatggaaaaagaaaaattgtcttgggccacacataaaatattctaacgatccctgatgagctaaaaaaaataaaaatctcaaaataaatcttattatgttttaagaaagtttacaaatttatgttgggccatattcaaagctatacagggctacatgcagcctgtgggctacaagttggaaaagtttgctctagagcctactattaaaattttattgcccttgttataacacatgacacccttctttttatgagaattcccatctatgaacccatcttattttttttgatcctttcacagtaaattaaaaaactgggcggtgcttcatacaataaaaactcaatgtatataaaactacatccatttttttgtggcctctttgtcctacggggggg

SEQ ID NO: 17477 - DNA, 616 bp, Homo sapiens
  misc_feature (1)...(616): n = A,T,C or G
ccacggcccggagcccaccgcgccnancacaccaccaccacccnaccccccaccccacccgtaatattcaaaggaatttcgctcttgttgcccggctggagtgcaatggcacgatctcggctcaccacacctctgcctccggggttcaagcacttctcctgcctcagcctcctgagtagctgggactacaggcgtgtgccaccacgcccagctaatttttgtatttttagtagagagggggtttcaccattttgcccaggctggtctcgaactcctgacctcatgatccacctgtcttaacctcccaaagggctgggattacaagcatgagcctttgtgcccggccctattttaccctttttgatagcctggtttgatatgaaaccccacttaaaatatttcaaaccttcctttttctaattttaaagatgaaaagtgaagaaattaagactttgcgtcgcacagcagtaacaagtaaaatcagaattccctaactggaaaatcttattttattttctcattataaactcgcaggggtctcattggacgtatcaggaatatcatctaaaattatgtgggcgtgttctttatgaggaaacccggaaaaaaaaaaaaa

SEQ ID NO: 17478 - DNA, 816 bp, Homo sapiens
ttttcctcgtctgtgttcgtctcccgtatggggggagccacgccgcccgccacgcaatgccgttaaaaaaaccccaccaacgcattgcagctcttaccttcttagatccttgagtccaccaagtgaagattactaagctctcctactgacggaagaaacaccaagtccagagaggtctagttattccagcttaggccctattgaggccctcctgcactaccccgctcagaacacccaccctaccaactcacacaaaaggcggatctttttgcttccccccccgcgaccctcaccccgacgactcgtgagaaacaagccctaaatgatgttgcctgcggaccatcctcccggtccccatacccggttttctttattaaaaacgcacgttgtccgtccccctaagtataagccttccccctaccccccatcccaccccccccccccgaaccccacaagcactccaaactggccctcttccccaaaagcgctgttattcctcctaaccatgtattcttatatattccacccataatttaaccccccacccaaccccccgccccccactctcgtatcaatcaaacaacgcgcccgactttcgccccgacccccactcctaccctccaaaacacaccgcctacctccccccccccccttcacccccccatacgcatcccacgccctccccccataacatttagccccaaaatagtaccgcgttctcattctttatctacccccctccactacactcttacgacactccgtctttccaccccccaccaccgcccccacacaccaccatacgacattgagacc

SEQ ID NO: 17479 - DNA, 179 bp, Homo sapiens
taggtggcggagaggaagttcctttagaactgcctgtttaatacatgtgcttggtatcttcttcactcattgaatgaattgatatttattgagcatttactgcttgttccagttgctgagaataccacagtgtacgaaataataataaaacaaaaaataccctgtcaaaaaaaaaaaaa

SEQ ID NO: 17480 - DNA, 1634 bp, Homo sapiens
  misc_feature (1)...(1634): n = A,T,C or G
agatttataatttgtggacatatagtgatagttagtnacactacactcatcacatcatnatattaccgacatcacgcgcagagtcagttatgagagtgattgttntatagttatgatatcagataccgcttcctgctaattatgatagaacgtacatcatagcaatatcattatacgactcattatattcatccacnatcagacgatcatctgtttacatgttanaacatatatttactattagatagatattgaatgtgtctgtaatgggcttcgctgtctctcgtatctctatgatacagcttacacttctnntcctgtcggagcgacacgacgaatgcgtgcgtggacgagtatgtcgcaggcggtctgacgtctatcacgncgacagagaaattgtatgtagtccgagactgggtgtcgagtcaggcgagtaagacacgagcgatgtgcgcaggcgcgccagccctccccgccccgtagcgcagcactctgagcttntctcactattttaaatcaccatttacagctcctgccacccanatttacatgtgcacaaagtaccagcacacgcgcacactgtatcctaccgcaccaaacaacacatcgacacgcgtgagcatactaccgcatcccactcgatcgcgcgtcgtctgttcttgtatttcattcatcgatcccgcgcattgtagcatagagtattgaggtacatngtgtgcagacaaccattagcgccacgaaccgtcgtagatacatatcaggccacgcgcaacgcggtcgcaccgcgatccccgacctgcgcagctgccccacccgagcagacgcagcgcgcccgctctccacgcgtatgcacacgtatacgcgtcggcgtccgggcgcgggtgctcgcgcaggccactgtggcgttgtggtagcgcctttagactgcgcctagacatgaagcgcagctcgccgacccgtgtcccgccgcgactgcctgcggagaatgttccacgtgtttgcagatgcgctccttgagtgacaacacatcgaccgatacacgcattacatgcccctctcatctacatcgctcaccctccgcacgcgtcgtgcatctacactcacgcgctccgtctcgtcggtgccgtatggatactcaccgccacagtcgatctctatatacgtagttccgtaaccgtatctctcgacgacgcgacgggcgcgtgactctattccacgttggcgtggtccgggcggtcggcggggagatgtgttagtaccgtcgtgtgtctaacgtgcgtactcgtgtgaaacagaactctaaacacgtagcagctacatctctcatccaaaagttcnacattcatacactacgaatactgtgtaacatctcgtcgccacactgcntccacaacccgtgtgcaatagcatcgtantctgacaccgtatcagagcatatactcaccacatatgcacactacncgtcaacgcctcgcgcactctactcatctctctacggcattcactatctgatgatacaccacnttcacgcgtatctacatcgccccgntgctacacgagacagangagattgagctgatntgtactactgtgcataagttagtcccgnagctctaacattagctgtgtcgacg

SEQ ID NO: 17481 - DNA, 747 bp, Homo sapiens
  misc_feature (1)...(747): n = A,T,C or G
ggttgctaacaattaacccatgataagaagaggttggatgtgagatattaaaagaaaaagacatttaaaagtccgaagagagggaaaagaagacagatgttgtccaaaaaatctctgaactgcatgaatagccatttaggcatcactgggatggagaactgagctattctgatcatcattagaaattgaggaaggagagcattgccaagtaagcaagaggagaaatcaaactgttcaacttccctcctttagattagtctggaaaatacaaatggcagctatagtaaaatattttatattttttttccaagacaatgcttccttagatggacacagttcaagatttggttattagaagtaataatcttatgatatacnctcacctactagagttctgtattgaattttatgaggatgcacacttattttactccacctacttctgttcagaacatggtgattttcagcccctttttaaaacacatatcgggattctaaccctctgtaattcacaatataccggcaaaaaaacgaccccaatctattggtgaatttcaaacccaaacccccagccctaggacgccccgaccggcttcgcacccacccgaagtgttactatgtcccccctttagactcgcaccctgtttttgtttctccacgccacgatactctgccttcttctcccctccccatctttcgtccccgcccccctccacctcccacacactctctccgcgaccctcctct

SEQ ID NO: 17482 - DNA, 250 bp, Homo sapiens
aagggtgaaagaagctttgagcaggtgccctccctctacatgttcccaccatcctgcgtccttgtgctgcgccggaccaggcatgcaagaacaacacaccaaggatggcggagcaacaagatagaagaggcctgagtcccaggatgactgcctggagcacagctgtctgcctgttcagggccttgtgtcacatactataatgtgagagacaaataaacttgttatgtttaagccagcaaaaaaaaaaaaa

SEQ ID NO: 17483 - DNA, 293 bp, Homo sapiens
tgatttaatgagaacttacaagtgctgctccttggacaggactgggatctgaaggaaggagtttagagagctcggttcctattggagtggcccagggaaccctgaggatccatctcccataactggacttcaaaaaactaacagtcctcagaacaagaattactgaagaaaacaaaaacaaaaaaaatcccctaacaatccaaggcaaagtcagacaggccaagttctgcttcttaaccctttgaatactatgcatttaaatacatgtattttctcaaagaaaaaaaaaaaaa

SEQ ID NO: 17484 - DNA, 424 bp, Homo sapiens
catgagtaattctgtccaaaccctgaatcatatcttggttattgaggattgcaccaagacctcaggatcgcctgtacagaaaaccagcaatcattatccaggaatggagatgaacatggagaaagtctaagagactgggttgactgtacaaactccaagatatagtacataagcctagagatcctttcttaaacttcgatattgaaattactttcctattatttttcctatttctttaaaaagcatattgtttggactaaattacagttattgggggttttttaaaaagtgtcaattcatggaccctctctattattatatttctttgtctttctatgctcaaactttttggactttcaaaatgtcattgtgtatttagaacaagagttctttattaaactttaaatatataaaaaaaaaaaaa

SEQ ID NO: 17485 - DNA, 271 bp, Homo sapiens
ctccgcctcaaaataaaaaaaaaggaaaaaaaagaaaagaacaacatagacaggcttttgtataaccatgtctttttagatgctttcatgttttttgacaagtttttctttgtctctacaggtagtactacattggaacttttaatcagtttttattactggaaacaaggtatcatcatattccttgtaatataactcttgatacaattattttatctaattgtcatgattgcccaataaatttatttgattaaaattaaaaaaaaaaaaa

SEQ ID NO: 17486 - DNA, 238 bp, Homo sapiens
tgtgtcccaccagagcatgagaccgtcactgttttttggttatgtcagtgatctatcttcactccctcccaccaagaagcataggaatgtattcaccaccagattaaaaccagcatcaatttgactctctgctctactgcactctaagttctgtgaatattaatagaaatttatttgttggatggttgactgcttaaattcatctgccgttcctcggttggagtcaaaaaaaaaaaaa

SEQ ID NO: 17487 - DNA, 380 bp, Homo sapiens
gtgaacagatagagaaggaggccatctactaaccagagagggagtgggccctccctatgaaccaaatataccagcaccttaatcttggacttcccaactttcagaactctgagaaataaatgtctgttgtttaagtcacccggtctacggtattttcttacagtattccaagctgcccaagacagggaacatgcatcagagaatgcagctggattctaaagcctgggaaaggccgggtcatggattattccacagagcctatagaaggaatgcagtcttccagtgctttgattttaaatcagtatgacctgtgctgaacttctaacctggaatactgctagacaataaatttatgttgttttaaactaaaaaaaaaaaaa

SEQ ID NO: 17488 - DNA, 268 bp, Homo sapiens
ctctctgctggcttcaccgatgactcacctcatgatgagaccgagaccatcatccctgtatggtgtgacttcctgttcatcacagcttctctggccagattgccgtatctgtctttttgcaattgtcacaattgggtgaagaattaccaagacctacttaactagattatctgggtgccacgaatattcactgctccattgcataacaccacttttgccttttcatcaacatgaaggtcaattaccattgccaagaaaaaaaaaaaaa

SEQ ID NO: 17489 - DNA, 268 bp, Homo sapiens
ctcttgccttaatctcctaaagtgctgggttaaagatgtgagccattgtgcctgacaagactttttatttttatgtagttaaacttttcatttttttcctttattgtttctgggtttcaggctatgcttagaaaggctttctgagcctcagaattgaaaaaatattcctttgcattttatggttgttatctatgttaagatttttaatccatctggaatttatatttgtatataatatatcttgatttaatgattaaaaaaaaaaaaa

SEQ ID NO: 17490 - DNA, 879 bp, Homo sapiens
  misc_feature (1)...(879): n = A,T,C or G
tttttttttttattntttttttcttcccccgggcgtgcccggtcttcaatctcttctcccctctcattctccctggaactccttgcctcaagcaatccacctgccctgacctcccaaagtgctgggattttgctatgagccactgcacccagccaggagaataaaaatctatagtaggtgggagctttcattgtccctgatctggaaaaactcagtgagctgccaagtaacaaaaaaatcctcctataattgggaggattaattatttctggtactgagatatacattggatgtgggatatatatccactttttacttccctatgaatatttcgcgaatctcctgtatctaatatttcaaacatattttgcgtgcattaaatgacacactatcgaacaaaaaaaaaatttatcgtaccatcccgcctctctcgctttcatctcacgcctcccccccttagcgaggattccatccttctccccctccccatccaccccctccccctcgtctctatcttcccccattactgcctttacttccactttccaccccccctttcaaccatcctttcttaaccaatgtgtttaatctcccttaatcccacccaaaatttatatcctctcaaaatcattcccatctctccacatccaccgcgcacctcttccatcctccactctattttcgcccccccccttctttctccgtctctttaacgtgcccatacccgtttcgctttctccccccacgccccctctctccatatccgagtttatccacttatacctagtccccgtccaatcgccctcccttcgtactcactcccatctctctaatcgaagtgccgcgcgtaacacgcgcgccaatattaaaagtcatctg

SEQ ID NO: 17491 - DNA, 230 bp, Homo sapiens
gcttatattcatcaggctgacatgtttttagctcaagagtggagacttctgtcaattatgtgggatcatgaatgcctgaaaggttggaggtccatgcgttgaccaagaagaactccagctgcttcagattgcttgattgtcactgaaaagtacacccaatatgaagaagattgcagttaagtggagattaaaattagatgtcttaataaggcatatcaaaaaaaaaaaaa

SEQ ID NO: 17492 - DNA, 253 bp, Homo sapiens
gtttcttgtgactttctgtgggactctgaggaatgttgggatgataatcacaggaaccaatggctgcctctggaaagcccataattctgcacattcatggagcttcactctgattccaaatccagaaagaccaccatgtcacttatggagacacttgaaatcctttccacatcttcactcatcacgcctggggtgagaactaggaatacgtgaataaaccaataacacgttactgaagtcaaaaaaaaaaaaa

SEQ ID NO: 17493 - DNA, 292 bp, Homo sapiens
gagaaagttagctgccatgctatgaggaaagatccacctggcaaaagactgatgcctgccaacaactgtgagaaactgaggcctctaacttatagctctgtgagtgagacaatttacaagtgaatcttcaagacccaggaaagccttcagatgactgcagccctagctgacatatgttgcaatctgaagagagcatctgacccacagccacctagctaagacactcccagattcctaacccacataagctgtgtgagataataaattctggttgtttccaaaaaaaaaaaaa

SEQ ID NO: 17494 - DNA, 757 bp, Homo sapiens
  misc_feature (1)...(757): n = A,T,C or G
cttataggcaacagngaaggccttgtgaggacacacaaagaaggctgcctctacaagccaagaaaagattcctcatcaggaactggtctgctggagcttgatctgggaccttcagcctctagaatttctggctcctccagaaaccagaggatcccgaggatgacacatcatcgtctgaattgcagcctccatgcttacatctttaatagaactgacgaataggacctgaagtacatgctatgtgaccttgatttagccaatgattgtttttctatttctatcagaaaagagaatcctaaacagtttgcattcacatgtaacgtacaaaagtgtctatctacagttttgcctgggacaatgttaattcccctccccctgtcataacataatctgcagtgatctgaactgtcaggataacccgcagattatcacatttatccaccatatcacgttagtcagagcggatatgcaagtggctagtatgttggatgccttgtttggacatatgggcttcagagggtgagagatgaaccatgcgaatattcagaattcttttgacatcagtaaaaattttaagcatagccacaggcatgccatgaaaattaaaagataaattatttcatcttacaaaaacactacctttttaaaaactcccccctgcctccctctcgcacaacttaccctcacaaaccacctaaacccctcctccacacaacatacactcataccgctctcattcctcccttgattgcccccg

SEQ ID NO: 17495 - DNA, 627 bp, Homo sapiens
  misc_feature (1)...(627): n = A,T,C or G
ctagngnggctcgcttattgagcttcgtgtctggaatacataaggctaaagaaactcaccactgtgtgattccttggtatatcagttgtctagagctatcataacaagtacaacagactggttgacttaaacaacagaaatgtattatttcacagttctgaaggctggaagtctgggatcaacgtgtcagcaagattggcttcttttcaggcccctctccttggattgcagatggctctcttctcatggtgtcttcacatgatcttccctctgtatttgtctgtgtcctaatcttctcttcttaaaaggacaccagtcatattggattagggcctatatggcagatgtacctgacagcaataacttggagtggccaacctggagattcattccttatctatgaggagcattggaacccttgacccatcccatggaatgcaggcttcatcatgggttgaatgaaggttgccagatggaggttgccaggggagggtgctaagtgaaaatgctatgtaaaccacatgcttttggcaggtggttgcagttttcctgtgcagcccatcaccactgggccaccctgtatgtaagtcccctcaataaaccctatgtctcacaaaaaaaaaaaaa

SEQ ID NO: 17496 - DNA, 767 bp, Homo sapiens
ctagccggcgcactctgtctttttagaggacagtggcctcatctgacagctgcatcatctttgatgagtaataccctccatcattttcaaggaatagcagccaaacaaagaaaataaatctcgagaagccagggacaacacacccctggatgttcagatgtgtccagagtgtcttccttctggtgggttcctggtctcactgacttcaagagtgaagccgcagaccttcgtagtgaatgttacagctcttaaaggcggcgtgtctggagttgttcgttccttccggtgggttcatggtctggctggcctcaggagtgaagctgcagacctttgcggtgagtgttacagttcatagaggtggcgcgtccggagttgttcgtttctcccctccggagttgttccgcccttccggggggttcatggtctcgctggcttcaggagcagagctgcagaccttcacgggtcttgtgactggagctcggaaaacaagtccctccgatctcctacctccccagggaaaatggcggataaatgacgcccgtctagcgcctgatgtgttactggcttgcagatgaaccaagcaccgttgtaaccatgtcattatcaatttcccacatgcctagacacactttggaaatcgccgcggatagttatgaacccgcccctgtcgagcggcgtcttttctcctgtgaaaaacacctcttcttctcttacatttcgtccggttccccccatgagccacctttgcgccgacaatattttcctcc

SEQ ID NO: 17497 - DNA, 765 bp, Homo sapiens
  misc_feature (1)...(765): n = A,T,C or G
cctanggtgtgaccntcttgttgaatttcaggggnagagccagccatgagtggcacagcccaaggcaggacgattgagaaccaggagacatataacttgtctacagacccggtgctcaggggaggagatcccagtgatcagagcctgcattcaggtcttacagagaaactctgcttcaacctctccagagactagaaacctctcaactcatgccagtgtggatgatgggcagggcctcagctgtgcaggatgaaggagaaaacggaagacaaatgcttcctaagcagactcccagctgagtttttatagccccacctttgctgcgattcctggaaccatcaattcctgagtatttggggtgttctgcagtgtaataagtttgcttttcacctcccactctaccagctgagaagaagtctgcatttttggatctgcaaagtcagctgaatgtgtcctcctccctccagcttccaggacaggtgttgttcttgtctcctccatcattttctttgtccttgtgggcgtatgctctgtttaagccccattgctgttatttttgttggctttcaagaggacaaggagataaatgaaagtagtcaatcttctgtctttacccatagtccttcacaggattctaccccaaagttctcctaaaagacttggttgactactagctgctgataacgctgagctgctcgcgcccgcaagacccacgtggcctcattgcgcctattcaacgtttatggctcatgttttttctcctcg

SEQ ID NO: 17498 - DNA, 882 bp, Homo sapiens
tctggggaggatccacgaaccctgtcttggggactggatcaagactatttttgtgtcacatatttctggcgagctctgatgggatgataatgactacttccgcgatccggaggcttatcacttggttacaactcggacaaacttgcatatcacactaaagtttttccaatgaacacgagagacactctaccgaatccatgaaatggccatcatagagtattcttgaatgatcacaaaagtccgatcttagcaaaagagcagataacttggcaacgcgtatgagacaaatcaataaaacattcaaacaccgcaacctcatattcctgacttaggtcgcaggaacattgcgtggactcgtgcatagcattaaatctgatagataaaagtcggcctgtattccctaccataacaataacaaaaaatgaaactggcgctccgtctggctcttacgctggatgcgagcttttcgctgcacgtttatctgccttttattgatgggtttaatttcactgatctcctcgctcacatggactcgcatagcacctctcggcacctcaagctggcgcgccagccgcgcctacacctcacctcaaacggcgggctatatctgctcctccccaccaactcgcgggcatcaccgccggaaaagaactatatttatctttaaggccccgcataagtgccacggaacccgtaccaaacgccgcttttacatggtatctattgctataaactccaaaccaccttttaatatatactacacattccgacctctagtatagaggtgtgtaaccgctgactagaaccttcatgaacccagcgcataacaccccgtataccaacttaacgcctctattcttccaccccacttctctccccccg

SEQ ID NO: 17499 - DNA, 263 bp, Homo sapiens
cttagtgcaacgcctgctatgatcacacacatgactatctgctgctccattggaaagccaatagcaatgaagggaaaggaccttctgattggagagtggaggaagaggcatcatctttgatcatcatcagattttacaactcattgttcccttccagtccacagggtgagagaatcatgtaaatggtcaaacaaacacttggattatagaagacacttgatatttttaatgacaataaaaatgtttacctaaaaaaaaaaaaa

SEQ ID NO: 17500 - DNA, 775 bp, Homo sapiens
tagcgagactgtagattgtggttgtggcattaaagcagcaggtgaacagacttcaacttttggagagtaatatgaatcaagaatgactcagtttttcatttgagtaacttgcaggtggcagtgatgcaacttatcatgataggtgttattggtctttaagtccatactgtggtcccaggaaatatgagattgtgttgacttttgtcctataattggagaagaagcaaaaagggactctaccttgtcctcagggacaatccgtgaaggcttgagtggagataaccccaccataaaacctatactgctggtgttcccagagagcaggctgcagtctgcatcagcctatgctaagaaaagagagacaactcctgcatctggaaattccttctctcaggggctgctggtgggagcaagatcctcagctctggccttcaaaagctcctgtgatctctgcacaatttctctaaatagaattatatttctgagacaagaccaggcctgataccacaggtttagctgactcacagttcagcatggctgaggaggcctcacgacacttacaattatggcagaagtggaagcaaacacatcctttttcacacggtggccagaataactgccaagcaaagcagggagagccttttaaaaaaccttcatatcagccctggcctggtgactcacacctgtattaccatcactttgggaggccgatgtgggccggttcgccagatcaggtattgaagacaagtcttggcccatatgggtgaacccgcct

SEQ ID NO: 17501 - DNA, 293 bp, Homo sapiens
ctttactggccctgtggtggaatagaaagtgcatctccggggaggaatccaagccagccggagaaatttgcgtaactaaaaggaagaactattcaaaatggcaagacatggaagcaacctatgtgtccatcaacagaagactgaaaaagaaaatgtggtattttgagatgtagtacaatggaatgctattcagccataaaaaaagactaaagtcatgtcttttgcagcaacatggatgaaattggagaccattatcttaagtaaaacaaatcagacacagaaaaaaaaaaaaa

SEQ ID NO: 17502 - DNA, 299 bp, Homo sapiens
cctgctggtgactgtgaggcctgttgggaggcgaacggacatgggatgaatttctcatcaatggttgatcgtcatcctcttggagctcgtcctcggggtagtgagctgaggttgttccaagtgtgtgacactccgccccagctttcaccgtgcgacgcgcctgttcccctttgccttctgccatgattggaaggtcctgaggcctccccagacgcaaatgccagtttttttcttcctgtacagcctgcagacctgcgagccaactaaactttttttctcatcagtcaaaaaaaaaaaaa

SEQ ID NO: 17503 - DNA, 768 bp, Homo sapiens
tctttggtgtaacaggaaagaatgttctccagtttcacaaataaattaccctatcatttccagtacaaaacttttgttaaaactgctgtcgccaggatctacacactgctgtcaatgggaggaaggaaggatggcacactgctcatgaggaaaaattttgaaagttagcaccaatcttgagtgactggtaaagtgacttgctgagagctgtcatctggtgcctctggttatttacccaggtgtagacatgggattccaccccaccctgccactgttcttccaaactgaaatctgaaaaatggcaagtctaaaagggataaaagaggttcttgcacttccatgaaaaagttctattggaggaggtatttatgaagattattcactgttggcatatagaaatgctactgatttttggtatgatccaaataagactacctcaaaagatataatcaaactctcaaaggacaacgataaagagaagatcctaacagcacccagagaaaattagcaaataacctaaaggagctccacttcattcggtattctcaatggaaaccatccaggttaggagggagtaggttgacattttcatggcctgaaagaaaaaaaaagaacatccaatatttctgtatccagcaaagctaatctgtaaatcttaacgaaagatcattttttccccaaacaaaccaaacctgaacaaattgattcccccccaccaccctcttataacatatgtcgtcaggagtttttgcctcctaatcaaccacc

SEQ ID NO: 17504 - DNA, 580 bp, Homo sapiens
ctagagggctcgacttcaagaactattgaagaaactgcaaagaggacatagttaccatggtcctcaaatttaagttgcttcaaagagaataaaatacctaagaatccaacttacaaaggatgtgaaggacgtcttcaaggagaactacaaaccactgctcaatgaagtaaaagaggacacaaacaaatggaagaacattccatgctcatggataggaagaatcaatatcatgataatggccatactgcgcgagaaaatcttgaaagcaataatacaaatacaggctgatttctcataggaaatactggaggctagaaacaataaaatggtatttttaaagtgtggaaaaaattttaattcagaattgtgtatccaataaaaatatcctttaaaatttagataaaatgtagacattttaagatgcaggcaagctcggagattttttgcaagcctatctgtacagcaggaaatactaaagaagtttctttggtcaaaaaagtatatttgccagaaggaaattaatatctaccacgattgaatacagagaattaaaaatgttaaattctgaaaaaaaaaaaaa

SEQ ID NO: 17505 - DNA, 915 bp, Homo sapiens
tgccttccctgtccctgcgcccccctcaccccccccccccgccccctggtcaatggccttcgctaacaaaataaagcatctactttcaccaccaggagggagtcatcgcatctgagggttcaggttctcaatgccaatttctcacgcagtggtaggtcaggtctttgaagctccatcctaaaattgcagggctctaaataacccagatgaaacctattgggatgaatccacaactgtctgcaacaaaaagatatctctgccccccataagcagccaatcctgcttggccctaacaaatacgaccccttaatcgctccctccccgacgcctctcttcaactgctccaccccggagcgtagatacacgaccccccccaccgcctcgtacacatccctccctgacccatcgtaccagcctccccccttacccctttccacccccctccgactattcctccctatactcttttcgtatcggcccaataactcccacctcccttcccaacttcacccgccccgaccgccctccttccccactcacaacgaccccacccctgtccgatacctccatatcaccactccaccgaaacaacacgcgcgcgcccaacgcccaaccagaaatccccactctccgacccaccaacacccccacgctgactcaccacactcacataatctacatctcgaccacactcctgttccttcccttatttacccccgcttcccaatcgcccaccgccttcacccaccccatttctcaccagcgcccacgcctcgggggaaaatacgcaacgccgaacgacccacgacccgcgaaacatatccgcgacgaaaattgcacaagctacaaaccccaacataatcacccttcaccgccattgcccgcctcgcatttcgcccccccccatttcccccc

SEQ ID NO: 17506 - DNA, 734 bp, Homo sapiens
tagatggtatcatagatcatccctcctcctgatggctggattccctcctcctttttttttttttttttggcataattgaaggagaattgatcccagccttttctgttaaaatttggttgggaatccatctggtccaggttagttgcaagggtctgctgcttcactcctgaagacagttagaccatgaacccaccaggaggaacaaactctggacacaccatctttaagaactgtaacactcactgggaggagtctcttttgtatttttgaagtcagcaagaccaacaacctaccggaagtaaccaattccagatacaatgccatactactttccaacaaacattgggctacaatacaacggatttaaaatatttggactttttcaaacttttacctccttagaacactcacattttcttcaaaatacatgttgctttgatctgttacttatgggttattaatccaacactttgctactgaaactgtgtgcccaacccgttggggctctggaatttactaaaaacacaacttccgccaacaaaaaaatattattggcctacgtttccttatcagtgtgaagccctacagaggcttccttttttgaaggaataataaaaaagtttattatttaaaattgatccaagacgaaaggtgaaaatacgagataaaccccctgcgcccgccccacgaactcctctctcctacgccacgcgtttaccgccccttataccacc

SEQ ID NO: 17507 - DNA, 792 bp, Homo sapiens
gtagtaggagactatctcaccgtgttgcccaggctaaccttgaactcctgggctcaagtaatcctcccgcctggcctctcaaaatgctccggattaccaggcgggagccacttgcacctggcttgccccactattttatagctgggacttgaggcccgagaaaggtctggaggctggaaagtccaaggtcaaggcatcagcagattcagtgcctagtgaggggtctgttttttattgatggtgtctccttgctgtgtcttcacatgatggaagaagcaaacaagctccctgaggcctctttcatttttctatttaatttttctcatttttatctttaatttttctattttactttaagctctgggaacatgcaggctcgccacacaggtatacatgtgccatggtggtctcctgcacctaccaacccatcatataagttccaacgcctggcctgcctcaggcacttgtcctcatgctctccctgcctctgctccccaccccgctataggctcctcctctgccacgttactactctctatgccccgtcatcccccattcgttatgttctatttcattctcctccacctcacctcgccctccttttctccccccctgccgcttcacctgcttgttatcccagtgtccacccgcccccccatccttctacaccacccccgctatccccgttcccgcgtaaatacctaccaataaacgccccacctatgtctctcgcccataatcccctttcgccccttgcaccgctgcttattcctcgcaaaaaaaatccccccc

SEQ ID NO: 17508 - DNA, 183 bp, Homo sapiens
ctagtagcaacttctactacagatgaagcgattaacttccaccatctctgtgagaaacatctgcctcttgaatgaagaagtaagaacacctggcttaaaatcaaattttataatgaataatttaagaaaaacacttttgaattattttaaatagaaaatttattaactggaaaaaaaaaaaaa

SEQ ID NO: 17509 - DNA, 176 bp, Homo sapiens
ggttaaaagatatcagctttatggtgccccatggatgtgctgagatggggaaaatcatgaaagaaggaagtatgtaccactgtgactcaacaaataaatcaaagtaaaatggacttaaatctttcaataagtcattcacaataaatatcactctggtgcacacaaaaaaaaaaaaa

SEQ ID NO: 17510 - DNA, 374 bp, Homo sapiens
tctctcgattagattccagtcttcttgtgtgacacctaagttccatcaagatgtaaggagattttatcaactatgtagtgaccacatcttctctccaacttcaccatcccctgacttctttatttctagaccagctttgtccactgtggtagccactagtcacatatgatatagagcattagatacagagctgtctctaattgagatatgctgtgtgtgaaacacagcctaattgcaaagatagtatgaaatatgaatgcaaaatgcctcattattgttatacattattacttattgattgtatgttaaaatgaaaatattttggatacattggattaaataaaatatattattaaattttaaaaaaaaaaaaa

SEQ ID NO: 17511 - DNA, 539 bp, Homo sapiens
agaacggaccagaagagtagtgagtaccaggaaggcctgagcacagaagacccacccagatccaaactcagattctggatagttttccaattgtcggaagacactgggcataaagcaagactcagatcccaaaggataacagagggactccaaaagctgggaacatgaagaaaaccagttgctcaattgtgagatacggtctattctgtgctctctgcagtaagagttaccccacagacaacacttacttgtggactggagattttcagacacaagcagcagagaattttaatagtatgcaaacaactgcaattaaacagctttactaatagtgctattttaaagagagaaaccttcagttttaaagtcagataaaatacatatgtatgtataaccaacatggaaagtctacaatgaactcaaaaagccttttgaaattactttaagaaattattttaaagaaatggttttgtccttgcccatttcaaggcattatgcatttgtaatatacagtcttttctaaggcaaaaaaaaaaaaa

SEQ ID NO: 17512 - DNA, 826 bp, Homo sapiens
  misc_feature (1)...(826): n = A,T,C or G
ccccgccccccccnnnnnnnntnnnnnnnttncccgtttgcgttnttcttttttgacgcnngtatttcntctttcccgcaaactacatattcttgtttcatgttagtttaaaatgatacattacttatatacacactgtatgtttcaccgtgcttcgaggaaataacattgctgaacattctgaaaataatttaacaattatagaacgcggaaaggtggaaataatccaagaagtagacataagacagtggactggctacgaattacagaatctgaagaacaacactgacattgtgattttatctatccccatatatctcaatgtgagtgccattgacctgcctccattaacaacccacaatatgtgtacacccttgaataaaataacaaaaaacattggcctcttattcctcaccgggggagctctgcggtcgcttacttttaaagaggggttttttttgatcctcgtttactgactcggtccactcaaccatatagttaggatgagctgcctatactcatataacggcgatacacctgttttctctaattctcggaatatcccattacattacttgcttacaaatagcctcgcaactgtactatccaacaaaaacgtaatatcttcgaatagaacacttggataccaagtaccgttatccgccttctaattattatcctccgcacatatattatccatatttcgcagattattctttacccaccgatactttcgtttaatcgcttttctgatcgagaataaacatccaatttgactttttatcatcatctcacttttatttaacaaaatagatgttggttttag

SEQ ID NO: 17513 - DNA, 340 bp, Homo sapiens
gccgctctggccccccactgtttttcaggcagcaaatgggtaattgcattgtgattgctgcaaaccaggtttcttgccgacaaaggatggttggaagcatatggaaagggtgaagaggaggaatactatggtgttgcatttggattggaggacacagagagaagtctacagtctgcatcctggaagagggcccgggccagaaccccaccatgctagcgccctgatcctgggcttccagcctccagaactgtgagaaataaatttccactctgtaaaagatcttggacttctagaactgtgaggaataaacttccattctgaataagtaaaaaaaaaaaaa

SEQ ID NO: 17514 - DNA, 306 bp, Homo sapiens
ctctgtacccaggctggagtcagtgccgcgattgtagatcactgctgctttaaattcctgagctaaagggatcctcccaccgcagctgccgacatgctaggactacaggcacgcatcaacacgcctggctaaattaaaaaaaattttttttcctgactttttaacgatcgccattctaactggtgtgagatggtatctcattgtgcttttgacttgtatttctctgatggccagagatgatgagcatttttttatgtgtctgttggctgcataaatgtcttgttttgagaagcaaaaaaaaaaaaa

SEQ ID NO: 17515 - DNA, 646 bp, Homo sapiens
tgggtgatccattcctctacatggaaggtacctcctggacctgccccaagtgatgtgtcgactggccccaaatcaacacctccaactcaagtttccacgtgggatttgggcttcatatttgatgtctatgccaaggctgccctggacagctccctagcctagtttcagcaactccgggggaagtggtacctctctgtggactctcccagatttaaagtaactgtctcttcaacatagcccttattttacatctcaaatggacccttcagatttggtgagatctgtccagctgtttcacatgacatggtgacagaaatgtagtttttagttttattttttagaaatgtagctttggcccggcacggtggctcacacctgtaatcccagcactttgggaggccgaggcaggtggatcacctgaggtcaggagtccaaaaccagcccgaacaagatgttgaaaccccatctctactaaagatacaaaaattagccgggcctggtggtgcatgcctgtaatcacagctacttgggaggctgaggcaggataatcacttgagcccgggaggcagaggttgcagtgagctgagattgcgccactgcactccagcctgtgtgacagagtgaggctgtctcaaaaaaaaaaaaa

SEQ ID NO: 17516 - DNA, 272 bp, Homo sapiens
ctccctgtgttgcccaagctgttcttgaactcctgagatgaaacaattctcctgccttgacttcccaaagtgctgggattccagaactgaaaaggcacattaaagatatttccagaataaataagtccgtcttcaatgttatttcaatgtgatgtttctactgctacaacaaggaaaattcaaattttaaataagtagattgagaaatagaaaaatagaaaattgatggagataaaatattattaaaggattagattggaaaaaaaaaaaaa

SEQ ID NO: 17517 - DNA, 566 bp, Homo sapiens
taatcccttgcctggggcaagctacgaggaattcaagcttaaaatccgggagtcttccgtatttttcattcacgctataaaacacatgtatgtaaaaagaatcaatacggggtcatggtaagagcttggaataaggttcaggtgagagagagctcagttatactcctggctctatcactaacttgtgtatttgggcaattatgtttcttgacttgtttggaaaatgtgggggttagattacaagtaaattgtttttaatggtaattccagtacatttctttctttatcaaaaataaaacagagattatttgccaatatttatgtcagctgttcggaagaataataaatgccatattttatatagctcctagctctacagctcaatgagaaataaactgtatagaatttaaagtccatgaggagtggtaataagagaagatattcattatgctactcattattattttaatataaatagagttacagaatctcagggagaacagttaacttaatttggacattgccacccacataattaaaactatcttagatgaaaaaaaaaaaaa

SEQ ID NO: 17518 - DNA, 318 bp, Homo sapiens
tactggaaatatttcctattgactgctgtggtctaaacgttggtgtcccccacccaaattcatatgttggcacctaaaaggaaccaaatatgttcactccaacctcttgaatggaattagtacttttataaaaggggcctgagagagctcccttgccccttccatcatgtgaggatgcagcagcaagatgccatctatggagcagacagcaagcccttaccatacactcaatctgccagtgccttgatcttggacttcacagcctccagaactgtgagcaataaatatctgttgtttatttacccaaaaaaaaaaaaa

SEQ ID NO: 17519 - DNA, 617 bp, Homo sapiens
agccatgggaaatgtaccacccgtcctagaataactttacagaaatgactcctaaaggaaagctgggtgattatgaagaaacgttccccgacaggaagtcacatataaccaggacgcaaagttaaaagaatcagctacccgccagtgcccggcccccggaacattccccagccatcccacggtgctctttcctcaatcagccacttcaagcaaacaccattcgctcctgctgcagagcaaagcttgctgtttctaggatcctaaacaagacatgaggtcatgctctccacctgtgaagaatgaaacgtaagctggggaaggaaggtgctgaggaggggaggaaagcaaattaggaagaccagcggccctgccgaagctttcagctcatgttactcacaccccaaagcaaactcctccataaaatgaggtttagtaatgcaacattttctaacatctggaacaaaatgatttgggtcaaacagatgacatatgaactgactgtaaatttgtttcaatgtgtactgggagggagggaaattaacaaatatgtcaaatccatgatctattaagtattgttgttttccataaagttcttctgttcaagaaaaaaaaaaaaa

SEQ ID NO: 17520 - DNA, 328 bp, Homo sapiens
  misc_feature (1)...(328): n = A,T,C or G
cccccccccccccaccctcccacccctcaccaaccagtgatcccacctatagtctattcctcacctctttagcgggccacnaattaattgtttaacacaaagcacttaccatctgtatgtttcctggcctcaaaagtgtaaacttatttaggaaaacaaggtatttatacataaaagtgacctctgcatatgccagcgcctcttccccttccaccacgaacagaagcagtctgaggccctcatcagatgcagatgctggtgtcatgcttcctgtacggtctgcagaaccatgacccaaataaacctcttttcttgaaaaaaaaaaaaa

SEQ ID NO: 17521 - DNA, 302 bp, Homo sapiens
  misc_feature (1)...(302): n = A,T,C or G
gggactcagcacatcatagggacagtaaaaattgcaacatgataaaatgaatacctgaccttcaccagggaaagtcattattaggcagcatgatctccagtctctgttcttcaaaggcattactcttctatcattccccanatgtaacatgtcctcaccaacccagagcgtgggtaaaacctttccctcaacctctgcactctacttttnccctagtatgctgtagccttccctcagatcccaaaccaatcatctnctcagagccactttccatgaatcttctcaatgtatatgaaatactc

SEQ ID NO: 17522 - DNA, 938 bp, Homo sapiens
  misc_feature (1)...(938): n = A,T,C or G
gggcgtgcaaagtttnngtntnttggnnngggnggtgcngagctnctaatntctgntagttagcaactggncaccacccatatcgagnaaccggcccatctgatcttgtgactcactcccaggaactgactcagcgcaggaagacagggacgcgccgtaatttcacctccgacccaaccaatcagcactctccaactcactgctcctgcactcccaccacattctctttaaaaactttgatccccaaatgttcggggagactgatttgagtaaaaataaaactccggtctcccgctcataaaacaaaaaaaacaaaacaaaaatcaaaacaaaaattatgtatacaaaaaaaactaaaaccaaatatataagagcttaaaaataaacataagcaaacaatagaagaggactcaaaataaaaaaggggcccttcttgcgccatcaggggggacatttgccgcccgcctcccttttgggggggggtaattcaataacctcggaccactacctcttggctgcgcccangcggggtgcgggaggggtttcttttctcttcaaggcgggagccgcggactccaacatttcggggaagagctctggaaacacctttgtttctacaggccggaagaggggcacaaccccaaaaagagccggcggtgggggggttttttattagggccgccccccccgcgggagttcacaacaataggggccccaaaccagggggggtaaaaccccgaagggaatataaataaaaacgggggcctcccccgtgaaactccccttggcgccctttggttcaaacccctccctttacaggaaaaaggggcctctttttcctttgagaagagggggctctttcttatactcccccgtggggttttacaatcgagggagggtgcgctcccaaaaggggtggggggccacacacacccttt

SEQ ID NO: 17523 - DNA, 906 bp, Homo sapiens
  misc_feature (1)...(906): n = A,T,C or G
cgcgggagccgcccccccggcccagaaagttgggttttggngggggttcggttnaaaaccgcttttgggganactttgcctgggcactggaaaagacattctgggcacctgctgttgggatggatgacttttgatgacaaaggacatcccacatcaagacctggtatgggctggaatgaagcgcttctctctctccatttgagaaaaggatttcttttcctgccagtgcgtggcactaaatgctgatgataaatgagacgtgaactcaacacagcaatgggtaagtgaaacaacagaagtctctcagccttattgtccaattgtcagcaagaacagggcctgacaatgctcagggctctcatcctgctggcagaactgaggactcatgttcctgctacaccacattctttcctgctgataaaacatggctgacaatctgtcttccctattgttcaattttttctttttaatggcatgaaacttggcacagagaattaatgctgaatagcaagaatcattcaaacattcttacccatggagtagtcaccaaccaggtactccttcatctttgacttgctcccgccatgcactgtttccagggcactgaacaagggtctccatcccgactggatctgcgtggaacacactttaaccagctcaccaatggatgtgacaacctggtagaggcaaagcaagtggcacttaaagccctctcctttaaagagccacattttttggtagggcgatgtatttctctgtccccctttttggacgtatcttaacggaaaggaaaaccccatggacaacctactcaaaaacctcttgaacaatcacccgattgtattaaattgcctttccctaatgacaaaagctggaaaacaactttcgcactttattaccccattt

SEQ ID NO: 17524 - DNA, 847 bp, Homo sapiens
  misc_feature (1)...(847): n = A,T,C or G
gttctgggagctatgcaatcttgggngccctgtggnaccagnaaggnatacccttcccaggttggctatttcctacaggtagcaaacaacttgcctgcaagatgcctttgatatgcaaaccaactcatcccaagtccattccccaaactggctcctttcatcaggcttaggacaccctagacgttatccttctgcccaaaatcaccctagggccagataccattcaactggggaccaccctgatagcccagagcctgctgacgttattcagcctatccaatcctaaacttgctcagtggcttaccctgcctcgcccgttccttcccttgagaaccacaaatgaaggaaagactttgcccatgcttttccctcactcctgcctcctgactcgacttggtgcctccctgtggggctctgaatggggtggcatggggtgtccccttctcttgggaaccagtcaagatcttactctgttgcccaggctggagtgcagtggtacaatcatggctcactgtagcttcaaccttctggacttgagtgaattttccaccttaagcttccccgaaggtgggacacagacatacccaggaaccggactttgcattttccccaccaatcaaggtgacaatattaacccttaccaatgccaagcaggggaaaaagggatggcacgataccagaacccactttttcttcgaaatttggttgggacccctggagcaaaaagggatcaacttactaaagcgaagggggtggaccgccctgccggtggcttattagagggccaccacaggagaactttgttggcacaccagggtgaaccccgggggcctgtggttaggaaaac

SEQ ID NO: 17525 - DNA, 445 bp, Homo sapiens
  misc_feature (1)...(445): n = A,T,C or G
ttcatatgaaaatctatttagttgggaaattctatttaactattgcctgtctcttgttatattctgtgtattataaacttgaaaagactagttattagtgacttctatttcttgggtaattctgaaatctagtaacataattagcagtatttagagaaaacttggtaactagaaaaattcctacttatatgtcttccttggttgtattaaagttttacagatcctgaaagcttcaaacttaataggcagaaaaatatgcccaatgaagaataatgtctcaagatgtcctacagtattttgtaagaagtatcagcagttccatctattataccttgcttcttgaaataaacatttcacccagagaacacttatgtcagagtaacaatatcctgaattcatattatcactaataaaagcagagtgattatgtnnaaaaaaaaaaaaa

SEQ ID NO: 17526 - DNA, 871 bp, Homo sapiens
  misc_feature (1)...(871): n = A,T,C or G
ttccttggagcncgtgagacatattcctncactctgtggccaangaccacnaacggcagcctctgctacatcttccttacggcctggcaaaagcatctccctaatgccctcggttggcttccgttccatttcccacagcagctattatgaacattcactgtcccataatctccccgcttgatgaggactacagcacctacttcacagaggaaataaaggcaagaacttcctaggcttctccctctcccgtactccacaggagtctccctgcacaagttctctttctgcctgccgccatccacgtaagatgggacttgctccttcttgccttccgccatgactgtgaagcctccccagccatgtggaactgttcatgaatatatactccatctactctatgttaatctactaaactataaagaaaagtttgggtaacaatcttaacctgtgtgactgaaggacatttactaaaacattttgccttctaagtttcctgttttgaatcaagacacctttgacatgcaaccaaccttccaaacaaaaaaatggttttatcacaattgggaattgcagttctctgccttctgatgccaatacaaatcttaaaaggactnntaagtgaaaagaaagaacgagaaaaaggatgataccatcttactccagttcttttgccaaaaccaaaaactatccagatgtatgtaattctgggaattgatatcctcaaacttcttcccaggggactaaattttcttgcttccccccactctttggagcagctgaatggcaagcagcagctgctacctttaactgagtgtttattcatgtgtggaggcatcgtgcatgcattttttcagctatcctcacaacatcc

SEQ ID NO: 17527 - DNA, 326 bp, Homo sapiens
  misc_feature (1)...(326): n = A,T,C or G
gtttttgnnggnaattcgggtactgaaacatattttgccactgggtgcactgaacaaaacttacagnatagcagttttctgacccacttactaaaaagaactgaatcactgaatcgagaccccagggnaaatgcagatttatacctttgatgtatttcttgatttttcttaaattaaattctataatcagtttttgagtctttgccatctttcttttaattgggtgatttcatatgtcttcttgaatataagccttttcaaagttttgattttctgtaaatgcaaatgcataataaaacatacatatagctttaaaaaaaaaaaaa

SEQ ID NO: 17528 - DNA, 849 bp, Homo sapiens
  misc_feature (1)...(849): n = A,T,C or G
cattaaactgtgcacttgtgcctggnaaatgatctcttggtgaagatttcccagnagttctataaaattcttgtgtttggatgtctagatctctagcaaggccaggcagcacagtgcatagaaactccttcagttacgngaaaaaaagaggaaaggcgtgagacactttgcctggttactatgggaattctcacttatcttacccgagtccaccaaggtggcacccccaggagtcagcaagagttgcagcattactgggcttggtgtgcccccaatgccaatatggttgcagcgactgcaggcttagagcataacactcaattccctttgaatacttagaaagctttctcaagaaggatggctacaaacaagtcaatactgaaatacctaactcttcgatgcctagacatctgcaaacatcctcaagtatcaagaacattcagaaaatcatgacatcgctgagaaaactaaatcagcaccagtcacaaatctcagagcgttggagatatgtgactattgagacagataattcaatatagctgtcttaagaaagctcagcaaacttgaagataacacagagaaggaatnggcagagttctgtcagagaaatttaacaaatagattgaaaaaatttttaagaagtaagcacaaattccggagctaaaatatccaattgaaaagctgaaaattgcatcagagtctctcaacagcagaactgacaaagcagaagaaaaaatgagtcagcttgaagacagactatatgaaaatacacatcagaggagaataataataaaaatagatcagggtaaacatttttatcaaagaaatataatngagaactcttacacc

SEQ ID NO: 17529 - DNA, 509 bp, Homo sapiens
  misc_feature (1)...(509): n = A,T,C or G
agctctataattgtcaagtaatattgattaggatggcaaggaaccattattacaaagagaaaaaactcaatagggtcgaaagcttatatgactcaggatcttggagaccaggtttggcagcaaaaatagtaaatatgctcctcatcctgcaagaatgggctgcatatattcacagccgggaggaagaggtgggcctggagaggacaccaggaggctgcaactgggtctggagaggctgacctaaggaagttctgggcctggagaggccgccgaaagggaaaaactgggcctggaaaggcccagttgtgaggaatctgatcatagtgacanaactgcctggatntagatggagaatcagtgggagtgggaaaaaaaantgtancaattcctctaagttatgctttgcatattacattatgacaganatattcatcttcccaaacgcattataagtttaagcattatacgtataagccatgtatattaacgtatatatacatatacattat

SEQ ID NO: 17530 - DNA, 817 bp, Homo sapiens
  misc_feature (1)...(817): n = A,T,C or G
tttcattgtttactcanaccaggnatgactggttgtgcacggtgagcaaaacgaagcatctgcctttaactcagcgagaggatgacaataaataatcatcaaacacatcattgcaaaataggaagtgaaataaaaagaagagcatgatgaaatagagaataacatggggttgtgtatggatggaataattaaagaaggcaaggggatcctaatgaatgagaagaagacaaaaatcctggaagggaaagagctttctttgcggaggaagactatatgcaaagacctcaggaaaatgagaaactgaaagaagggcccctgtgactagcatgaagtgggtgaaggagaaatgatgtgaaattaaattggaaaagtcagcaggaattagaactcccacaaccatgctggccaaatgcaaaggccactttatttctttgtggccttgaaagcttaccctaaaaaaaaaatgcccagagagggggcttgatttttttcccatggcccgaattcgaaaatttttttatttcccattttttttttttcccaaaattggggttaaattaaatgggtccttttaaagagttttaccttttttttcttctaaaataaaaaaagcggaaaaaattggaaaatttgggccttgcaaaaaaaattttttttttttcttttaaacaaacgccttctatggggggggaaataaatttataaaaggccccttaaaccctccttttttttttacccccccaaaaaaaattttcttttttaaacccccggggagattttttttttgtttctccccctttttttttgttggagaggg

SEQ ID NO: 17531 - DNA, 123 bp, Homo sapiens
tgagcaacatagggagaccccgtatctacaataaatttttaaaaattagctggacatggtggcacacgcctgtggtcccagctactcaggacagagtgagaccctgtctcaaaaaaaaaaaaa

SEQ ID NO: 17532 - DNA, 297 bp, Homo sapiens
ctggcccaggagttcgagaccactgtgggcgacatgatggaactttgtctctacaaaaaatacaaaaattagccaggcacacacctgtaagtcccagctactagggaggctgaagtggaaggcttgcttgagcctgggaagttgaggccatggcactccagcgtgggtgacagaacgagaccctgtctcgaataaagtaaaataaaaataaacttaatataattaatttaacttattaatcaattaacaagttgataaaattaataaaattcagttctccagttaaaaaaaaaaaaa

SEQ ID NO: 17533 - DNA, 883 bp, Homo sapiens
  misc_feature (1)...(883): n = A,T,C or G
tttccaggatcagtgggnagtcctgnccttgttttcctgcaactaaacagtctcacgatgatgggagacagtgatacgtcatcaggcatgatcttctctcaagaagcctgcaacctggaatcttctcacaaggagtgtgcaacctagattcttctcacaaggagagtgcaagctaaattcttcgcatgtgcagttcacgataggtttcatgctcccatgagaatctaatgctgatgctaatctgactggaggcagagctcagggaaggatgagagtgaaggggagtggctgtaagtacagatgaagctttgctcccttgcgggctactcacctcctgctctgcgtcccacccagatcctaacaggccatggtaccagtctgtggcccagggtttgaagaccccagatctatataattaaaactactgtatgtaagaaacagttctgtatacagagtgtatgagaaaagtaaaatgttatacggtatgaggatgtgggtttttgttaaataacagtaattttgtttaagttaaagagtatctaaaagttgttccaaaataaaaaaaagatacaatggtatagataaaattagattattataagcagtagggggaaaaaagaattaaaaaatttaagagactataaaaggttgatgaaaatcttatccgtgtgtagtcaaagttgactgagattgacagaatttgtttacaaggtttttattaaaattaactttatggccgggaagcagtggctcacgccctgtaattccagcacttttgggaggcctgaggggggccggacaccgaggtcagggagaatccagacccattctgtccacaatgggggaaaccccattctttcacaatactaaaaatagccagggg

SEQ ID NO: 17534 - DNA, 887 bp, Homo sapiens
  misc_feature (1)...(887): n = A,T,C or G
accctgaggagnagnaatttaacccatcaaanaacctacagctctgatactctcagaaaaaataagactcaacacaaagaagtaaaaagattattctgtcaacgaagggtcttgaccgaataatgtatacatcagatcttttcatcttgcacttcttggacactgtgattcaaaagggagattatttgtgtcagtaaagaagtatccataatgataaaacacaagtacttcaaagaacaacctgtgcttctcaaaaggaaaatagtttggatccatttacttttctcctctacttcacattctaaatgactgagaaaatgtcttctcgttttcaatacaacccatgggaaatcatactcaaataagtagtaactgaatgaactaatctggaaaagtggtcctcaatttgtttctgtaatatcagctatcacaatactgccttgatatttcatacaattctgcagagtataaaaaagcaaaagcctctaaaagttggtactagaatgtactacacgctcaatatagaccacaaaatggatcagacatgaagcttagtattgtctgtgtgcacagtgtttaaatattcccttgttttaaaagtgccagtgtttgttaagtaacttaaaatatttgccacatgtagcttattttttttactttntattatatttttgtcataggtaaaaaagtgaaaagatttatgacagtcattnttttaanactaagttaagctatataaatttgttgtgaaataaaatacattttaattatatacaattaaagatcctaattttaatttgcaagtattttcaagattacaagntacgttatcaattggtttacttataacatatcctaagggtggctacatttaatatttctaagtt

SEQ ID NO: 17535 - DNA, 260 bp, Homo sapiens
  misc_feature (1)...(260): n = A,T,C or G
tttcagtactcggacactgtaacttacctgnaccgagtagctggggttacaggcatgtgccaccacacctggttaattttgtcaaatatgtgtttttaatgttaagtatgttttcttattatgaaagtaatatatgatcactatagactatttgtaaaactggaaatataaaaatgaaaaaatggtatatttccttccaatcttgtctctgtccagatatatttttaacaaaatgtagatgacaatgaaaaaaaaaaaaa

SEQ ID NO: 17536 - DNA, 968 bp, Homo sapiens
  misc_feature (1)...(968): n = A,T,C or G
cccgggtgccgcccgcccctggcccagacccgatgaggtaatttggnngggcggctgccgttttaaataanccgcactttcggggnaccagngcagaaccaggaaanccgnggccacaaggaaccacaacagaccagcagcagacaccgaagaccagcggaaaagcagcgcaacaggccctccgcggggcggccgggcacccccgcacggaacaaaacccgcagacccccccggggaaagacgaagacacccctgcagcaaaaaacgcacctgcaaccatgaggagcaggatacagaagtacaaccgacccccagagagggcgggagccacccccacagcaggggaaaatcctccacagaggcaacaaggaaacagcggcaggaagaatggccaacaaccccgccgctggcggcaagntaccacggcaggaccaccgggcctgaacacaccgcacagcacagtaaagagcacaccccaagcaggaagaacagcagcaccgggcggccgggcacctgcccaacaaccaccggcggagaccaaatcacggcggactgagcggaacacgccacacaccgggggacgaaaaacccgccgccggtggctccccaaagccaaaaaagccgcccggccgacaaaggacacccacaaaacgggaaggacgccccccacgcgaacacgcagcggcacacaagcccacccccccgccgcaaaaaccacccaaacaggggccgcctcgccggcccgcgcggagcccccacagccgccaccccccccggagggggcctccagggaaccgcgcccccctgcccgggccccccccggggcggacggccgcggcccgccgggaggagccacccccccgagcggcaagcaccgcgcagacaccgaaaccagggccgaaccccagcaagcaagaacccccgggaaaggccccccccaagcgccccggacccagcacaaacccaac

SEQ ID NO: 17537 - DNA, 163 bp, Homo sapiens
  misc_feature (1)...(163): n = A,T,C or G
ggtgcgggtngtncttaccacaggtcacaagnatggcttctgnaannccccagccattatatgatatccatattaagtgctgaagaaaagaaaaaagagtggagaagagtatgcttatgcttcttcttattaaagaaattttctcaaaacaaaaaaaaaaaaa

SEQ ID NO: 17538 - DNA, 361 bp, Homo sapiens
  misc_feature (1)...(361): n = A,T,C or G
tttttggggaagacactggnatggnaagaccagaaggccagnatacaagaaggnaatctgtcactaattattcaccagactaaggcatggagtttcagaaataaggcacaggacactgaaccagaagtatggatttgaacctagttcattacttcctaattaagtgaccttggacaaggcaattaaccacaggaactcagtctgcatattaaagaaggaggaggtagagtagctaataatatttaccttgaagtttacttttttttgctttttaaagaaataaacatgtacttgcctagcataggaactgattcatggtagatactcaataaatgcaattcaaatttgaaaaaaaaaaaaa

SEQ ID NO: 17539 - DNA, 512 bp, Homo sapiens
  misc_feature (1)...(512): n = A,T,C or G
gggtgcnngagggnaaaactggctatagtttttcgatgtgctnngctctcannacctggcctacagnaaaaaaactgacacagacttccttagatgtgttgtcttcctgtcactggtgcattccttatcaatgtgggtggctccgcactcagccctgtgatcacctgagtaatgggaagtcagtgagtgcagtgcctgcagagggagcgtgcttgccaatcaccatcacccacttttgcacttgtgccagaggatgtgcccaagccagcctgagaaagatgaaagacacatggctcagacactccattaccccatcccagggccattaacctgccaggcataatccaaaattcttatcaagttatcttcaatctatgcaaggaaaatatttatcccaaaggaggattttcaggagatgacacatgaggggcattcatcacagtcaagtcttttgttttgaaatacggaatctgcatacctactgctttccaagttttgtaaaaaaaaaaaaa

SEQ ID NO: 17540 - DNA, 263 bp, Homo sapiens
  misc_feature (1)...(263): n = A,T,C or G
atctttggaggccagtagaacctggttcttcatnntgcttcattatttcgctgcttgtgaaggaggtcatgaggatggagttctcatgaatgagatgactgcccttgtagaacagactcaagagagactcttgctccttacatcatgtgaagacacagaaagaaggtatcatctaagaatcaggaaaccgttccttgatctcggacttcccagtctccagaaccgtgagaaataaatgtctctggtttacaaaaaaaaaaaaa

SEQ ID NO: 17541 - DNA, 422 bp, Homo sapiens
  misc_feature (1)...(422): n = A,T,C or G
acatttggtagtccacgtgcaatgtcctananaaccanaaacagcagctgcagttcctggtattattttcagaaatcccttaaaatcaccaagtgcatgtgcatgagatggaaccaggcaaggagaaccgagatgacatcacatcaaggagctcccatgccctctgccagaggcctctgcccttcacttccacatggcaaagtcacttctcctttcagtgctgttcgtgtgtctcccacaccactcttgggagacttccctgccctccaccactagcctgccttaacctgctggctaggtgctcctcctcaatgttcccatagcactttgggcaaaccattattttagccctatatcacctatctgcatctgtatacttgactgattacatgtgtatttcttccttgtgaaaaaaaaaaaaa

SEQ ID NO: 17542 - DNA, 208 bp, Homo sapiens
  misc_feature (1)...(208): n = A,T,C or G
tttcatgccacaagcattctggncacanaattgagtctcctcagcatcggnagaatctgcagacagaatgcacttggctctccagaattccagctgggaaaaagtcctgaatgattcattgttatcaattaaatttactatagcacttgttgcttttattttttcttttctatattcataaaagatattatttataaaaaaaaaaaaa

SEQ ID NO: 17543 - DNA, 247 bp, Homo sapiens
  misc_feature (1)...(247): n = A,T,C or G
gtctcctgaggcangatctcccttctgttacctccaaagtgctgnaaatataggcgtgagccaccacacttggctgctttcaccatttcagactgaacctggagaagaacctgaggaaaaaatatgactttaaaattttgatgaatggagaaatctctttccattcacgttcctttcctccatttcattcttattgtgaaatatgcaaacaaacatatggatacatcagttattaaaaaaaaaaaaa

SEQ ID NO: 17544 - DNA, 891 bp, Homo sapiens
  misc_feature (1)...(891): n = A,T,C or G
gccggtcagtttncctgtccagtgtggcatttcctactgttgctgtcataatgaaatccacctcaaagccccaaatccttcttcttactggaggaatatgacctctctacaaaggaaactattctcaatgttgtgagacaccagaatgcagccagaggaacttaatgagggccaagttaccatcataaatgagaaaagtggctgtaatgacatgtgctcgaataattacccttgtcaactgtaacttattcgaggagtctccgactgatttgaataatactcctcatcacagactcataaccgtctgggctccctctcccacctctccgaaggctctgctgtccctcccctctctacgcgggttgcctcctgtatggttcttggcatctctcgttctgcctcttccctattgcccgcgtacagaacgtcgtatctcattctccttatccggttctccctcctccccctcaaccccacgtacatcgcgttatccttccttagtatgtttcactgtcagatttggtttaacatcacctagattgtaatattttcaggtgcaagtttccgtgtaatcctctcctttaaccaccgaccaccattcatctcacctctccctctccgctccccccttaccggatttacccccattccttatccctcctccccgttcctcccctttttccccatttccttctcccgtaccatactcatcctccgttatccccattcccgtctcttcttttcaccacagatctagtccggctttgccctccttcctttgtggagcctacgaacgataaccccgctactccggactgattttccctcaccgctccgcctattaccctagtccccccaccctaaccgccacattcgctcgctgcaacgttg

SEQ ID NO: 17545 - DNA, 333 bp, Homo sapiens
ttcggagcagtcctaatccatccgcaccaaagggaaagattaatccccttcccagagaggtgtatcaaagaatctgtggacatctgttaaaaccaccatggtcattaatattttgaagaaaatgctttaaggctatccaaatgttgtgttgctccttaacatttcattcactcttttagcattcatcagtggatcttgcctttttaacataaataatgtcacattagccattgtttgacaaaatacataatgtcaataagctattgtgaaatcaggtcttgtattgtactaaccacaataaaatctacacggtctagatgaaaaaaaaaaaaa

SEQ ID NO: 17546 - DNA, 369 bp, Homo sapiens
  misc_feature (1)...(369): n = A,T,C or G
acttcccgggtgaggnnaagcgngagtatgtagcaacaacctctggnagnaaatggagtggttatcactaatgcaaacatattacattgaatgaaagaatcttctttcacagctttgcagcaaacacacagaagacatgaagaaaataagtccacagcccaaattatcacaacgagtttggaacttaggatatccttcattttggctaatcagatcccttcctagttatgatggggcaaacttcgtaataacacacagcctggactccaccaatgggaataattaccatctgtagaagtattatgaaactgccttataaaagtttttttattaaataaatatataaaattaaactcaaaaaaaaaaaaa

SEQ ID NO: 17547 - DNA, 159 bp, Homo sapiens
  misc_feature (1)...(159): n = A,T,C or G
ttccagcaatgnagtagccctgctgtttgcctggccctcatganaaatctgctcttaaccctgctttcctgctgaagccctgaaacacctgtgttccaggccacctgctaacaataaataatgctgccctgatgtggggaattagcaaaaaaaaaaaaa

SEQ ID NO: 17548 - DNA, 409 bp, Homo sapiens
gttccaactttctcatatcttaactctggtgaaaacagaaaatattgtcagtgaacgtctactaaatacaggtcctggactttggtttctcttctggtaaagtgagaacagtgtctcccattagccaaaataagcagaggtcagtgaaataacaatgtaacaccaagacatggtgcacttctcaggtgaaaacttttatgtaagtaccaagtattgatttatttctaaaataccattatctttattagaaacactccagagggcaaaatactttcattgttttggaaattaaacaaaagtacaagcaaatattggcttaaaatgtaactaactggaccattttaaagataataattcatatcactgacattcaaaataaaacaatcatgtaaaacgaaaaaaaaaaaaa

SEQ ID NO: 17549 - DNA, 554 bp, Homo sapiens
  misc_feature (1)...(554): n = A,T,C or G
ctttccgagtattnaaggactacagtatcccantactcggtaagcctacaagnaggaactatgagctgggtggacttccagagccagcattccaggatctcttccccanagccctgtccacagttcacagctgcagagccctccaggtcctgtggggttgttgaatagagaagcatacacaaccctgtgcttacatggggagaagaactctttccgttttttttacacctctggttaccactttctcttccgatacaggcatcctgctaatttggtggagtttgtagagagaagagaactggccagtccccgccttccccccatctctggcctcactgtttattgggtcactgtgactatgcagattatatatttcggataaattattagcgttcatctgagtgcttatttagggtcctgttgcaaatgtttcttgaatattttaaaattaaggagatgtttaaattgagtacactgaaatgtggatgactgttaatgtgaatgaactgctttcagaataagaacatttatttacaagttcaaaaaaaaaaaaa

SEQ ID NO: 17550 - DNA, 172 bp, Homo sapiens
  misc_feature (1)...(172): n = A,T,C or G
ttccgagcaacctgcaagaaacagnagaaaaaggnaaaacanaatatacaagtaaaaaaaattccaaaaccgaagacaaaagaacagggatgttttaatcctttgtcagtgttgtgtatatgtgtttaataaagttgaacagatgtaaaaaaaaaaaagaaaaaaaaaaaaa

SEQ ID NO: 17551 - DNA, 875 bp, Homo sapiens
  misc_feature (1)...(875): n = A,T,C or G
tttccgaggtttnatnacagggctttncaactaccagncccctttncatnctacaagttgccatttgatttgctttggataataaagcatgaatgattacaaccacatttacatagaattcggagtgctaagatgcaaaattcaccacatcttacttctttgccttggtaatcatggatgaatgttccaagatgatgatgaaaactacagcagcccgggttactaagtgactacagccgagaacaccccacatgcctccccacatcatcatctgtgagggacaggtggcatgagcaaaaatataaatatttgttagtgtaagccactgaaattacaggattgtctgttactttggtataccatatattaattgataagaatggtatcaaatcttctacttcgttatttaaaaatgcatcaaaatataacatacacttaaagatttgagtagttatttctttaaaaaagcaattaacagagaatccactttgaatgtgtcgctaaagaaaaagcaaaatcaagcaaacaaatcaaaataaaaccttaactatctatgaattgttttcctagaaaaagtgttatatatttttagaatcaaaattagcagattttaaagtattctgagctattaaaaattaaagaaattaaatttatttgttccaaaaatttataatttntggtctctctgtctcttattaaaataacggcaattcattttctggaataaaaagaattggttttaattctatgtgtctagattcacagagtcacgaaattttaataccttatggaatcctgatagaaacattctaatctggctactatctggntttggtatgccttcccactattccaaaaggatttttagtaagtac

SEQ ID NO: 17552 - DNA, 814 bp, Homo sapiens
ggaggcccccgttctatacatgaaaccctgtcctttagaagcaccactgacggctacttcaacttatacctgcgtgtctccagtgcatgaagaatttttgggaaagagagctcctttatcacagatgaaaacactggcagcctgcatatggggaactctcagctgggaaacatgaaatctttttttataccaaaacacacaccttggaagaaaaactttacccatgactaactaaagtcattcttacgagaacatcatggagaggataaacatgccgcatccctttctctcaccttcccgatcaggaccttctagagtcacacaaatcactggttgttttagccagtctgactccaagcatgaacacaccatcgttgcccgtgcattatttcagcctagccaacaaaaactcccaagccatcctggaactttcggagatgactgaaacacaagaaaaaaacacggcagactttaacaaaccgtacaactggggacaaccagccccaacgttttgcaccgccgcccgcaaagagcggactgaccataattacgggccagcccctgcctccaacccctgcccaatttcagagcaggatggcgggtttcccactccgaacctggctgccaaggctcactcctaggcaaatgctgccctcttcccctcttcacataaccccgtccgccagcaaggtcacgtccccattctcgactatcagccatccaccccgcgccagacacgcgcctctcactcatcccccacaacgacatctccgaccctggcttggcccaccgccccgctacacgatcggcaccg

SEQ ID NO: 17553 - DNA, 323 bp, Homo sapiens
  misc_feature (1)...(323): n = A,T,C or G
ttttccgaggnnnaagancagngatgttcatgaaggnacactncaaacagncccatggnaaaggctcgcaagggaaaaaactactggcatcttgccaacaaccagaaccaactaacagccaggcatgtgagtgtgatacctttgaagctgatgatcctgcacccctaatcaagtgacatgacagcagccctggcacatatcttcactgcaacctcaggagacccaaagccagatcaacccagaaagtcattactgagttcctgacccacagaaactgtggagtaataaatgtttactgttgttttaagccaaaaaaaaaaaaa

SEQ ID NO: 17554 - DNA, 1154 bp, Homo sapiens
  misc_feature (1)...(1154): n = A,T,C or G
cgcgggcgggcccgcccgggccttgacaagtttttgtctttaaaaagggagttttgcgttctacctangccaattttngaggtacagatgaaacccgctcctttgcatgcagaacaggagtttacatttcctcagggcagcgttgctcctcttggaacctctgagggtcgtatctcacaggctcttttgctggatctcactgcacgtgactcgccggccaggcatgatcaacctctgctcttccttccctccccgcgaggaggcctgggatgacacctctgtccaacttcatcagctcctgaaaagtatttctccagctctaatcctgttgggagggcctcgaagcaacaaaagaattacctgtggcaggccatggaaaagccaatgacttgtccccccgtgataacattgcattactagtacctccttgcgcactttcactctgggatgagtactggaacttgctccatgccaaccaggtaaatctcatatactgacactaagagccgtgcactctgacttgctgaaagcactggcattcttatttatactcctttacaatatgggaacacatctcatcaagcttcagggaccacccacatatgttcatttattacgtcggcgatatttaatcctgagaagtaccacaggcatctcgtcttgcaatacgaggcatntcgatatgtatccccacagtatgactggtaaaatactgggggccggtacnncccagatagagcgcgaagcagacacatcccggctagtgtgacaagcgcagagggtttaaacatccgcaacactttccttagcgaaaacctggacnccctttgaaacaagcccagggggtattttacactcttttacccacagacaaattctaccttggggttcgcccacttactacgcagctctggcccactcaaggcaaaacaacctcgcaacgaaggggacaacagcgtatcttcaaccatccgcaacgtaacattgtatcgtcgtatcccgcctgtaacagagcaccacttttgcaagtaccacactagtagcgctttccacatgtacatatcaatctactcggtgggacaaatggaaagaaccattntgcccttcgcccacccccgtggggcgcctgcgttcccgaacccaccactgaccca

SEQ ID NO: 17555 - DNA, 853 bp, Homo sapiens
  misc_feature (1)...(853): n = A,T,C or G
gttcggagtggagaccccaaattcccctgnanctccaaacacactcaaggcaanaagaagaagatggagggaaggcagaagtggacagaggtgttgagcaagcatatttaagatatctctaaaaaaattgtttgcatataagaacatcagaccatgtgagcatattgctaagcccttccctggggtcttgggaaaggcccatgcaactgaagggccccgaagtggaagctttatcagctgcacagcaagtcagcttctaatttatttcaacaccaagccagggttccaggacatggctcccatatctccattctcttctgtgtcaaggtccgttccatgcccaccaactgggctccttatccagatgtggggacttgtggcctcccctttattcaggagtgttcagcagaactaagatgccctattatcaagtccttcctcattctcaatttctcccaaatgatctgctgcatcttcatgaaaacctgcctcctcctcagacaagggcctcctcaactgtactcgctacttctcattggtctgggtcattgctgtgaaatatggaaaaaactatctttgagtcagtaaagaatatgaaaaagttaaacaggttttattaggcaaaaattcaaagtgggcagggaatggggaatcaaggaatatacacccaacctttgcatgttggacagggataagaaaaacgtccctagtgtaagatgcctatggtaaataatagcatgggatcacctgggacctgattccggaaaggattttcaaaacattagaagtctatgatgtaagaccaggcccagaagatnttttaaccccagtgggacttaccaatcccaaagat

SEQ ID NO: 17556 - DNA, 375 bp, Homo sapiens
  misc_feature (1)...(375): n = A,T,C or G
gtgcngggangnaaaccnnagttctgnaagtttaataaattcgctaatgtcactcaaataataagtgaaaggaccataatttacatcagatctgacaccaaagttccgtactctcgatattacacagggttgtcaacaattccatatatgtatagctacctttactctttctctgttttagtatatagtgtagcattatttgctttcagagatacatttgaccatttaagtttgtcaatgcatttattatactttgtagccagttgtgattttttaatttattttctccagatggctgtgtaatttcagaagccctcctctttccaaccaatatgataagcgcattaaagtgagctcatttcaaaaaaaaaaaaa

SEQ ID NO: 17557 - DNA, 316 bp, Homo sapiens
acatcttgggtcaagaaagccaaattttgacactagtaccatgtgtttcataaggatttgcttcactgatagagaaaatggctgttgacaatggttgactgaagccgacatagcctaataaggaaaggagacactttattgattataagacaaaagtgcccaaactaggttttgtccctttaaattttattgactataaaatggagatcttgtaccttttaaatttgcatttagtgtgatattacaattacttttactatcactctattcatgctctctaagagagcacacacatttattacgaaaaaaaaaaaaa

SEQ ID NO: 17558 - DNA, 185 bp, Homo sapiens
  misc_feature (1)...(185): n = A,T,C or G
ggtcggggctcttatgcagtgtaagaacacancactcttcccctctgaaggagtagcaacgacatgccatcttggacacagacccagctctcacccaacaccaaatctgcttgtgccttgatcttggacttacaacctccagaactgtgagaaataaatttctgtttgctataaaaaaaaaaaaa

SEQ ID NO: 17559 - DNA, 221 bp, Homo sapiens
  misc_feature (1)...(221): n = A,T,C or G
cgctcgggtaaccgccnactacaccgctccacttgtcactgaaccaagaaaaatatccaaaagaatttaaaagttacctgtatgaagcacaataaaacattttctgatttattattcattccttaaatatattctgggcacagacttttatatatatatagtacactgaagcatttacacagtgcttacaaaataaaaaggtgcaatcaaaaaaaaaaaaa

SEQ ID NO: 17560 - DNA, 839 bp, Homo sapiens
  misc_feature (1)...(839): n = A,T,C or G
gttctgagcaataacacttttacctacctttgtctgcaatcctactgctctgagacacctacactcagtttgaagaactgcaatctccagtctgctgacatgggtagaatctcgtttgtcacctgtatatgacagcaccaatgaaatggtgatttggcattcttggcttgtcagtgtatgaaataccatgtagcaaaacaaaactatgtttccaaagagttttgttcttgtcgtccaggctggagggcaatagcgcgatctcggctcactgcaacctcctccttgtgtgttcaagcgattctcctgcctccgcttcctgagtagctgggattgcagacgcctgccaccacgcccagctaatgtttgtatttttagtagagacggggtttcaccatgttgaccaggctggtctcaaactcctgacctcagatgatccacctgcctgggcctcccaaagtgctaagattacaggtgtgagccactgtgcggggccacaagttgtttcttatatcctatatatcctaataaagaatacaactgccaagaagacatttgagggagaaaataaacattgactctttgtatcatagttatactgcttcatctcaaatcctatcaagttattaatgtttgtatttttagtaaacgtaactagatgaaaactactaaagtgggcaaataagaaatgttagtttaaaaaaaatagaatggaagaagatgtttgaaaactatagcatttattaaatagntaatattaaaatacaaagtttgaaaatatagtctatatgattaaagaaaaataataaagcactatcaagatactaaaaaaaaanaaaaat

SEQ ID NO: 17561 - DNA, 444 bp, Homo sapiens
  misc_feature (1)...(444): n = A,T,C or G
actatctgggcngnnaaccccgnaatcaacaaaacaaaatctccagaacctgacctgaccaacctcgctagactcggcccacactgccctgctgcagagccccaggccctgcactgccctgccctggatcatctactccatcatcactgtctggaccatggctgctgagaatagctgactgagagttagagaagctgcgccgcccggatggaaccatgtgcttgggccctcacagagtcacatggcactaggaattcggacgtacaaacatcctgacgcgccactaaccttgtttggactccactgaccctgtggtctgcttgccttcctcactcccagtaactcacattgtaattttttgtcaaccgttgccggcaagcatttgttaatgttaagaataacaataaagaaaatagccttaattgagcgcgaaaaaaaaaaaaa

SEQ ID NO: 17562 - DNA, 841 bp, Homo sapiens
  misc_feature (1)...(841): n = A,T,C or G
ttcgtgagctcgaaccagtattacttgccttgtctcanatgaaagttgaactgtggacatttgagttaatgctgaaataagatttgagggactgttgggaaggcaaaattggttttgaaatgtgtgtctaaatacaactgtaaatacagctatgatgtacctaaatgaagaagaagaagaagaggaagaagcagaaaaagaagcagaagcagcagcagcagcagcagcgggcgaagaagaagaagaagaagagagggaagagggagaaattttaccaaaaatttgaaatattttaaaatatttttccctccttttgttttgtcacaggccagtccctggaaatgtgaaccttctattatttatcacacacttttgaatattgtactagcccggcaagaacattagaaaaggcatttaaaaattgatagaatattatgttcctggattagaagacataatattaaaatggttattttctataaaactccatacaaatttaatttattcaatttagaactttgatgggaaaattgaaacttggcaaaagtattctgacatctttttaagaataaatgaggagagctggaggagttttaaaagaaaaattattagaaggagttggatctgcaggacaatgaaattgtttatagggttaaattaaataaagcagtggttttactggcccaaatattattaaagcggactgggtggatataaagtaaaaaccaggaaatcagacttacttattttttagtacatagctcttgcactcttagaaaatgctaagcttcaaataaaacttacctgagtatttacggaatactcaaatccccttagaacc

SEQ ID NO: 17563 - DNA, 417 bp, Homo sapiens
  misc_feature (1)...(417): n = A,T,C or G
gttctggtaggnctctcgctctgtcacccanatggnatgcagtggcacaatctcgcttcactgcaacctccacctcccagnatcaagtgattctcttgcctcagcctcccgcgtatgctgggattacaggcacgtgctaccacacctggctaatttttgtatttttagtagagacgggattcaccatgttggccaggctggtcttgaactcctgagctcaaatgatccgcccgcctcagcctcccaaagtgctgggattacaggcgtgagccaccatgcctggcagttgccaaattttataccaaaggtgtattcctccttacaaactttcagaggtagtatgtatatttttacattatttattagaaaccataaataggtaaataaaaattccaaaaatggtcaaaaaaaaaaaaa

SEQ ID NO: 17564 - DNA, 309 bp, Homo sapiens
  misc_feature (1)...(309): n = A,T,C or G
ccttcgggtcnnttatccanaccttcttctccgnagaagcttcctcanaactaaggaaaaccggtgcaaagaatccaaaatgttgcataaatatctggcttcattaaatgtcagtctacatcttcactttcacttgtgaaagcaatgaaatctgggctaaagaagacatttttgactccttccatcctaaataactgctttgccagaagggagtaaaatgctgcagctggtgtgggaaaatctatggtccttgtctctaaaattggttttcctctaataaacttcaaactgttgggaaaaaaaaaaaaa

SEQ ID NO: 17565 - DNA, 514 bp, Homo sapiens
  misc_feature (1)...(514): n = A,T,C or G
cgttcgggcagngatttcgcttttgttgcccactgtggnatgcatggtgcgatctcggctcaccgcaaccgccgcctcccaggttcaagcaattctcctgcctcagcctcctgagtagctgggataacaggcatgtgccaccatgcccagctaatttttgtattattagtagagatggggtttcaccatgtcggccaggctggtctcaaactcctgacctcgtgatctgcccatctcggcctcccaaagtgctgggattacaggcatgagccactgccctgggccaactgaataaatttttaattcattttgtgtgtgtgcacgcatatgcatgctaaaaattgcctcctaagtttccgtgattgttttttccacctgggaggaaaatttcagttttttaatccatatattgaataacaacgtgatctttttatggactgtggtatattatagataaataattatttaattattacaataaagcaaatggcatagttggtcaaaaaaaaaaaaa

SEQ ID NO: 17566 - DNA, 483 bp, Homo sapiens
ccaaagttctccctcctgttccatcttgcctggcctggcctcccctcctgctctgacgccacgggatccttggctccactgggcccccaaaatcactgagctaaagggaaaattcaagctgggaactgctcaggacaaacctgccttccgttctattcgaagtcatccctccagctcactgagatagacgcatattctgattgcctcctttggaaaggcatattggaaactcaggagaaggcaaccacttgtctctccgtgacctggaagccctctccctgcttcgaattgtccccatctttctggatagaaccaaatactgcttatatatattgactgatgcctcatgtctccctaaaatgtataaaaccaaactgttcccctgaccaccttgggcacatgtcaaaacttactgcaggctgtgtccggggtgcatgtccctaactttggccaataaaccttctaaaaagaaaaaaaaaaaaa

SEQ ID NO: 17567 - DNA, 561 bp, Homo sapiens
tttcccgtcgatttgccttcttctatcctcccctcaaacctttggtcttgctgttcctgtgcctggaatgttctactgacacccaccacagcctggttacttctcatcattcaggctttggttcagatgggatctccacagagaggactttcctgctgtcttagatagtccatgccatgttcacatctgtctcctgcctccaccagtcaagctctatcctgtttctctgtttgttttattaataaaataagaattgttgacacttaagggaactcctgtctcacgtgcagactcccagggcgggattaaaaaatgcaaaaataccatgttaccttgcaaatccatgtgaaatctgtggctgatattattataccactctatgtgacgtaatgaagcataattgagttcgcttctataatggatttatttatcaaggcatttggattctattttatggttgaccaatttcctgggagtgaaagttctaatgaccacctctccagtaaaccaagggcccactgcttggaggaaaaaaaaagaagggccctcgttgggctcagc

SEQ ID NO: 17568 - DNA, 430 bp, Homo sapiens
  misc_feature (1)...(430): n = A,T,C or G
gtttgggggcattctccctctcacttttcagaaaaanatctcgcttcctanaattaagaggccaagtctaccttccttgcaagaaaaagaattcagaagaagaggaaattattcacggctaaggttagggttagaatttgggattttgataaagaagagctgcaaagaaactggtactttaaaggaagttaattttaaatattactgcactgtataaatcatgtatttttaatgttctcagagaaatataagatttgaataattttattacctcttgaaaactgtgttcaatccattttaccactctgagaccagatgaatttcatggtttataagtattatctaatacacatttccatggcatttgataaattatatattattaaattgaaaataagtttatttgcagattaattgaaaaaaaaaaaaa

SEQ ID NO: 17569 - DNA, 334 bp, Homo sapiens
  misc_feature (1)...(334): n = A,T,C or G
tttccagggtaactggncaagtgtcctggggccttccaggnactgaagctgccttatctcacctcagctgcnctttctgatccaagcttgaaaaaacccatcccaagacctatgttgggctgctgtggctctgtctgtgaaatgggctgaaacttctggctggcgtgggaccaaggcagagacagaaccacgtggttccaccccagttccatggcattggcagggccatggaacttggattaaaactactgaagtgacacaaataaagacccaaactgaaggattggtgaggaatgcccccaccacctcaaatgagcagacaaaaaaaaaaaaa

SEQ ID NO: 17570 - DNA, 2777 bp, Homo sapiens
  misc_feature (1)...(2777): n = A,T,C or G
tttttattgtgagtgttggtntggtnnngnntggnngcggcgcnggganggcgnggcagcngtnngnnagnagtaantatgnntagngtantgnntntgtgagnnannttantgatggtgnggntgatgtgttacgtctgtagatgattntatgtgnagtgtgngcgggtggnntaagtcngacagacagatactantnctatcaaattntnctataantgttangtaagtagtgatggactangtgctgacactagtgcgagcatcgctgagacgacgtacgcgacgcacgacacagagtagcaantgacanacgtagnncagacnactgcatncagctaccgtacgcctgnntacattacgacgcagtgcatatgacagtcacgcngcagcaactactagatcacagtcgactgatcactggantagcngaatgcagagcagacacagcgtgccnatcactggatctgatacctctcnttatgtacatngccacgctgcactncaagncagctgtgcgcncagtagngacgcgcagacggcgcagcgcacgactgatgtgatgtagcgcanccangatnatgcagccngtcatgacgtcaggacccgatgcgtgcgntcancnanctgntcgcgtcacngcctgtaaatnatagtagctgtaggngncctgtcgcgcacacgctcngcaggtacatgctcagtactggatnatcctcatcaatcgtgagcncagcacngagacgcngtactactatntactgacgacgacgcantangagntcgacggattgtgagcnangacgtatgcagtacgcagagtagtncgatatgcatgtantactacagtatgacgacagtnatgacacgatgcaatnnagtatgtcatgctacacgagtacntcgacnacntgcnacgacgcatgatcagnatnatagngnaccgacaagatangtagtacgtacagcactganctagcatcactaagtantcatnatgatganacgcagactntaacgcgatcacttgtactgatctngntctatacgtctcgcnntccgcngtagtgactgcatgatgntcatcnntcgtatactgacgcatcatgatatttcatctagncacgatatatctcagntcgtagnacctancntaaacgcagcgacagcacgtanccacatgactagaccagtcgtatgtgatgtatcactgcactcganacgactactagcntnctatatacnactatcatactacagacnttactgcacagnataatctaatgactatcatncgcgaccatgtngtcgcagcgatgntctnacatcgtcgaacgagtgtagatgtgtctgcntngtactatgtgttgtacgtntctcgcnctagatgtacnctacgcnagtgagtctacagcatgacngctcatgcatgnactacnacatgcactagctatacgcccgagaatgtacatacangtacnaggtacgatcgtcgcctacgntcntantcatagagccgataacganactacgcctgcactgcgtanctactcgcacatcgcgcacatatgtcgtgcatcatttntcatncgtcgtacganctacgacctgttcacacattngtanatgcgcgacnncgcactatgcacgcgtcgtacgaccagttagatgtgnatgaagtatatntatnatgacatgnactagcacgacgtgtaaattatcncacgatcanagnatngattangttganctgntgtccagatgacagtaganctaacnatgatctganagcacgnactgagagtattangcatangntcgtatgtaatcgaagncgatgcacagtactcngctacgagattctgcatnatnatgagacgcagtacatcgactcatnatnatgatctatcatatgacttgaatngttacnatntgatgtnatgnagntaatagtcgcttnatacctgcnatcntagctgctangtcgactgaatatacgtcgcgtaacgtctgtacgcaggngatcngtancgtacatgcgctgcngtcacgatgcgacaccgagtcgtatgactgtantcatagcancagcacgcagncgacacgagagtnngagttnacgataatatganacgtcgatcntatagtgntgtgacgtacgcatcagtgtagcgacgacactgacgcacnntgcacgatcgtactgaacncaagcagcagcactgtgtcngtgtattgcagagnngtaagtacgaccngangcnncagcatanatanatcatcgctcgtgantgnagcatgtnatntaccnnacnacatcgcaacgntatgattaatgacgtcgacngaaggtnatnatcctgcatntattagcgacgacgtgcatngtanacgntngatgtcatatnacgcagtactannngcgtcanattggacgtgcgtngtnacgttgcactnagattgtcgcanctcgcagcactacagcagntgcagactcnagncacagnacgangtnaancgacaggntcgtacgcgtgcgcaacacgancgactacngtagggtcnngtngtagatctatanatnacgactagganatnatnaggatgctagncgtcacnagtgccaagtntatgatcagacagttgataatntgnagngntagctgtgcttnatatggtanaacgangatatnatgcgnctgntggatnatacgncaagatgacgngtnaactacgcgnnagatgatncatcgaatgatatntgttcgcagntcact

SEQ ID NO: 17571 - DNA, 849 bp, Homo sapiens
  misc_feature (1)...(849): n = A,T,C or G
gaggccgccagctgagattagaaaaggctggagaaaaaaccanggtttggagagggggaggggagaaaggaggcccgggtgtggggggggttagacgttgcggccccccccaaatcgcactcgtcccacctcccccgttttttatttatcatatataaaaaggcggctttctgcgcgtcgttctttcgagtccagtcgtacaggttttactttccgtcccgtcttgcccagagcacaatcgcggccccaggcccggtgccctatagagtccgcccgctacgcaccacctaaaagttcaccccccccgccagggaggacgacggcggagccggcgtcgggggcacgacgagaccatacggacgcgtgggttggagccaaggtgtgttaagatttagagctttacaaggggatgtcctacccctttcgcgcggtttatatggtacgtgtcttaacgggcggagacaaaccacccgatctgcgttgtcccttcgtagccggggagctagagtcgaggaattaatcatcttcgaatcacttaggcgcctaaagaacgtaatctgaacgtaccctctataggaagcacctcagattccacccgttacagagatcataacaacttcccttgtgttcttttccgttatatcgccccatcacctcagggtcttaccaaaatagggcccgccggttcggttgtttgtcgcagtcctcccgctattatagttaatttacgaggacccgagttgaactcgttcccccctctaagcgggatagagataaggggagggccggcatgtggcttgcgggatcttttatgtaatgcggccaccgcgatgaagaagtaattttacc

SEQ ID NO: 17572 - DNA, 626 bp, Homo sapiens
  misc_feature (1)...(626): n = A,T,C or G
cctttcgggtncttccgctttttggnagnatgtgctagtttggtctttctgagaatgatcgcttcctctctgaaatacctgacagctcctgtgaacatagtcagctccctgggcctcagtttctccatttggaagaagaactgtagcttttcaggagcatatcatcaatctgcagtattaggaactacgagaccatgcaacgttgattctccttacagttgctatcaatgaaacaatcccagactggctgttaaaatgaccaaattctctctttcacctgcctcatggtccaggtgtctggcagaaagagacccaatgaccattttgaatttcagttgacgggagaaaagggaggacttgcctgcttcttcatgtttgatgtgctatgagcagcttcagtgatgtggtttcaatgagcagaactttccttgtacatcaaaggatgggccgagggtgctgtcaaccaattctcttcctccgatctcttcaaacgcagagtcgcccaggctctgacagttttgatgcatggataaggaccggttactttgcattttttttaatatggcagaaaattcgaactcatattttaacaataaacactgaaataatgggcaaaaaaaaaaaaa

SEQ ID NO: 17573 - DNA, 356 bp, Homo sapiens
  misc_feature (1)...(356): n = A,T,C or G
ggggcgggccgcctgggctcgcccgtcccgtctttgaaaagactgtgcgttgcagaaacncttttgagacacncgggacatangggcctgaatccataaaagtgtctttataagggatagaaaggaaaagaacanaagaccatgtgaagatggaggcagaaactggagtgatgtgtctacaaatcaagcaacgccaagaattgcaacaaccacctgaagctaggagtgaggcatgggatggattctctctcagaacctccagaaggaactaaccctcctgacatcttgatttcagacgtatggtctccacaaaaatgagaataaattcatgttgttctaagctaaaaaaaaaaaaa

SEQ ID NO: 17574 - DNA, 286 bp, Homo sapiens
gggtctgggagacactgcctgtctgtgattctgaatagtgaaaattttatttagcagcccgaaactgagggaattccaactgtgtcaacttgtgcaactacgtctggctgtagagctttccaaactttggaagacatgttatctctaattatcatcttactgcaaataaaagagactttcatacaaatgatacacacaatttatgccaggctttaatcagcatgtaatcggcctatgattgggtcaccattcaataaaaaacttaacaaatgcaaaaaaaaaaaaa

SEQ ID NO: 17575 - DNA, 391 bp, Homo sapiens
  misc_feature (1)...(391): n = A,T,C or G
gccggtgcgcccgcccgggcccgcccgccccgtcttttgnnngntgttccttttggttacacgccggttttnacggnnacaccctnaacaagatcccctggnaaacctttcttggnacccgctccaccttctcaggnagtttatgatcacctcggagttgttcagcaatgagacacttgccttgaacaaaaggtttcaaggacgtagaagagctccttttngaaaactatgttgcagcctggaggagaaaggtggtacacttggtataggccggttggtcccctgaacttctcctagagactcttcctggcagagcctgaatgtaaggaaactgtcagccaccaaaaaaggcagtgaagtcaattaaaaatcaagtggaaaaaaaaaaaaa

SEQ ID NO: 17576 - DNA, 478 bp, Homo sapiens
  misc_feature (1)...(478): n = A,T,C or G
cttcgggggnnacactccnctgtgcagtaagtggcatcttttgtctacattaaanaacgagtattctttgccagtgtctgctggtttcttttcctgagcctgttgtgacaaccctgcagtagatgatgataataacagcatctagcatctacggagcacttacttagtatcagggaatggaatatcatttccatttcacgtataaggaaactgggacacaggggaaataatctgaccaaggacacagctaagaaacttacgcttttaccactgtgttacaagccttgttatatactgtaaacttgttatgtaatacataatttcttgaatatttttcatgttattaaaactctgataacatattattttaatgtctaaatcaatattatatcctttatataaccagacctctattatgaaatacttagattgtttcactcttttatttaataaataatgctgtagaaaaaaaaaaaaa

SEQ ID NO: 17577 - DNA, 362 bp, Homo sapiens
  misc_feature (1)...(362): n = A,T,C or G
caactcggtngaaaaagccnatatctggaccagacggaagagacgagcaatgtgaccatgagatcagaaactggagtgatatacccatgggggaaggactgccgcaagcaccagccctgtgcaactgatttcatcctttaggcctccgggactatttctttctgctgcaaagaccaaaatgacactgaggaggaagaagagaaaagtaaaacatatccatgcacaaaagcataatcttgagaatgaaacattctcaaaaaattttgtgtgtatgtatatatgtaagaatgaatattccttcttttttttttgctaccacactgaaccattaaaagaaagagtaaatttgaaaaaaaaaaaaa

SEQ ID NO: 17578 - DNA, 410 bp, Homo sapiens
  misc_feature (1)...(410): n = A,T,C or G
aaactcgtgtttcctaaccaaatttctctgnatgcattaatatgctaatattaatgactggccaatattctctatagtttgttgagctttattccccaagatattatggcctgcgaattgcagtaatttcagcaactgtgaacatcccacggagaatatgaactggaacattttttagatcagcataaagcgtggaaaataaacaccactcagaggacttcctctcaggtcaattttgtatgtatgcacaaaagactgctgcctgcgatgtgaatcaagaaaggacaggaaaaaaattctacttttaatatttttagtttgtagactttcagaaaaatttacatccactttattagtgtgaaaaatactgttaattattaaaattcaaatataatgtaaaaaaaaaaaaa

SEQ ID NO: 17579 - DNA, 318 bp, Homo sapiens
  misc_feature (1)...(318): n = A,T,C or G
aactcggggatcttacccgnatttccctcctccatgcactttcctggtgacctgacactatctcacatggcatgagcaaaagcacctcatgcttggatgctgtggagccacaaaaagctcaacgcagaaagtcaaagacctctcagatttaccctaccaattttaaggtgactgcttccttggcctgaagaattttatcaccatagtgaagattctgctaattttcctatagaacactactcacagtatttggtttcaattgtattttcagttttgaaattagagaattctccagatgtaaagataaaaaaaaaaaaa

SEQ ID NO: 17580 - DNA, 608 bp, Homo sapiens
  misc_feature (1)...(608): n = A,T,C or G
aactcgggggttaacaacctncctttaaagnnttttttcctcctggnctgggtcacaattcgtcagatgctccacacaggaacctctggcacagataagttaacaggttaacatccacacagagggaaatacagcataagctatatcaaggaattcctttcctggcaccttggctggagagccagaaagattgcttctttctgtggttgatgtgttgagatataaatgtacactcaggtaggagcagcaataaaagaaataggaggacctggagggcatttatattccttacttttagttgttttcctacagtccagatgtattgctatctttggaccctgtgaaatgttcctttatttttataataaactcctgttttgcttgtcactgggtttctattcttgcaaacaagaaatttcaactaacacaaatgggattgaagtctctttagaagaaaatgtaataatattttattgtctgtgatacaatgtaccttaatgacaaattgatgattggcttggactgatacattgtgctaatattgaaaatgagagctggaagaatgtgacccaaaataataaatcacagttttcacaaaaaaaaaaaaa

SEQ ID NO: 17581 - DNA, 860 bp, Homo sapiens
  misc_feature (1)...(860): n = A,T,C or G
atggcttgcgaaaaagcacccatttggacatcagctaattcctgctctgnacatnatntggtcatgtgacagttnctgttgatccggggggctcaggaagttttttntggccagcctcatgtttggntgtatatagacttggaagtgtntgtgggggagaaanatgatgntgatatatttacagtgacaaaaggaattcatggcttgggaccaagacttttnatcgaacaaatttttgattaagaataacaggnatcttttttgtgggagnctaccatgatatggggggtttttaggttttttgaaatggtaatttgggaaggaaggtgaatgtatagtgtgttccatgggaaagaaaagattgaagaataggtggatgtagagaattgtgttgggaattaaaaggattgaagtattgtttggtttaggaaaaccattttttatggaattgtgtgggaaggtggggattttccgggatgagaaatgggaggattttgttttatgtgaactgtttggaagtaaggtaaatcaggattgggttttggatgtatatttataactaattattagaagtaccaagagaacaagccttggaaatgtatggtaaccgctttgcgttttgggttttaggtttaacctattccctattagtatactatcgtaagaagttgtgcggaccacgtttcctttatttttttttttggaaggattcacatcagttgggattatcccctgtatcattcgtggatggttaacaagtgaaaaaaaggtggttgggaatttatatgaatagtaaagaaaggagataatatatctcaaacctgagataggattcaaactccaactccactctgagcgtg

SEQ ID NO: 17582 - DNA, 665 bp, Homo sapiens
  misc_feature (1)...(665): n = A,T,C or G
gggtcggggtacctgatatgnaattctanctgtgnatagnattacctctgtgtcctctgagtcttccaagcaaaagaaacttgagtgatcatggaaccctcaaaaaaaaatgttcattgttcatcatgtttctttccctattagaatataagctcctcagggcagggatttaagactatctttagttcactgacgtatccccagtgcctagagcaatacttcacataataggtattcagtaaatatttgaatggatgaggaataaagcacatattctccattcataatttaaaaaaatcaatgttcccgaagctatttaaggggatatttcatctacaataggaacacacattctgctatcaagaaaagctgcttttaaatgaaaggcaagagctgaattacaaatattatggtgacagtaaaaagcagattgcacattgcagaaatgccacaaacgagaatgagatcatttgaagaaattctctttaaactaagaataatgagataaaaaagattttgacaatgtttaactatcaaaatcacaagaatccaaggagagatccagttacctacactatacatagtaggctcacagtaattgttgaatgaattgaaatagaaaaaanaataaagttggtattaatatctcctcaaaaaaaaaaaaa

SEQ ID NO: 17583 - DNA, 309 bp, Homo sapiens
  misc_feature (1)...(309): n = A,T,C or G
gccgggagggccccgcccgggcccgccccgccccggtcctttggnnnngnttttaccgagttggnganaacagnagacttgggctncccagtgtncccattncagnnacgttccagncagtagaagggaaatgcagcacgtgaggacatagtgttccttttctctgaaggatgcagcaagaaagcgccctcttggaaagggagacgaagctcttaccagacaccaaacctgctggcaccgtgatcttggacctcccagcctccagaaccatgagaaataaatttatgttgtatgtnaaaaaaaaaaaaa

SEQ ID NO: 17584 - DNA, 503 bp, Homo sapiens
  misc_feature (1)...(503): n = A,T,C or G
gactcggtggccaacagcaaatttttccatgttctggnagtcagagagaaaaaaccacctgtatcatcatcaacaaatattaacagaacgccagtggagtgtgaggactgtgcaaggagcctcgggggatgcagagagacaaaagacatgccaagacactcatgatctacgtgaaaagacaggaccctgacatgcttagataaacagcagcaaaattagctcctcaatcttttactaccctgtccatccaatctccaaagacagtgcatagacccattatggcacttaaaataattcccatttatctgtttggcttttctatctcattcaaacagtgagtttcccaaatactgatgattctctcttttgcaatttcatacccccaatgcccactacaatatttgaaatacagatgatgctcagtaaatattgattggatggatttcaatggactgaaggcgatttgggcaggcaacttagacgcagaggtaaaaaaaaaaaaa

SEQ ID NO: 17585 - DNA, 856 bp, Homo sapiens
ctggtcgttaaaaagaacacctgttctcacatcagcatcattcctgctcttgacctcatctggtcatgtgacagttcctgttgatccggggggctcaggaagttctctctggccagcctcatgtttggctgtatatagacttggaagtgtctgtggggagaagcatgatgctgatatatttacagtgacaaaatgaatccatgcctgggcccaagactattcacccaccaaattctgactcaagactaacaggcatctctttgtgccacccacatcatctgtgtctttcagttctttgaatgtcacttgggaagacggtgactgcacagtgtgttccatgcgacagagcagatcgagaaacaggtggatgccgagaaatttgctgagatttagacaggattaagcaatgtatgcccttagacgaccatttattctgacttgtctgggagtggggggattttccggatgagaatggaggaacttctattaccgaaacttctttggaatcaggccaaccagcatgggctttggctctaacccctaaacctagttacctgcacgtactagaaactagcggttgtaaatttaggcccaaccaccacgttctgtgggtcttagcccctaaccctgctactctactgttaccattaaaaacgaacaattcgaaacgaattctttttacttctttttcaatgaagggatttagatgcagtcgaaaggacccctgcttcaattggggagtttctacctgtttgaaaacattgttttaggatttactttacttgggaaagaatcgaagttttaatttccacctcggctggcattcccttgccaaaccctctattccccccccccc

SEQ ID NO: 17586 - DNA, 878 bp, Homo sapiens
  misc_feature (1)...(878): n = A,T,C or G
gttgggggggtccacctttccttgggacacacctgcattacattcaaggcatgacttttccagcagtttgtgagctggccggcattgtccccaaaaggataaaggcctaggttctttacctgactggcagaagcattccagcaccacgaaaggactctaaacattgttttcttcaacaaagattcccagagtcgtgggccatactcttaacactgaagtgcatagaacttggcagaaatctacacttcagagataataacatatcattccatgaaataaaggaaaaggcataatcaaaaaaagaagttaaatatggaaacccgttttgacaacaaatgaatgcagttgaagccagacaggaaaggtgctatgtatgcatttttttacatgtttcacataaattatgatattgcaagaccctatcaggtttttttttcttattttcatgtcctttcagtcagatgtattatttatattgctctccatcttacattaaaggaaaatttcaaagactgctgcttttaaataacagaaccacacttgtaaaatctgtcaacattatatatgtggtcattcaccagcgtgcatttcattcattattataggtggggaaattctcaagggccacttgggatgtcccatggaaataaaattatgaatttcttgaatgttgtcgaaaaggagnaagaagaaaacagggttggtactttatttagacggattattgggcatctcccccccgaagacatcttattcaacacatcataatttagtgaataaaaaatatttacccgagggataaaaagagtttcctttaaaagggcaccaggtggaaaaatcaagattcatcaanaagattatattaaaaggggttttac

SEQ ID NO: 17587 - DNA, 439 bp, Homo sapiens
  misc_feature (1)...(439): n = A,T,C or G
ccacttcggggtggcngagacgcgctttcggatcacactgtggcatatccgtaggggcaggcgatggtccttgcagaactatccactcggccagcccaacaggtctaccaaccaccccgggcgtcggaactaatacgaaaagcatgactctttgtgaagaaacgagtcagtgactgaaacaccctggtggaaacctggtgacagaccttacactttctctttcgaataacctggtgcggaggatattattattggaagaaagaataaacagaatttaggggggaacaaacagtcgtcttacacaaggaatgggaaaaaaaactgatgtatattgacaagtacctttacatgcgaaaggaagagttgttcttgtgacgtcaatagaaacattgagctatcaaagaaacataagaataatggtctgattggcctctaggga

SEQ ID NO: 17588 - DNA, 864 bp, Homo sapiens
  misc_feature (1)...(864): n = A,T,C or G
gttggggtcttgccttatgttgcctatnatgatactcgactccttggctcaagcgattgtcctgcctcagcctctcagtagctggaactacggcacgggccatgacaccaagccctgtctcagttttgacagacctggtccttctcatcttttatgttgatcaagggccatgtcccttaaagaaagctgttctgcttacccaatcgaaatggtgaagtctttcctccttcccggctcgaaggactctagcatatctccctttttattatacttttgacttttaaaatattttactattattattttcaaagtagtaaatgcaccataatttcacacttcaaatgacttatggtgaaaagcacctgcattactcagcattagccactttccattcttttctgtttgctttggtgtttaacttcatgcttctaaatagtttgctaatacaggtgttacttattatttttttctttagaggttatcatttaatttcttaaaattgaaaataaggagttagctctcttacttcctacattattctaactcgtattttcacatatttggtggaaatcaatctggttctgttattataattatgcatataacatgcagagatcagccatgtagtattcaatgattatacacgttttttttttcactgatgcaataattgtacatatttatgggatacaatgtggacgttttgataccatgcgtgacagtcaaatcaggagttaattagcagatatattaccctcaaacatttatcatttttttgttgcaataagatgcgaaaatcctctctcctagctattgttcattcggccaatccattatttgttcacctttagccaaccctactgc

SEQ ID NO: 17589 - DNA, 829 bp, Homo sapiens
  misc_feature (1)...(829): n = A,T,C or G
aactcggggtgngggaggnagncactttgnnnctgcgttgttggggcagcccactgnaaaggtggacaactcatcgccaggagctgaagtccccagcctaacaacccanaggaactcagacttgccaacaaccgtgtacatgagcttgaagacaaacttgcaactgcagtccaaccttgagatgaccgcaacttcacgagaagccttgagccagaaccacccaactaagccgtccccagattcctcatacccatcactgtcagaaagagtttgttgtaagctgctaagaattagggtgagctgttaaacagaaatagataagaaacaaccatttttcccatcctcactaattttcatttgaatgccttttacctaatacaaaggttgaatgtggttttcatttgttcaatggtcacctgtagttcttttgctgagaattatctgtcatcatattttcatttcctcttattaattcacaagagctccttatgtatgaaggacacaattctttatcttttttgcatgttgcagttagtgttttctcagttttccattttgtttctatttctctagacactgaggttgtttgatattttttaaaagtttcaatttgttgtagaaaaatctatccatatttccttctatggattgttcttttgagataatgcagagaaaaatcttactcatccctaaattaaatatatatctacctatatttgctaagaggattacataataagaccataaacatggactatttaatctattaaaatggatttgcataaaaatcgggacaaaataaatttttttctctccaaaaaaaaaaaaa

SEQ ID NO: 17590 - DNA, 838 bp, Homo sapiens
  misc_feature (1)...(838): n = A,T,C or G
atatctttgtgttagtcttcctttttgggtaccatattcacananactttcanatcccattgaggcgtacagaggaaaaccaaatatcctgcaattaaaaactagaaacaagctatttgtgaaaatgctttgtgatgtgttcattcattttacaaagttaaacctttgttttgattcagcatgttggaaacactgttttgtagaatctacaatgtgacatttctaagcccattgaggcctatactgaaaaatcaaagatcccgtgataaaaacagaaataagctatctgtgaatatgctttgcaatgtgaggattcatctcacagagttaaacctttgtattgcacagcagtctggaaactctctttttgtaaaaaatctatgaagaaacattttggagaccattgaggcctacagtgaaatgttgaatatcctgtgattagaactagaaacaagctatccataaaaatgttttgtgatgtttgaattcattttacagagttaaccctttgtttgaattctgcatgttggaaacactctttttgtagaatctacaaaaggacatttcagagcttattgaggcctatagtgaaaaacataatattccatgataaaaactagaaacaagctccttgggaaaatcctttgtaatgtgtggattcatcacacagagttaaacctttgttttgattcatcaggttagaaacactactttcttaggatctacaaaggaacatttcaaagccaattgagttacataatgaaaaacttaatattccaccattnaaaatangaacanaannaaaaaaaaaaatgggcctccgttggcctcacgcgtg

SEQ ID NO: 17591 - DNA, 186 bp, Homo sapiens
caacttcccttctgattcttccttcctgtgcttagcaacaaggtcagacagtttaacttgaaaaagcaaaattgagtaaagtacttgttaatagtatgttgctatgttggatttggaatacactgagacatttatcttgtttttttaaaaataaaattctaaaatattatttcaaaaaaaaaaaaa

SEQ ID NO: 17592 - DNA, 872 bp, Homo sapiens
  misc_feature (1)...(872): n = A,T,C or G
acaactggttacaagaacctactttcgggtgggtccacactgcctttatgagctgtaacactcaccgcgaaggtctacagcttcactcctgaagccagtgagaccacgaacccaccaggagaaacgaaaacacgccgccttaagagctgtgacactcaccgcgaaggtctgcagcttcactcctgagccagcgagatcacgaacccacgagaaggaagaaactccaaacacatccgaacatcagaaggaacaaactctggacatgccgcctttaagaactgtaacactcgctgcgagggtccgcggcttcattcttgaagtcagaccaagaacccaccaattccagacacaccaagtattcgaggggactgaggcaggagaatggcatgaacccgggaggcagagcttgcagtgagccgagatcgcctcactgcactccagcctgggcgagagagtgagactccgtctcaaaaaaaaaaagaaaaacaaaagcattctttaacacagataaagtgactgtgaaagncagcacataaaaacaagaaatacaaataaaagaaaaaaatacagtgggaaagaaacaaattcccctcaggtgtgcgggagaatggaccatgcccattcaagatctcagtaaccatgtgtagtcaatctagaggtaaagatgcctgagagagtgggtataggagatgaagacatagcagtagccttacaagtccgatgttaccaccaatatcatctttcattgtggacagtatattttcactgtgactagaattccaccagntcaagagctaatcaaacaaagaggccacagctcctttttcagtctgggctttattcaattaatccttttaaaattcctgcttttg

SEQ ID NO: 17593 - DNA, 274 bp, Homo sapiens
  misc_feature (1)...(274): n = A,T,C or G
ccttgccgggnatgnatggcagtataanacanaanananagcctccaanactcaactacnagtccccaaagtcaatcagcataagcattggcaaggatgtggaacaacacgaactcttgctgggagacacaggattgggaaaaccatttntcgaaaacaatttggcattatgtaaaattgttggagtcttttctgactaccaaccagcaattctattctgatatttactcttactaaataaagtctagacttgcactgtccaaaaaaaaaaaaa

SEQ ID NO: 17594 - DNA, 837 bp, Homo sapiens
  misc_feature (1)...(837): n = A,T,C or G
aaagtccgggtacanaaaccaaattttcaagnacgnaaaatatttactggagtacattatttgacaaactattcaaaggaatgaccccactatttatgcagttttaagcagagaaggagagtctccaggaactatacgaattaatcaacttgagcaatcagcctgttttacagcctcctgccttgtagactactttttccaaaactctatgtgggatgtggtcacctagttggttggaaccagctcctgacagaccccagcaactgacagatgaacctgagtgaactttcctcattatcatgctaaagtctccatcccgaaaggaactatagcttcattaccagaacatgcaacctttgtgctggcataaaggctcactgcgtctaaagcaactgggacccgtcccgtacatgtgatgatgcacactctcctctctccatagcgccataaactctctcagggagacactgctttgaggaatgcttccttacttgtgctaagtaataaaactcctattgattaaaatttgcattcttgtggattcgtttgttactggacaagtgagtgaattcattttttttcagggtagtcatcaaaataaactttgtggatatgattgtacattacttattcttttattctcatacctccatttatattcatgttctgttaattctacattcctaaagaataaactttctctttcaaaagatctattatgggctctatacaatggctgtataattttctatgagaactattggaggagctgcctaattaaatctccgctttaggggtgtaaccctcttggtcaatttctagacttctatcaaagac

SEQ ID NO: 17595 - DNA, 797 bp, Homo sapiens
  misc_feature (1)...(797): n = A,T,C or G
cgacttcgggtgnnacaaaaacgtaattttcaactttncaagtattattggttcaaaaagtacatttcataaggccatcgctgtcacanaggatagtgattcctagtataggtctgagcaaagtaaattgaaaaccttctggaaaagatgcgccattctagatgccattaagaacatttgcggttcatgggaggaggtcgaaatatcaatattaagaggaatttggaagaagttgaattcaatcatcatggatgactatggaattcaagacttttagtggaaggaatcaatgcagatgtgatggaaatagcataaggactggatttagaagtggagcctgaaatcctgcaatttcatgagaaaactttatggaaaagcaattgtttcttatggacgatcaaagaaagtggcttcttgaaacggaacttattcctggtaaatatgctgtgaatattgtggaaatgacaacaaacatccagaaaattacgtaaaggcagttaaagcagtagcaggcttttagataattgactccagaagttccacaatgagtaaaacgttatccaataacatcacaagctaaagaaaaatctttcttgaaaatagtcaatcaatgcagcaaacttcattgttttcttaattgaaaaaattgccatagctaccccaatcttcagcaaccattaccctggatcagtcaataaccatcaacatcgagacaacatncctcagcagcaaaatattatgatgcactaaattgtgagatgattcttaacattttttagcaataaagttttcaatca

SEQ ID NO: 17596 - DNA, 844 bp, Homo sapiens
  misc_feature (1)...(844): n = A,T,C or G
ttttctggagaataccacatatgctactcattggnaaacgtgatagcaaattgaaattgctctgagttcataatgaagaatgaccaacatctattattcatcaaatgaaattctccactaaacaaaatcctgacctttgtgaaagtgcttctttaactttgtaactaatgcaataaccacatgacctttggtgctcaaaaacccttgagtggctctctacaacttctgcagattcttaagagttgggtacatgaaatagctatttctaggtaaagtcaaccaggccagtgtgaaaataaggttcgataaattattccttccagtattagagtttaaatatgaatttctaggatcttcctgattttcaccattgtgacaaatttatatgcttgtggtaatttgggagaaacctaatctgtacattattaatatggaattaaactctacttggctgaattaaaactggtaaaaaatgtgggacagacattacactttcatggcatttcttctaaccttgacaactgcttcacttacctgggtggtatttgatacacaccaaacctccctagggactcgcagataattttcaaccacttgcccttactttgtgttcccccacatctacctcaaccactatttgctacgttccgaccatatcagccgtactcttgacccaaatccaaaattttgccacacatgaaaacttcgtcctttcccttcaaacaaccgcgctcctttggcgcacaaaaaaaatccctccatgcgaaaacactcacccctcttttggctaaactcttttttgatccgcgccatgactccaatatccacataatcaacccaaggg

SEQ ID NO: 17597 - DNA, 842 bp, Homo sapiens
  misc_feature (1)...(842): n = A,T,C or G
actcgggggtacgaagcccanctttctacanagatcttacacaggnaacctcaaagagctcaactcatgcttctaccaaggacccctggnaccacccgctggtccctcactagcctaaaaacttctcctctggaagacaccacaactacaggtccccttctttgcccctaaccagcaggaagtagccagaatgaccgccgccctgttcccaacagcggttggtgtgtcctgtctagaggggggactgagttggttccagctgggctttctgggttaagtaggggctcagaaagctgcgaaactcactcatttcctacatcatggcttactttggtcctggatgaataatattgacgatatatgcttaaaatattcctaacatcagaatttgtgcatgtgttttcttcccccaagaaagctataaaaagcgaaacttttgctgtaagcttacctgtgtccatgctccctctctcccttcctcctcccctgaaactgaaaggaattttaacagccagtttttctgtgaccagcagaacttgtctatgctcccaattccaattccttgtaaacacaatttgtaaaatcctgtgagattctgtctcctttgccatgccactgcaaggttataaagtagataaaacttaagttacaattctggttttcctcaagacctaagacttgttaattggctnntgttatctctctgganacatcttcccaccacatgtattttcttgccttaaagaagttaaaagggtgatccaaaaatctaacactggctacccgctcgggaccctttcatgctgtggaagcgttgtactgtcactctgctcaataaagct

SEQ ID NO: 17598 - DNA, 247 bp, Homo sapiens
  misc_feature (1)...(247): n = A,T,C or G
gaaaatccagttgggaagaaaactngnaatcgtgggcatncccagtggtcccattcagaacgttccaagcagtagtatggaaatgcagcacgtgaggacatagtgttccttttctctgaaggatgcagcaagaaagcgccatcttggaaagggagacgaagctcttaccagacaccaaacctgctggcaccgtgatcttggacctcccagcctccagaaccatgaaaaataaatttatgttgtatgt

SEQ ID NO: 17599 - DNA, 317 bp, Homo sapiens
  misc_feature (1)...(317): n = A,T,C or G
cactcgggtgtaaaaactgctttacttgtgcttgttctccaatgggnaacgtggnaggaaagcccaacctgaactgcagataagcccccagctgaatccaatcaagttcaaccaagctcagaaaaacttcagctgacctacagatattttcacaaggaataaaaatggttatggcaaaccactggaattggggattgtttgttatgcagcattattgcagtaaaaactgtccaatacaataactgtgttacaattcagaaaacattgtattaaaataacaaagtatggaagtccaaaaaaaaacaaaaaaaaaaaaa

SEQ ID NO: 17600 - DNA, 844 bp, Homo sapiens
  misc_feature (1)...(844): n = A,T,C or G
cactcggggnnaggagacctcactttgncgtgctncaaggtggtctcaaactcctcggcttaagtgatccctctgcctcagcttcctaagtgctgtcattacagttgtttttatcatttaaaaggtgactagggcaatgggattacctctgatatcagagagttggcaatcatgtaaccctgaaagtcatggcacaatatggcagaacaagcacgtctggggcctgggagtcctgaggtaattgagaattagtcacatttgttatttttagcactgcctgattttgtctggaaatggaagtgaaactataaaaacagaacaaaacccgcacaaagaagactctcaggaaatgctggctgaatgacagaatgaacattgataaatgaagacttcttcaaataactgatgctagacatctctaaatatatcagaaataacatgtgaccatgacatcattcatcatttttccatcaaaacatttgaaaataacttggattcatttattagagctttattttcccacatcttgcagtaccctagagttctacagtaattaaccttatgctgaatggcagaggacatgcactaagctcctatttaaaatctattcatgatgcattttaaatattcagtagagacttcttaacatgcagccatagtctattgaaaatgggatttcctaaagccaggagattggatattaatatctggcattcgtataaggacaggtttntgttaaccctattataaaaggactgatgatgtgaatatatattggttactagctcacttatatttctgtgctaataattactgtaacccatatgttaagtttttttattta

SEQ ID NO: 17601 - DNA, 452 bp, Homo sapiens
  misc_feature (1)...(452): n = A,T,C or G
aaactcgggnnnaacaanccncagttagggatttcactgaaaaccggacctcaaatcctaaaaaatgacaaatgtcaagggaaaaacaaaatacgatttcaagttagagaaagatggaagtgggaagatatgcttctgtagtaataatgacaagagaaagcctcttaacggagatgatgtcaaagtggaactattttaaaagggtgtcattcctacaatgatctgtgaaaggagcctcccgaacaggatggacaggtcatgcgaagtcctgaatgcatgggagtcacaatgtttaagatacacccttcagctctcggtgaccaacttttaaagacagctgcttttggtgtgagggttaaaggagtctgtggatgctcttagaattatggttactttggccccaattttcagaatttgaaagtaaacttaatcgactgggaaaaaaaaaaaaa

SEQ ID NO: 17602 - DNA, 456 bp, Homo sapiens
  misc_feature (1)...(456): n = A,T,C or G
ccctcggttagngaaccacncctcngggtggnccgaaaatcccgtaagtccgcccgactatcatttccacccctggnacgatggtgataagccctgttgttttattgatgatgaagtctccctgagccccaacaaggatttcatatgtgatctccccatttgacccttcgtctgcgtcgactgcagtgagctggaattgaaaatcacaacataaatctttttgggtctcaacttttcaccaccatgtcgttttttcccccaacaaaagaagcttgctttcaaagaaaaaaacacaggaaagtttccttgacatatatactgttttttgttttttgtttttttaactgaggctactgtgtcctgttacaatactaaagcaatcacaaaaataagagtgattttgttttttgtgagagtgattaagaaataaactttggatcttgaaaaaaaaaaaaa

SEQ ID NO: 17603 - DNA, 425 bp, Homo sapiens
ccttgcgagctaaaggccaccgtaattaatgataaaagagcaccaccaaaatggcagcatgaagagccactggaagaaagaagattggggagctgctctcagggagcagaagatggcctctcaaggccatcttaatcttcgaagcagaaacttttcaatgtcaacaagggccttaaagaattaaaattactatggatgagtcaatattgtgcattcttactttacttattttcaaaaagaattatttgcagtctttgattcttacagtggtatacgtgctagggagtaagtgtatttggcaagtaaatgtgaatatttgcatattgggggacatttgatagattctattattgttttaaattatttatagacaatctctgttcaagcataaatatactttattgctgcatgtaaaaaaaaaaaaa

SEQ ID NO: 17604 - DNA, 347 bp, Homo sapiens
  misc_feature (1)...(347): n = A,T,C or G
ccgggatcctatcacatggtgggcctaagngatccctnataaccagctccaggtgacgcaaaaacactggttcatgggtcccctcccagaagtgtgattgaactgactaggggacatctttatggatcactgaagaagaatacttcatttctcaaacaacacaaattatggcattcagcagcagccagatataccttacacgtggaattttaaatgcaggggaacaccaaataagttggtaaaaccaggaagaatggatgggatggtcttaggagcaagcatgggggaatgggtgctcattataacattattagtgaaataaaataaaccttagaaaaaaaaaaaaa

SEQ ID NO: 17605 - DNA, 472 bp, Homo sapiens
  misc_feature (1)...(472): n = A,T,C or G
cctgggngnacaaccttttttcagtgccgaaggccactcatttatcctctttgctgaagcaactcttcaaatcttccacccatttttcattgtgttttaaaattactgtgttgtgaaattttttatatattctaaaaataagtcttttagagatatacatatcacaaacatttttcttccagtctgtggttgcttttttatttcatctattctaatctttagaagtttaaaaatttgattatgacattctagaagagttttttaagattggagttggctattcctcaagaagacagacaaaactttctgactatgagtcttcatatatcttgtgtagatgaaagtcaaaaaagaaaaataaaaagaaagagaattctggctcttgaaacttaaataaagagcttcaaaattaaaagccttcaaaaaataaagacaaaaagtcttgtgcagatgaaagttaaaaaaaaaaaaa

SEQ ID NO: 17606 - DNA, 305 bp, Homo sapiens
  misc_feature (1)...(305): n = A,T,C or G
cttgccaggtatgatggctctggtcaactgacacagagnaaccaagatgcaagagtaactgagaatatgtcttgatgatgagcgaaccagtcctacaaccagtgtctcctaccttttggtcttgagctagaagccaattaatcccaagcacagaatagtttctaggtacactggacttttcaaaccacttgaagcctcaaagcttcagtactgaaagcttagtttgctagatgatgtataccttaaaccactaggcttctctctattgaaataaataggcttgtgccatgctaaaaaaaaaaaaa

SEQ ID NO: 17607 - DNA, 247 bp, Homo sapiens
  misc_feature (1)...(247): n = A,T,C or G
cctggccanctaaaggccannctactctaacttcanaaaatcattcagaaggcaccagtatttcaagttttacaagtccagaaaaatgatattctgtgatgtatttggcaaatgttttctttaagtgactattttaaaggaaaccacagccagtttgcactcatgcaggacacactccaatatctgtctactgtactcgcacaagtatatttaaatttttctgcttattttcacaaaaaaaaaaaaa

SEQ ID NO: 17608 - DNA, 613 bp, Homo sapiens
  misc_feature (1)...(613): n = A,T,C or G
gcctgggcaannanatncaggtctgttaattccaaagctgtttaagggtaattgtggctgacagagcagcattcacggaacatcactactgtgcttggctggaacagtgtcactgtgtctgaaagtcttgataatgttcagttgactgtactaattgtcctgttttatgcatggctagccaagtggtaaccaagagttttaaacaatggatctttattaaggtattaatttttgtcaaggaaactgacgtgatttgaaagaatgtttactgtgtgtgacacgtgtggaagaaattgtttgtgttttcccctcttccatgtttaggaaataaaataaccaaaaagtgtgtgcgtgtagcactttttaaccttaattgtcttttatttatattggtatcttgatataaaaattgaaatttgttataatgataaagaaattagagatgtgaaacatgattgataaagtaaggagtaaaattggtaaaaatgcttaaagatataatttagtgttataatacttttagctgaaatgtttatttattgggtttaaacaactatatatgtatgtgtgtatgtttaaaatatattccatgaggaatcgaaaaaaaaaaaaa

SEQ ID NO: 17609 - DNA, 921 bp, Homo sapiens
  misc_feature (1)...(921): n = A,T,C or G
tttgcgagtgaaacgcagccacacanacattctgaatccccttgctgctggcccaaaatgcccaanaaggtgaagaatgggacaaatgtgggacattttaccccaaaatcatgagcaagaaggtccaaagataaagacagacagtagcagtaatggcggagactgggtccaggcaatagctgtgaaggctggccacctggatgaacacccagagatgaccttgaagaacatctgccagctcaggaccacatcagggacttctagcccaacaataagctaagttaaaccaggacactatgggatattttagaagagcaaacagcagctcctcagtgccagtgcatctttaagtcccagctcaataccaaataatgcagatgtaagagaatagattcacgaaagaaaaaaaagtgaagcctctattcaagaactttcacaaggagtgtgctcaaactcctgtgtgcagtggaatgaccaaaaatctgcagcttccagtcttactgtgaagtcggtagggttgagatagaaccctttttgcttattaacaagattctcagatgctgtggatatagaaccntttaagagtcgccttgataagttctcgcacaggcttcggctgcggggcggttcattttcccccatcagatcctcctaccctgctatcttttccatggtccccccacggtccctcctccttgtcgtccctcctccgtctctttcgctctccggcttcgcctctctcttcacggctncctgcgtcctgctctctttcttggcttctgtctccctcttccggcggttttttttcttttccttcattagcctactctcttcccccgctctttactcctcgtcgtccgtctccctctcctcccggcttgtgtctctcctccggcgatactcatgcttcatcctccctca

SEQ ID NO: 17610 - DNA, 245 bp, Homo sapiens
  misc_feature (1)...(245): n = A,T,C or G
ccttggcgaggttttctcctgtgtggtttctggnaaaaacaactgtcaacattctgcaaaacaatcactgactcaaaaaactcaagagggagtaaagataattaataaaatatgagattaaggaggatttgggagaatgaggcattcctttaccaggaagtgaagactctgcaaattagaaaaattatgaaggcatgtaagaaaataaaaaatcatttaagtggtgtgcaataaaaaaaaaaaaa

SEQ ID NO: 17611 - DNA, 233 bp, Homo sapiens
  misc_feature (1)...(233): n = A,T,C or G
ttgttgtgnnaaaaccacctgtcatgttgnagnaacgnaaggcaagnatgatcctggaagccaaatgggtgcctgtagaagaggaaatgatgcacagggattttgctttgattcatcaccaggttgactaggtgaccaggcttcttaccattcatgtgatctgcacctgtgatcaaaagccttctttatattctgtgagaataaaagaggatggcagcacaaaaaaaaaaaaa

SEQ ID NO: 17612 - DNA, 895 bp, Homo sapiens
gcctggtaggcattactaccataaattactttctagttgctgagaacgggagattttaaattttgcatttagaagacaagaaattcaatctgaagaggccccatatttccagttaagtgaccactcagaagggaaggacagcgctcaataaccaaggtcaagagttgggtttagggtttgtggcgattttttttgggggtggcaagaataagccgtatattaatctcttaaaataaatatagcaagaaaagcctgcctaacataattcatacgtatgcatatgttatcatattacagtgttttgcagttttagatcagtgcctgctgaaatactctttggattgcttttgcttttttgccgccctgttgcgcttacttgtcgtcggcgactatcgtgcctttccccttcctcgcgtggccttttttccctctctcctggttctctgccgttcctctcctttcccgtggcgtccgttgtggtctcgcctcccttcctctcttccctcccctcctcctcctgtttgctctctcctctcctctttttcccctctccctccgcctcttctcccccccttctcttcctgtcccccctcctttccccccgtccccttctgtgtcgccttttccgctcttttttcttttcctttccgccctcctccgttgcgtccccgcccctctcttctttctcccctttttcccccgcccgttttcgctccccctcctcctgttccccgcccccctccctcttttcccccgcctccttctttgtcctctccctccccccctttccccccccccctccccctcttctctttccctttttttggtctcttcctcgcgtccttccccttcgttctgcctttttcccgcccccatcccctcacaaaaaaaacaa

SEQ ID NO: 17613 - DNA, 393 bp, Homo sapiens
  misc_feature (1)...(393): n = A,T,C or G
ccctgcgantaccaccaatattcggnanaanacttctacccgncggnagnacgacaagataagcacatcctcaatgcagcgtgacctgcacctccgagcccggggtcagctgccacaccaaggagtccccaccttgccgcccccgccgggctgcgggaggaggcaaacggcgtctcctaccgctcctcaggagctgggggtgtttcagaggaggtgcaggaaaaggcggggaagtgtttggccatccatgaagccagaaacctctgtggattcaatatcaaccaaaagagcatccaagaaaaagtccagctgcgtggagacatcattggacaccaccatttctgaaaatatactccaatattaaacttgattatattgcgaaaaaaaaaaaaa

SEQ ID NO: 17614 - DNA, 371 bp, Homo sapiens
gcactccgttggaaaaaccagcttttccgtttaggaaaaagcgccaacatgagaaaatagactgtagggcatggtccaacagctcagcataatagctgtatagccctcaggactagacagttgcacaaagaaacaaaatgttgccaacaaccccctgacttagaatcagatccttctacagtcaagcctcagatgagacctccagccctggccaacactgatcgcagccttgcgagacacgcagagctcctcaaggccaaattctgacccacaaaataagagagaataaatgtgtgttgtttctgttaatattgttacacagcaatagatgaataataaaatgctcaaattagactacaaaaaaaaaaaaa

SEQ ID NO: 17615 - DNA, 298 bp, Homo sapiens
  misc_feature (1)...(298): n = A,T,C or G
cctagaggagtcaanctctncagtttctgcataccagtaaactactgcagctagctgttgcctaggaccccatgaggaggtgactcaacaaagaaggcagttttcggatcctgatgatttcatccccctaaccctgaccaatcaacaaccacaattttctggacctacacctttcacaattcttttacaaaatgccgcccataacttctttgggagacagacttgtgggtcctttccatccccttacttggccgtcatatgatcaataaatgtcttctctgctgtaaaaaaaaaaaaa

SEQ ID NO: 17616 - DNA, 635 bp, Homo sapiens
  misc_feature (1)...(635): n = A,T,C or G
ccttggcgaggttagcaagaagactatgactggcactggtgaaactattgtggaccacaanaggacctgcaaaatanaggccatgtatgctggagcaacaggatggaaggagtgaagaactctaagaacattatgatgcagagttgttataccagcaatgcactgtctatctcttgatttttatgtgagagaacagttgttttgtttacatcgctattagggatgattactcccaattctaactattgcattctcttccttctttattatttctctcatagaactgttcatgtaaatttttactcgtgtctctacatacatatccataacatgtataacaaaattttgtctttgaaaatgtaacattagtgaagttatttaaaggcatatgtgttgtgaactattataactaagatattgggaaggaaatttgttaaatatattattcctaaatctcataagctacttacattaagcacaggaattctagctaatgagtaagaatgcttttttatgtagacagtatattcaatattggatacttttgtactctaaaatcatagccatatataactaaacaatggtcacatgggaacatagtaaataaaaaatgtaaaaatacaaaaaaaaaaaaa

SEQ ID NO: 17617 - DNA, 687 bp, Homo sapiens
  misc_feature (1)...(687): n = A,T,C or G
ggccacgggggggtctgttagggggtagacnagttaaagtctttaaaannngncctgncgtttggnnaaanccngatccttggggacagcgattcaagacacaccatacagcaacctcgagactagcttctggncccaaaactgccatccagaagtgtgactcttgacaatttgttgaatctcactggcattttatttctgtcaagagtacattcagccagataggaccatgctgagacatagcaggccctcgaacaggggtgcaggcaataagctgcgaagatggaacttgaatcccggacctcacgctccaaatgcacaattcctcactttccccccgctgcctgatacagaactggaggaaaaagaaatgggatctaattaagcgtagcacatcccagcaactattttatgctgaatgattactttcaagcttaatttgcctctatttaagtgtaactaacacataatctctaggataaacatctcggaattctttccgaattatccccttattttaagtttaggtgtgcatttgacaatctgcattgctgccaacagtagttggaagattactacctgaaagctgaggaagtttgcttcagctactacatgcccttccttgtggtggatgtgccagtcacggcccaataattgaggaaataaatgttggcgccttaaaagaaa

SEQ ID NO: 17618 - DNA, 446 bp, Homo sapiens
gttggccagttatgcaaaataacacaatgatttttaaaaaaaaaacaacagggacaacaataaaaagaaaaacaaggaagcccaaacctgcagtttgcaggaatacaaatgatggaagccgtgaacctgacaaaatagcatcaacataaaatttctaatagtttgaattttaacttaccagacactctttcaaaacgaattgtaagagaacagctttctttttaatttaacaagcatttatgtagcacccattatgtgcaagctactgtttttagcacttttcaaatattaactcatttaaatcattgtgacaacagtatgaggtatgtattgttatcaatatggatggtacaactggagtcaagagaagttaaataatttgcccaaccttacatatctaataaatgcttttggggttcagaaaatcacacccaaaaaaaaaaaaa

SEQ ID NO: 17619 - DNA, 557 bp, Homo sapiens
  misc_feature (1)...(557): n = A,T,C or G
gaactccgatgnaaagcagggcttcctgattgaacanaacaacacataatataacttgcctggtagccacacttaccgtactatcttcgggaggagaggctgggatgagctataaggcatgctttgcatggaattcacgttatgtggacagggactaacagactgtggacctgatgtgcttcacataccagaggaacactgttgactcataacaaaggcactcgccggtgaagttcatgggcttacactgtgctgaccacagcatagatgactttcacaccatccggacagtgcttcatttctgctgaccacctcccttggccctgttcctgaagaatggaataattagaaaggtttttctatggagcttctattatggatgagctttttttggtgccctcgagtggttttgagggcagaaaaaactattcagaggttaatgttgctttttaaaagttaatattaaattattaaaggtacagattaataagccctatttttcctaaagcttttatgttctgcataaaatcttattggttcttggaaaaaaaaaaaaa

SEQ ID NO: 17620 - DNA, 932 bp, Homo sapiens
  misc_feature (1)...(932): n = A,T,C or G
ttggccagctaatgtcaacactgtacatcaggnaacatatctaccctgctcaaggtcacatataagctttgaatacagagctggagttcaaaccctgatggtccaagtgcagttcaacaggagaatctcccccacataatcagtcaggagcccagcttctgagccttctacggtcctcccaggggttttctctaatccgaccatccagaagaggaaaaaggcaaaaggagtgcctcatggaaggtccttatgggcaagtctggaagaggagctcatttttctctcctttaattgattacaatatggctgtacttaactacaggtggggctgggaaagattcccactgggacactagacaggtatttttttgagagacgcctctgcacttgaaagagagaatcctgatttttgggaaataaacggcgcatcacttccacagcacatatttgtgtgcctttggcaccctgaatctgccatcgccgtctctcatccgaagaaatttctaccggccgctaagcccagtacccctacacccgacgcacacgaccatgtcccgccacacgcagccctccccctacttccacaccccccgacgcgacgcccggagtaccgctactgtcgcagcccgcgtcctcgctcccgactgccgcccccctaggtgcaccccgccgtatttaccttggtaccccgataccgcccctcccgctttttccccgctcccgtgtatggccccgagttcggtcgcccccacccccccccgtgtacccctcccccccctccccggacccagattccatttccctatcgcagtcccgcccatcgcccccgtcttttgcttgcccgactccgttcgcccgcacccgtctccctatctccccccccggccccccgggctcaccccggagtaacccccgcccgcatgcctcgcccg

SEQ ID NO: 17621 - DNA, 1252 bp, Homo sapiens
  misc_feature (1)...(1252): n = A,T,C or G
ggagctcacaggggngaaggggnaaggggcncacaccatccacctcctctctatancanncttttcttctttcttcgacgncncttcggtctctccagagatatctggtntcgctcggtgagcgcgagcggcgcgtttcctcgcggacggcggtatattctcactctcgttagcgcgataagccatggacgaatgtctgcactcctgttcactgtccgcggctgctccgtatcgccacacggcgcgtccctcttcggcgtagcgagatgcgatcccacacacatccgcacgcagcatatcattagacttttatctatgttatgtgaggttggcgtgtcccccgttgtatataagtgtggttacaccgcgccccgtgttaccagtatatattcattaactccctctattctagcctgtttttcttgttttcttcctcatggcgcaccggtgccgagcccctcagttactctcacctcgtccatccacctcgtccgcctcccccgcgaaacactatctccaccttaccgccgtttccccttttgttgggggcgggcggggggaaaaatattnngccttctttttttttggggggggaaccctttaaaactctccggggttttttaaaccccggcgggactcccccccgggaggacccctttggggaagggaatggggnccaattaggggcccggccaaatatcttttgtgggggccctttcccaaacttggagcccaaacaccccgtctcttggccccccttcctctctgtgggttttcccaaaaagggggataantttctnccccctgtggcctctttctcaaaggcccctctccnccanaaagagtatgaggtcctttgttgttggaaacccataccaaaggcgcccaaagagaaaaagaggcccttgtgccccaataaaactctcctgggggagagagcccaccaaagagtgcgtgtgtaaaaacaaacnaaatttctgggtgagnagaagagaaattatcttgggggagaagaggtggacaaaacaactcttctttgtggggggggaaaaatattcgttggaaaaaatttctcttgtggcgggggggcggctcttattttgttgggaaaaagacacacacgggggggtgtttctcttttcttttctccacaacaacaaatttctctagtggatgggggagagaaaacaccttatattacacccactctcctcacaaagaaagaatagttatatacaaacaatctcttctt

SEQ ID NO: 17622 - DNA, 947 bp, Homo sapiens
  misc_feature (1)...(947): n = A,T,C or G
cttgcgancccnaagtttattgagcttgttccgggcaattggcccatcacttgattcataataataaaataggaggaattaattctctgctgtccaaacaagctgtttctaagaatctgaaagaagataaaccagtgaaagaaaaggatatagatggaaggcctaggcctggggatgtgcaggcacctagtataaaatctcagagctcagatactcctttggaaggtgaaccccctctaagtcacaatcctgaaggacagcaatatgtagaagcagggacatacattgtgttggaaattcagctggacaaagccttggttccaaagcgaatgccacaggagctagccagaagaatcagggaccactgtgccacactagaaatccacgctgacacctttgagactgctgttgacctggggatgcggtgtgcancggcccaccagctcgcccaaatgctacacagctttcctgctgattcacacatgccttcttgtggattcacatcctctccactcctgccccccctgccttcccccgttctaactacccggccctgccactttctcccattcactctttcccctccccccccccccttcttcactactccgccctgctccccccgcgggtcccggtacgcctgccgctggtcacccccccctcactcccttttgcccccatccccccccgcccgctttattcgcccttcaccttttgttccccttttccctcacacccctcgtcccgtccccgtttctctccccccccttcgccccgtcccgcgtgcccatattgcgcactccccacacccctcgttctcccccccagttcatacaaccgtcccgttccgttacccgtctacgctcgccgactagtgttaccccacccgccatgccgcctcgatttcgccctctttattactccccttctcttcacgtcataacact
